United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 111

SEQ ID NO: 3939174 - RNA, 21 nt, Shigella flexneri 2a str. 301
aucaacuuauugguaaacuca

SEQ ID NO: 3939175 - RNA, 13 nt, Shigella flexneri 2a str. 301
aucaagaaaugca

SEQ ID NO: 3939176 - RNA, 13 nt, Shigella flexneri 2a str. 301
aucaagacaugau

SEQ ID NO: 3939177 - RNA, 15 nt, Shigella flexneri 2a str. 301
aucaagauuaaaagu

SEQ ID NO: 3939178 - RNA, 12 nt, Shigella flexneri 2a str. 301
aucaagcaacau

SEQ ID NO: 3939179 - RNA, 14 nt, Shigella flexneri 2a str. 301
aucaagcaacauaa

SEQ ID NO: 3939180 - RNA, 18 nt, Shigella flexneri 2a str. 301
aucaagcaugauauucac

SEQ ID NO: 3939181 - RNA, 15 nt, Shigella flexneri 2a str. 301
aucaagccagaaagu

SEQ ID NO: 3939182 - RNA, 13 nt, Shigella flexneri 2a str. 301
aucaagccauagc

SEQ ID NO: 3939183 - RNA, 18 nt, Shigella flexneri 2a str. 301
aucaagccccagcaggau

SEQ ID NO: 3939184 - RNA, 18 nt, Shigella flexneri 2a str. 301
aucaagcgccgaguaaaa

SEQ ID NO: 3939185 - RNA, 14 nt, Shigella flexneri 2a str. 301
aucaagucagaugc

SEQ ID NO: 3939186 - RNA, 16 nt, Shigella flexneri 2a str. 301
aucaauaacagcgcaa

SEQ ID NO: 3939187 - RNA, 21 nt, Shigella flexneri 2a str. 301
aucaauaaguuacacaucauu

SEQ ID NO: 3939188 - RNA, 14 nt, Shigella flexneri 2a str. 301
aucaauaccagccc

SEQ ID NO: 3939189 - RNA, 16 nt, Shigella flexneri 2a str. 301
aucaauaccauuauca

SEQ ID NO: 3939190 - RNA, 20 nt, Shigella flexneri 2a str. 301
aucaauaccauuaucauuga

SEQ ID NO: 3939191 - RNA, 22 nt, Shigella flexneri 2a str. 301
aucaauaccgcguaauacauca

SEQ ID NO: 3939192 - RNA, 22 nt, Shigella flexneri 2a str. 301
aucaauaccugguccuucaucu

SEQ ID NO: 3939193 - RNA, 20 nt, Shigella flexneri 2a str. 301
aucaauacuuuccagcauau

SEQ ID NO: 3939194 - RNA, 21 nt, Shigella flexneri 2a str. 301
aucaauacuuuccagcauaug

SEQ ID NO: 3939195 - RNA, 18 nt, Shigella flexneri 2a str. 301
aucaauagcaguaauuuu

SEQ ID NO: 3939196 - RNA, 20 nt, Shigella flexneri 2a str. 301
aucaauagcaguaauuuuac

SEQ ID NO: 3939197 - RNA, 22 nt, Shigella flexneri 2a str. 301
aucaauagcuaacgaaagaaca

SEQ ID NO: 3939198 - RNA, 13 nt, Shigella flexneri 2a str. 301
aucaauauauugc

SEQ ID NO: 3939199 - RNA, 14 nt, Shigella flexneri 2a str. 301
aucaauauccaccg

SEQ ID NO: 3939200 - RNA, 14 nt, Shigella flexneri 2a str. 301
aucaaucaccgcuu

SEQ ID NO: 3939201 - RNA, 15 nt, Shigella flexneri 2a str. 301
aucaaucagagccau

SEQ ID NO: 3939202 - RNA, 22 nt, Shigella flexneri 2a str. 301
aucaauccaguguaaaacagca

SEQ ID NO: 3939203 - RNA, 15 nt, Shigella flexneri 2a str. 301
aucaaucgcaaucug

SEQ ID NO: 3939204 - RNA, 15 nt, Shigella flexneri 2a str. 301
aucaaucucagcaag

SEQ ID NO: 3939205 - RNA, 15 nt, Shigella flexneri 2a str. 301
aucaaugccagcaua

SEQ ID NO: 3939206 - RNA, 21 nt, Shigella flexneri 2a str. 301
aucaauggaugaacgagcugc

SEQ ID NO: 3939207 - RNA, 18 nt, Shigella flexneri 2a str. 301
aucaauggaugcaaucac

SEQ ID NO: 3939208 - RNA, 19 nt, Shigella flexneri 2a str. 301
aucaauggaugcaaucaca

SEQ ID NO: 3939209 - RNA, 22 nt, Shigella flexneri 2a str. 301
aucagccauuuugcacauucca

SEQ ID NO: 3939210 - RNA, 22 nt, Shigella flexneri 2a str. 301
aucagcccaaagcagaguugcu

SEQ ID NO: 3939211 - RNA, 18 nt, Shigella flexneri 2a str. 301
aucagcgcauagagacuu

SEQ ID NO: 3939212 - RNA, 15 nt, Shigella flexneri 2a str. 301
aucagcgccaccagc

SEQ ID NO: 3939213 - RNA, 14 nt, Shigella flexneri 2a str. 301
aucagcgccagcgc

SEQ ID NO: 3939214 - RNA, 16 nt, Shigella flexneri 2a str. 301
aucagcggacgcugcu

SEQ ID NO: 3939215 - RNA, 14 nt, Shigella flexneri 2a str. 301
aucagcggacugca

SEQ ID NO: 3939216 - RNA, 22 nt, Shigella flexneri 2a str. 301
aucagcggugccgcgauaccac

SEQ ID NO: 3939217 - RNA, 23 nt, Shigella flexneri 2a str. 301
aucagcguaggacacagaauguu

SEQ ID NO: 3939218 - RNA, 15 nt, Shigella flexneri 2a str. 301
aucagcguccagccc

SEQ ID NO: 3939219 - RNA, 19 nt, Shigella flexneri 2a str. 301
aucagcguccagcccuccg

SEQ ID NO: 3939220 - RNA, 22 nt, Shigella flexneri 2a str. 301
aucagcuaauggcugcgggcga

SEQ ID NO: 3939221 - RNA, 16 nt, Shigella flexneri 2a str. 301
aucagcuauucuuaua

SEQ ID NO: 3939222 - RNA, 22 nt, Shigella flexneri 2a str. 301
aucagcuccccuggauugcagg

SEQ ID NO: 3939223 - RNA, 15 nt, Shigella flexneri 2a str. 301
aucagcuccggcagc

SEQ ID NO: 3939224 - RNA, 19 nt, Shigella flexneri 2a str. 301
aucagcuccggcagcugcu

SEQ ID NO: 3939225 - RNA, 19 nt, Shigella flexneri 2a str. 301
aucagcugguuauuuucug

SEQ ID NO: 3939226 - RNA, 14 nt, Shigella flexneri 2a str. 301
aucagcuuauccau

SEQ ID NO: 3939227 - RNA, 19 nt, Shigella flexneri 2a str. 301
aucagcuuuggugaaaaaa

SEQ ID NO: 3939228 - RNA, 10 nt, Shigella flexneri 2a str. 301
aucaggaaac

SEQ ID NO: 3939229 - RNA, 15 nt, Shigella flexneri 2a str. 301
aucaggaccugcucu

SEQ ID NO: 3939230 - RNA, 18 nt, Shigella flexneri 2a str. 301
aucaggcaguuuugcguu

SEQ ID NO: 3939231 - RNA, 17 nt, Shigella flexneri 2a str. 301
aucaggcaucugagcau

SEQ ID NO: 3939232 - RNA, 20 nt, Shigella flexneri 2a str. 301
aucaggccuacaaaaugugc

SEQ ID NO: 3939233 - RNA, 17 nt, Shigella flexneri 2a str. 301
aucaggccuacagcaua

SEQ ID NO: 3939234 - RNA, 18 nt, Shigella flexneri 2a str. 301
aucaggcuguguuuaaga

SEQ ID NO: 3939235 - RNA, 18 nt, Shigella flexneri 2a str. 301
aucagggaagggucuuuu

SEQ ID NO: 3939236 - RNA, 18 nt, Shigella flexneri 2a str. 301
aucagggagucuugcugg

SEQ ID NO: 3939237 - RNA, 16 nt, Shigella flexneri 2a str. 301
aucaggggcagcacca

SEQ ID NO: 3939238 - RNA, 14 nt, Shigella flexneri 2a str. 301
aucaggguaaauuu

SEQ ID NO: 3939239 - RNA, 21 nt, Shigella flexneri 2a str. 301
aucaggguuaaaauaccagau

SEQ ID NO: 3939240 - RNA, 22 nt, Shigella flexneri 2a str. 301
aucaggucaucaaucaguucau

SEQ ID NO: 3939241 - RNA, 14 nt, Shigella flexneri 2a str. 301
aucaguaagccagc

SEQ ID NO: 3939242 - RNA, 22 nt, Shigella flexneri 2a str. 301
aucagucuagcccgauggcauc

SEQ ID NO: 3939243 - RNA, 17 nt, Shigella flexneri 2a str. 301
aucagugguguagggca

SEQ ID NO: 3939244 - RNA, 15 nt, Shigella flexneri 2a str. 301
aucaguuaacggcag

SEQ ID NO: 3939245 - RNA, 14 nt, Shigella flexneri 2a str. 301
aucaguuaaggauc

SEQ ID NO: 3939246 - RNA, 21 nt, Shigella flexneri 2a str. 301
aucaguuaaggaucaguugac

SEQ ID NO: 3939247 - RNA, 16 nt, Shigella flexneri 2a str. 301
aucaguuccaguucau

SEQ ID NO: 3939248 - RNA, 18 nt, Shigella flexneri 2a str. 301
aucaguugaugaaucugc

SEQ ID NO: 3939249 - RNA, 22 nt, Shigella flexneri 2a str. 301
aucaguugauuaugaucgccac

SEQ ID NO: 3939250 - RNA, 19 nt, Shigella flexneri 2a str. 301
aucaguuggaugcugcaua

SEQ ID NO: 3939251 - RNA, 19 nt, Shigella flexneri 2a str. 301
aucaguuguucagaaugcc

SEQ ID NO: 3939252 - RNA, 22 nt, Shigella flexneri 2a str. 301
aucaguuuuuucauugaaugcg

SEQ ID NO: 3939253 - RNA, 13 nt, Shigella flexneri 2a str. 301
aucauaaaaauca

SEQ ID NO: 3939254 - RNA, 14 nt, Shigella flexneri 2a str. 301
aucauaaaaauuaa

SEQ ID NO: 3939255 - RNA, 18 nt, Shigella flexneri 2a str. 301
aucauaacccuuuccuuc

SEQ ID NO: 3939256 - RNA, 22 nt, Shigella flexneri 2a str. 301
aucauaccuccgcaauaugcgc

SEQ ID NO: 3939257 - RNA, 22 nt, Shigella flexneri 2a str. 301
aucauauuaaauuuuuucacug

SEQ ID NO: 3939258 - RNA, 19 nt, Shigella flexneri 2a str. 301
aucauauuuccuuccuugg

SEQ ID NO: 3939259 - RNA, 13 nt, Shigella flexneri 2a str. 301
aucauauuuucca

SEQ ID NO: 3939260 - RNA, 14 nt, Shigella flexneri 2a str. 301
aucaucaaagccaa

SEQ ID NO: 3939261 - RNA, 15 nt, Shigella flexneri 2a str. 301
aucaucaacuggcaa

SEQ ID NO: 3939262 - RNA, 12 nt, Shigella flexneri 2a str. 301
aucaucaauaug

SEQ ID NO: 3939263 - RNA, 12 nt, Shigella flexneri 2a str. 301
aucaucacuccc

SEQ ID NO: 3939264 - RNA, 18 nt, Shigella flexneri 2a str. 301
aucaucacugccaggagc

SEQ ID NO: 3939265 - RNA, 22 nt, Shigella flexneri 2a str. 301
aucaucagcauuuucuauuucu

SEQ ID NO: 3939266 - RNA, 15 nt, Shigella flexneri 2a str. 301
aucaucaggggcagc

SEQ ID NO: 3939267 - RNA, 20 nt, Shigella flexneri 2a str. 301
aucaucaggggcagcaccau

SEQ ID NO: 3939268 - RNA, 17 nt, Shigella flexneri 2a str. 301
aucaucagugcuuuauc

SEQ ID NO: 3939269 - RNA, 15 nt, Shigella flexneri 2a str. 301
aucaucauuaauauc

SEQ ID NO: 3939270 - RNA, 13 nt, Shigella flexneri 2a str. 301
aucaucauuugca

SEQ ID NO: 3939271 - RNA, 16 nt, Shigella flexneri 2a str. 301
aucaucauuuuuucac

SEQ ID NO: 3939272 - RNA, 15 nt, Shigella flexneri 2a str. 301
aucauccagacugcu

SEQ ID NO: 3939273 - RNA, 17 nt, Shigella flexneri 2a str. 301
aucauccagcacgguga

SEQ ID NO: 3939274 - RNA, 15 nt, Shigella flexneri 2a str. 301
aucauccauauuuuc

SEQ ID NO: 3939275 - RNA, 23 nt, Shigella flexneri 2a str. 301
aucauccauauuuucagcagugg

SEQ ID NO: 3939276 - RNA, 12 nt, Shigella flexneri 2a str. 301
aucauccauccg

SEQ ID NO: 3939277 - RNA, 16 nt, Shigella flexneri 2a str. 301
aucauccauccggcug

SEQ ID NO: 3939278 - RNA, 16 nt, Shigella flexneri 2a str. 301
aucaucccccugcgau

SEQ ID NO: 3939279 - RNA, 23 nt, Shigella flexneri 2a str. 301
aucaucccccugcgauugugaca

SEQ ID NO: 3939280 - RNA, 19 nt, Shigella flexneri 2a str. 301
aucauccccguaucuucau

SEQ ID NO: 3939281 - RNA, 20 nt, Shigella flexneri 2a str. 301
aucauccccguaucuucaug

SEQ ID NO: 3939282 - RNA, 15 nt, Shigella flexneri 2a str. 301
aucauccgcacaauc

SEQ ID NO: 3939283 - RNA, 18 nt, Shigella flexneri 2a str. 301
aucauccgcacaaucccu

SEQ ID NO: 3939284 - RNA, 19 nt, Shigella flexneri 2a str. 301
aucauccugcugcacgccc

SEQ ID NO: 3939285 - RNA, 17 nt, Shigella flexneri 2a str. 301
aucaucgcauccagugc

SEQ ID NO: 3939286 - RNA, 23 nt, Shigella flexneri 2a str. 301
aucaucgcccaguugaucaccag

SEQ ID NO: 3939287 - RNA, 22 nt, Shigella flexneri 2a str. 301
aucaucgccccgcucacgcagc

SEQ ID NO: 3939288 - RNA, 17 nt, Shigella flexneri 2a str. 301
aucaucgcggcacacag

SEQ ID NO: 3939289 - RNA, 18 nt, Shigella flexneri 2a str. 301
aucaucgcggcacacagc

SEQ ID NO: 3939290 - RNA, 19 nt, Shigella flexneri 2a str. 301
aucaucgcggcacacagca

SEQ ID NO: 3939291 - RNA, 19 nt, Shigella flexneri 2a str. 301
aucaucgcguacucaccgc

SEQ ID NO: 3939292 - RNA, 20 nt, Shigella flexneri 2a str. 301
aucaucgcguacucaccgcu

SEQ ID NO: 3939293 - RNA, 20 nt, Shigella flexneri 2a str. 301
aucaucgcgugacagccuug

SEQ ID NO: 3939294 - RNA, 20 nt, Shigella flexneri 2a str. 301
aucaucgcuuucaggucagc

SEQ ID NO: 3939295 - RNA, 17 nt, Shigella flexneri 2a str. 301
aucaucgguaccgccag

SEQ ID NO: 3939296 - RNA, 22 nt, Shigella flexneri 2a str. 301
aucaucgucguuucuuuuuuau

SEQ ID NO: 3939297 - RNA, 19 nt, Shigella flexneri 2a str. 301
aucaucguucauauauucc

SEQ ID NO: 3939298 - RNA, 22 nt, Shigella flexneri 2a str. 301
aucaucucccacgcggcaacgg

SEQ ID NO: 3939299 - RNA, 16 nt, Shigella flexneri 2a str. 301
aucaucugccacuucu

SEQ ID NO: 3939300 - RNA, 16 nt, Shigella flexneri 2a str. 301
aucaucuuuauauauu

SEQ ID NO: 3939301 - RNA, 13 nt, Shigella flexneri 2a str. 301
aucaugaccccag

SEQ ID NO: 3939302 - RNA, 17 nt, Shigella flexneri 2a str. 301
aucaugacgggcaagaa

SEQ ID NO: 3939303 - RNA, 23 nt, Shigella flexneri 2a str. 301
aucaugagguuguggcauuagau

SEQ ID NO: 3939304 - RNA, 17 nt, Shigella flexneri 2a str. 301
aucaugcaguaccagau

SEQ ID NO: 3939305 - RNA, 18 nt, Shigella flexneri 2a str. 301
aucaugccggccagcgcc

SEQ ID NO: 3939306 - RNA, 19 nt, Shigella flexneri 2a str. 301
aucaugccggccagcgcca

SEQ ID NO: 3939307 - RNA, 19 nt, Shigella flexneri 2a str. 301
aucaugccuacaaccguug

SEQ ID NO: 3939308 - RNA, 18 nt, Shigella flexneri 2a str. 301
auccccagacaaaagcga

SEQ ID NO: 3939309 - RNA, 13 nt, Shigella flexneri 2a str. 301
auccccagccuaa

SEQ ID NO: 3939310 - RNA, 18 nt, Shigella flexneri 2a str. 301
auccccagccuaagccau

SEQ ID NO: 3939311 - RNA, 21 nt, Shigella flexneri 2a str. 301
auccccgcucucccaguaacc

SEQ ID NO: 3939312 - RNA, 15 nt, Shigella flexneri 2a str. 301
auccccgcuuccugc

SEQ ID NO: 3939313 - RNA, 14 nt, Shigella flexneri 2a str. 301
auccccgggcggcc

SEQ ID NO: 3939314 - RNA, 19 nt, Shigella flexneri 2a str. 301
auccccgggcggccucuuc

SEQ ID NO: 3939315 - RNA, 13 nt, Shigella flexneri 2a str. 301
auccccucaaccu

SEQ ID NO: 3939316 - RNA, 12 nt, Shigella flexneri 2a str. 301
auccccugcgcg

SEQ ID NO: 3939317 - RNA, 21 nt, Shigella flexneri 2a str. 301
auccccuucucaaucccuuuc

SEQ ID NO: 3939318 - RNA, 15 nt, Shigella flexneri 2a str. 301
aucccgauuaaucag

SEQ ID NO: 3939319 - RNA, 21 nt, Shigella flexneri 2a str. 301
aucccgcgauaugccggcauc

SEQ ID NO: 3939320 - RNA, 14 nt, Shigella flexneri 2a str. 301
aucccggaagccac

SEQ ID NO: 3939321 - RNA, 14 nt, Shigella flexneri 2a str. 301
aucccggcacccgc

SEQ ID NO: 3939322 - RNA, 13 nt, Shigella flexneri 2a str. 301
aucccgugacggu

SEQ ID NO: 3939323 - RNA, 22 nt, Shigella flexneri 2a str. 301
aucccuccacgacguguuccug

SEQ ID NO: 3939324 - RNA, 14 nt, Shigella flexneri 2a str. 301
aucccucucaucca

SEQ ID NO: 3939325 - RNA, 11 nt, Shigella flexneri 2a str. 301
aucccucuuuc

SEQ ID NO: 3939326 - RNA, 12 nt, Shigella flexneri 2a str. 301
auccgacaaaug

SEQ ID NO: 3939327 - RNA, 14 nt, Shigella flexneri 2a str. 301
auccgacacuggca

SEQ ID NO: 3939328 - RNA, 19 nt, Shigella flexneri 2a str. 301
auccgacauuucugcugcc

SEQ ID NO: 3939329 - RNA, 20 nt, Shigella flexneri 2a str. 301
auccgacauuucugcugccu

SEQ ID NO: 3939330 - RNA, 17 nt, Shigella flexneri 2a str. 301
auccgacgguuucacga

SEQ ID NO: 3939331 - RNA, 17 nt, Shigella flexneri 2a str. 301
auccgacuuacucugaa

SEQ ID NO: 3939332 - RNA, 21 nt, Shigella flexneri 2a str. 301
auccgacuuaucacugccagu

SEQ ID NO: 3939333 - RNA, 22 nt, Shigella flexneri 2a str. 301
auccgagaaucguacucaccag

SEQ ID NO: 3939334 - RNA, 20 nt, Shigella flexneri 2a str. 301
auccgaucgcgcaucagcag

SEQ ID NO: 3939335 - RNA, 13 nt, Shigella flexneri 2a str. 301
auccgcaaugugu

SEQ ID NO: 3939336 - RNA, 17 nt, Shigella flexneri 2a str. 301
auccgcacaaucccuua

SEQ ID NO: 3939337 - RNA, 19 nt, Shigella flexneri 2a str. 301
auccgcagucccuuuccca

SEQ ID NO: 3939338 - RNA, 15 nt, Shigella flexneri 2a str. 301
auccgcaucacucca

SEQ ID NO: 3939339 - RNA, 14 nt, Shigella flexneri 2a str. 301
auccgccagccaau

SEQ ID NO: 3939340 - RNA, 17 nt, Shigella flexneri 2a str. 301
auccgccauuucuccuc

SEQ ID NO: 3939341 - RNA, 13 nt, Shigella flexneri 2a str. 301
auccgcccacacc

SEQ ID NO: 3939342 - RNA, 17 nt, Shigella flexneri 2a str. 301
auccgccgauguugcau

SEQ ID NO: 3939343 - RNA, 20 nt, Shigella flexneri 2a str. 301
auccgccgcgcggugggcua

SEQ ID NO: 3939344 - RNA, 22 nt, Shigella flexneri 2a str. 301
auccgcucccuggcccaucgcc

SEQ ID NO: 3939345 - RNA, 22 nt, Shigella flexneri 2a str. 301
auccggauacagccccaggguu

SEQ ID NO: 3939346 - RNA, 21 nt, Shigella flexneri 2a str. 301
auccggaucgagaauauucac

SEQ ID NO: 3939347 - RNA, 22 nt, Shigella flexneri 2a str. 301
auccggcaacaaaauauccugu

SEQ ID NO: 3939348 - RNA, 13 nt, Shigella flexneri 2a str. 301
auccggcaauaag

SEQ ID NO: 3939349 - RNA, 12 nt, Shigella flexneri 2a str. 301
auccggcaccaa

SEQ ID NO: 3939350 - RNA, 13 nt, Shigella flexneri 2a str. 301
auccggcaccaau

SEQ ID NO: 3939351 - RNA, 15 nt, Shigella flexneri 2a str. 301
auccggcaccuuuuc

SEQ ID NO: 3939352 - RNA, 14 nt, Shigella flexneri 2a str. 301
auccggcaugaaca

SEQ ID NO: 3939353 - RNA, 20 nt, Shigella flexneri 2a str. 301
auccggcauuuuacgcauua

SEQ ID NO: 3939354 - RNA, 17 nt, Shigella flexneri 2a str. 301
auccggccuacagaccg

SEQ ID NO: 3939355 - RNA, 17 nt, Shigella flexneri 2a str. 301
auccggcgaauuaccag

SEQ ID NO: 3939356 - RNA, 19 nt, Shigella flexneri 2a str. 301
auccggcguggaaaccuug

SEQ ID NO: 3939357 - RNA, 23 nt, Shigella flexneri 2a str. 301
auccggcguuuucaaccagccga

SEQ ID NO: 3939358 - RNA, 13 nt, Shigella flexneri 2a str. 301
auccgguguggca

SEQ ID NO: 3939359 - RNA, 18 nt, Shigella flexneri 2a str. 301
auccgguuaucagaagau

SEQ ID NO: 3939360 - RNA, 15 nt, Shigella flexneri 2a str. 301
auccguaaagcccau

SEQ ID NO: 3939361 - RNA, 16 nt, Shigella flexneri 2a str. 301
auccguaaugccugau

SEQ ID NO: 3939362 - RNA, 14 nt, Shigella flexneri 2a str. 301
auccguccuacgaa

SEQ ID NO: 3939363 - RNA, 13 nt, Shigella flexneri 2a str. 301
auccguccuccgu

SEQ ID NO: 3939364 - RNA, 21 nt, Shigella flexneri 2a str. 301
auccguccuccguaucuuguc

SEQ ID NO: 3939365 - RNA, 14 nt, Shigella flexneri 2a str. 301
auccuaaaggcaaa

SEQ ID NO: 3939366 - RNA, 20 nt, Shigella flexneri 2a str. 301
auccuaaaggcaaaaugcca

SEQ ID NO: 3939367 - RNA, 18 nt, Shigella flexneri 2a str. 301
auccuacgaccgcaugcg

SEQ ID NO: 3939368 - RNA, 14 nt, Shigella flexneri 2a str. 301
auccuauauuccuu

SEQ ID NO: 3939369 - RNA, 16 nt, Shigella flexneri 2a str. 301
auccucaacgccgcau

SEQ ID NO: 3939370 - RNA, 15 nt, Shigella flexneri 2a str. 301
auccucaagaauaug

SEQ ID NO: 3939371 - RNA, 19 nt, Shigella flexneri 2a str. 301
auccucuaucuguuugcca

SEQ ID NO: 3939372 - RNA, 18 nt, Shigella flexneri 2a str. 301
auccucuuugcuuccuga

SEQ ID NO: 3939373 - RNA, 22 nt, Shigella flexneri 2a str. 301
auccugaaauuccugagaggau

SEQ ID NO: 3939374 - RNA, 21 nt, Shigella flexneri 2a str. 301
auccugaauaacuggcgcgac

SEQ ID NO: 3939375 - RNA, 14 nt, Shigella flexneri 2a str. 301
auccugaaucaccu

SEQ ID NO: 3939376 - RNA, 15 nt, Shigella flexneri 2a str. 301
auccugaaucaccug

SEQ ID NO: 3939377 - RNA, 14 nt, Shigella flexneri 2a str. 301
auccugaccaccau

SEQ ID NO: 3939378 - RNA, 23 nt, Shigella flexneri 2a str. 301
auccugagccaguuuuucuuuuu

SEQ ID NO: 3939379 - RNA, 22 nt, Shigella flexneri 2a str. 301
auccugauagcuuacggcgcug

SEQ ID NO: 3939380 - RNA, 21 nt, Shigella flexneri 2a str. 301
auccugauaggauuucugauu

SEQ ID NO: 3939381 - RNA, 18 nt, Shigella flexneri 2a str. 301
auccugaucaagcacaug

SEQ ID NO: 3939382 - RNA, 20 nt, Shigella flexneri 2a str. 301
auccugaucaagcacaugcu

SEQ ID NO: 3939383 - RNA, 19 nt, Shigella flexneri 2a str. 301
auccugauccugcaacagc

SEQ ID NO: 3939384 - RNA, 19 nt, Shigella flexneri 2a str. 301
auccugcccacuccagcua

SEQ ID NO: 3939385 - RNA, 16 nt, Shigella flexneri 2a str. 301
auccugccgagauaca

SEQ ID NO: 3939386 - RNA, 13 nt, Shigella flexneri 2a str. 301
auccugccgcagu

SEQ ID NO: 3939387 - RNA, 18 nt, Shigella flexneri 2a str. 301
auccugcgcacaagccca

SEQ ID NO: 3939388 - RNA, 19 nt, Shigella flexneri 2a str. 301
auccugcgcuuccugcaac

SEQ ID NO: 3939389 - RNA, 20 nt, Shigella flexneri 2a str. 301
auccugcguuaaucgccgua

SEQ ID NO: 3939390 - RNA, 15 nt, Shigella flexneri 2a str. 301
auccuggccuggauu

SEQ ID NO: 3939391 - RNA, 18 nt, Shigella flexneri 2a str. 301
auccuggggguucaucac

SEQ ID NO: 3939392 - RNA, 16 nt, Shigella flexneri 2a str. 301
auccugguuauuucac

SEQ ID NO: 3939393 - RNA, 24 nt, Shigella flexneri 2a str. 301
auccuguacgacaaaagaauggcu

SEQ ID NO: 3939394 - RNA, 13 nt, Shigella flexneri 2a str. 301
auccugucaguuc

SEQ ID NO: 3939395 - RNA, 16 nt, Shigella flexneri 2a str. 301
auccuucacacugccu

SEQ ID NO: 3939396 - RNA, 17 nt, Shigella flexneri 2a str. 301
auccuucacacugccuc

SEQ ID NO: 3939397 - RNA, 19 nt, Shigella flexneri 2a str. 301
auccuucagcaacuuguuc

SEQ ID NO: 3939398 - RNA, 14 nt, Shigella flexneri 2a str. 301
auccuuccagcucc

SEQ ID NO: 3939399 - RNA, 18 nt, Shigella flexneri 2a str. 301
auccuuccagcuccagcc

SEQ ID NO: 3939400 - RNA, 19 nt, Shigella flexneri 2a str. 301
auccuuccagcuccagccg

SEQ ID NO: 3939401 - RNA, 20 nt, Shigella flexneri 2a str. 301
auccuuuccuuaagccagcg

SEQ ID NO: 3939402 - RNA, 15 nt, Shigella flexneri 2a str. 301
aucgaaaaugcgcau

SEQ ID NO: 3939403 - RNA, 16 nt, Shigella flexneri 2a str. 301
aucgaaaugaauagag

SEQ ID NO: 3939404 - RNA, 12 nt, Shigella flexneri 2a str. 301
aucgaacagcag

SEQ ID NO: 3939405 - RNA, 13 nt, Shigella flexneri 2a str. 301
aucgaacagcagc

SEQ ID NO: 3939406 - RNA, 23 nt, Shigella flexneri 2a str. 301
aucgaacaugcgggucuuacugg

SEQ ID NO: 3939407 - RNA, 13 nt, Shigella flexneri 2a str. 301
aucgaagagacaa

SEQ ID NO: 3939408 - RNA, 16 nt, Shigella flexneri 2a str. 301
aucgcugaaagauggc

SEQ ID NO: 3939409 - RNA, 17 nt, Shigella flexneri 2a str. 301
aucgcugaaagauggcg

SEQ ID NO: 3939410 - RNA, 16 nt, Shigella flexneri 2a str. 301
aucgcugaacgcaccu

SEQ ID NO: 3939411 - RNA, 19 nt, Shigella flexneri 2a str. 301
aucgcugaacgcaccuucc

SEQ ID NO: 3939412 - RNA, 17 nt, Shigella flexneri 2a str. 301
aucgcugacacgggaaa

SEQ ID NO: 3939413 - RNA, 19 nt, Shigella flexneri 2a str. 301
aucgcugagcuccugcauu

SEQ ID NO: 3939414 - RNA, 20 nt, Shigella flexneri 2a str. 301
aucgcugcgcucuaaaauca

SEQ ID NO: 3939415 - RNA, 19 nt, Shigella flexneri 2a str. 301
aucgcuguggaacaucacc

SEQ ID NO: 3939416 - RNA, 18 nt, Shigella flexneri 2a str. 301
aucgcuucggucugcgga

SEQ ID NO: 3939417 - RNA, 17 nt, Shigella flexneri 2a str. 301
aucgcuucgucaagacg

SEQ ID NO: 3939418 - RNA, 14 nt, Shigella flexneri 2a str. 301
aucgcuuucagugu

SEQ ID NO: 3939419 - RNA, 18 nt, Shigella flexneri 2a str. 301
aucggaaacaaauacaug

SEQ ID NO: 3939420 - RNA, 13 nt, Shigella flexneri 2a str. 301
aucggaacaacag

SEQ ID NO: 3939421 - RNA, 14 nt, Shigella flexneri 2a str. 301
aucggaacaacagu

SEQ ID NO: 3939422 - RNA, 23 nt, Shigella flexneri 2a str. 301
aucggaugacgccacagcauucu

SEQ ID NO: 3939423 - RNA, 22 nt, Shigella flexneri 2a str. 301
aucggcaacaugacugcggcgu

SEQ ID NO: 3939424 - RNA, 12 nt, Shigella flexneri 2a str. 301
aucggcaaggaa

SEQ ID NO: 3939425 - RNA, 16 nt, Shigella flexneri 2a str. 301
aucggcaagguugaag

SEQ ID NO: 3939426 - RNA, 14 nt, Shigella flexneri 2a str. 301
aucggcaaucacau

SEQ ID NO: 3939427 - RNA, 14 nt, Shigella flexneri 2a str. 301
aucggcaaucgccu

SEQ ID NO: 3939428 - RNA, 21 nt, Shigella flexneri 2a str. 301
aucggcaccauuuaaaucaau

SEQ ID NO: 3939429 - RNA, 12 nt, Shigella flexneri 2a str. 301
aucggcaggcag

SEQ ID NO: 3939430 - RNA, 19 nt, Shigella flexneri 2a str. 301
aucggcauacagcgacaga

SEQ ID NO: 3939431 - RNA, 19 nt, Shigella flexneri 2a str. 301
aucggcauuaaucugcucg

SEQ ID NO: 3939432 - RNA, 17 nt, Shigella flexneri 2a str. 301
aucggccuuccauaaug

SEQ ID NO: 3939433 - RNA, 19 nt, Shigella flexneri 2a str. 301
aucggcgcggaaucgcccu

SEQ ID NO: 3939434 - RNA, 22 nt, Shigella flexneri 2a str. 301
aucggcgcuacggcguuucacu

SEQ ID NO: 3939435 - RNA, 20 nt, Shigella flexneri 2a str. 301
aucggcggcgauguccagac

SEQ ID NO: 3939436 - RNA, 19 nt, Shigella flexneri 2a str. 301
aucggcggugaccagcagc

SEQ ID NO: 3939437 - RNA, 21 nt, Shigella flexneri 2a str. 301
aucggcggugaccagcagcau

SEQ ID NO: 3939438 - RNA, 17 nt, Shigella flexneri 2a str. 301
aucggcguacuggcaau

SEQ ID NO: 3939439 - RNA, 21 nt, Shigella flexneri 2a str. 301
aucggcgucauuuuuucgaca

SEQ ID NO: 3939440 - RNA, 17 nt, Shigella flexneri 2a str. 301
aucggcguuuucugacc

SEQ ID NO: 3939441 - RNA, 13 nt, Shigella flexneri 2a str. 301
aucggcuuuggca

SEQ ID NO: 3939442 - RNA, 15 nt, Shigella flexneri 2a str. 301
aucgggagagauaag

SEQ ID NO: 3939443 - RNA, 18 nt, Shigella flexneri 2a str. 301
aucgggagagauaagaua

SEQ ID NO: 3939444 - RNA, 12 nt, Shigella flexneri 2a str. 301
aucgggcguuau

SEQ ID NO: 3939445 - RNA, 14 nt, Shigella flexneri 2a str. 301
aucgggucaccgcc

SEQ ID NO: 3939446 - RNA, 16 nt, Shigella flexneri 2a str. 301
aucgggucaccgccga

SEQ ID NO: 3939447 - RNA, 18 nt, Shigella flexneri 2a str. 301
aucgguaccgccagcagg

SEQ ID NO: 3939448 - RNA, 20 nt, Shigella flexneri 2a str. 301
aucggugaaaguaacaaagc

SEQ ID NO: 3939449 - RNA, 18 nt, Shigella flexneri 2a str. 301
aucggugaggaucaccag

SEQ ID NO: 3939450 - RNA, 18 nt, Shigella flexneri 2a str. 301
aucggugcacgaugccug

SEQ ID NO: 3939451 - RNA, 15 nt, Shigella flexneri 2a str. 301
aucggugcagagccc

SEQ ID NO: 3939452 - RNA, 20 nt, Shigella flexneri 2a str. 301
aucggugcaucgcgcaaaga

SEQ ID NO: 3939453 - RNA, 17 nt, Shigella flexneri 2a str. 301
aucggugcggcaaugcc

SEQ ID NO: 3939454 - RNA, 21 nt, Shigella flexneri 2a str. 301
aucggugcuggccuauuauga

SEQ ID NO: 3939455 - RNA, 20 nt, Shigella flexneri 2a str. 301
aucggugguguaaccuucac

SEQ ID NO: 3939456 - RNA, 17 nt, Shigella flexneri 2a str. 301
aucgguuuucagcucgc

SEQ ID NO: 3939457 - RNA, 14 nt, Shigella flexneri 2a str. 301
aucguaaucagcau

SEQ ID NO: 3939458 - RNA, 15 nt, Shigella flexneri 2a str. 301
aucguacaggcacau

SEQ ID NO: 3939459 - RNA, 20 nt, Shigella flexneri 2a str. 301
aucguacaggcacaugucca

SEQ ID NO: 3939460 - RNA, 19 nt, Shigella flexneri 2a str. 301
aucguauccggcauuauca

SEQ ID NO: 3939461 - RNA, 21 nt, Shigella flexneri 2a str. 301
aucguauucuggcuucgcgau

SEQ ID NO: 3939462 - RNA, 16 nt, Shigella flexneri 2a str. 301
aucgucaaugccguca

SEQ ID NO: 3939463 - RNA, 21 nt, Shigella flexneri 2a str. 301
aucgucacgaucgcgccagcc

SEQ ID NO: 3939464 - RNA, 21 nt, Shigella flexneri 2a str. 301
aucgucacgcgcgccaagccc

SEQ ID NO: 3939465 - RNA, 19 nt, Shigella flexneri 2a str. 301
aucgucagcucgcugccau

SEQ ID NO: 3939466 - RNA, 21 nt, Shigella flexneri 2a str. 301
aucgucauggcuguccuuuac

SEQ ID NO: 3939467 - RNA, 17 nt, Shigella flexneri 2a str. 301
aucguccacgucaucaa

SEQ ID NO: 3939468 - RNA, 21 nt, Shigella flexneri 2a str. 301
aucguccacuugaaaauuaua

SEQ ID NO: 3939469 - RNA, 16 nt, Shigella flexneri 2a str. 301
aucguccagcagcaau

SEQ ID NO: 3939470 - RNA, 13 nt, Shigella flexneri 2a str. 301
aucguccauuucu

SEQ ID NO: 3939471 - RNA, 13 nt, Shigella flexneri 2a str. 301
aucguccgccagc

SEQ ID NO: 3939472 - RNA, 17 nt, Shigella flexneri 2a str. 301
aucguccgccagccuac

SEQ ID NO: 3939473 - RNA, 16 nt, Shigella flexneri 2a str. 301
aucgucgccagaccaa

SEQ ID NO: 3939474 - RNA, 16 nt, Shigella flexneri 2a str. 301
aucgucucgauacgcc

SEQ ID NO: 3939475 - RNA, 19 nt, Shigella flexneri 2a str. 301
aucgugagcguauugguga

SEQ ID NO: 3939476 - RNA, 18 nt, Shigella flexneri 2a str. 301
aucgugauacaacugccg

SEQ ID NO: 3939477 - RNA, 20 nt, Shigella flexneri 2a str. 301
aucgugccaggaccauucac

SEQ ID NO: 3939478 - RNA, 16 nt, Shigella flexneri 2a str. 301
aucgugcgcgccguga

SEQ ID NO: 3939479 - RNA, 21 nt, Shigella flexneri 2a str. 301
aucgugcugguagaagcuggc

SEQ ID NO: 3939480 - RNA, 19 nt, Shigella flexneri 2a str. 301
aucguggccaugaccgccg

SEQ ID NO: 3939481 - RNA, 15 nt, Shigella flexneri 2a str. 301
aucguggugaugauc

SEQ ID NO: 3939482 - RNA, 15 nt, Shigella flexneri 2a str. 301
aucguuaaauucuaa

SEQ ID NO: 3939483 - RNA, 13 nt, Shigella flexneri 2a str. 301
aucguuaauuccu

SEQ ID NO: 3939484 - RNA, 22 nt, Shigella flexneri 2a str. 301
aucguuaauuccucauuucccu

SEQ ID NO: 3939485 - RNA, 15 nt, Shigella flexneri 2a str. 301
aucguucagggagua

SEQ ID NO: 3939486 - RNA, 21 nt, Shigella flexneri 2a str. 301
aucguuguuacaacaucaaca

SEQ ID NO: 3939487 - RNA, 18 nt, Shigella flexneri 2a str. 301
aucguuugcauccagcuc

SEQ ID NO: 3939488 - RNA, 13 nt, Shigella flexneri 2a str. 301
aucuaaaacccgg

SEQ ID NO: 3939489 - RNA, 12 nt, Shigella flexneri 2a str. 301
aucuaaaugcca

SEQ ID NO: 3939490 - RNA, 16 nt, Shigella flexneri 2a str. 301
aucuaaaugccacuga

SEQ ID NO: 3939491 - RNA, 19 nt, Shigella flexneri 2a str. 301
aucuaaccauuauuaaauu

SEQ ID NO: 3939492 - RNA, 20 nt, Shigella flexneri 2a str. 301
aucuaaccuacuuuuuaauu

SEQ ID NO: 3939493 - RNA, 16 nt, Shigella flexneri 2a str. 301
aucuaacgcccgagcc

SEQ ID NO: 3939494 - RNA, 20 nt, Shigella flexneri 2a str. 301
aucuaagaucccugccauuu

SEQ ID NO: 3939495 - RNA, 14 nt, Shigella flexneri 2a str. 301
aucuacaaaaaacu

SEQ ID NO: 3939496 - RNA, 20 nt, Shigella flexneri 2a str. 301
aucuacaaaaccacacuucu

SEQ ID NO: 3939497 - RNA, 20 nt, Shigella flexneri 2a str. 301
aucuacacgcuaccaaaaaa

SEQ ID NO: 3939498 - RNA, 21 nt, Shigella flexneri 2a str. 301
aucuacacgcuaccaaaaaau

SEQ ID NO: 3939499 - RNA, 15 nt, Shigella flexneri 2a str. 301
aucuaccacugccug

SEQ ID NO: 3939500 - RNA, 17 nt, Shigella flexneri 2a str. 301
aucuaccguuacggcug

SEQ ID NO: 3939501 - RNA, 21 nt, Shigella flexneri 2a str. 301
aucuaccguuacggcuggaag

SEQ ID NO: 3939502 - RNA, 22 nt, Shigella flexneri 2a str. 301
aucuacucguuuauuaugccac

SEQ ID NO: 3939503 - RNA, 15 nt, Shigella flexneri 2a str. 301
aucuauagcacccgc

SEQ ID NO: 3939504 - RNA, 15 nt, Shigella flexneri 2a str. 301
aucuauauacaauca

SEQ ID NO: 3939505 - RNA, 15 nt, Shigella flexneri 2a str. 301
aucuaugguuuuuuc

SEQ ID NO: 3939506 - RNA, 23 nt, Shigella flexneri 2a str. 301
aucuaugguuuuuucuacacaga

SEQ ID NO: 3939507 - RNA, 17 nt, Shigella flexneri 2a str. 301
aucucaaacgguucuuu

SEQ ID NO: 3939508 - RNA, 13 nt, Shigella flexneri 2a str. 301
aucuucagcugca

SEQ ID NO: 3939509 - RNA, 21 nt, Shigella flexneri 2a str. 301
aucuucauagauagccagcaa

SEQ ID NO: 3939510 - RNA, 20 nt, Shigella flexneri 2a str. 301
aucuucauccgccccggcuu

SEQ ID NO: 3939511 - RNA, 15 nt, Shigella flexneri 2a str. 301
aucuucauccggcug

SEQ ID NO: 3939512 - RNA, 15 nt, Shigella flexneri 2a str. 301
aucuucauggagaac

SEQ ID NO: 3939513 - RNA, 20 nt, Shigella flexneri 2a str. 301
aucuucauugugcgguccau

SEQ ID NO: 3939514 - RNA, 17 nt, Shigella flexneri 2a str. 301
aucuuccaccuggaacc

SEQ ID NO: 3939515 - RNA, 14 nt, Shigella flexneri 2a str. 301
aucuuccagaucac

SEQ ID NO: 3939516 - RNA, 13 nt, Shigella flexneri 2a str. 301
aucuucccagccc

SEQ ID NO: 3939517 - RNA, 15 nt, Shigella flexneri 2a str. 301
aucuucccagcgcag

SEQ ID NO: 3939518 - RNA, 20 nt, Shigella flexneri 2a str. 301
aucuuccggcgggcaaacgg

SEQ ID NO: 3939519 - RNA, 16 nt, Shigella flexneri 2a str. 301
aucuucgagauucuua

SEQ ID NO: 3939520 - RNA, 20 nt, Shigella flexneri 2a str. 301
aucuucgagauucuuaaagu

SEQ ID NO: 3939521 - RNA, 19 nt, Shigella flexneri 2a str. 301
aucuucggcgucagaaaua

SEQ ID NO: 3939522 - RNA, 18 nt, Shigella flexneri 2a str. 301
aucuucucuauaaaaaag

SEQ ID NO: 3939523 - RNA, 14 nt, Shigella flexneri 2a str. 301
aucuucuucuaugc

SEQ ID NO: 3939524 - RNA, 20 nt, Shigella flexneri 2a str. 301
aucuucuugcagcuuaauca

SEQ ID NO: 3939525 - RNA, 17 nt, Shigella flexneri 2a str. 301
aucuugcaaaaucaaua

SEQ ID NO: 3939526 - RNA, 22 nt, Shigella flexneri 2a str. 301
aucuugcaaauucaauauauug

SEQ ID NO: 3939527 - RNA, 14 nt, Shigella flexneri 2a str. 301
aucuugucuuccau

SEQ ID NO: 3939528 - RNA, 16 nt, Shigella flexneri 2a str. 301
aucuuguucauagugc

SEQ ID NO: 3939529 - RNA, 18 nt, Shigella flexneri 2a str. 301
aucuuuaaaaaaagcauu

SEQ ID NO: 3939530 - RNA, 21 nt, Shigella flexneri 2a str. 301
aucuuuaaaaaaagcauuuaa

SEQ ID NO: 3939531 - RNA, 13 nt, Shigella flexneri 2a str. 301
aucuuuauauauu

SEQ ID NO: 3939532 - RNA, 14 nt, Shigella flexneri 2a str. 301
aucuuuauauauug

SEQ ID NO: 3939533 - RNA, 15 nt, Shigella flexneri 2a str. 301
aucuuuaugaaauau

SEQ ID NO: 3939534 - RNA, 13 nt, Shigella flexneri 2a str. 301
aucuuucacgccc

SEQ ID NO: 3939535 - RNA, 14 nt, Shigella flexneri 2a str. 301
aucuuucauuuccg

SEQ ID NO: 3939536 - RNA, 14 nt, Shigella flexneri 2a str. 301
aucuuuccucacuc

SEQ ID NO: 3939537 - RNA, 22 nt, Shigella flexneri 2a str. 301
aucuuucugcgaauugagauga

SEQ ID NO: 3939538 - RNA, 21 nt, Shigella flexneri 2a str. 301
aucuuucugcgcaucuucccc

SEQ ID NO: 3939539 - RNA, 12 nt, Shigella flexneri 2a str. 301
aucuuugaugcc

SEQ ID NO: 3939540 - RNA, 15 nt, Shigella flexneri 2a str. 301
aucuuuuacaagcaa

SEQ ID NO: 3939541 - RNA, 22 nt, Shigella flexneri 2a str. 301
aucuuuuacaagcaacuugcaa

SEQ ID NO: 3939542 - RNA, 13 nt, Shigella flexneri 2a str. 301
aucuuuucugagu

SEQ ID NO: 3939543 - RNA, 15 nt, Shigella flexneri 2a str. 301
aucuuuucuuucgcc

SEQ ID NO: 3939544 - RNA, 16 nt, Shigella flexneri 2a str. 301
aucuuuuugccugaga

SEQ ID NO: 3939545 - RNA, 14 nt, Shigella flexneri 2a str. 301
augaaaaaauagaa

SEQ ID NO: 3939546 - RNA, 15 nt, Shigella flexneri 2a str. 301
augaaaaccguauuc

SEQ ID NO: 3939547 - RNA, 18 nt, Shigella flexneri 2a str. 301
augaaaagucauccggcg

SEQ ID NO: 3939548 - RNA, 20 nt, Shigella flexneri 2a str. 301
augaaaccuucuugacgcug

SEQ ID NO: 3939549 - RNA, 23 nt, Shigella flexneri 2a str. 301
augaaaccuucuugacgcugauu

SEQ ID NO: 3939550 - RNA, 16 nt, Shigella flexneri 2a str. 301
augaaacgcaaauacu

SEQ ID NO: 3939551 - RNA, 17 nt, Shigella flexneri 2a str. 301
augaaacgcgaggaugc

SEQ ID NO: 3939552 - RNA, 15 nt, Shigella flexneri 2a str. 301
augaaacgcguucag

SEQ ID NO: 3939553 - RNA, 18 nt, Shigella flexneri 2a str. 301
augaaagaagcuuuccac

SEQ ID NO: 3939554 - RNA, 20 nt, Shigella flexneri 2a str. 301
augaaagccccaccagcaaa

SEQ ID NO: 3939555 - RNA, 21 nt, Shigella flexneri 2a str. 301
augaaagccccaccagcaaau

SEQ ID NO: 3939556 - RNA, 18 nt, Shigella flexneri 2a str. 301
augaaagcgaucuuucug

SEQ ID NO: 3939557 - RNA, 19 nt, Shigella flexneri 2a str. 301
augaaagugguuucaugau

SEQ ID NO: 3939558 - RNA, 17 nt, Shigella flexneri 2a str. 301
augaaauaaaaauaaga

SEQ ID NO: 3939559 - RNA, 20 nt, Shigella flexneri 2a str. 301
augaaauaguugcauuccag

SEQ ID NO: 3939560 - RNA, 17 nt, Shigella flexneri 2a str. 301
augaacaaguauaucaa

SEQ ID NO: 3939561 - RNA, 21 nt, Shigella flexneri 2a str. 301
augaacgguuuaaaccugauu

SEQ ID NO: 3939562 - RNA, 20 nt, Shigella flexneri 2a str. 301
augaagaacaaguucaagau

SEQ ID NO: 3939563 - RNA, 13 nt, Shigella flexneri 2a str. 301
augaagcacugca

SEQ ID NO: 3939564 - RNA, 13 nt, Shigella flexneri 2a str. 301
augaagcccgcug

SEQ ID NO: 3939565 - RNA, 22 nt, Shigella flexneri 2a str. 301
augaagccuaccgggaugcuga

SEQ ID NO: 3939566 - RNA, 20 nt, Shigella flexneri 2a str. 301
augaaguacuuuggaaguau

SEQ ID NO: 3939567 - RNA, 15 nt, Shigella flexneri 2a str. 301
augaagucugccguu

SEQ ID NO: 3939568 - RNA, 19 nt, Shigella flexneri 2a str. 301
augaauauauaauuaaaaa

SEQ ID NO: 3939569 - RNA, 19 nt, Shigella flexneri 2a str. 301
augaauauauccgaaaaag

SEQ ID NO: 3939570 - RNA, 12 nt, Shigella flexneri 2a str. 301
augaauauugcg

SEQ ID NO: 3939571 - RNA, 16 nt, Shigella flexneri 2a str. 301
augaaucagcaaggaa

SEQ ID NO: 3939572 - RNA, 15 nt, Shigella flexneri 2a str. 301
augaaugauaaaauu

SEQ ID NO: 3939573 - RNA, 21 nt, Shigella flexneri 2a str. 301
augaaugcaaggcucaccacc

SEQ ID NO: 3939574 - RNA, 15 nt, Shigella flexneri 2a str. 301
augaauggaguuguc

SEQ ID NO: 3939575 - RNA, 16 nt, Shigella flexneri 2a str. 301
augaauguuuuccugc

SEQ ID NO: 3939576 - RNA, 21 nt, Shigella flexneri 2a str. 301
augaauguuuuccugcuucac

SEQ ID NO: 3939577 - RNA, 21 nt, Shigella flexneri 2a str. 301
augaauuaccaacgugcucac

SEQ ID NO: 3939578 - RNA, 20 nt, Shigella flexneri 2a str. 301
augaauuuaucuuuaagcac

SEQ ID NO: 3939579 - RNA, 13 nt, Shigella flexneri 2a str. 301
augacacacucug

SEQ ID NO: 3939580 - RNA, 23 nt, Shigella flexneri 2a str. 301
augacagcgccgacuguuaccuc

SEQ ID NO: 3939581 - RNA, 14 nt, Shigella flexneri 2a str. 301
augacaucuccagc

SEQ ID NO: 3939582 - RNA, 12 nt, Shigella flexneri 2a str. 301
augacauuaucu

SEQ ID NO: 3939583 - RNA, 20 nt, Shigella flexneri 2a str. 301
augaccaaaaacauugccgu

SEQ ID NO: 3939584 - RNA, 16 nt, Shigella flexneri 2a str. 301
augaccauaaaaggca

SEQ ID NO: 3939585 - RNA, 21 nt, Shigella flexneri 2a str. 301
augaccauaaaaggcaccugg

SEQ ID NO: 3939586 - RNA, 14 nt, Shigella flexneri 2a str. 301
augacccgagccac

SEQ ID NO: 3939587 - RNA, 19 nt, Shigella flexneri 2a str. 301
augaccgacguuaugcucg

SEQ ID NO: 3939588 - RNA, 15 nt, Shigella flexneri 2a str. 301
augaccguuacugau

SEQ ID NO: 3939589 - RNA, 13 nt, Shigella flexneri 2a str. 301
augaccugcaaau

SEQ ID NO: 3939590 - RNA, 16 nt, Shigella flexneri 2a str. 301
augaccuuccagcgcc

SEQ ID NO: 3939591 - RNA, 19 nt, Shigella flexneri 2a str. 301
augaccuugucaugcagcu

SEQ ID NO: 3939592 - RNA, 15 nt, Shigella flexneri 2a str. 301
augaccuuucauucu

SEQ ID NO: 3939593 - RNA, 16 nt, Shigella flexneri 2a str. 301
augacgaacuucauca

SEQ ID NO: 3939594 - RNA, 15 nt, Shigella flexneri 2a str. 301
augacgacaaggcag

SEQ ID NO: 3939595 - RNA, 15 nt, Shigella flexneri 2a str. 301
augacgauacggaau

SEQ ID NO: 3939596 - RNA, 20 nt, Shigella flexneri 2a str. 301
augacgcccuacaaggaacg

SEQ ID NO: 3939597 - RNA, 17 nt, Shigella flexneri 2a str. 301
augacgcguaacggcgg

SEQ ID NO: 3939598 - RNA, 22 nt, Shigella flexneri 2a str. 301
augacggagaguacugccggga

SEQ ID NO: 3939599 - RNA, 15 nt, Shigella flexneri 2a str. 301
augacggcagauuua

SEQ ID NO: 3939600 - RNA, 23 nt, Shigella flexneri 2a str. 301
augacuacgacauugaagaauua

SEQ ID NO: 3939601 - RNA, 22 nt, Shigella flexneri 2a str. 301
augacuaucauugcgugguuuu

SEQ ID NO: 3939602 - RNA, 17 nt, Shigella flexneri 2a str. 301
augacuccaacuuacug

SEQ ID NO: 3939603 - RNA, 18 nt, Shigella flexneri 2a str. 301
augacuccaacuuacuga

SEQ ID NO: 3939604 - RNA, 14 nt, Shigella flexneri 2a str. 301
augacucgccgcug

SEQ ID NO: 3939605 - RNA, 14 nt, Shigella flexneri 2a str. 301
augacuuaauaaaa

SEQ ID NO: 3939606 - RNA, 18 nt, Shigella flexneri 2a str. 301
augacuuaauaaaauagc

SEQ ID NO: 3939607 - RNA, 20 nt, Shigella flexneri 2a str. 301
augacuuucuggcacgaccu

SEQ ID NO: 3939608 - RNA, 16 nt, Shigella flexneri 2a str. 301
augcaugauccggcau

SEQ ID NO: 3939609 - RNA, 14 nt, Shigella flexneri 2a str. 301
augcaugcccggca

SEQ ID NO: 3939610 - RNA, 19 nt, Shigella flexneri 2a str. 301
augcaugcccggcauccgg

SEQ ID NO: 3939611 - RNA, 16 nt, Shigella flexneri 2a str. 301
augcauuguuugcaaa

SEQ ID NO: 3939612 - RNA, 22 nt, Shigella flexneri 2a str. 301
augcauuguuugcaaaaucaaa

SEQ ID NO: 3939613 - RNA, 21 nt, Shigella flexneri 2a str. 301
augccaaaaauaaucuauuga

SEQ ID NO: 3939614 - RNA, 22 nt, Shigella flexneri 2a str. 301
augccaaauauuucuuuaucac

SEQ ID NO: 3939615 - RNA, 24 nt, Shigella flexneri 2a str. 301
augccaaauauuucuuuaucacca

SEQ ID NO: 3939616 - RNA, 14 nt, Shigella flexneri 2a str. 301
augccaacuggcau

SEQ ID NO: 3939617 - RNA, 18 nt, Shigella flexneri 2a str. 301
augccaacuggcauaacc

SEQ ID NO: 3939618 - RNA, 23 nt, Shigella flexneri 2a str. 301
augccaaucaguucaccacuuug

SEQ ID NO: 3939619 - RNA, 23 nt, Shigella flexneri 2a str. 301
augccaaucuucacaucaucauc

SEQ ID NO: 3939620 - RNA, 15 nt, Shigella flexneri 2a str. 301
augccacaaacgccg

SEQ ID NO: 3939621 - RNA, 18 nt, Shigella flexneri 2a str. 301
augccacaaacgccgugc

SEQ ID NO: 3939622 - RNA, 17 nt, Shigella flexneri 2a str. 301
augccacauuagauaaa

SEQ ID NO: 3939623 - RNA, 20 nt, Shigella flexneri 2a str. 301
augccacauuagauaaaaau

SEQ ID NO: 3939624 - RNA, 23 nt, Shigella flexneri 2a str. 301
augccacauuagauaaaaaugaa

SEQ ID NO: 3939625 - RNA, 15 nt, Shigella flexneri 2a str. 301
augccaccaauaaug

SEQ ID NO: 3939626 - RNA, 14 nt, Shigella flexneri 2a str. 301
augccaccacaccg

SEQ ID NO: 3939627 - RNA, 21 nt, Shigella flexneri 2a str. 301
augccacgacguuuuccaucg

SEQ ID NO: 3939628 - RNA, 17 nt, Shigella flexneri 2a str. 301
augccacgccacagccg

SEQ ID NO: 3939629 - RNA, 19 nt, Shigella flexneri 2a str. 301
augccacgugagcuuuucu

SEQ ID NO: 3939630 - RNA, 21 nt, Shigella flexneri 2a str. 301
augccacgugagcuuuucugc

SEQ ID NO: 3939631 - RNA, 22 nt, Shigella flexneri 2a str. 301
augccagaaagcguauccauca

SEQ ID NO: 3939632 - RNA, 17 nt, Shigella flexneri 2a str. 301
augccagaauccccacu

SEQ ID NO: 3939633 - RNA, 24 nt, Shigella flexneri 2a str. 301
augccagaauccccacugcauggc

SEQ ID NO: 3939634 - RNA, 16 nt, Shigella flexneri 2a str. 301
augccagauaagacac

SEQ ID NO: 3939635 - RNA, 14 nt, Shigella flexneri 2a str. 301
augccagcuuucac

SEQ ID NO: 3939636 - RNA, 17 nt, Shigella flexneri 2a str. 301
augccaggccaguucuu

SEQ ID NO: 3939637 - RNA, 16 nt, Shigella flexneri 2a str. 301
augccaguaacucauu

SEQ ID NO: 3939638 - RNA, 15 nt, Shigella flexneri 2a str. 301
augccagucaaugaa

SEQ ID NO: 3939639 - RNA, 14 nt, Shigella flexneri 2a str. 301
augccagucaguua

SEQ ID NO: 3939640 - RNA, 22 nt, Shigella flexneri 2a str. 301
augccagucccgcgacaaucgc

SEQ ID NO: 3939641 - RNA, 20 nt, Shigella flexneri 2a str. 301
augccaucuacacgcuacca

SEQ ID NO: 3939642 - RNA, 18 nt, Shigella flexneri 2a str. 301
augccaucugccagcaag

SEQ ID NO: 3939643 - RNA, 17 nt, Shigella flexneri 2a str. 301
augccauuuccagcgcu

SEQ ID NO: 3939644 - RNA, 12 nt, Shigella flexneri 2a str. 301
augccauuugcc

SEQ ID NO: 3939645 - RNA, 20 nt, Shigella flexneri 2a str. 301
augcccauucaccgacguga

SEQ ID NO: 3939646 - RNA, 24 nt, Shigella flexneri 2a str. 301
augcccgacuugagcgcagucugg

SEQ ID NO: 3939647 - RNA, 16 nt, Shigella flexneri 2a str. 301
augcccgaugaccuug

SEQ ID NO: 3939648 - RNA, 22 nt, Shigella flexneri 2a str. 301
augcccgccccggcgaucccag

SEQ ID NO: 3939649 - RNA, 12 nt, Shigella flexneri 2a str. 301
augcccggacua

SEQ ID NO: 3939650 - RNA, 22 nt, Shigella flexneri 2a str. 301
augcccggccugugucacuuug

SEQ ID NO: 3939651 - RNA, 16 nt, Shigella flexneri 2a str. 301
augcccggcugcgcga

SEQ ID NO: 3939652 - RNA, 22 nt, Shigella flexneri 2a str. 301
augcccgguauuugccgggcau

SEQ ID NO: 3939653 - RNA, 20 nt, Shigella flexneri 2a str. 301
augcccucaauaucuuuccc

SEQ ID NO: 3939654 - RNA, 15 nt, Shigella flexneri 2a str. 301
augcccugcggcugg

SEQ ID NO: 3939655 - RNA, 22 nt, Shigella flexneri 2a str. 301
augccgaaaaaagucauuacca

SEQ ID NO: 3939656 - RNA, 15 nt, Shigella flexneri 2a str. 301
augccgaguggcauu

SEQ ID NO: 3939657 - RNA, 15 nt, Shigella flexneri 2a str. 301
augccgaucaucauc

SEQ ID NO: 3939658 - RNA, 20 nt, Shigella flexneri 2a str. 301
augccgaucaucauccagca

SEQ ID NO: 3939659 - RNA, 23 nt, Shigella flexneri 2a str. 301
augccgaucgucugggcauugaa

SEQ ID NO: 3939660 - RNA, 16 nt, Shigella flexneri 2a str. 301
augccgcacaucaccg

SEQ ID NO: 3939661 - RNA, 18 nt, Shigella flexneri 2a str. 301
augccgccauugacagaa

SEQ ID NO: 3939662 - RNA, 18 nt, Shigella flexneri 2a str. 301
augccgccgacaguuauc

SEQ ID NO: 3939663 - RNA, 20 nt, Shigella flexneri 2a str. 301
augccgccgaggauacagcc

SEQ ID NO: 3939664 - RNA, 15 nt, Shigella flexneri 2a str. 301
augccgccguagaaa

SEQ ID NO: 3939665 - RNA, 22 nt, Shigella flexneri 2a str. 301
augccgcggcgcggcggguuaa

SEQ ID NO: 3939666 - RNA, 21 nt, Shigella flexneri 2a str. 301
augccgcguuggugcagaaga

SEQ ID NO: 3939667 - RNA, 21 nt, Shigella flexneri 2a str. 301
augccgcuucaguugcgccug

SEQ ID NO: 3939668 - RNA, 18 nt, Shigella flexneri 2a str. 301
augccggaugcgccagca

SEQ ID NO: 3939669 - RNA, 22 nt, Shigella flexneri 2a str. 301
augccggaugcgccagcauccg

SEQ ID NO: 3939670 - RNA, 18 nt, Shigella flexneri 2a str. 301
augccggaugcggcguga

SEQ ID NO: 3939671 - RNA, 20 nt, Shigella flexneri 2a str. 301
augccggccagcgccaccac

SEQ ID NO: 3939672 - RNA, 19 nt, Shigella flexneri 2a str. 301
augccgggacgaucggcga

SEQ ID NO: 3939673 - RNA, 22 nt, Shigella flexneri 2a str. 301
augccggguuugccgugugccg

SEQ ID NO: 3939674 - RNA, 13 nt, Shigella flexneri 2a str. 301
augccuaccaaac

SEQ ID NO: 3939675 - RNA, 20 nt, Shigella flexneri 2a str. 301
augccugaugcgacgcuugc

SEQ ID NO: 3939676 - RNA, 23 nt, Shigella flexneri 2a str. 301
augccugaugguguugcaccauc

SEQ ID NO: 3939677 - RNA, 19 nt, Shigella flexneri 2a str. 301
augccugauguacaaccau

SEQ ID NO: 3939678 - RNA, 21 nt, Shigella flexneri 2a str. 301
augccugcacuuugugucagc

SEQ ID NO: 3939679 - RNA, 21 nt, Shigella flexneri 2a str. 301
augccuugugggccugaaagc

SEQ ID NO: 3939680 - RNA, 22 nt, Shigella flexneri 2a str. 301
augccuugugggccugaaagcu

SEQ ID NO: 3939681 - RNA, 17 nt, Shigella flexneri 2a str. 301
augccuuguuugaucau

SEQ ID NO: 3939682 - RNA, 17 nt, Shigella flexneri 2a str. 301
augccuuucucagaagu

SEQ ID NO: 3939683 - RNA, 14 nt, Shigella flexneri 2a str. 301
augcgaagguggcg

SEQ ID NO: 3939684 - RNA, 15 nt, Shigella flexneri 2a str. 301
augcgacaacagaaa

SEQ ID NO: 3939685 - RNA, 17 nt, Shigella flexneri 2a str. 301
augcgacaacuggcagc

SEQ ID NO: 3939686 - RNA, 22 nt, Shigella flexneri 2a str. 301
augcgacauagaucuaaaugcc

SEQ ID NO: 3939687 - RNA, 21 nt, Shigella flexneri 2a str. 301
augcgacgcuugacgcgucuu

SEQ ID NO: 3939688 - RNA, 13 nt, Shigella flexneri 2a str. 301
augcgacgcuugc

SEQ ID NO: 3939689 - RNA, 12 nt, Shigella flexneri 2a str. 301
augcgacggcac

SEQ ID NO: 3939690 - RNA, 17 nt, Shigella flexneri 2a str. 301
augcgagauguccccug

SEQ ID NO: 3939691 - RNA, 20 nt, Shigella flexneri 2a str. 301
augcgaguaaacaggggcug

SEQ ID NO: 3939692 - RNA, 16 nt, Shigella flexneri 2a str. 301
augcgauaacccgcuc

SEQ ID NO: 3939693 - RNA, 18 nt, Shigella flexneri 2a str. 301
augcgcaaccguaaacga

SEQ ID NO: 3939694 - RNA, 23 nt, Shigella flexneri 2a str. 301
augcgcaaccguaaacgaucauc

SEQ ID NO: 3939695 - RNA, 17 nt, Shigella flexneri 2a str. 301
augcgcauugccagagu

SEQ ID NO: 3939696 - RNA, 23 nt, Shigella flexneri 2a str. 301
augcgcauugccagagugaaaau

SEQ ID NO: 3939697 - RNA, 15 nt, Shigella flexneri 2a str. 301
augcgccaaccugcu

SEQ ID NO: 3939698 - RNA, 15 nt, Shigella flexneri 2a str. 301
augcgccagcauccg

SEQ ID NO: 3939699 - RNA, 23 nt, Shigella flexneri 2a str. 301
augcgccagguaacgaagauggc

SEQ ID NO: 3939700 - RNA, 14 nt, Shigella flexneri 2a str. 301
augcgcgaacugga

SEQ ID NO: 3939701 - RNA, 17 nt, Shigella flexneri 2a str. 301
augcgcggcauacagcc

SEQ ID NO: 3939702 - RNA, 20 nt, Shigella flexneri 2a str. 301
augcgcguagcgcguacaaa

SEQ ID NO: 3939703 - RNA, 21 nt, Shigella flexneri 2a str. 301
augcgcucuguugguaaaugc

SEQ ID NO: 3939704 - RNA, 14 nt, Shigella flexneri 2a str. 301
augcgcugagugua

SEQ ID NO: 3939705 - RNA, 22 nt, Shigella flexneri 2a str. 301
augcgcugaguguaacgcuugc

SEQ ID NO: 3939706 - RNA, 21 nt, Shigella flexneri 2a str. 301
augcgcuucgcuuaccaugcc

SEQ ID NO: 3939707 - RNA, 20 nt, Shigella flexneri 2a str. 301
auggcgcgccaccucuuuca

SEQ ID NO: 3939708 - RNA, 18 nt, Shigella flexneri 2a str. 301
auggcgcgcggcaggaag

SEQ ID NO: 3939709 - RNA, 21 nt, Shigella flexneri 2a str. 301
auggcggcagccuccugcacg

SEQ ID NO: 3939710 - RNA, 18 nt, Shigella flexneri 2a str. 301
auggcggcuaggacgcac

SEQ ID NO: 3939711 - RNA, 16 nt, Shigella flexneri 2a str. 301
auggcgggauguguaa

SEQ ID NO: 3939712 - RNA, 22 nt, Shigella flexneri 2a str. 301
auggcggggagggaauccagca

SEQ ID NO: 3939713 - RNA, 15 nt, Shigella flexneri 2a str. 301
auggcggucgcgagu

SEQ ID NO: 3939714 - RNA, 19 nt, Shigella flexneri 2a str. 301
auggcggugagggggggau

SEQ ID NO: 3939715 - RNA, 13 nt, Shigella flexneri 2a str. 301
auggcguacucaa

SEQ ID NO: 3939716 - RNA, 23 nt, Shigella flexneri 2a str. 301
auggcguagcagcagcgauucgu

SEQ ID NO: 3939717 - RNA, 16 nt, Shigella flexneri 2a str. 301
auggcgugagcugccu

SEQ ID NO: 3939718 - RNA, 16 nt, Shigella flexneri 2a str. 301
auggcuacguagcuca

SEQ ID NO: 3939719 - RNA, 14 nt, Shigella flexneri 2a str. 301
auggcuaucaagau

SEQ ID NO: 3939720 - RNA, 14 nt, Shigella flexneri 2a str. 301
auggcucaccagca

SEQ ID NO: 3939721 - RNA, 14 nt, Shigella flexneri 2a str. 301
auggcucagauuga

SEQ ID NO: 3939722 - RNA, 16 nt, Shigella flexneri 2a str. 301
auggcucagauugaac

SEQ ID NO: 3939723 - RNA, 19 nt, Shigella flexneri 2a str. 301
auggcucgccauccaguga

SEQ ID NO: 3939724 - RNA, 16 nt, Shigella flexneri 2a str. 301
auggcucugcggcgga

SEQ ID NO: 3939725 - RNA, 22 nt, Shigella flexneri 2a str. 301
auggcugaaagcgccgggaaug

SEQ ID NO: 3939726 - RNA, 18 nt, Shigella flexneri 2a str. 301
auggcugaccagaauuua

SEQ ID NO: 3939727 - RNA, 22 nt, Shigella flexneri 2a str. 301
auggcugccaaugauaucggaa

SEQ ID NO: 3939728 - RNA, 16 nt, Shigella flexneri 2a str. 301
auggcuggcaauacug

SEQ ID NO: 3939729 - RNA, 14 nt, Shigella flexneri 2a str. 301
auggcuguccuuua

SEQ ID NO: 3939730 - RNA, 21 nt, Shigella flexneri 2a str. 301
auggcuguuuucagcaccaga

SEQ ID NO: 3939731 - RNA, 16 nt, Shigella flexneri 2a str. 301
auggcuucaucccagu

SEQ ID NO: 3939732 - RNA, 18 nt, Shigella flexneri 2a str. 301
augggaaaugacauucac

SEQ ID NO: 3939733 - RNA, 20 nt, Shigella flexneri 2a str. 301
augggaccgcuaccacggaa

SEQ ID NO: 3939734 - RNA, 11 nt, Shigella flexneri 2a str. 301
augggagcaga

SEQ ID NO: 3939735 - RNA, 15 nt, Shigella flexneri 2a str. 301
augggcauuucugcg

SEQ ID NO: 3939736 - RNA, 17 nt, Shigella flexneri 2a str. 301
augggcgccauuuuuca

SEQ ID NO: 3939737 - RNA, 18 nt, Shigella flexneri 2a str. 301
auggggguccugagcacu

SEQ ID NO: 3939738 - RNA, 23 nt, Shigella flexneri 2a str. 301
auggggucaggugggaccaccgc

SEQ ID NO: 3939739 - RNA, 11 nt, Shigella flexneri 2a str. 301
augggguggaa

SEQ ID NO: 3939740 - RNA, 21 nt, Shigella flexneri 2a str. 301
augggguggaacggugaaaac

SEQ ID NO: 3939741 - RNA, 15 nt, Shigella flexneri 2a str. 301
augggucggcgauaa

SEQ ID NO: 3939742 - RNA, 19 nt, Shigella flexneri 2a str. 301
augggugacaucgcccuga

SEQ ID NO: 3939743 - RNA, 20 nt, Shigella flexneri 2a str. 301
augggugcaaugagaaugcg

SEQ ID NO: 3939744 - RNA, 16 nt, Shigella flexneri 2a str. 301
augguaacaccagagu

SEQ ID NO: 3939745 - RNA, 17 nt, Shigella flexneri 2a str. 301
augguaucgggcaguuu

SEQ ID NO: 3939746 - RNA, 18 nt, Shigella flexneri 2a str. 301
augguauuguccugcaag

SEQ ID NO: 3939747 - RNA, 19 nt, Shigella flexneri 2a str. 301
auggucaacgucaacuuug

SEQ ID NO: 3939748 - RNA, 14 nt, Shigella flexneri 2a str. 301
auggucagccagcg

SEQ ID NO: 3939749 - RNA, 23 nt, Shigella flexneri 2a str. 301
auggucagcuucaccuuccagua

SEQ ID NO: 3939750 - RNA, 21 nt, Shigella flexneri 2a str. 301
auggucagguauuuugucagc

SEQ ID NO: 3939751 - RNA, 20 nt, Shigella flexneri 2a str. 301
auggucaguacgccgccguu

SEQ ID NO: 3939752 - RNA, 16 nt, Shigella flexneri 2a str. 301
auggucgcaucauuua

SEQ ID NO: 3939753 - RNA, 20 nt, Shigella flexneri 2a str. 301
auggucgcaucauuuaaaaa

SEQ ID NO: 3939754 - RNA, 22 nt, Shigella flexneri 2a str. 301
auggucgcaucauuuaaaaaga

SEQ ID NO: 3939755 - RNA, 20 nt, Shigella flexneri 2a str. 301
auggucucgccgauagucag

SEQ ID NO: 3939756 - RNA, 17 nt, Shigella flexneri 2a str. 301
auggucuguaccaccag

SEQ ID NO: 3939757 - RNA, 19 nt, Shigella flexneri 2a str. 301
auggucuuguaggccagau

SEQ ID NO: 3939758 - RNA, 14 nt, Shigella flexneri 2a str. 301
auggugaaaguaaa

SEQ ID NO: 3939759 - RNA, 13 nt, Shigella flexneri 2a str. 301
augguggaguggc

SEQ ID NO: 3939760 - RNA, 19 nt, Shigella flexneri 2a str. 301
augguggccgccacgcgug

SEQ ID NO: 3939761 - RNA, 21 nt, Shigella flexneri 2a str. 301
augguggugggggaaggauuc

SEQ ID NO: 3939762 - RNA, 17 nt, Shigella flexneri 2a str. 301
augguguaaaugccggu

SEQ ID NO: 3939763 - RNA, 14 nt, Shigella flexneri 2a str. 301
augguguacucauu

SEQ ID NO: 3939764 - RNA, 22 nt, Shigella flexneri 2a str. 301
auggugucgguauaccauuucu

SEQ ID NO: 3939765 - RNA, 17 nt, Shigella flexneri 2a str. 301
augguguucagauggcc

SEQ ID NO: 3939766 - RNA, 18 nt, Shigella flexneri 2a str. 301
augguguuggcaaucagc

SEQ ID NO: 3939767 - RNA, 22 nt, Shigella flexneri 2a str. 301
augguguuggcaaucagcggca

SEQ ID NO: 3939768 - RNA, 19 nt, Shigella flexneri 2a str. 301
augguguuuuccaccguga

SEQ ID NO: 3939769 - RNA, 21 nt, Shigella flexneri 2a str. 301
augguuacgcagauauucguu

SEQ ID NO: 3939770 - RNA, 13 nt, Shigella flexneri 2a str. 301
augguuacgcaua

SEQ ID NO: 3939771 - RNA, 17 nt, Shigella flexneri 2a str. 301
augguuucauuccagua

SEQ ID NO: 3939772 - RNA, 13 nt, Shigella flexneri 2a str. 301
augguuucauucu

SEQ ID NO: 3939773 - RNA, 16 nt, Shigella flexneri 2a str. 301
augguuugggcguuac

SEQ ID NO: 3939774 - RNA, 11 nt, Shigella flexneri 2a str. 301
augguuuucaa

SEQ ID NO: 3939775 - RNA, 20 nt, Shigella flexneri 2a str. 301
augguuuuuggguucagcau

SEQ ID NO: 3939776 - RNA, 13 nt, Shigella flexneri 2a str. 301
auguaaaaauacu

SEQ ID NO: 3939777 - RNA, 18 nt, Shigella flexneri 2a str. 301
auguaaaaccaacaguau

SEQ ID NO: 3939778 - RNA, 21 nt, Shigella flexneri 2a str. 301
auguaaaaggcgcuaaaaaua

SEQ ID NO: 3939779 - RNA, 13 nt, Shigella flexneri 2a str. 301
auguaaauaacag

SEQ ID NO: 3939780 - RNA, 22 nt, Shigella flexneri 2a str. 301
auguaaucaacuccgccagcaa

SEQ ID NO: 3939781 - RNA, 20 nt, Shigella flexneri 2a str. 301
auguaaucuguugaaauaau

SEQ ID NO: 3939782 - RNA, 21 nt, Shigella flexneri 2a str. 301
auguaaucuguugaaauaaug

SEQ ID NO: 3939783 - RNA, 16 nt, Shigella flexneri 2a str. 301
auguaauuaagcgcaa

SEQ ID NO: 3939784 - RNA, 21 nt, Shigella flexneri 2a str. 301
auguacucuuuauugcaaaca

SEQ ID NO: 3939785 - RNA, 16 nt, Shigella flexneri 2a str. 301
auguagcgcugcaaac

SEQ ID NO: 3939786 - RNA, 23 nt, Shigella flexneri 2a str. 301
auguagcguuuuauaccaacaaa

SEQ ID NO: 3939787 - RNA, 16 nt, Shigella flexneri 2a str. 301
auguagucaucugcac

SEQ ID NO: 3939788 - RNA, 13 nt, Shigella flexneri 2a str. 301
auguauaucggcc

SEQ ID NO: 3939789 - RNA, 13 nt, Shigella flexneri 2a str. 301
auguaugaaguac

SEQ ID NO: 3939790 - RNA, 19 nt, Shigella flexneri 2a str. 301
auguauggcgauagcccag

SEQ ID NO: 3939791 - RNA, 20 nt, Shigella flexneri 2a str. 301
auguauggcgauagcccaga

SEQ ID NO: 3939792 - RNA, 14 nt, Shigella flexneri 2a str. 301
augucacagccgca

SEQ ID NO: 3939793 - RNA, 18 nt, Shigella flexneri 2a str. 301
augucacccacuguggua

SEQ ID NO: 3939794 - RNA, 16 nt, Shigella flexneri 2a str. 301
augucagaugcggcgu

SEQ ID NO: 3939795 - RNA, 17 nt, Shigella flexneri 2a str. 301
augucagaugcggcgug

SEQ ID NO: 3939796 - RNA, 18 nt, Shigella flexneri 2a str. 301
augucagaugcggcguga

SEQ ID NO: 3939797 - RNA, 20 nt, Shigella flexneri 2a str. 301
augucagggccaucgcgguu

SEQ ID NO: 3939798 - RNA, 14 nt, Shigella flexneri 2a str. 301
augucaucagcauu

SEQ ID NO: 3939799 - RNA, 15 nt, Shigella flexneri 2a str. 301
auguccggaaauuug

SEQ ID NO: 3939800 - RNA, 21 nt, Shigella flexneri 2a str. 301
auguccugacgcccgaaggcg

SEQ ID NO: 3939801 - RNA, 22 nt, Shigella flexneri 2a str. 301
auguccugcauccgcuuaaucu

SEQ ID NO: 3939802 - RNA, 22 nt, Shigella flexneri 2a str. 301
augucgauauggggauccccau

SEQ ID NO: 3939803 - RNA, 16 nt, Shigella flexneri 2a str. 301
augucgcgcacuggau

SEQ ID NO: 3939804 - RNA, 15 nt, Shigella flexneri 2a str. 301
augucgcgccaggcg

SEQ ID NO: 3939805 - RNA, 23 nt, Shigella flexneri 2a str. 301
augucgcucaaugcgcugagugu

SEQ ID NO: 3939806 - RNA, 14 nt, Shigella flexneri 2a str. 301
augucggaugcaga

SEQ ID NO: 3939807 - RNA, 17 nt, Shigella flexneri 2a str. 301
auuaauaaaauuaucca

SEQ ID NO: 3939808 - RNA, 13 nt, Shigella flexneri 2a str. 301
auuaauaacacau

SEQ ID NO: 3939809 - RNA, 11 nt, Shigella flexneri 2a str. 301
auuaauacaac

SEQ ID NO: 3939810 - RNA, 20 nt, Shigella flexneri 2a str. 301
auuaauacaacaacacccau

SEQ ID NO: 3939811 - RNA, 18 nt, Shigella flexneri 2a str. 301
auuaauaugcucaacaau

SEQ ID NO: 3939812 - RNA, 19 nt, Shigella flexneri 2a str. 301
auuaauccagggaucaaca

SEQ ID NO: 3939813 - RNA, 22 nt, Shigella flexneri 2a str. 301
auuaaucgagauaccuaacauu

SEQ ID NO: 3939814 - RNA, 23 nt, Shigella flexneri 2a str. 301
auuaaucgauaaaccagcaacca

SEQ ID NO: 3939815 - RNA, 23 nt, Shigella flexneri 2a str. 301
auuaauggugauggucgucaauc

SEQ ID NO: 3939816 - RNA, 18 nt, Shigella flexneri 2a str. 301
auuaauugcaacgcccau

SEQ ID NO: 3939817 - RNA, 15 nt, Shigella flexneri 2a str. 301
auuaauugccgccag

SEQ ID NO: 3939818 - RNA, 20 nt, Shigella flexneri 2a str. 301
auuaauugccguuaaaacua

SEQ ID NO: 3939819 - RNA, 22 nt, Shigella flexneri 2a str. 301
auuaauugccguuaaaacuaaa

SEQ ID NO: 3939820 - RNA, 14 nt, Shigella flexneri 2a str. 301
auuaauuucauuuu

SEQ ID NO: 3939821 - RNA, 22 nt, Shigella flexneri 2a str. 301
auuacaacguauuauauauaau

SEQ ID NO: 3939822 - RNA, 18 nt, Shigella flexneri 2a str. 301
auuacaagaaucaugcca

SEQ ID NO: 3939823 - RNA, 20 nt, Shigella flexneri 2a str. 301
auuacaagaaucaugccaaa

SEQ ID NO: 3939824 - RNA, 12 nt, Shigella flexneri 2a str. 301
auuacacagcca

SEQ ID NO: 3939825 - RNA, 14 nt, Shigella flexneri 2a str. 301
auuacagcaccuua

SEQ ID NO: 3939826 - RNA, 12 nt, Shigella flexneri 2a str. 301
auuacccaaaac

SEQ ID NO: 3939827 - RNA, 23 nt, Shigella flexneri 2a str. 301
auuacccugcacguuggcgcaua

SEQ ID NO: 3939828 - RNA, 22 nt, Shigella flexneri 2a str. 301
auuacccuucgcccugcgucgc

SEQ ID NO: 3939829 - RNA, 19 nt, Shigella flexneri 2a str. 301
auuaccgccaccaggaacg

SEQ ID NO: 3939830 - RNA, 18 nt, Shigella flexneri 2a str. 301
auuaccgccacuaucgcc

SEQ ID NO: 3939831 - RNA, 13 nt, Shigella flexneri 2a str. 301
auuaccuuccuca

SEQ ID NO: 3939832 - RNA, 17 nt, Shigella flexneri 2a str. 301
auuaccuuuuuacccau

SEQ ID NO: 3939833 - RNA, 17 nt, Shigella flexneri 2a str. 301
auuacgacucaacccca

SEQ ID NO: 3939834 - RNA, 20 nt, Shigella flexneri 2a str. 301
auuacgagucacaaacauca

SEQ ID NO: 3939835 - RNA, 21 nt, Shigella flexneri 2a str. 301
auuacgcaaugcguacuucuu

SEQ ID NO: 3939836 - RNA, 22 nt, Shigella flexneri 2a str. 301
auuacgcaggcaauccauaacg

SEQ ID NO: 3939837 - RNA, 14 nt, Shigella flexneri 2a str. 301
auuacgcucacugc

SEQ ID NO: 3939838 - RNA, 18 nt, Shigella flexneri 2a str. 301
auuacgcucacugcaaaa

SEQ ID NO: 3939839 - RNA, 13 nt, Shigella flexneri 2a str. 301
auuacgcuguuca

SEQ ID NO: 3939840 - RNA, 14 nt, Shigella flexneri 2a str. 301
auuacggauuaaau

SEQ ID NO: 3939841 - RNA, 21 nt, Shigella flexneri 2a str. 301
auuacgggcgaaguucgccau

SEQ ID NO: 3939842 - RNA, 15 nt, Shigella flexneri 2a str. 301
auuacggucaaauua

SEQ ID NO: 3939843 - RNA, 19 nt, Shigella flexneri 2a str. 301
auuacguccaucacaauca

SEQ ID NO: 3939844 - RNA, 21 nt, Shigella flexneri 2a str. 301
auuacgugaaguaaaaggucu

SEQ ID NO: 3939845 - RNA, 21 nt, Shigella flexneri 2a str. 301
auuacguggguaggaucaauu

SEQ ID NO: 3939846 - RNA, 16 nt, Shigella flexneri 2a str. 301
auuacuaaaugugcaa

SEQ ID NO: 3939847 - RNA, 15 nt, Shigella flexneri 2a str. 301
auuacucaacgucaa

SEQ ID NO: 3939848 - RNA, 15 nt, Shigella flexneri 2a str. 301
auuacucagcgcugc

SEQ ID NO: 3939849 - RNA, 23 nt, Shigella flexneri 2a str. 301
auuacugccuugaugaaaaaacc

SEQ ID NO: 3939850 - RNA, 14 nt, Shigella flexneri 2a str. 301
auuacuuacacauc

SEQ ID NO: 3939851 - RNA, 22 nt, Shigella flexneri 2a str. 301
auuacuuaucccugucuaacca

SEQ ID NO: 3939852 - RNA, 15 nt, Shigella flexneri 2a str. 301
auuacuuccuucaug

SEQ ID NO: 3939853 - RNA, 18 nt, Shigella flexneri 2a str. 301
auuacuuuaagccuuccg

SEQ ID NO: 3939854 - RNA, 16 nt, Shigella flexneri 2a str. 301
auuacuuuauuuauau

SEQ ID NO: 3939855 - RNA, 23 nt, Shigella flexneri 2a str. 301
auuacuuuauuuauaucagugau

SEQ ID NO: 3939856 - RNA, 18 nt, Shigella flexneri 2a str. 301
auuacuuuccaucuuucc

SEQ ID NO: 3939857 - RNA, 21 nt, Shigella flexneri 2a str. 301
auuacuuucggugacuucaaa

SEQ ID NO: 3939858 - RNA, 13 nt, Shigella flexneri 2a str. 301
auuagauaaaaau

SEQ ID NO: 3939859 - RNA, 17 nt, Shigella flexneri 2a str. 301
auuagauaaaaaugaag

SEQ ID NO: 3939860 - RNA, 14 nt, Shigella flexneri 2a str. 301
auuagcaauaccau

SEQ ID NO: 3939861 - RNA, 14 nt, Shigella flexneri 2a str. 301
auuagcaauauuuu

SEQ ID NO: 3939862 - RNA, 18 nt, Shigella flexneri 2a str. 301
auuagcaauauuuuuaug

SEQ ID NO: 3939863 - RNA, 21 nt, Shigella flexneri 2a str. 301
auuagcaaugcgcuguaauuu

SEQ ID NO: 3939864 - RNA, 16 nt, Shigella flexneri 2a str. 301
auuagcagcccgcagc

SEQ ID NO: 3939865 - RNA, 23 nt, Shigella flexneri 2a str. 301
auuagcagcccgcagcgccuggc

SEQ ID NO: 3939866 - RNA, 17 nt, Shigella flexneri 2a str. 301
auuagcauggccgccaa

SEQ ID NO: 3939867 - RNA, 12 nt, Shigella flexneri 2a str. 301
auuagccaggca

SEQ ID NO: 3939868 - RNA, 23 nt, Shigella flexneri 2a str. 301
auuagcguccggcugccagccag

SEQ ID NO: 3939869 - RNA, 19 nt, Shigella flexneri 2a str. 301
auuagggcggacaaccagc

SEQ ID NO: 3939870 - RNA, 18 nt, Shigella flexneri 2a str. 301
auuagucaauuaaaaaau

SEQ ID NO: 3939871 - RNA, 16 nt, Shigella flexneri 2a str. 301
auuagucuuuaucugc

SEQ ID NO: 3939872 - RNA, 22 nt, Shigella flexneri 2a str. 301
auuauaauaagcgcaaggguaa

SEQ ID NO: 3939873 - RNA, 19 nt, Shigella flexneri 2a str. 301
auuauaguaucguuaaauu

SEQ ID NO: 3939874 - RNA, 13 nt, Shigella flexneri 2a str. 301
auuauaugugcuu

SEQ ID NO: 3939875 - RNA, 17 nt, Shigella flexneri 2a str. 301
auuaucagagauucuuu

SEQ ID NO: 3939876 - RNA, 16 nt, Shigella flexneri 2a str. 301
auuauccacggcacag

SEQ ID NO: 3939877 - RNA, 12 nt, Shigella flexneri 2a str. 301
auuauccaugcc

SEQ ID NO: 3939878 - RNA, 15 nt, Shigella flexneri 2a str. 301
auuaucccccagcac

SEQ ID NO: 3939879 - RNA, 17 nt, Shigella flexneri 2a str. 301
auuaucgcgucuaaauu

SEQ ID NO: 3939880 - RNA, 17 nt, Shigella flexneri 2a str. 301
auuaucgucauggcugu

SEQ ID NO: 3939881 - RNA, 20 nt, Shigella flexneri 2a str. 301
auuaucguuacgacgcaauc

SEQ ID NO: 3939882 - RNA, 16 nt, Shigella flexneri 2a str. 301
auuaucugcaauuacu

SEQ ID NO: 3939883 - RNA, 11 nt, Shigella flexneri 2a str. 301
auuaucuggau

SEQ ID NO: 3939884 - RNA, 16 nt, Shigella flexneri 2a str. 301
auuaucuggcaagccu

SEQ ID NO: 3939885 - RNA, 20 nt, Shigella flexneri 2a str. 301
auuaucuggcaagccugaaa

SEQ ID NO: 3939886 - RNA, 21 nt, Shigella flexneri 2a str. 301
auuaucuggcaagccugaaaa

SEQ ID NO: 3939887 - RNA, 12 nt, Shigella flexneri 2a str. 301
auuaucuucacc

SEQ ID NO: 3939888 - RNA, 20 nt, Shigella flexneri 2a str. 301
auuaucuucaccguucguga

SEQ ID NO: 3939889 - RNA, 16 nt, Shigella flexneri 2a str. 301
auuaugaaacaagaag

SEQ ID NO: 3939890 - RNA, 18 nt, Shigella flexneri 2a str. 301
auuaugacuccagcgcca

SEQ ID NO: 3939891 - RNA, 15 nt, Shigella flexneri 2a str. 301
auuaugaucaaaauc

SEQ ID NO: 3939892 - RNA, 22 nt, Shigella flexneri 2a str. 301
auuaugaucaaaaucauauaau

SEQ ID NO: 3939893 - RNA, 16 nt, Shigella flexneri 2a str. 301
auuaugcagccuucau

SEQ ID NO: 3939894 - RNA, 15 nt, Shigella flexneri 2a str. 301
auuaugccugauuac

SEQ ID NO: 3939895 - RNA, 16 nt, Shigella flexneri 2a str. 301
auuauggaucaccauc

SEQ ID NO: 3939896 - RNA, 20 nt, Shigella flexneri 2a str. 301
auuaugucgcucaaugcgcu

SEQ ID NO: 3939897 - RNA, 22 nt, Shigella flexneri 2a str. 301
auuaugucgcucaaugugcuga

SEQ ID NO: 3939898 - RNA, 19 nt, Shigella flexneri 2a str. 301
auuaugugguuaugccauu

SEQ ID NO: 3939899 - RNA, 17 nt, Shigella flexneri 2a str. 301
auuauucauaaugccca

SEQ ID NO: 3939900 - RNA, 17 nt, Shigella flexneri 2a str. 301
auuauuccauccugcuc

SEQ ID NO: 3939901 - RNA, 16 nt, Shigella flexneri 2a str. 301
auuauuccguuucguu

SEQ ID NO: 3939902 - RNA, 13 nt, Shigella flexneri 2a str. 301
auuauugagcgca

SEQ ID NO: 3939903 - RNA, 12 nt, Shigella flexneri 2a str. 301
auuauugccgca

SEQ ID NO: 3939904 - RNA, 23 nt, Shigella flexneri 2a str. 301
auuauuggcaucguauuucagac

SEQ ID NO: 3939905 - RNA, 20 nt, Shigella flexneri 2a str. 301
auuauuucaaugcauuauca

SEQ ID NO: 3939906 - RNA, 19 nt, Shigella flexneri 2a str. 301
auuauuugcgucagcucac

SEQ ID NO: 3939907 - RNA, 20 nt, Shigella flexneri 2a str. 301
auuccggcgugacgaucacc

SEQ ID NO: 3939908 - RNA, 22 nt, Shigella flexneri 2a str. 301
auuccggcgugacgaucaccac

SEQ ID NO: 3939909 - RNA, 23 nt, Shigella flexneri 2a str. 301
auuccgggaaacgaaccauaaaa

SEQ ID NO: 3939910 - RNA, 19 nt, Shigella flexneri 2a str. 301
auuccgggaauucgaagcu

SEQ ID NO: 3939911 - RNA, 22 nt, Shigella flexneri 2a str. 301
auuccggugaccaguuauuugg

SEQ ID NO: 3939912 - RNA, 19 nt, Shigella flexneri 2a str. 301
auuccggugcugcgucagu

SEQ ID NO: 3939913 - RNA, 18 nt, Shigella flexneri 2a str. 301
auuccgucuccggaaugg

SEQ ID NO: 3939914 - RNA, 20 nt, Shigella flexneri 2a str. 301
auuccuaugcaacaacugaa

SEQ ID NO: 3939915 - RNA, 14 nt, Shigella flexneri 2a str. 301
auuccuauuuuguu

SEQ ID NO: 3939916 - RNA, 22 nt, Shigella flexneri 2a str. 301
auuccucauuucccuguugccu

SEQ ID NO: 3939917 - RNA, 21 nt, Shigella flexneri 2a str. 301
auuccucccguuaugaucagc

SEQ ID NO: 3939918 - RNA, 17 nt, Shigella flexneri 2a str. 301
auuccuccgguagccau

SEQ ID NO: 3939919 - RNA, 20 nt, Shigella flexneri 2a str. 301
auuccugacccagcaccagu

SEQ ID NO: 3939920 - RNA, 22 nt, Shigella flexneri 2a str. 301
auuccugccgcguuggcaaugu

SEQ ID NO: 3939921 - RNA, 21 nt, Shigella flexneri 2a str. 301
auuccugcgcuuccagcucca

SEQ ID NO: 3939922 - RNA, 17 nt, Shigella flexneri 2a str. 301
auuccugcugacggcac

SEQ ID NO: 3939923 - RNA, 22 nt, Shigella flexneri 2a str. 301
auuccugcuuauuguauuucuu

SEQ ID NO: 3939924 - RNA, 20 nt, Shigella flexneri 2a str. 301
auuccuggggucaucagcau

SEQ ID NO: 3939925 - RNA, 15 nt, Shigella flexneri 2a str. 301
auucgaaauagagaa

SEQ ID NO: 3939926 - RNA, 21 nt, Shigella flexneri 2a str. 301
auucgaaauagagaaaguaaa

SEQ ID NO: 3939927 - RNA, 22 nt, Shigella flexneri 2a str. 301
auucgaaccucggaaugccgga

SEQ ID NO: 3939928 - RNA, 15 nt, Shigella flexneri 2a str. 301
auucgagaagcccau

SEQ ID NO: 3939929 - RNA, 20 nt, Shigella flexneri 2a str. 301
auucgaucaaacaauuuuca

SEQ ID NO: 3939930 - RNA, 18 nt, Shigella flexneri 2a str. 301
auucgauucacauuuaaa

SEQ ID NO: 3939931 - RNA, 12 nt, Shigella flexneri 2a str. 301
auucgccgccga

SEQ ID NO: 3939932 - RNA, 17 nt, Shigella flexneri 2a str. 301
auucgccgcgacacaac

SEQ ID NO: 3939933 - RNA, 18 nt, Shigella flexneri 2a str. 301
auucgccgguuccagcuu

SEQ ID NO: 3939934 - RNA, 19 nt, Shigella flexneri 2a str. 301
auucgccugacgcaauaac

SEQ ID NO: 3939935 - RNA, 20 nt, Shigella flexneri 2a str. 301
auucgcuccccugcaaauua

SEQ ID NO: 3939936 - RNA, 14 nt, Shigella flexneri 2a str. 301
auucggcaaucacc

SEQ ID NO: 3939937 - RNA, 16 nt, Shigella flexneri 2a str. 301
auucggcggcgugccu

SEQ ID NO: 3939938 - RNA, 17 nt, Shigella flexneri 2a str. 301
auucggcuacuacggcg

SEQ ID NO: 3939939 - RNA, 14 nt, Shigella flexneri 2a str. 301
auucggcuccagau

SEQ ID NO: 3939940 - RNA, 22 nt, Shigella flexneri 2a str. 301
auucgggauugccagaugcgac

SEQ ID NO: 3939941 - RNA, 19 nt, Shigella flexneri 2a str. 301
auucgucguauagaucacu

SEQ ID NO: 3939942 - RNA, 21 nt, Shigella flexneri 2a str. 301
auucguuuuucuucagcagcc

SEQ ID NO: 3939943 - RNA, 16 nt, Shigella flexneri 2a str. 301
auucuacagaaaugaa

SEQ ID NO: 3939944 - RNA, 15 nt, Shigella flexneri 2a str. 301
auucuaccguuggcc

SEQ ID NO: 3939945 - RNA, 16 nt, Shigella flexneri 2a str. 301
auucucacuccagcca

SEQ ID NO: 3939946 - RNA, 22 nt, Shigella flexneri 2a str. 301
auucucagcgguugcaaggcuu

SEQ ID NO: 3939947 - RNA, 19 nt, Shigella flexneri 2a str. 301
auucucagcugcaagauga

SEQ ID NO: 3939948 - RNA, 22 nt, Shigella flexneri 2a str. 301
auucucagcugcaagaugaaua

SEQ ID NO: 3939949 - RNA, 14 nt, Shigella flexneri 2a str. 301
auucucaucaccau

SEQ ID NO: 3939950 - RNA, 22 nt, Shigella flexneri 2a str. 301
auucuccaaugccguucucugg

SEQ ID NO: 3939951 - RNA, 16 nt, Shigella flexneri 2a str. 301
auucuccggcaggaaa

SEQ ID NO: 3939952 - RNA, 16 nt, Shigella flexneri 2a str. 301
auucuccuucacgauc

SEQ ID NO: 3939953 - RNA, 13 nt, Shigella flexneri 2a str. 301
auucugacugggu

SEQ ID NO: 3939954 - RNA, 15 nt, Shigella flexneri 2a str. 301
auucugacuggguca

SEQ ID NO: 3939955 - RNA, 21 nt, Shigella flexneri 2a str. 301
auucugagagcaugaaaugaa

SEQ ID NO: 3939956 - RNA, 22 nt, Shigella flexneri 2a str. 301
auucugcaaggcaaaauacguu

SEQ ID NO: 3939957 - RNA, 17 nt, Shigella flexneri 2a str. 301
auucugcgcugacucua

SEQ ID NO: 3939958 - RNA, 15 nt, Shigella flexneri 2a str. 301
auucugcugauuaac

SEQ ID NO: 3939959 - RNA, 20 nt, Shigella flexneri 2a str. 301
auucuggcaccaccuggcuu

SEQ ID NO: 3939960 - RNA, 16 nt, Shigella flexneri 2a str. 301
auucugggaacuauau

SEQ ID NO: 3939961 - RNA, 13 nt, Shigella flexneri 2a str. 301
auucuguucagua

SEQ ID NO: 3939962 - RNA, 22 nt, Shigella flexneri 2a str. 301
auucuguucaguacgaaauaac

SEQ ID NO: 3939963 - RNA, 17 nt, Shigella flexneri 2a str. 301
auucuguuuuaucagac

SEQ ID NO: 3939964 - RNA, 23 nt, Shigella flexneri 2a str. 301
auucuuaaagucuuuguauuuau

SEQ ID NO: 3939965 - RNA, 12 nt, Shigella flexneri 2a str. 301
auucuucaagug

SEQ ID NO: 3939966 - RNA, 22 nt, Shigella flexneri 2a str. 301
auucuugccaucaaucacuuug

SEQ ID NO: 3939967 - RNA, 16 nt, Shigella flexneri 2a str. 301
auucuugccuuuccuc

SEQ ID NO: 3939968 - RNA, 14 nt, Shigella flexneri 2a str. 301
auucuuuuccucuc

SEQ ID NO: 3939969 - RNA, 19 nt, Shigella flexneri 2a str. 301
auugaaaaagugccaaaaa

SEQ ID NO: 3939970 - RNA, 20 nt, Shigella flexneri 2a str. 301
auugaaaaagugccaaaaau

SEQ ID NO: 3939971 - RNA, 20 nt, Shigella flexneri 2a str. 301
auugaaauagccaauacgau

SEQ ID NO: 3939972 - RNA, 17 nt, Shigella flexneri 2a str. 301
auugaacagcagaacau

SEQ ID NO: 3939973 - RNA, 16 nt, Shigella flexneri 2a str. 301
auugaacgguuaaucu

SEQ ID NO: 3939974 - RNA, 22 nt, Shigella flexneri 2a str. 301
auugaacucuuaagguucacuu

SEQ ID NO: 3939975 - RNA, 20 nt, Shigella flexneri 2a str. 301
auugaagauguugccacacg

SEQ ID NO: 3939976 - RNA, 15 nt, Shigella flexneri 2a str. 301
auugaagauuuugcu

SEQ ID NO: 3939977 - RNA, 23 nt, Shigella flexneri 2a str. 301
auugaaucacgacaaacacaaua

SEQ ID NO: 3939978 - RNA, 22 nt, Shigella flexneri 2a str. 301
auugaaugucugucugacaacc

SEQ ID NO: 3939979 - RNA, 15 nt, Shigella flexneri 2a str. 301
auugacgaaaagcug

SEQ ID NO: 3939980 - RNA, 23 nt, Shigella flexneri 2a str. 301
auugacgcuguuguuuuuucaac

SEQ ID NO: 3939981 - RNA, 14 nt, Shigella flexneri 2a str. 301
auugacggaauauu

SEQ ID NO: 3939982 - RNA, 15 nt, Shigella flexneri 2a str. 301
auugacguuccuuuc

SEQ ID NO: 3939983 - RNA, 17 nt, Shigella flexneri 2a str. 301
auugacguuccuuucuu

SEQ ID NO: 3939984 - RNA, 20 nt, Shigella flexneri 2a str. 301
auugacuggaugccaguauu

SEQ ID NO: 3939985 - RNA, 23 nt, Shigella flexneri 2a str. 301
auugagaaccacaaugaagaaag

SEQ ID NO: 3939986 - RNA, 23 nt, Shigella flexneri 2a str. 301
auugagacguaguauccacacca

SEQ ID NO: 3939987 - RNA, 16 nt, Shigella flexneri 2a str. 301
auugagaugacgccac

SEQ ID NO: 3939988 - RNA, 21 nt, Shigella flexneri 2a str. 301
auugagcgauuuaugauauuu

SEQ ID NO: 3939989 - RNA, 15 nt, Shigella flexneri 2a str. 301
auugagcuggucuga

SEQ ID NO: 3939990 - RNA, 17 nt, Shigella flexneri 2a str. 301
auugaggcgcugaaugu

SEQ ID NO: 3939991 - RNA, 17 nt, Shigella flexneri 2a str. 301
auugaguacggucugca

SEQ ID NO: 3939992 - RNA, 14 nt, Shigella flexneri 2a str. 301
auugagucagaaau

SEQ ID NO: 3939993 - RNA, 15 nt, Shigella flexneri 2a str. 301
auugaguuugaugac

SEQ ID NO: 3939994 - RNA, 22 nt, Shigella flexneri 2a str. 301
auugauaaucucccguuccugg

SEQ ID NO: 3939995 - RNA, 22 nt, Shigella flexneri 2a str. 301
auugauccccgcuuccugcagc

SEQ ID NO: 3939996 - RNA, 18 nt, Shigella flexneri 2a str. 301
auugauccgcgauaaguc

SEQ ID NO: 3939997 - RNA, 14 nt, Shigella flexneri 2a str. 301
auugauuaaaggaa

SEQ ID NO: 3939998 - RNA, 16 nt, Shigella flexneri 2a str. 301
auugauuaaaggaagg

SEQ ID NO: 3939999 - RNA, 17 nt, Shigella flexneri 2a str. 301
auugauuaaaggaaggu

SEQ ID NO: 3940000 - RNA, 16 nt, Shigella flexneri 2a str. 301
auugauucaucucuuc

SEQ ID NO: 3940001 - RNA, 19 nt, Shigella flexneri 2a str. 301
auugauucgaucaaacaau

SEQ ID NO: 3940002 - RNA, 15 nt, Shigella flexneri 2a str. 301
auugauuuaucaggu

SEQ ID NO: 3940003 - RNA, 13 nt, Shigella flexneri 2a str. 301
auugauuuucuug

SEQ ID NO: 3940004 - RNA, 15 nt, Shigella flexneri 2a str. 301
auugcaaaccucagg

SEQ ID NO: 3940005 - RNA, 21 nt, Shigella flexneri 2a str. 301
auugcaaagagaacugagcga

SEQ ID NO: 3940006 - RNA, 18 nt, Shigella flexneri 2a str. 301
auuguguagccagaaugc

SEQ ID NO: 3940007 - RNA, 14 nt, Shigella flexneri 2a str. 301
auugugucaacucc

SEQ ID NO: 3940008 - RNA, 17 nt, Shigella flexneri 2a str. 301
auugugugauacuucuu

SEQ ID NO: 3940009 - RNA, 18 nt, Shigella flexneri 2a str. 301
auugugugauacuucuuc

SEQ ID NO: 3940010 - RNA, 21 nt, Shigella flexneri 2a str. 301
auuguuaacgccgcgccgugc

SEQ ID NO: 3940011 - RNA, 17 nt, Shigella flexneri 2a str. 301
auuguuauaccagucca

SEQ ID NO: 3940012 - RNA, 21 nt, Shigella flexneri 2a str. 301
auuguuaucguuugcauuauc

SEQ ID NO: 3940013 - RNA, 17 nt, Shigella flexneri 2a str. 301
auuguugauaaggaaau

SEQ ID NO: 3940014 - RNA, 17 nt, Shigella flexneri 2a str. 301
auuguuuccauauguac

SEQ ID NO: 3940015 - RNA, 18 nt, Shigella flexneri 2a str. 301
auuguuugcaaaaucaaa

SEQ ID NO: 3940016 - RNA, 18 nt, Shigella flexneri 2a str. 301
auuguuugucaugacgac

SEQ ID NO: 3940017 - RNA, 17 nt, Shigella flexneri 2a str. 301
auuguuuugaugaauca

SEQ ID NO: 3940018 - RNA, 20 nt, Shigella flexneri 2a str. 301
auuuaaaaagaaaaaacuaa

SEQ ID NO: 3940019 - RNA, 14 nt, Shigella flexneri 2a str. 301
auuuaaaucaaacg

SEQ ID NO: 3940020 - RNA, 23 nt, Shigella flexneri 2a str. 301
auuuaacaccaucauauuuucca

SEQ ID NO: 3940021 - RNA, 15 nt, Shigella flexneri 2a str. 301
auuuaacagcaaaac

SEQ ID NO: 3940022 - RNA, 16 nt, Shigella flexneri 2a str. 301
auuuaacaguugucca

SEQ ID NO: 3940023 - RNA, 20 nt, Shigella flexneri 2a str. 301
auuuaacccuucaagaauua

SEQ ID NO: 3940024 - RNA, 14 nt, Shigella flexneri 2a str. 301
auuuaacggcagca

SEQ ID NO: 3940025 - RNA, 22 nt, Shigella flexneri 2a str. 301
auuuaacucaccgaugaucgcc

SEQ ID NO: 3940026 - RNA, 16 nt, Shigella flexneri 2a str. 301
auuuaagguguugcgu

SEQ ID NO: 3940027 - RNA, 18 nt, Shigella flexneri 2a str. 301
auuuaagguuaugcaagu

SEQ ID NO: 3940028 - RNA, 14 nt, Shigella flexneri 2a str. 301
auuuaaucaguucu

SEQ ID NO: 3940029 - RNA, 14 nt, Shigella flexneri 2a str. 301
auuuaauuacugag

SEQ ID NO: 3940030 - RNA, 21 nt, Shigella flexneri 2a str. 301
auuuacaagcguuuacccaaa

SEQ ID NO: 3940031 - RNA, 16 nt, Shigella flexneri 2a str. 301
auuuacacaauuuugu

SEQ ID NO: 3940032 - RNA, 17 nt, Shigella flexneri 2a str. 301
auuuacacaauuuugua

SEQ ID NO: 3940033 - RNA, 12 nt, Shigella flexneri 2a str. 301
auuuacacuuca

SEQ ID NO: 3940034 - RNA, 14 nt, Shigella flexneri 2a str. 301
auuuacacuucauc

SEQ ID NO: 3940035 - RNA, 21 nt, Shigella flexneri 2a str. 301
auuuacacuucauccuucaca

SEQ ID NO: 3940036 - RNA, 16 nt, Shigella flexneri 2a str. 301
auuuacagccugccag

SEQ ID NO: 3940037 - RNA, 21 nt, Shigella flexneri 2a str. 301
auuuacagccugccagcaugc

SEQ ID NO: 3940038 - RNA, 23 nt, Shigella flexneri 2a str. 301
auuuacgccgacguuggcuauau

SEQ ID NO: 3940039 - RNA, 23 nt, Shigella flexneri 2a str. 301
auuuacgcugucuuuugaucaaa

SEQ ID NO: 3940040 - RNA, 16 nt, Shigella flexneri 2a str. 301
auuuacgcuuuucuuc

SEQ ID NO: 3940041 - RNA, 21 nt, Shigella flexneri 2a str. 301
auuuacggguacgcagcugac

SEQ ID NO: 3940042 - RNA, 16 nt, Shigella flexneri 2a str. 301
auuuacgguauaaccc

SEQ ID NO: 3940043 - RNA, 13 nt, Shigella flexneri 2a str. 301
auuuacuacguaa

SEQ ID NO: 3940044 - RNA, 18 nt, Shigella flexneri 2a str. 301
auuuacuauuauuuuuca

SEQ ID NO: 3940045 - RNA, 23 nt, Shigella flexneri 2a str. 301
auuuagcugucccaagugauuuu

SEQ ID NO: 3940046 - RNA, 14 nt, Shigella flexneri 2a str. 301
auuuauaaaagaaa

SEQ ID NO: 3940047 - RNA, 15 nt, Shigella flexneri 2a str. 301
auuuauagauuuacu

SEQ ID NO: 3940048 - RNA, 13 nt, Shigella flexneri 2a str. 301
auuuauauaaaua

SEQ ID NO: 3940049 - RNA, 19 nt, Shigella flexneri 2a str. 301
auuuauauaaauauaauca

SEQ ID NO: 3940050 - RNA, 22 nt, Shigella flexneri 2a str. 301
auuuaucgacugccagagucaa

SEQ ID NO: 3940051 - RNA, 15 nt, Shigella flexneri 2a str. 301
auuuaucuucccagc

SEQ ID NO: 3940052 - RNA, 14 nt, Shigella flexneri 2a str. 301
auuuaucuucgagc

SEQ ID NO: 3940053 - RNA, 22 nt, Shigella flexneri 2a str. 301
auuuaugccauguucaucaagc

SEQ ID NO: 3940054 - RNA, 19 nt, Shigella flexneri 2a str. 301
auuuaugcgcuaaauguuu

SEQ ID NO: 3940055 - RNA, 17 nt, Shigella flexneri 2a str. 301
auuuaugggguggaacg

SEQ ID NO: 3940056 - RNA, 18 nt, Shigella flexneri 2a str. 301
auuuauggugcuaguuau

SEQ ID NO: 3940057 - RNA, 21 nt, Shigella flexneri 2a str. 301
auuuauuaucuggcaagccug

SEQ ID NO: 3940058 - RNA, 14 nt, Shigella flexneri 2a str. 301
auuuauuucagaac

SEQ ID NO: 3940059 - RNA, 21 nt, Shigella flexneri 2a str. 301
auuuauuuccuucgcuuuaau

SEQ ID NO: 3940060 - RNA, 13 nt, Shigella flexneri 2a str. 301
auuuauuugcaaa

SEQ ID NO: 3940061 - RNA, 18 nt, Shigella flexneri 2a str. 301
auuuauuuuccaaaauaa

SEQ ID NO: 3940062 - RNA, 19 nt, Shigella flexneri 2a str. 301
auuuauuuuuccuccauug

SEQ ID NO: 3940063 - RNA, 13 nt, Shigella flexneri 2a str. 301
auuucaacagauu

SEQ ID NO: 3940064 - RNA, 20 nt, Shigella flexneri 2a str. 301
auuucaacagauuacauuaa

SEQ ID NO: 3940065 - RNA, 15 nt, Shigella flexneri 2a str. 301
auuucaacagguuuu

SEQ ID NO: 3940066 - RNA, 22 nt, Shigella flexneri 2a str. 301
auuucaacagguuuuguugccc

SEQ ID NO: 3940067 - RNA, 13 nt, Shigella flexneri 2a str. 301
auuucaauaacuc

SEQ ID NO: 3940068 - RNA, 18 nt, Shigella flexneri 2a str. 301
auuucaauaacuccaucu

SEQ ID NO: 3940069 - RNA, 20 nt, Shigella flexneri 2a str. 301
auuucaauaucgccuuuugc

SEQ ID NO: 3940070 - RNA, 16 nt, Shigella flexneri 2a str. 301
auuucaauaugauaaa

SEQ ID NO: 3940071 - RNA, 19 nt, Shigella flexneri 2a str. 301
auuucaauaugauaaaccu

SEQ ID NO: 3940072 - RNA, 13 nt, Shigella flexneri 2a str. 301
auuucaaugcauu

SEQ ID NO: 3940073 - RNA, 22 nt, Shigella flexneri 2a str. 301
auuucaaugcauuaucagagau

SEQ ID NO: 3940074 - RNA, 21 nt, Shigella flexneri 2a str. 301
auuucaaugcgcguaauuugc

SEQ ID NO: 3940075 - RNA, 22 nt, Shigella flexneri 2a str. 301
auuucaaugggguaacagguuu

SEQ ID NO: 3940076 - RNA, 17 nt, Shigella flexneri 2a str. 301
auuucacacauaucaca

SEQ ID NO: 3940077 - RNA, 16 nt, Shigella flexneri 2a str. 301
auuucacaccaucaac

SEQ ID NO: 3940078 - RNA, 18 nt, Shigella flexneri 2a str. 301
auuucacaccaucaacaa

SEQ ID NO: 3940079 - RNA, 13 nt, Shigella flexneri 2a str. 301
auuucacaguaau

SEQ ID NO: 3940080 - RNA, 23 nt, Shigella flexneri 2a str. 301
auuucaccgggccgaccgcuuca

SEQ ID NO: 3940081 - RNA, 20 nt, Shigella flexneri 2a str. 301
auuucaccgucaucgacaaa

SEQ ID NO: 3940082 - RNA, 19 nt, Shigella flexneri 2a str. 301
auuucaccugcauuugcug

SEQ ID NO: 3940083 - RNA, 22 nt, Shigella flexneri 2a str. 301
auuucacguucacguaaguacu

SEQ ID NO: 3940084 - RNA, 20 nt, Shigella flexneri 2a str. 301
auuucacuauguuaguuaca

SEQ ID NO: 3940085 - RNA, 19 nt, Shigella flexneri 2a str. 301
auuucacuucaaccacauu

SEQ ID NO: 3940086 - RNA, 21 nt, Shigella flexneri 2a str. 301
auuucacuugcuguaauuuca

SEQ ID NO: 3940087 - RNA, 18 nt, Shigella flexneri 2a str. 301
auuucagaaaguauauaa

SEQ ID NO: 3940088 - RNA, 19 nt, Shigella flexneri 2a str. 301
auuucagaauagacaaaaa

SEQ ID NO: 3940089 - RNA, 18 nt, Shigella flexneri 2a str. 301
auuucagaccuguugccc

SEQ ID NO: 3940090 - RNA, 18 nt, Shigella flexneri 2a str. 301
auuucagcaagacaaugu

SEQ ID NO: 3940091 - RNA, 14 nt, Shigella flexneri 2a str. 301
auuucagccccagc

SEQ ID NO: 3940092 - RNA, 21 nt, Shigella flexneri 2a str. 301
auuucagcgcagacaaucaca

SEQ ID NO: 3940093 - RNA, 22 nt, Shigella flexneri 2a str. 301
auuucaguaauauauauucucu

SEQ ID NO: 3940094 - RNA, 23 nt, Shigella flexneri 2a str. 301
auuucaguaauauauauucucug

SEQ ID NO: 3940095 - RNA, 20 nt, Shigella flexneri 2a str. 301
auuucaguauugagcaaugu

SEQ ID NO: 3940096 - RNA, 14 nt, Shigella flexneri 2a str. 301
auuucaucaccagc

SEQ ID NO: 3940097 - RNA, 15 nt, Shigella flexneri 2a str. 301
auuucaucaccagcu

SEQ ID NO: 3940098 - RNA, 13 nt, Shigella flexneri 2a str. 301
auuucaucgccca

SEQ ID NO: 3940099 - RNA, 20 nt, Shigella flexneri 2a str. 301
auuucaucgcuacaccaauc

SEQ ID NO: 3940100 - RNA, 19 nt, Shigella flexneri 2a str. 301
auuucaucugccuuauuga

SEQ ID NO: 3940101 - RNA, 17 nt, Shigella flexneri 2a str. 301
auuucaugaagcugaca

SEQ ID NO: 3940102 - RNA, 14 nt, Shigella flexneri 2a str. 301
auuucauguuugaa

SEQ ID NO: 3940103 - RNA, 13 nt, Shigella flexneri 2a str. 301
auuucauuauuca

SEQ ID NO: 3940104 - RNA, 15 nt, Shigella flexneri 2a str. 301
auuuccaagauuaaa

SEQ ID NO: 3940105 - RNA, 16 nt, Shigella flexneri 2a str. 301
auuuuauuucuguauu

SEQ ID NO: 3940106 - RNA, 20 nt, Shigella flexneri 2a str. 301
auuuuauuucuguauuacag

SEQ ID NO: 3940107 - RNA, 17 nt, Shigella flexneri 2a str. 301
auuuucaauaaccugca

SEQ ID NO: 3940108 - RNA, 20 nt, Shigella flexneri 2a str. 301
auuuucaauaaccugcaaaa

SEQ ID NO: 3940109 - RNA, 22 nt, Shigella flexneri 2a str. 301
auuuucagaaggauaauuaauc

SEQ ID NO: 3940110 - RNA, 17 nt, Shigella flexneri 2a str. 301
auuuucagccaucaucc

SEQ ID NO: 3940111 - RNA, 13 nt, Shigella flexneri 2a str. 301
auuuucagcgugc

SEQ ID NO: 3940112 - RNA, 21 nt, Shigella flexneri 2a str. 301
auuuucagcgugcccacguuc

SEQ ID NO: 3940113 - RNA, 14 nt, Shigella flexneri 2a str. 301
auuuucauccauua

SEQ ID NO: 3940114 - RNA, 21 nt, Shigella flexneri 2a str. 301
auuuucauuugcgcggcaguc

SEQ ID NO: 3940115 - RNA, 22 nt, Shigella flexneri 2a str. 301
auuuucccuucugagaucaaug

SEQ ID NO: 3940116 - RNA, 20 nt, Shigella flexneri 2a str. 301
auuuuccuccagcagcacaa

SEQ ID NO: 3940117 - RNA, 22 nt, Shigella flexneri 2a str. 301
auuuuccuccagcagcacaauc

SEQ ID NO: 3940118 - RNA, 18 nt, Shigella flexneri 2a str. 301
auuuuccuugaaaaagag

SEQ ID NO: 3940119 - RNA, 16 nt, Shigella flexneri 2a str. 301
auuuucgaaaaaaaag

SEQ ID NO: 3940120 - RNA, 19 nt, Shigella flexneri 2a str. 301
auuuucgaaaaaaaagaag

SEQ ID NO: 3940121 - RNA, 14 nt, Shigella flexneri 2a str. 301
auuuucgccacuuc

SEQ ID NO: 3940122 - RNA, 18 nt, Shigella flexneri 2a str. 301
auuuucgccaucucaaaa

SEQ ID NO: 3940123 - RNA, 14 nt, Shigella flexneri 2a str. 301
auuuucucuuucag

SEQ ID NO: 3940124 - RNA, 19 nt, Shigella flexneri 2a str. 301
auuuucuucagcaguucag

SEQ ID NO: 3940125 - RNA, 19 nt, Shigella flexneri 2a str. 301
auuuugaagucuuuuuuca

SEQ ID NO: 3940126 - RNA, 16 nt, Shigella flexneri 2a str. 301
auuuugauggaagaaa

SEQ ID NO: 3940127 - RNA, 17 nt, Shigella flexneri 2a str. 301
auuuugcagaucgccaa

SEQ ID NO: 3940128 - RNA, 18 nt, Shigella flexneri 2a str. 301
auuuugcaguaacaauau

SEQ ID NO: 3940129 - RNA, 15 nt, Shigella flexneri 2a str. 301
auuuugccagcauga

SEQ ID NO: 3940130 - RNA, 17 nt, Shigella flexneri 2a str. 301
auuuugccagcaugacu

SEQ ID NO: 3940131 - RNA, 17 nt, Shigella flexneri 2a str. 301
auuuugccagccgcagc

SEQ ID NO: 3940132 - RNA, 21 nt, Shigella flexneri 2a str. 301
auuuugcccugcugaucgcca

SEQ ID NO: 3940133 - RNA, 22 nt, Shigella flexneri 2a str. 301
auuuugccuucauacugcggcg

SEQ ID NO: 3940134 - RNA, 13 nt, Shigella flexneri 2a str. 301
auuuugcgcuucu

SEQ ID NO: 3940135 - RNA, 18 nt, Shigella flexneri 2a str. 301
auuuugcguguuucagaa

SEQ ID NO: 3940136 - RNA, 16 nt, Shigella flexneri 2a str. 301
auuuugcguuucugcu

SEQ ID NO: 3940137 - RNA, 20 nt, Shigella flexneri 2a str. 301
auuuugcugaugcagcgaug

SEQ ID NO: 3940138 - RNA, 19 nt, Shigella flexneri 2a str. 301
auuuugcugccguuuucaa

SEQ ID NO: 3940139 - RNA, 17 nt, Shigella flexneri 2a str. 301
auuuugcuuuugauguu

SEQ ID NO: 3940140 - RNA, 19 nt, Shigella flexneri 2a str. 301
auuuuggguuccacuucug

SEQ ID NO: 3940141 - RNA, 13 nt, Shigella flexneri 2a str. 301
auuuugugcagca

SEQ ID NO: 3940142 - RNA, 16 nt, Shigella flexneri 2a str. 301
auuuugugcagcaugc

SEQ ID NO: 3940143 - RNA, 22 nt, Shigella flexneri 2a str. 301
auuuuguguugaggaucacaaa

SEQ ID NO: 3940144 - RNA, 15 nt, Shigella flexneri 2a str. 301
auuuuuaaacaucaa

SEQ ID NO: 3940145 - RNA, 17 nt, Shigella flexneri 2a str. 301
auuuuuaaacaucaaac

SEQ ID NO: 3940146 - RNA, 15 nt, Shigella flexneri 2a str. 301
auuuuuaagcgccau

SEQ ID NO: 3940147 - RNA, 18 nt, Shigella flexneri 2a str. 301
auuuuuacuccacuuccu

SEQ ID NO: 3940148 - RNA, 20 nt, Shigella flexneri 2a str. 301
auuuuuauauagccagccuc

SEQ ID NO: 3940149 - RNA, 14 nt, Shigella flexneri 2a str. 301
auuuuucaauaucc

SEQ ID NO: 3940150 - RNA, 20 nt, Shigella flexneri 2a str. 301
auuuuucacuuaaugaauca

SEQ ID NO: 3940151 - RNA, 14 nt, Shigella flexneri 2a str. 301
auuuuucagcccac

SEQ ID NO: 3940152 - RNA, 13 nt, Shigella flexneri 2a str. 301
auuuuucauaauc

SEQ ID NO: 3940153 - RNA, 17 nt, Shigella flexneri 2a str. 301
auuuuuccagcauuucu

SEQ ID NO: 3940154 - RNA, 22 nt, Shigella flexneri 2a str. 301
auuuuucgagggugcgaauaag

SEQ ID NO: 3940155 - RNA, 15 nt, Shigella flexneri 2a str. 301
auuuuucgcuaaaaa

SEQ ID NO: 3940156 - RNA, 16 nt, Shigella flexneri 2a str. 301
auuuuucgcuaaaaaa

SEQ ID NO: 3940157 - RNA, 16 nt, Shigella flexneri 2a str. 301
auuuuugacuagugau

SEQ ID NO: 3940158 - RNA, 15 nt, Shigella flexneri 2a str. 301
auuuuugcagcaaac

SEQ ID NO: 3940159 - RNA, 16 nt, Shigella flexneri 2a str. 301
auuuuugugaagaaua

SEQ ID NO: 3940160 - RNA, 17 nt, Shigella flexneri 2a str. 301
auuuuuuccagcgcaug

SEQ ID NO: 3940161 - RNA, 20 nt, Shigella flexneri 2a str. 301
auuuuuuccgcaaaaacgac

SEQ ID NO: 3940162 - RNA, 16 nt, Shigella flexneri 2a str. 301
auuuuuucgacaucaa

SEQ ID NO: 3940163 - RNA, 22 nt, Shigella flexneri 2a str. 301
auuuuuuuaaucgucaguuuuu

SEQ ID NO: 3940164 - RNA, 17 nt, Shigella flexneri 2a str. 301
auuuuuuuucaaccuaa

SEQ ID NO: 3940165 - RNA, 20 nt, Shigella flexneri 2a str. 301
auuuuuuuucaggaaauaaa

SEQ ID NO: 3940166 - RNA, 21 nt, Shigella flexneri 2a str. 301
auuuuuuuucaggaaauaaau

SEQ ID NO: 3940167 - RNA, 12 nt, Shigella flexneri 2a str. 301
auuuuuuuuccg

SEQ ID NO: 3940168 - RNA, 16 nt, Shigella flexneri 2a str. 301
caaaaaaaacagcgcc

SEQ ID NO: 3940169 - RNA, 19 nt, Shigella flexneri 2a str. 301
caaaaaaaccgccucaggc

SEQ ID NO: 3940170 - RNA, 12 nt, Shigella flexneri 2a str. 301
caaaaaaauaag

SEQ ID NO: 3940171 - RNA, 13 nt, Shigella flexneri 2a str. 301
caaaaaaccaucc

SEQ ID NO: 3940172 - RNA, 13 nt, Shigella flexneri 2a str. 301
caaaaaaccgcca

SEQ ID NO: 3940173 - RNA, 15 nt, Shigella flexneri 2a str. 301
caaaaaaccgccauu

SEQ ID NO: 3940174 - RNA, 14 nt, Shigella flexneri 2a str. 301
caaaaaacggaaag

SEQ ID NO: 3940175 - RNA, 18 nt, Shigella flexneri 2a str. 301
caaaaaacuggaaaaaua

SEQ ID NO: 3940176 - RNA, 19 nt, Shigella flexneri 2a str. 301
caaaaaacuggaaaaauaa

SEQ ID NO: 3940177 - RNA, 17 nt, Shigella flexneri 2a str. 301
caaaaaaggugcugaaa

SEQ ID NO: 3940178 - RNA, 13 nt, Shigella flexneri 2a str. 301
caaaaaauagcaa

SEQ ID NO: 3940179 - RNA, 17 nt, Shigella flexneri 2a str. 301
caaaaaauugcgucagu

SEQ ID NO: 3940180 - RNA, 20 nt, Shigella flexneri 2a str. 301
caaaaacaacgagccaauaa

SEQ ID NO: 3940181 - RNA, 16 nt, Shigella flexneri 2a str. 301
caaaaacccuucuucc

SEQ ID NO: 3940182 - RNA, 18 nt, Shigella flexneri 2a str. 301
caaaaacucauaaauuca

SEQ ID NO: 3940183 - RNA, 13 nt, Shigella flexneri 2a str. 301
caaaaacuuccau

SEQ ID NO: 3940184 - RNA, 17 nt, Shigella flexneri 2a str. 301
caaaaacuucggcgcga

SEQ ID NO: 3940185 - RNA, 16 nt, Shigella flexneri 2a str. 301
caaaaagauuaaaaaa

SEQ ID NO: 3940186 - RNA, 18 nt, Shigella flexneri 2a str. 301
caaaaagcguauccugac

SEQ ID NO: 3940187 - RNA, 18 nt, Shigella flexneri 2a str. 301
caaaaagcucaaucgaga

SEQ ID NO: 3940188 - RNA, 15 nt, Shigella flexneri 2a str. 301
caaaaaguccaaaag

SEQ ID NO: 3940189 - RNA, 14 nt, Shigella flexneri 2a str. 301
caaaaauaaucauc

SEQ ID NO: 3940190 - RNA, 15 nt, Shigella flexneri 2a str. 301
caaaaauaaucaucu

SEQ ID NO: 3940191 - RNA, 21 nt, Shigella flexneri 2a str. 301
caaaaauaccaccaaugucga

SEQ ID NO: 3940192 - RNA, 21 nt, Shigella flexneri 2a str. 301
caaaaauccagauuuauaaaa

SEQ ID NO: 3940193 - RNA, 17 nt, Shigella flexneri 2a str. 301
caaaaaucgacagcagg

SEQ ID NO: 3940194 - RNA, 19 nt, Shigella flexneri 2a str. 301
caaaaaucgcaaauugacu

SEQ ID NO: 3940195 - RNA, 15 nt, Shigella flexneri 2a str. 301
caaaaaucggcaaca

SEQ ID NO: 3940196 - RNA, 16 nt, Shigella flexneri 2a str. 301
caaaaaucggcaacau

SEQ ID NO: 3940197 - RNA, 18 nt, Shigella flexneri 2a str. 301
caaaaaucggcaacauua

SEQ ID NO: 3940198 - RNA, 18 nt, Shigella flexneri 2a str. 301
caaaacaaugggaaaaca

SEQ ID NO: 3940199 - RNA, 13 nt, Shigella flexneri 2a str. 301
caaaacacugcgc

SEQ ID NO: 3940200 - RNA, 20 nt, Shigella flexneri 2a str. 301
caaaacagggcuuacugaaa

SEQ ID NO: 3940201 - RNA, 14 nt, Shigella flexneri 2a str. 301
caaaacauacccag

SEQ ID NO: 3940202 - RNA, 20 nt, Shigella flexneri 2a str. 301
caaaacauacccaguuucau

SEQ ID NO: 3940203 - RNA, 15 nt, Shigella flexneri 2a str. 301
caaaacccaggcuua

SEQ ID NO: 3940204 - RNA, 16 nt, Shigella flexneri 2a str. 301
caaaaccucuuccagc

SEQ ID NO: 3940205 - RNA, 20 nt, Shigella flexneri 2a str. 301
caaacguggucgccagcauu

SEQ ID NO: 3940206 - RNA, 21 nt, Shigella flexneri 2a str. 301
caaacuaucuguguaaugaau

SEQ ID NO: 3940207 - RNA, 16 nt, Shigella flexneri 2a str. 301
caaacucaauuaccaa

SEQ ID NO: 3940208 - RNA, 19 nt, Shigella flexneri 2a str. 301
caaacuccgugaagcucac

SEQ ID NO: 3940209 - RNA, 18 nt, Shigella flexneri 2a str. 301
caaacucgcgcaggcuga

SEQ ID NO: 3940210 - RNA, 21 nt, Shigella flexneri 2a str. 301
caaacucgcgcaggcugacau

SEQ ID NO: 3940211 - RNA, 23 nt, Shigella flexneri 2a str. 301
caaacucggcuucgcuaagauac

SEQ ID NO: 3940212 - RNA, 13 nt, Shigella flexneri 2a str. 301
caaacucuuuucc

SEQ ID NO: 3940213 - RNA, 22 nt, Shigella flexneri 2a str. 301
caaacugauuaucgaucaugac

SEQ ID NO: 3940214 - RNA, 22 nt, Shigella flexneri 2a str. 301
caaacugcgcgagcgucauaua

SEQ ID NO: 3940215 - RNA, 19 nt, Shigella flexneri 2a str. 301
caaacugcucguucagcac

SEQ ID NO: 3940216 - RNA, 21 nt, Shigella flexneri 2a str. 301
caaacugcucguucagcacuu

SEQ ID NO: 3940217 - RNA, 13 nt, Shigella flexneri 2a str. 301
caaacuuaacacu

SEQ ID NO: 3940218 - RNA, 14 nt, Shigella flexneri 2a str. 301
caaacuuaacacug

SEQ ID NO: 3940219 - RNA, 15 nt, Shigella flexneri 2a str. 301
caaacuuaccgccgc

SEQ ID NO: 3940220 - RNA, 17 nt, Shigella flexneri 2a str. 301
caaacuuaccgccgcuc

SEQ ID NO: 3940221 - RNA, 18 nt, Shigella flexneri 2a str. 301
caaacuuaugcugcgcca

SEQ ID NO: 3940222 - RNA, 13 nt, Shigella flexneri 2a str. 301
caaacuucuucag

SEQ ID NO: 3940223 - RNA, 18 nt, Shigella flexneri 2a str. 301
caaagaaauccacaaauu

SEQ ID NO: 3940224 - RNA, 23 nt, Shigella flexneri 2a str. 301
caaagacaaauuuugaacagaac

SEQ ID NO: 3940225 - RNA, 20 nt, Shigella flexneri 2a str. 301
caaagacgcgguaaaagccc

SEQ ID NO: 3940226 - RNA, 20 nt, Shigella flexneri 2a str. 301
caaagauaaaauaaccaucu

SEQ ID NO: 3940227 - RNA, 18 nt, Shigella flexneri 2a str. 301
caaagaugaugucacagc

SEQ ID NO: 3940228 - RNA, 16 nt, Shigella flexneri 2a str. 301
caaagauguugucauu

SEQ ID NO: 3940229 - RNA, 23 nt, Shigella flexneri 2a str. 301
caaagauguugucauuacaacaa

SEQ ID NO: 3940230 - RNA, 16 nt, Shigella flexneri 2a str. 301
caaagauuuuaccaau

SEQ ID NO: 3940231 - RNA, 13 nt, Shigella flexneri 2a str. 301
caaagcacgcugu

SEQ ID NO: 3940232 - RNA, 17 nt, Shigella flexneri 2a str. 301
caaagcagaaacccauu

SEQ ID NO: 3940233 - RNA, 18 nt, Shigella flexneri 2a str. 301
caaagcauuuuuucacau

SEQ ID NO: 3940234 - RNA, 13 nt, Shigella flexneri 2a str. 301
caaagccaacagc

SEQ ID NO: 3940235 - RNA, 19 nt, Shigella flexneri 2a str. 301
caaagccaauuaacgaaau

SEQ ID NO: 3940236 - RNA, 23 nt, Shigella flexneri 2a str. 301
caaagcccacgccaucauaccca

SEQ ID NO: 3940237 - RNA, 17 nt, Shigella flexneri 2a str. 301
caaagccgcgugcgcug

SEQ ID NO: 3940238 - RNA, 14 nt, Shigella flexneri 2a str. 301
caaagccuuucacu

SEQ ID NO: 3940239 - RNA, 19 nt, Shigella flexneri 2a str. 301
caaagcgcacuuugccaga

SEQ ID NO: 3940240 - RNA, 23 nt, Shigella flexneri 2a str. 301
caaagcgcacuuugucaaaaauc

SEQ ID NO: 3940241 - RNA, 20 nt, Shigella flexneri 2a str. 301
caaagcugguggcaagaccu

SEQ ID NO: 3940242 - RNA, 16 nt, Shigella flexneri 2a str. 301
caaagcugucaccaau

SEQ ID NO: 3940243 - RNA, 13 nt, Shigella flexneri 2a str. 301
caaaggccagcaa

SEQ ID NO: 3940244 - RNA, 14 nt, Shigella flexneri 2a str. 301
caaaggccagcaau

SEQ ID NO: 3940245 - RNA, 17 nt, Shigella flexneri 2a str. 301
caaaggcgaguucaauc

SEQ ID NO: 3940246 - RNA, 21 nt, Shigella flexneri 2a str. 301
caaaggcguuauacugcggca

SEQ ID NO: 3940247 - RNA, 14 nt, Shigella flexneri 2a str. 301
caaaggcuccaggu

SEQ ID NO: 3940248 - RNA, 21 nt, Shigella flexneri 2a str. 301
caaagggcgucgcuuaauuga

SEQ ID NO: 3940249 - RNA, 19 nt, Shigella flexneri 2a str. 301
caaagguuuccucaugcau

SEQ ID NO: 3940250 - RNA, 18 nt, Shigella flexneri 2a str. 301
caaaguaaaaaagggcga

SEQ ID NO: 3940251 - RNA, 21 nt, Shigella flexneri 2a str. 301
caaaguaccaucguccagcag

SEQ ID NO: 3940252 - RNA, 17 nt, Shigella flexneri 2a str. 301
caaaguacggacgcggc

SEQ ID NO: 3940253 - RNA, 14 nt, Shigella flexneri 2a str. 301
caaagucaaacugg

SEQ ID NO: 3940254 - RNA, 14 nt, Shigella flexneri 2a str. 301
caaagucuccuuug

SEQ ID NO: 3940255 - RNA, 16 nt, Shigella flexneri 2a str. 301
caaagugaauacagaa

SEQ ID NO: 3940256 - RNA, 17 nt, Shigella flexneri 2a str. 301
caaagugaauacagaac

SEQ ID NO: 3940257 - RNA, 13 nt, Shigella flexneri 2a str. 301
caaagugccccca

SEQ ID NO: 3940258 - RNA, 14 nt, Shigella flexneri 2a str. 301
caaagugcccccaa

SEQ ID NO: 3940259 - RNA, 13 nt, Shigella flexneri 2a str. 301
caaaguuaccgga

SEQ ID NO: 3940260 - RNA, 18 nt, Shigella flexneri 2a str. 301
caaaguuaccggaagcgc

SEQ ID NO: 3940261 - RNA, 13 nt, Shigella flexneri 2a str. 301
caaauaaaauccc

SEQ ID NO: 3940262 - RNA, 18 nt, Shigella flexneri 2a str. 301
caaauaaacgaaucugca

SEQ ID NO: 3940263 - RNA, 19 nt, Shigella flexneri 2a str. 301
caaauaaauagauccagga

SEQ ID NO: 3940264 - RNA, 18 nt, Shigella flexneri 2a str. 301
caaauaacguaaaaaccc

SEQ ID NO: 3940265 - RNA, 22 nt, Shigella flexneri 2a str. 301
caaauaauuacuucgccggaau

SEQ ID NO: 3940266 - RNA, 14 nt, Shigella flexneri 2a str. 301
caaauaauuccugc

SEQ ID NO: 3940267 - RNA, 14 nt, Shigella flexneri 2a str. 301
caaauacaccuaua

SEQ ID NO: 3940268 - RNA, 13 nt, Shigella flexneri 2a str. 301
caaauacaugaug

SEQ ID NO: 3940269 - RNA, 21 nt, Shigella flexneri 2a str. 301
caaauacauugauauacagcc

SEQ ID NO: 3940270 - RNA, 19 nt, Shigella flexneri 2a str. 301
caaauacgcuuuuucccug

SEQ ID NO: 3940271 - RNA, 14 nt, Shigella flexneri 2a str. 301
caaauacugacugg

SEQ ID NO: 3940272 - RNA, 15 nt, Shigella flexneri 2a str. 301
caaauagacacaaga

SEQ ID NO: 3940273 - RNA, 17 nt, Shigella flexneri 2a str. 301
caaauagccaauuccca

SEQ ID NO: 3940274 - RNA, 15 nt, Shigella flexneri 2a str. 301
caaauagccagcaga

SEQ ID NO: 3940275 - RNA, 20 nt, Shigella flexneri 2a str. 301
caaauagugccuggcugcgu

SEQ ID NO: 3940276 - RNA, 20 nt, Shigella flexneri 2a str. 301
caaauaucuauauacaauca

SEQ ID NO: 3940277 - RNA, 18 nt, Shigella flexneri 2a str. 301
caaauaucuuauagacua

SEQ ID NO: 3940278 - RNA, 15 nt, Shigella flexneri 2a str. 301
caaauauuucuuuau

SEQ ID NO: 3940279 - RNA, 22 nt, Shigella flexneri 2a str. 301
caaaucaccauauucagcagca

SEQ ID NO: 3940280 - RNA, 13 nt, Shigella flexneri 2a str. 301
caaaucacuauua

SEQ ID NO: 3940281 - RNA, 19 nt, Shigella flexneri 2a str. 301
caaaucacuauuaaagaaa

SEQ ID NO: 3940282 - RNA, 16 nt, Shigella flexneri 2a str. 301
caaaucagaggcuguu

SEQ ID NO: 3940283 - RNA, 16 nt, Shigella flexneri 2a str. 301
caaaucauccagaccg

SEQ ID NO: 3940284 - RNA, 16 nt, Shigella flexneri 2a str. 301
caaauccacguuccag

SEQ ID NO: 3940285 - RNA, 16 nt, Shigella flexneri 2a str. 301
caaauccagcgccaca

SEQ ID NO: 3940286 - RNA, 17 nt, Shigella flexneri 2a str. 301
caaauccgcacucaucu

SEQ ID NO: 3940287 - RNA, 15 nt, Shigella flexneri 2a str. 301
caaauccuucagacu

SEQ ID NO: 3940288 - RNA, 21 nt, Shigella flexneri 2a str. 301
caaaucgacgccacaaucuga

SEQ ID NO: 3940289 - RNA, 19 nt, Shigella flexneri 2a str. 301
caaaucgauaaaacuuccc

SEQ ID NO: 3940290 - RNA, 20 nt, Shigella flexneri 2a str. 301
caaaucgcaguagcgggcgu

SEQ ID NO: 3940291 - RNA, 18 nt, Shigella flexneri 2a str. 301
caaaucgcccagcaaaua

SEQ ID NO: 3940292 - RNA, 12 nt, Shigella flexneri 2a str. 301
caaaucgcggca

SEQ ID NO: 3940293 - RNA, 16 nt, Shigella flexneri 2a str. 301
caaaucggaacaacag

SEQ ID NO: 3940294 - RNA, 22 nt, Shigella flexneri 2a str. 301
caaaucucccuugcgggaucag

SEQ ID NO: 3940295 - RNA, 19 nt, Shigella flexneri 2a str. 301
caaaucugauuaauauuga

SEQ ID NO: 3940296 - RNA, 20 nt, Shigella flexneri 2a str. 301
caaaucugucguaacugcgc

SEQ ID NO: 3940297 - RNA, 15 nt, Shigella flexneri 2a str. 301
caaaucuuauaugau

SEQ ID NO: 3940298 - RNA, 18 nt, Shigella flexneri 2a str. 301
caaaucuucgucgugaaa

SEQ ID NO: 3940299 - RNA, 21 nt, Shigella flexneri 2a str. 301
caaaucuucgucgugaaagga

SEQ ID NO: 3940300 - RNA, 14 nt, Shigella flexneri 2a str. 301
caaaucuuuucugc

SEQ ID NO: 3940301 - RNA, 20 nt, Shigella flexneri 2a str. 301
caaaugaacaccaaacccug

SEQ ID NO: 3940302 - RNA, 13 nt, Shigella flexneri 2a str. 301
caaaugcaucagu

SEQ ID NO: 3940303 - RNA, 20 nt, Shigella flexneri 2a str. 301
caaaugcgacaacuggcagc

SEQ ID NO: 3940304 - RNA, 14 nt, Shigella flexneri 2a str. 301
caaaugcgcagcca

SEQ ID NO: 3940305 - RNA, 21 nt, Shigella flexneri 2a str. 301
caaccaaggaaggucacgaug

SEQ ID NO: 3940306 - RNA, 12 nt, Shigella flexneri 2a str. 301
caaccaaucgcg

SEQ ID NO: 3940307 - RNA, 16 nt, Shigella flexneri 2a str. 301
caaccaaucgcggcga

SEQ ID NO: 3940308 - RNA, 20 nt, Shigella flexneri 2a str. 301
caaccacaaaacacucuuca

SEQ ID NO: 3940309 - RNA, 15 nt, Shigella flexneri 2a str. 301
caaccacaaccgccg

SEQ ID NO: 3940310 - RNA, 19 nt, Shigella flexneri 2a str. 301
caaccaccucaguacccgc

SEQ ID NO: 3940311 - RNA, 21 nt, Shigella flexneri 2a str. 301
caaccacuucaguaucuuuua

SEQ ID NO: 3940312 - RNA, 22 nt, Shigella flexneri 2a str. 301
caaccacuuuaucgagaauacu

SEQ ID NO: 3940313 - RNA, 22 nt, Shigella flexneri 2a str. 301
caaccagaaagaugcaucauua

SEQ ID NO: 3940314 - RNA, 15 nt, Shigella flexneri 2a str. 301
caaccagaagagaac

SEQ ID NO: 3940315 - RNA, 15 nt, Shigella flexneri 2a str. 301
caaccagauaaccau

SEQ ID NO: 3940316 - RNA, 14 nt, Shigella flexneri 2a str. 301
caaccagcacgccg

SEQ ID NO: 3940317 - RNA, 21 nt, Shigella flexneri 2a str. 301
caaccagcagauguagcucac

SEQ ID NO: 3940318 - RNA, 14 nt, Shigella flexneri 2a str. 301
caaccagccagcgc

SEQ ID NO: 3940319 - RNA, 18 nt, Shigella flexneri 2a str. 301
caaccagcuuaugccugu

SEQ ID NO: 3940320 - RNA, 19 nt, Shigella flexneri 2a str. 301
caaccaguugugcaccacc

SEQ ID NO: 3940321 - RNA, 22 nt, Shigella flexneri 2a str. 301
caaccauacggucugccagucg

SEQ ID NO: 3940322 - RNA, 13 nt, Shigella flexneri 2a str. 301
caaccauccccaa

SEQ ID NO: 3940323 - RNA, 16 nt, Shigella flexneri 2a str. 301
caaccauccccaaaaa

SEQ ID NO: 3940324 - RNA, 23 nt, Shigella flexneri 2a str. 301
caaccaucgguacgcuuucaccc

SEQ ID NO: 3940325 - RNA, 13 nt, Shigella flexneri 2a str. 301
caaccauuugugc

SEQ ID NO: 3940326 - RNA, 13 nt, Shigella flexneri 2a str. 301
caacccacacauu

SEQ ID NO: 3940327 - RNA, 14 nt, Shigella flexneri 2a str. 301
caacccagaagaaa

SEQ ID NO: 3940328 - RNA, 17 nt, Shigella flexneri 2a str. 301
caacccgugaagguugc

SEQ ID NO: 3940329 - RNA, 22 nt, Shigella flexneri 2a str. 301
caacccgugaagguugcgccuu

SEQ ID NO: 3940330 - RNA, 20 nt, Shigella flexneri 2a str. 301
caacccuaaagcacccagca

SEQ ID NO: 3940331 - RNA, 15 nt, Shigella flexneri 2a str. 301
caacccugcccuuca

SEQ ID NO: 3940332 - RNA, 18 nt, Shigella flexneri 2a str. 301
caacccuuuccagcgccg

SEQ ID NO: 3940333 - RNA, 16 nt, Shigella flexneri 2a str. 301
caaccgaacccagcag

SEQ ID NO: 3940334 - RNA, 19 nt, Shigella flexneri 2a str. 301
caaccgaacccagcagguc

SEQ ID NO: 3940335 - RNA, 20 nt, Shigella flexneri 2a str. 301
caaccgagcgccccagaccu

SEQ ID NO: 3940336 - RNA, 17 nt, Shigella flexneri 2a str. 301
caaccgauaucuuuccg

SEQ ID NO: 3940337 - RNA, 13 nt, Shigella flexneri 2a str. 301
caaccgccaccga

SEQ ID NO: 3940338 - RNA, 21 nt, Shigella flexneri 2a str. 301
caaccgcgacugggaggacag

SEQ ID NO: 3940339 - RNA, 17 nt, Shigella flexneri 2a str. 301
caaccgcgguacgccau

SEQ ID NO: 3940340 - RNA, 14 nt, Shigella flexneri 2a str. 301
caaccggcacaaua

SEQ ID NO: 3940341 - RNA, 17 nt, Shigella flexneri 2a str. 301
caaccggcgggaaaaau

SEQ ID NO: 3940342 - RNA, 21 nt, Shigella flexneri 2a str. 301
caaccgguggcaguagcgccu

SEQ ID NO: 3940343 - RNA, 23 nt, Shigella flexneri 2a str. 301
caaccgguggcaguagcgccucu

SEQ ID NO: 3940344 - RNA, 21 nt, Shigella flexneri 2a str. 301
caaccguaaacgaucaucgac

SEQ ID NO: 3940345 - RNA, 17 nt, Shigella flexneri 2a str. 301
caaccguccuccguauc

SEQ ID NO: 3940346 - RNA, 21 nt, Shigella flexneri 2a str. 301
caaccguggcguaaaucaucg

SEQ ID NO: 3940347 - RNA, 21 nt, Shigella flexneri 2a str. 301
caaccguugccgaacguaggc

SEQ ID NO: 3940348 - RNA, 18 nt, Shigella flexneri 2a str. 301
caaccguuugauauaaac

SEQ ID NO: 3940349 - RNA, 14 nt, Shigella flexneri 2a str. 301
caaccuaaaguaaa

SEQ ID NO: 3940350 - RNA, 15 nt, Shigella flexneri 2a str. 301
caaccuagccuuccu

SEQ ID NO: 3940351 - RNA, 19 nt, Shigella flexneri 2a str. 301
caaccugcacgaaaccacu

SEQ ID NO: 3940352 - RNA, 20 nt, Shigella flexneri 2a str. 301
caaccugcacguuaucagac

SEQ ID NO: 3940353 - RNA, 19 nt, Shigella flexneri 2a str. 301
caaccugcuuuaaaagcuc

SEQ ID NO: 3940354 - RNA, 18 nt, Shigella flexneri 2a str. 301
caaccuuauuuccagaua

SEQ ID NO: 3940355 - RNA, 14 nt, Shigella flexneri 2a str. 301
caacgaagaaaacg

SEQ ID NO: 3940356 - RNA, 16 nt, Shigella flexneri 2a str. 301
caacgaaggccugcau

SEQ ID NO: 3940357 - RNA, 18 nt, Shigella flexneri 2a str. 301
caacgacauacucagcgc

SEQ ID NO: 3940358 - RNA, 14 nt, Shigella flexneri 2a str. 301
caacgaccagaaau

SEQ ID NO: 3940359 - RNA, 12 nt, Shigella flexneri 2a str. 301
caacgacggcca

SEQ ID NO: 3940360 - RNA, 16 nt, Shigella flexneri 2a str. 301
caacgagagucgacac

SEQ ID NO: 3940361 - RNA, 15 nt, Shigella flexneri 2a str. 301
caacgagauaaaauu

SEQ ID NO: 3940362 - RNA, 18 nt, Shigella flexneri 2a str. 301
caacgagccaauaaaaau

SEQ ID NO: 3940363 - RNA, 16 nt, Shigella flexneri 2a str. 301
caacgauucaagaaac

SEQ ID NO: 3940364 - RNA, 20 nt, Shigella flexneri 2a str. 301
caacgcaaacgcccguccau

SEQ ID NO: 3940365 - RNA, 13 nt, Shigella flexneri 2a str. 301
caacgcaaagaga

SEQ ID NO: 3940366 - RNA, 18 nt, Shigella flexneri 2a str. 301
caacgcaaagagagaagc

SEQ ID NO: 3940367 - RNA, 20 nt, Shigella flexneri 2a str. 301
caacgcaaagagagaagcca

SEQ ID NO: 3940368 - RNA, 15 nt, Shigella flexneri 2a str. 301
caacgcaacaucgca

SEQ ID NO: 3940369 - RNA, 20 nt, Shigella flexneri 2a str. 301
caacgcaauauccgccacuu

SEQ ID NO: 3940370 - RNA, 15 nt, Shigella flexneri 2a str. 301
caacgccagcagcag

SEQ ID NO: 3940371 - RNA, 14 nt, Shigella flexneri 2a str. 301
caacgccaucgcca

SEQ ID NO: 3940372 - RNA, 15 nt, Shigella flexneri 2a str. 301
caacgcccaucaaca

SEQ ID NO: 3940373 - RNA, 17 nt, Shigella flexneri 2a str. 301
caacgccccuucugccg

SEQ ID NO: 3940374 - RNA, 18 nt, Shigella flexneri 2a str. 301
caacgccccuucugccgc

SEQ ID NO: 3940375 - RNA, 15 nt, Shigella flexneri 2a str. 301
caacgccgccagacc

SEQ ID NO: 3940376 - RNA, 23 nt, Shigella flexneri 2a str. 301
caacgccuaaacuaaucgacagu

SEQ ID NO: 3940377 - RNA, 18 nt, Shigella flexneri 2a str. 301
caacgccuaaugccagcg

SEQ ID NO: 3940378 - RNA, 20 nt, Shigella flexneri 2a str. 301
caacgccuuccgucagcaaa

SEQ ID NO: 3940379 - RNA, 14 nt, Shigella flexneri 2a str. 301
caacgccuucuucg

SEQ ID NO: 3940380 - RNA, 18 nt, Shigella flexneri 2a str. 301
caacgccuuugucgggca

SEQ ID NO: 3940381 - RNA, 14 nt, Shigella flexneri 2a str. 301
caacgcgccaccga

SEQ ID NO: 3940382 - RNA, 15 nt, Shigella flexneri 2a str. 301
caacgcgccgccaac

SEQ ID NO: 3940383 - RNA, 16 nt, Shigella flexneri 2a str. 301
caacgcgcggaacuga

SEQ ID NO: 3940384 - RNA, 12 nt, Shigella flexneri 2a str. 301
caacgcgcggcu

SEQ ID NO: 3940385 - RNA, 13 nt, Shigella flexneri 2a str. 301
caacgcgcgguga

SEQ ID NO: 3940386 - RNA, 14 nt, Shigella flexneri 2a str. 301
caacgcgcggugau

SEQ ID NO: 3940387 - RNA, 19 nt, Shigella flexneri 2a str. 301
caacgcggagcgguaguuc

SEQ ID NO: 3940388 - RNA, 15 nt, Shigella flexneri 2a str. 301
caacgcggcggugau

SEQ ID NO: 3940389 - RNA, 20 nt, Shigella flexneri 2a str. 301
caacgcguuuuuucgauauc

SEQ ID NO: 3940390 - RNA, 14 nt, Shigella flexneri 2a str. 301
caacgcucuccugc

SEQ ID NO: 3940391 - RNA, 15 nt, Shigella flexneri 2a str. 301
caacgcugccagccg

SEQ ID NO: 3940392 - RNA, 17 nt, Shigella flexneri 2a str. 301
caacgcugccagccgcc

SEQ ID NO: 3940393 - RNA, 19 nt, Shigella flexneri 2a str. 301
caacgcugccagccgccgc

SEQ ID NO: 3940394 - RNA, 16 nt, Shigella flexneri 2a str. 301
caacgcugcugccggc

SEQ ID NO: 3940395 - RNA, 11 nt, Shigella flexneri 2a str. 301
caacgcugucc

SEQ ID NO: 3940396 - RNA, 18 nt, Shigella flexneri 2a str. 301
caacggaacgaaaaaaau

SEQ ID NO: 3940397 - RNA, 19 nt, Shigella flexneri 2a str. 301
caacggaacgaaaaaaauc

SEQ ID NO: 3940398 - RNA, 20 nt, Shigella flexneri 2a str. 301
caacggaacgaaaaaaauca

SEQ ID NO: 3940399 - RNA, 20 nt, Shigella flexneri 2a str. 301
caacggaccaauaaacgcca

SEQ ID NO: 3940400 - RNA, 22 nt, Shigella flexneri 2a str. 301
caacggaccaauaaacgccagg

SEQ ID NO: 3940401 - RNA, 19 nt, Shigella flexneri 2a str. 301
caacggaggauuuuucgcg

SEQ ID NO: 3940402 - RNA, 21 nt, Shigella flexneri 2a str. 301
caacggcaacaauucccgcag

SEQ ID NO: 3940403 - RNA, 19 nt, Shigella flexneri 2a str. 301
caacggcgaaagcuggcac

SEQ ID NO: 3940404 - RNA, 23 nt, Shigella flexneri 2a str. 301
caacggcgaaagcuggcacuggg

SEQ ID NO: 3940405 - RNA, 21 nt, Shigella flexneri 2a str. 301
caagccggaauuauccgguga

SEQ ID NO: 3940406 - RNA, 17 nt, Shigella flexneri 2a str. 301
caagcgaaugaggcagc

SEQ ID NO: 3940407 - RNA, 20 nt, Shigella flexneri 2a str. 301
caagcgauaacucgcuuugc

SEQ ID NO: 3940408 - RNA, 15 nt, Shigella flexneri 2a str. 301
caagcgauaauuuau

SEQ ID NO: 3940409 - RNA, 13 nt, Shigella flexneri 2a str. 301
caagcgccgccag

SEQ ID NO: 3940410 - RNA, 16 nt, Shigella flexneri 2a str. 301
caagcgccgccagucg

SEQ ID NO: 3940411 - RNA, 14 nt, Shigella flexneri 2a str. 301
caagcgcgcuguca

SEQ ID NO: 3940412 - RNA, 13 nt, Shigella flexneri 2a str. 301
caagcgcugagac

SEQ ID NO: 3940413 - RNA, 22 nt, Shigella flexneri 2a str. 301
caagcgcugagacgcgcuugcu

SEQ ID NO: 3940414 - RNA, 21 nt, Shigella flexneri 2a str. 301
caagcggaauauuuuuaccgu

SEQ ID NO: 3940415 - RNA, 20 nt, Shigella flexneri 2a str. 301
caagcggagaagguuggcgu

SEQ ID NO: 3940416 - RNA, 15 nt, Shigella flexneri 2a str. 301
caagcggugcgaugc

SEQ ID NO: 3940417 - RNA, 24 nt, Shigella flexneri 2a str. 301
caagcggugcgaugccuggcaaug

SEQ ID NO: 3940418 - RNA, 19 nt, Shigella flexneri 2a str. 301
caagcguaugauugccuga

SEQ ID NO: 3940419 - RNA, 18 nt, Shigella flexneri 2a str. 301
caagcgucgcaucaggca

SEQ ID NO: 3940420 - RNA, 21 nt, Shigella flexneri 2a str. 301
caagcgucgcaucaggcauga

SEQ ID NO: 3940421 - RNA, 21 nt, Shigella flexneri 2a str. 301
caagcgucgcaucaggcauuu

SEQ ID NO: 3940422 - RNA, 20 nt, Shigella flexneri 2a str. 301
caagcguuucaucuucaguc

SEQ ID NO: 3940423 - RNA, 16 nt, Shigella flexneri 2a str. 301
caagcucaaaauaaua

SEQ ID NO: 3940424 - RNA, 20 nt, Shigella flexneri 2a str. 301
caagcucgcagagaucauac

SEQ ID NO: 3940425 - RNA, 22 nt, Shigella flexneri 2a str. 301
caagcucguugguuccacggca

SEQ ID NO: 3940426 - RNA, 20 nt, Shigella flexneri 2a str. 301
caagcugcgugagccgaaau

SEQ ID NO: 3940427 - RNA, 14 nt, Shigella flexneri 2a str. 301
caagcuguucuucc

SEQ ID NO: 3940428 - RNA, 17 nt, Shigella flexneri 2a str. 301
caagcuuacguuaccca

SEQ ID NO: 3940429 - RNA, 18 nt, Shigella flexneri 2a str. 301
caagcuuacguuacccag

SEQ ID NO: 3940430 - RNA, 20 nt, Shigella flexneri 2a str. 301
caagcuuacguuacccagca

SEQ ID NO: 3940431 - RNA, 22 nt, Shigella flexneri 2a str. 301
caaggaaacuaaacgccgcgcc

SEQ ID NO: 3940432 - RNA, 12 nt, Shigella flexneri 2a str. 301
caaggaaauaau

SEQ ID NO: 3940433 - RNA, 17 nt, Shigella flexneri 2a str. 301
caaggaagccugacagg

SEQ ID NO: 3940434 - RNA, 11 nt, Shigella flexneri 2a str. 301
caaggaagcga

SEQ ID NO: 3940435 - RNA, 18 nt, Shigella flexneri 2a str. 301
caaggcagagucauuucu

SEQ ID NO: 3940436 - RNA, 18 nt, Shigella flexneri 2a str. 301
caaggcaggcaucaauga

SEQ ID NO: 3940437 - RNA, 19 nt, Shigella flexneri 2a str. 301
caaggcauauaccacaccc

SEQ ID NO: 3940438 - RNA, 15 nt, Shigella flexneri 2a str. 301
caaggcaucgugauc

SEQ ID NO: 3940439 - RNA, 16 nt, Shigella flexneri 2a str. 301
caaggcuauucagcag

SEQ ID NO: 3940440 - RNA, 21 nt, Shigella flexneri 2a str. 301
caagggaaauaagaaaagcga

SEQ ID NO: 3940441 - RNA, 19 nt, Shigella flexneri 2a str. 301
caagggcggcgagaaacuu

SEQ ID NO: 3940442 - RNA, 16 nt, Shigella flexneri 2a str. 301
caaggguaagggagga

SEQ ID NO: 3940443 - RNA, 17 nt, Shigella flexneri 2a str. 301
caaggguaagggaggau

SEQ ID NO: 3940444 - RNA, 22 nt, Shigella flexneri 2a str. 301
caagggugccgggaacuggcaa

SEQ ID NO: 3940445 - RNA, 20 nt, Shigella flexneri 2a str. 301
caagggugucggcacacaca

SEQ ID NO: 3940446 - RNA, 16 nt, Shigella flexneri 2a str. 301
caagguacgaaaaaaa

SEQ ID NO: 3940447 - RNA, 14 nt, Shigella flexneri 2a str. 301
caagguauccagac

SEQ ID NO: 3940448 - RNA, 14 nt, Shigella flexneri 2a str. 301
caagguauugcacg

SEQ ID NO: 3940449 - RNA, 23 nt, Shigella flexneri 2a str. 301
caaggugcgcgaugcuuucccac

SEQ ID NO: 3940450 - RNA, 21 nt, Shigella flexneri 2a str. 301
caagguugaagguggcgaagu

SEQ ID NO: 3940451 - RNA, 18 nt, Shigella flexneri 2a str. 301
caaguaaaaggagauaaa

SEQ ID NO: 3940452 - RNA, 17 nt, Shigella flexneri 2a str. 301
caaguaacugacaccga

SEQ ID NO: 3940453 - RNA, 13 nt, Shigella flexneri 2a str. 301
caaguaauaaagc

SEQ ID NO: 3940454 - RNA, 23 nt, Shigella flexneri 2a str. 301
caaguaauagaacuauaauugcu

SEQ ID NO: 3940455 - RNA, 12 nt, Shigella flexneri 2a str. 301
caaguauaucaa

SEQ ID NO: 3940456 - RNA, 12 nt, Shigella flexneri 2a str. 301
caaguaucuauu

SEQ ID NO: 3940457 - RNA, 13 nt, Shigella flexneri 2a str. 301
caaguaucuauuc

SEQ ID NO: 3940458 - RNA, 19 nt, Shigella flexneri 2a str. 301
caaguauucacucugcugu

SEQ ID NO: 3940459 - RNA, 19 nt, Shigella flexneri 2a str. 301
caagucaacgucauuaucu

SEQ ID NO: 3940460 - RNA, 16 nt, Shigella flexneri 2a str. 301
caagucauuguccagu

SEQ ID NO: 3940461 - RNA, 22 nt, Shigella flexneri 2a str. 301
caagucucaagagugaacacgu

SEQ ID NO: 3940462 - RNA, 15 nt, Shigella flexneri 2a str. 301
caagucuucacugcu

SEQ ID NO: 3940463 - RNA, 19 nt, Shigella flexneri 2a str. 301
caagugcggcgcaccagca

SEQ ID NO: 3940464 - RNA, 14 nt, Shigella flexneri 2a str. 301
caaguuacuccugg

SEQ ID NO: 3940465 - RNA, 15 nt, Shigella flexneri 2a str. 301
caaguuacuccuggu

SEQ ID NO: 3940466 - RNA, 16 nt, Shigella flexneri 2a str. 301
caaguuacuccuggua

SEQ ID NO: 3940467 - RNA, 17 nt, Shigella flexneri 2a str. 301
caaguucgaacgccgcc

SEQ ID NO: 3940468 - RNA, 23 nt, Shigella flexneri 2a str. 301
caaguucgaacgccgccaguacg

SEQ ID NO: 3940469 - RNA, 19 nt, Shigella flexneri 2a str. 301
caaguucuucgaagcacuc

SEQ ID NO: 3940470 - RNA, 18 nt, Shigella flexneri 2a str. 301
caaguuguauugcucaac

SEQ ID NO: 3940471 - RNA, 16 nt, Shigella flexneri 2a str. 301
caaguuuugucaguuc

SEQ ID NO: 3940472 - RNA, 13 nt, Shigella flexneri 2a str. 301
caauaaaagaaau

SEQ ID NO: 3940473 - RNA, 12 nt, Shigella flexneri 2a str. 301
caauaaacgccu

SEQ ID NO: 3940474 - RNA, 18 nt, Shigella flexneri 2a str. 301
caauaaacuucaauauau

SEQ ID NO: 3940475 - RNA, 16 nt, Shigella flexneri 2a str. 301
caauaaauugcaggaa

SEQ ID NO: 3940476 - RNA, 18 nt, Shigella flexneri 2a str. 301
caauaacacauugcugua

SEQ ID NO: 3940477 - RNA, 19 nt, Shigella flexneri 2a str. 301
caauaacacauugcuguau

SEQ ID NO: 3940478 - RNA, 17 nt, Shigella flexneri 2a str. 301
caauaacacgcuaccac

SEQ ID NO: 3940479 - RNA, 13 nt, Shigella flexneri 2a str. 301
caauaaccaucag

SEQ ID NO: 3940480 - RNA, 14 nt, Shigella flexneri 2a str. 301
caauaaccaucagc

SEQ ID NO: 3940481 - RNA, 21 nt, Shigella flexneri 2a str. 301
caauaacccgcuguaaaugcu

SEQ ID NO: 3940482 - RNA, 17 nt, Shigella flexneri 2a str. 301
caauaaccggcacuuca

SEQ ID NO: 3940483 - RNA, 14 nt, Shigella flexneri 2a str. 301
caauaacuccaucu

SEQ ID NO: 3940484 - RNA, 22 nt, Shigella flexneri 2a str. 301
caauaacucuuugaugaaacau

SEQ ID NO: 3940485 - RNA, 18 nt, Shigella flexneri 2a str. 301
caauaagcgcagccaaaa

SEQ ID NO: 3940486 - RNA, 23 nt, Shigella flexneri 2a str. 301
caauaaguuacacaucauuagua

SEQ ID NO: 3940487 - RNA, 15 nt, Shigella flexneri 2a str. 301
caauaauacccagca

SEQ ID NO: 3940488 - RNA, 22 nt, Shigella flexneri 2a str. 301
caauaaucaaucuuuacacaca

SEQ ID NO: 3940489 - RNA, 21 nt, Shigella flexneri 2a str. 301
caauaaucaucucuccuuucg

SEQ ID NO: 3940490 - RNA, 17 nt, Shigella flexneri 2a str. 301
caauaaucgccuuaccc

SEQ ID NO: 3940491 - RNA, 21 nt, Shigella flexneri 2a str. 301
caauaaucucuacaccaacgc

SEQ ID NO: 3940492 - RNA, 22 nt, Shigella flexneri 2a str. 301
caauaaucucuuuacccagcgg

SEQ ID NO: 3940493 - RNA, 21 nt, Shigella flexneri 2a str. 301
caauaaugaugucaucaagcg

SEQ ID NO: 3940494 - RNA, 21 nt, Shigella flexneri 2a str. 301
caauacaaaauuuaacaccau

SEQ ID NO: 3940495 - RNA, 16 nt, Shigella flexneri 2a str. 301
caauacaccuccggcu

SEQ ID NO: 3940496 - RNA, 20 nt, Shigella flexneri 2a str. 301
caauacaccuccggcugggc

SEQ ID NO: 3940497 - RNA, 12 nt, Shigella flexneri 2a str. 301
caauacauagaa

SEQ ID NO: 3940498 - RNA, 13 nt, Shigella flexneri 2a str. 301
caauacauagaaa

SEQ ID NO: 3940499 - RNA, 17 nt, Shigella flexneri 2a str. 301
caauacccacugcgcag

SEQ ID NO: 3940500 - RNA, 20 nt, Shigella flexneri 2a str. 301
caauacccguccacacggca

SEQ ID NO: 3940501 - RNA, 15 nt, Shigella flexneri 2a str. 301
caauacccugaccca

SEQ ID NO: 3940502 - RNA, 22 nt, Shigella flexneri 2a str. 301
caauaccgcccaccaccagcga

SEQ ID NO: 3940503 - RNA, 16 nt, Shigella flexneri 2a str. 301
caauaccgccugcaaa

SEQ ID NO: 3940504 - RNA, 19 nt, Shigella flexneri 2a str. 301
caauaccgccugcaaauaa

SEQ ID NO: 3940505 - RNA, 20 nt, Shigella flexneri 2a str. 301
caaucuccguguaggccuga

SEQ ID NO: 3940506 - RNA, 16 nt, Shigella flexneri 2a str. 301
caaucucgcgcccguc

SEQ ID NO: 3940507 - RNA, 15 nt, Shigella flexneri 2a str. 301
caaucucuuccagaa

SEQ ID NO: 3940508 - RNA, 16 nt, Shigella flexneri 2a str. 301
caaucucuuuuuccac

SEQ ID NO: 3940509 - RNA, 14 nt, Shigella flexneri 2a str. 301
caaucugcaaaaua

SEQ ID NO: 3940510 - RNA, 15 nt, Shigella flexneri 2a str. 301
caaucugcuugcgau

SEQ ID NO: 3940511 - RNA, 12 nt, Shigella flexneri 2a str. 301
caaucugugccg

SEQ ID NO: 3940512 - RNA, 19 nt, Shigella flexneri 2a str. 301
caaucuuaggggacauuua

SEQ ID NO: 3940513 - RNA, 20 nt, Shigella flexneri 2a str. 301
caaucuuccucgccagcgau

SEQ ID NO: 3940514 - RNA, 18 nt, Shigella flexneri 2a str. 301
caaucuuuacacacaagc

SEQ ID NO: 3940515 - RNA, 20 nt, Shigella flexneri 2a str. 301
caaugaaacgcaaauacuga

SEQ ID NO: 3940516 - RNA, 21 nt, Shigella flexneri 2a str. 301
caaugaaagccccaccagcaa

SEQ ID NO: 3940517 - RNA, 18 nt, Shigella flexneri 2a str. 301
caaugaaaggcuucccaa

SEQ ID NO: 3940518 - RNA, 19 nt, Shigella flexneri 2a str. 301
caaugaagaaccgcaccag

SEQ ID NO: 3940519 - RNA, 17 nt, Shigella flexneri 2a str. 301
caaugaccacuccggca

SEQ ID NO: 3940520 - RNA, 17 nt, Shigella flexneri 2a str. 301
caaugacgggcuuaacu

SEQ ID NO: 3940521 - RNA, 17 nt, Shigella flexneri 2a str. 301
caaugacguuaauaaaa

SEQ ID NO: 3940522 - RNA, 20 nt, Shigella flexneri 2a str. 301
caaugacuagcgccauaaua

SEQ ID NO: 3940523 - RNA, 18 nt, Shigella flexneri 2a str. 301
caaugacucgcgguuuau

SEQ ID NO: 3940524 - RNA, 21 nt, Shigella flexneri 2a str. 301
caaugagagggcgauaaaucu

SEQ ID NO: 3940525 - RNA, 20 nt, Shigella flexneri 2a str. 301
caaugaguggugaaaaaaag

SEQ ID NO: 3940526 - RNA, 17 nt, Shigella flexneri 2a str. 301
caaugaguucgcgcgcu

SEQ ID NO: 3940527 - RNA, 13 nt, Shigella flexneri 2a str. 301
caaugauaagccu

SEQ ID NO: 3940528 - RNA, 14 nt, Shigella flexneri 2a str. 301
caaugauucaggca

SEQ ID NO: 3940529 - RNA, 15 nt, Shigella flexneri 2a str. 301
caaugauuucugcca

SEQ ID NO: 3940530 - RNA, 17 nt, Shigella flexneri 2a str. 301
caaugcaggcaccugcc

SEQ ID NO: 3940531 - RNA, 22 nt, Shigella flexneri 2a str. 301
caaugcaggcaucggugaugcu

SEQ ID NO: 3940532 - RNA, 13 nt, Shigella flexneri 2a str. 301
caaugcaguucca

SEQ ID NO: 3940533 - RNA, 19 nt, Shigella flexneri 2a str. 301
caaugcaucgcgaccaauc

SEQ ID NO: 3940534 - RNA, 18 nt, Shigella flexneri 2a str. 301
caaugcauuaucagagau

SEQ ID NO: 3940535 - RNA, 14 nt, Shigella flexneri 2a str. 301
caaugccacgccac

SEQ ID NO: 3940536 - RNA, 15 nt, Shigella flexneri 2a str. 301
caaugccacgccaca

SEQ ID NO: 3940537 - RNA, 15 nt, Shigella flexneri 2a str. 301
caaugccauccagcu

SEQ ID NO: 3940538 - RNA, 16 nt, Shigella flexneri 2a str. 301
caaugcccaucacuau

SEQ ID NO: 3940539 - RNA, 16 nt, Shigella flexneri 2a str. 301
caaugcccgguguucc

SEQ ID NO: 3940540 - RNA, 18 nt, Shigella flexneri 2a str. 301
caaugccgcggcgcggcg

SEQ ID NO: 3940541 - RNA, 19 nt, Shigella flexneri 2a str. 301
caaugccgucaccagcauc

SEQ ID NO: 3940542 - RNA, 11 nt, Shigella flexneri 2a str. 301
caaugcgcauc

SEQ ID NO: 3940543 - RNA, 14 nt, Shigella flexneri 2a str. 301
caaugcgcaucaaa

SEQ ID NO: 3940544 - RNA, 19 nt, Shigella flexneri 2a str. 301
caaugcgcaucaaagccag

SEQ ID NO: 3940545 - RNA, 21 nt, Shigella flexneri 2a str. 301
caaugcgggugcaaucaacac

SEQ ID NO: 3940546 - RNA, 22 nt, Shigella flexneri 2a str. 301
caaugcguagcugagcaacaaa

SEQ ID NO: 3940547 - RNA, 18 nt, Shigella flexneri 2a str. 301
caaugcucucuucgccaa

SEQ ID NO: 3940548 - RNA, 16 nt, Shigella flexneri 2a str. 301
caaugcugcgaucagu

SEQ ID NO: 3940549 - RNA, 12 nt, Shigella flexneri 2a str. 301
caauggcacugu

SEQ ID NO: 3940550 - RNA, 20 nt, Shigella flexneri 2a str. 301
caauggcaggcucagacuga

SEQ ID NO: 3940551 - RNA, 14 nt, Shigella flexneri 2a str. 301
caauggcauccgcc

SEQ ID NO: 3940552 - RNA, 18 nt, Shigella flexneri 2a str. 301
caauggccguuccggcaa

SEQ ID NO: 3940553 - RNA, 18 nt, Shigella flexneri 2a str. 301
caauggcgacuucugcuu

SEQ ID NO: 3940554 - RNA, 16 nt, Shigella flexneri 2a str. 301
caauggcggugauccc

SEQ ID NO: 3940555 - RNA, 23 nt, Shigella flexneri 2a str. 301
caauggcuccgggugugacaaca

SEQ ID NO: 3940556 - RNA, 22 nt, Shigella flexneri 2a str. 301
caauggcuggccccgucagcaa

SEQ ID NO: 3940557 - RNA, 23 nt, Shigella flexneri 2a str. 301
caaugggguaacagguuuaaaca

SEQ ID NO: 3940558 - RNA, 17 nt, Shigella flexneri 2a str. 301
caauggguaacggcaga

SEQ ID NO: 3940559 - RNA, 15 nt, Shigella flexneri 2a str. 301
caauggucagccaca

SEQ ID NO: 3940560 - RNA, 16 nt, Shigella flexneri 2a str. 301
caauggucagccacag

SEQ ID NO: 3940561 - RNA, 22 nt, Shigella flexneri 2a str. 301
caauguaaggugcaucggggaa

SEQ ID NO: 3940562 - RNA, 18 nt, Shigella flexneri 2a str. 301
caaugucagggccaucgc

SEQ ID NO: 3940563 - RNA, 23 nt, Shigella flexneri 2a str. 301
caaugucugucauauuaucuauc

SEQ ID NO: 3940564 - RNA, 20 nt, Shigella flexneri 2a str. 301
caaugugaaaacccugcgca

SEQ ID NO: 3940565 - RNA, 14 nt, Shigella flexneri 2a str. 301
caaugugcuaauca

SEQ ID NO: 3940566 - RNA, 19 nt, Shigella flexneri 2a str. 301
caaugugcuaaucagugcc

SEQ ID NO: 3940567 - RNA, 21 nt, Shigella flexneri 2a str. 301
caaugugcuaaucagugccug

SEQ ID NO: 3940568 - RNA, 20 nt, Shigella flexneri 2a str. 301
caaugugcugagaacaagau

SEQ ID NO: 3940569 - RNA, 19 nt, Shigella flexneri 2a str. 301
caauguggguagccaaugc

SEQ ID NO: 3940570 - RNA, 23 nt, Shigella flexneri 2a str. 301
caauguuaccgaucgccagcagg

SEQ ID NO: 3940571 - RNA, 14 nt, Shigella flexneri 2a str. 301
caauguucguccau

SEQ ID NO: 3940572 - RNA, 16 nt, Shigella flexneri 2a str. 301
caauguugcgggggcu

SEQ ID NO: 3940573 - RNA, 20 nt, Shigella flexneri 2a str. 301
caauguuguggccaguaauc

SEQ ID NO: 3940574 - RNA, 20 nt, Shigella flexneri 2a str. 301
caauguuucucuggcgcgcu

SEQ ID NO: 3940575 - RNA, 12 nt, Shigella flexneri 2a str. 301
caauuaaaaaau

SEQ ID NO: 3940576 - RNA, 14 nt, Shigella flexneri 2a str. 301
caauuaaaaaauua

SEQ ID NO: 3940577 - RNA, 16 nt, Shigella flexneri 2a str. 301
caauuaacgaaaucuc

SEQ ID NO: 3940578 - RNA, 22 nt, Shigella flexneri 2a str. 301
caauuaacgguaauaauucucc

SEQ ID NO: 3940579 - RNA, 21 nt, Shigella flexneri 2a str. 301
caauuaaugcaccaacaaaua

SEQ ID NO: 3940580 - RNA, 22 nt, Shigella flexneri 2a str. 301
caauuaaugcaccaacaaauag

SEQ ID NO: 3940581 - RNA, 17 nt, Shigella flexneri 2a str. 301
caauuaauugccagccg

SEQ ID NO: 3940582 - RNA, 21 nt, Shigella flexneri 2a str. 301
caauuaauugccagccgucau

SEQ ID NO: 3940583 - RNA, 16 nt, Shigella flexneri 2a str. 301
caauuacaguuucuga

SEQ ID NO: 3940584 - RNA, 15 nt, Shigella flexneri 2a str. 301
caauuacaugcuggu

SEQ ID NO: 3940585 - RNA, 18 nt, Shigella flexneri 2a str. 301
caauuaccaacucaucgc

SEQ ID NO: 3940586 - RNA, 17 nt, Shigella flexneri 2a str. 301
caauuaccgccaccagg

SEQ ID NO: 3940587 - RNA, 12 nt, Shigella flexneri 2a str. 301
caauuaccuucc

SEQ ID NO: 3940588 - RNA, 22 nt, Shigella flexneri 2a str. 301
caauuaccuuccacaauggcau

SEQ ID NO: 3940589 - RNA, 19 nt, Shigella flexneri 2a str. 301
caauuacgccgagcgccag

SEQ ID NO: 3940590 - RNA, 20 nt, Shigella flexneri 2a str. 301
caauuacgccgagcgccagc

SEQ ID NO: 3940591 - RNA, 20 nt, Shigella flexneri 2a str. 301
caauuacugagagaaaaaaa

SEQ ID NO: 3940592 - RNA, 15 nt, Shigella flexneri 2a str. 301
caauuagcuuuaauc

SEQ ID NO: 3940593 - RNA, 22 nt, Shigella flexneri 2a str. 301
caauuagugggauucaccaauc

SEQ ID NO: 3940594 - RNA, 15 nt, Shigella flexneri 2a str. 301
caauuauaauacgcu

SEQ ID NO: 3940595 - RNA, 23 nt, Shigella flexneri 2a str. 301
caauuauaguaucguuaaauucu

SEQ ID NO: 3940596 - RNA, 21 nt, Shigella flexneri 2a str. 301
caauuaucccugcggaaaaaa

SEQ ID NO: 3940597 - RNA, 23 nt, Shigella flexneri 2a str. 301
caauuaucccugcggaaaaaaga

SEQ ID NO: 3940598 - RNA, 14 nt, Shigella flexneri 2a str. 301
caauuaucuggaau

SEQ ID NO: 3940599 - RNA, 20 nt, Shigella flexneri 2a str. 301
caauuaucuggaauuccuuu

SEQ ID NO: 3940600 - RNA, 19 nt, Shigella flexneri 2a str. 301
caauucacgaauauuuccc

SEQ ID NO: 3940601 - RNA, 13 nt, Shigella flexneri 2a str. 301
caauuccauuucc

SEQ ID NO: 3940602 - RNA, 20 nt, Shigella flexneri 2a str. 301
caauucccggaccgucaucu

SEQ ID NO: 3940603 - RNA, 15 nt, Shigella flexneri 2a str. 301
caauuccuauuuugu

SEQ ID NO: 3940604 - RNA, 17 nt, Shigella flexneri 2a str. 301
cacagacaauaaacggc

SEQ ID NO: 3940605 - RNA, 19 nt, Shigella flexneri 2a str. 301
cacagacauaaagccugcu

SEQ ID NO: 3940606 - RNA, 14 nt, Shigella flexneri 2a str. 301
cacagacuuaauau

SEQ ID NO: 3940607 - RNA, 20 nt, Shigella flexneri 2a str. 301
cacagaggcagcaucucgcg

SEQ ID NO: 3940608 - RNA, 17 nt, Shigella flexneri 2a str. 301
cacagaugcaggauuuc

SEQ ID NO: 3940609 - RNA, 14 nt, Shigella flexneri 2a str. 301
cacagcaguccagc

SEQ ID NO: 3940610 - RNA, 15 nt, Shigella flexneri 2a str. 301
cacagcaguugugug

SEQ ID NO: 3940611 - RNA, 14 nt, Shigella flexneri 2a str. 301
cacagccaacacau

SEQ ID NO: 3940612 - RNA, 15 nt, Shigella flexneri 2a str. 301
cacagcccgccgcca

SEQ ID NO: 3940613 - RNA, 18 nt, Shigella flexneri 2a str. 301
cacagccgagcgccacca

SEQ ID NO: 3940614 - RNA, 15 nt, Shigella flexneri 2a str. 301
cacagccgcaggccu

SEQ ID NO: 3940615 - RNA, 22 nt, Shigella flexneri 2a str. 301
cacagcggaguaaucgccagca

SEQ ID NO: 3940616 - RNA, 22 nt, Shigella flexneri 2a str. 301
cacaggaaaaacuuuuaccugc

SEQ ID NO: 3940617 - RNA, 14 nt, Shigella flexneri 2a str. 301
cacaggcaucguga

SEQ ID NO: 3940618 - RNA, 19 nt, Shigella flexneri 2a str. 301
cacaggccggagccagccg

SEQ ID NO: 3940619 - RNA, 19 nt, Shigella flexneri 2a str. 301
cacaggcggucgaacaggu

SEQ ID NO: 3940620 - RNA, 22 nt, Shigella flexneri 2a str. 301
cacaggcguucuacauaaaacg

SEQ ID NO: 3940621 - RNA, 17 nt, Shigella flexneri 2a str. 301
cacagggugaucaccag

SEQ ID NO: 3940622 - RNA, 20 nt, Shigella flexneri 2a str. 301
cacaggucagcaggagcagc

SEQ ID NO: 3940623 - RNA, 19 nt, Shigella flexneri 2a str. 301
cacagguuuguagaacgua

SEQ ID NO: 3940624 - RNA, 16 nt, Shigella flexneri 2a str. 301
cacagugaaucucuua

SEQ ID NO: 3940625 - RNA, 12 nt, Shigella flexneri 2a str. 301
cacagugacccg

SEQ ID NO: 3940626 - RNA, 18 nt, Shigella flexneri 2a str. 301
cacagugaugaaaacgaa

SEQ ID NO: 3940627 - RNA, 22 nt, Shigella flexneri 2a str. 301
cacagugcugauuuugcaacaa

SEQ ID NO: 3940628 - RNA, 14 nt, Shigella flexneri 2a str. 301
cacaguuauaaaau

SEQ ID NO: 3940629 - RNA, 18 nt, Shigella flexneri 2a str. 301
cacaguuauaaaaugaua

SEQ ID NO: 3940630 - RNA, 14 nt, Shigella flexneri 2a str. 301
cacaguugcucaau

SEQ ID NO: 3940631 - RNA, 21 nt, Shigella flexneri 2a str. 301
cacauaaacagguaaagacca

SEQ ID NO: 3940632 - RNA, 21 nt, Shigella flexneri 2a str. 301
cacauaagagcgggacaacaa

SEQ ID NO: 3940633 - RNA, 15 nt, Shigella flexneri 2a str. 301
cacauaauccagaca

SEQ ID NO: 3940634 - RNA, 16 nt, Shigella flexneri 2a str. 301
cacauacugcaucagc

SEQ ID NO: 3940635 - RNA, 16 nt, Shigella flexneri 2a str. 301
cacauacuuauuauga

SEQ ID NO: 3940636 - RNA, 20 nt, Shigella flexneri 2a str. 301
cacauagcgugacaccagca

SEQ ID NO: 3940637 - RNA, 22 nt, Shigella flexneri 2a str. 301
cacauaguagguccugaccaaa

SEQ ID NO: 3940638 - RNA, 21 nt, Shigella flexneri 2a str. 301
cacauauuauugaaaucacua

SEQ ID NO: 3940639 - RNA, 15 nt, Shigella flexneri 2a str. 301
cacauauugcagcuu

SEQ ID NO: 3940640 - RNA, 23 nt, Shigella flexneri 2a str. 301
cacaucaaugaugaacgccacau

SEQ ID NO: 3940641 - RNA, 22 nt, Shigella flexneri 2a str. 301
cacaucaauggaugcaaucaca

SEQ ID NO: 3940642 - RNA, 14 nt, Shigella flexneri 2a str. 301
cacaucaauuugcc

SEQ ID NO: 3940643 - RNA, 22 nt, Shigella flexneri 2a str. 301
cacaucaauuugcccaccgguu

SEQ ID NO: 3940644 - RNA, 17 nt, Shigella flexneri 2a str. 301
cacaucaccuccagcga

SEQ ID NO: 3940645 - RNA, 20 nt, Shigella flexneri 2a str. 301
cacaucagccagaugcaccg

SEQ ID NO: 3940646 - RNA, 15 nt, Shigella flexneri 2a str. 301
cacaucaucaaagcc

SEQ ID NO: 3940647 - RNA, 16 nt, Shigella flexneri 2a str. 301
cacaucaucaaagcca

SEQ ID NO: 3940648 - RNA, 22 nt, Shigella flexneri 2a str. 301
cacauccacgccuuuuuucacu

SEQ ID NO: 3940649 - RNA, 14 nt, Shigella flexneri 2a str. 301
cacauccaguacgc

SEQ ID NO: 3940650 - RNA, 13 nt, Shigella flexneri 2a str. 301
cacauccaguggc

SEQ ID NO: 3940651 - RNA, 14 nt, Shigella flexneri 2a str. 301
cacauccaguggcg

SEQ ID NO: 3940652 - RNA, 14 nt, Shigella flexneri 2a str. 301
cacaucccagcaga

SEQ ID NO: 3940653 - RNA, 22 nt, Shigella flexneri 2a str. 301
cacauccguggguugccagagg

SEQ ID NO: 3940654 - RNA, 14 nt, Shigella flexneri 2a str. 301
cacaucgacccaga

SEQ ID NO: 3940655 - RNA, 23 nt, Shigella flexneri 2a str. 301
cacaucgccgaccgcaaccggcc

SEQ ID NO: 3940656 - RNA, 13 nt, Shigella flexneri 2a str. 301
cacaucgcugaca

SEQ ID NO: 3940657 - RNA, 20 nt, Shigella flexneri 2a str. 301
cacaucgcugugcugcugac

SEQ ID NO: 3940658 - RNA, 16 nt, Shigella flexneri 2a str. 301
cacaugaguugcugga

SEQ ID NO: 3940659 - RNA, 15 nt, Shigella flexneri 2a str. 301
cacaugaugauggcu

SEQ ID NO: 3940660 - RNA, 23 nt, Shigella flexneri 2a str. 301
cacaugcaacgucaucaccggcu

SEQ ID NO: 3940661 - RNA, 13 nt, Shigella flexneri 2a str. 301
cacaugcagcgcc

SEQ ID NO: 3940662 - RNA, 21 nt, Shigella flexneri 2a str. 301
cacaugccgcgcgguauaucc

SEQ ID NO: 3940663 - RNA, 12 nt, Shigella flexneri 2a str. 301
cacaugcugaca

SEQ ID NO: 3940664 - RNA, 18 nt, Shigella flexneri 2a str. 301
cacauguuuauaacuucc

SEQ ID NO: 3940665 - RNA, 16 nt, Shigella flexneri 2a str. 301
cacauuagauaaaaau

SEQ ID NO: 3940666 - RNA, 17 nt, Shigella flexneri 2a str. 301
cacauuauaggccugau

SEQ ID NO: 3940667 - RNA, 17 nt, Shigella flexneri 2a str. 301
cacauuaucucaacaca

SEQ ID NO: 3940668 - RNA, 16 nt, Shigella flexneri 2a str. 301
cacauuccucugucag

SEQ ID NO: 3940669 - RNA, 20 nt, Shigella flexneri 2a str. 301
cacauugucggcaucguaau

SEQ ID NO: 3940670 - RNA, 17 nt, Shigella flexneri 2a str. 301
cacauuguuaaagccuu

SEQ ID NO: 3940671 - RNA, 11 nt, Shigella flexneri 2a str. 301
cacauuucacu

SEQ ID NO: 3940672 - RNA, 22 nt, Shigella flexneri 2a str. 301
cacauuucagaaaguauauaaa

SEQ ID NO: 3940673 - RNA, 19 nt, Shigella flexneri 2a str. 301
cacauuuuguaggccugau

SEQ ID NO: 3940674 - RNA, 19 nt, Shigella flexneri 2a str. 301
caccaaaaccacagaaccu

SEQ ID NO: 3940675 - RNA, 14 nt, Shigella flexneri 2a str. 301
caccaaacagacca

SEQ ID NO: 3940676 - RNA, 15 nt, Shigella flexneri 2a str. 301
caccaaacagaccau

SEQ ID NO: 3940677 - RNA, 22 nt, Shigella flexneri 2a str. 301
caccaaacgggcaagccagcau

SEQ ID NO: 3940678 - RNA, 16 nt, Shigella flexneri 2a str. 301
caccaaacugaugccc

SEQ ID NO: 3940679 - RNA, 17 nt, Shigella flexneri 2a str. 301
caccaaacuucagcccu

SEQ ID NO: 3940680 - RNA, 13 nt, Shigella flexneri 2a str. 301
caccaacaggugc

SEQ ID NO: 3940681 - RNA, 17 nt, Shigella flexneri 2a str. 301
caccaacaucaugccag

SEQ ID NO: 3940682 - RNA, 17 nt, Shigella flexneri 2a str. 301
caccaacccuuaccccu

SEQ ID NO: 3940683 - RNA, 16 nt, Shigella flexneri 2a str. 301
caccaacgauuuuuuc

SEQ ID NO: 3940684 - RNA, 17 nt, Shigella flexneri 2a str. 301
caccaacuccacuucac

SEQ ID NO: 3940685 - RNA, 15 nt, Shigella flexneri 2a str. 301
caccaauaaugaacg

SEQ ID NO: 3940686 - RNA, 22 nt, Shigella flexneri 2a str. 301
caccaauacgcauaugcaucag

SEQ ID NO: 3940687 - RNA, 18 nt, Shigella flexneri 2a str. 301
caccaauagccgcgccga

SEQ ID NO: 3940688 - RNA, 13 nt, Shigella flexneri 2a str. 301
caccaauauugac

SEQ ID NO: 3940689 - RNA, 12 nt, Shigella flexneri 2a str. 301
caccaaucggca

SEQ ID NO: 3940690 - RNA, 23 nt, Shigella flexneri 2a str. 301
caccaaugaaagccccaccagca

SEQ ID NO: 3940691 - RNA, 11 nt, Shigella flexneri 2a str. 301
caccaaugacg

SEQ ID NO: 3940692 - RNA, 19 nt, Shigella flexneri 2a str. 301
caccaauggcuggccugga

SEQ ID NO: 3940693 - RNA, 18 nt, Shigella flexneri 2a str. 301
caccaauguaggccugau

SEQ ID NO: 3940694 - RNA, 23 nt, Shigella flexneri 2a str. 301
caccaauguaggccugauaagac

SEQ ID NO: 3940695 - RNA, 14 nt, Shigella flexneri 2a str. 301
caccacacaaccga

SEQ ID NO: 3940696 - RNA, 19 nt, Shigella flexneri 2a str. 301
caccacaccggaccagacg

SEQ ID NO: 3940697 - RNA, 17 nt, Shigella flexneri 2a str. 301
caccacacgaauuccaa

SEQ ID NO: 3940698 - RNA, 21 nt, Shigella flexneri 2a str. 301
caccacagacaaacagcucga

SEQ ID NO: 3940699 - RNA, 19 nt, Shigella flexneri 2a str. 301
caccacagacaaucgccag

SEQ ID NO: 3940700 - RNA, 12 nt, Shigella flexneri 2a str. 301
caccacaugccg

SEQ ID NO: 3940701 - RNA, 11 nt, Shigella flexneri 2a str. 301
caccacauucu

SEQ ID NO: 3940702 - RNA, 17 nt, Shigella flexneri 2a str. 301
caccaccaaaaacgcca

SEQ ID NO: 3940703 - RNA, 15 nt, Shigella flexneri 2a str. 301
caccaccaaagguua

SEQ ID NO: 3940704 - RNA, 16 nt, Shigella flexneri 2a str. 301
cacccaccagcgccga

SEQ ID NO: 3940705 - RNA, 14 nt, Shigella flexneri 2a str. 301
cacccaccauaagc

SEQ ID NO: 3940706 - RNA, 15 nt, Shigella flexneri 2a str. 301
cacccaccauaagcc

SEQ ID NO: 3940707 - RNA, 19 nt, Shigella flexneri 2a str. 301
cacccacguuaguguggcc

SEQ ID NO: 3940708 - RNA, 16 nt, Shigella flexneri 2a str. 301
cacccacuaaucgucc

SEQ ID NO: 3940709 - RNA, 20 nt, Shigella flexneri 2a str. 301
cacccagcagcgccgcgccu

SEQ ID NO: 3940710 - RNA, 14 nt, Shigella flexneri 2a str. 301
cacccagcaucugc

SEQ ID NO: 3940711 - RNA, 15 nt, Shigella flexneri 2a str. 301
cacccagcgaagcaa

SEQ ID NO: 3940712 - RNA, 23 nt, Shigella flexneri 2a str. 301
cacccagcgaagcaaaccaggcc

SEQ ID NO: 3940713 - RNA, 21 nt, Shigella flexneri 2a str. 301
cacccagcgcccccacaacag

SEQ ID NO: 3940714 - RNA, 22 nt, Shigella flexneri 2a str. 301
cacccagcgcccccacaacagu

SEQ ID NO: 3940715 - RNA, 21 nt, Shigella flexneri 2a str. 301
cacccaguacgggcagcgcau

SEQ ID NO: 3940716 - RNA, 21 nt, Shigella flexneri 2a str. 301
cacccauguugaucgccacgu

SEQ ID NO: 3940717 - RNA, 20 nt, Shigella flexneri 2a str. 301
cacccauguuuaauucacgc

SEQ ID NO: 3940718 - RNA, 16 nt, Shigella flexneri 2a str. 301
cacccauugccgccuc

SEQ ID NO: 3940719 - RNA, 22 nt, Shigella flexneri 2a str. 301
cacccauuuauccagcggcagc

SEQ ID NO: 3940720 - RNA, 16 nt, Shigella flexneri 2a str. 301
caccccaccuuaccug

SEQ ID NO: 3940721 - RNA, 16 nt, Shigella flexneri 2a str. 301
caccccagacuucccc

SEQ ID NO: 3940722 - RNA, 11 nt, Shigella flexneri 2a str. 301
caccccagcag

SEQ ID NO: 3940723 - RNA, 13 nt, Shigella flexneri 2a str. 301
cacccccaccccg

SEQ ID NO: 3940724 - RNA, 16 nt, Shigella flexneri 2a str. 301
cacccccaccccggcc

SEQ ID NO: 3940725 - RNA, 19 nt, Shigella flexneri 2a str. 301
caccccgaaaugcccgcuu

SEQ ID NO: 3940726 - RNA, 21 nt, Shigella flexneri 2a str. 301
caccccuuuacugacuguccc

SEQ ID NO: 3940727 - RNA, 16 nt, Shigella flexneri 2a str. 301
cacccgcagcaagcgu

SEQ ID NO: 3940728 - RNA, 22 nt, Shigella flexneri 2a str. 301
cacccgcagcaagcguuugagc

SEQ ID NO: 3940729 - RNA, 15 nt, Shigella flexneri 2a str. 301
cacccgcagccauca

SEQ ID NO: 3940730 - RNA, 22 nt, Shigella flexneri 2a str. 301
cacccgccgcuauuauaucgcu

SEQ ID NO: 3940731 - RNA, 22 nt, Shigella flexneri 2a str. 301
cacccgccguuagccagcgcac

SEQ ID NO: 3940732 - RNA, 19 nt, Shigella flexneri 2a str. 301
cacccggaggaaagcaccu

SEQ ID NO: 3940733 - RNA, 22 nt, Shigella flexneri 2a str. 301
cacccguacagggugagggcaa

SEQ ID NO: 3940734 - RNA, 15 nt, Shigella flexneri 2a str. 301
cacccgucguugcaa

SEQ ID NO: 3940735 - RNA, 19 nt, Shigella flexneri 2a str. 301
cacccguuuucuccaugcg

SEQ ID NO: 3940736 - RNA, 19 nt, Shigella flexneri 2a str. 301
cacccuaacccucucccca

SEQ ID NO: 3940737 - RNA, 20 nt, Shigella flexneri 2a str. 301
cacccuaacccucuccccga

SEQ ID NO: 3940738 - RNA, 20 nt, Shigella flexneri 2a str. 301
cacccucaaaauuucuccuu

SEQ ID NO: 3940739 - RNA, 23 nt, Shigella flexneri 2a str. 301
cacccugcccguuucucuuaaau

SEQ ID NO: 3940740 - RNA, 15 nt, Shigella flexneri 2a str. 301
cacccuugaugcaga

SEQ ID NO: 3940741 - RNA, 13 nt, Shigella flexneri 2a str. 301
caccgaaaucgcc

SEQ ID NO: 3940742 - RNA, 21 nt, Shigella flexneri 2a str. 301
caccgaacagcucaacgcgug

SEQ ID NO: 3940743 - RNA, 18 nt, Shigella flexneri 2a str. 301
caccgaagacgugcgcca

SEQ ID NO: 3940744 - RNA, 18 nt, Shigella flexneri 2a str. 301
caccgacaaauuucaucg

SEQ ID NO: 3940745 - RNA, 16 nt, Shigella flexneri 2a str. 301
caccgacauugccagc

SEQ ID NO: 3940746 - RNA, 18 nt, Shigella flexneri 2a str. 301
caccgaccaucccaccac

SEQ ID NO: 3940747 - RNA, 13 nt, Shigella flexneri 2a str. 301
caccgacccggua

SEQ ID NO: 3940748 - RNA, 14 nt, Shigella flexneri 2a str. 301
caccgacgcaguca

SEQ ID NO: 3940749 - RNA, 21 nt, Shigella flexneri 2a str. 301
caccgacgucgauauaauuga

SEQ ID NO: 3940750 - RNA, 18 nt, Shigella flexneri 2a str. 301
caccgacguuugcgccca

SEQ ID NO: 3940751 - RNA, 19 nt, Shigella flexneri 2a str. 301
caccgacuggcuccgggaa

SEQ ID NO: 3940752 - RNA, 16 nt, Shigella flexneri 2a str. 301
caccgagcagcacaau

SEQ ID NO: 3940753 - RNA, 20 nt, Shigella flexneri 2a str. 301
caccgaggcauucagccagu

SEQ ID NO: 3940754 - RNA, 17 nt, Shigella flexneri 2a str. 301
caccgaggccaaaacca

SEQ ID NO: 3940755 - RNA, 16 nt, Shigella flexneri 2a str. 301
caccgauauugccacc

SEQ ID NO: 3940756 - RNA, 18 nt, Shigella flexneri 2a str. 301
caccgaucguaacgcguu

SEQ ID NO: 3940757 - RNA, 17 nt, Shigella flexneri 2a str. 301
caccgaugaucaacagc

SEQ ID NO: 3940758 - RNA, 19 nt, Shigella flexneri 2a str. 301
caccgaugaucaacagcau

SEQ ID NO: 3940759 - RNA, 21 nt, Shigella flexneri 2a str. 301
caccgaugaucaacagcauca

SEQ ID NO: 3940760 - RNA, 15 nt, Shigella flexneri 2a str. 301
caccgaugcacagca

SEQ ID NO: 3940761 - RNA, 23 nt, Shigella flexneri 2a str. 301
caccgauucccgggcacacuuag

SEQ ID NO: 3940762 - RNA, 15 nt, Shigella flexneri 2a str. 301
caccgauugcaggaa

SEQ ID NO: 3940763 - RNA, 18 nt, Shigella flexneri 2a str. 301
caccgauuuuguaaaaga

SEQ ID NO: 3940764 - RNA, 19 nt, Shigella flexneri 2a str. 301
caccgauuuuguaaaagaa

SEQ ID NO: 3940765 - RNA, 24 nt, Shigella flexneri 2a str. 301
caccgcaagccaaauacauugaua

SEQ ID NO: 3940766 - RNA, 17 nt, Shigella flexneri 2a str. 301
caccgcaauaaccauca

SEQ ID NO: 3940767 - RNA, 15 nt, Shigella flexneri 2a str. 301
caccgcaaucgccag

SEQ ID NO: 3940768 - RNA, 21 nt, Shigella flexneri 2a str. 301
caccgcaccuguaauacggcu

SEQ ID NO: 3940769 - RNA, 15 nt, Shigella flexneri 2a str. 301
caccgcagccgccac

SEQ ID NO: 3940770 - RNA, 19 nt, Shigella flexneri 2a str. 301
caccgcagccgccacaaua

SEQ ID NO: 3940771 - RNA, 18 nt, Shigella flexneri 2a str. 301
caccgcaguaaucggcga

SEQ ID NO: 3940772 - RNA, 18 nt, Shigella flexneri 2a str. 301
caccgcaucaauauuaag

SEQ ID NO: 3940773 - RNA, 14 nt, Shigella flexneri 2a str. 301
caccgccaaagaua

SEQ ID NO: 3940774 - RNA, 17 nt, Shigella flexneri 2a str. 301
caccgccaaagauaaaa

SEQ ID NO: 3940775 - RNA, 23 nt, Shigella flexneri 2a str. 301
caccgccaaagauaaaauaacca

SEQ ID NO: 3940776 - RNA, 14 nt, Shigella flexneri 2a str. 301
caccgccaccaccg

SEQ ID NO: 3940777 - RNA, 16 nt, Shigella flexneri 2a str. 301
caccgcccagugcagu

SEQ ID NO: 3940778 - RNA, 12 nt, Shigella flexneri 2a str. 301
caccgccgagac

SEQ ID NO: 3940779 - RNA, 15 nt, Shigella flexneri 2a str. 301
caccgccggauagcu

SEQ ID NO: 3940780 - RNA, 22 nt, Shigella flexneri 2a str. 301
caccgccguuaccuucggcccc

SEQ ID NO: 3940781 - RNA, 15 nt, Shigella flexneri 2a str. 301
caccgccugcgaugg

SEQ ID NO: 3940782 - RNA, 19 nt, Shigella flexneri 2a str. 301
caccgcgaauuuuuucgca

SEQ ID NO: 3940783 - RNA, 20 nt, Shigella flexneri 2a str. 301
caccgcgaucuuccacgccu

SEQ ID NO: 3940784 - RNA, 22 nt, Shigella flexneri 2a str. 301
caccgcgaucuuccacgccugc

SEQ ID NO: 3940785 - RNA, 16 nt, Shigella flexneri 2a str. 301
caccgcgccgggcaga

SEQ ID NO: 3940786 - RNA, 15 nt, Shigella flexneri 2a str. 301
caccgcguaugccca

SEQ ID NO: 3940787 - RNA, 23 nt, Shigella flexneri 2a str. 301
caccgcguuccacggggacucca

SEQ ID NO: 3940788 - RNA, 14 nt, Shigella flexneri 2a str. 301
caccgcguuuucca

SEQ ID NO: 3940789 - RNA, 20 nt, Shigella flexneri 2a str. 301
caccgcucuucauacgcggc

SEQ ID NO: 3940790 - RNA, 13 nt, Shigella flexneri 2a str. 301
caccgcuggcaga

SEQ ID NO: 3940791 - RNA, 21 nt, Shigella flexneri 2a str. 301
caccgcuggcugcgaacgcaa

SEQ ID NO: 3940792 - RNA, 20 nt, Shigella flexneri 2a str. 301
caccggaaccgucgcgccag

SEQ ID NO: 3940793 - RNA, 22 nt, Shigella flexneri 2a str. 301
caccggaauaaugaugucucug

SEQ ID NO: 3940794 - RNA, 13 nt, Shigella flexneri 2a str. 301
caccggaccagac

SEQ ID NO: 3940795 - RNA, 13 nt, Shigella flexneri 2a str. 301
caccggacgcaca

SEQ ID NO: 3940796 - RNA, 18 nt, Shigella flexneri 2a str. 301
caccggacggacuuccag

SEQ ID NO: 3940797 - RNA, 19 nt, Shigella flexneri 2a str. 301
caccggauguagcaacgga

SEQ ID NO: 3940798 - RNA, 16 nt, Shigella flexneri 2a str. 301
caccggcaaucugcug

SEQ ID NO: 3940799 - RNA, 14 nt, Shigella flexneri 2a str. 301
caccggcaccacuu

SEQ ID NO: 3940800 - RNA, 16 nt, Shigella flexneri 2a str. 301
caccggcgacauccca

SEQ ID NO: 3940801 - RNA, 20 nt, Shigella flexneri 2a str. 301
caccggggacaggcgggcca

SEQ ID NO: 3940802 - RNA, 16 nt, Shigella flexneri 2a str. 301
caccggguaccagaau

SEQ ID NO: 3940803 - RNA, 21 nt, Shigella flexneri 2a str. 301
cacgcagggggucgcggguuc

SEQ ID NO: 3940804 - RNA, 21 nt, Shigella flexneri 2a str. 301
cacgcagggugugcuccaguc

SEQ ID NO: 3940805 - RNA, 16 nt, Shigella flexneri 2a str. 301
cacgcagucucucucc

SEQ ID NO: 3940806 - RNA, 22 nt, Shigella flexneri 2a str. 301
cacgcauaucguagccccaguc

SEQ ID NO: 3940807 - RNA, 23 nt, Shigella flexneri 2a str. 301
cacgcaucacuuucggugacaga

SEQ ID NO: 3940808 - RNA, 13 nt, Shigella flexneri 2a str. 301
cacgcaucgcgaa

SEQ ID NO: 3940809 - RNA, 14 nt, Shigella flexneri 2a str. 301
cacgcauuaauaag

SEQ ID NO: 3940810 - RNA, 16 nt, Shigella flexneri 2a str. 301
cacgcauucagcaaau

SEQ ID NO: 3940811 - RNA, 14 nt, Shigella flexneri 2a str. 301
cacgccaacaaaca

SEQ ID NO: 3940812 - RNA, 19 nt, Shigella flexneri 2a str. 301
cacgccaacaaacaguaca

SEQ ID NO: 3940813 - RNA, 13 nt, Shigella flexneri 2a str. 301
cacgccaauaccg

SEQ ID NO: 3940814 - RNA, 22 nt, Shigella flexneri 2a str. 301
cacgccagacaucaccaguacc

SEQ ID NO: 3940815 - RNA, 14 nt, Shigella flexneri 2a str. 301
cacgccagccugcu

SEQ ID NO: 3940816 - RNA, 17 nt, Shigella flexneri 2a str. 301
cacgccaggccacgcuu

SEQ ID NO: 3940817 - RNA, 22 nt, Shigella flexneri 2a str. 301
cacgccauauguguuugugcug

SEQ ID NO: 3940818 - RNA, 12 nt, Shigella flexneri 2a str. 301
cacgccaucauc

SEQ ID NO: 3940819 - RNA, 15 nt, Shigella flexneri 2a str. 301
cacgccaucuggcug

SEQ ID NO: 3940820 - RNA, 23 nt, Shigella flexneri 2a str. 301
cacgccaucuggcugacggugau

SEQ ID NO: 3940821 - RNA, 17 nt, Shigella flexneri 2a str. 301
cacgcccagcucaaacg

SEQ ID NO: 3940822 - RNA, 13 nt, Shigella flexneri 2a str. 301
cacgcccauugag

SEQ ID NO: 3940823 - RNA, 20 nt, Shigella flexneri 2a str. 301
cacgcccugauaaaucaccu

SEQ ID NO: 3940824 - RNA, 18 nt, Shigella flexneri 2a str. 301
cacgccgaaugccgggua

SEQ ID NO: 3940825 - RNA, 22 nt, Shigella flexneri 2a str. 301
cacgccgauaaucaacaaacca

SEQ ID NO: 3940826 - RNA, 12 nt, Shigella flexneri 2a str. 301
cacgccgcaucc

SEQ ID NO: 3940827 - RNA, 22 nt, Shigella flexneri 2a str. 301
cacgccgcauccggcaugaaca

SEQ ID NO: 3940828 - RNA, 16 nt, Shigella flexneri 2a str. 301
cacgccgcaucuggca

SEQ ID NO: 3940829 - RNA, 14 nt, Shigella flexneri 2a str. 301
cacgccgccagacc

SEQ ID NO: 3940830 - RNA, 17 nt, Shigella flexneri 2a str. 301
cacgccgguucccagac

SEQ ID NO: 3940831 - RNA, 23 nt, Shigella flexneri 2a str. 301
cacgccguuuuuacccagcagca

SEQ ID NO: 3940832 - RNA, 16 nt, Shigella flexneri 2a str. 301
cacgccugcauccgcc

SEQ ID NO: 3940833 - RNA, 12 nt, Shigella flexneri 2a str. 301
cacgccugccgc

SEQ ID NO: 3940834 - RNA, 16 nt, Shigella flexneri 2a str. 301
cacgccugccgccagc

SEQ ID NO: 3940835 - RNA, 15 nt, Shigella flexneri 2a str. 301
cacgccuucuccggc

SEQ ID NO: 3940836 - RNA, 16 nt, Shigella flexneri 2a str. 301
cacgccuucuuccagc

SEQ ID NO: 3940837 - RNA, 22 nt, Shigella flexneri 2a str. 301
cacgcgaacaacagaucaacau

SEQ ID NO: 3940838 - RNA, 23 nt, Shigella flexneri 2a str. 301
cacgcgaacaacagaucaacaua

SEQ ID NO: 3940839 - RNA, 14 nt, Shigella flexneri 2a str. 301
cacgcgcauauuga

SEQ ID NO: 3940840 - RNA, 13 nt, Shigella flexneri 2a str. 301
cacgcgcuccagg

SEQ ID NO: 3940841 - RNA, 15 nt, Shigella flexneri 2a str. 301
cacgcgcuccaggag

SEQ ID NO: 3940842 - RNA, 12 nt, Shigella flexneri 2a str. 301
cacgcgcugccu

SEQ ID NO: 3940843 - RNA, 13 nt, Shigella flexneri 2a str. 301
cacgcgcuucaca

SEQ ID NO: 3940844 - RNA, 21 nt, Shigella flexneri 2a str. 301
cacgcgcuucagucgccagcg

SEQ ID NO: 3940845 - RNA, 21 nt, Shigella flexneri 2a str. 301
cacgcggagcgccugucugca

SEQ ID NO: 3940846 - RNA, 22 nt, Shigella flexneri 2a str. 301
cacgcgggagagccccugccgc

SEQ ID NO: 3940847 - RNA, 17 nt, Shigella flexneri 2a str. 301
cacgcgguuacgcaccg

SEQ ID NO: 3940848 - RNA, 14 nt, Shigella flexneri 2a str. 301
cacgcuaauaccaa

SEQ ID NO: 3940849 - RNA, 14 nt, Shigella flexneri 2a str. 301
cacgcucagcaauu

SEQ ID NO: 3940850 - RNA, 15 nt, Shigella flexneri 2a str. 301
cacgcucagcaauug

SEQ ID NO: 3940851 - RNA, 15 nt, Shigella flexneri 2a str. 301
cacgcugcaucgcca

SEQ ID NO: 3940852 - RNA, 17 nt, Shigella flexneri 2a str. 301
cacgcugcgguuuacgc

SEQ ID NO: 3940853 - RNA, 17 nt, Shigella flexneri 2a str. 301
cacgcugucggcacuga

SEQ ID NO: 3940854 - RNA, 20 nt, Shigella flexneri 2a str. 301
cacgcugucggcacugacca

SEQ ID NO: 3940855 - RNA, 21 nt, Shigella flexneri 2a str. 301
cacgcugucuggcgucuccug

SEQ ID NO: 3940856 - RNA, 15 nt, Shigella flexneri 2a str. 301
cacgcuuaacaaccc

SEQ ID NO: 3940857 - RNA, 18 nt, Shigella flexneri 2a str. 301
cacgcuuaaccccgggcu

SEQ ID NO: 3940858 - RNA, 22 nt, Shigella flexneri 2a str. 301
cacgcuuaaccccgggcuggau

SEQ ID NO: 3940859 - RNA, 21 nt, Shigella flexneri 2a str. 301
cacgcuuuacaauauccagcg

SEQ ID NO: 3940860 - RNA, 18 nt, Shigella flexneri 2a str. 301
cacgcuuuucaucagauc

SEQ ID NO: 3940861 - RNA, 15 nt, Shigella flexneri 2a str. 301
cacggaaucaccgcc

SEQ ID NO: 3940862 - RNA, 11 nt, Shigella flexneri 2a str. 301
cacggacaggu

SEQ ID NO: 3940863 - RNA, 21 nt, Shigella flexneri 2a str. 301
cacggauauauccguggcuuu

SEQ ID NO: 3940864 - RNA, 20 nt, Shigella flexneri 2a str. 301
cacggaucaggcggcucacc

SEQ ID NO: 3940865 - RNA, 13 nt, Shigella flexneri 2a str. 301
cacggcaacacgc

SEQ ID NO: 3940866 - RNA, 15 nt, Shigella flexneri 2a str. 301
cacggcaaucaugau

SEQ ID NO: 3940867 - RNA, 18 nt, Shigella flexneri 2a str. 301
cacggcagcaacuuaauc

SEQ ID NO: 3940868 - RNA, 15 nt, Shigella flexneri 2a str. 301
cacggcauaagccgu

SEQ ID NO: 3940869 - RNA, 15 nt, Shigella flexneri 2a str. 301
cacggccacagccag

SEQ ID NO: 3940870 - RNA, 16 nt, Shigella flexneri 2a str. 301
cacggccacagccagc

SEQ ID NO: 3940871 - RNA, 15 nt, Shigella flexneri 2a str. 301
cacggccacucugcc

SEQ ID NO: 3940872 - RNA, 16 nt, Shigella flexneri 2a str. 301
cacggccacucugccu

SEQ ID NO: 3940873 - RNA, 17 nt, Shigella flexneri 2a str. 301
cacggcgcagcuucaca

SEQ ID NO: 3940874 - RNA, 16 nt, Shigella flexneri 2a str. 301
cacggcgcaugccuca

SEQ ID NO: 3940875 - RNA, 15 nt, Shigella flexneri 2a str. 301
cacggcguggcauca

SEQ ID NO: 3940876 - RNA, 15 nt, Shigella flexneri 2a str. 301
cacggcuccagcaau

SEQ ID NO: 3940877 - RNA, 21 nt, Shigella flexneri 2a str. 301
cacgggcaauaucgacgccag

SEQ ID NO: 3940878 - RNA, 20 nt, Shigella flexneri 2a str. 301
cacgggcgcggaaagcaccu

SEQ ID NO: 3940879 - RNA, 17 nt, Shigella flexneri 2a str. 301
cacgggcgcuuguuauc

SEQ ID NO: 3940880 - RNA, 22 nt, Shigella flexneri 2a str. 301
cacgggcuuaucaguucgcggc

SEQ ID NO: 3940881 - RNA, 20 nt, Shigella flexneri 2a str. 301
cacggguucgugacgucuca

SEQ ID NO: 3940882 - RNA, 14 nt, Shigella flexneri 2a str. 301
cacgguacuggcag

SEQ ID NO: 3940883 - RNA, 14 nt, Shigella flexneri 2a str. 301
cacgguauuugcca

SEQ ID NO: 3940884 - RNA, 17 nt, Shigella flexneri 2a str. 301
cacggugcgacacugcg

SEQ ID NO: 3940885 - RNA, 18 nt, Shigella flexneri 2a str. 301
cacgguuaguucaaugcg

SEQ ID NO: 3940886 - RNA, 19 nt, Shigella flexneri 2a str. 301
cacgguuuaucggcgacca

SEQ ID NO: 3940887 - RNA, 16 nt, Shigella flexneri 2a str. 301
cacgguuuuuccagcu

SEQ ID NO: 3940888 - RNA, 13 nt, Shigella flexneri 2a str. 301
cacguaccacggc

SEQ ID NO: 3940889 - RNA, 14 nt, Shigella flexneri 2a str. 301
cacguaccacggca

SEQ ID NO: 3940890 - RNA, 13 nt, Shigella flexneri 2a str. 301
cacguaccagaug

SEQ ID NO: 3940891 - RNA, 15 nt, Shigella flexneri 2a str. 301
cacguaggccggaua

SEQ ID NO: 3940892 - RNA, 14 nt, Shigella flexneri 2a str. 301
cacguaggccugau

SEQ ID NO: 3940893 - RNA, 18 nt, Shigella flexneri 2a str. 301
cacguccgguggcauccg

SEQ ID NO: 3940894 - RNA, 14 nt, Shigella flexneri 2a str. 301
cacgucguucgggc

SEQ ID NO: 3940895 - RNA, 22 nt, Shigella flexneri 2a str. 301
cacgucuuccauugccgcuuuc

SEQ ID NO: 3940896 - RNA, 15 nt, Shigella flexneri 2a str. 301
cacgugccagauguu

SEQ ID NO: 3940897 - RNA, 21 nt, Shigella flexneri 2a str. 301
cacguggugugggcggugaug

SEQ ID NO: 3940898 - RNA, 18 nt, Shigella flexneri 2a str. 301
cacguuagaaacaaaaaa

SEQ ID NO: 3940899 - RNA, 13 nt, Shigella flexneri 2a str. 301
cacguucacccau

SEQ ID NO: 3940900 - RNA, 19 nt, Shigella flexneri 2a str. 301
cacguuccagaaugcuacg

SEQ ID NO: 3940901 - RNA, 17 nt, Shigella flexneri 2a str. 301
cacguuccccagaugcg

SEQ ID NO: 3940902 - RNA, 23 nt, Shigella flexneri 2a str. 301
cacguuccguauaccgucaggau

SEQ ID NO: 3940903 - RNA, 21 nt, Shigella flexneri 2a str. 301
cacuucaccgcgaauauaagc

SEQ ID NO: 3940904 - RNA, 22 nt, Shigella flexneri 2a str. 301
cacuucauagccgccgcgcaug

SEQ ID NO: 3940905 - RNA, 18 nt, Shigella flexneri 2a str. 301
cacuucaucgccguugcg

SEQ ID NO: 3940906 - RNA, 19 nt, Shigella flexneri 2a str. 301
cacuucauuaaccacgauc

SEQ ID NO: 3940907 - RNA, 20 nt, Shigella flexneri 2a str. 301
cacuuccaccagcaacggca

SEQ ID NO: 3940908 - RNA, 15 nt, Shigella flexneri 2a str. 301
cacuuccaccagcgg

SEQ ID NO: 3940909 - RNA, 22 nt, Shigella flexneri 2a str. 301
cacuuccaccagcggcugaaua

SEQ ID NO: 3940910 - RNA, 23 nt, Shigella flexneri 2a str. 301
cacuuccagcuccguuaaccgug

SEQ ID NO: 3940911 - RNA, 22 nt, Shigella flexneri 2a str. 301
cacuuccggugccgguuucacg

SEQ ID NO: 3940912 - RNA, 15 nt, Shigella flexneri 2a str. 301
cacuuccucaagcgu

SEQ ID NO: 3940913 - RNA, 11 nt, Shigella flexneri 2a str. 301
cacuuccugcc

SEQ ID NO: 3940914 - RNA, 22 nt, Shigella flexneri 2a str. 301
cacuuccugcucggucugcugg

SEQ ID NO: 3940915 - RNA, 21 nt, Shigella flexneri 2a str. 301
cacuucgcgcaaccaguccuc

SEQ ID NO: 3940916 - RNA, 18 nt, Shigella flexneri 2a str. 301
cacuucgcuuacgccugc

SEQ ID NO: 3940917 - RNA, 16 nt, Shigella flexneri 2a str. 301
cacuucgucagaaaug

SEQ ID NO: 3940918 - RNA, 22 nt, Shigella flexneri 2a str. 301
cacuucugaguucggcaugggg

SEQ ID NO: 3940919 - RNA, 23 nt, Shigella flexneri 2a str. 301
cacuucugaguucggcauggggu

SEQ ID NO: 3940920 - RNA, 19 nt, Shigella flexneri 2a str. 301
cacuucuguuacuccagcg

SEQ ID NO: 3940921 - RNA, 12 nt, Shigella flexneri 2a str. 301
cacuucuucagc

SEQ ID NO: 3940922 - RNA, 17 nt, Shigella flexneri 2a str. 301
cacuucuucagccaguu

SEQ ID NO: 3940923 - RNA, 16 nt, Shigella flexneri 2a str. 301
cacuugaccaacuuca

SEQ ID NO: 3940924 - RNA, 14 nt, Shigella flexneri 2a str. 301
cacuugcagcuccu

SEQ ID NO: 3940925 - RNA, 20 nt, Shigella flexneri 2a str. 301
cacuugcaggaacagugccu

SEQ ID NO: 3940926 - RNA, 16 nt, Shigella flexneri 2a str. 301
cacuugcgcauaauaa

SEQ ID NO: 3940927 - RNA, 22 nt, Shigella flexneri 2a str. 301
cacuugcggcacccauuuaucc

SEQ ID NO: 3940928 - RNA, 21 nt, Shigella flexneri 2a str. 301
cacuugucguucaggcgcuga

SEQ ID NO: 3940929 - RNA, 17 nt, Shigella flexneri 2a str. 301
cacuuguucagcgaugu

SEQ ID NO: 3940930 - RNA, 20 nt, Shigella flexneri 2a str. 301
cacuuucaaauccggccagc

SEQ ID NO: 3940931 - RNA, 17 nt, Shigella flexneri 2a str. 301
cacuuucacgcccauaa

SEQ ID NO: 3940932 - RNA, 14 nt, Shigella flexneri 2a str. 301
cacuuucagcacgu

SEQ ID NO: 3940933 - RNA, 12 nt, Shigella flexneri 2a str. 301
cacuuucaguuu

SEQ ID NO: 3940934 - RNA, 15 nt, Shigella flexneri 2a str. 301
cacuuuccaguuccg

SEQ ID NO: 3940935 - RNA, 15 nt, Shigella flexneri 2a str. 301
cacuuugaccgccag

SEQ ID NO: 3940936 - RNA, 17 nt, Shigella flexneri 2a str. 301
cacuuugccagaaaucc

SEQ ID NO: 3940937 - RNA, 18 nt, Shigella flexneri 2a str. 301
cacuuugcccuucacgca

SEQ ID NO: 3940938 - RNA, 13 nt, Shigella flexneri 2a str. 301
cacuuugugucag

SEQ ID NO: 3940939 - RNA, 20 nt, Shigella flexneri 2a str. 301
cacuuuucggcaaccgcauc

SEQ ID NO: 3940940 - RNA, 15 nt, Shigella flexneri 2a str. 301
cacuuuugccagacg

SEQ ID NO: 3940941 - RNA, 18 nt, Shigella flexneri 2a str. 301
cacuuuuuguaauuuuuu

SEQ ID NO: 3940942 - RNA, 18 nt, Shigella flexneri 2a str. 301
cagaaaacgguugauaua

SEQ ID NO: 3940943 - RNA, 16 nt, Shigella flexneri 2a str. 301
cagaaaauuuucauca

SEQ ID NO: 3940944 - RNA, 20 nt, Shigella flexneri 2a str. 301
cagaaaauuuucaucaguaa

SEQ ID NO: 3940945 - RNA, 15 nt, Shigella flexneri 2a str. 301
cagaaacaaacgcaa

SEQ ID NO: 3940946 - RNA, 13 nt, Shigella flexneri 2a str. 301
cagaaacaaccug

SEQ ID NO: 3940947 - RNA, 16 nt, Shigella flexneri 2a str. 301
cagaaacacacuuucc

SEQ ID NO: 3940948 - RNA, 17 nt, Shigella flexneri 2a str. 301
cagaaacacacuuucca

SEQ ID NO: 3940949 - RNA, 13 nt, Shigella flexneri 2a str. 301
cagaaacagccau

SEQ ID NO: 3940950 - RNA, 16 nt, Shigella flexneri 2a str. 301
cagaaacgccaccauu

SEQ ID NO: 3940951 - RNA, 18 nt, Shigella flexneri 2a str. 301
cagaaacgccauccagcc

SEQ ID NO: 3940952 - RNA, 21 nt, Shigella flexneri 2a str. 301
cagaaagcgacuuugccuggc

SEQ ID NO: 3940953 - RNA, 15 nt, Shigella flexneri 2a str. 301
cagaaagcgccagca

SEQ ID NO: 3940954 - RNA, 18 nt, Shigella flexneri 2a str. 301
cagaaagcgccagcaaga

SEQ ID NO: 3940955 - RNA, 23 nt, Shigella flexneri 2a str. 301
cagaaagcggaucaguuccagca

SEQ ID NO: 3940956 - RNA, 13 nt, Shigella flexneri 2a str. 301
cagaaagggaaga

SEQ ID NO: 3940957 - RNA, 21 nt, Shigella flexneri 2a str. 301
cagaaagucaaaagccuccga

SEQ ID NO: 3940958 - RNA, 14 nt, Shigella flexneri 2a str. 301
cagaaagucauggc

SEQ ID NO: 3940959 - RNA, 21 nt, Shigella flexneri 2a str. 301
cagaaaguuuuucaacaccau

SEQ ID NO: 3940960 - RNA, 23 nt, Shigella flexneri 2a str. 301
cagaaaguuuuucaacaccauga

SEQ ID NO: 3940961 - RNA, 17 nt, Shigella flexneri 2a str. 301
cagaaauagaaagugac

SEQ ID NO: 3940962 - RNA, 16 nt, Shigella flexneri 2a str. 301
cagaaaucggccuucc

SEQ ID NO: 3940963 - RNA, 20 nt, Shigella flexneri 2a str. 301
cagaaaugccaguaacucau

SEQ ID NO: 3940964 - RNA, 14 nt, Shigella flexneri 2a str. 301
cagaaauggcccaa

SEQ ID NO: 3940965 - RNA, 16 nt, Shigella flexneri 2a str. 301
cagaaaugguaaagaa

SEQ ID NO: 3940966 - RNA, 18 nt, Shigella flexneri 2a str. 301
cagaaaugguaaagaagg

SEQ ID NO: 3940967 - RNA, 23 nt, Shigella flexneri 2a str. 301
cagaaauuguggcguccaggaca

SEQ ID NO: 3940968 - RNA, 16 nt, Shigella flexneri 2a str. 301
cagaaauuuccugagc

SEQ ID NO: 3940969 - RNA, 18 nt, Shigella flexneri 2a str. 301
cagaacaaacuacauagc

SEQ ID NO: 3940970 - RNA, 20 nt, Shigella flexneri 2a str. 301
cagaacacgcucccagcaga

SEQ ID NO: 3940971 - RNA, 14 nt, Shigella flexneri 2a str. 301
cagaacagcuacag

SEQ ID NO: 3940972 - RNA, 20 nt, Shigella flexneri 2a str. 301
cagaaccacggaauaaccag

SEQ ID NO: 3940973 - RNA, 17 nt, Shigella flexneri 2a str. 301
cagaacgaccaguucac

SEQ ID NO: 3940974 - RNA, 18 nt, Shigella flexneri 2a str. 301
cagaacgccgaauaacgc

SEQ ID NO: 3940975 - RNA, 19 nt, Shigella flexneri 2a str. 301
cagaacggauaucgagaau

SEQ ID NO: 3940976 - RNA, 23 nt, Shigella flexneri 2a str. 301
cagaacuucugguaacagcggac

SEQ ID NO: 3940977 - RNA, 14 nt, Shigella flexneri 2a str. 301
cagaagacgcucca

SEQ ID NO: 3940978 - RNA, 16 nt, Shigella flexneri 2a str. 301
cagaagcacugccaga

SEQ ID NO: 3940979 - RNA, 20 nt, Shigella flexneri 2a str. 301
cagaagcauuuuacauccug

SEQ ID NO: 3940980 - RNA, 22 nt, Shigella flexneri 2a str. 301
cagaagcauuuuacauccugau

SEQ ID NO: 3940981 - RNA, 23 nt, Shigella flexneri 2a str. 301
cagaagcauuuuacauccugaua

SEQ ID NO: 3940982 - RNA, 15 nt, Shigella flexneri 2a str. 301
cagaagcgacaccag

SEQ ID NO: 3940983 - RNA, 23 nt, Shigella flexneri 2a str. 301
cagaaggagcuaauaaugagcag

SEQ ID NO: 3940984 - RNA, 22 nt, Shigella flexneri 2a str. 301
cagaaggccgcaguaaagcgca

SEQ ID NO: 3940985 - RNA, 22 nt, Shigella flexneri 2a str. 301
cagaagguaaauuguuggcgua

SEQ ID NO: 3940986 - RNA, 20 nt, Shigella flexneri 2a str. 301
cagaaggugauggcauaacg

SEQ ID NO: 3940987 - RNA, 19 nt, Shigella flexneri 2a str. 301
cagaaguccggaaagccau

SEQ ID NO: 3940988 - RNA, 14 nt, Shigella flexneri 2a str. 301
cagaagugaccguc

SEQ ID NO: 3940989 - RNA, 16 nt, Shigella flexneri 2a str. 301
cagaaguugcacccag

SEQ ID NO: 3940990 - RNA, 17 nt, Shigella flexneri 2a str. 301
cagaaguugcacccagu

SEQ ID NO: 3940991 - RNA, 14 nt, Shigella flexneri 2a str. 301
cagaaguugcucaa

SEQ ID NO: 3940992 - RNA, 19 nt, Shigella flexneri 2a str. 301
cagaauaaacaacuguggu

SEQ ID NO: 3940993 - RNA, 15 nt, Shigella flexneri 2a str. 301
cagaauaacggcaga

SEQ ID NO: 3940994 - RNA, 22 nt, Shigella flexneri 2a str. 301
cagaauaacggcagaagcugca

SEQ ID NO: 3940995 - RNA, 21 nt, Shigella flexneri 2a str. 301
cagaauaacgugaucgaacau

SEQ ID NO: 3940996 - RNA, 21 nt, Shigella flexneri 2a str. 301
cagaauaccuugcugcuccag

SEQ ID NO: 3940997 - RNA, 23 nt, Shigella flexneri 2a str. 301
cagaauaccuugcugcuccagcg

SEQ ID NO: 3940998 - RNA, 20 nt, Shigella flexneri 2a str. 301
cagaauagaaaguugccaga

SEQ ID NO: 3940999 - RNA, 15 nt, Shigella flexneri 2a str. 301
cagaauagacaaaaa

SEQ ID NO: 3941000 - RNA, 20 nt, Shigella flexneri 2a str. 301
cagaauagccgcagccauca

SEQ ID NO: 3941001 - RNA, 17 nt, Shigella flexneri 2a str. 301
cagaauagcgccgccaa

SEQ ID NO: 3941002 - RNA, 19 nt, Shigella flexneri 2a str. 301
cagacgugauaaacaucca

SEQ ID NO: 3941003 - RNA, 23 nt, Shigella flexneri 2a str. 301
cagacguguugucagcucaucca

SEQ ID NO: 3941004 - RNA, 14 nt, Shigella flexneri 2a str. 301
cagacguucuuccu

SEQ ID NO: 3941005 - RNA, 21 nt, Shigella flexneri 2a str. 301
cagacguugauaaccacggcg

SEQ ID NO: 3941006 - RNA, 15 nt, Shigella flexneri 2a str. 301
cagacguuucgccag

SEQ ID NO: 3941007 - RNA, 16 nt, Shigella flexneri 2a str. 301
cagacguuucgccagc

SEQ ID NO: 3941008 - RNA, 15 nt, Shigella flexneri 2a str. 301
cagacguuuuuucug

SEQ ID NO: 3941009 - RNA, 17 nt, Shigella flexneri 2a str. 301
cagacuauucagcucuu

SEQ ID NO: 3941010 - RNA, 14 nt, Shigella flexneri 2a str. 301
cagacucaaaccaa

SEQ ID NO: 3941011 - RNA, 14 nt, Shigella flexneri 2a str. 301
cagacuccgcuucg

SEQ ID NO: 3941012 - RNA, 13 nt, Shigella flexneri 2a str. 301
cagacuccugaag

SEQ ID NO: 3941013 - RNA, 14 nt, Shigella flexneri 2a str. 301
cagacuccugaaga

SEQ ID NO: 3941014 - RNA, 18 nt, Shigella flexneri 2a str. 301
cagacucucauuuuucag

SEQ ID NO: 3941015 - RNA, 15 nt, Shigella flexneri 2a str. 301
cagacugaauacgcu

SEQ ID NO: 3941016 - RNA, 15 nt, Shigella flexneri 2a str. 301
cagacugaugugauc

SEQ ID NO: 3941017 - RNA, 15 nt, Shigella flexneri 2a str. 301
cagacugcacauggc

SEQ ID NO: 3941018 - RNA, 16 nt, Shigella flexneri 2a str. 301
cagacugcucagcucc

SEQ ID NO: 3941019 - RNA, 23 nt, Shigella flexneri 2a str. 301
cagacugggcaagaucuggcgaa

SEQ ID NO: 3941020 - RNA, 11 nt, Shigella flexneri 2a str. 301
cagacuuugcg

SEQ ID NO: 3941021 - RNA, 18 nt, Shigella flexneri 2a str. 301
cagacuuuuugcggcagc

SEQ ID NO: 3941022 - RNA, 20 nt, Shigella flexneri 2a str. 301
cagagaaaccacaucaaucc

SEQ ID NO: 3941023 - RNA, 15 nt, Shigella flexneri 2a str. 301
cagagaaacgccagc

SEQ ID NO: 3941024 - RNA, 18 nt, Shigella flexneri 2a str. 301
cagagaaacgccagcagc

SEQ ID NO: 3941025 - RNA, 20 nt, Shigella flexneri 2a str. 301
cagagaaacgccagcagcag

SEQ ID NO: 3941026 - RNA, 13 nt, Shigella flexneri 2a str. 301
cagagaaagcaaa

SEQ ID NO: 3941027 - RNA, 20 nt, Shigella flexneri 2a str. 301
cagagaacaucaauccaaac

SEQ ID NO: 3941028 - RNA, 19 nt, Shigella flexneri 2a str. 301
cagagaacuguagacaaaa

SEQ ID NO: 3941029 - RNA, 15 nt, Shigella flexneri 2a str. 301
cagagagacaaucgc

SEQ ID NO: 3941030 - RNA, 14 nt, Shigella flexneri 2a str. 301
cagagagcgaauau

SEQ ID NO: 3941031 - RNA, 18 nt, Shigella flexneri 2a str. 301
cagagagcgaauaucauu

SEQ ID NO: 3941032 - RNA, 21 nt, Shigella flexneri 2a str. 301
cagagauaaccacguucauuu

SEQ ID NO: 3941033 - RNA, 14 nt, Shigella flexneri 2a str. 301
cagagauacaggcc

SEQ ID NO: 3941034 - RNA, 16 nt, Shigella flexneri 2a str. 301
cagagauacaggccac

SEQ ID NO: 3941035 - RNA, 21 nt, Shigella flexneri 2a str. 301
cagagauauucagcccggcaa

SEQ ID NO: 3941036 - RNA, 19 nt, Shigella flexneri 2a str. 301
cagagaucagauaauauuu

SEQ ID NO: 3941037 - RNA, 23 nt, Shigella flexneri 2a str. 301
cagagaucgccccggcaagaaau

SEQ ID NO: 3941038 - RNA, 22 nt, Shigella flexneri 2a str. 301
cagagauggccgguuuguuauc

SEQ ID NO: 3941039 - RNA, 16 nt, Shigella flexneri 2a str. 301
cagagauucgguaacc

SEQ ID NO: 3941040 - RNA, 13 nt, Shigella flexneri 2a str. 301
cagagauucuuuu

SEQ ID NO: 3941041 - RNA, 15 nt, Shigella flexneri 2a str. 301
cagagauucuuuucc

SEQ ID NO: 3941042 - RNA, 18 nt, Shigella flexneri 2a str. 301
cagagauuugcuccagcg

SEQ ID NO: 3941043 - RNA, 23 nt, Shigella flexneri 2a str. 301
cagagcaaaaaucgacagcagga

SEQ ID NO: 3941044 - RNA, 18 nt, Shigella flexneri 2a str. 301
cagagcaccaucgcugau

SEQ ID NO: 3941045 - RNA, 13 nt, Shigella flexneri 2a str. 301
cagagcagcaaca

SEQ ID NO: 3941046 - RNA, 14 nt, Shigella flexneri 2a str. 301
cagagcaucgguau

SEQ ID NO: 3941047 - RNA, 18 nt, Shigella flexneri 2a str. 301
cagagccauccaguuuaa

SEQ ID NO: 3941048 - RNA, 13 nt, Shigella flexneri 2a str. 301
cagagcccgggcg

SEQ ID NO: 3941049 - RNA, 20 nt, Shigella flexneri 2a str. 301
cagagccgcgauaaaauccc

SEQ ID NO: 3941050 - RNA, 12 nt, Shigella flexneri 2a str. 301
cagagccugaau

SEQ ID NO: 3941051 - RNA, 15 nt, Shigella flexneri 2a str. 301
cagagccugaauaaa

SEQ ID NO: 3941052 - RNA, 13 nt, Shigella flexneri 2a str. 301
cagagccugccaa

SEQ ID NO: 3941053 - RNA, 16 nt, Shigella flexneri 2a str. 301
cagagcgaaggagagc

SEQ ID NO: 3941054 - RNA, 15 nt, Shigella flexneri 2a str. 301
cagagcugaauauca

SEQ ID NO: 3941055 - RNA, 15 nt, Shigella flexneri 2a str. 301
cagagcugcguuuga

SEQ ID NO: 3941056 - RNA, 22 nt, Shigella flexneri 2a str. 301
cagagcuucaaccguugcugga

SEQ ID NO: 3941057 - RNA, 19 nt, Shigella flexneri 2a str. 301
cagaggaaucgcuguugag

SEQ ID NO: 3941058 - RNA, 22 nt, Shigella flexneri 2a str. 301
cagaggaaucgcuguugaggca

SEQ ID NO: 3941059 - RNA, 14 nt, Shigella flexneri 2a str. 301
cagaggagccauca

SEQ ID NO: 3941060 - RNA, 14 nt, Shigella flexneri 2a str. 301
cagaggcccgcccc

SEQ ID NO: 3941061 - RNA, 14 nt, Shigella flexneri 2a str. 301
cagaguaucgccau

SEQ ID NO: 3941062 - RNA, 19 nt, Shigella flexneri 2a str. 301
cagaguauuuccagcucaa

SEQ ID NO: 3941063 - RNA, 13 nt, Shigella flexneri 2a str. 301
cagagucauuucu

SEQ ID NO: 3941064 - RNA, 18 nt, Shigella flexneri 2a str. 301
cagagucauuucugccuu

SEQ ID NO: 3941065 - RNA, 12 nt, Shigella flexneri 2a str. 301
cagagugaaaau

SEQ ID NO: 3941066 - RNA, 15 nt, Shigella flexneri 2a str. 301
cagaguugaaaaaca

SEQ ID NO: 3941067 - RNA, 20 nt, Shigella flexneri 2a str. 301
cagaguugagcaguccccac

SEQ ID NO: 3941068 - RNA, 12 nt, Shigella flexneri 2a str. 301
cagaguugcuga

SEQ ID NO: 3941069 - RNA, 12 nt, Shigella flexneri 2a str. 301
cagaguuuuuua

SEQ ID NO: 3941070 - RNA, 11 nt, Shigella flexneri 2a str. 301
cagauaaaaua

SEQ ID NO: 3941071 - RNA, 22 nt, Shigella flexneri 2a str. 301
cagauaaaauacacuuuaaugc

SEQ ID NO: 3941072 - RNA, 22 nt, Shigella flexneri 2a str. 301
cagauaaacaucgggacaugau

SEQ ID NO: 3941073 - RNA, 21 nt, Shigella flexneri 2a str. 301
cagauaaaucauaauaaagau

SEQ ID NO: 3941074 - RNA, 14 nt, Shigella flexneri 2a str. 301
cagauaacaccaua

SEQ ID NO: 3941075 - RNA, 13 nt, Shigella flexneri 2a str. 301
cagauaacccagc

SEQ ID NO: 3941076 - RNA, 15 nt, Shigella flexneri 2a str. 301
cagauaacccagcag

SEQ ID NO: 3941077 - RNA, 23 nt, Shigella flexneri 2a str. 301
cagauaacccaggggucaguucc

SEQ ID NO: 3941078 - RNA, 13 nt, Shigella flexneri 2a str. 301
cagauaagacacu

SEQ ID NO: 3941079 - RNA, 14 nt, Shigella flexneri 2a str. 301
cagauaagacacua

SEQ ID NO: 3941080 - RNA, 19 nt, Shigella flexneri 2a str. 301
cagauaagccugcgcgccc

SEQ ID NO: 3941081 - RNA, 18 nt, Shigella flexneri 2a str. 301
cagauaaggcguuuacgc

SEQ ID NO: 3941082 - RNA, 23 nt, Shigella flexneri 2a str. 301
cagauaaggugccaauccuucuu

SEQ ID NO: 3941083 - RNA, 22 nt, Shigella flexneri 2a str. 301
cagauaauauuuaucuucccag

SEQ ID NO: 3941084 - RNA, 13 nt, Shigella flexneri 2a str. 301
cagauaaucaccu

SEQ ID NO: 3941085 - RNA, 18 nt, Shigella flexneri 2a str. 301
cagauaaucaccugccuu

SEQ ID NO: 3941086 - RNA, 14 nt, Shigella flexneri 2a str. 301
cagauaaucgccau

SEQ ID NO: 3941087 - RNA, 23 nt, Shigella flexneri 2a str. 301
cagauaaugcccgaaugcagcuc

SEQ ID NO: 3941088 - RNA, 22 nt, Shigella flexneri 2a str. 301
cagauaauggcuguugaaugcc

SEQ ID NO: 3941089 - RNA, 22 nt, Shigella flexneri 2a str. 301
cagauacaaaaaaggccgcagg

SEQ ID NO: 3941090 - RNA, 20 nt, Shigella flexneri 2a str. 301
cagauacaguuuuugcgcuu

SEQ ID NO: 3941091 - RNA, 19 nt, Shigella flexneri 2a str. 301
cagauaccaaaaucggcaa

SEQ ID NO: 3941092 - RNA, 14 nt, Shigella flexneri 2a str. 301
cagauaccacauca

SEQ ID NO: 3941093 - RNA, 20 nt, Shigella flexneri 2a str. 301
cagauacgauguuguagcau

SEQ ID NO: 3941094 - RNA, 22 nt, Shigella flexneri 2a str. 301
cagauacugaugaacgcgcagg

SEQ ID NO: 3941095 - RNA, 20 nt, Shigella flexneri 2a str. 301
cagauaggcaucagcaauug

SEQ ID NO: 3941096 - RNA, 16 nt, Shigella flexneri 2a str. 301
cagauaguugauuaau

SEQ ID NO: 3941097 - RNA, 21 nt, Shigella flexneri 2a str. 301
cagauaucccgccagcaccag

SEQ ID NO: 3941098 - RNA, 17 nt, Shigella flexneri 2a str. 301
cagauaucgcggauaug

SEQ ID NO: 3941099 - RNA, 22 nt, Shigella flexneri 2a str. 301
cagauauugcaccccgagcuua

SEQ ID NO: 3941100 - RNA, 21 nt, Shigella flexneri 2a str. 301
cagauauuuauuucagaacag

SEQ ID NO: 3941101 - RNA, 15 nt, Shigella flexneri 2a str. 301
cagaucaacauacuu

SEQ ID NO: 3941102 - RNA, 12 nt, Shigella flexneri 2a str. 301
cagcaaucccaa

SEQ ID NO: 3941103 - RNA, 17 nt, Shigella flexneri 2a str. 301
cagcaaucccaaaauaa

SEQ ID NO: 3941104 - RNA, 15 nt, Shigella flexneri 2a str. 301
cagcaauccccagac

SEQ ID NO: 3941105 - RNA, 15 nt, Shigella flexneri 2a str. 301
cagcaauccugcaug

SEQ ID NO: 3941106 - RNA, 14 nt, Shigella flexneri 2a str. 301
cagcaaucgaccag

SEQ ID NO: 3941107 - RNA, 23 nt, Shigella flexneri 2a str. 301
cagcaaucgaccaggccaucagc

SEQ ID NO: 3941108 - RNA, 21 nt, Shigella flexneri 2a str. 301
cagcaaucgcgccagccguuu

SEQ ID NO: 3941109 - RNA, 18 nt, Shigella flexneri 2a str. 301
cagcaaucucuucaagcu

SEQ ID NO: 3941110 - RNA, 15 nt, Shigella flexneri 2a str. 301
cagcaauggaaaaag

SEQ ID NO: 3941111 - RNA, 14 nt, Shigella flexneri 2a str. 301
cagcaauguuucuc

SEQ ID NO: 3941112 - RNA, 15 nt, Shigella flexneri 2a str. 301
cagcaauguuucucu

SEQ ID NO: 3941113 - RNA, 18 nt, Shigella flexneri 2a str. 301
cagcaauugucgcagaag

SEQ ID NO: 3941114 - RNA, 13 nt, Shigella flexneri 2a str. 301
cagcaauuuacgc

SEQ ID NO: 3941115 - RNA, 21 nt, Shigella flexneri 2a str. 301
cagcaauuuacgcuuuucuuc

SEQ ID NO: 3941116 - RNA, 23 nt, Shigella flexneri 2a str. 301
cagcaauuuacgcuuuucuuccg

SEQ ID NO: 3941117 - RNA, 16 nt, Shigella flexneri 2a str. 301
cagcaauuuaucuuug

SEQ ID NO: 3941118 - RNA, 15 nt, Shigella flexneri 2a str. 301
cagcacaaaucggca

SEQ ID NO: 3941119 - RNA, 14 nt, Shigella flexneri 2a str. 301
cagcacaacgagcu

SEQ ID NO: 3941120 - RNA, 21 nt, Shigella flexneri 2a str. 301
cagcacaaucaaaucgacagc

SEQ ID NO: 3941121 - RNA, 15 nt, Shigella flexneri 2a str. 301
cagcacaaugccggu

SEQ ID NO: 3941122 - RNA, 19 nt, Shigella flexneri 2a str. 301
cagcacaaugccggugaug

SEQ ID NO: 3941123 - RNA, 22 nt, Shigella flexneri 2a str. 301
cagcacaccacaucgccgaccg

SEQ ID NO: 3941124 - RNA, 21 nt, Shigella flexneri 2a str. 301
cagcacaucaucaaagccaau

SEQ ID NO: 3941125 - RNA, 23 nt, Shigella flexneri 2a str. 301
cagcacauuucagaaaguauaua

SEQ ID NO: 3941126 - RNA, 19 nt, Shigella flexneri 2a str. 301
cagcaccacuuccggcaac

SEQ ID NO: 3941127 - RNA, 14 nt, Shigella flexneri 2a str. 301
cagcaccagagaac

SEQ ID NO: 3941128 - RNA, 17 nt, Shigella flexneri 2a str. 301
cagcaccagagaacuga

SEQ ID NO: 3941129 - RNA, 18 nt, Shigella flexneri 2a str. 301
cagcaccagagaacugaa

SEQ ID NO: 3941130 - RNA, 12 nt, Shigella flexneri 2a str. 301
cagcaccagaua

SEQ ID NO: 3941131 - RNA, 19 nt, Shigella flexneri 2a str. 301
cagcaccagcgauuguuca

SEQ ID NO: 3941132 - RNA, 23 nt, Shigella flexneri 2a str. 301
cagcaccaguucacccucauuca

SEQ ID NO: 3941133 - RNA, 12 nt, Shigella flexneri 2a str. 301
cagcaccaucau

SEQ ID NO: 3941134 - RNA, 15 nt, Shigella flexneri 2a str. 301
cagcacccaguaagc

SEQ ID NO: 3941135 - RNA, 14 nt, Shigella flexneri 2a str. 301
cagcacccugaguu

SEQ ID NO: 3941136 - RNA, 14 nt, Shigella flexneri 2a str. 301
cagcaccgcagaga

SEQ ID NO: 3941137 - RNA, 17 nt, Shigella flexneri 2a str. 301
cagcaccgcgacaauca

SEQ ID NO: 3941138 - RNA, 18 nt, Shigella flexneri 2a str. 301
cagcaccgcgacaaucag

SEQ ID NO: 3941139 - RNA, 14 nt, Shigella flexneri 2a str. 301
cagcaccgucaaac

SEQ ID NO: 3941140 - RNA, 18 nt, Shigella flexneri 2a str. 301
cagcaccgucuggcagau

SEQ ID NO: 3941141 - RNA, 19 nt, Shigella flexneri 2a str. 301
cagcaccugcuugaacgca

SEQ ID NO: 3941142 - RNA, 20 nt, Shigella flexneri 2a str. 301
cagcaccugcuugaacgcac

SEQ ID NO: 3941143 - RNA, 19 nt, Shigella flexneri 2a str. 301
cagcaccuuaugcgggcca

SEQ ID NO: 3941144 - RNA, 23 nt, Shigella flexneri 2a str. 301
cagcacgaaugucguuuccaugg

SEQ ID NO: 3941145 - RNA, 17 nt, Shigella flexneri 2a str. 301
cagcacgacuauuauga

SEQ ID NO: 3941146 - RNA, 21 nt, Shigella flexneri 2a str. 301
cagcacgaucagugccgcacc

SEQ ID NO: 3941147 - RNA, 15 nt, Shigella flexneri 2a str. 301
cagcacgcauucgaa

SEQ ID NO: 3941148 - RNA, 14 nt, Shigella flexneri 2a str. 301
cagcacgcugaagg

SEQ ID NO: 3941149 - RNA, 22 nt, Shigella flexneri 2a str. 301
cagcacggugaagaagcggaaa

SEQ ID NO: 3941150 - RNA, 14 nt, Shigella flexneri 2a str. 301
cagcacgucuucca

SEQ ID NO: 3941151 - RNA, 20 nt, Shigella flexneri 2a str. 301
cagcacgucuuccauugccg

SEQ ID NO: 3941152 - RNA, 23 nt, Shigella flexneri 2a str. 301
cagcacguuaaucaaaucaacaa

SEQ ID NO: 3941153 - RNA, 15 nt, Shigella flexneri 2a str. 301
cagcacguugaacug

SEQ ID NO: 3941154 - RNA, 16 nt, Shigella flexneri 2a str. 301
cagcacuacaccccag

SEQ ID NO: 3941155 - RNA, 15 nt, Shigella flexneri 2a str. 301
cagcacuaugacugc

SEQ ID NO: 3941156 - RNA, 17 nt, Shigella flexneri 2a str. 301
cagcacuccugccacca

SEQ ID NO: 3941157 - RNA, 14 nt, Shigella flexneri 2a str. 301
cagcacugauaauc

SEQ ID NO: 3941158 - RNA, 18 nt, Shigella flexneri 2a str. 301
cagcacugauuuuuucca

SEQ ID NO: 3941159 - RNA, 23 nt, Shigella flexneri 2a str. 301
cagcacugauuuuuuccaacagg

SEQ ID NO: 3941160 - RNA, 15 nt, Shigella flexneri 2a str. 301
cagcacugcuuaaau

SEQ ID NO: 3941161 - RNA, 15 nt, Shigella flexneri 2a str. 301
cagcacuggugcugu

SEQ ID NO: 3941162 - RNA, 22 nt, Shigella flexneri 2a str. 301
cagcacuuaucucuuccgcauu

SEQ ID NO: 3941163 - RNA, 20 nt, Shigella flexneri 2a str. 301
cagcacuucacccaucgcca

SEQ ID NO: 3941164 - RNA, 17 nt, Shigella flexneri 2a str. 301
cagcacuuccagcuccg

SEQ ID NO: 3941165 - RNA, 14 nt, Shigella flexneri 2a str. 301
cagcagaacaucag

SEQ ID NO: 3941166 - RNA, 16 nt, Shigella flexneri 2a str. 301
cagcagacagccuacc

SEQ ID NO: 3941167 - RNA, 20 nt, Shigella flexneri 2a str. 301
cagcagacagccuaccagac

SEQ ID NO: 3941168 - RNA, 14 nt, Shigella flexneri 2a str. 301
cagcagaccagcaa

SEQ ID NO: 3941169 - RNA, 16 nt, Shigella flexneri 2a str. 301
cagcagaccagcaaaa

SEQ ID NO: 3941170 - RNA, 17 nt, Shigella flexneri 2a str. 301
cagcagaccuucugcca

SEQ ID NO: 3941171 - RNA, 20 nt, Shigella flexneri 2a str. 301
cagcagagaaaauaucccgu

SEQ ID NO: 3941172 - RNA, 15 nt, Shigella flexneri 2a str. 301
cagcagagcaaaaau

SEQ ID NO: 3941173 - RNA, 21 nt, Shigella flexneri 2a str. 301
cagcagauaucccgccagcac

SEQ ID NO: 3941174 - RNA, 23 nt, Shigella flexneri 2a str. 301
cagcagauaucccgccagcacca

SEQ ID NO: 3941175 - RNA, 22 nt, Shigella flexneri 2a str. 301
cagcagauauugccccacaccg

SEQ ID NO: 3941176 - RNA, 18 nt, Shigella flexneri 2a str. 301
cagcagauugcgaauaug

SEQ ID NO: 3941177 - RNA, 20 nt, Shigella flexneri 2a str. 301
cagcagcaaugcaggcaccu

SEQ ID NO: 3941178 - RNA, 16 nt, Shigella flexneri 2a str. 301
cagcagcagacagccu

SEQ ID NO: 3941179 - RNA, 23 nt, Shigella flexneri 2a str. 301
cagcagcagacagccuaccagac

SEQ ID NO: 3941180 - RNA, 12 nt, Shigella flexneri 2a str. 301
cagcagcagccg

SEQ ID NO: 3941181 - RNA, 11 nt, Shigella flexneri 2a str. 301
cagcagcagcg

SEQ ID NO: 3941182 - RNA, 11 nt, Shigella flexneri 2a str. 301
cagcagcaggu

SEQ ID NO: 3941183 - RNA, 14 nt, Shigella flexneri 2a str. 301
cagcagcaggucac

SEQ ID NO: 3941184 - RNA, 22 nt, Shigella flexneri 2a str. 301
cagcagccgcgcuuucuucuuc

SEQ ID NO: 3941185 - RNA, 19 nt, Shigella flexneri 2a str. 301
cagcagcgaaucagcccag

SEQ ID NO: 3941186 - RNA, 16 nt, Shigella flexneri 2a str. 301
cagcagcggagaaaug

SEQ ID NO: 3941187 - RNA, 18 nt, Shigella flexneri 2a str. 301
cagcagcggcucggucag

SEQ ID NO: 3941188 - RNA, 19 nt, Shigella flexneri 2a str. 301
cagcagcucaucaagcugu

SEQ ID NO: 3941189 - RNA, 17 nt, Shigella flexneri 2a str. 301
cagcaggaucuccagcu

SEQ ID NO: 3941190 - RNA, 17 nt, Shigella flexneri 2a str. 301
cagcaggauggcuggcc

SEQ ID NO: 3941191 - RNA, 15 nt, Shigella flexneri 2a str. 301
cagcaggcagaucca

SEQ ID NO: 3941192 - RNA, 15 nt, Shigella flexneri 2a str. 301
cagcaggcucagaag

SEQ ID NO: 3941193 - RNA, 19 nt, Shigella flexneri 2a str. 301
cagcaggucaccgaaaucg

SEQ ID NO: 3941194 - RNA, 17 nt, Shigella flexneri 2a str. 301
cagcaggugcgccagcg

SEQ ID NO: 3941195 - RNA, 13 nt, Shigella flexneri 2a str. 301
cagcaggugucca

SEQ ID NO: 3941196 - RNA, 16 nt, Shigella flexneri 2a str. 301
cagcaguaaaccaccc

SEQ ID NO: 3941197 - RNA, 14 nt, Shigella flexneri 2a str. 301
cagcaguaaaccgc

SEQ ID NO: 3941198 - RNA, 17 nt, Shigella flexneri 2a str. 301
cagcaguacgccgagaa

SEQ ID NO: 3941199 - RNA, 22 nt, Shigella flexneri 2a str. 301
cagcaguauuaacgccauauca

SEQ ID NO: 3941200 - RNA, 15 nt, Shigella flexneri 2a str. 301
cagcaguccagcgcg

SEQ ID NO: 3941201 - RNA, 23 nt, Shigella flexneri 2a str. 301
cagcaguccagcgcgaacgugac

SEQ ID NO: 3941202 - RNA, 20 nt, Shigella flexneri 2a str. 301
cagccauugcuaccgcuucg

SEQ ID NO: 3941203 - RNA, 15 nt, Shigella flexneri 2a str. 301
cagcccaaagcagag

SEQ ID NO: 3941204 - RNA, 19 nt, Shigella flexneri 2a str. 301
cagcccaauaccuucauug

SEQ ID NO: 3941205 - RNA, 14 nt, Shigella flexneri 2a str. 301
cagcccaaucaucg

SEQ ID NO: 3941206 - RNA, 12 nt, Shigella flexneri 2a str. 301
cagcccagcccu

SEQ ID NO: 3941207 - RNA, 12 nt, Shigella flexneri 2a str. 301
cagcccaugaau

SEQ ID NO: 3941208 - RNA, 13 nt, Shigella flexneri 2a str. 301
cagccccacagca

SEQ ID NO: 3941209 - RNA, 16 nt, Shigella flexneri 2a str. 301
cagccccagcgucagc

SEQ ID NO: 3941210 - RNA, 16 nt, Shigella flexneri 2a str. 301
cagccccugcgccagc

SEQ ID NO: 3941211 - RNA, 15 nt, Shigella flexneri 2a str. 301
cagcccgagguuauu

SEQ ID NO: 3941212 - RNA, 15 nt, Shigella flexneri 2a str. 301
cagcccgcagcgccu

SEQ ID NO: 3941213 - RNA, 14 nt, Shigella flexneri 2a str. 301
cagcccggcaaugg

SEQ ID NO: 3941214 - RNA, 18 nt, Shigella flexneri 2a str. 301
cagcccggcauguuucaa

SEQ ID NO: 3941215 - RNA, 14 nt, Shigella flexneri 2a str. 301
cagcccgucucagc

SEQ ID NO: 3941216 - RNA, 21 nt, Shigella flexneri 2a str. 301
cagcccugccaggucaucauu

SEQ ID NO: 3941217 - RNA, 14 nt, Shigella flexneri 2a str. 301
cagcccuucuuuca

SEQ ID NO: 3941218 - RNA, 19 nt, Shigella flexneri 2a str. 301
cagcccuucuuucacuuca

SEQ ID NO: 3941219 - RNA, 17 nt, Shigella flexneri 2a str. 301
cagccgacaaugccaca

SEQ ID NO: 3941220 - RNA, 22 nt, Shigella flexneri 2a str. 301
cagccgaguagaucaacacauc

SEQ ID NO: 3941221 - RNA, 14 nt, Shigella flexneri 2a str. 301
cagccgaucauugg

SEQ ID NO: 3941222 - RNA, 22 nt, Shigella flexneri 2a str. 301
cagccgaugcagguuggcgacg

SEQ ID NO: 3941223 - RNA, 13 nt, Shigella flexneri 2a str. 301
cagccgccagaaa

SEQ ID NO: 3941224 - RNA, 22 nt, Shigella flexneri 2a str. 301
cagccgccagggcaagcgccua

SEQ ID NO: 3941225 - RNA, 22 nt, Shigella flexneri 2a str. 301
cagccgccgcuaucggcaagga

SEQ ID NO: 3941226 - RNA, 23 nt, Shigella flexneri 2a str. 301
cagccgccgcuaucggcaaggaa

SEQ ID NO: 3941227 - RNA, 23 nt, Shigella flexneri 2a str. 301
cagccgcgcgcuucugguuauau

SEQ ID NO: 3941228 - RNA, 19 nt, Shigella flexneri 2a str. 301
cagccgcuaacuuccugcu

SEQ ID NO: 3941229 - RNA, 15 nt, Shigella flexneri 2a str. 301
cagccgcuaccagcg

SEQ ID NO: 3941230 - RNA, 20 nt, Shigella flexneri 2a str. 301
cagccgcuaccagcgcggca

SEQ ID NO: 3941231 - RNA, 20 nt, Shigella flexneri 2a str. 301
cagccggagguguucauaau

SEQ ID NO: 3941232 - RNA, 13 nt, Shigella flexneri 2a str. 301
cagccggcaaagu

SEQ ID NO: 3941233 - RNA, 20 nt, Shigella flexneri 2a str. 301
cagccgucacgacagaacuc

SEQ ID NO: 3941234 - RNA, 23 nt, Shigella flexneri 2a str. 301
cagccgucgagggcaaccugcuu

SEQ ID NO: 3941235 - RNA, 22 nt, Shigella flexneri 2a str. 301
cagccuaagccauuuaacucac

SEQ ID NO: 3941236 - RNA, 15 nt, Shigella flexneri 2a str. 301
cagccuacaaaaacu

SEQ ID NO: 3941237 - RNA, 17 nt, Shigella flexneri 2a str. 301
cagccuacaaaaacuca

SEQ ID NO: 3941238 - RNA, 21 nt, Shigella flexneri 2a str. 301
cagccucaagcacccgccgcu

SEQ ID NO: 3941239 - RNA, 15 nt, Shigella flexneri 2a str. 301
cagccucccauuucc

SEQ ID NO: 3941240 - RNA, 23 nt, Shigella flexneri 2a str. 301
cagccucgcuggucagcgccagu

SEQ ID NO: 3941241 - RNA, 14 nt, Shigella flexneri 2a str. 301
cagccucugccgcg

SEQ ID NO: 3941242 - RNA, 16 nt, Shigella flexneri 2a str. 301
cagccugaccgcacac

SEQ ID NO: 3941243 - RNA, 21 nt, Shigella flexneri 2a str. 301
cagccugaccgcacaccccgg

SEQ ID NO: 3941244 - RNA, 20 nt, Shigella flexneri 2a str. 301
cagccugauacaggaaggcc

SEQ ID NO: 3941245 - RNA, 14 nt, Shigella flexneri 2a str. 301
cagccugccagcau

SEQ ID NO: 3941246 - RNA, 15 nt, Shigella flexneri 2a str. 301
cagccugccagcaug

SEQ ID NO: 3941247 - RNA, 15 nt, Shigella flexneri 2a str. 301
cagccugcgcuucuu

SEQ ID NO: 3941248 - RNA, 19 nt, Shigella flexneri 2a str. 301
cagccuguuccagacgcug

SEQ ID NO: 3941249 - RNA, 15 nt, Shigella flexneri 2a str. 301
cagccuuaaacucaa

SEQ ID NO: 3941250 - RNA, 12 nt, Shigella flexneri 2a str. 301
cagccuucuuca

SEQ ID NO: 3941251 - RNA, 19 nt, Shigella flexneri 2a str. 301
cagccuucuucauccagcg

SEQ ID NO: 3941252 - RNA, 14 nt, Shigella flexneri 2a str. 301
cagccuuuccugca

SEQ ID NO: 3941253 - RNA, 13 nt, Shigella flexneri 2a str. 301
cagccuuucucag

SEQ ID NO: 3941254 - RNA, 22 nt, Shigella flexneri 2a str. 301
cagcgaaaguaacaccauccau

SEQ ID NO: 3941255 - RNA, 18 nt, Shigella flexneri 2a str. 301
cagcgaaauacagguccc

SEQ ID NO: 3941256 - RNA, 16 nt, Shigella flexneri 2a str. 301
cagcgaaaucgccuuu

SEQ ID NO: 3941257 - RNA, 22 nt, Shigella flexneri 2a str. 301
cagcgaaccuuccaucgcaucu

SEQ ID NO: 3941258 - RNA, 17 nt, Shigella flexneri 2a str. 301
cagcgaagcccacgccg

SEQ ID NO: 3941259 - RNA, 18 nt, Shigella flexneri 2a str. 301
cagcgaagcccacgccgc

SEQ ID NO: 3941260 - RNA, 16 nt, Shigella flexneri 2a str. 301
cagcgaauggguugua

SEQ ID NO: 3941261 - RNA, 15 nt, Shigella flexneri 2a str. 301
cagcgaauuccaguu

SEQ ID NO: 3941262 - RNA, 18 nt, Shigella flexneri 2a str. 301
cagcgacaggaacgccgc

SEQ ID NO: 3941263 - RNA, 16 nt, Shigella flexneri 2a str. 301
cagcgacagggccagg

SEQ ID NO: 3941264 - RNA, 18 nt, Shigella flexneri 2a str. 301
cagcgacguugauuuugu

SEQ ID NO: 3941265 - RNA, 18 nt, Shigella flexneri 2a str. 301
cagcgagauaacgcugau

SEQ ID NO: 3941266 - RNA, 17 nt, Shigella flexneri 2a str. 301
cagcgagcuggcgcuga

SEQ ID NO: 3941267 - RNA, 17 nt, Shigella flexneri 2a str. 301
cagcgagguacaaccau

SEQ ID NO: 3941268 - RNA, 20 nt, Shigella flexneri 2a str. 301
cagcgaguuuuucaguccac

SEQ ID NO: 3941269 - RNA, 21 nt, Shigella flexneri 2a str. 301
cagcgauaaugaaugaugcgg

SEQ ID NO: 3941270 - RNA, 14 nt, Shigella flexneri 2a str. 301
cagcgaucagcauu

SEQ ID NO: 3941271 - RNA, 13 nt, Shigella flexneri 2a str. 301
cagcgaucgcuuu

SEQ ID NO: 3941272 - RNA, 19 nt, Shigella flexneri 2a str. 301
cagcgaucuuucgcggcag

SEQ ID NO: 3941273 - RNA, 19 nt, Shigella flexneri 2a str. 301
cagcgaugcccagugacca

SEQ ID NO: 3941274 - RNA, 19 nt, Shigella flexneri 2a str. 301
cagcgauggacgcagacca

SEQ ID NO: 3941275 - RNA, 21 nt, Shigella flexneri 2a str. 301
cagcgauucaacaguagccuc

SEQ ID NO: 3941276 - RNA, 14 nt, Shigella flexneri 2a str. 301
cagcgauuccaguu

SEQ ID NO: 3941277 - RNA, 18 nt, Shigella flexneri 2a str. 301
cagcgauugucagcuggu

SEQ ID NO: 3941278 - RNA, 15 nt, Shigella flexneri 2a str. 301
cagcgauuugcggaa

SEQ ID NO: 3941279 - RNA, 16 nt, Shigella flexneri 2a str. 301
cagcgcaagcugaaca

SEQ ID NO: 3941280 - RNA, 22 nt, Shigella flexneri 2a str. 301
cagcgcaauaccgauaucgcca

SEQ ID NO: 3941281 - RNA, 15 nt, Shigella flexneri 2a str. 301
cagcgcaaucaccgg

SEQ ID NO: 3941282 - RNA, 16 nt, Shigella flexneri 2a str. 301
cagcgcaccagaaaca

SEQ ID NO: 3941283 - RNA, 18 nt, Shigella flexneri 2a str. 301
cagcgcaccagcgucauc

SEQ ID NO: 3941284 - RNA, 23 nt, Shigella flexneri 2a str. 301
cagcgcaccugugguagcggcuc

SEQ ID NO: 3941285 - RNA, 15 nt, Shigella flexneri 2a str. 301
cagcgcagcacccag

SEQ ID NO: 3941286 - RNA, 16 nt, Shigella flexneri 2a str. 301
cagcgcagcucuggca

SEQ ID NO: 3941287 - RNA, 12 nt, Shigella flexneri 2a str. 301
cagcgcaggaaa

SEQ ID NO: 3941288 - RNA, 20 nt, Shigella flexneri 2a str. 301
cagcgcaggcagguuaauga

SEQ ID NO: 3941289 - RNA, 20 nt, Shigella flexneri 2a str. 301
cagcgcauagagacuuuucc

SEQ ID NO: 3941290 - RNA, 23 nt, Shigella flexneri 2a str. 301
cagcgcauagagacuuuuccagc

SEQ ID NO: 3941291 - RNA, 20 nt, Shigella flexneri 2a str. 301
cagcgcauagcuaauccccu

SEQ ID NO: 3941292 - RNA, 14 nt, Shigella flexneri 2a str. 301
cagcgcaucagaca

SEQ ID NO: 3941293 - RNA, 14 nt, Shigella flexneri 2a str. 301
cagcgcaucaggca

SEQ ID NO: 3941294 - RNA, 20 nt, Shigella flexneri 2a str. 301
cagcgcauccauuacaucac

SEQ ID NO: 3941295 - RNA, 21 nt, Shigella flexneri 2a str. 301
cagcgcauccauuacaucacg

SEQ ID NO: 3941296 - RNA, 14 nt, Shigella flexneri 2a str. 301
cagcgcauccuggc

SEQ ID NO: 3941297 - RNA, 17 nt, Shigella flexneri 2a str. 301
cagcgcauggcggcagc

SEQ ID NO: 3941298 - RNA, 23 nt, Shigella flexneri 2a str. 301
cagcgcauggcggcagcgugcca

SEQ ID NO: 3941299 - RNA, 14 nt, Shigella flexneri 2a str. 301
cagcgcauucggca

SEQ ID NO: 3941300 - RNA, 12 nt, Shigella flexneri 2a str. 301
cagcgcauugcu

SEQ ID NO: 3941301 - RNA, 20 nt, Shigella flexneri 2a str. 301
cagcgcauugcuaaugcugg

SEQ ID NO: 3941302 - RNA, 21 nt, Shigella flexneri 2a str. 301
cagcgucgcaucaggcaaugu

SEQ ID NO: 3941303 - RNA, 16 nt, Shigella flexneri 2a str. 301
cagcgucgcauccgac

SEQ ID NO: 3941304 - RNA, 22 nt, Shigella flexneri 2a str. 301
cagcgucgcauccgacauugaa

SEQ ID NO: 3941305 - RNA, 15 nt, Shigella flexneri 2a str. 301
cagcgucgcaucugg

SEQ ID NO: 3941306 - RNA, 14 nt, Shigella flexneri 2a str. 301
cagcgucgucagca

SEQ ID NO: 3941307 - RNA, 20 nt, Shigella flexneri 2a str. 301
cagcgugaacugggccugca

SEQ ID NO: 3941308 - RNA, 16 nt, Shigella flexneri 2a str. 301
cagcguguugaggaag

SEQ ID NO: 3941309 - RNA, 23 nt, Shigella flexneri 2a str. 301
cagcguuaacugcuuaucaucac

SEQ ID NO: 3941310 - RNA, 22 nt, Shigella flexneri 2a str. 301
cagcguuaaugauaucccugcu

SEQ ID NO: 3941311 - RNA, 19 nt, Shigella flexneri 2a str. 301
cagcguuaucccaucccac

SEQ ID NO: 3941312 - RNA, 20 nt, Shigella flexneri 2a str. 301
cagcguuaucccaucccacu

SEQ ID NO: 3941313 - RNA, 14 nt, Shigella flexneri 2a str. 301
cagcguuccccaga

SEQ ID NO: 3941314 - RNA, 18 nt, Shigella flexneri 2a str. 301
cagcguucgccaaaccca

SEQ ID NO: 3941315 - RNA, 15 nt, Shigella flexneri 2a str. 301
cagcguugaaugcau

SEQ ID NO: 3941316 - RNA, 20 nt, Shigella flexneri 2a str. 301
cagcguuuccagcaccaguu

SEQ ID NO: 3941317 - RNA, 21 nt, Shigella flexneri 2a str. 301
cagcguuuccagcaccaguuc

SEQ ID NO: 3941318 - RNA, 19 nt, Shigella flexneri 2a str. 301
cagcguuuccagccagucg

SEQ ID NO: 3941319 - RNA, 20 nt, Shigella flexneri 2a str. 301
cagcguuucgaacaggccga

SEQ ID NO: 3941320 - RNA, 14 nt, Shigella flexneri 2a str. 301
cagcguuugaacau

SEQ ID NO: 3941321 - RNA, 23 nt, Shigella flexneri 2a str. 301
cagcguuugaacauuauuuuugc

SEQ ID NO: 3941322 - RNA, 14 nt, Shigella flexneri 2a str. 301
cagcuacuggugcc

SEQ ID NO: 3941323 - RNA, 22 nt, Shigella flexneri 2a str. 301
cagcuaucguuauccauauggc

SEQ ID NO: 3941324 - RNA, 19 nt, Shigella flexneri 2a str. 301
cagcuauucuuauaaagaa

SEQ ID NO: 3941325 - RNA, 20 nt, Shigella flexneri 2a str. 301
cagcucaaacggcguuuucu

SEQ ID NO: 3941326 - RNA, 17 nt, Shigella flexneri 2a str. 301
cagcucacaaauacgcu

SEQ ID NO: 3941327 - RNA, 15 nt, Shigella flexneri 2a str. 301
cagcucacuucgauc

SEQ ID NO: 3941328 - RNA, 17 nt, Shigella flexneri 2a str. 301
cagcucauauuccugca

SEQ ID NO: 3941329 - RNA, 18 nt, Shigella flexneri 2a str. 301
cagcucauauuccugcau

SEQ ID NO: 3941330 - RNA, 23 nt, Shigella flexneri 2a str. 301
cagcucauauuccugcauugcuu

SEQ ID NO: 3941331 - RNA, 12 nt, Shigella flexneri 2a str. 301
cagcucauccag

SEQ ID NO: 3941332 - RNA, 17 nt, Shigella flexneri 2a str. 301
cagcucauucagccggg

SEQ ID NO: 3941333 - RNA, 13 nt, Shigella flexneri 2a str. 301
cagcuccagcaga

SEQ ID NO: 3941334 - RNA, 19 nt, Shigella flexneri 2a str. 301
cagcuccagcccgcgucgu

SEQ ID NO: 3941335 - RNA, 14 nt, Shigella flexneri 2a str. 301
cagcuccauccacc

SEQ ID NO: 3941336 - RNA, 22 nt, Shigella flexneri 2a str. 301
cagcucccacaguuucagcccc

SEQ ID NO: 3941337 - RNA, 19 nt, Shigella flexneri 2a str. 301
cagcuccgggcucaugcug

SEQ ID NO: 3941338 - RNA, 23 nt, Shigella flexneri 2a str. 301
cagcuccgggcucaugcugucca

SEQ ID NO: 3941339 - RNA, 19 nt, Shigella flexneri 2a str. 301
cagcuccgguauacguccc

SEQ ID NO: 3941340 - RNA, 17 nt, Shigella flexneri 2a str. 301
cagcuccguccagccac

SEQ ID NO: 3941341 - RNA, 18 nt, Shigella flexneri 2a str. 301
cagcuccucuuucaucuc

SEQ ID NO: 3941342 - RNA, 21 nt, Shigella flexneri 2a str. 301
cagcuccucuuucaucucccg

SEQ ID NO: 3941343 - RNA, 14 nt, Shigella flexneri 2a str. 301
cagcucgaccgcug

SEQ ID NO: 3941344 - RNA, 18 nt, Shigella flexneri 2a str. 301
cagcucgaugauguguuc

SEQ ID NO: 3941345 - RNA, 17 nt, Shigella flexneri 2a str. 301
cagcucgcgcaguucac

SEQ ID NO: 3941346 - RNA, 16 nt, Shigella flexneri 2a str. 301
cagcucggcaaucugu

SEQ ID NO: 3941347 - RNA, 22 nt, Shigella flexneri 2a str. 301
cagcucucagacgauuacucgc

SEQ ID NO: 3941348 - RNA, 18 nt, Shigella flexneri 2a str. 301
cagcucucgcguuacuac

SEQ ID NO: 3941349 - RNA, 12 nt, Shigella flexneri 2a str. 301
cagcucugcugu

SEQ ID NO: 3941350 - RNA, 12 nt, Shigella flexneri 2a str. 301
cagcucuuccuu

SEQ ID NO: 3941351 - RNA, 20 nt, Shigella flexneri 2a str. 301
cagcucuuccuucagcuccc

SEQ ID NO: 3941352 - RNA, 15 nt, Shigella flexneri 2a str. 301
cagcucuugcuccac

SEQ ID NO: 3941353 - RNA, 20 nt, Shigella flexneri 2a str. 301
cagcucuuuuccagccauca

SEQ ID NO: 3941354 - RNA, 18 nt, Shigella flexneri 2a str. 301
cagcugaccgguugcugg

SEQ ID NO: 3941355 - RNA, 17 nt, Shigella flexneri 2a str. 301
cagcugauccuucuguu

SEQ ID NO: 3941356 - RNA, 20 nt, Shigella flexneri 2a str. 301
cagcugccguccccaucagg

SEQ ID NO: 3941357 - RNA, 20 nt, Shigella flexneri 2a str. 301
cagcugcgcuucaauacgcu

SEQ ID NO: 3941358 - RNA, 17 nt, Shigella flexneri 2a str. 301
cagcugcucauuacagu

SEQ ID NO: 3941359 - RNA, 15 nt, Shigella flexneri 2a str. 301
cagcugcucccagcg

SEQ ID NO: 3941360 - RNA, 19 nt, Shigella flexneri 2a str. 301
cagcuggucgcccuucauc

SEQ ID NO: 3941361 - RNA, 21 nt, Shigella flexneri 2a str. 301
cagcugguguaacugcgccag

SEQ ID NO: 3941362 - RNA, 23 nt, Shigella flexneri 2a str. 301
cagcugguguaacugcgccagac

SEQ ID NO: 3941363 - RNA, 19 nt, Shigella flexneri 2a str. 301
cagcugguugaugcgcccu

SEQ ID NO: 3941364 - RNA, 15 nt, Shigella flexneri 2a str. 301
cagcuuaaucaccag

SEQ ID NO: 3941365 - RNA, 19 nt, Shigella flexneri 2a str. 301
cagcuuacgagugcgcucu

SEQ ID NO: 3941366 - RNA, 23 nt, Shigella flexneri 2a str. 301
cagcuuacgagugcgcucuucaa

SEQ ID NO: 3941367 - RNA, 13 nt, Shigella flexneri 2a str. 301
cagcuuacgcuga

SEQ ID NO: 3941368 - RNA, 16 nt, Shigella flexneri 2a str. 301
cagcuuagaaauucac

SEQ ID NO: 3941369 - RNA, 15 nt, Shigella flexneri 2a str. 301
cagcuuaucuuuuuc

SEQ ID NO: 3941370 - RNA, 21 nt, Shigella flexneri 2a str. 301
cagcuucaaaucauuacaguu

SEQ ID NO: 3941371 - RNA, 15 nt, Shigella flexneri 2a str. 301
cagcuucaccuucca

SEQ ID NO: 3941372 - RNA, 18 nt, Shigella flexneri 2a str. 301
cagcuucacgcgccagcu

SEQ ID NO: 3941373 - RNA, 10 nt, Shigella flexneri 2a str. 301
cagcuucaga

SEQ ID NO: 3941374 - RNA, 18 nt, Shigella flexneri 2a str. 301
cagcuucagauugcacca

SEQ ID NO: 3941375 - RNA, 15 nt, Shigella flexneri 2a str. 301
cagcuucaucaucgc

SEQ ID NO: 3941376 - RNA, 20 nt, Shigella flexneri 2a str. 301
cagcuucgccaguuuuucaa

SEQ ID NO: 3941377 - RNA, 14 nt, Shigella flexneri 2a str. 301
cagcuucgcuuccc

SEQ ID NO: 3941378 - RNA, 21 nt, Shigella flexneri 2a str. 301
cagcuucgcuucccaacgcag

SEQ ID NO: 3941379 - RNA, 19 nt, Shigella flexneri 2a str. 301
cagcuucucgugaaacuca

SEQ ID NO: 3941380 - RNA, 19 nt, Shigella flexneri 2a str. 301
cagcuucuuauccagcugc

SEQ ID NO: 3941381 - RNA, 15 nt, Shigella flexneri 2a str. 301
cagcuugccgcgcuc

SEQ ID NO: 3941382 - RNA, 17 nt, Shigella flexneri 2a str. 301
cagcuugcgauccugca

SEQ ID NO: 3941383 - RNA, 15 nt, Shigella flexneri 2a str. 301
cagcuugcuuuccag

SEQ ID NO: 3941384 - RNA, 21 nt, Shigella flexneri 2a str. 301
cagcuuuaaauuacugagcaa

SEQ ID NO: 3941385 - RNA, 16 nt, Shigella flexneri 2a str. 301
cagcuuucaccugcgc

SEQ ID NO: 3941386 - RNA, 13 nt, Shigella flexneri 2a str. 301
cagcuuucagaga

SEQ ID NO: 3941387 - RNA, 18 nt, Shigella flexneri 2a str. 301
cagcuuucagcagcggcu

SEQ ID NO: 3941388 - RNA, 18 nt, Shigella flexneri 2a str. 301
cagcuuucccuucaggcg

SEQ ID NO: 3941389 - RNA, 13 nt, Shigella flexneri 2a str. 301
cagcuuucgcuua

SEQ ID NO: 3941390 - RNA, 20 nt, Shigella flexneri 2a str. 301
cagcuuugcccgaucaucaa

SEQ ID NO: 3941391 - RNA, 21 nt, Shigella flexneri 2a str. 301
cagcuuugcccgaucaucaaa

SEQ ID NO: 3941392 - RNA, 13 nt, Shigella flexneri 2a str. 301
cagcuuuggugaa

SEQ ID NO: 3941393 - RNA, 13 nt, Shigella flexneri 2a str. 301
cagcuuuuacagc

SEQ ID NO: 3941394 - RNA, 21 nt, Shigella flexneri 2a str. 301
cagcuuuuccauaucaagcau

SEQ ID NO: 3941395 - RNA, 18 nt, Shigella flexneri 2a str. 301
cagcuuuuuaaucgccau

SEQ ID NO: 3941396 - RNA, 13 nt, Shigella flexneri 2a str. 301
cagcuuuuuccug

SEQ ID NO: 3941397 - RNA, 15 nt, Shigella flexneri 2a str. 301
cagcuuuuuccugcg

SEQ ID NO: 3941398 - RNA, 19 nt, Shigella flexneri 2a str. 301
caggaaaagguaggccuga

SEQ ID NO: 3941399 - RNA, 15 nt, Shigella flexneri 2a str. 301
caggaaacccaacgc

SEQ ID NO: 3941400 - RNA, 21 nt, Shigella flexneri 2a str. 301
caggaaacccaacgcaaagag

SEQ ID NO: 3941401 - RNA, 12 nt, Shigella flexneri 2a str. 301
caggaaauaaau

SEQ ID NO: 3941402 - RNA, 13 nt, Shigella flexneri 2a str. 301
caggcuacuccca

SEQ ID NO: 3941403 - RNA, 15 nt, Shigella flexneri 2a str. 301
caggcuacucccagu

SEQ ID NO: 3941404 - RNA, 16 nt, Shigella flexneri 2a str. 301
caggcuacucccagua

SEQ ID NO: 3941405 - RNA, 17 nt, Shigella flexneri 2a str. 301
caggcuacucccaguag

SEQ ID NO: 3941406 - RNA, 23 nt, Shigella flexneri 2a str. 301
caggcucagaagacgcuccagug

SEQ ID NO: 3941407 - RNA, 13 nt, Shigella flexneri 2a str. 301
caggcuccggaaa

SEQ ID NO: 3941408 - RNA, 15 nt, Shigella flexneri 2a str. 301
caggcucgccgccgc

SEQ ID NO: 3941409 - RNA, 21 nt, Shigella flexneri 2a str. 301
caggcucgccgccgcuggcgu

SEQ ID NO: 3941410 - RNA, 14 nt, Shigella flexneri 2a str. 301
caggcucugguguu

SEQ ID NO: 3941411 - RNA, 15 nt, Shigella flexneri 2a str. 301
caggcucuuuaaaca

SEQ ID NO: 3941412 - RNA, 12 nt, Shigella flexneri 2a str. 301
caggcugaugga

SEQ ID NO: 3941413 - RNA, 18 nt, Shigella flexneri 2a str. 301
caggcugcaaagucuggg

SEQ ID NO: 3941414 - RNA, 15 nt, Shigella flexneri 2a str. 301
caggcugcuauccag

SEQ ID NO: 3941415 - RNA, 22 nt, Shigella flexneri 2a str. 301
caggcuguuaaggaaauccugc

SEQ ID NO: 3941416 - RNA, 20 nt, Shigella flexneri 2a str. 301
caggcuguuaccccugcggc

SEQ ID NO: 3941417 - RNA, 21 nt, Shigella flexneri 2a str. 301
caggcuguuaccccugcggcc

SEQ ID NO: 3941418 - RNA, 16 nt, Shigella flexneri 2a str. 301
caggcuuaauugcgca

SEQ ID NO: 3941419 - RNA, 19 nt, Shigella flexneri 2a str. 301
caggcuuauggcucgccau

SEQ ID NO: 3941420 - RNA, 13 nt, Shigella flexneri 2a str. 301
caggcuucaacac

SEQ ID NO: 3941421 - RNA, 14 nt, Shigella flexneri 2a str. 301
caggcuucaacaca

SEQ ID NO: 3941422 - RNA, 21 nt, Shigella flexneri 2a str. 301
caggcuucaacacaggccggc

SEQ ID NO: 3941423 - RNA, 15 nt, Shigella flexneri 2a str. 301
caggcuuuauucuga

SEQ ID NO: 3941424 - RNA, 20 nt, Shigella flexneri 2a str. 301
caggcuuuauucugacgcca

SEQ ID NO: 3941425 - RNA, 17 nt, Shigella flexneri 2a str. 301
caggcuuuuaacaccug

SEQ ID NO: 3941426 - RNA, 13 nt, Shigella flexneri 2a str. 301
cagggaaaaauug

SEQ ID NO: 3941427 - RNA, 23 nt, Shigella flexneri 2a str. 301
cagggaaaugacggucaucaccu

SEQ ID NO: 3941428 - RNA, 19 nt, Shigella flexneri 2a str. 301
cagggacgagucgucgaua

SEQ ID NO: 3941429 - RNA, 23 nt, Shigella flexneri 2a str. 301
cagggacgagucgucgauaucga

SEQ ID NO: 3941430 - RNA, 21 nt, Shigella flexneri 2a str. 301
cagggaguacguggaggaugg

SEQ ID NO: 3941431 - RNA, 17 nt, Shigella flexneri 2a str. 301
cagggagucuugcugga

SEQ ID NO: 3941432 - RNA, 16 nt, Shigella flexneri 2a str. 301
cagggauaaagccccc

SEQ ID NO: 3941433 - RNA, 18 nt, Shigella flexneri 2a str. 301
cagggauauuucaccgcc

SEQ ID NO: 3941434 - RNA, 16 nt, Shigella flexneri 2a str. 301
cagggaucaacauuca

SEQ ID NO: 3941435 - RNA, 18 nt, Shigella flexneri 2a str. 301
cagggaucaacauucaga

SEQ ID NO: 3941436 - RNA, 17 nt, Shigella flexneri 2a str. 301
cagggaucauccacccg

SEQ ID NO: 3941437 - RNA, 15 nt, Shigella flexneri 2a str. 301
cagggaugaagugaa

SEQ ID NO: 3941438 - RNA, 22 nt, Shigella flexneri 2a str. 301
cagggaugaagugaagaugaau

SEQ ID NO: 3941439 - RNA, 15 nt, Shigella flexneri 2a str. 301
cagggauggcuuuua

SEQ ID NO: 3941440 - RNA, 22 nt, Shigella flexneri 2a str. 301
cagggcaauuaaaaauuucccc

SEQ ID NO: 3941441 - RNA, 23 nt, Shigella flexneri 2a str. 301
cagggcacuuuuauccugucagu

SEQ ID NO: 3941442 - RNA, 14 nt, Shigella flexneri 2a str. 301
cagggcgcuggcga

SEQ ID NO: 3941443 - RNA, 14 nt, Shigella flexneri 2a str. 301
cagggcggccgcca

SEQ ID NO: 3941444 - RNA, 24 nt, Shigella flexneri 2a str. 301
cagggcuuuaccugucagcucuuu

SEQ ID NO: 3941445 - RNA, 14 nt, Shigella flexneri 2a str. 301
caggggcagcacca

SEQ ID NO: 3941446 - RNA, 18 nt, Shigella flexneri 2a str. 301
caggggcggggaauucua

SEQ ID NO: 3941447 - RNA, 19 nt, Shigella flexneri 2a str. 301
caggguaaaaccaugccau

SEQ ID NO: 3941448 - RNA, 20 nt, Shigella flexneri 2a str. 301
caggguagacuuggcuuucu

SEQ ID NO: 3941449 - RNA, 19 nt, Shigella flexneri 2a str. 301
caggguauggaucccucuu

SEQ ID NO: 3941450 - RNA, 24 nt, Shigella flexneri 2a str. 301
caggguauuaucaauaccgauggc

SEQ ID NO: 3941451 - RNA, 22 nt, Shigella flexneri 2a str. 301
cagggugacaaauuugugcucu

SEQ ID NO: 3941452 - RNA, 17 nt, Shigella flexneri 2a str. 301
cagggugcuggcgcuca

SEQ ID NO: 3941453 - RNA, 18 nt, Shigella flexneri 2a str. 301
caggguuugcaucgccau

SEQ ID NO: 3941454 - RNA, 16 nt, Shigella flexneri 2a str. 301
caggguuuugcccagc

SEQ ID NO: 3941455 - RNA, 19 nt, Shigella flexneri 2a str. 301
cagguaaacaccuucaucc

SEQ ID NO: 3941456 - RNA, 20 nt, Shigella flexneri 2a str. 301
cagguaaacaccuucaucca

SEQ ID NO: 3941457 - RNA, 13 nt, Shigella flexneri 2a str. 301
cagguaaagacca

SEQ ID NO: 3941458 - RNA, 18 nt, Shigella flexneri 2a str. 301
cagguaaagugcgagucg

SEQ ID NO: 3941459 - RNA, 15 nt, Shigella flexneri 2a str. 301
cagguaaucugccau

SEQ ID NO: 3941460 - RNA, 21 nt, Shigella flexneri 2a str. 301
cagguaaugaauggacuccac

SEQ ID NO: 3941461 - RNA, 18 nt, Shigella flexneri 2a str. 301
cagguaauuugaucaaau

SEQ ID NO: 3941462 - RNA, 14 nt, Shigella flexneri 2a str. 301
cagguacuggaaaa

SEQ ID NO: 3941463 - RNA, 16 nt, Shigella flexneri 2a str. 301
cagguacuuuugaaug

SEQ ID NO: 3941464 - RNA, 20 nt, Shigella flexneri 2a str. 301
cagguagcgcauaagccacc

SEQ ID NO: 3941465 - RNA, 16 nt, Shigella flexneri 2a str. 301
cagguagguuggugaa

SEQ ID NO: 3941466 - RNA, 19 nt, Shigella flexneri 2a str. 301
cagguaguggucaggauua

SEQ ID NO: 3941467 - RNA, 13 nt, Shigella flexneri 2a str. 301
cagguaucgacaa

SEQ ID NO: 3941468 - RNA, 20 nt, Shigella flexneri 2a str. 301
cagguauucggugugcagcg

SEQ ID NO: 3941469 - RNA, 18 nt, Shigella flexneri 2a str. 301
cagguauuuugucagccc

SEQ ID NO: 3941470 - RNA, 20 nt, Shigella flexneri 2a str. 301
caggucaccgaaaucgccaa

SEQ ID NO: 3941471 - RNA, 17 nt, Shigella flexneri 2a str. 301
caggucagcaggagcag

SEQ ID NO: 3941472 - RNA, 13 nt, Shigella flexneri 2a str. 301
caggucagucagu

SEQ ID NO: 3941473 - RNA, 19 nt, Shigella flexneri 2a str. 301
caggucagucaguggcagc

SEQ ID NO: 3941474 - RNA, 23 nt, Shigella flexneri 2a str. 301
caggucaucauugcagucauaac

SEQ ID NO: 3941475 - RNA, 15 nt, Shigella flexneri 2a str. 301
cagguccccgcuucg

SEQ ID NO: 3941476 - RNA, 22 nt, Shigella flexneri 2a str. 301
caggucgucuuuuacagcgcca

SEQ ID NO: 3941477 - RNA, 16 nt, Shigella flexneri 2a str. 301
caggugaaaaauaaaa

SEQ ID NO: 3941478 - RNA, 17 nt, Shigella flexneri 2a str. 301
caggugaaaaauaaaag

SEQ ID NO: 3941479 - RNA, 21 nt, Shigella flexneri 2a str. 301
caggugaccuguccuguaggc

SEQ ID NO: 3941480 - RNA, 17 nt, Shigella flexneri 2a str. 301
caggugacgcgggcagc

SEQ ID NO: 3941481 - RNA, 19 nt, Shigella flexneri 2a str. 301
caggugacgcgggcagcag

SEQ ID NO: 3941482 - RNA, 17 nt, Shigella flexneri 2a str. 301
caggugauacugacagc

SEQ ID NO: 3941483 - RNA, 21 nt, Shigella flexneri 2a str. 301
caggugaugcauagcaaccgc

SEQ ID NO: 3941484 - RNA, 11 nt, Shigella flexneri 2a str. 301
caggugcagcc

SEQ ID NO: 3941485 - RNA, 21 nt, Shigella flexneri 2a str. 301
caggugcagcccguaagcaaa

SEQ ID NO: 3941486 - RNA, 15 nt, Shigella flexneri 2a str. 301
caggugcgccagcga

SEQ ID NO: 3941487 - RNA, 19 nt, Shigella flexneri 2a str. 301
caggugggcgcuggcuccu

SEQ ID NO: 3941488 - RNA, 21 nt, Shigella flexneri 2a str. 301
caggugggcgcuggcuccuga

SEQ ID NO: 3941489 - RNA, 17 nt, Shigella flexneri 2a str. 301
caggugguuagcugcgu

SEQ ID NO: 3941490 - RNA, 19 nt, Shigella flexneri 2a str. 301
cagguguuauagcgcugaa

SEQ ID NO: 3941491 - RNA, 19 nt, Shigella flexneri 2a str. 301
cagguuaaugacccacccc

SEQ ID NO: 3941492 - RNA, 18 nt, Shigella flexneri 2a str. 301
cagguuacgcaccagaua

SEQ ID NO: 3941493 - RNA, 21 nt, Shigella flexneri 2a str. 301
cagguuauugacguuccccug

SEQ ID NO: 3941494 - RNA, 12 nt, Shigella flexneri 2a str. 301
cagguucaacag

SEQ ID NO: 3941495 - RNA, 18 nt, Shigella flexneri 2a str. 301
cagguuccccccacaauc

SEQ ID NO: 3941496 - RNA, 15 nt, Shigella flexneri 2a str. 301
cagguugcccagcgc

SEQ ID NO: 3941497 - RNA, 21 nt, Shigella flexneri 2a str. 301
cagguugcccagcgcgccgcc

SEQ ID NO: 3941498 - RNA, 13 nt, Shigella flexneri 2a str. 301
cagguugcucaua

SEQ ID NO: 3941499 - RNA, 23 nt, Shigella flexneri 2a str. 301
cagguuguacuuuccagccacag

SEQ ID NO: 3941500 - RNA, 17 nt, Shigella flexneri 2a str. 301
cagguuuaaacagagau

SEQ ID NO: 3941501 - RNA, 22 nt, Shigella flexneri 2a str. 301
cagucgugcgguaguuucuccc

SEQ ID NO: 3941502 - RNA, 19 nt, Shigella flexneri 2a str. 301
cagucguucaaccacuuca

SEQ ID NO: 3941503 - RNA, 14 nt, Shigella flexneri 2a str. 301
cagucucaaaccgg

SEQ ID NO: 3941504 - RNA, 21 nt, Shigella flexneri 2a str. 301
cagucugcgcccugggcuuca

SEQ ID NO: 3941505 - RNA, 22 nt, Shigella flexneri 2a str. 301
cagucuggacaaagagcuuuca

SEQ ID NO: 3941506 - RNA, 12 nt, Shigella flexneri 2a str. 301
cagucuggagca

SEQ ID NO: 3941507 - RNA, 22 nt, Shigella flexneri 2a str. 301
cagucuuaaaggggugaaaaaa

SEQ ID NO: 3941508 - RNA, 15 nt, Shigella flexneri 2a str. 301
cagucuucaucaucc

SEQ ID NO: 3941509 - RNA, 19 nt, Shigella flexneri 2a str. 301
cagucuucaucauccucuu

SEQ ID NO: 3941510 - RNA, 15 nt, Shigella flexneri 2a str. 301
cagugaaaccgugaa

SEQ ID NO: 3941511 - RNA, 18 nt, Shigella flexneri 2a str. 301
cagugaaaguuuucaccg

SEQ ID NO: 3941512 - RNA, 20 nt, Shigella flexneri 2a str. 301
cagugaacaauuaacguauc

SEQ ID NO: 3941513 - RNA, 11 nt, Shigella flexneri 2a str. 301
cagugaaccca

SEQ ID NO: 3941514 - RNA, 21 nt, Shigella flexneri 2a str. 301
cagugaacgcccccucacccu

SEQ ID NO: 3941515 - RNA, 22 nt, Shigella flexneri 2a str. 301
cagugaagucgggcagaaugcc

SEQ ID NO: 3941516 - RNA, 23 nt, Shigella flexneri 2a str. 301
cagugaagucgggcagaaugccc

SEQ ID NO: 3941517 - RNA, 21 nt, Shigella flexneri 2a str. 301
cagugacaaauuccgaacaaa

SEQ ID NO: 3941518 - RNA, 22 nt, Shigella flexneri 2a str. 301
cagugacagguugcucauaaaa

SEQ ID NO: 3941519 - RNA, 21 nt, Shigella flexneri 2a str. 301
cagugacaguguuauucccaa

SEQ ID NO: 3941520 - RNA, 14 nt, Shigella flexneri 2a str. 301
cagugaccaccguc

SEQ ID NO: 3941521 - RNA, 22 nt, Shigella flexneri 2a str. 301
cagugaccaccgucccaguaau

SEQ ID NO: 3941522 - RNA, 23 nt, Shigella flexneri 2a str. 301
cagugaccaccgucccaguaauu

SEQ ID NO: 3941523 - RNA, 18 nt, Shigella flexneri 2a str. 301
cagugaccaucuuccagc

SEQ ID NO: 3941524 - RNA, 21 nt, Shigella flexneri 2a str. 301
cagugaccaucuuccagcauc

SEQ ID NO: 3941525 - RNA, 18 nt, Shigella flexneri 2a str. 301
cagugacccgcagccagc

SEQ ID NO: 3941526 - RNA, 18 nt, Shigella flexneri 2a str. 301
cagugacuucugccagcu

SEQ ID NO: 3941527 - RNA, 19 nt, Shigella flexneri 2a str. 301
cagugaguccuguuucgga

SEQ ID NO: 3941528 - RNA, 14 nt, Shigella flexneri 2a str. 301
cagugauaacucaa

SEQ ID NO: 3941529 - RNA, 14 nt, Shigella flexneri 2a str. 301
cagugauauauuuu

SEQ ID NO: 3941530 - RNA, 14 nt, Shigella flexneri 2a str. 301
cagugauucauagu

SEQ ID NO: 3941531 - RNA, 19 nt, Shigella flexneri 2a str. 301
cagugauuucuucauuaaa

SEQ ID NO: 3941532 - RNA, 17 nt, Shigella flexneri 2a str. 301
cagugauuuuugcugaa

SEQ ID NO: 3941533 - RNA, 17 nt, Shigella flexneri 2a str. 301
cagugcaaaugccagau

SEQ ID NO: 3941534 - RNA, 22 nt, Shigella flexneri 2a str. 301
cagugcaggcaccagccccugg

SEQ ID NO: 3941535 - RNA, 13 nt, Shigella flexneri 2a str. 301
cagugcauuuucg

SEQ ID NO: 3941536 - RNA, 14 nt, Shigella flexneri 2a str. 301
cagugccaguucuu

SEQ ID NO: 3941537 - RNA, 20 nt, Shigella flexneri 2a str. 301
cagugccauuaacaggccaa

SEQ ID NO: 3941538 - RNA, 14 nt, Shigella flexneri 2a str. 301
cagugccccgagcg

SEQ ID NO: 3941539 - RNA, 19 nt, Shigella flexneri 2a str. 301
cagugccgaaaugucuucc

SEQ ID NO: 3941540 - RNA, 22 nt, Shigella flexneri 2a str. 301
cagugccgcacauagcaccacc

SEQ ID NO: 3941541 - RNA, 18 nt, Shigella flexneri 2a str. 301
cagugccgcccaccacuc

SEQ ID NO: 3941542 - RNA, 12 nt, Shigella flexneri 2a str. 301
cagugccgcgcc

SEQ ID NO: 3941543 - RNA, 17 nt, Shigella flexneri 2a str. 301
cagugccgguggaaggg

SEQ ID NO: 3941544 - RNA, 18 nt, Shigella flexneri 2a str. 301
cagugccucacgaucaca

SEQ ID NO: 3941545 - RNA, 20 nt, Shigella flexneri 2a str. 301
cagugccucacgaucacagc

SEQ ID NO: 3941546 - RNA, 14 nt, Shigella flexneri 2a str. 301
cagugcguaagcgc

SEQ ID NO: 3941547 - RNA, 20 nt, Shigella flexneri 2a str. 301
cagugcuccaccuugcggaa

SEQ ID NO: 3941548 - RNA, 20 nt, Shigella flexneri 2a str. 301
cagugcugauuuugcaacaa

SEQ ID NO: 3941549 - RNA, 17 nt, Shigella flexneri 2a str. 301
caguggcugauuggcau

SEQ ID NO: 3941550 - RNA, 20 nt, Shigella flexneri 2a str. 301
caguggcuuaucuuccuguu

SEQ ID NO: 3941551 - RNA, 14 nt, Shigella flexneri 2a str. 301
cagugggauuaaaa

SEQ ID NO: 3941552 - RNA, 16 nt, Shigella flexneri 2a str. 301
cagugggccagaaaaa

SEQ ID NO: 3941553 - RNA, 14 nt, Shigella flexneri 2a str. 301
cagugggcgcugcu

SEQ ID NO: 3941554 - RNA, 23 nt, Shigella flexneri 2a str. 301
caguggguaaugcugugaagaug

SEQ ID NO: 3941555 - RNA, 23 nt, Shigella flexneri 2a str. 301
caguggguuaugaaacuccaccg

SEQ ID NO: 3941556 - RNA, 13 nt, Shigella flexneri 2a str. 301
caguguccaacca

SEQ ID NO: 3941557 - RNA, 16 nt, Shigella flexneri 2a str. 301
caguguccagcggcau

SEQ ID NO: 3941558 - RNA, 20 nt, Shigella flexneri 2a str. 301
caguguuucgacaauaauca

SEQ ID NO: 3941559 - RNA, 18 nt, Shigella flexneri 2a str. 301
caguuaaccugcuccuca

SEQ ID NO: 3941560 - RNA, 22 nt, Shigella flexneri 2a str. 301
caguuaaccugcuccucaguuu

SEQ ID NO: 3941561 - RNA, 21 nt, Shigella flexneri 2a str. 301
caguuaacgcggauccccugc

SEQ ID NO: 3941562 - RNA, 22 nt, Shigella flexneri 2a str. 301
caguuaagcaauaccgcgaauc

SEQ ID NO: 3941563 - RNA, 17 nt, Shigella flexneri 2a str. 301
caguuacccagcggaua

SEQ ID NO: 3941564 - RNA, 14 nt, Shigella flexneri 2a str. 301
caguuacgcagacg

SEQ ID NO: 3941565 - RNA, 18 nt, Shigella flexneri 2a str. 301
caguuacugccaccaucc

SEQ ID NO: 3941566 - RNA, 12 nt, Shigella flexneri 2a str. 301
caguuauaaaau

SEQ ID NO: 3941567 - RNA, 19 nt, Shigella flexneri 2a str. 301
caguuaucaaauucauugc

SEQ ID NO: 3941568 - RNA, 18 nt, Shigella flexneri 2a str. 301
caguuauuuggcauaucg

SEQ ID NO: 3941569 - RNA, 21 nt, Shigella flexneri 2a str. 301
caguucaaagcguggugauac

SEQ ID NO: 3941570 - RNA, 23 nt, Shigella flexneri 2a str. 301
caguucaacgcggcgcugccgug

SEQ ID NO: 3941571 - RNA, 16 nt, Shigella flexneri 2a str. 301
caguucacaccagcca

SEQ ID NO: 3941572 - RNA, 22 nt, Shigella flexneri 2a str. 301
caguucacccucauucaccagu

SEQ ID NO: 3941573 - RNA, 16 nt, Shigella flexneri 2a str. 301
caguucacgaauauuu

SEQ ID NO: 3941574 - RNA, 19 nt, Shigella flexneri 2a str. 301
caguucacgaauauuuccc

SEQ ID NO: 3941575 - RNA, 22 nt, Shigella flexneri 2a str. 301
caguucacgaauauuucccggc

SEQ ID NO: 3941576 - RNA, 12 nt, Shigella flexneri 2a str. 301
caguucagaagc

SEQ ID NO: 3941577 - RNA, 18 nt, Shigella flexneri 2a str. 301
caguucagaagcugaagc

SEQ ID NO: 3941578 - RNA, 20 nt, Shigella flexneri 2a str. 301
caguucagaaggacgggauu

SEQ ID NO: 3941579 - RNA, 22 nt, Shigella flexneri 2a str. 301
caguucagcgauauccagcgau

SEQ ID NO: 3941580 - RNA, 22 nt, Shigella flexneri 2a str. 301
caguucauguucaucaauagcu

SEQ ID NO: 3941581 - RNA, 19 nt, Shigella flexneri 2a str. 301
caguuccacuucugcacgg

SEQ ID NO: 3941582 - RNA, 19 nt, Shigella flexneri 2a str. 301
caguuccagcagcgcaauu

SEQ ID NO: 3941583 - RNA, 18 nt, Shigella flexneri 2a str. 301
caguucccagggcuuucg

SEQ ID NO: 3941584 - RNA, 14 nt, Shigella flexneri 2a str. 301
caguucccccugcc

SEQ ID NO: 3941585 - RNA, 19 nt, Shigella flexneri 2a str. 301
caguuccgcaaagcccauc

SEQ ID NO: 3941586 - RNA, 22 nt, Shigella flexneri 2a str. 301
caguuccggcaucgacaguuuc

SEQ ID NO: 3941587 - RNA, 23 nt, Shigella flexneri 2a str. 301
caguuccggcaucgacaguuuca

SEQ ID NO: 3941588 - RNA, 12 nt, Shigella flexneri 2a str. 301
caguuccgggau

SEQ ID NO: 3941589 - RNA, 14 nt, Shigella flexneri 2a str. 301
caguuccugcaacu

SEQ ID NO: 3941590 - RNA, 17 nt, Shigella flexneri 2a str. 301
caguuccugcaacuucu

SEQ ID NO: 3941591 - RNA, 16 nt, Shigella flexneri 2a str. 301
caguucgauauccagu

SEQ ID NO: 3941592 - RNA, 14 nt, Shigella flexneri 2a str. 301
caguucgauuuccc

SEQ ID NO: 3941593 - RNA, 24 nt, Shigella flexneri 2a str. 301
caguucgcccgcuucaucgugcuc

SEQ ID NO: 3941594 - RNA, 20 nt, Shigella flexneri 2a str. 301
caguucgccguacugacggc

SEQ ID NO: 3941595 - RNA, 15 nt, Shigella flexneri 2a str. 301
caguucggaaacagu

SEQ ID NO: 3941596 - RNA, 16 nt, Shigella flexneri 2a str. 301
caguucuacuggaauu

SEQ ID NO: 3941597 - RNA, 18 nt, Shigella flexneri 2a str. 301
caguucuggaagagauga

SEQ ID NO: 3941598 - RNA, 18 nt, Shigella flexneri 2a str. 301
caguucuggcaccggacg

SEQ ID NO: 3941599 - RNA, 20 nt, Shigella flexneri 2a str. 301
caguucuggcaccggacgcu

SEQ ID NO: 3941600 - RNA, 15 nt, Shigella flexneri 2a str. 301
cauaaugugcgcaca

SEQ ID NO: 3941601 - RNA, 17 nt, Shigella flexneri 2a str. 301
cauaauuuccagcagug

SEQ ID NO: 3941602 - RNA, 12 nt, Shigella flexneri 2a str. 301
cauacaaauaag

SEQ ID NO: 3941603 - RNA, 22 nt, Shigella flexneri 2a str. 301
cauacaccguuuuacaacgcug

SEQ ID NO: 3941604 - RNA, 15 nt, Shigella flexneri 2a str. 301
cauacagcggacagc

SEQ ID NO: 3941605 - RNA, 17 nt, Shigella flexneri 2a str. 301
cauacagcggacagcca

SEQ ID NO: 3941606 - RNA, 19 nt, Shigella flexneri 2a str. 301
cauacagcuuuuacagcca

SEQ ID NO: 3941607 - RNA, 22 nt, Shigella flexneri 2a str. 301
cauacaucgcgcuuaucgccag

SEQ ID NO: 3941608 - RNA, 14 nt, Shigella flexneri 2a str. 301
cauaccacagcaaa

SEQ ID NO: 3941609 - RNA, 13 nt, Shigella flexneri 2a str. 301
cauaccaccgacg

SEQ ID NO: 3941610 - RNA, 15 nt, Shigella flexneri 2a str. 301
cauaccaccgacgug

SEQ ID NO: 3941611 - RNA, 16 nt, Shigella flexneri 2a str. 301
cauaccccacauaguu

SEQ ID NO: 3941612 - RNA, 21 nt, Shigella flexneri 2a str. 301
cauacccgccagugcugaagg

SEQ ID NO: 3941613 - RNA, 16 nt, Shigella flexneri 2a str. 301
cauacccggaaguaaa

SEQ ID NO: 3941614 - RNA, 17 nt, Shigella flexneri 2a str. 301
cauaccggacgacggca

SEQ ID NO: 3941615 - RNA, 15 nt, Shigella flexneri 2a str. 301
cauaccuaaaaaauc

SEQ ID NO: 3941616 - RNA, 16 nt, Shigella flexneri 2a str. 301
cauaccuaaaaaaucc

SEQ ID NO: 3941617 - RNA, 14 nt, Shigella flexneri 2a str. 301
cauaccuaaaagca

SEQ ID NO: 3941618 - RNA, 23 nt, Shigella flexneri 2a str. 301
cauaccuaaaagcacgccagaca

SEQ ID NO: 3941619 - RNA, 17 nt, Shigella flexneri 2a str. 301
cauaccuaccugcaguu

SEQ ID NO: 3941620 - RNA, 13 nt, Shigella flexneri 2a str. 301
cauaccugagugg

SEQ ID NO: 3941621 - RNA, 17 nt, Shigella flexneri 2a str. 301
cauaccuuccagcgcgu

SEQ ID NO: 3941622 - RNA, 18 nt, Shigella flexneri 2a str. 301
cauacgcguaaaacagcc

SEQ ID NO: 3941623 - RNA, 20 nt, Shigella flexneri 2a str. 301
cauacgcguaaaacagccag

SEQ ID NO: 3941624 - RNA, 20 nt, Shigella flexneri 2a str. 301
cauacggaaaaucucauuug

SEQ ID NO: 3941625 - RNA, 20 nt, Shigella flexneri 2a str. 301
cauacggcacuuucaucgcg

SEQ ID NO: 3941626 - RNA, 18 nt, Shigella flexneri 2a str. 301
cauacggguuuuccccuu

SEQ ID NO: 3941627 - RNA, 21 nt, Shigella flexneri 2a str. 301
cauacguacaaacgcuuuacu

SEQ ID NO: 3941628 - RNA, 22 nt, Shigella flexneri 2a str. 301
cauacguacaaacgcuuuacuc

SEQ ID NO: 3941629 - RNA, 15 nt, Shigella flexneri 2a str. 301
cauacguuucaccag

SEQ ID NO: 3941630 - RNA, 16 nt, Shigella flexneri 2a str. 301
cauacucagcgccugc

SEQ ID NO: 3941631 - RNA, 17 nt, Shigella flexneri 2a str. 301
cauacuccagucgcugc

SEQ ID NO: 3941632 - RNA, 15 nt, Shigella flexneri 2a str. 301
cauacucuccuccag

SEQ ID NO: 3941633 - RNA, 13 nt, Shigella flexneri 2a str. 301
cauacucuuucca

SEQ ID NO: 3941634 - RNA, 14 nt, Shigella flexneri 2a str. 301
cauacucuuugaca

SEQ ID NO: 3941635 - RNA, 19 nt, Shigella flexneri 2a str. 301
cauacucuuugacaacauc

SEQ ID NO: 3941636 - RNA, 18 nt, Shigella flexneri 2a str. 301
cauacugacaaacugcgc

SEQ ID NO: 3941637 - RNA, 12 nt, Shigella flexneri 2a str. 301
cauacugacgga

SEQ ID NO: 3941638 - RNA, 17 nt, Shigella flexneri 2a str. 301
cauacugcaucagcgcc

SEQ ID NO: 3941639 - RNA, 19 nt, Shigella flexneri 2a str. 301
cauacugcccgagcgccau

SEQ ID NO: 3941640 - RNA, 19 nt, Shigella flexneri 2a str. 301
cauacugccgaccaucugu

SEQ ID NO: 3941641 - RNA, 21 nt, Shigella flexneri 2a str. 301
cauacugggggcacugaaagc

SEQ ID NO: 3941642 - RNA, 16 nt, Shigella flexneri 2a str. 301
cauacugucuccacua

SEQ ID NO: 3941643 - RNA, 14 nt, Shigella flexneri 2a str. 301
cauacuuccacgca

SEQ ID NO: 3941644 - RNA, 22 nt, Shigella flexneri 2a str. 301
cauagaaaaagaauugcagaua

SEQ ID NO: 3941645 - RNA, 14 nt, Shigella flexneri 2a str. 301
cauagaccauugca

SEQ ID NO: 3941646 - RNA, 17 nt, Shigella flexneri 2a str. 301
cauagaggaauggcaga

SEQ ID NO: 3941647 - RNA, 15 nt, Shigella flexneri 2a str. 301
cauagauaccuucuu

SEQ ID NO: 3941648 - RNA, 22 nt, Shigella flexneri 2a str. 301
cauagaucuaaaugccacugaa

SEQ ID NO: 3941649 - RNA, 23 nt, Shigella flexneri 2a str. 301
cauagauuaauuucccaccacua

SEQ ID NO: 3941650 - RNA, 22 nt, Shigella flexneri 2a str. 301
cauagcaaccgcgacugggagg

SEQ ID NO: 3941651 - RNA, 14 nt, Shigella flexneri 2a str. 301
cauagcacacuuuc

SEQ ID NO: 3941652 - RNA, 21 nt, Shigella flexneri 2a str. 301
cauagcaucccaauacccgca

SEQ ID NO: 3941653 - RNA, 15 nt, Shigella flexneri 2a str. 301
cauagccgccgcgca

SEQ ID NO: 3941654 - RNA, 17 nt, Shigella flexneri 2a str. 301
cauagccuaauccuucu

SEQ ID NO: 3941655 - RNA, 15 nt, Shigella flexneri 2a str. 301
cauagcgacaggcuu

SEQ ID NO: 3941656 - RNA, 20 nt, Shigella flexneri 2a str. 301
cauagcgacaggcuuucuuc

SEQ ID NO: 3941657 - RNA, 15 nt, Shigella flexneri 2a str. 301
cauagcgcccuuuca

SEQ ID NO: 3941658 - RNA, 19 nt, Shigella flexneri 2a str. 301
cauagcgcccuuucagcgc

SEQ ID NO: 3941659 - RNA, 22 nt, Shigella flexneri 2a str. 301
cauagcgccucuuuauaaauau

SEQ ID NO: 3941660 - RNA, 16 nt, Shigella flexneri 2a str. 301
cauagcggagcaauuu

SEQ ID NO: 3941661 - RNA, 15 nt, Shigella flexneri 2a str. 301
cauagcgucccagua

SEQ ID NO: 3941662 - RNA, 16 nt, Shigella flexneri 2a str. 301
cauagcgugacaccag

SEQ ID NO: 3941663 - RNA, 13 nt, Shigella flexneri 2a str. 301
cauagcucgcuuc

SEQ ID NO: 3941664 - RNA, 15 nt, Shigella flexneri 2a str. 301
cauaggcggcaaaca

SEQ ID NO: 3941665 - RNA, 14 nt, Shigella flexneri 2a str. 301
cauaguagccagcc

SEQ ID NO: 3941666 - RNA, 17 nt, Shigella flexneri 2a str. 301
cauaguagccagccaga

SEQ ID NO: 3941667 - RNA, 19 nt, Shigella flexneri 2a str. 301
cauaguagccagccagaau

SEQ ID NO: 3941668 - RNA, 18 nt, Shigella flexneri 2a str. 301
cauagugcaaauccacuc

SEQ ID NO: 3941669 - RNA, 18 nt, Shigella flexneri 2a str. 301
cauaguggguuucugccg

SEQ ID NO: 3941670 - RNA, 19 nt, Shigella flexneri 2a str. 301
cauaguguguuccucugcu

SEQ ID NO: 3941671 - RNA, 20 nt, Shigella flexneri 2a str. 301
cauaguguguuccucugcuc

SEQ ID NO: 3941672 - RNA, 20 nt, Shigella flexneri 2a str. 301
cauauaaccggcaacagaac

SEQ ID NO: 3941673 - RNA, 12 nt, Shigella flexneri 2a str. 301
cauauaagcguu

SEQ ID NO: 3941674 - RNA, 15 nt, Shigella flexneri 2a str. 301
cauauaauacgcauc

SEQ ID NO: 3941675 - RNA, 15 nt, Shigella flexneri 2a str. 301
cauauaccgcaucag

SEQ ID NO: 3941676 - RNA, 20 nt, Shigella flexneri 2a str. 301
cauauaccgcaucagcaucg

SEQ ID NO: 3941677 - RNA, 18 nt, Shigella flexneri 2a str. 301
cauauaccgucagcgucu

SEQ ID NO: 3941678 - RNA, 10 nt, Shigella flexneri 2a str. 301
cauauaccuc

SEQ ID NO: 3941679 - RNA, 17 nt, Shigella flexneri 2a str. 301
cauauaccucagcagac

SEQ ID NO: 3941680 - RNA, 18 nt, Shigella flexneri 2a str. 301
cauauacgccaucgccag

SEQ ID NO: 3941681 - RNA, 23 nt, Shigella flexneri 2a str. 301
cauauacgccaucgccagcagcc

SEQ ID NO: 3941682 - RNA, 19 nt, Shigella flexneri 2a str. 301
cauauagccgcgcaguuuc

SEQ ID NO: 3941683 - RNA, 16 nt, Shigella flexneri 2a str. 301
cauauaggaggccucg

SEQ ID NO: 3941684 - RNA, 17 nt, Shigella flexneri 2a str. 301
cauaucaaaaagcugua

SEQ ID NO: 3941685 - RNA, 22 nt, Shigella flexneri 2a str. 301
cauaucaacgccucgcguccgc

SEQ ID NO: 3941686 - RNA, 19 nt, Shigella flexneri 2a str. 301
cauaucaauaguaaccaga

SEQ ID NO: 3941687 - RNA, 18 nt, Shigella flexneri 2a str. 301
cauaucacccuuuucugc

SEQ ID NO: 3941688 - RNA, 18 nt, Shigella flexneri 2a str. 301
cauaucaccguucacugc

SEQ ID NO: 3941689 - RNA, 15 nt, Shigella flexneri 2a str. 301
cauaucagcaacucu

SEQ ID NO: 3941690 - RNA, 21 nt, Shigella flexneri 2a str. 301
cauaucauucgacaacugcug

SEQ ID NO: 3941691 - RNA, 14 nt, Shigella flexneri 2a str. 301
cauauccaccaccc

SEQ ID NO: 3941692 - RNA, 20 nt, Shigella flexneri 2a str. 301
cauauccaccacccagcgcc

SEQ ID NO: 3941693 - RNA, 19 nt, Shigella flexneri 2a str. 301
cauaucgaaccagcggaca

SEQ ID NO: 3941694 - RNA, 16 nt, Shigella flexneri 2a str. 301
cauaucgguaaaugcu

SEQ ID NO: 3941695 - RNA, 18 nt, Shigella flexneri 2a str. 301
cauaucguagccccaguc

SEQ ID NO: 3941696 - RNA, 17 nt, Shigella flexneri 2a str. 301
cauaugauucauauugc

SEQ ID NO: 3941697 - RNA, 16 nt, Shigella flexneri 2a str. 301
cauaugcacaugauga

SEQ ID NO: 3941698 - RNA, 14 nt, Shigella flexneri 2a str. 301
cauaugcagcaucc

SEQ ID NO: 3941699 - RNA, 20 nt, Shigella flexneri 2a str. 301
cauaugcagcauccaacuga

SEQ ID NO: 3941700 - RNA, 16 nt, Shigella flexneri 2a str. 301
cgcgcacaucaggacg

SEQ ID NO: 3941701 - RNA, 15 nt, Shigella flexneri 2a str. 301
cgcgcaccuacagcc

SEQ ID NO: 3941702 - RNA, 21 nt, Shigella flexneri 2a str. 301
cgcgcaccuuuaaugcaucag

SEQ ID NO: 3941703 - RNA, 19 nt, Shigella flexneri 2a str. 301
cgcgcacgcccaucagcgg

SEQ ID NO: 3941704 - RNA, 20 nt, Shigella flexneri 2a str. 301
cgcgcacucgcccugaccug

SEQ ID NO: 3941705 - RNA, 17 nt, Shigella flexneri 2a str. 301
cgcgcagcgucgcauca

SEQ ID NO: 3941706 - RNA, 22 nt, Shigella flexneri 2a str. 301
cgcgcaggcggauugcuucugc

SEQ ID NO: 3941707 - RNA, 22 nt, Shigella flexneri 2a str. 301
cgcgcagggugcagaaucaauc

SEQ ID NO: 3941708 - RNA, 22 nt, Shigella flexneri 2a str. 301
cgcgcagugccgguggaagggc

SEQ ID NO: 3941709 - RNA, 18 nt, Shigella flexneri 2a str. 301
cgcgcaguucgucgcguu

SEQ ID NO: 3941710 - RNA, 18 nt, Shigella flexneri 2a str. 301
cgcgcaguuucuuaccua

SEQ ID NO: 3941711 - RNA, 22 nt, Shigella flexneri 2a str. 301
cgcgcaguuugucuucaaugcg

SEQ ID NO: 3941712 - RNA, 15 nt, Shigella flexneri 2a str. 301
cgcgcauaaugcaga

SEQ ID NO: 3941713 - RNA, 15 nt, Shigella flexneri 2a str. 301
cgcgcaucagcuccg

SEQ ID NO: 3941714 - RNA, 18 nt, Shigella flexneri 2a str. 301
cgcgccaagauagaacca

SEQ ID NO: 3941715 - RNA, 17 nt, Shigella flexneri 2a str. 301
cgcgccaaucagcgcag

SEQ ID NO: 3941716 - RNA, 13 nt, Shigella flexneri 2a str. 301
cgcgccaccauuc

SEQ ID NO: 3941717 - RNA, 14 nt, Shigella flexneri 2a str. 301
cgcgccaccgacca

SEQ ID NO: 3941718 - RNA, 18 nt, Shigella flexneri 2a str. 301
cgcgccagaaagcagcau

SEQ ID NO: 3941719 - RNA, 22 nt, Shigella flexneri 2a str. 301
cgcgccagaacacgcucccagc

SEQ ID NO: 3941720 - RNA, 12 nt, Shigella flexneri 2a str. 301
cgcgccagccag

SEQ ID NO: 3941721 - RNA, 16 nt, Shigella flexneri 2a str. 301
cgcgccagccuucacg

SEQ ID NO: 3941722 - RNA, 21 nt, Shigella flexneri 2a str. 301
cgcgccauauaauacgcaucg

SEQ ID NO: 3941723 - RNA, 21 nt, Shigella flexneri 2a str. 301
cgcgccauuucggcgugcugu

SEQ ID NO: 3941724 - RNA, 22 nt, Shigella flexneri 2a str. 301
cgcgccauuucggcgugcuguc

SEQ ID NO: 3941725 - RNA, 18 nt, Shigella flexneri 2a str. 301
cgcgcccauacggcucag

SEQ ID NO: 3941726 - RNA, 14 nt, Shigella flexneri 2a str. 301
cgcgccccacugga

SEQ ID NO: 3941727 - RNA, 13 nt, Shigella flexneri 2a str. 301
cgcgcccgcgcag

SEQ ID NO: 3941728 - RNA, 14 nt, Shigella flexneri 2a str. 301
cgcgcccgcgcagc

SEQ ID NO: 3941729 - RNA, 17 nt, Shigella flexneri 2a str. 301
cgcgcccuccugcagcg

SEQ ID NO: 3941730 - RNA, 13 nt, Shigella flexneri 2a str. 301
cgcgccgcauccg

SEQ ID NO: 3941731 - RNA, 20 nt, Shigella flexneri 2a str. 301
cgcgccgccaacccuucugc

SEQ ID NO: 3941732 - RNA, 21 nt, Shigella flexneri 2a str. 301
cgcgccgcgcugcuguagcag

SEQ ID NO: 3941733 - RNA, 21 nt, Shigella flexneri 2a str. 301
cgcgccgcgguacagcucggu

SEQ ID NO: 3941734 - RNA, 16 nt, Shigella flexneri 2a str. 301
cgcgccgggcagaguc

SEQ ID NO: 3941735 - RNA, 15 nt, Shigella flexneri 2a str. 301
cgcgccucaggcacu

SEQ ID NO: 3941736 - RNA, 13 nt, Shigella flexneri 2a str. 301
cgcgccugccagg

SEQ ID NO: 3941737 - RNA, 16 nt, Shigella flexneri 2a str. 301
cgcgccuucgugcggc

SEQ ID NO: 3941738 - RNA, 12 nt, Shigella flexneri 2a str. 301
cgcgcgcagcac

SEQ ID NO: 3941739 - RNA, 12 nt, Shigella flexneri 2a str. 301
cgcgcgccgcca

SEQ ID NO: 3941740 - RNA, 21 nt, Shigella flexneri 2a str. 301
cgcgcgcugccagaaccgcuu

SEQ ID NO: 3941741 - RNA, 18 nt, Shigella flexneri 2a str. 301
cgcgcggcgaaccagccg

SEQ ID NO: 3941742 - RNA, 15 nt, Shigella flexneri 2a str. 301
cgcgcguaugcguca

SEQ ID NO: 3941743 - RNA, 13 nt, Shigella flexneri 2a str. 301
cgcgcgucacgau

SEQ ID NO: 3941744 - RNA, 22 nt, Shigella flexneri 2a str. 301
cgcgcguccccugcccgcgauc

SEQ ID NO: 3941745 - RNA, 15 nt, Shigella flexneri 2a str. 301
cgcgcuacggccgcc

SEQ ID NO: 3941746 - RNA, 22 nt, Shigella flexneri 2a str. 301
cgcgcucgaagcgggcgcgcag

SEQ ID NO: 3941747 - RNA, 18 nt, Shigella flexneri 2a str. 301
cgcgcucugccagcaaau

SEQ ID NO: 3941748 - RNA, 14 nt, Shigella flexneri 2a str. 301
cgcgcucuucuucg

SEQ ID NO: 3941749 - RNA, 18 nt, Shigella flexneri 2a str. 301
cgcgcugagguccggcca

SEQ ID NO: 3941750 - RNA, 22 nt, Shigella flexneri 2a str. 301
cgcgcugccagaaccgcuucuu

SEQ ID NO: 3941751 - RNA, 15 nt, Shigella flexneri 2a str. 301
cgcgcugucgggcag

SEQ ID NO: 3941752 - RNA, 16 nt, Shigella flexneri 2a str. 301
cgcgcugucgggcagc

SEQ ID NO: 3941753 - RNA, 16 nt, Shigella flexneri 2a str. 301
cgcgcuuaacgcgggc

SEQ ID NO: 3941754 - RNA, 19 nt, Shigella flexneri 2a str. 301
cgcgcuuaucgccagcgcc

SEQ ID NO: 3941755 - RNA, 17 nt, Shigella flexneri 2a str. 301
cgcgcuucacaugccac

SEQ ID NO: 3941756 - RNA, 15 nt, Shigella flexneri 2a str. 301
cgcgcuucgguguua

SEQ ID NO: 3941757 - RNA, 14 nt, Shigella flexneri 2a str. 301
cgcgcuugccgccg

SEQ ID NO: 3941758 - RNA, 16 nt, Shigella flexneri 2a str. 301
cgcggaagacccggcg

SEQ ID NO: 3941759 - RNA, 19 nt, Shigella flexneri 2a str. 301
cgcggaagacccggcggcg

SEQ ID NO: 3941760 - RNA, 17 nt, Shigella flexneri 2a str. 301
cgcggacuccgcuguua

SEQ ID NO: 3941761 - RNA, 13 nt, Shigella flexneri 2a str. 301
cgcggauccccug

SEQ ID NO: 3941762 - RNA, 19 nt, Shigella flexneri 2a str. 301
cgcggaugcguuuuaccag

SEQ ID NO: 3941763 - RNA, 22 nt, Shigella flexneri 2a str. 301
cgcggauggccucugccagcug

SEQ ID NO: 3941764 - RNA, 23 nt, Shigella flexneri 2a str. 301
cgcggauggccucugccagcugc

SEQ ID NO: 3941765 - RNA, 19 nt, Shigella flexneri 2a str. 301
cgcggauuuuauucagcag

SEQ ID NO: 3941766 - RNA, 22 nt, Shigella flexneri 2a str. 301
cgcggcacacagcacggcagca

SEQ ID NO: 3941767 - RNA, 12 nt, Shigella flexneri 2a str. 301
cgcggcagcagg

SEQ ID NO: 3941768 - RNA, 21 nt, Shigella flexneri 2a str. 301
cgcggcagccaccgccagcgg

SEQ ID NO: 3941769 - RNA, 13 nt, Shigella flexneri 2a str. 301
cgcggcaggcauc

SEQ ID NO: 3941770 - RNA, 16 nt, Shigella flexneri 2a str. 301
cgcggcauacagccag

SEQ ID NO: 3941771 - RNA, 20 nt, Shigella flexneri 2a str. 301
cgcggcgaaggugccugccc

SEQ ID NO: 3941772 - RNA, 15 nt, Shigella flexneri 2a str. 301
cgcggcgacuuccag

SEQ ID NO: 3941773 - RNA, 23 nt, Shigella flexneri 2a str. 301
cgcggcgauaaugcccagcaacg

SEQ ID NO: 3941774 - RNA, 16 nt, Shigella flexneri 2a str. 301
cgcggcguaaccgccc

SEQ ID NO: 3941775 - RNA, 12 nt, Shigella flexneri 2a str. 301
cgcggcucgugg

SEQ ID NO: 3941776 - RNA, 20 nt, Shigella flexneri 2a str. 301
cgcggcuuugucauaaccaa

SEQ ID NO: 3941777 - RNA, 20 nt, Shigella flexneri 2a str. 301
cgcggguaaguacgccauca

SEQ ID NO: 3941778 - RNA, 14 nt, Shigella flexneri 2a str. 301
cgcgggucaccgcg

SEQ ID NO: 3941779 - RNA, 15 nt, Shigella flexneri 2a str. 301
cgcgguaaaagccca

SEQ ID NO: 3941780 - RNA, 17 nt, Shigella flexneri 2a str. 301
cgcgguaaacugcauga

SEQ ID NO: 3941781 - RNA, 17 nt, Shigella flexneri 2a str. 301
cgcgguaaagcgcggca

SEQ ID NO: 3941782 - RNA, 21 nt, Shigella flexneri 2a str. 301
cgcgguaaagcgcggcaguga

SEQ ID NO: 3941783 - RNA, 12 nt, Shigella flexneri 2a str. 301
cgcgguagcacg

SEQ ID NO: 3941784 - RNA, 17 nt, Shigella flexneri 2a str. 301
cgcgguagcacgucauc

SEQ ID NO: 3941785 - RNA, 14 nt, Shigella flexneri 2a str. 301
cgcggugcgccgua

SEQ ID NO: 3941786 - RNA, 16 nt, Shigella flexneri 2a str. 301
cgcgguguauaccagc

SEQ ID NO: 3941787 - RNA, 20 nt, Shigella flexneri 2a str. 301
cgcgguguugauacaggcgc

SEQ ID NO: 3941788 - RNA, 21 nt, Shigella flexneri 2a str. 301
cgcguaaauuugcucaucgau

SEQ ID NO: 3941789 - RNA, 14 nt, Shigella flexneri 2a str. 301
cgcguaacggcggu

SEQ ID NO: 3941790 - RNA, 16 nt, Shigella flexneri 2a str. 301
cgcguaacugaagcau

SEQ ID NO: 3941791 - RNA, 13 nt, Shigella flexneri 2a str. 301
cgcguaacugcug

SEQ ID NO: 3941792 - RNA, 19 nt, Shigella flexneri 2a str. 301
cgcguaagcgauauuguuu

SEQ ID NO: 3941793 - RNA, 17 nt, Shigella flexneri 2a str. 301
cgcguaaugcuucuacc

SEQ ID NO: 3941794 - RNA, 15 nt, Shigella flexneri 2a str. 301
cgcguaauggcagca

SEQ ID NO: 3941795 - RNA, 16 nt, Shigella flexneri 2a str. 301
cgcguacacuuuccug

SEQ ID NO: 3941796 - RNA, 14 nt, Shigella flexneri 2a str. 301
cgcguaccgcagca

SEQ ID NO: 3941797 - RNA, 13 nt, Shigella flexneri 2a str. 301
cgcguaccgccga

SEQ ID NO: 3941798 - RNA, 17 nt, Shigella flexneri 2a str. 301
cgcguagagaauccagu

SEQ ID NO: 3941799 - RNA, 19 nt, Shigella flexneri 2a str. 301
cgcguaugguuuuuccagc

SEQ ID NO: 3941800 - RNA, 16 nt, Shigella flexneri 2a str. 301
cgcgucagucgccccc

SEQ ID NO: 3941801 - RNA, 20 nt, Shigella flexneri 2a str. 301
cgcgucauugacgcuggcuu

SEQ ID NO: 3941802 - RNA, 19 nt, Shigella flexneri 2a str. 301
cgcguccggcgucgcuucu

SEQ ID NO: 3941803 - RNA, 19 nt, Shigella flexneri 2a str. 301
cgcgucggcgucagcgcca

SEQ ID NO: 3941804 - RNA, 20 nt, Shigella flexneri 2a str. 301
cgcgucguccccacagcguc

SEQ ID NO: 3941805 - RNA, 22 nt, Shigella flexneri 2a str. 301
cgcgucuuaucaugccuacggg

SEQ ID NO: 3941806 - RNA, 16 nt, Shigella flexneri 2a str. 301
cgcgucuuaucuggcc

SEQ ID NO: 3941807 - RNA, 22 nt, Shigella flexneri 2a str. 301
cgcgugccuaacaauucgccag

SEQ ID NO: 3941808 - RNA, 16 nt, Shigella flexneri 2a str. 301
cgcgugcgcggcagcc

SEQ ID NO: 3941809 - RNA, 19 nt, Shigella flexneri 2a str. 301
cgcguggaaaaacccauca

SEQ ID NO: 3941810 - RNA, 11 nt, Shigella flexneri 2a str. 301
cgcguggaaca

SEQ ID NO: 3941811 - RNA, 15 nt, Shigella flexneri 2a str. 301
cgcguguuccagaga

SEQ ID NO: 3941812 - RNA, 15 nt, Shigella flexneri 2a str. 301
cgcguuagccauaaa

SEQ ID NO: 3941813 - RNA, 15 nt, Shigella flexneri 2a str. 301
cgcguuauccgcuuu

SEQ ID NO: 3941814 - RNA, 22 nt, Shigella flexneri 2a str. 301
cgcguugaugccgugcagcacg

SEQ ID NO: 3941815 - RNA, 20 nt, Shigella flexneri 2a str. 301
cgcguugcuuauugccggau

SEQ ID NO: 3941816 - RNA, 22 nt, Shigella flexneri 2a str. 301
cgcguuguauaacguggugaaa

SEQ ID NO: 3941817 - RNA, 17 nt, Shigella flexneri 2a str. 301
cgcguuuaaucacacca

SEQ ID NO: 3941818 - RNA, 14 nt, Shigella flexneri 2a str. 301
cgcguuuacagagc

SEQ ID NO: 3941819 - RNA, 21 nt, Shigella flexneri 2a str. 301
cgcguuucugcgcuucugcca

SEQ ID NO: 3941820 - RNA, 18 nt, Shigella flexneri 2a str. 301
cgcuaaaaagcgccguuu

SEQ ID NO: 3941821 - RNA, 17 nt, Shigella flexneri 2a str. 301
cgcuaaacaggaucugg

SEQ ID NO: 3941822 - RNA, 13 nt, Shigella flexneri 2a str. 301
cgcuaaaugccgc

SEQ ID NO: 3941823 - RNA, 13 nt, Shigella flexneri 2a str. 301
cgcuaaauguuua

SEQ ID NO: 3941824 - RNA, 13 nt, Shigella flexneri 2a str. 301
cgcuaacagcagc

SEQ ID NO: 3941825 - RNA, 17 nt, Shigella flexneri 2a str. 301
cgcuaaccgccugaaau

SEQ ID NO: 3941826 - RNA, 16 nt, Shigella flexneri 2a str. 301
cgcuaaucgcaccgac

SEQ ID NO: 3941827 - RNA, 19 nt, Shigella flexneri 2a str. 301
cgcuaaugcgacccaugca

SEQ ID NO: 3941828 - RNA, 21 nt, Shigella flexneri 2a str. 301
cgcuaaugcgacccaugcacc

SEQ ID NO: 3941829 - RNA, 14 nt, Shigella flexneri 2a str. 301
cgcuaccaccaaac

SEQ ID NO: 3941830 - RNA, 18 nt, Shigella flexneri 2a str. 301
cgcuaccaggaagcgacc

SEQ ID NO: 3941831 - RNA, 17 nt, Shigella flexneri 2a str. 301
cgcuaccauuugcgcgg

SEQ ID NO: 3941832 - RNA, 12 nt, Shigella flexneri 2a str. 301
cgcuaccgccga

SEQ ID NO: 3941833 - RNA, 20 nt, Shigella flexneri 2a str. 301
cgcuaccugccgccaccaug

SEQ ID NO: 3941834 - RNA, 13 nt, Shigella flexneri 2a str. 301
cgcuacgacguuc

SEQ ID NO: 3941835 - RNA, 14 nt, Shigella flexneri 2a str. 301
cgcuacuggacauu

SEQ ID NO: 3941836 - RNA, 13 nt, Shigella flexneri 2a str. 301
cgcuacuggcaau

SEQ ID NO: 3941837 - RNA, 15 nt, Shigella flexneri 2a str. 301
cgcuacuucaaacaa

SEQ ID NO: 3941838 - RNA, 18 nt, Shigella flexneri 2a str. 301
cgcuagcgucguggcaaa

SEQ ID NO: 3941839 - RNA, 21 nt, Shigella flexneri 2a str. 301
cgcuagcgucguggcaaaaug

SEQ ID NO: 3941840 - RNA, 20 nt, Shigella flexneri 2a str. 301
cgcuaguacccgaucacaac

SEQ ID NO: 3941841 - RNA, 15 nt, Shigella flexneri 2a str. 301
cgcuagugcauugag

SEQ ID NO: 3941842 - RNA, 20 nt, Shigella flexneri 2a str. 301
cgcuaucaauacuuuccagc

SEQ ID NO: 3941843 - RNA, 14 nt, Shigella flexneri 2a str. 301
cgcuaucagcgcca

SEQ ID NO: 3941844 - RNA, 15 nt, Shigella flexneri 2a str. 301
cgcuauccagcgcau

SEQ ID NO: 3941845 - RNA, 14 nt, Shigella flexneri 2a str. 301
cgcuauguuuauca

SEQ ID NO: 3941846 - RNA, 19 nt, Shigella flexneri 2a str. 301
cgcuauucgaaccaacacu

SEQ ID NO: 3941847 - RNA, 23 nt, Shigella flexneri 2a str. 301
cgcuauuugcgccuggauuuucu

SEQ ID NO: 3941848 - RNA, 18 nt, Shigella flexneri 2a str. 301
cgcucaauaaucaaucuu

SEQ ID NO: 3941849 - RNA, 15 nt, Shigella flexneri 2a str. 301
cgcucaaugcgcuga

SEQ ID NO: 3941850 - RNA, 12 nt, Shigella flexneri 2a str. 301
cgcucacgcagc

SEQ ID NO: 3941851 - RNA, 18 nt, Shigella flexneri 2a str. 301
cgcucacgcagcggcggc

SEQ ID NO: 3941852 - RNA, 17 nt, Shigella flexneri 2a str. 301
cgcucacgcgcugccuc

SEQ ID NO: 3941853 - RNA, 13 nt, Shigella flexneri 2a str. 301
cgcucacugcaaa

SEQ ID NO: 3941854 - RNA, 15 nt, Shigella flexneri 2a str. 301
cgcucagcaauugca

SEQ ID NO: 3941855 - RNA, 16 nt, Shigella flexneri 2a str. 301
cgcucagcgccacauc

SEQ ID NO: 3941856 - RNA, 19 nt, Shigella flexneri 2a str. 301
cgcucaggguaccgauaga

SEQ ID NO: 3941857 - RNA, 22 nt, Shigella flexneri 2a str. 301
cgcucagucggcgcuuuugcau

SEQ ID NO: 3941858 - RNA, 13 nt, Shigella flexneri 2a str. 301
cgcucauaaccaa

SEQ ID NO: 3941859 - RNA, 14 nt, Shigella flexneri 2a str. 301
cgcucauacuucca

SEQ ID NO: 3941860 - RNA, 15 nt, Shigella flexneri 2a str. 301
cgcucaucaggccua

SEQ ID NO: 3941861 - RNA, 20 nt, Shigella flexneri 2a str. 301
cgcucaucgaagagacaaaa

SEQ ID NO: 3941862 - RNA, 12 nt, Shigella flexneri 2a str. 301
cgcucaucggca

SEQ ID NO: 3941863 - RNA, 14 nt, Shigella flexneri 2a str. 301
cgcucaucugcugc

SEQ ID NO: 3941864 - RNA, 17 nt, Shigella flexneri 2a str. 301
cgcucaucugcugcguu

SEQ ID NO: 3941865 - RNA, 20 nt, Shigella flexneri 2a str. 301
cgcucauuuucucuuucagc

SEQ ID NO: 3941866 - RNA, 22 nt, Shigella flexneri 2a str. 301
cgcuccaaggucuccgcccagc

SEQ ID NO: 3941867 - RNA, 12 nt, Shigella flexneri 2a str. 301
cgcuccacuuca

SEQ ID NO: 3941868 - RNA, 12 nt, Shigella flexneri 2a str. 301
cgcuccauucca

SEQ ID NO: 3941869 - RNA, 19 nt, Shigella flexneri 2a str. 301
cgcuccauugcccgcccga

SEQ ID NO: 3941870 - RNA, 18 nt, Shigella flexneri 2a str. 301
cgcucccggauaucccag

SEQ ID NO: 3941871 - RNA, 20 nt, Shigella flexneri 2a str. 301
cgcucccggcugcaaccaga

SEQ ID NO: 3941872 - RNA, 13 nt, Shigella flexneri 2a str. 301
cgcucccugccag

SEQ ID NO: 3941873 - RNA, 17 nt, Shigella flexneri 2a str. 301
cgcuccgcaccugagua

SEQ ID NO: 3941874 - RNA, 14 nt, Shigella flexneri 2a str. 301
cgcuccgucagcac

SEQ ID NO: 3941875 - RNA, 19 nt, Shigella flexneri 2a str. 301
cgcucgagagagaaaauaa

SEQ ID NO: 3941876 - RNA, 19 nt, Shigella flexneri 2a str. 301
cgcucgccaaagcagugaa

SEQ ID NO: 3941877 - RNA, 13 nt, Shigella flexneri 2a str. 301
cgcucgcgccgca

SEQ ID NO: 3941878 - RNA, 20 nt, Shigella flexneri 2a str. 301
cgcucgcgccgcauccgaca

SEQ ID NO: 3941879 - RNA, 15 nt, Shigella flexneri 2a str. 301
cgcucggcggcuggc

SEQ ID NO: 3941880 - RNA, 20 nt, Shigella flexneri 2a str. 301
cgcucggcuguuucuggaug

SEQ ID NO: 3941881 - RNA, 18 nt, Shigella flexneri 2a str. 301
cgcucgguagugccaacg

SEQ ID NO: 3941882 - RNA, 16 nt, Shigella flexneri 2a str. 301
cgcucguugcagaaug

SEQ ID NO: 3941883 - RNA, 17 nt, Shigella flexneri 2a str. 301
cgcucucaagccacuuu

SEQ ID NO: 3941884 - RNA, 20 nt, Shigella flexneri 2a str. 301
cgcucucaagccacuuuccu

SEQ ID NO: 3941885 - RNA, 13 nt, Shigella flexneri 2a str. 301
cgcucucagcugg

SEQ ID NO: 3941886 - RNA, 13 nt, Shigella flexneri 2a str. 301
cgcucugagcugc

SEQ ID NO: 3941887 - RNA, 21 nt, Shigella flexneri 2a str. 301
cgcucuucgaggccgcggcuc

SEQ ID NO: 3941888 - RNA, 19 nt, Shigella flexneri 2a str. 301
cgcucuuguucuuccggca

SEQ ID NO: 3941889 - RNA, 21 nt, Shigella flexneri 2a str. 301
cgcucuuuuguucgcggcggc

SEQ ID NO: 3941890 - RNA, 23 nt, Shigella flexneri 2a str. 301
cgcucuuuuguucgcggcggccu

SEQ ID NO: 3941891 - RNA, 21 nt, Shigella flexneri 2a str. 301
cgcugaaagcugaacaaagcc

SEQ ID NO: 3941892 - RNA, 22 nt, Shigella flexneri 2a str. 301
cgcugaaagcugaacaaagccg

SEQ ID NO: 3941893 - RNA, 19 nt, Shigella flexneri 2a str. 301
cgcugaaaggauuucgcaa

SEQ ID NO: 3941894 - RNA, 17 nt, Shigella flexneri 2a str. 301
cgcugaacgcaccuucc

SEQ ID NO: 3941895 - RNA, 22 nt, Shigella flexneri 2a str. 301
cgcugaacugauugccacccug

SEQ ID NO: 3941896 - RNA, 16 nt, Shigella flexneri 2a str. 301
cgcugaacuggcgaag

SEQ ID NO: 3941897 - RNA, 17 nt, Shigella flexneri 2a str. 301
cgcugaagaaaauggcc

SEQ ID NO: 3941898 - RNA, 22 nt, Shigella flexneri 2a str. 301
cgcugaagaaaauggccagcca

SEQ ID NO: 3941899 - RNA, 19 nt, Shigella flexneri 2a str. 301
cgcugaauaaacucaccaa

SEQ ID NO: 3941900 - RNA, 22 nt, Shigella flexneri 2a str. 301
cgcugaaucaacaggcgguaac

SEQ ID NO: 3941901 - RNA, 13 nt, Shigella flexneri 2a str. 301
cgcugacagcgcg

SEQ ID NO: 3941902 - RNA, 23 nt, Shigella flexneri 2a str. 301
cgcugacauuacgcgcuucguug

SEQ ID NO: 3941903 - RNA, 14 nt, Shigella flexneri 2a str. 301
cgcugacggcagcg

SEQ ID NO: 3941904 - RNA, 22 nt, Shigella flexneri 2a str. 301
cgcugacguuauugaucgccag

SEQ ID NO: 3941905 - RNA, 15 nt, Shigella flexneri 2a str. 301
cgcugacucuacuga

SEQ ID NO: 3941906 - RNA, 16 nt, Shigella flexneri 2a str. 301
cgcugagagaagcacg

SEQ ID NO: 3941907 - RNA, 22 nt, Shigella flexneri 2a str. 301
cgcugagcgauaaaaucagaaa

SEQ ID NO: 3941908 - RNA, 18 nt, Shigella flexneri 2a str. 301
cgcugagguuaugcaaac

SEQ ID NO: 3941909 - RNA, 20 nt, Shigella flexneri 2a str. 301
cgcugagugugaauaccgcu

SEQ ID NO: 3941910 - RNA, 17 nt, Shigella flexneri 2a str. 301
cgcugauaaaucccgcc

SEQ ID NO: 3941911 - RNA, 17 nt, Shigella flexneri 2a str. 301
cgcugauauacccuuca

SEQ ID NO: 3941912 - RNA, 15 nt, Shigella flexneri 2a str. 301
cgcugauuaccuucc

SEQ ID NO: 3941913 - RNA, 12 nt, Shigella flexneri 2a str. 301
cgcugauucaag

SEQ ID NO: 3941914 - RNA, 16 nt, Shigella flexneri 2a str. 301
cgcugauugcuuucuu

SEQ ID NO: 3941915 - RNA, 20 nt, Shigella flexneri 2a str. 301
cgcugauuggccccauugcc

SEQ ID NO: 3941916 - RNA, 19 nt, Shigella flexneri 2a str. 301
cgcugauugggaaaucaga

SEQ ID NO: 3941917 - RNA, 22 nt, Shigella flexneri 2a str. 301
cgcugauuugcuucaauacgcu

SEQ ID NO: 3941918 - RNA, 22 nt, Shigella flexneri 2a str. 301
cgcugcaaggcucuauacgcau

SEQ ID NO: 3941919 - RNA, 21 nt, Shigella flexneri 2a str. 301
cgcugcacaauugccagcccu

SEQ ID NO: 3941920 - RNA, 14 nt, Shigella flexneri 2a str. 301
cgcugcacuuucuc

SEQ ID NO: 3941921 - RNA, 17 nt, Shigella flexneri 2a str. 301
cgcugcauugcccaaua

SEQ ID NO: 3941922 - RNA, 13 nt, Shigella flexneri 2a str. 301
cgcugccagccgc

SEQ ID NO: 3941923 - RNA, 17 nt, Shigella flexneri 2a str. 301
cgcugccagccgccgcu

SEQ ID NO: 3941924 - RNA, 18 nt, Shigella flexneri 2a str. 301
cgcugccccugguuaucu

SEQ ID NO: 3941925 - RNA, 13 nt, Shigella flexneri 2a str. 301
cgcugccgcuucu

SEQ ID NO: 3941926 - RNA, 21 nt, Shigella flexneri 2a str. 301
cgcugcgcuuacacacccggc

SEQ ID NO: 3941927 - RNA, 19 nt, Shigella flexneri 2a str. 301
cgcugcgcuuauccggccc

SEQ ID NO: 3941928 - RNA, 17 nt, Shigella flexneri 2a str. 301
cgcugcggcgcgcaucu

SEQ ID NO: 3941929 - RNA, 13 nt, Shigella flexneri 2a str. 301
cgcugcuaauuua

SEQ ID NO: 3941930 - RNA, 19 nt, Shigella flexneri 2a str. 301
cgcugcuuguuccacuuca

SEQ ID NO: 3941931 - RNA, 20 nt, Shigella flexneri 2a str. 301
cgcugcuuguuccacuucau

SEQ ID NO: 3941932 - RNA, 16 nt, Shigella flexneri 2a str. 301
cgcugcuuuccugcug

SEQ ID NO: 3941933 - RNA, 22 nt, Shigella flexneri 2a str. 301
cgcuggagaacaaggcuuuaau

SEQ ID NO: 3941934 - RNA, 17 nt, Shigella flexneri 2a str. 301
cgcuggagcacccgcgc

SEQ ID NO: 3941935 - RNA, 23 nt, Shigella flexneri 2a str. 301
cgcuggcagcugcuacgccguca

SEQ ID NO: 3941936 - RNA, 13 nt, Shigella flexneri 2a str. 301
cgcuggcgcaugu

SEQ ID NO: 3941937 - RNA, 15 nt, Shigella flexneri 2a str. 301
cgcuggcgcgccgcc

SEQ ID NO: 3941938 - RNA, 19 nt, Shigella flexneri 2a str. 301
cgcuggcgcucaagucgaa

SEQ ID NO: 3941939 - RNA, 23 nt, Shigella flexneri 2a str. 301
cgcuggcgggcguuaucacguug

SEQ ID NO: 3941940 - RNA, 16 nt, Shigella flexneri 2a str. 301
cgcuggcgucacgccg

SEQ ID NO: 3941941 - RNA, 18 nt, Shigella flexneri 2a str. 301
cgcugggagaauugcgaa

SEQ ID NO: 3941942 - RNA, 19 nt, Shigella flexneri 2a str. 301
cgcuggugaguaacgcgga

SEQ ID NO: 3941943 - RNA, 14 nt, Shigella flexneri 2a str. 301
cgcugguguacugc

SEQ ID NO: 3941944 - RNA, 17 nt, Shigella flexneri 2a str. 301
cgcugguuaccaccugc

SEQ ID NO: 3941945 - RNA, 18 nt, Shigella flexneri 2a str. 301
cgcuguaauuaccagcgc

SEQ ID NO: 3941946 - RNA, 20 nt, Shigella flexneri 2a str. 301
cgcuguaauuuuuuuauuga

SEQ ID NO: 3941947 - RNA, 20 nt, Shigella flexneri 2a str. 301
cgcuguacgguaauggcaaa

SEQ ID NO: 3941948 - RNA, 16 nt, Shigella flexneri 2a str. 301
cgcuguauuuugcguu

SEQ ID NO: 3941949 - RNA, 16 nt, Shigella flexneri 2a str. 301
cgcuguccggcgcacu

SEQ ID NO: 3941950 - RNA, 17 nt, Shigella flexneri 2a str. 301
cgcugucggugccauca

SEQ ID NO: 3941951 - RNA, 20 nt, Shigella flexneri 2a str. 301
cgcugucuggcgucuccugc

SEQ ID NO: 3941952 - RNA, 15 nt, Shigella flexneri 2a str. 301
cgcugucuuccuggu

SEQ ID NO: 3941953 - RNA, 19 nt, Shigella flexneri 2a str. 301
cgcugucuuuugaucaaau

SEQ ID NO: 3941954 - RNA, 16 nt, Shigella flexneri 2a str. 301
cgcugugagcaggcgu

SEQ ID NO: 3941955 - RNA, 23 nt, Shigella flexneri 2a str. 301
cgcugugcugcugacguagcagc

SEQ ID NO: 3941956 - RNA, 15 nt, Shigella flexneri 2a str. 301
cgcuguguaaaccca

SEQ ID NO: 3941957 - RNA, 23 nt, Shigella flexneri 2a str. 301
cgcuguguaaacccagccgcguc

SEQ ID NO: 3941958 - RNA, 19 nt, Shigella flexneri 2a str. 301
cgcuguguguaggccagcg

SEQ ID NO: 3941959 - RNA, 20 nt, Shigella flexneri 2a str. 301
cgcugugugugcugauuucg

SEQ ID NO: 3941960 - RNA, 20 nt, Shigella flexneri 2a str. 301
cgcuguugaggcacaucuua

SEQ ID NO: 3941961 - RNA, 15 nt, Shigella flexneri 2a str. 301
cgcuguugucugaau

SEQ ID NO: 3941962 - RNA, 17 nt, Shigella flexneri 2a str. 301
cgcuguugucugaauga

SEQ ID NO: 3941963 - RNA, 19 nt, Shigella flexneri 2a str. 301
cgcuguuuagcgcggcaau

SEQ ID NO: 3941964 - RNA, 20 nt, Shigella flexneri 2a str. 301
cgcuuaaccccgggcuggau

SEQ ID NO: 3941965 - RNA, 15 nt, Shigella flexneri 2a str. 301
cgcuuaacgcgggcu

SEQ ID NO: 3941966 - RNA, 14 nt, Shigella flexneri 2a str. 301
cgcuuaacgcgucu

SEQ ID NO: 3941967 - RNA, 23 nt, Shigella flexneri 2a str. 301
cgcuuaaucaauugcaggaaggu

SEQ ID NO: 3941968 - RNA, 17 nt, Shigella flexneri 2a str. 301
cgcuuacccuaaauccg

SEQ ID NO: 3941969 - RNA, 17 nt, Shigella flexneri 2a str. 301
cgcuuacgccugccagc

SEQ ID NO: 3941970 - RNA, 14 nt, Shigella flexneri 2a str. 301
cgcuuaucaggccu

SEQ ID NO: 3941971 - RNA, 19 nt, Shigella flexneri 2a str. 301
cgcuuaucaggccuacgcg

SEQ ID NO: 3941972 - RNA, 15 nt, Shigella flexneri 2a str. 301
cgcuuaucccagcca

SEQ ID NO: 3941973 - RNA, 14 nt, Shigella flexneri 2a str. 301
cgcuuauccggccc

SEQ ID NO: 3941974 - RNA, 19 nt, Shigella flexneri 2a str. 301
cgcuucaaggugcgcgaug

SEQ ID NO: 3941975 - RNA, 14 nt, Shigella flexneri 2a str. 301
cgcuucaccaauca

SEQ ID NO: 3941976 - RNA, 13 nt, Shigella flexneri 2a str. 301
cgcuucaccaccg

SEQ ID NO: 3941977 - RNA, 22 nt, Shigella flexneri 2a str. 301
cgcuucaccgacaucuuucugc

SEQ ID NO: 3941978 - RNA, 14 nt, Shigella flexneri 2a str. 301
cgcuucaggaauaa

SEQ ID NO: 3941979 - RNA, 16 nt, Shigella flexneri 2a str. 301
cgcuucagucgccagc

SEQ ID NO: 3941980 - RNA, 19 nt, Shigella flexneri 2a str. 301
cgcuucagugacuucugcc

SEQ ID NO: 3941981 - RNA, 18 nt, Shigella flexneri 2a str. 301
cgcuucaugcuuaaucau

SEQ ID NO: 3941982 - RNA, 13 nt, Shigella flexneri 2a str. 301
cgcuuccagcaga

SEQ ID NO: 3941983 - RNA, 19 nt, Shigella flexneri 2a str. 301
cgcuuccagcgcaucugcc

SEQ ID NO: 3941984 - RNA, 16 nt, Shigella flexneri 2a str. 301
cgcuuccagcuccgcu

SEQ ID NO: 3941985 - RNA, 23 nt, Shigella flexneri 2a str. 301
cgcuuccauugagaaagcccugg

SEQ ID NO: 3941986 - RNA, 14 nt, Shigella flexneri 2a str. 301
cgcuuccugcaacg

SEQ ID NO: 3941987 - RNA, 17 nt, Shigella flexneri 2a str. 301
cgcuucgagauugcgga

SEQ ID NO: 3941988 - RNA, 16 nt, Shigella flexneri 2a str. 301
cgcuucggcgccuuuu

SEQ ID NO: 3941989 - RNA, 21 nt, Shigella flexneri 2a str. 301
cgcuucggcuccagcgcgucu

SEQ ID NO: 3941990 - RNA, 21 nt, Shigella flexneri 2a str. 301
cgcuucgguuuucgcgccagc

SEQ ID NO: 3941991 - RNA, 23 nt, Shigella flexneri 2a str. 301
cgcuucgguuuucgcgccagcca

SEQ ID NO: 3941992 - RNA, 14 nt, Shigella flexneri 2a str. 301
cgcuucucccagcc

SEQ ID NO: 3941993 - RNA, 13 nt, Shigella flexneri 2a str. 301
cgcuucugcguuc

SEQ ID NO: 3941994 - RNA, 11 nt, Shigella flexneri 2a str. 301
cgcuucugcuu

SEQ ID NO: 3941995 - RNA, 17 nt, Shigella flexneri 2a str. 301
cgcuucuggcggcggca

SEQ ID NO: 3941996 - RNA, 19 nt, Shigella flexneri 2a str. 301
cgcuucugguuauauuucc

SEQ ID NO: 3941997 - RNA, 16 nt, Shigella flexneri 2a str. 301
cgcuucugucgcuuca

SEQ ID NO: 3941998 - RNA, 13 nt, Shigella flexneri 2a str. 301
cgcuugacgcguc

SEQ ID NO: 3941999 - RNA, 14 nt, Shigella flexneri 2a str. 301
cgcuugacgcgucu

SEQ ID NO: 3942000 - RNA, 21 nt, Shigella flexneri 2a str. 301
cgcuugagcaggagcagcagg

SEQ ID NO: 3942001 - RNA, 20 nt, Shigella flexneri 2a str. 301
cgcuugaguauuuaccagaa

SEQ ID NO: 3942002 - RNA, 19 nt, Shigella flexneri 2a str. 301
cgcuugauucuguucagua

SEQ ID NO: 3942003 - RNA, 19 nt, Shigella flexneri 2a str. 301
cgcuugccugugccacggc

SEQ ID NO: 3942004 - RNA, 23 nt, Shigella flexneri 2a str. 301
cgcuugcguaucgacggcguauu

SEQ ID NO: 3942005 - RNA, 15 nt, Shigella flexneri 2a str. 301
cgcuugcucgcgcac

SEQ ID NO: 3942006 - RNA, 22 nt, Shigella flexneri 2a str. 301
cgcuugcugauaacgugcagcu

SEQ ID NO: 3942007 - RNA, 23 nt, Shigella flexneri 2a str. 301
cgcuugcugauaacgugcagcuu

SEQ ID NO: 3942008 - RNA, 20 nt, Shigella flexneri 2a str. 301
cgcuuggcaagcccagcacc

SEQ ID NO: 3942009 - RNA, 18 nt, Shigella flexneri 2a str. 301
cgcuugucacuucugccu

SEQ ID NO: 3942010 - RNA, 20 nt, Shigella flexneri 2a str. 301
cgcuuuacaauauccagcgc

SEQ ID NO: 3942011 - RNA, 14 nt, Shigella flexneri 2a str. 301
cgcuuuacguuccu

SEQ ID NO: 3942012 - RNA, 16 nt, Shigella flexneri 2a str. 301
cgcuuuaucgccgcug

SEQ ID NO: 3942013 - RNA, 14 nt, Shigella flexneri 2a str. 301
cgcuuucaggucag

SEQ ID NO: 3942014 - RNA, 15 nt, Shigella flexneri 2a str. 301
cgcuuucagugucug

SEQ ID NO: 3942015 - RNA, 23 nt, Shigella flexneri 2a str. 301
cgcuuucauguuaaauuccggcu

SEQ ID NO: 3942016 - RNA, 17 nt, Shigella flexneri 2a str. 301
cgcuuucgcuuucucuu

SEQ ID NO: 3942017 - RNA, 17 nt, Shigella flexneri 2a str. 301
cgcuuucucugcaagaa

SEQ ID NO: 3942018 - RNA, 23 nt, Shigella flexneri 2a str. 301
cgcuuucugagcggccuuuuccu

SEQ ID NO: 3942019 - RNA, 15 nt, Shigella flexneri 2a str. 301
cgcuuugcaccagaa

SEQ ID NO: 3942020 - RNA, 14 nt, Shigella flexneri 2a str. 301
cgcuuugccaccca

SEQ ID NO: 3942021 - RNA, 14 nt, Shigella flexneri 2a str. 301
cgcuuuggaaggua

SEQ ID NO: 3942022 - RNA, 20 nt, Shigella flexneri 2a str. 301
cgcuuugggcucaucaauac

SEQ ID NO: 3942023 - RNA, 19 nt, Shigella flexneri 2a str. 301
cgcuuuguuuaugccggau

SEQ ID NO: 3942024 - RNA, 13 nt, Shigella flexneri 2a str. 301
cgcuuuuaccagc

SEQ ID NO: 3942025 - RNA, 16 nt, Shigella flexneri 2a str. 301
cgcuuuuggcaggaac

SEQ ID NO: 3942026 - RNA, 21 nt, Shigella flexneri 2a str. 301
cgcuuuuuccaggcuggcagg

SEQ ID NO: 3942027 - RNA, 16 nt, Shigella flexneri 2a str. 301
cgcuuuuucugcgcac

SEQ ID NO: 3942028 - RNA, 19 nt, Shigella flexneri 2a str. 301
cgcuuuuuuagguacaaag

SEQ ID NO: 3942029 - RNA, 17 nt, Shigella flexneri 2a str. 301
cgcuuuuuucagcgcca

SEQ ID NO: 3942030 - RNA, 16 nt, Shigella flexneri 2a str. 301
cgcuuuuuuuacgucu

SEQ ID NO: 3942031 - RNA, 12 nt, Shigella flexneri 2a str. 301
cggaaaaaagaa

SEQ ID NO: 3942032 - RNA, 21 nt, Shigella flexneri 2a str. 301
cggaaaauuauuuuaaauuuc

SEQ ID NO: 3942033 - RNA, 14 nt, Shigella flexneri 2a str. 301
cggaaacagugcug

SEQ ID NO: 3942034 - RNA, 15 nt, Shigella flexneri 2a str. 301
cggaaagaucgccac

SEQ ID NO: 3942035 - RNA, 21 nt, Shigella flexneri 2a str. 301
cggaaagcaccugcgcaggca

SEQ ID NO: 3942036 - RNA, 13 nt, Shigella flexneri 2a str. 301
cggaaaucuccag

SEQ ID NO: 3942037 - RNA, 15 nt, Shigella flexneri 2a str. 301
cggaaaucuccagau

SEQ ID NO: 3942038 - RNA, 18 nt, Shigella flexneri 2a str. 301
cggaaaucuccagauaau

SEQ ID NO: 3942039 - RNA, 20 nt, Shigella flexneri 2a str. 301
cggaaauuaccgcaccacca

SEQ ID NO: 3942040 - RNA, 23 nt, Shigella flexneri 2a str. 301
cggaaauuaccgcaccaccagca

SEQ ID NO: 3942041 - RNA, 21 nt, Shigella flexneri 2a str. 301
cggaacaacagucccaggcag

SEQ ID NO: 3942042 - RNA, 18 nt, Shigella flexneri 2a str. 301
cggaacacucuuccaguc

SEQ ID NO: 3942043 - RNA, 15 nt, Shigella flexneri 2a str. 301
cggaacaucugcccc

SEQ ID NO: 3942044 - RNA, 14 nt, Shigella flexneri 2a str. 301
cggaacccagcgcg

SEQ ID NO: 3942045 - RNA, 21 nt, Shigella flexneri 2a str. 301
cggaacccagcgcgauacgca

SEQ ID NO: 3942046 - RNA, 15 nt, Shigella flexneri 2a str. 301
cggaacgaaaaaaau

SEQ ID NO: 3942047 - RNA, 16 nt, Shigella flexneri 2a str. 301
cggaacgaaaaaaauc

SEQ ID NO: 3942048 - RNA, 13 nt, Shigella flexneri 2a str. 301
cggaacugaugau

SEQ ID NO: 3942049 - RNA, 15 nt, Shigella flexneri 2a str. 301
cggaacugugcugcc

SEQ ID NO: 3942050 - RNA, 16 nt, Shigella flexneri 2a str. 301
cggaacugugcugccg

SEQ ID NO: 3942051 - RNA, 15 nt, Shigella flexneri 2a str. 301
cggaagacacauugc

SEQ ID NO: 3942052 - RNA, 22 nt, Shigella flexneri 2a str. 301
cggaagcaaaauaaccggcaag

SEQ ID NO: 3942053 - RNA, 12 nt, Shigella flexneri 2a str. 301
cggaagccacca

SEQ ID NO: 3942054 - RNA, 13 nt, Shigella flexneri 2a str. 301
cggaagccaccac

SEQ ID NO: 3942055 - RNA, 15 nt, Shigella flexneri 2a str. 301
cggaagcgucaaggu

SEQ ID NO: 3942056 - RNA, 18 nt, Shigella flexneri 2a str. 301
cggaaguaccaauggcaa

SEQ ID NO: 3942057 - RNA, 17 nt, Shigella flexneri 2a str. 301
cggaaguaguucaucaa

SEQ ID NO: 3942058 - RNA, 16 nt, Shigella flexneri 2a str. 301
cggaaucaccggcaaa

SEQ ID NO: 3942059 - RNA, 20 nt, Shigella flexneri 2a str. 301
cggaaugauauuggucacca

SEQ ID NO: 3942060 - RNA, 15 nt, Shigella flexneri 2a str. 301
cggaauggcaucuuc

SEQ ID NO: 3942061 - RNA, 19 nt, Shigella flexneri 2a str. 301
cggaaugggcuguucacca

SEQ ID NO: 3942062 - RNA, 24 nt, Shigella flexneri 2a str. 301
cggaaugggcuguucaccacugaa

SEQ ID NO: 3942063 - RNA, 16 nt, Shigella flexneri 2a str. 301
cggaaugucaucauca

SEQ ID NO: 3942064 - RNA, 11 nt, Shigella flexneri 2a str. 301
cggaauuucaa

SEQ ID NO: 3942065 - RNA, 14 nt, Shigella flexneri 2a str. 301
cggaauuuuccuuc

SEQ ID NO: 3942066 - RNA, 20 nt, Shigella flexneri 2a str. 301
cggacaaaguuccugccgau

SEQ ID NO: 3942067 - RNA, 17 nt, Shigella flexneri 2a str. 301
cggacaauaauaucuuu

SEQ ID NO: 3942068 - RNA, 18 nt, Shigella flexneri 2a str. 301
cggacaauaauaucuuuu

SEQ ID NO: 3942069 - RNA, 14 nt, Shigella flexneri 2a str. 301
cggacacacuucau

SEQ ID NO: 3942070 - RNA, 18 nt, Shigella flexneri 2a str. 301
cggacacugcuuacaggc

SEQ ID NO: 3942071 - RNA, 14 nt, Shigella flexneri 2a str. 301
cggacagaccugcg

SEQ ID NO: 3942072 - RNA, 23 nt, Shigella flexneri 2a str. 301
cggacagagauucgguaaccauc

SEQ ID NO: 3942073 - RNA, 21 nt, Shigella flexneri 2a str. 301
cggacaugaaccgugucgcca

SEQ ID NO: 3942074 - RNA, 13 nt, Shigella flexneri 2a str. 301
cggaccagcaaca

SEQ ID NO: 3942075 - RNA, 14 nt, Shigella flexneri 2a str. 301
cggaccagcaaguc

SEQ ID NO: 3942076 - RNA, 14 nt, Shigella flexneri 2a str. 301
cggaccgcauucac

SEQ ID NO: 3942077 - RNA, 21 nt, Shigella flexneri 2a str. 301
cggaccugucggggccagcgc

SEQ ID NO: 3942078 - RNA, 19 nt, Shigella flexneri 2a str. 301
cggacgacggcaucgccau

SEQ ID NO: 3942079 - RNA, 16 nt, Shigella flexneri 2a str. 301
cggacgcguuucauuc

SEQ ID NO: 3942080 - RNA, 18 nt, Shigella flexneri 2a str. 301
cggacgcuaacccgcguc

SEQ ID NO: 3942081 - RNA, 23 nt, Shigella flexneri 2a str. 301
cggacgcuaacccgcgucugcgu

SEQ ID NO: 3942082 - RNA, 21 nt, Shigella flexneri 2a str. 301
cggacggucgacgggcccaua

SEQ ID NO: 3942083 - RNA, 18 nt, Shigella flexneri 2a str. 301
cggacguaaugauguaaa

SEQ ID NO: 3942084 - RNA, 22 nt, Shigella flexneri 2a str. 301
cggacguucgcccacuucuuuc

SEQ ID NO: 3942085 - RNA, 15 nt, Shigella flexneri 2a str. 301
cggacguuugccaug

SEQ ID NO: 3942086 - RNA, 22 nt, Shigella flexneri 2a str. 301
cggacguuugccaugcauaucc

SEQ ID NO: 3942087 - RNA, 15 nt, Shigella flexneri 2a str. 301
cggacuuuuuauuua

SEQ ID NO: 3942088 - RNA, 14 nt, Shigella flexneri 2a str. 301
cggagaacaggaau

SEQ ID NO: 3942089 - RNA, 16 nt, Shigella flexneri 2a str. 301
cggagacaaacagggu

SEQ ID NO: 3942090 - RNA, 17 nt, Shigella flexneri 2a str. 301
cggagaguaaacgguga

SEQ ID NO: 3942091 - RNA, 15 nt, Shigella flexneri 2a str. 301
cggagaugcggaaau

SEQ ID NO: 3942092 - RNA, 22 nt, Shigella flexneri 2a str. 301
cggagcaaaaaaccgccauuca

SEQ ID NO: 3942093 - RNA, 12 nt, Shigella flexneri 2a str. 301
cggagcaaccug

SEQ ID NO: 3942094 - RNA, 15 nt, Shigella flexneri 2a str. 301
cggagcaaccugcac

SEQ ID NO: 3942095 - RNA, 20 nt, Shigella flexneri 2a str. 301
cggagccagccguugcccgu

SEQ ID NO: 3942096 - RNA, 14 nt, Shigella flexneri 2a str. 301
cggagccauucccc

SEQ ID NO: 3942097 - RNA, 16 nt, Shigella flexneri 2a str. 301
cggagcgccaccaccc

SEQ ID NO: 3942098 - RNA, 17 nt, Shigella flexneri 2a str. 301
cggagcggacugcugcg

SEQ ID NO: 3942099 - RNA, 23 nt, Shigella flexneri 2a str. 301
cggagcucccaggcuccgccaga

SEQ ID NO: 3942100 - RNA, 19 nt, Shigella flexneri 2a str. 301
cggagcuucacccgcagca

SEQ ID NO: 3942101 - RNA, 19 nt, Shigella flexneri 2a str. 301
cggagggguuuuugccagc

SEQ ID NO: 3942102 - RNA, 15 nt, Shigella flexneri 2a str. 301
cggagguuuuuuccu

SEQ ID NO: 3942103 - RNA, 16 nt, Shigella flexneri 2a str. 301
cggagguuuuuuccuc

SEQ ID NO: 3942104 - RNA, 22 nt, Shigella flexneri 2a str. 301
cggaguugaccagcuccagcag

SEQ ID NO: 3942105 - RNA, 22 nt, Shigella flexneri 2a str. 301
cggauaaacaauguuauccggc

SEQ ID NO: 3942106 - RNA, 14 nt, Shigella flexneri 2a str. 301
cggauaaagcugcc

SEQ ID NO: 3942107 - RNA, 21 nt, Shigella flexneri 2a str. 301
cggauaagacgccccggcguc

SEQ ID NO: 3942108 - RNA, 22 nt, Shigella flexneri 2a str. 301
cggauaaggcgcucgcgccgca

SEQ ID NO: 3942109 - RNA, 22 nt, Shigella flexneri 2a str. 301
cggauaaucgcuggugccgugg

SEQ ID NO: 3942110 - RNA, 16 nt, Shigella flexneri 2a str. 301
cggauaaucggcaaua

SEQ ID NO: 3942111 - RNA, 21 nt, Shigella flexneri 2a str. 301
cggauaauggagccagaucug

SEQ ID NO: 3942112 - RNA, 16 nt, Shigella flexneri 2a str. 301
cggauaccaccagugc

SEQ ID NO: 3942113 - RNA, 19 nt, Shigella flexneri 2a str. 301
cggauaccaccagugccau

SEQ ID NO: 3942114 - RNA, 20 nt, Shigella flexneri 2a str. 301
cggauaccaccagugccauu

SEQ ID NO: 3942115 - RNA, 14 nt, Shigella flexneri 2a str. 301
cggauagagcgcgg

SEQ ID NO: 3942116 - RNA, 22 nt, Shigella flexneri 2a str. 301
cggauagcguguuuuauaccuc

SEQ ID NO: 3942117 - RNA, 22 nt, Shigella flexneri 2a str. 301
cggauauccacccgcagccauc

SEQ ID NO: 3942118 - RNA, 17 nt, Shigella flexneri 2a str. 301
cggauauuuugccaggu

SEQ ID NO: 3942119 - RNA, 20 nt, Shigella flexneri 2a str. 301
cggaucaggcggcucaccug

SEQ ID NO: 3942120 - RNA, 23 nt, Shigella flexneri 2a str. 301
cggaucaugguagcgugauggcc

SEQ ID NO: 3942121 - RNA, 14 nt, Shigella flexneri 2a str. 301
cggaucauuaguca

SEQ ID NO: 3942122 - RNA, 17 nt, Shigella flexneri 2a str. 301
cggaucgguagaccgga

SEQ ID NO: 3942123 - RNA, 20 nt, Shigella flexneri 2a str. 301
cggaucuuuucuuucgccca

SEQ ID NO: 3942124 - RNA, 11 nt, Shigella flexneri 2a str. 301
cggaugacaga

SEQ ID NO: 3942125 - RNA, 16 nt, Shigella flexneri 2a str. 301
cggaugacccagcgcg

SEQ ID NO: 3942126 - RNA, 15 nt, Shigella flexneri 2a str. 301
cggaugaguacagcg

SEQ ID NO: 3942127 - RNA, 18 nt, Shigella flexneri 2a str. 301
cggaugaguacagcgcau

SEQ ID NO: 3942128 - RNA, 15 nt, Shigella flexneri 2a str. 301
cggaugaugcucccc

SEQ ID NO: 3942129 - RNA, 14 nt, Shigella flexneri 2a str. 301
cggaugauucacau

SEQ ID NO: 3942130 - RNA, 24 nt, Shigella flexneri 2a str. 301
cggaugcagcaucaugucgcccac

SEQ ID NO: 3942131 - RNA, 19 nt, Shigella flexneri 2a str. 301
cggaugcgaugcuggcgca

SEQ ID NO: 3942132 - RNA, 14 nt, Shigella flexneri 2a str. 301
cggaugcgccagca

SEQ ID NO: 3942133 - RNA, 14 nt, Shigella flexneri 2a str. 301
cggaugcgccguca

SEQ ID NO: 3942134 - RNA, 15 nt, Shigella flexneri 2a str. 301
cggaugcgccgucag

SEQ ID NO: 3942135 - RNA, 22 nt, Shigella flexneri 2a str. 301
cggaugcggcgugaacgccuua

SEQ ID NO: 3942136 - RNA, 20 nt, Shigella flexneri 2a str. 301
cggaugcggcgugaaugccu

SEQ ID NO: 3942137 - RNA, 20 nt, Shigella flexneri 2a str. 301
cggaugcggugcaagcaccu

SEQ ID NO: 3942138 - RNA, 22 nt, Shigella flexneri 2a str. 301
cggauguuucaccggaugccgg

SEQ ID NO: 3942139 - RNA, 18 nt, Shigella flexneri 2a str. 301
cggauguuucuucaacac

SEQ ID NO: 3942140 - RNA, 20 nt, Shigella flexneri 2a str. 301
cggauucacgccaaccagcu

SEQ ID NO: 3942141 - RNA, 17 nt, Shigella flexneri 2a str. 301
cggauuucauauccggc

SEQ ID NO: 3942142 - RNA, 21 nt, Shigella flexneri 2a str. 301
cggauuuuauucagcagacca

SEQ ID NO: 3942143 - RNA, 16 nt, Shigella flexneri 2a str. 301
cggcaaaacagggcuu

SEQ ID NO: 3942144 - RNA, 13 nt, Shigella flexneri 2a str. 301
cggcaaaaccguu

SEQ ID NO: 3942145 - RNA, 23 nt, Shigella flexneri 2a str. 301
cggcaaaaucaauucaucgcucu

SEQ ID NO: 3942146 - RNA, 12 nt, Shigella flexneri 2a str. 301
cggcaaacacgc

SEQ ID NO: 3942147 - RNA, 13 nt, Shigella flexneri 2a str. 301
cggcaaacacgcc

SEQ ID NO: 3942148 - RNA, 23 nt, Shigella flexneri 2a str. 301
cggcaaacguaagcgucugcucc

SEQ ID NO: 3942149 - RNA, 14 nt, Shigella flexneri 2a str. 301
cggcaaacugcuga

SEQ ID NO: 3942150 - RNA, 23 nt, Shigella flexneri 2a str. 301
cggcaaagugaauacagaacagu

SEQ ID NO: 3942151 - RNA, 23 nt, Shigella flexneri 2a str. 301
cggcaaauucauuaccaaccuga

SEQ ID NO: 3942152 - RNA, 19 nt, Shigella flexneri 2a str. 301
cggcaacaaauucacgccu

SEQ ID NO: 3942153 - RNA, 13 nt, Shigella flexneri 2a str. 301
cggcaaccgcauc

SEQ ID NO: 3942154 - RNA, 22 nt, Shigella flexneri 2a str. 301
cggcaacgacugcgagcaaaau

SEQ ID NO: 3942155 - RNA, 17 nt, Shigella flexneri 2a str. 301
cggcaacguacuuacuc

SEQ ID NO: 3942156 - RNA, 13 nt, Shigella flexneri 2a str. 301
cggcaacgucacc

SEQ ID NO: 3942157 - RNA, 21 nt, Shigella flexneri 2a str. 301
cggcaacgucggaaaccgcuu

SEQ ID NO: 3942158 - RNA, 19 nt, Shigella flexneri 2a str. 301
cggcaagaaauaccgaaga

SEQ ID NO: 3942159 - RNA, 16 nt, Shigella flexneri 2a str. 301
cggcaagaucagcauc

SEQ ID NO: 3942160 - RNA, 20 nt, Shigella flexneri 2a str. 301
cggcaagauggauuacaccu

SEQ ID NO: 3942161 - RNA, 22 nt, Shigella flexneri 2a str. 301
cggcaaggguugagauuuauuu

SEQ ID NO: 3942162 - RNA, 15 nt, Shigella flexneri 2a str. 301
cggcaagugccuguu

SEQ ID NO: 3942163 - RNA, 15 nt, Shigella flexneri 2a str. 301
cggcaauaagcaacg

SEQ ID NO: 3942164 - RNA, 16 nt, Shigella flexneri 2a str. 301
cggcaauaauccccgc

SEQ ID NO: 3942165 - RNA, 17 nt, Shigella flexneri 2a str. 301
cggcaaucacaucacca

SEQ ID NO: 3942166 - RNA, 20 nt, Shigella flexneri 2a str. 301
cggcaaucauucccagaccu

SEQ ID NO: 3942167 - RNA, 12 nt, Shigella flexneri 2a str. 301
cggcaaucgcca

SEQ ID NO: 3942168 - RNA, 13 nt, Shigella flexneri 2a str. 301
cggcaaucgccag

SEQ ID NO: 3942169 - RNA, 22 nt, Shigella flexneri 2a str. 301
cggcaaucgccagaucagcuuc

SEQ ID NO: 3942170 - RNA, 23 nt, Shigella flexneri 2a str. 301
cggcaaucgccagaucagcuuca

SEQ ID NO: 3942171 - RNA, 17 nt, Shigella flexneri 2a str. 301
cggcaaucgcugcuaau

SEQ ID NO: 3942172 - RNA, 15 nt, Shigella flexneri 2a str. 301
cggcaaucggugcaa

SEQ ID NO: 3942173 - RNA, 23 nt, Shigella flexneri 2a str. 301
cggcaaucggugcaaaugccaga

SEQ ID NO: 3942174 - RNA, 15 nt, Shigella flexneri 2a str. 301
cggcaaucuguuaug

SEQ ID NO: 3942175 - RNA, 21 nt, Shigella flexneri 2a str. 301
cggcaaugaauauuccacagc

SEQ ID NO: 3942176 - RNA, 14 nt, Shigella flexneri 2a str. 301
cggcaaugcgcccc

SEQ ID NO: 3942177 - RNA, 18 nt, Shigella flexneri 2a str. 301
cggcaaugcguuccagca

SEQ ID NO: 3942178 - RNA, 16 nt, Shigella flexneri 2a str. 301
cggcaauuagcggcug

SEQ ID NO: 3942179 - RNA, 18 nt, Shigella flexneri 2a str. 301
cggcaauuagcggcuggc

SEQ ID NO: 3942180 - RNA, 17 nt, Shigella flexneri 2a str. 301
cggcaauucucugcucc

SEQ ID NO: 3942181 - RNA, 19 nt, Shigella flexneri 2a str. 301
cggcaauucucugcuccug

SEQ ID NO: 3942182 - RNA, 21 nt, Shigella flexneri 2a str. 301
cggcaauucucugcuccugau

SEQ ID NO: 3942183 - RNA, 13 nt, Shigella flexneri 2a str. 301
cggcaauuuuuac

SEQ ID NO: 3942184 - RNA, 22 nt, Shigella flexneri 2a str. 301
cggcacacagcacggcagcaac

SEQ ID NO: 3942185 - RNA, 16 nt, Shigella flexneri 2a str. 301
cggcacagaaacgcca

SEQ ID NO: 3942186 - RNA, 11 nt, Shigella flexneri 2a str. 301
cggcacaucga

SEQ ID NO: 3942187 - RNA, 13 nt, Shigella flexneri 2a str. 301
cggcaccacaaac

SEQ ID NO: 3942188 - RNA, 23 nt, Shigella flexneri 2a str. 301
cggcaccacaaacucuuuuccgg

SEQ ID NO: 3942189 - RNA, 15 nt, Shigella flexneri 2a str. 301
cggcaccagcgcaga

SEQ ID NO: 3942190 - RNA, 18 nt, Shigella flexneri 2a str. 301
cggcaccagcgcagaaga

SEQ ID NO: 3942191 - RNA, 22 nt, Shigella flexneri 2a str. 301
cggcaccuaauaacucuccucc

SEQ ID NO: 3942192 - RNA, 19 nt, Shigella flexneri 2a str. 301
cggcaccuuuucaucaggu

SEQ ID NO: 3942193 - RNA, 19 nt, Shigella flexneri 2a str. 301
cggcacgcguugcgcauga

SEQ ID NO: 3942194 - RNA, 21 nt, Shigella flexneri 2a str. 301
cggcacgcguugcgcaugacc

SEQ ID NO: 3942195 - RNA, 18 nt, Shigella flexneri 2a str. 301
cggcacggaaagcagcau

SEQ ID NO: 3942196 - RNA, 18 nt, Shigella flexneri 2a str. 301
cggcacggcaaucaugau

SEQ ID NO: 3942197 - RNA, 19 nt, Shigella flexneri 2a str. 301
cggcacguuccugcauacg

SEQ ID NO: 3942198 - RNA, 18 nt, Shigella flexneri 2a str. 301
cggcacuauuauauucug

SEQ ID NO: 3942199 - RNA, 15 nt, Shigella flexneri 2a str. 301
cggcacuccucuuca

SEQ ID NO: 3942200 - RNA, 17 nt, Shigella flexneri 2a str. 301
cggcacuguuucgccag

SEQ ID NO: 3942201 - RNA, 14 nt, Shigella flexneri 2a str. 301
cggcagaaaaucca

SEQ ID NO: 3942202 - RNA, 13 nt, Shigella flexneri 2a str. 301
cggcagaacggug

SEQ ID NO: 3942203 - RNA, 14 nt, Shigella flexneri 2a str. 301
cggcagacgggcaa

SEQ ID NO: 3942204 - RNA, 20 nt, Shigella flexneri 2a str. 301
cggcagagaaaccacaucaa

SEQ ID NO: 3942205 - RNA, 22 nt, Shigella flexneri 2a str. 301
cggcagagugaagguuucugca

SEQ ID NO: 3942206 - RNA, 15 nt, Shigella flexneri 2a str. 301
cggcagcaaucgacc

SEQ ID NO: 3942207 - RNA, 19 nt, Shigella flexneri 2a str. 301
cggcagcaaucgaccaggc

SEQ ID NO: 3942208 - RNA, 15 nt, Shigella flexneri 2a str. 301
cggcagcggcuucau

SEQ ID NO: 3942209 - RNA, 23 nt, Shigella flexneri 2a str. 301
cggcagcgucggaagcgagguau

SEQ ID NO: 3942210 - RNA, 22 nt, Shigella flexneri 2a str. 301
cggcaggaagugauugccgaag

SEQ ID NO: 3942211 - RNA, 19 nt, Shigella flexneri 2a str. 301
cggcaggccuaacacaugc

SEQ ID NO: 3942212 - RNA, 22 nt, Shigella flexneri 2a str. 301
cggcaggccuaacacaugcaag

SEQ ID NO: 3942213 - RNA, 17 nt, Shigella flexneri 2a str. 301
cggcagguugaugauga

SEQ ID NO: 3942214 - RNA, 17 nt, Shigella flexneri 2a str. 301
cggcagguugcagagca

SEQ ID NO: 3942215 - RNA, 19 nt, Shigella flexneri 2a str. 301
cggcaguauagcggcaugg

SEQ ID NO: 3942216 - RNA, 15 nt, Shigella flexneri 2a str. 301
cggcagucugcugac

SEQ ID NO: 3942217 - RNA, 20 nt, Shigella flexneri 2a str. 301
cggcagucugcugaccaccu

SEQ ID NO: 3942218 - RNA, 17 nt, Shigella flexneri 2a str. 301
cggcagugccaguucuu

SEQ ID NO: 3942219 - RNA, 21 nt, Shigella flexneri 2a str. 301
cggcaguggcuaagcaggcug

SEQ ID NO: 3942220 - RNA, 18 nt, Shigella flexneri 2a str. 301
cggcauaaagcugcggau

SEQ ID NO: 3942221 - RNA, 22 nt, Shigella flexneri 2a str. 301
cggcauaaucauuacaaccgcu

SEQ ID NO: 3942222 - RNA, 22 nt, Shigella flexneri 2a str. 301
cggcauacuuugauuaaccguu

SEQ ID NO: 3942223 - RNA, 19 nt, Shigella flexneri 2a str. 301
cggcauagccaccuggcug

SEQ ID NO: 3942224 - RNA, 21 nt, Shigella flexneri 2a str. 301
cggcauagccaccuggcugcg

SEQ ID NO: 3942225 - RNA, 23 nt, Shigella flexneri 2a str. 301
cggcauauuaaccaugacgccga

SEQ ID NO: 3942226 - RNA, 13 nt, Shigella flexneri 2a str. 301
cggcaucaaccag

SEQ ID NO: 3942227 - RNA, 20 nt, Shigella flexneri 2a str. 301
cggcauccagguuucuucca

SEQ ID NO: 3942228 - RNA, 16 nt, Shigella flexneri 2a str. 301
cggcauccauucguuc

SEQ ID NO: 3942229 - RNA, 19 nt, Shigella flexneri 2a str. 301
cggcaucgcauucaccaga

SEQ ID NO: 3942230 - RNA, 22 nt, Shigella flexneri 2a str. 301
cggcaucgccgcuaucgcugau

SEQ ID NO: 3942231 - RNA, 14 nt, Shigella flexneri 2a str. 301
cggcaucgcuccac

SEQ ID NO: 3942232 - RNA, 18 nt, Shigella flexneri 2a str. 301
cggcaucgcuccacgcca

SEQ ID NO: 3942233 - RNA, 22 nt, Shigella flexneri 2a str. 301
cggcaucgggcgaguuuccauc

SEQ ID NO: 3942234 - RNA, 21 nt, Shigella flexneri 2a str. 301
cggcaugaaaacccuucaaau

SEQ ID NO: 3942235 - RNA, 16 nt, Shigella flexneri 2a str. 301
cggcaugaaagcgaug

SEQ ID NO: 3942236 - RNA, 17 nt, Shigella flexneri 2a str. 301
cggcaugagccgccgcc

SEQ ID NO: 3942237 - RNA, 18 nt, Shigella flexneri 2a str. 301
cggcaugagccgccgcca

SEQ ID NO: 3942238 - RNA, 14 nt, Shigella flexneri 2a str. 301
cggcauggaucgcc

SEQ ID NO: 3942239 - RNA, 16 nt, Shigella flexneri 2a str. 301
cggcaugguuccggcu

SEQ ID NO: 3942240 - RNA, 16 nt, Shigella flexneri 2a str. 301
cggcauuaccggcaau

SEQ ID NO: 3942241 - RNA, 24 nt, Shigella flexneri 2a str. 301
cggcauuacugguuugcagauaac

SEQ ID NO: 3942242 - RNA, 23 nt, Shigella flexneri 2a str. 301
cggcauucagugcaaaugccaga

SEQ ID NO: 3942243 - RNA, 17 nt, Shigella flexneri 2a str. 301
cggcauucccagccccc

SEQ ID NO: 3942244 - RNA, 15 nt, Shigella flexneri 2a str. 301
cggcauucugcuggc

SEQ ID NO: 3942245 - RNA, 17 nt, Shigella flexneri 2a str. 301
cggcauuuauggugcua

SEQ ID NO: 3942246 - RNA, 19 nt, Shigella flexneri 2a str. 301
cggcauuuccauaccuaaa

SEQ ID NO: 3942247 - RNA, 14 nt, Shigella flexneri 2a str. 301
cggcauuuccgcca

SEQ ID NO: 3942248 - RNA, 13 nt, Shigella flexneri 2a str. 301
cggcauuuugugc

SEQ ID NO: 3942249 - RNA, 15 nt, Shigella flexneri 2a str. 301
cggcauuuuucggcg

SEQ ID NO: 3942250 - RNA, 16 nt, Shigella flexneri 2a str. 301
cggccacagccagcca

SEQ ID NO: 3942251 - RNA, 19 nt, Shigella flexneri 2a str. 301
cggccacagccagccaacg

SEQ ID NO: 3942252 - RNA, 14 nt, Shigella flexneri 2a str. 301
cggccacagcgcca

SEQ ID NO: 3942253 - RNA, 20 nt, Shigella flexneri 2a str. 301
cggccacucugccuguaugu

SEQ ID NO: 3942254 - RNA, 19 nt, Shigella flexneri 2a str. 301
cggccacucuuuggcaacc

SEQ ID NO: 3942255 - RNA, 14 nt, Shigella flexneri 2a str. 301
cggccagcgcaccu

SEQ ID NO: 3942256 - RNA, 14 nt, Shigella flexneri 2a str. 301
cggccagcgguuga

SEQ ID NO: 3942257 - RNA, 23 nt, Shigella flexneri 2a str. 301
cggccaguaagcaguccagcgcc

SEQ ID NO: 3942258 - RNA, 17 nt, Shigella flexneri 2a str. 301
cggccagugcuucgcgg

SEQ ID NO: 3942259 - RNA, 22 nt, Shigella flexneri 2a str. 301
cggccaguuucggacgcggcac

SEQ ID NO: 3942260 - RNA, 20 nt, Shigella flexneri 2a str. 301
cggccaucaguacgcauucg

SEQ ID NO: 3942261 - RNA, 15 nt, Shigella flexneri 2a str. 301
cggccauugaauauu

SEQ ID NO: 3942262 - RNA, 18 nt, Shigella flexneri 2a str. 301
cggcccgcucggcggcug

SEQ ID NO: 3942263 - RNA, 19 nt, Shigella flexneri 2a str. 301
cggcccgcucggcggcugg

SEQ ID NO: 3942264 - RNA, 15 nt, Shigella flexneri 2a str. 301
cggcccggaggaugc

SEQ ID NO: 3942265 - RNA, 17 nt, Shigella flexneri 2a str. 301
cggcccuuuuuuuacuu

SEQ ID NO: 3942266 - RNA, 16 nt, Shigella flexneri 2a str. 301
cggccgcacuuacagc

SEQ ID NO: 3942267 - RNA, 13 nt, Shigella flexneri 2a str. 301
cggccguuccauu

SEQ ID NO: 3942268 - RNA, 19 nt, Shigella flexneri 2a str. 301
cggccuacaaaaucgugca

SEQ ID NO: 3942269 - RNA, 17 nt, Shigella flexneri 2a str. 301
cggccuaucaacgucgu

SEQ ID NO: 3942270 - RNA, 19 nt, Shigella flexneri 2a str. 301
cggccucgcuacgccagca

SEQ ID NO: 3942271 - RNA, 18 nt, Shigella flexneri 2a str. 301
cggccucuucaaacggca

SEQ ID NO: 3942272 - RNA, 14 nt, Shigella flexneri 2a str. 301
cggcgaaagcuggc

SEQ ID NO: 3942273 - RNA, 21 nt, Shigella flexneri 2a str. 301
cggcgaaagcuggcacuggga

SEQ ID NO: 3942274 - RNA, 14 nt, Shigella flexneri 2a str. 301
cggcgaacuuaauc

SEQ ID NO: 3942275 - RNA, 16 nt, Shigella flexneri 2a str. 301
cggcgaagagagcgcc

SEQ ID NO: 3942276 - RNA, 15 nt, Shigella flexneri 2a str. 301
cggcgaauuaccagc

SEQ ID NO: 3942277 - RNA, 13 nt, Shigella flexneri 2a str. 301
cggcgacccgcga

SEQ ID NO: 3942278 - RNA, 13 nt, Shigella flexneri 2a str. 301
cggcgacugaggc

SEQ ID NO: 3942279 - RNA, 20 nt, Shigella flexneri 2a str. 301
cggcgagauaaugcgauaac

SEQ ID NO: 3942280 - RNA, 17 nt, Shigella flexneri 2a str. 301
cggcgagcaacgcagcg

SEQ ID NO: 3942281 - RNA, 18 nt, Shigella flexneri 2a str. 301
cggcgagguacgcccagc

SEQ ID NO: 3942282 - RNA, 13 nt, Shigella flexneri 2a str. 301
cggcgaguauucu

SEQ ID NO: 3942283 - RNA, 14 nt, Shigella flexneri 2a str. 301
cggcgauuuacagc

SEQ ID NO: 3942284 - RNA, 15 nt, Shigella flexneri 2a str. 301
cggcgcaacauccgc

SEQ ID NO: 3942285 - RNA, 16 nt, Shigella flexneri 2a str. 301
cggcgcaacauccgcu

SEQ ID NO: 3942286 - RNA, 18 nt, Shigella flexneri 2a str. 301
cggcgcaucggucgauga

SEQ ID NO: 3942287 - RNA, 13 nt, Shigella flexneri 2a str. 301
cggcgcaugccuc

SEQ ID NO: 3942288 - RNA, 18 nt, Shigella flexneri 2a str. 301
cggcgcgaguuugccgcu

SEQ ID NO: 3942289 - RNA, 14 nt, Shigella flexneri 2a str. 301
cggcgcgauaucga

SEQ ID NO: 3942290 - RNA, 13 nt, Shigella flexneri 2a str. 301
cggcgcucaaucc

SEQ ID NO: 3942291 - RNA, 13 nt, Shigella flexneri 2a str. 301
cggcgcucugccc

SEQ ID NO: 3942292 - RNA, 23 nt, Shigella flexneri 2a str. 301
cggcgcugcaauuggucgcgcaa

SEQ ID NO: 3942293 - RNA, 18 nt, Shigella flexneri 2a str. 301
cggcgcuuccagcaaauc

SEQ ID NO: 3942294 - RNA, 15 nt, Shigella flexneri 2a str. 301
cggcgcuuuugcauc

SEQ ID NO: 3942295 - RNA, 17 nt, Shigella flexneri 2a str. 301
cggcggaucaccgcguc

SEQ ID NO: 3942296 - RNA, 20 nt, Shigella flexneri 2a str. 301
cggcggaugaguuuacgaac

SEQ ID NO: 3942297 - RNA, 14 nt, Shigella flexneri 2a str. 301
cggcggcaacguca

SEQ ID NO: 3942298 - RNA, 17 nt, Shigella flexneri 2a str. 301
cggcggcacagccagcg

SEQ ID NO: 3942299 - RNA, 22 nt, Shigella flexneri 2a str. 301
cggcggcgauguccagacgcgc

SEQ ID NO: 3942300 - RNA, 10 nt, Shigella flexneri 2a str. 301
cggcggcgga

SEQ ID NO: 3942301 - RNA, 22 nt, Shigella flexneri 2a str. 301
cggcggcucguuagacggcgcu

SEQ ID NO: 3942302 - RNA, 18 nt, Shigella flexneri 2a str. 301
cggcggguuaaccagcac

SEQ ID NO: 3942303 - RNA, 20 nt, Shigella flexneri 2a str. 301
cggcggucuucucaccgccg

SEQ ID NO: 3942304 - RNA, 18 nt, Shigella flexneri 2a str. 301
cggcggugaccagcagca

SEQ ID NO: 3942305 - RNA, 19 nt, Shigella flexneri 2a str. 301
cggcggugagaagaccgcc

SEQ ID NO: 3942306 - RNA, 21 nt, Shigella flexneri 2a str. 301
cggcggugagaagaccgccgc

SEQ ID NO: 3942307 - RNA, 15 nt, Shigella flexneri 2a str. 301
cggcggugucgccag

SEQ ID NO: 3942308 - RNA, 15 nt, Shigella flexneri 2a str. 301
cggcgguugacgccc

SEQ ID NO: 3942309 - RNA, 17 nt, Shigella flexneri 2a str. 301
cggcgguugacgccccu

SEQ ID NO: 3942310 - RNA, 15 nt, Shigella flexneri 2a str. 301
cggcguaaacgccuu

SEQ ID NO: 3942311 - RNA, 22 nt, Shigella flexneri 2a str. 301
cggcguaaacgccuuauccgcc

SEQ ID NO: 3942312 - RNA, 16 nt, Shigella flexneri 2a str. 301
cggcguaaccgcccag

SEQ ID NO: 3942313 - RNA, 18 nt, Shigella flexneri 2a str. 301
cggcguaaccgcccagug

SEQ ID NO: 3942314 - RNA, 13 nt, Shigella flexneri 2a str. 301
cggcguaacgcac

SEQ ID NO: 3942315 - RNA, 22 nt, Shigella flexneri 2a str. 301
cggcguaccuuugccuuccagc

SEQ ID NO: 3942316 - RNA, 21 nt, Shigella flexneri 2a str. 301
cggcguaucguaaaacgcgga

SEQ ID NO: 3942317 - RNA, 19 nt, Shigella flexneri 2a str. 301
cggcgucauaauccggcaa

SEQ ID NO: 3942318 - RNA, 21 nt, Shigella flexneri 2a str. 301
cggcguccuggaacuggugga

SEQ ID NO: 3942319 - RNA, 15 nt, Shigella flexneri 2a str. 301
cggcgucugaaucaa

SEQ ID NO: 3942320 - RNA, 21 nt, Shigella flexneri 2a str. 301
cggcgucugguaucgcgccag

SEQ ID NO: 3942321 - RNA, 22 nt, Shigella flexneri 2a str. 301
cggcgugaacgccuuauccggc

SEQ ID NO: 3942322 - RNA, 13 nt, Shigella flexneri 2a str. 301
cggcgugaaugcc

SEQ ID NO: 3942323 - RNA, 18 nt, Shigella flexneri 2a str. 301
cggcgugaccucuucggc

SEQ ID NO: 3942324 - RNA, 15 nt, Shigella flexneri 2a str. 301
cggcgugacgaucac

SEQ ID NO: 3942325 - RNA, 17 nt, Shigella flexneri 2a str. 301
cggcgugauuggcauca

SEQ ID NO: 3942326 - RNA, 13 nt, Shigella flexneri 2a str. 301
cggcgugccgucg

SEQ ID NO: 3942327 - RNA, 18 nt, Shigella flexneri 2a str. 301
cggcgugcgcgcccauac

SEQ ID NO: 3942328 - RNA, 17 nt, Shigella flexneri 2a str. 301
cggcguucauccugcug

SEQ ID NO: 3942329 - RNA, 19 nt, Shigella flexneri 2a str. 301
cggcguucauccugcuggu

SEQ ID NO: 3942330 - RNA, 15 nt, Shigella flexneri 2a str. 301
cggcguuccaccgcu

SEQ ID NO: 3942331 - RNA, 19 nt, Shigella flexneri 2a str. 301
cggcguuucacauucgccg

SEQ ID NO: 3942332 - RNA, 22 nt, Shigella flexneri 2a str. 301
cggcguuuuguagagcagcacg

SEQ ID NO: 3942333 - RNA, 23 nt, Shigella flexneri 2a str. 301
cggcguuuuguagagcagcacgc

SEQ ID NO: 3942334 - RNA, 19 nt, Shigella flexneri 2a str. 301
cggcuacacuauuuccuug

SEQ ID NO: 3942335 - RNA, 13 nt, Shigella flexneri 2a str. 301
cggcuaucuacgc

SEQ ID NO: 3942336 - RNA, 13 nt, Shigella flexneri 2a str. 301
cggcuauuuccgg

SEQ ID NO: 3942337 - RNA, 14 nt, Shigella flexneri 2a str. 301
cggcucaccugcac

SEQ ID NO: 3942338 - RNA, 15 nt, Shigella flexneri 2a str. 301
cggcucaugcaucag

SEQ ID NO: 3942339 - RNA, 13 nt, Shigella flexneri 2a str. 301
cggcuccgcccca

SEQ ID NO: 3942340 - RNA, 24 nt, Shigella flexneri 2a str. 301
cggcuccgguuaacgccgcgcccg

SEQ ID NO: 3942341 - RNA, 15 nt, Shigella flexneri 2a str. 301
cggcuccguuccgcu

SEQ ID NO: 3942342 - RNA, 17 nt, Shigella flexneri 2a str. 301
cggcucggcuccgggcg

SEQ ID NO: 3942343 - RNA, 16 nt, Shigella flexneri 2a str. 301
cggcucucaccuugua

SEQ ID NO: 3942344 - RNA, 16 nt, Shigella flexneri 2a str. 301
cggcugaaaugaugcu

SEQ ID NO: 3942345 - RNA, 18 nt, Shigella flexneri 2a str. 301
cggcugaacgugcucugc

SEQ ID NO: 3942346 - RNA, 13 nt, Shigella flexneri 2a str. 301
cggcugaccacca

SEQ ID NO: 3942347 - RNA, 15 nt, Shigella flexneri 2a str. 301
cggcugcagugcaau

SEQ ID NO: 3942348 - RNA, 14 nt, Shigella flexneri 2a str. 301
cggcugccagccag

SEQ ID NO: 3942349 - RNA, 13 nt, Shigella flexneri 2a str. 301
cggcugcccauca

SEQ ID NO: 3942350 - RNA, 15 nt, Shigella flexneri 2a str. 301
cggcugcccaucauc

SEQ ID NO: 3942351 - RNA, 16 nt, Shigella flexneri 2a str. 301
cggcugcgcgacggcg

SEQ ID NO: 3942352 - RNA, 18 nt, Shigella flexneri 2a str. 301
cggcugcugaggcugacc

SEQ ID NO: 3942353 - RNA, 18 nt, Shigella flexneri 2a str. 301
cggcugcuucggucagca

SEQ ID NO: 3942354 - RNA, 15 nt, Shigella flexneri 2a str. 301
cggcuggccacaaac

SEQ ID NO: 3942355 - RNA, 15 nt, Shigella flexneri 2a str. 301
cggcuggcugaccug

SEQ ID NO: 3942356 - RNA, 16 nt, Shigella flexneri 2a str. 301
cggcuggcugaccuga

SEQ ID NO: 3942357 - RNA, 15 nt, Shigella flexneri 2a str. 301
cggcugggaaaucac

SEQ ID NO: 3942358 - RNA, 23 nt, Shigella flexneri 2a str. 301
cggcuguagagcuaccggcagga

SEQ ID NO: 3942359 - RNA, 22 nt, Shigella flexneri 2a str. 301
cggcuguaguccuaacagagca

SEQ ID NO: 3942360 - RNA, 14 nt, Shigella flexneri 2a str. 301
cggcuguccggcac

SEQ ID NO: 3942361 - RNA, 16 nt, Shigella flexneri 2a str. 301
cggcuguccggcacca

SEQ ID NO: 3942362 - RNA, 22 nt, Shigella flexneri 2a str. 301
cggcuguugauguccaguuccc

SEQ ID NO: 3942363 - RNA, 19 nt, Shigella flexneri 2a str. 301
cggcuguuggugccagaua

SEQ ID NO: 3942364 - RNA, 17 nt, Shigella flexneri 2a str. 301
cggcuuagcguuacguu

SEQ ID NO: 3942365 - RNA, 14 nt, Shigella flexneri 2a str. 301
cggcuuauauauua

SEQ ID NO: 3942366 - RNA, 20 nt, Shigella flexneri 2a str. 301
cggcuucgcaucccgguauc

SEQ ID NO: 3942367 - RNA, 15 nt, Shigella flexneri 2a str. 301
cggcuucgccuccug

SEQ ID NO: 3942368 - RNA, 19 nt, Shigella flexneri 2a str. 301
cggcuucgccuccuguucu

SEQ ID NO: 3942369 - RNA, 16 nt, Shigella flexneri 2a str. 301
cggcuugaaccagcca

SEQ ID NO: 3942370 - RNA, 15 nt, Shigella flexneri 2a str. 301
cggcuuguggugaaa

SEQ ID NO: 3942371 - RNA, 16 nt, Shigella flexneri 2a str. 301
cggcuuguggugaaac

SEQ ID NO: 3942372 - RNA, 13 nt, Shigella flexneri 2a str. 301
cggcuuucaaggc

SEQ ID NO: 3942373 - RNA, 23 nt, Shigella flexneri 2a str. 301
cggcuuuguuacccccauccacg

SEQ ID NO: 3942374 - RNA, 17 nt, Shigella flexneri 2a str. 301
cggcuuuuagcugguga

SEQ ID NO: 3942375 - RNA, 18 nt, Shigella flexneri 2a str. 301
cggcuuuuuacuucucag

SEQ ID NO: 3942376 - RNA, 16 nt, Shigella flexneri 2a str. 301
cggcuuuuuuacgccu

SEQ ID NO: 3942377 - RNA, 16 nt, Shigella flexneri 2a str. 301
cggcuuuuuugucucc

SEQ ID NO: 3942378 - RNA, 20 nt, Shigella flexneri 2a str. 301
cgggaaaccaacuccagcgg

SEQ ID NO: 3942379 - RNA, 12 nt, Shigella flexneri 2a str. 301
cgggaacagaau

SEQ ID NO: 3942380 - RNA, 20 nt, Shigella flexneri 2a str. 301
cgggaagcucucuuccaguu

SEQ ID NO: 3942381 - RNA, 17 nt, Shigella flexneri 2a str. 301
cgggaauauuaacgaca

SEQ ID NO: 3942382 - RNA, 17 nt, Shigella flexneri 2a str. 301
cgggacaacaaacgcaa

SEQ ID NO: 3942383 - RNA, 21 nt, Shigella flexneri 2a str. 301
cgggagaaacccggccacagc

SEQ ID NO: 3942384 - RNA, 18 nt, Shigella flexneri 2a str. 301
cgggagagauaagauaaa

SEQ ID NO: 3942385 - RNA, 13 nt, Shigella flexneri 2a str. 301
cgggaucaccaga

SEQ ID NO: 3942386 - RNA, 18 nt, Shigella flexneri 2a str. 301
cgggaucaccagaccaau

SEQ ID NO: 3942387 - RNA, 16 nt, Shigella flexneri 2a str. 301
cgggaucugcguaccc

SEQ ID NO: 3942388 - RNA, 20 nt, Shigella flexneri 2a str. 301
cgggaugaaaggcaagcacg

SEQ ID NO: 3942389 - RNA, 20 nt, Shigella flexneri 2a str. 301
cgggaugguguaaaugccgg

SEQ ID NO: 3942390 - RNA, 21 nt, Shigella flexneri 2a str. 301
cgggauguguaaguaaugaca

SEQ ID NO: 3942391 - RNA, 14 nt, Shigella flexneri 2a str. 301
cgggcaaagcgacg

SEQ ID NO: 3942392 - RNA, 15 nt, Shigella flexneri 2a str. 301
cgggcaaagcgacgc

SEQ ID NO: 3942393 - RNA, 14 nt, Shigella flexneri 2a str. 301
cgggcaacugcugc

SEQ ID NO: 3942394 - RNA, 17 nt, Shigella flexneri 2a str. 301
cgggcaagccagcauac

SEQ ID NO: 3942395 - RNA, 17 nt, Shigella flexneri 2a str. 301
cgggcacagauuuccaa

SEQ ID NO: 3942396 - RNA, 21 nt, Shigella flexneri 2a str. 301
cgggcacagauuuccaagcgc

SEQ ID NO: 3942397 - RNA, 17 nt, Shigella flexneri 2a str. 301
cgggcacaggcgaugcc

SEQ ID NO: 3942398 - RNA, 20 nt, Shigella flexneri 2a str. 301
cgggcagaaugcccugcggc

SEQ ID NO: 3942399 - RNA, 19 nt, Shigella flexneri 2a str. 301
cgggcagcagaaccaggga

SEQ ID NO: 3942400 - RNA, 16 nt, Shigella flexneri 2a str. 301
cgggcaggcuucaaca

SEQ ID NO: 3942401 - RNA, 16 nt, Shigella flexneri 2a str. 301
cgggcaucaucuuccg

SEQ ID NO: 3942402 - RNA, 21 nt, Shigella flexneri 2a str. 301
cgggcaugucgguuguacaaa

SEQ ID NO: 3942403 - RNA, 15 nt, Shigella flexneri 2a str. 301
cgggccaaagcauuc

SEQ ID NO: 3942404 - RNA, 21 nt, Shigella flexneri 2a str. 301
cgggccauaaaaggaagaggc

SEQ ID NO: 3942405 - RNA, 20 nt, Shigella flexneri 2a str. 301
cgggcccauaacgccugcuc

SEQ ID NO: 3942406 - RNA, 21 nt, Shigella flexneri 2a str. 301
cgggccgcaaaccagcgcaug

SEQ ID NO: 3942407 - RNA, 15 nt, Shigella flexneri 2a str. 301
cgggccuccccggau

SEQ ID NO: 3942408 - RNA, 15 nt, Shigella flexneri 2a str. 301
cgggccugaacaagc

SEQ ID NO: 3942409 - RNA, 16 nt, Shigella flexneri 2a str. 301
cgggccugaacaagca

SEQ ID NO: 3942410 - RNA, 15 nt, Shigella flexneri 2a str. 301
cgggcgaacuggcgu

SEQ ID NO: 3942411 - RNA, 20 nt, Shigella flexneri 2a str. 301
cgggcgacgcugcgccgacc

SEQ ID NO: 3942412 - RNA, 20 nt, Shigella flexneri 2a str. 301
cgggcguagugcccgcagua

SEQ ID NO: 3942413 - RNA, 15 nt, Shigella flexneri 2a str. 301
cgggcuuccggcaau

SEQ ID NO: 3942414 - RNA, 15 nt, Shigella flexneri 2a str. 301
cggggaacgcaaaau

SEQ ID NO: 3942415 - RNA, 16 nt, Shigella flexneri 2a str. 301
cggggacaggcggccc

SEQ ID NO: 3942416 - RNA, 18 nt, Shigella flexneri 2a str. 301
cggggagagucauuaugc

SEQ ID NO: 3942417 - RNA, 13 nt, Shigella flexneri 2a str. 301
cggggaucacucc

SEQ ID NO: 3942418 - RNA, 20 nt, Shigella flexneri 2a str. 301
cggggauuauugccgcagcg

SEQ ID NO: 3942419 - RNA, 12 nt, Shigella flexneri 2a str. 301
cggggcauucau

SEQ ID NO: 3942420 - RNA, 18 nt, Shigella flexneri 2a str. 301
cggggcggcuaucccaaa

SEQ ID NO: 3942421 - RNA, 18 nt, Shigella flexneri 2a str. 301
cggggcuaccgccagacc

SEQ ID NO: 3942422 - RNA, 20 nt, Shigella flexneri 2a str. 301
cggggcuguuuuccagcacc

SEQ ID NO: 3942423 - RNA, 21 nt, Shigella flexneri 2a str. 301
cggggcuguuuuccagcacca

SEQ ID NO: 3942424 - RNA, 19 nt, Shigella flexneri 2a str. 301
cggggcuuuucucuaucug

SEQ ID NO: 3942425 - RNA, 17 nt, Shigella flexneri 2a str. 301
cggggugcaucgcccug

SEQ ID NO: 3942426 - RNA, 14 nt, Shigella flexneri 2a str. 301
cgggguuugcagau

SEQ ID NO: 3942427 - RNA, 14 nt, Shigella flexneri 2a str. 301
cggguaaccagcca

SEQ ID NO: 3942428 - RNA, 16 nt, Shigella flexneri 2a str. 301
cggguaaguacgccau

SEQ ID NO: 3942429 - RNA, 14 nt, Shigella flexneri 2a str. 301
cgggucaccgccga

SEQ ID NO: 3942430 - RNA, 16 nt, Shigella flexneri 2a str. 301
cgggucaccgcggugu

SEQ ID NO: 3942431 - RNA, 14 nt, Shigella flexneri 2a str. 301
cgggucagcggggu

SEQ ID NO: 3942432 - RNA, 15 nt, Shigella flexneri 2a str. 301
cgggucaggccagga

SEQ ID NO: 3942433 - RNA, 20 nt, Shigella flexneri 2a str. 301
cgggucaguauuccaaucgg

SEQ ID NO: 3942434 - RNA, 20 nt, Shigella flexneri 2a str. 301
cgggucaguccccacgccau

SEQ ID NO: 3942435 - RNA, 23 nt, Shigella flexneri 2a str. 301
cgggucauccaggaacuccagau

SEQ ID NO: 3942436 - RNA, 16 nt, Shigella flexneri 2a str. 301
cggguccgggcaucag

SEQ ID NO: 3942437 - RNA, 15 nt, Shigella flexneri 2a str. 301
cgggugaucuucaua

SEQ ID NO: 3942438 - RNA, 19 nt, Shigella flexneri 2a str. 301
cgggugaucuucauagaua

SEQ ID NO: 3942439 - RNA, 21 nt, Shigella flexneri 2a str. 301
cgggugcaaucaacaccacug

SEQ ID NO: 3942440 - RNA, 23 nt, Shigella flexneri 2a str. 301
cgggugcaaucaacaccacugcc

SEQ ID NO: 3942441 - RNA, 19 nt, Shigella flexneri 2a str. 301
cgggugcgacaggagccgc

SEQ ID NO: 3942442 - RNA, 19 nt, Shigella flexneri 2a str. 301
cggguggcgauaauaaucu

SEQ ID NO: 3942443 - RNA, 17 nt, Shigella flexneri 2a str. 301
cggguggcucucgccag

SEQ ID NO: 3942444 - RNA, 19 nt, Shigella flexneri 2a str. 301
cggguggcucucgccagca

SEQ ID NO: 3942445 - RNA, 19 nt, Shigella flexneri 2a str. 301
cgggugguaauaccacccg

SEQ ID NO: 3942446 - RNA, 19 nt, Shigella flexneri 2a str. 301
cggguggugcguaccaggc

SEQ ID NO: 3942447 - RNA, 14 nt, Shigella flexneri 2a str. 301
cggguuaaauccug

SEQ ID NO: 3942448 - RNA, 20 nt, Shigella flexneri 2a str. 301
cggguuaaccagcaccagcu

SEQ ID NO: 3942449 - RNA, 20 nt, Shigella flexneri 2a str. 301
cggguugcgguuucaacugc

SEQ ID NO: 3942450 - RNA, 15 nt, Shigella flexneri 2a str. 301
cggguuggagcgcgu

SEQ ID NO: 3942451 - RNA, 18 nt, Shigella flexneri 2a str. 301
cggguuuacuuccccggc

SEQ ID NO: 3942452 - RNA, 15 nt, Shigella flexneri 2a str. 301
cggguuuucaacggc

SEQ ID NO: 3942453 - RNA, 22 nt, Shigella flexneri 2a str. 301
cggguuuucgcugccacaccau

SEQ ID NO: 3942454 - RNA, 18 nt, Shigella flexneri 2a str. 301
cgguaaaaccuuugcgaa

SEQ ID NO: 3942455 - RNA, 18 nt, Shigella flexneri 2a str. 301
cgguaaaagcccauuauu

SEQ ID NO: 3942456 - RNA, 20 nt, Shigella flexneri 2a str. 301
cgguaaaaucauccugcugc

SEQ ID NO: 3942457 - RNA, 18 nt, Shigella flexneri 2a str. 301
cgguaaaauggucagcca

SEQ ID NO: 3942458 - RNA, 17 nt, Shigella flexneri 2a str. 301
cgguaaaccguuaucac

SEQ ID NO: 3942459 - RNA, 22 nt, Shigella flexneri 2a str. 301
cgguaaagaagagcggcaaacg

SEQ ID NO: 3942460 - RNA, 17 nt, Shigella flexneri 2a str. 301
cgguaaagcgcggcagu

SEQ ID NO: 3942461 - RNA, 14 nt, Shigella flexneri 2a str. 301
cgguaaauugcccc

SEQ ID NO: 3942462 - RNA, 13 nt, Shigella flexneri 2a str. 301
cgguaacauccag

SEQ ID NO: 3942463 - RNA, 22 nt, Shigella flexneri 2a str. 301
cgguaacgauacggcccagacc

SEQ ID NO: 3942464 - RNA, 23 nt, Shigella flexneri 2a str. 301
cgguaacgauuucaucgcccagg

SEQ ID NO: 3942465 - RNA, 17 nt, Shigella flexneri 2a str. 301
cgguaacgccaguuuaa

SEQ ID NO: 3942466 - RNA, 18 nt, Shigella flexneri 2a str. 301
cgguaacgccaguuuaau

SEQ ID NO: 3942467 - RNA, 20 nt, Shigella flexneri 2a str. 301
cgguaacguugcucaagggu

SEQ ID NO: 3942468 - RNA, 13 nt, Shigella flexneri 2a str. 301
cgguaacucugau

SEQ ID NO: 3942469 - RNA, 21 nt, Shigella flexneri 2a str. 301
cgguaaguucacgcagguuag

SEQ ID NO: 3942470 - RNA, 22 nt, Shigella flexneri 2a str. 301
cgguaauaaaugccggaagcug

SEQ ID NO: 3942471 - RNA, 15 nt, Shigella flexneri 2a str. 301
cgguaaugacuccaa

SEQ ID NO: 3942472 - RNA, 16 nt, Shigella flexneri 2a str. 301
cgguaauggcaaagau

SEQ ID NO: 3942473 - RNA, 19 nt, Shigella flexneri 2a str. 301
cgguaauuauugaugaagu

SEQ ID NO: 3942474 - RNA, 14 nt, Shigella flexneri 2a str. 301
cgguaauuccggcg

SEQ ID NO: 3942475 - RNA, 20 nt, Shigella flexneri 2a str. 301
cgguaccuuugaacugcuga

SEQ ID NO: 3942476 - RNA, 15 nt, Shigella flexneri 2a str. 301
cgguacucgcgcagu

SEQ ID NO: 3942477 - RNA, 13 nt, Shigella flexneri 2a str. 301
cgguacuucucac

SEQ ID NO: 3942478 - RNA, 16 nt, Shigella flexneri 2a str. 301
cgguagaauuguaauc

SEQ ID NO: 3942479 - RNA, 22 nt, Shigella flexneri 2a str. 301
cgguagcacgucaucugcacgg

SEQ ID NO: 3942480 - RNA, 21 nt, Shigella flexneri 2a str. 301
cgguagcagcuuucagcagcg

SEQ ID NO: 3942481 - RNA, 14 nt, Shigella flexneri 2a str. 301
cgguagccauuccc

SEQ ID NO: 3942482 - RNA, 20 nt, Shigella flexneri 2a str. 301
cgguagccccgcgaacgggg

SEQ ID NO: 3942483 - RNA, 15 nt, Shigella flexneri 2a str. 301
cgguagucaccgccc

SEQ ID NO: 3942484 - RNA, 15 nt, Shigella flexneri 2a str. 301
cgguaguggcaacca

SEQ ID NO: 3942485 - RNA, 17 nt, Shigella flexneri 2a str. 301
cgguaguuucagcggcg

SEQ ID NO: 3942486 - RNA, 16 nt, Shigella flexneri 2a str. 301
cgguaguuucucccca

SEQ ID NO: 3942487 - RNA, 13 nt, Shigella flexneri 2a str. 301
cgguaucaaacac

SEQ ID NO: 3942488 - RNA, 14 nt, Shigella flexneri 2a str. 301
cgguaucaccaccc

SEQ ID NO: 3942489 - RNA, 19 nt, Shigella flexneri 2a str. 301
cgguaucaccacccagcgg

SEQ ID NO: 3942490 - RNA, 20 nt, Shigella flexneri 2a str. 301
cgguaucaccacccagcggu

SEQ ID NO: 3942491 - RNA, 21 nt, Shigella flexneri 2a str. 301
cgguaucaccacccagcggua

SEQ ID NO: 3942492 - RNA, 13 nt, Shigella flexneri 2a str. 301
cgguauccaucag

SEQ ID NO: 3942493 - RNA, 16 nt, Shigella flexneri 2a str. 301
cgguaugacccagcgc

SEQ ID NO: 3942494 - RNA, 18 nt, Shigella flexneri 2a str. 301
cgguauuaaucugccagc

SEQ ID NO: 3942495 - RNA, 23 nt, Shigella flexneri 2a str. 301
cgguauugccuguauuccuggcc

SEQ ID NO: 3942496 - RNA, 14 nt, Shigella flexneri 2a str. 301
cgguauuggugaaa

SEQ ID NO: 3942497 - RNA, 14 nt, Shigella flexneri 2a str. 301
cggucaacgcgcgg

SEQ ID NO: 3942498 - RNA, 16 nt, Shigella flexneri 2a str. 301
cggucaacgcgcggcu

SEQ ID NO: 3942499 - RNA, 21 nt, Shigella flexneri 2a str. 301
cggucaacgcgcggcuuaucg

SEQ ID NO: 3942500 - RNA, 23 nt, Shigella flexneri 2a str. 301
cggucaagcgcagcgcccccggc

SEQ ID NO: 3942501 - RNA, 17 nt, Shigella flexneri 2a str. 301
cggucacaucgcugaca

SEQ ID NO: 3942502 - RNA, 12 nt, Shigella flexneri 2a str. 301
cggucagcagca

SEQ ID NO: 3942503 - RNA, 14 nt, Shigella flexneri 2a str. 301
cggucagcagcacc

SEQ ID NO: 3942504 - RNA, 16 nt, Shigella flexneri 2a str. 301
cggucagcagcaccac

SEQ ID NO: 3942505 - RNA, 12 nt, Shigella flexneri 2a str. 301
cggucagccauu

SEQ ID NO: 3942506 - RNA, 13 nt, Shigella flexneri 2a str. 301
cggucauugccug

SEQ ID NO: 3942507 - RNA, 23 nt, Shigella flexneri 2a str. 301
cgguccgccguagccgguaaugg

SEQ ID NO: 3942508 - RNA, 18 nt, Shigella flexneri 2a str. 301
cgguccuggcgaucgggc

SEQ ID NO: 3942509 - RNA, 16 nt, Shigella flexneri 2a str. 301
cggucgaugcgcaacg

SEQ ID NO: 3942510 - RNA, 19 nt, Shigella flexneri 2a str. 301
cggucgccgucaggcaagc

SEQ ID NO: 3942511 - RNA, 15 nt, Shigella flexneri 2a str. 301
cggucgcugacgcca

SEQ ID NO: 3942512 - RNA, 15 nt, Shigella flexneri 2a str. 301
cggucggcuucccug

SEQ ID NO: 3942513 - RNA, 23 nt, Shigella flexneri 2a str. 301
cggucguaaucgcccgcuuccag

SEQ ID NO: 3942514 - RNA, 22 nt, Shigella flexneri 2a str. 301
cggucguuaccaguaaaugcgg

SEQ ID NO: 3942515 - RNA, 20 nt, Shigella flexneri 2a str. 301
cggucuaaaucuuccgccgg

SEQ ID NO: 3942516 - RNA, 20 nt, Shigella flexneri 2a str. 301
cggucuaccgauccggcacc

SEQ ID NO: 3942517 - RNA, 16 nt, Shigella flexneri 2a str. 301
cggucugguguaucug

SEQ ID NO: 3942518 - RNA, 20 nt, Shigella flexneri 2a str. 301
cggucugguguaucugcugu

SEQ ID NO: 3942519 - RNA, 14 nt, Shigella flexneri 2a str. 301
cggucuuuucucau

SEQ ID NO: 3942520 - RNA, 22 nt, Shigella flexneri 2a str. 301
cggugaaaguaacugacaguag

SEQ ID NO: 3942521 - RNA, 19 nt, Shigella flexneri 2a str. 301
cggugaagcgcccugcaau

SEQ ID NO: 3942522 - RNA, 18 nt, Shigella flexneri 2a str. 301
cggugaaggcaaacuguc

SEQ ID NO: 3942523 - RNA, 13 nt, Shigella flexneri 2a str. 301
cggugaccagcag

SEQ ID NO: 3942524 - RNA, 17 nt, Shigella flexneri 2a str. 301
cggugaccgaucgcccg

SEQ ID NO: 3942525 - RNA, 17 nt, Shigella flexneri 2a str. 301
cggugagcugcaucugu

SEQ ID NO: 3942526 - RNA, 21 nt, Shigella flexneri 2a str. 301
cggugauaaacccaacggcaa

SEQ ID NO: 3942527 - RNA, 14 nt, Shigella flexneri 2a str. 301
cggugauacagcaa

SEQ ID NO: 3942528 - RNA, 19 nt, Shigella flexneri 2a str. 301
cggugauacugaucgucau

SEQ ID NO: 3942529 - RNA, 20 nt, Shigella flexneri 2a str. 301
cggugauauacgucacuuca

SEQ ID NO: 3942530 - RNA, 15 nt, Shigella flexneri 2a str. 301
cggugauuuccgccg

SEQ ID NO: 3942531 - RNA, 21 nt, Shigella flexneri 2a str. 301
cggugauuuccgccgccagca

SEQ ID NO: 3942532 - RNA, 22 nt, Shigella flexneri 2a str. 301
cggugauuuccgccgccagcag

SEQ ID NO: 3942533 - RNA, 22 nt, Shigella flexneri 2a str. 301
cggugcaacccgccagguuuca

SEQ ID NO: 3942534 - RNA, 16 nt, Shigella flexneri 2a str. 301
cggugcaucuucacac

SEQ ID NO: 3942535 - RNA, 17 nt, Shigella flexneri 2a str. 301
cggugccaucauacagc

SEQ ID NO: 3942536 - RNA, 23 nt, Shigella flexneri 2a str. 301
cggugccgcgauaccacccgcag

SEQ ID NO: 3942537 - RNA, 23 nt, Shigella flexneri 2a str. 301
cggugcgaauugccaccauccgc

SEQ ID NO: 3942538 - RNA, 13 nt, Shigella flexneri 2a str. 301
cggugcgagcgcc

SEQ ID NO: 3942539 - RNA, 23 nt, Shigella flexneri 2a str. 301
cggugcggcucucuuucuccagc

SEQ ID NO: 3942540 - RNA, 17 nt, Shigella flexneri 2a str. 301
cggugcgguaagcugcg

SEQ ID NO: 3942541 - RNA, 15 nt, Shigella flexneri 2a str. 301
cggugcuccagugcg

SEQ ID NO: 3942542 - RNA, 12 nt, Shigella flexneri 2a str. 301
cggugcuggcgc

SEQ ID NO: 3942543 - RNA, 13 nt, Shigella flexneri 2a str. 301
cggugcuggucug

SEQ ID NO: 3942544 - RNA, 18 nt, Shigella flexneri 2a str. 301
cgguggaacauuuaccgc

SEQ ID NO: 3942545 - RNA, 17 nt, Shigella flexneri 2a str. 301
cgguggccgucgagcag

SEQ ID NO: 3942546 - RNA, 17 nt, Shigella flexneri 2a str. 301
cgguggccuugccguug

SEQ ID NO: 3942547 - RNA, 15 nt, Shigella flexneri 2a str. 301
cggugguauuaccgc

SEQ ID NO: 3942548 - RNA, 15 nt, Shigella flexneri 2a str. 301
cgguggucauaauau

SEQ ID NO: 3942549 - RNA, 19 nt, Shigella flexneri 2a str. 301
cggugguguaaccuucacc

SEQ ID NO: 3942550 - RNA, 21 nt, Shigella flexneri 2a str. 301
cggugguugccggucuggugu

SEQ ID NO: 3942551 - RNA, 17 nt, Shigella flexneri 2a str. 301
cggugguuguuccugcg

SEQ ID NO: 3942552 - RNA, 23 nt, Shigella flexneri 2a str. 301
cgguguaaccaucaaaacgcugg

SEQ ID NO: 3942553 - RNA, 21 nt, Shigella flexneri 2a str. 301
cggugugcagcguacuucaug

SEQ ID NO: 3942554 - RNA, 18 nt, Shigella flexneri 2a str. 301
cgguguucaagccaaaac

SEQ ID NO: 3942555 - RNA, 19 nt, Shigella flexneri 2a str. 301
cgguguucaagccaaaacg

SEQ ID NO: 3942556 - RNA, 16 nt, Shigella flexneri 2a str. 301
cgguguucguuguauc

SEQ ID NO: 3942557 - RNA, 22 nt, Shigella flexneri 2a str. 301
cgguguuguuggucaggaaacu

SEQ ID NO: 3942558 - RNA, 14 nt, Shigella flexneri 2a str. 301
cgguuaaaaauaau

SEQ ID NO: 3942559 - RNA, 17 nt, Shigella flexneri 2a str. 301
cgguuaacaguuuguuu

SEQ ID NO: 3942560 - RNA, 14 nt, Shigella flexneri 2a str. 301
cgguuaauaaugau

SEQ ID NO: 3942561 - RNA, 23 nt, Shigella flexneri 2a str. 301
cgguuaauugcgccagcacauca

SEQ ID NO: 3942562 - RNA, 23 nt, Shigella flexneri 2a str. 301
cgguuagaacaauuaacccgcga

SEQ ID NO: 3942563 - RNA, 19 nt, Shigella flexneri 2a str. 301
cgguuagaauaccugccug

SEQ ID NO: 3942564 - RNA, 13 nt, Shigella flexneri 2a str. 301
cgguuagcggcuu

SEQ ID NO: 3942565 - RNA, 21 nt, Shigella flexneri 2a str. 301
cgguuagucgcugguugcaug

SEQ ID NO: 3942566 - RNA, 17 nt, Shigella flexneri 2a str. 301
cgguuaucacucuugac

SEQ ID NO: 3942567 - RNA, 23 nt, Shigella flexneri 2a str. 301
cgguucaauaucuuccuggcgcu

SEQ ID NO: 3942568 - RNA, 15 nt, Shigella flexneri 2a str. 301
cgguucagcgucggc

SEQ ID NO: 3942569 - RNA, 17 nt, Shigella flexneri 2a str. 301
cgguucagcgucggcgu

SEQ ID NO: 3942570 - RNA, 14 nt, Shigella flexneri 2a str. 301
cgguucaucacgaa

SEQ ID NO: 3942571 - RNA, 11 nt, Shigella flexneri 2a str. 301
cgguucccaga

SEQ ID NO: 3942572 - RNA, 18 nt, Shigella flexneri 2a str. 301
cgguugaccggccagucu

SEQ ID NO: 3942573 - RNA, 14 nt, Shigella flexneri 2a str. 301
cgguugacugcuga

SEQ ID NO: 3942574 - RNA, 15 nt, Shigella flexneri 2a str. 301
cgguugacugcugag

SEQ ID NO: 3942575 - RNA, 22 nt, Shigella flexneri 2a str. 301
cgguugaugccguuccacccag

SEQ ID NO: 3942576 - RNA, 12 nt, Shigella flexneri 2a str. 301
cgguugccauaa

SEQ ID NO: 3942577 - RNA, 18 nt, Shigella flexneri 2a str. 301
cgguugcuuuucacaacc

SEQ ID NO: 3942578 - RNA, 22 nt, Shigella flexneri 2a str. 301
cgguuggcaucagaggaaugau

SEQ ID NO: 3942579 - RNA, 18 nt, Shigella flexneri 2a str. 301
cgguuguagcucggcgca

SEQ ID NO: 3942580 - RNA, 23 nt, Shigella flexneri 2a str. 301
cgguuguucaaccaccggcacca

SEQ ID NO: 3942581 - RNA, 11 nt, Shigella flexneri 2a str. 301
cgguuuaaccg

SEQ ID NO: 3942582 - RNA, 18 nt, Shigella flexneri 2a str. 301
cgguuuaucaucggucag

SEQ ID NO: 3942583 - RNA, 23 nt, Shigella flexneri 2a str. 301
cgguuuauccauccccagagcac

SEQ ID NO: 3942584 - RNA, 17 nt, Shigella flexneri 2a str. 301
cgguuuauccccaagga

SEQ ID NO: 3942585 - RNA, 15 nt, Shigella flexneri 2a str. 301
cgguuuaucucaucu

SEQ ID NO: 3942586 - RNA, 20 nt, Shigella flexneri 2a str. 301
cgguuucaaauuacgaucca

SEQ ID NO: 3942587 - RNA, 15 nt, Shigella flexneri 2a str. 301
cgguuucaauccagg

SEQ ID NO: 3942588 - RNA, 16 nt, Shigella flexneri 2a str. 301
cgguuucacuauuacc

SEQ ID NO: 3942589 - RNA, 21 nt, Shigella flexneri 2a str. 301
cgguuucagcucacggccggu

SEQ ID NO: 3942590 - RNA, 15 nt, Shigella flexneri 2a str. 301
cgguuucugaauuuc

SEQ ID NO: 3942591 - RNA, 18 nt, Shigella flexneri 2a str. 301
cgguuugcggcaggacag

SEQ ID NO: 3942592 - RNA, 17 nt, Shigella flexneri 2a str. 301
cgguuuguaggccugau

SEQ ID NO: 3942593 - RNA, 19 nt, Shigella flexneri 2a str. 301
cgguuuguaggccugauaa

SEQ ID NO: 3942594 - RNA, 19 nt, Shigella flexneri 2a str. 301
cgguuuucgcgccagccag

SEQ ID NO: 3942595 - RNA, 20 nt, Shigella flexneri 2a str. 301
cgguuuucgcgccagccagu

SEQ ID NO: 3942596 - RNA, 13 nt, Shigella flexneri 2a str. 301
cgguuuugccagc

SEQ ID NO: 3942597 - RNA, 16 nt, Shigella flexneri 2a str. 301
cgguuuugcuauccag

SEQ ID NO: 3942598 - RNA, 19 nt, Shigella flexneri 2a str. 301
cgguuuuguugccgcccgu

SEQ ID NO: 3942599 - RNA, 13 nt, Shigella flexneri 2a str. 301
cgguuuuuugcuc

SEQ ID NO: 3942600 - RNA, 14 nt, Shigella flexneri 2a str. 301
cguaaacaacuggc

SEQ ID NO: 3942601 - RNA, 15 nt, Shigella flexneri 2a str. 301
cguaaacaacuggcg

SEQ ID NO: 3942602 - RNA, 18 nt, Shigella flexneri 2a str. 301
cguaaaccacugacacag

SEQ ID NO: 3942603 - RNA, 18 nt, Shigella flexneri 2a str. 301
cguaaagcgucgcaucag

SEQ ID NO: 3942604 - RNA, 19 nt, Shigella flexneri 2a str. 301
cguaaaggcggcagaacag

SEQ ID NO: 3942605 - RNA, 20 nt, Shigella flexneri 2a str. 301
cguaaaggcggcagaacaga

SEQ ID NO: 3942606 - RNA, 16 nt, Shigella flexneri 2a str. 301
cguaaauaguccggaa

SEQ ID NO: 3942607 - RNA, 21 nt, Shigella flexneri 2a str. 301
cguaaauaguccggaagaugc

SEQ ID NO: 3942608 - RNA, 14 nt, Shigella flexneri 2a str. 301
cguaaaucccgcca

SEQ ID NO: 3942609 - RNA, 16 nt, Shigella flexneri 2a str. 301
cguaaaucccgccauu

SEQ ID NO: 3942610 - RNA, 15 nt, Shigella flexneri 2a str. 301
cguaaaucuuuacca

SEQ ID NO: 3942611 - RNA, 17 nt, Shigella flexneri 2a str. 301
cguaacacauaacgcca

SEQ ID NO: 3942612 - RNA, 11 nt, Shigella flexneri 2a str. 301
cguaacauauu

SEQ ID NO: 3942613 - RNA, 14 nt, Shigella flexneri 2a str. 301
cguaacccaccacc

SEQ ID NO: 3942614 - RNA, 18 nt, Shigella flexneri 2a str. 301
cguaacccacugacuucu

SEQ ID NO: 3942615 - RNA, 13 nt, Shigella flexneri 2a str. 301
cguaacgacugac

SEQ ID NO: 3942616 - RNA, 12 nt, Shigella flexneri 2a str. 301
cguaacgacugc

SEQ ID NO: 3942617 - RNA, 16 nt, Shigella flexneri 2a str. 301
cguaacgacugcggau

SEQ ID NO: 3942618 - RNA, 22 nt, Shigella flexneri 2a str. 301
cguaagcgcauccggcaccagc

SEQ ID NO: 3942619 - RNA, 21 nt, Shigella flexneri 2a str. 301
cguaauaagguucauugagcg

SEQ ID NO: 3942620 - RNA, 17 nt, Shigella flexneri 2a str. 301
cguaauacccuugcaga

SEQ ID NO: 3942621 - RNA, 21 nt, Shigella flexneri 2a str. 301
cguaauaguuucugacauuuu

SEQ ID NO: 3942622 - RNA, 23 nt, Shigella flexneri 2a str. 301
cguaauaguuucugacauuuuua

SEQ ID NO: 3942623 - RNA, 18 nt, Shigella flexneri 2a str. 301
cguaaucccggauaucac

SEQ ID NO: 3942624 - RNA, 20 nt, Shigella flexneri 2a str. 301
cguaaugauguaaaaauacu

SEQ ID NO: 3942625 - RNA, 20 nt, Shigella flexneri 2a str. 301
cguaauggcagcauucaggu

SEQ ID NO: 3942626 - RNA, 19 nt, Shigella flexneri 2a str. 301
cguaauguugaguggaagc

SEQ ID NO: 3942627 - RNA, 14 nt, Shigella flexneri 2a str. 301
cguaauuugccguu

SEQ ID NO: 3942628 - RNA, 19 nt, Shigella flexneri 2a str. 301
cguacaaaacgcaccacuu

SEQ ID NO: 3942629 - RNA, 19 nt, Shigella flexneri 2a str. 301
cguacaaaauuagaaaggg

SEQ ID NO: 3942630 - RNA, 12 nt, Shigella flexneri 2a str. 301
cguacaccaaca

SEQ ID NO: 3942631 - RNA, 15 nt, Shigella flexneri 2a str. 301
cguacaccaacauca

SEQ ID NO: 3942632 - RNA, 21 nt, Shigella flexneri 2a str. 301
cguacaucccgcgaacgagaa

SEQ ID NO: 3942633 - RNA, 18 nt, Shigella flexneri 2a str. 301
cguaccacgcacagcccg

SEQ ID NO: 3942634 - RNA, 16 nt, Shigella flexneri 2a str. 301
cguaccacggcauuuc

SEQ ID NO: 3942635 - RNA, 20 nt, Shigella flexneri 2a str. 301
cguaccaucauuggagaguu

SEQ ID NO: 3942636 - RNA, 16 nt, Shigella flexneri 2a str. 301
cguaccaugcgcauca

SEQ ID NO: 3942637 - RNA, 18 nt, Shigella flexneri 2a str. 301
cguaccaugcgcaucauc

SEQ ID NO: 3942638 - RNA, 16 nt, Shigella flexneri 2a str. 301
cguacccagcagcgcc

SEQ ID NO: 3942639 - RNA, 16 nt, Shigella flexneri 2a str. 301
cguacccgccugauag

SEQ ID NO: 3942640 - RNA, 17 nt, Shigella flexneri 2a str. 301
cguacccgcugcugacu

SEQ ID NO: 3942641 - RNA, 16 nt, Shigella flexneri 2a str. 301
cguacccggaucgcgg

SEQ ID NO: 3942642 - RNA, 13 nt, Shigella flexneri 2a str. 301
cguaccgcagcaa

SEQ ID NO: 3942643 - RNA, 22 nt, Shigella flexneri 2a str. 301
cguaccgcagcaauggccggaa

SEQ ID NO: 3942644 - RNA, 23 nt, Shigella flexneri 2a str. 301
cguaccgguaaaccugguguucg

SEQ ID NO: 3942645 - RNA, 17 nt, Shigella flexneri 2a str. 301
cguaccucacguuccag

SEQ ID NO: 3942646 - RNA, 13 nt, Shigella flexneri 2a str. 301
cguaccuucaggc

SEQ ID NO: 3942647 - RNA, 12 nt, Shigella flexneri 2a str. 301
cguacgacguuc

SEQ ID NO: 3942648 - RNA, 16 nt, Shigella flexneri 2a str. 301
cguacgacguucaggc

SEQ ID NO: 3942649 - RNA, 24 nt, Shigella flexneri 2a str. 301
cguacgcaauccucuuuuccgaac

SEQ ID NO: 3942650 - RNA, 19 nt, Shigella flexneri 2a str. 301
cguacgcgccccacuggau

SEQ ID NO: 3942651 - RNA, 15 nt, Shigella flexneri 2a str. 301
cguacucaauuuuca

SEQ ID NO: 3942652 - RNA, 16 nt, Shigella flexneri 2a str. 301
cguacucaccgcucac

SEQ ID NO: 3942653 - RNA, 14 nt, Shigella flexneri 2a str. 301
cguacuccaucucg

SEQ ID NO: 3942654 - RNA, 21 nt, Shigella flexneri 2a str. 301
cguacucugccacuacccgca

SEQ ID NO: 3942655 - RNA, 12 nt, Shigella flexneri 2a str. 301
cguacugcugaa

SEQ ID NO: 3942656 - RNA, 15 nt, Shigella flexneri 2a str. 301
cguacugcugaauga

SEQ ID NO: 3942657 - RNA, 16 nt, Shigella flexneri 2a str. 301
cguacuggcaaucgcc

SEQ ID NO: 3942658 - RNA, 18 nt, Shigella flexneri 2a str. 301
cguacuggcaaucgccag

SEQ ID NO: 3942659 - RNA, 23 nt, Shigella flexneri 2a str. 301
cguacuggcaaucgccagcggca

SEQ ID NO: 3942660 - RNA, 17 nt, Shigella flexneri 2a str. 301
cguacuucaugaguucc

SEQ ID NO: 3942661 - RNA, 12 nt, Shigella flexneri 2a str. 301
cguacuuccuua

SEQ ID NO: 3942662 - RNA, 16 nt, Shigella flexneri 2a str. 301
cguacuugccaauacg

SEQ ID NO: 3942663 - RNA, 22 nt, Shigella flexneri 2a str. 301
cguagaaaccacucgccagacc

SEQ ID NO: 3942664 - RNA, 14 nt, Shigella flexneri 2a str. 301
cguagacugcagcg

SEQ ID NO: 3942665 - RNA, 19 nt, Shigella flexneri 2a str. 301
cguagaucauagagcacgg

SEQ ID NO: 3942666 - RNA, 24 nt, Shigella flexneri 2a str. 301
cguagcaccgacgucgauauaauu

SEQ ID NO: 3942667 - RNA, 15 nt, Shigella flexneri 2a str. 301
cguagccagauuguu

SEQ ID NO: 3942668 - RNA, 16 nt, Shigella flexneri 2a str. 301
cguagcguuuuuucau

SEQ ID NO: 3942669 - RNA, 14 nt, Shigella flexneri 2a str. 301
cguagcucaucuuc

SEQ ID NO: 3942670 - RNA, 17 nt, Shigella flexneri 2a str. 301
cguagcuguucaggaga

SEQ ID NO: 3942671 - RNA, 14 nt, Shigella flexneri 2a str. 301
cguaggccaaccgu

SEQ ID NO: 3942672 - RNA, 21 nt, Shigella flexneri 2a str. 301
cguaggccagauaagacgcgc

SEQ ID NO: 3942673 - RNA, 21 nt, Shigella flexneri 2a str. 301
cguaggccagcggcuccccgc

SEQ ID NO: 3942674 - RNA, 20 nt, Shigella flexneri 2a str. 301
cguaggccggauaaggcguu

SEQ ID NO: 3942675 - RNA, 19 nt, Shigella flexneri 2a str. 301
cguaggccugauaagacgc

SEQ ID NO: 3942676 - RNA, 18 nt, Shigella flexneri 2a str. 301
cguaggucggauaagacg

SEQ ID NO: 3942677 - RNA, 19 nt, Shigella flexneri 2a str. 301
cguaguguggggaaugaua

SEQ ID NO: 3942678 - RNA, 17 nt, Shigella flexneri 2a str. 301
cguaguucuuucucugc

SEQ ID NO: 3942679 - RNA, 15 nt, Shigella flexneri 2a str. 301
cguauacaagaacgu

SEQ ID NO: 3942680 - RNA, 12 nt, Shigella flexneri 2a str. 301
cguauccaucac

SEQ ID NO: 3942681 - RNA, 15 nt, Shigella flexneri 2a str. 301
cguaucccccagagc

SEQ ID NO: 3942682 - RNA, 21 nt, Shigella flexneri 2a str. 301
cguauccgaugaaucaccaca

SEQ ID NO: 3942683 - RNA, 13 nt, Shigella flexneri 2a str. 301
cguauccggcaug

SEQ ID NO: 3942684 - RNA, 20 nt, Shigella flexneri 2a str. 301
cguauccggcaugucacaaa

SEQ ID NO: 3942685 - RNA, 11 nt, Shigella flexneri 2a str. 301
cguauccggcu

SEQ ID NO: 3942686 - RNA, 20 nt, Shigella flexneri 2a str. 301
cguaucuucaugcuccagca

SEQ ID NO: 3942687 - RNA, 14 nt, Shigella flexneri 2a str. 301
cguaucuuccaggg

SEQ ID NO: 3942688 - RNA, 17 nt, Shigella flexneri 2a str. 301
cguaugaucauccgccu

SEQ ID NO: 3942689 - RNA, 14 nt, Shigella flexneri 2a str. 301
cguaugcagccagg

SEQ ID NO: 3942690 - RNA, 18 nt, Shigella flexneri 2a str. 301
cguaugcagccaggccau

SEQ ID NO: 3942691 - RNA, 14 nt, Shigella flexneri 2a str. 301
cguaugcccagcgc

SEQ ID NO: 3942692 - RNA, 15 nt, Shigella flexneri 2a str. 301
cguaugcccagcgca

SEQ ID NO: 3942693 - RNA, 12 nt, Shigella flexneri 2a str. 301
cguaugcgucag

SEQ ID NO: 3942694 - RNA, 15 nt, Shigella flexneri 2a str. 301
cguaugcgucagcaa

SEQ ID NO: 3942695 - RNA, 18 nt, Shigella flexneri 2a str. 301
cguauucaacgguaaguu

SEQ ID NO: 3942696 - RNA, 22 nt, Shigella flexneri 2a str. 301
cguauucggcaagcguaacgug

SEQ ID NO: 3942697 - RNA, 21 nt, Shigella flexneri 2a str. 301
cguauucugacugucagaugc

SEQ ID NO: 3942698 - RNA, 22 nt, Shigella flexneri 2a str. 301
cguauugagaucaccugcugga

SEQ ID NO: 3942699 - RNA, 22 nt, Shigella flexneri 2a str. 301
cguauugcgcagagaugcccau

SEQ ID NO: 3942700 - RNA, 14 nt, Shigella flexneri 2a str. 301
cguauugcgccggu

SEQ ID NO: 3942701 - RNA, 14 nt, Shigella flexneri 2a str. 301
cguauuuauuuucc

SEQ ID NO: 3942702 - RNA, 15 nt, Shigella flexneri 2a str. 301
cguauuuauuuucca

SEQ ID NO: 3942703 - RNA, 23 nt, Shigella flexneri 2a str. 301
cguauuuuuugcucauaaaauca

SEQ ID NO: 3942704 - RNA, 18 nt, Shigella flexneri 2a str. 301
cgucaaacgcacgucuga

SEQ ID NO: 3942705 - RNA, 21 nt, Shigella flexneri 2a str. 301
cgucaacaccgggugcagaca

SEQ ID NO: 3942706 - RNA, 18 nt, Shigella flexneri 2a str. 301
cgucaacggugccauuga

SEQ ID NO: 3942707 - RNA, 23 nt, Shigella flexneri 2a str. 301
cgucaacuuuguuagcgaauaaa

SEQ ID NO: 3942708 - RNA, 18 nt, Shigella flexneri 2a str. 301
cgucaagcgucgcaucag

SEQ ID NO: 3942709 - RNA, 17 nt, Shigella flexneri 2a str. 301
cgucaaggguugccgga

SEQ ID NO: 3942710 - RNA, 13 nt, Shigella flexneri 2a str. 301
cgucaaucugccc

SEQ ID NO: 3942711 - RNA, 20 nt, Shigella flexneri 2a str. 301
cgucaaucugcuccauuagc

SEQ ID NO: 3942712 - RNA, 20 nt, Shigella flexneri 2a str. 301
cgucaauuuguuccgccagc

SEQ ID NO: 3942713 - RNA, 13 nt, Shigella flexneri 2a str. 301
cgucacaggccau

SEQ ID NO: 3942714 - RNA, 16 nt, Shigella flexneri 2a str. 301
cgucaccaccugggug

SEQ ID NO: 3942715 - RNA, 14 nt, Shigella flexneri 2a str. 301
cgucaccacuucac

SEQ ID NO: 3942716 - RNA, 15 nt, Shigella flexneri 2a str. 301
cgucaccuugccagu

SEQ ID NO: 3942717 - RNA, 17 nt, Shigella flexneri 2a str. 301
cgucacgcucauccugg

SEQ ID NO: 3942718 - RNA, 17 nt, Shigella flexneri 2a str. 301
cgucacguucugcgccg

SEQ ID NO: 3942719 - RNA, 20 nt, Shigella flexneri 2a str. 301
cgucacugaaucgcuguuaa

SEQ ID NO: 3942720 - RNA, 20 nt, Shigella flexneri 2a str. 301
cgucacuggugugucaucug

SEQ ID NO: 3942721 - RNA, 16 nt, Shigella flexneri 2a str. 301
cgucacugguucaaag

SEQ ID NO: 3942722 - RNA, 17 nt, Shigella flexneri 2a str. 301
cgucagagcaccaucgc

SEQ ID NO: 3942723 - RNA, 14 nt, Shigella flexneri 2a str. 301
cgucagauccgcca

SEQ ID NO: 3942724 - RNA, 17 nt, Shigella flexneri 2a str. 301
cgucagcaaaauacuga

SEQ ID NO: 3942725 - RNA, 16 nt, Shigella flexneri 2a str. 301
cgucagcauguuuaua

SEQ ID NO: 3942726 - RNA, 17 nt, Shigella flexneri 2a str. 301
cgucagccacuccacug

SEQ ID NO: 3942727 - RNA, 14 nt, Shigella flexneri 2a str. 301
cgucagccgcccgc

SEQ ID NO: 3942728 - RNA, 17 nt, Shigella flexneri 2a str. 301
cgucagcgaguugauca

SEQ ID NO: 3942729 - RNA, 23 nt, Shigella flexneri 2a str. 301
cgucagcguuccacgugcggccg

SEQ ID NO: 3942730 - RNA, 14 nt, Shigella flexneri 2a str. 301
cgucaggauaaacu

SEQ ID NO: 3942731 - RNA, 23 nt, Shigella flexneri 2a str. 301
cgucaggcaaucgagcccagaug

SEQ ID NO: 3942732 - RNA, 14 nt, Shigella flexneri 2a str. 301
cgucaggccgccac

SEQ ID NO: 3942733 - RNA, 13 nt, Shigella flexneri 2a str. 301
cgucagguuuugu

SEQ ID NO: 3942734 - RNA, 17 nt, Shigella flexneri 2a str. 301
cgucaguaaccgcuuuu

SEQ ID NO: 3942735 - RNA, 18 nt, Shigella flexneri 2a str. 301
cgucaguacauagccauc

SEQ ID NO: 3942736 - RNA, 19 nt, Shigella flexneri 2a str. 301
cgucaguacauagccaucu

SEQ ID NO: 3942737 - RNA, 21 nt, Shigella flexneri 2a str. 301
cgucaguacauagccaucugc

SEQ ID NO: 3942738 - RNA, 18 nt, Shigella flexneri 2a str. 301
cgucagugucuuaucugg

SEQ ID NO: 3942739 - RNA, 23 nt, Shigella flexneri 2a str. 301
cgucagugucuuaucuggcauuu

SEQ ID NO: 3942740 - RNA, 22 nt, Shigella flexneri 2a str. 301
cgucaguuuuucacccgcaauc

SEQ ID NO: 3942741 - RNA, 15 nt, Shigella flexneri 2a str. 301
cgucauacuccaguc

SEQ ID NO: 3942742 - RNA, 17 nt, Shigella flexneri 2a str. 301
cgucauacugcucagac

SEQ ID NO: 3942743 - RNA, 16 nt, Shigella flexneri 2a str. 301
cgucauauuacugcaa

SEQ ID NO: 3942744 - RNA, 18 nt, Shigella flexneri 2a str. 301
cgucauauuacugcaacu

SEQ ID NO: 3942745 - RNA, 18 nt, Shigella flexneri 2a str. 301
cgucaucacgcaggcugu

SEQ ID NO: 3942746 - RNA, 15 nt, Shigella flexneri 2a str. 301
cgucaucagcaauuu

SEQ ID NO: 3942747 - RNA, 18 nt, Shigella flexneri 2a str. 301
cgucaucauagacuuccc

SEQ ID NO: 3942748 - RNA, 22 nt, Shigella flexneri 2a str. 301
cgucaucauucaucgccuucuu

SEQ ID NO: 3942749 - RNA, 18 nt, Shigella flexneri 2a str. 301
cgucauccagcacuugca

SEQ ID NO: 3942750 - RNA, 15 nt, Shigella flexneri 2a str. 301
cgucaucccagucuu

SEQ ID NO: 3942751 - RNA, 19 nt, Shigella flexneri 2a str. 301
cgucaucccagucuucauc

SEQ ID NO: 3942752 - RNA, 19 nt, Shigella flexneri 2a str. 301
cgucaucggcguugcccau

SEQ ID NO: 3942753 - RNA, 14 nt, Shigella flexneri 2a str. 301
cgucauuaccgcga

SEQ ID NO: 3942754 - RNA, 20 nt, Shigella flexneri 2a str. 301
cgucauuagcgauaaauguc

SEQ ID NO: 3942755 - RNA, 13 nt, Shigella flexneri 2a str. 301
cgucauuaucugc

SEQ ID NO: 3942756 - RNA, 16 nt, Shigella flexneri 2a str. 301
cgucauuaucugcaga

SEQ ID NO: 3942757 - RNA, 15 nt, Shigella flexneri 2a str. 301
cgucauugacgcugg

SEQ ID NO: 3942758 - RNA, 23 nt, Shigella flexneri 2a str. 301
cgucauuguuaacgccgcgccgu

SEQ ID NO: 3942759 - RNA, 20 nt, Shigella flexneri 2a str. 301
cgucauuucgaagaaaccga

SEQ ID NO: 3942760 - RNA, 21 nt, Shigella flexneri 2a str. 301
cgucauuucgaagaaaccgau

SEQ ID NO: 3942761 - RNA, 21 nt, Shigella flexneri 2a str. 301
cgucauuuucaucgcuuucuu

SEQ ID NO: 3942762 - RNA, 12 nt, Shigella flexneri 2a str. 301
cguccagaugcg

SEQ ID NO: 3942763 - RNA, 14 nt, Shigella flexneri 2a str. 301
cguccagcagcaau

SEQ ID NO: 3942764 - RNA, 15 nt, Shigella flexneri 2a str. 301
cguccagcagcaaug

SEQ ID NO: 3942765 - RNA, 22 nt, Shigella flexneri 2a str. 301
cguccagcgaaccuuccaucgc

SEQ ID NO: 3942766 - RNA, 23 nt, Shigella flexneri 2a str. 301
cguccauccacaggguguauuca

SEQ ID NO: 3942767 - RNA, 13 nt, Shigella flexneri 2a str. 301
cgucccagccuug

SEQ ID NO: 3942768 - RNA, 18 nt, Shigella flexneri 2a str. 301
cgucccagucgucauccc

SEQ ID NO: 3942769 - RNA, 17 nt, Shigella flexneri 2a str. 301
cgucccaugaugcgcgg

SEQ ID NO: 3942770 - RNA, 13 nt, Shigella flexneri 2a str. 301
cguccgcacgcug

SEQ ID NO: 3942771 - RNA, 20 nt, Shigella flexneri 2a str. 301
cguccgcucggucacugaca

SEQ ID NO: 3942772 - RNA, 15 nt, Shigella flexneri 2a str. 301
cguccggcugccagc

SEQ ID NO: 3942773 - RNA, 16 nt, Shigella flexneri 2a str. 301
cguccgguuuacuucc

SEQ ID NO: 3942774 - RNA, 21 nt, Shigella flexneri 2a str. 301
cguccgguuuacuuccgggaa

SEQ ID NO: 3942775 - RNA, 23 nt, Shigella flexneri 2a str. 301
cguccucacuguuuucuaacuca

SEQ ID NO: 3942776 - RNA, 15 nt, Shigella flexneri 2a str. 301
cguccucuucccaga

SEQ ID NO: 3942777 - RNA, 20 nt, Shigella flexneri 2a str. 301
cguccuggcaacggacgacc

SEQ ID NO: 3942778 - RNA, 22 nt, Shigella flexneri 2a str. 301
cgucgaacgcugcgcgaccauc

SEQ ID NO: 3942779 - RNA, 19 nt, Shigella flexneri 2a str. 301
cgucgaucaacgcuggcau

SEQ ID NO: 3942780 - RNA, 14 nt, Shigella flexneri 2a str. 301
cgucgauugcucaa

SEQ ID NO: 3942781 - RNA, 18 nt, Shigella flexneri 2a str. 301
cgucgauugcucaacgcc

SEQ ID NO: 3942782 - RNA, 23 nt, Shigella flexneri 2a str. 301
cgucgauuguuauaccaguccac

SEQ ID NO: 3942783 - RNA, 20 nt, Shigella flexneri 2a str. 301
cgucgcaauacccugaccca

SEQ ID NO: 3942784 - RNA, 13 nt, Shigella flexneri 2a str. 301
cgucgcacccggc

SEQ ID NO: 3942785 - RNA, 18 nt, Shigella flexneri 2a str. 301
cgucgcaucaggcauugu

SEQ ID NO: 3942786 - RNA, 18 nt, Shigella flexneri 2a str. 301
cgucgccagacgcagcaa

SEQ ID NO: 3942787 - RNA, 14 nt, Shigella flexneri 2a str. 301
cgucgccagcgccu

SEQ ID NO: 3942788 - RNA, 18 nt, Shigella flexneri 2a str. 301
cgucgccaguaccagcag

SEQ ID NO: 3942789 - RNA, 14 nt, Shigella flexneri 2a str. 301
cgucgcccgaugca

SEQ ID NO: 3942790 - RNA, 19 nt, Shigella flexneri 2a str. 301
cgucgccgcuuucggcgca

SEQ ID NO: 3942791 - RNA, 21 nt, Shigella flexneri 2a str. 301
cgucgcuuaauugaccugccg

SEQ ID NO: 3942792 - RNA, 14 nt, Shigella flexneri 2a str. 301
cgucgcuuuccagu

SEQ ID NO: 3942793 - RNA, 15 nt, Shigella flexneri 2a str. 301
cgucggauauaaaaa

SEQ ID NO: 3942794 - RNA, 21 nt, Shigella flexneri 2a str. 301
cgucggcaucgggcagcaucg

SEQ ID NO: 3942795 - RNA, 17 nt, Shigella flexneri 2a str. 301
cgucggcgucagcgcca

SEQ ID NO: 3942796 - RNA, 18 nt, Shigella flexneri 2a str. 301
cgucgggcuggugcugaa

SEQ ID NO: 3942797 - RNA, 15 nt, Shigella flexneri 2a str. 301
cgucguagccaccau

SEQ ID NO: 3942798 - RNA, 15 nt, Shigella flexneri 2a str. 301
cgucguaguaguuca

SEQ ID NO: 3942799 - RNA, 15 nt, Shigella flexneri 2a str. 301
cgucgucccuuccgc

SEQ ID NO: 3942800 - RNA, 15 nt, Shigella flexneri 2a str. 301
cgucgucgugaagca

SEQ ID NO: 3942801 - RNA, 14 nt, Shigella flexneri 2a str. 301
cgucgugaagcaga

SEQ ID NO: 3942802 - RNA, 22 nt, Shigella flexneri 2a str. 301
cgucgugaagcagagcagacgc

SEQ ID NO: 3942803 - RNA, 19 nt, Shigella flexneri 2a str. 301
cgucguggcaaaaugcauc

SEQ ID NO: 3942804 - RNA, 19 nt, Shigella flexneri 2a str. 301
cgucguuacugucgcgcag

SEQ ID NO: 3942805 - RNA, 14 nt, Shigella flexneri 2a str. 301
cgucuacaaaaacu

SEQ ID NO: 3942806 - RNA, 15 nt, Shigella flexneri 2a str. 301
cgucucaaucaccac

SEQ ID NO: 3942807 - RNA, 19 nt, Shigella flexneri 2a str. 301
cgucucagcaccgucuggc

SEQ ID NO: 3942808 - RNA, 23 nt, Shigella flexneri 2a str. 301
cgucucagcgccgcuuuccaggc

SEQ ID NO: 3942809 - RNA, 12 nt, Shigella flexneri 2a str. 301
cgucuccaucaa

SEQ ID NO: 3942810 - RNA, 15 nt, Shigella flexneri 2a str. 301
cgucuccaucaauac

SEQ ID NO: 3942811 - RNA, 20 nt, Shigella flexneri 2a str. 301
cgucucccgaugccagcaca

SEQ ID NO: 3942812 - RNA, 12 nt, Shigella flexneri 2a str. 301
cgucugaaaacu

SEQ ID NO: 3942813 - RNA, 16 nt, Shigella flexneri 2a str. 301
cgucugaauaucaucc

SEQ ID NO: 3942814 - RNA, 17 nt, Shigella flexneri 2a str. 301
cgucuggcaucaccgcg

SEQ ID NO: 3942815 - RNA, 18 nt, Shigella flexneri 2a str. 301
cgucugggcaaaaucauc

SEQ ID NO: 3942816 - RNA, 20 nt, Shigella flexneri 2a str. 301
cgucugggcaaaaucaucac

SEQ ID NO: 3942817 - RNA, 21 nt, Shigella flexneri 2a str. 301
cgucugguaucgcgccagcca

SEQ ID NO: 3942818 - RNA, 23 nt, Shigella flexneri 2a str. 301
cgucugguaucgcgccagccagu

SEQ ID NO: 3942819 - RNA, 19 nt, Shigella flexneri 2a str. 301
cgucuguuuuaucucccug

SEQ ID NO: 3942820 - RNA, 19 nt, Shigella flexneri 2a str. 301
cgucuuaucaggccuacaa

SEQ ID NO: 3942821 - RNA, 23 nt, Shigella flexneri 2a str. 301
cgucuuaucaggccuacauuggu

SEQ ID NO: 3942822 - RNA, 16 nt, Shigella flexneri 2a str. 301
cgucuuaucaugccua

SEQ ID NO: 3942823 - RNA, 19 nt, Shigella flexneri 2a str. 301
cgucuuaucaugccuacag

SEQ ID NO: 3942824 - RNA, 12 nt, Shigella flexneri 2a str. 301
cgucuuaucugg

SEQ ID NO: 3942825 - RNA, 12 nt, Shigella flexneri 2a str. 301
cgucuucaucaa

SEQ ID NO: 3942826 - RNA, 14 nt, Shigella flexneri 2a str. 301
cgucuucccgcagc

SEQ ID NO: 3942827 - RNA, 15 nt, Shigella flexneri 2a str. 301
cgucuucccgcagcc

SEQ ID NO: 3942828 - RNA, 22 nt, Shigella flexneri 2a str. 301
cgucuucugguugcgaaaaaau

SEQ ID NO: 3942829 - RNA, 21 nt, Shigella flexneri 2a str. 301
cgucuucugguuuuucugaaa

SEQ ID NO: 3942830 - RNA, 16 nt, Shigella flexneri 2a str. 301
cgucuuuauccugacu

SEQ ID NO: 3942831 - RNA, 17 nt, Shigella flexneri 2a str. 301
cgucuuugguauaguga

SEQ ID NO: 3942832 - RNA, 13 nt, Shigella flexneri 2a str. 301
cgucuuuuuucac

SEQ ID NO: 3942833 - RNA, 14 nt, Shigella flexneri 2a str. 301
cgugaaacucagcc

SEQ ID NO: 3942834 - RNA, 23 nt, Shigella flexneri 2a str. 301
cgugaacggcuucgccuccuguu

SEQ ID NO: 3942835 - RNA, 16 nt, Shigella flexneri 2a str. 301
cgugaacgugcaaaau

SEQ ID NO: 3942836 - RNA, 21 nt, Shigella flexneri 2a str. 301
cgugaacugggccugcauauc

SEQ ID NO: 3942837 - RNA, 22 nt, Shigella flexneri 2a str. 301
cgugaacuucgccauuuucugc

SEQ ID NO: 3942838 - RNA, 11 nt, Shigella flexneri 2a str. 301
cgugaagaugc

SEQ ID NO: 3942839 - RNA, 18 nt, Shigella flexneri 2a str. 301
cgugaagaugccaacugg

SEQ ID NO: 3942840 - RNA, 13 nt, Shigella flexneri 2a str. 301
cgugaagcuggca

SEQ ID NO: 3942841 - RNA, 17 nt, Shigella flexneri 2a str. 301
cgugaauauggaacgga

SEQ ID NO: 3942842 - RNA, 21 nt, Shigella flexneri 2a str. 301
cgugaaugccguaggcccagc

SEQ ID NO: 3942843 - RNA, 17 nt, Shigella flexneri 2a str. 301
cgugaaugggaaaugac

SEQ ID NO: 3942844 - RNA, 21 nt, Shigella flexneri 2a str. 301
cgugaccaguaccaccgcgaa

SEQ ID NO: 3942845 - RNA, 14 nt, Shigella flexneri 2a str. 301
cgugacuaaaaccc

SEQ ID NO: 3942846 - RNA, 15 nt, Shigella flexneri 2a str. 301
cgugacuaaaacccu

SEQ ID NO: 3942847 - RNA, 16 nt, Shigella flexneri 2a str. 301
cgugagaacaccaccu

SEQ ID NO: 3942848 - RNA, 22 nt, Shigella flexneri 2a str. 301
cgugagcggaacggcaggaaua

SEQ ID NO: 3942849 - RNA, 21 nt, Shigella flexneri 2a str. 301
cgugagcguauuggugaauug

SEQ ID NO: 3942850 - RNA, 20 nt, Shigella flexneri 2a str. 301
cgugagggaaacaacaccgu

SEQ ID NO: 3942851 - RNA, 14 nt, Shigella flexneri 2a str. 301
cgugagguaacaau

SEQ ID NO: 3942852 - RNA, 20 nt, Shigella flexneri 2a str. 301
cgugauccaccccugauuaa

SEQ ID NO: 3942853 - RNA, 20 nt, Shigella flexneri 2a str. 301
cgugaucgaacaucugcgug

SEQ ID NO: 3942854 - RNA, 22 nt, Shigella flexneri 2a str. 301
cgugaucgucuucaaccgcagu

SEQ ID NO: 3942855 - RNA, 23 nt, Shigella flexneri 2a str. 301
cgugauuguggcaaucauauuca

SEQ ID NO: 3942856 - RNA, 16 nt, Shigella flexneri 2a str. 301
cgugcaaauucaauau

SEQ ID NO: 3942857 - RNA, 14 nt, Shigella flexneri 2a str. 301
cgugcagugauuca

SEQ ID NO: 3942858 - RNA, 19 nt, Shigella flexneri 2a str. 301
cgugcauagcagcacacca

SEQ ID NO: 3942859 - RNA, 13 nt, Shigella flexneri 2a str. 301
cgugccagagcau

SEQ ID NO: 3942860 - RNA, 17 nt, Shigella flexneri 2a str. 301
cgugccagagcaucuac

SEQ ID NO: 3942861 - RNA, 13 nt, Shigella flexneri 2a str. 301
cgugccagauguu

SEQ ID NO: 3942862 - RNA, 23 nt, Shigella flexneri 2a str. 301
cgugccagauguuugaacugggc

SEQ ID NO: 3942863 - RNA, 23 nt, Shigella flexneri 2a str. 301
cgugccaggguggcucaaucgcc

SEQ ID NO: 3942864 - RNA, 15 nt, Shigella flexneri 2a str. 301
cgugccauuaauguc

SEQ ID NO: 3942865 - RNA, 14 nt, Shigella flexneri 2a str. 301
cgugccgcagcuuc

SEQ ID NO: 3942866 - RNA, 13 nt, Shigella flexneri 2a str. 301
cgugccgcauuuc

SEQ ID NO: 3942867 - RNA, 23 nt, Shigella flexneri 2a str. 301
cgugcgaauaaugguaucgacac

SEQ ID NO: 3942868 - RNA, 18 nt, Shigella flexneri 2a str. 301
cgugcgcaauaacccaga

SEQ ID NO: 3942869 - RNA, 14 nt, Shigella flexneri 2a str. 301
cgugcgcgccguga

SEQ ID NO: 3942870 - RNA, 14 nt, Shigella flexneri 2a str. 301
cgugcgcuuuuuag

SEQ ID NO: 3942871 - RNA, 19 nt, Shigella flexneri 2a str. 301
cgugcggccguuccauuca

SEQ ID NO: 3942872 - RNA, 14 nt, Shigella flexneri 2a str. 301
cgugcggcugugcg

SEQ ID NO: 3942873 - RNA, 17 nt, Shigella flexneri 2a str. 301
cgugcgggcaucaucuu

SEQ ID NO: 3942874 - RNA, 19 nt, Shigella flexneri 2a str. 301
cgugcgggcgaaagcagaa

SEQ ID NO: 3942875 - RNA, 18 nt, Shigella flexneri 2a str. 301
cgugcgguuucagcucac

SEQ ID NO: 3942876 - RNA, 20 nt, Shigella flexneri 2a str. 301
cgugcguuuguaggccggau

SEQ ID NO: 3942877 - RNA, 22 nt, Shigella flexneri 2a str. 301
cgugcuacgguugacugaaaag

SEQ ID NO: 3942878 - RNA, 20 nt, Shigella flexneri 2a str. 301
cgugcucaccacgcagcagc

SEQ ID NO: 3942879 - RNA, 22 nt, Shigella flexneri 2a str. 301
cgugcucaccacgcagcagcca

SEQ ID NO: 3942880 - RNA, 16 nt, Shigella flexneri 2a str. 301
cgugcucgaacauccc

SEQ ID NO: 3942881 - RNA, 19 nt, Shigella flexneri 2a str. 301
cgugcucgacagcgcuaau

SEQ ID NO: 3942882 - RNA, 13 nt, Shigella flexneri 2a str. 301
cgugcugccagcg

SEQ ID NO: 3942883 - RNA, 16 nt, Shigella flexneri 2a str. 301
cgugcugccagcgauu

SEQ ID NO: 3942884 - RNA, 15 nt, Shigella flexneri 2a str. 301
cgugcugcgcagacg

SEQ ID NO: 3942885 - RNA, 22 nt, Shigella flexneri 2a str. 301
cgugcugguggucagcagcuuu

SEQ ID NO: 3942886 - RNA, 15 nt, Shigella flexneri 2a str. 301
cgugcuguacagcag

SEQ ID NO: 3942887 - RNA, 17 nt, Shigella flexneri 2a str. 301
cgugcuguacagcagua

SEQ ID NO: 3942888 - RNA, 19 nt, Shigella flexneri 2a str. 301
cgugcuuuuauuauuacuu

SEQ ID NO: 3942889 - RNA, 16 nt, Shigella flexneri 2a str. 301
cguggaauaauuccgg

SEQ ID NO: 3942890 - RNA, 19 nt, Shigella flexneri 2a str. 301
cguggaauuuguccaccaa

SEQ ID NO: 3942891 - RNA, 19 nt, Shigella flexneri 2a str. 301
cguggagcaacacgccagc

SEQ ID NO: 3942892 - RNA, 17 nt, Shigella flexneri 2a str. 301
cguggagcaacugcgcu

SEQ ID NO: 3942893 - RNA, 20 nt, Shigella flexneri 2a str. 301
cguggaucaagccccagcag

SEQ ID NO: 3942894 - RNA, 23 nt, Shigella flexneri 2a str. 301
cguggaugcgauguucccccagc

SEQ ID NO: 3942895 - RNA, 13 nt, Shigella flexneri 2a str. 301
cguggaugggacu

SEQ ID NO: 3942896 - RNA, 18 nt, Shigella flexneri 2a str. 301
cguggcaugacgcagguc

SEQ ID NO: 3942897 - RNA, 14 nt, Shigella flexneri 2a str. 301
cguggccuccaaaa

SEQ ID NO: 3942898 - RNA, 19 nt, Shigella flexneri 2a str. 301
cguggcgagcgauaaccca

SEQ ID NO: 3942899 - RNA, 13 nt, Shigella flexneri 2a str. 301
cguggcgcagugc

SEQ ID NO: 3942900 - RNA, 15 nt, Shigella flexneri 2a str. 301
cguggcgcagugccu

SEQ ID NO: 3942901 - RNA, 22 nt, Shigella flexneri 2a str. 301
cguggcggaaaucuuucauuuc

SEQ ID NO: 3942902 - RNA, 15 nt, Shigella flexneri 2a str. 301
cguggcugacggccc

SEQ ID NO: 3942903 - RNA, 17 nt, Shigella flexneri 2a str. 301
cgugggcaucgcgacag

SEQ ID NO: 3942904 - RNA, 12 nt, Shigella flexneri 2a str. 301
cgugggcgcugu

SEQ ID NO: 3942905 - RNA, 21 nt, Shigella flexneri 2a str. 301
cgugguugcgccugggccgau

SEQ ID NO: 3942906 - RNA, 15 nt, Shigella flexneri 2a str. 301
cgugguuuaugcaau

SEQ ID NO: 3942907 - RNA, 21 nt, Shigella flexneri 2a str. 301
cguguacaaacccagccgccg

SEQ ID NO: 3942908 - RNA, 20 nt, Shigella flexneri 2a str. 301
cgugucgagcauugccagca

SEQ ID NO: 3942909 - RNA, 15 nt, Shigella flexneri 2a str. 301
cgugucuuuuacuga

SEQ ID NO: 3942910 - RNA, 15 nt, Shigella flexneri 2a str. 301
cguguuaauuaccua

SEQ ID NO: 3942911 - RNA, 23 nt, Shigella flexneri 2a str. 301
cguguucacgaaaacagcgcagc

SEQ ID NO: 3942912 - RNA, 15 nt, Shigella flexneri 2a str. 301
cguguucugaauaaa

SEQ ID NO: 3942913 - RNA, 17 nt, Shigella flexneri 2a str. 301
cguguugaggaagcgca

SEQ ID NO: 3942914 - RNA, 21 nt, Shigella flexneri 2a str. 301
cguguugucagcucauccagc

SEQ ID NO: 3942915 - RNA, 22 nt, Shigella flexneri 2a str. 301
cguguuuaugaaaguuuaacua

SEQ ID NO: 3942916 - RNA, 12 nt, Shigella flexneri 2a str. 301
cguguuucagaa

SEQ ID NO: 3942917 - RNA, 17 nt, Shigella flexneri 2a str. 301
cguguuuccgggccgaa

SEQ ID NO: 3942918 - RNA, 16 nt, Shigella flexneri 2a str. 301
cguguuucucaaauga

SEQ ID NO: 3942919 - RNA, 17 nt, Shigella flexneri 2a str. 301
cguuaaauccagauccu

SEQ ID NO: 3942920 - RNA, 20 nt, Shigella flexneri 2a str. 301
cguuaaauucuaauguuaaa

SEQ ID NO: 3942921 - RNA, 15 nt, Shigella flexneri 2a str. 301
cguuaaccacuucag

SEQ ID NO: 3942922 - RNA, 13 nt, Shigella flexneri 2a str. 301
cguuaacugcuga

SEQ ID NO: 3942923 - RNA, 14 nt, Shigella flexneri 2a str. 301
cguuaacugcugau

SEQ ID NO: 3942924 - RNA, 21 nt, Shigella flexneri 2a str. 301
cguuaagacuuuuuucauggg

SEQ ID NO: 3942925 - RNA, 21 nt, Shigella flexneri 2a str. 301
cguuaauauugcccgggcgag

SEQ ID NO: 3942926 - RNA, 13 nt, Shigella flexneri 2a str. 301
cguuaauccgccc

SEQ ID NO: 3942927 - RNA, 17 nt, Shigella flexneri 2a str. 301
cguuaccacaaugcaau

SEQ ID NO: 3942928 - RNA, 20 nt, Shigella flexneri 2a str. 301
cguuaccacaaugcaauaau

SEQ ID NO: 3942929 - RNA, 15 nt, Shigella flexneri 2a str. 301
cguuacccagcacgg

SEQ ID NO: 3942930 - RNA, 22 nt, Shigella flexneri 2a str. 301
cguuaccguaccaaccgcaauu

SEQ ID NO: 3942931 - RNA, 13 nt, Shigella flexneri 2a str. 301
cguuaccuucggc

SEQ ID NO: 3942932 - RNA, 13 nt, Shigella flexneri 2a str. 301
cguuacgcagcau

SEQ ID NO: 3942933 - RNA, 18 nt, Shigella flexneri 2a str. 301
cguuacgccccaacacaa

SEQ ID NO: 3942934 - RNA, 21 nt, Shigella flexneri 2a str. 301
cguuacgccccgguuucucuu

SEQ ID NO: 3942935 - RNA, 19 nt, Shigella flexneri 2a str. 301
cguuacguaccacgcacag

SEQ ID NO: 3942936 - RNA, 12 nt, Shigella flexneri 2a str. 301
cguuacguacuu

SEQ ID NO: 3942937 - RNA, 17 nt, Shigella flexneri 2a str. 301
cguuacguucuccugaa

SEQ ID NO: 3942938 - RNA, 16 nt, Shigella flexneri 2a str. 301
cguuacucuccggacu

SEQ ID NO: 3942939 - RNA, 16 nt, Shigella flexneri 2a str. 301
cguuacugucgcgcag

SEQ ID NO: 3942940 - RNA, 18 nt, Shigella flexneri 2a str. 301
cguuagccagcgcaccag

SEQ ID NO: 3942941 - RNA, 20 nt, Shigella flexneri 2a str. 301
cguuagccagcgcaccagcg

SEQ ID NO: 3942942 - RNA, 13 nt, Shigella flexneri 2a str. 301
cguuaguguggcc

SEQ ID NO: 3942943 - RNA, 19 nt, Shigella flexneri 2a str. 301
cguuauaucccauuuuuga

SEQ ID NO: 3942944 - RNA, 12 nt, Shigella flexneri 2a str. 301
cguuaucaccug

SEQ ID NO: 3942945 - RNA, 19 nt, Shigella flexneri 2a str. 301
cguuaucccaucccacuca

SEQ ID NO: 3942946 - RNA, 20 nt, Shigella flexneri 2a str. 301
cguuauccggcuaacaaaau

SEQ ID NO: 3942947 - RNA, 15 nt, Shigella flexneri 2a str. 301
cguuaugaucagcaa

SEQ ID NO: 3942948 - RNA, 16 nt, Shigella flexneri 2a str. 301
cguuauguaacaacug

SEQ ID NO: 3942949 - RNA, 16 nt, Shigella flexneri 2a str. 301
cguuauucagccugac

SEQ ID NO: 3942950 - RNA, 15 nt, Shigella flexneri 2a str. 301
cguucaaccacuuca

SEQ ID NO: 3942951 - RNA, 21 nt, Shigella flexneri 2a str. 301
cguucaccgaagacgugcgcc

SEQ ID NO: 3942952 - RNA, 11 nt, Shigella flexneri 2a str. 301
cguucacgccg

SEQ ID NO: 3942953 - RNA, 21 nt, Shigella flexneri 2a str. 301
cguucacgucgcauccggcau

SEQ ID NO: 3942954 - RNA, 13 nt, Shigella flexneri 2a str. 301
cguucacugccac

SEQ ID NO: 3942955 - RNA, 17 nt, Shigella flexneri 2a str. 301
cguucagccauacguug

SEQ ID NO: 3942956 - RNA, 17 nt, Shigella flexneri 2a str. 301
cguucaguucaaaguua

SEQ ID NO: 3942957 - RNA, 22 nt, Shigella flexneri 2a str. 301
cguucauaaauacagagcacgc

SEQ ID NO: 3942958 - RNA, 18 nt, Shigella flexneri 2a str. 301
cguucaucaguuccaguu

SEQ ID NO: 3942959 - RNA, 15 nt, Shigella flexneri 2a str. 301
cguucauccaacaau

SEQ ID NO: 3942960 - RNA, 11 nt, Shigella flexneri 2a str. 301
cguucauccca

SEQ ID NO: 3942961 - RNA, 13 nt, Shigella flexneri 2a str. 301
cguucauccugcu

SEQ ID NO: 3942962 - RNA, 16 nt, Shigella flexneri 2a str. 301
cguucauuaacgcccc

SEQ ID NO: 3942963 - RNA, 13 nt, Shigella flexneri 2a str. 301
cguuccaccgcuc

SEQ ID NO: 3942964 - RNA, 23 nt, Shigella flexneri 2a str. 301
cguuccaccgcucccagcaugac

SEQ ID NO: 3942965 - RNA, 14 nt, Shigella flexneri 2a str. 301
cguuccagcaacuc

SEQ ID NO: 3942966 - RNA, 13 nt, Shigella flexneri 2a str. 301
cguucccagcgga

SEQ ID NO: 3942967 - RNA, 13 nt, Shigella flexneri 2a str. 301
cguucccauucac

SEQ ID NO: 3942968 - RNA, 14 nt, Shigella flexneri 2a str. 301
cguuccccagaagc

SEQ ID NO: 3942969 - RNA, 15 nt, Shigella flexneri 2a str. 301
cguuccuaacaugcc

SEQ ID NO: 3942970 - RNA, 13 nt, Shigella flexneri 2a str. 301
cguuccugcaacg

SEQ ID NO: 3942971 - RNA, 21 nt, Shigella flexneri 2a str. 301
cguuccuuuacggugaacuca

SEQ ID NO: 3942972 - RNA, 15 nt, Shigella flexneri 2a str. 301
cguucgacaccacua

SEQ ID NO: 3942973 - RNA, 12 nt, Shigella flexneri 2a str. 301
cguucgccguuu

SEQ ID NO: 3942974 - RNA, 20 nt, Shigella flexneri 2a str. 301
cguucggaucgcgugcggca

SEQ ID NO: 3942975 - RNA, 19 nt, Shigella flexneri 2a str. 301
cguucguagaaaaaacagc

SEQ ID NO: 3942976 - RNA, 21 nt, Shigella flexneri 2a str. 301
cguucucugcaaucaccacug

SEQ ID NO: 3942977 - RNA, 16 nt, Shigella flexneri 2a str. 301
cguucugaucuuucuu

SEQ ID NO: 3942978 - RNA, 14 nt, Shigella flexneri 2a str. 301
cguucuucccgccu

SEQ ID NO: 3942979 - RNA, 15 nt, Shigella flexneri 2a str. 301
cguugaaaaaucaaa

SEQ ID NO: 3942980 - RNA, 14 nt, Shigella flexneri 2a str. 301
cguugaaagauaau

SEQ ID NO: 3942981 - RNA, 14 nt, Shigella flexneri 2a str. 301
cguugacaaacugc

SEQ ID NO: 3942982 - RNA, 13 nt, Shigella flexneri 2a str. 301
cguugaccagcau

SEQ ID NO: 3942983 - RNA, 21 nt, Shigella flexneri 2a str. 301
cguugaccugaauacccgcau

SEQ ID NO: 3942984 - RNA, 20 nt, Shigella flexneri 2a str. 301
cguugagaauggccaaucac

SEQ ID NO: 3942985 - RNA, 19 nt, Shigella flexneri 2a str. 301
cguugagagguaaaaccug

SEQ ID NO: 3942986 - RNA, 22 nt, Shigella flexneri 2a str. 301
cguugaggauggcgucgauaau

SEQ ID NO: 3942987 - RNA, 22 nt, Shigella flexneri 2a str. 301
cguugauaaacguacauccaug

SEQ ID NO: 3942988 - RNA, 17 nt, Shigella flexneri 2a str. 301
cguugaucggcuggcga

SEQ ID NO: 3942989 - RNA, 12 nt, Shigella flexneri 2a str. 301
cguugaucucuc

SEQ ID NO: 3942990 - RNA, 16 nt, Shigella flexneri 2a str. 301
cguugaucucuccggu

SEQ ID NO: 3942991 - RNA, 12 nt, Shigella flexneri 2a str. 301
cguugaugcagg

SEQ ID NO: 3942992 - RNA, 21 nt, Shigella flexneri 2a str. 301
cguugauuuugucauggcgca

SEQ ID NO: 3942993 - RNA, 23 nt, Shigella flexneri 2a str. 301
cguugcaaucagcggugccgcga

SEQ ID NO: 3942994 - RNA, 19 nt, Shigella flexneri 2a str. 301
cguugcaggaaccgcauac

SEQ ID NO: 3942995 - RNA, 21 nt, Shigella flexneri 2a str. 301
cguugcauaaaugccgcaaug

SEQ ID NO: 3942996 - RNA, 18 nt, Shigella flexneri 2a str. 301
cguugcccggagcagcag

SEQ ID NO: 3942997 - RNA, 20 nt, Shigella flexneri 2a str. 301
cguugccggauauacccgcc

SEQ ID NO: 3942998 - RNA, 17 nt, Shigella flexneri 2a str. 301
cguugcgcgucaacugu

SEQ ID NO: 3942999 - RNA, 16 nt, Shigella flexneri 2a str. 301
cguugcuaugcugaau

SEQ ID NO: 3943000 - RNA, 13 nt, Shigella flexneri 2a str. 301
cguugcucuucuc

SEQ ID NO: 3943001 - RNA, 19 nt, Shigella flexneri 2a str. 301
cguugcuuuuugcgcaucc

SEQ ID NO: 3943002 - RNA, 13 nt, Shigella flexneri 2a str. 301
cguuggccugaua

SEQ ID NO: 3943003 - RNA, 19 nt, Shigella flexneri 2a str. 301
cguuggcucgcuccagugc

SEQ ID NO: 3943004 - RNA, 17 nt, Shigella flexneri 2a str. 301
cguuggugauaaaacgc

SEQ ID NO: 3943005 - RNA, 18 nt, Shigella flexneri 2a str. 301
cguugguguccacgccgc

SEQ ID NO: 3943006 - RNA, 18 nt, Shigella flexneri 2a str. 301
cguuguaguguuccugcg

SEQ ID NO: 3943007 - RNA, 15 nt, Shigella flexneri 2a str. 301
cguugucgccaucca

SEQ ID NO: 3943008 - RNA, 18 nt, Shigella flexneri 2a str. 301
cguugugacuuugugaag

SEQ ID NO: 3943009 - RNA, 23 nt, Shigella flexneri 2a str. 301
cguugugcaucaggcaaacuuca

SEQ ID NO: 3943010 - RNA, 17 nt, Shigella flexneri 2a str. 301
cguugugcgauccacgc

SEQ ID NO: 3943011 - RNA, 17 nt, Shigella flexneri 2a str. 301
cguugugcgcgacauac

SEQ ID NO: 3943012 - RNA, 14 nt, Shigella flexneri 2a str. 301
cguugugucgccag

SEQ ID NO: 3943013 - RNA, 16 nt, Shigella flexneri 2a str. 301
cguugugucgccagca

SEQ ID NO: 3943014 - RNA, 19 nt, Shigella flexneri 2a str. 301
cguuguuccuuccagcugg

SEQ ID NO: 3943015 - RNA, 16 nt, Shigella flexneri 2a str. 301
cguuuaaucacaccau

SEQ ID NO: 3943016 - RNA, 19 nt, Shigella flexneri 2a str. 301
cguuuaaucacaccauuga

SEQ ID NO: 3943017 - RNA, 20 nt, Shigella flexneri 2a str. 301
cguuuacccaaacuuaacac

SEQ ID NO: 3943018 - RNA, 14 nt, Shigella flexneri 2a str. 301
cguuuaccgccauc

SEQ ID NO: 3943019 - RNA, 15 nt, Shigella flexneri 2a str. 301
cguuuacgccgcauc

SEQ ID NO: 3943020 - RNA, 17 nt, Shigella flexneri 2a str. 301
cguuuacgcuuuccagc

SEQ ID NO: 3943021 - RNA, 17 nt, Shigella flexneri 2a str. 301
cguuuaucgacagacgc

SEQ ID NO: 3943022 - RNA, 15 nt, Shigella flexneri 2a str. 301
cguuuaugaguauuu

SEQ ID NO: 3943023 - RNA, 18 nt, Shigella flexneri 2a str. 301
cguuuaugaucaucaagg

SEQ ID NO: 3943024 - RNA, 22 nt, Shigella flexneri 2a str. 301
cguuuauuuccccgcucuaccu

SEQ ID NO: 3943025 - RNA, 20 nt, Shigella flexneri 2a str. 301
cguuucacauucgccgccga

SEQ ID NO: 3943026 - RNA, 20 nt, Shigella flexneri 2a str. 301
cguuucacugccggacguuc

SEQ ID NO: 3943027 - RNA, 19 nt, Shigella flexneri 2a str. 301
cguuuccagcaccaguuca

SEQ ID NO: 3943028 - RNA, 17 nt, Shigella flexneri 2a str. 301
cguuuccauucgcugcu

SEQ ID NO: 3943029 - RNA, 11 nt, Shigella flexneri 2a str. 301
cguuucccugu

SEQ ID NO: 3943030 - RNA, 20 nt, Shigella flexneri 2a str. 301
cguuucgaauuacacagcca

SEQ ID NO: 3943031 - RNA, 21 nt, Shigella flexneri 2a str. 301
cguuucgcagguuccgcauac

SEQ ID NO: 3943032 - RNA, 19 nt, Shigella flexneri 2a str. 301
cguuucgcagucgccagca

SEQ ID NO: 3943033 - RNA, 20 nt, Shigella flexneri 2a str. 301
cguuucuacaagcagagaga

SEQ ID NO: 3943034 - RNA, 22 nt, Shigella flexneri 2a str. 301
cguuucuucgacacguuccuca

SEQ ID NO: 3943035 - RNA, 17 nt, Shigella flexneri 2a str. 301
cguuucuucuacaggcu

SEQ ID NO: 3943036 - RNA, 12 nt, Shigella flexneri 2a str. 301
cguuucuuuuuc

SEQ ID NO: 3943037 - RNA, 22 nt, Shigella flexneri 2a str. 301
cguuugacauaguagccagcca

SEQ ID NO: 3943038 - RNA, 16 nt, Shigella flexneri 2a str. 301
cguuugcaggccugau

SEQ ID NO: 3943039 - RNA, 16 nt, Shigella flexneri 2a str. 301
cguuugcgcccagcca

SEQ ID NO: 3943040 - RNA, 18 nt, Shigella flexneri 2a str. 301
cguuugcgcccagccagu

SEQ ID NO: 3943041 - RNA, 23 nt, Shigella flexneri 2a str. 301
cguuuggggcauauuaucagcaa

SEQ ID NO: 3943042 - RNA, 20 nt, Shigella flexneri 2a str. 301
cguuuggggguaacccaccg

SEQ ID NO: 3943043 - RNA, 15 nt, Shigella flexneri 2a str. 301
cguuuguaggcggau

SEQ ID NO: 3943044 - RNA, 13 nt, Shigella flexneri 2a str. 301
cguuugucaucag

SEQ ID NO: 3943045 - RNA, 22 nt, Shigella flexneri 2a str. 301
cguuuuaaugcgauccugagcc

SEQ ID NO: 3943046 - RNA, 17 nt, Shigella flexneri 2a str. 301
cguuuucaaccagccga

SEQ ID NO: 3943047 - RNA, 22 nt, Shigella flexneri 2a str. 301
cguuuucagguuacgcccuuca

SEQ ID NO: 3943048 - RNA, 21 nt, Shigella flexneri 2a str. 301
cguuuucgccacaucagguaa

SEQ ID NO: 3943049 - RNA, 20 nt, Shigella flexneri 2a str. 301
cguuuucuccagcgccgcca

SEQ ID NO: 3943050 - RNA, 19 nt, Shigella flexneri 2a str. 301
cguuuugcggaugcagcgg

SEQ ID NO: 3943051 - RNA, 16 nt, Shigella flexneri 2a str. 301
cguuuuggcagacaac

SEQ ID NO: 3943052 - RNA, 19 nt, Shigella flexneri 2a str. 301
cguuuugugguguuuuuuu

SEQ ID NO: 3943053 - RNA, 23 nt, Shigella flexneri 2a str. 301
cguuuugugguguuuuuuuaauc

SEQ ID NO: 3943054 - RNA, 17 nt, Shigella flexneri 2a str. 301
cguuuuuacccagcagc

SEQ ID NO: 3943055 - RNA, 21 nt, Shigella flexneri 2a str. 301
cguuuuuaucuucacacacau

SEQ ID NO: 3943056 - RNA, 18 nt, Shigella flexneri 2a str. 301
cguuuuucuucagcagcc

SEQ ID NO: 3943057 - RNA, 15 nt, Shigella flexneri 2a str. 301
cguuuuuuguacucu

SEQ ID NO: 3943058 - RNA, 13 nt, Shigella flexneri 2a str. 301
cuaaaaaaugacg

SEQ ID NO: 3943059 - RNA, 15 nt, Shigella flexneri 2a str. 301
cuaaaaauugcagac

SEQ ID NO: 3943060 - RNA, 22 nt, Shigella flexneri 2a str. 301
cuaaaagcacgccagacaucac

SEQ ID NO: 3943061 - RNA, 20 nt, Shigella flexneri 2a str. 301
cuaaaagcgauuauuuauuc

SEQ ID NO: 3943062 - RNA, 22 nt, Shigella flexneri 2a str. 301
cuaaaaucauucgugagcuggu

SEQ ID NO: 3943063 - RNA, 16 nt, Shigella flexneri 2a str. 301
cuaaacguuagcacga

SEQ ID NO: 3943064 - RNA, 18 nt, Shigella flexneri 2a str. 301
cuaaacguuuaaaaacuu

SEQ ID NO: 3943065 - RNA, 20 nt, Shigella flexneri 2a str. 301
cuaaagcaacuccaucaagc

SEQ ID NO: 3943066 - RNA, 17 nt, Shigella flexneri 2a str. 301
cuaaaggcaaaaugcca

SEQ ID NO: 3943067 - RNA, 14 nt, Shigella flexneri 2a str. 301
cuaaaguaaaggca

SEQ ID NO: 3943068 - RNA, 19 nt, Shigella flexneri 2a str. 301
cuaaauccgccaucaacac

SEQ ID NO: 3943069 - RNA, 17 nt, Shigella flexneri 2a str. 301
cuaaaucuuccgccggg

SEQ ID NO: 3943070 - RNA, 15 nt, Shigella flexneri 2a str. 301
cuaaaugcugcagcc

SEQ ID NO: 3943071 - RNA, 17 nt, Shigella flexneri 2a str. 301
cuaaauguucaauaagc

SEQ ID NO: 3943072 - RNA, 14 nt, Shigella flexneri 2a str. 301
cuaacaccaucagu

SEQ ID NO: 3943073 - RNA, 20 nt, Shigella flexneri 2a str. 301
cuaacagaacaauaauaacu

SEQ ID NO: 3943074 - RNA, 14 nt, Shigella flexneri 2a str. 301
cuaacagcaauccc

SEQ ID NO: 3943075 - RNA, 13 nt, Shigella flexneri 2a str. 301
cuaacaggcuuuu

SEQ ID NO: 3943076 - RNA, 12 nt, Shigella flexneri 2a str. 301
cuaacaucaucc

SEQ ID NO: 3943077 - RNA, 23 nt, Shigella flexneri 2a str. 301
cuaacaucauccccguaucuuca

SEQ ID NO: 3943078 - RNA, 16 nt, Shigella flexneri 2a str. 301
cuaacccgcgacuggc

SEQ ID NO: 3943079 - RNA, 20 nt, Shigella flexneri 2a str. 301
cuaacccgcgucugcgugcg

SEQ ID NO: 3943080 - RNA, 15 nt, Shigella flexneri 2a str. 301
cuaacccucucccca

SEQ ID NO: 3943081 - RNA, 17 nt, Shigella flexneri 2a str. 301
cuaacccucuccccaag

SEQ ID NO: 3943082 - RNA, 19 nt, Shigella flexneri 2a str. 301
cuaacccucuccccaaggg

SEQ ID NO: 3943083 - RNA, 15 nt, Shigella flexneri 2a str. 301
cuaacccucuccccg

SEQ ID NO: 3943084 - RNA, 15 nt, Shigella flexneri 2a str. 301
cuaaccgaauucaaa

SEQ ID NO: 3943085 - RNA, 15 nt, Shigella flexneri 2a str. 301
cuaaccgcuuuucca

SEQ ID NO: 3943086 - RNA, 17 nt, Shigella flexneri 2a str. 301
cuaaccgcuuuuccagc

SEQ ID NO: 3943087 - RNA, 18 nt, Shigella flexneri 2a str. 301
cuaaccgcuuuuccagca

SEQ ID NO: 3943088 - RNA, 18 nt, Shigella flexneri 2a str. 301
cuaacgcgucuuaucugg

SEQ ID NO: 3943089 - RNA, 20 nt, Shigella flexneri 2a str. 301
cuaacgcgucuuaucuggcc

SEQ ID NO: 3943090 - RNA, 17 nt, Shigella flexneri 2a str. 301
cuaacuguuucgcggua

SEQ ID NO: 3943091 - RNA, 14 nt, Shigella flexneri 2a str. 301
cuaacuucuuuuuc

SEQ ID NO: 3943092 - RNA, 15 nt, Shigella flexneri 2a str. 301
cuaacuucuuuuucg

SEQ ID NO: 3943093 - RNA, 20 nt, Shigella flexneri 2a str. 301
cuaagaauguccauuauuuc

SEQ ID NO: 3943094 - RNA, 15 nt, Shigella flexneri 2a str. 301
cuaagcaggcuggcu

SEQ ID NO: 3943095 - RNA, 15 nt, Shigella flexneri 2a str. 301
cuaagccauuuaacu

SEQ ID NO: 3943096 - RNA, 20 nt, Shigella flexneri 2a str. 301
cuaagccauuuaacucaccg

SEQ ID NO: 3943097 - RNA, 16 nt, Shigella flexneri 2a str. 301
cuaagccgugcauaac

SEQ ID NO: 3943098 - RNA, 24 nt, Shigella flexneri 2a str. 301
cuaagcgcacuuugucaucagucu

SEQ ID NO: 3943099 - RNA, 24 nt, Shigella flexneri 2a str. 301
cuaaggguauagaagccauccagc

SEQ ID NO: 3943100 - RNA, 17 nt, Shigella flexneri 2a str. 301
cuaaggucaccaguuca

SEQ ID NO: 3943101 - RNA, 15 nt, Shigella flexneri 2a str. 301
cuaauaaugagcaga

SEQ ID NO: 3943102 - RNA, 17 nt, Shigella flexneri 2a str. 301
cuaauaauugccccuug

SEQ ID NO: 3943103 - RNA, 23 nt, Shigella flexneri 2a str. 301
cuaauauuagucaauuaaaaaau

SEQ ID NO: 3943104 - RNA, 16 nt, Shigella flexneri 2a str. 301
cuaaucaauuuuucau

SEQ ID NO: 3943105 - RNA, 20 nt, Shigella flexneri 2a str. 301
cuaaucagcuuuuccauauc

SEQ ID NO: 3943106 - RNA, 13 nt, Shigella flexneri 2a str. 301
cuaaucagugccu

SEQ ID NO: 3943107 - RNA, 15 nt, Shigella flexneri 2a str. 301
cuaaucaucaucagu

SEQ ID NO: 3943108 - RNA, 23 nt, Shigella flexneri 2a str. 301
cuaaucaucuguugugccacauc

SEQ ID NO: 3943109 - RNA, 21 nt, Shigella flexneri 2a str. 301
cuaauccagcccgauugcgcc

SEQ ID NO: 3943110 - RNA, 15 nt, Shigella flexneri 2a str. 301
cuaauccugaagacg

SEQ ID NO: 3943111 - RNA, 17 nt, Shigella flexneri 2a str. 301
cuaaucgcacaaaauca

SEQ ID NO: 3943112 - RNA, 17 nt, Shigella flexneri 2a str. 301
cuaaucucuucaccaua

SEQ ID NO: 3943113 - RNA, 17 nt, Shigella flexneri 2a str. 301
cuaaucuugaaaccaga

SEQ ID NO: 3943114 - RNA, 21 nt, Shigella flexneri 2a str. 301
cuaaugagucaggacaguaaa

SEQ ID NO: 3943115 - RNA, 22 nt, Shigella flexneri 2a str. 301
cuaaugauguccugcauccgcu

SEQ ID NO: 3943116 - RNA, 15 nt, Shigella flexneri 2a str. 301
cuaaugccugagaca

SEQ ID NO: 3943117 - RNA, 21 nt, Shigella flexneri 2a str. 301
cuaaugcuuuuuccugcguca

SEQ ID NO: 3943118 - RNA, 18 nt, Shigella flexneri 2a str. 301
cuaauggcugcgggcgac

SEQ ID NO: 3943119 - RNA, 20 nt, Shigella flexneri 2a str. 301
cuaauggcugcgggcgacca

SEQ ID NO: 3943120 - RNA, 15 nt, Shigella flexneri 2a str. 301
cuaauguauggcgau

SEQ ID NO: 3943121 - RNA, 18 nt, Shigella flexneri 2a str. 301
cuaauuuuuccagcauuu

SEQ ID NO: 3943122 - RNA, 17 nt, Shigella flexneri 2a str. 301
cuacaaaaacugccgca

SEQ ID NO: 3943123 - RNA, 14 nt, Shigella flexneri 2a str. 301
cuacaaaaccugca

SEQ ID NO: 3943124 - RNA, 23 nt, Shigella flexneri 2a str. 301
cuacaaaaucgugcaaauucaau

SEQ ID NO: 3943125 - RNA, 14 nt, Shigella flexneri 2a str. 301
cuacaaaaucuauu

SEQ ID NO: 3943126 - RNA, 23 nt, Shigella flexneri 2a str. 301
cuacaaaaucuugcaaauucaau

SEQ ID NO: 3943127 - RNA, 18 nt, Shigella flexneri 2a str. 301
cuacaaacguugcugacu

SEQ ID NO: 3943128 - RNA, 19 nt, Shigella flexneri 2a str. 301
cuacaaacguugcugacug

SEQ ID NO: 3943129 - RNA, 20 nt, Shigella flexneri 2a str. 301
cuacaaaugggcacaauuca

SEQ ID NO: 3943130 - RNA, 22 nt, Shigella flexneri 2a str. 301
cuacaaauuugugcaaauucaa

SEQ ID NO: 3943131 - RNA, 23 nt, Shigella flexneri 2a str. 301
cuacaaauuugugcaaauucaau

SEQ ID NO: 3943132 - RNA, 22 nt, Shigella flexneri 2a str. 301
cuacaacuccguugaaauugcu

SEQ ID NO: 3943133 - RNA, 13 nt, Shigella flexneri 2a str. 301
cuacaagcagaga

SEQ ID NO: 3943134 - RNA, 18 nt, Shigella flexneri 2a str. 301
cuacaagcagagagacaa

SEQ ID NO: 3943135 - RNA, 22 nt, Shigella flexneri 2a str. 301
cuacaaguccguugaaaaugcu

SEQ ID NO: 3943136 - RNA, 16 nt, Shigella flexneri 2a str. 301
cuacacauacuuauua

SEQ ID NO: 3943137 - RNA, 21 nt, Shigella flexneri 2a str. 301
cuacacauuaucucaacacac

SEQ ID NO: 3943138 - RNA, 17 nt, Shigella flexneri 2a str. 301
cuacaccaugccgguga

SEQ ID NO: 3943139 - RNA, 14 nt, Shigella flexneri 2a str. 301
cuacacccagcccc

SEQ ID NO: 3943140 - RNA, 15 nt, Shigella flexneri 2a str. 301
cuacacccagccccg

SEQ ID NO: 3943141 - RNA, 20 nt, Shigella flexneri 2a str. 301
cuacacgcuaccaaaaaauc

SEQ ID NO: 3943142 - RNA, 22 nt, Shigella flexneri 2a str. 301
cuacacgcuaccaaaaaaucaa

SEQ ID NO: 3943143 - RNA, 20 nt, Shigella flexneri 2a str. 301
cuacacuaaacgucucacua

SEQ ID NO: 3943144 - RNA, 19 nt, Shigella flexneri 2a str. 301
cuacacuauuuccuugguc

SEQ ID NO: 3943145 - RNA, 23 nt, Shigella flexneri 2a str. 301
cuacagagcgagggagaaaaccc

SEQ ID NO: 3943146 - RNA, 17 nt, Shigella flexneri 2a str. 301
cuacagaggaaucgcug

SEQ ID NO: 3943147 - RNA, 23 nt, Shigella flexneri 2a str. 301
cuacagaggaaucgcuguugagg

SEQ ID NO: 3943148 - RNA, 20 nt, Shigella flexneri 2a str. 301
cuacagccaugcgaaugcca

SEQ ID NO: 3943149 - RNA, 18 nt, Shigella flexneri 2a str. 301
cuacagcgcccgccagca

SEQ ID NO: 3943150 - RNA, 19 nt, Shigella flexneri 2a str. 301
cuacagguuugugccgaac

SEQ ID NO: 3943151 - RNA, 17 nt, Shigella flexneri 2a str. 301
cuacauauuuuucauau

SEQ ID NO: 3943152 - RNA, 14 nt, Shigella flexneri 2a str. 301
cuaccacaugauua

SEQ ID NO: 3943153 - RNA, 17 nt, Shigella flexneri 2a str. 301
cuaccacgccgauaauc

SEQ ID NO: 3943154 - RNA, 16 nt, Shigella flexneri 2a str. 301
cuaccacguaacgacu

SEQ ID NO: 3943155 - RNA, 11 nt, Shigella flexneri 2a str. 301
cuaccagcacc

SEQ ID NO: 3943156 - RNA, 16 nt, Shigella flexneri 2a str. 301
cuaccagcgccaccgg

SEQ ID NO: 3943157 - RNA, 13 nt, Shigella flexneri 2a str. 301
cuaccaucaaugg

SEQ ID NO: 3943158 - RNA, 13 nt, Shigella flexneri 2a str. 301
cuaccaugcuaau

SEQ ID NO: 3943159 - RNA, 19 nt, Shigella flexneri 2a str. 301
cuaccauuuguucuuuuuu

SEQ ID NO: 3943160 - RNA, 15 nt, Shigella flexneri 2a str. 301
cuacccauauuuaau

SEQ ID NO: 3943161 - RNA, 19 nt, Shigella flexneri 2a str. 301
cuaccgcaggggcggggaa

SEQ ID NO: 3943162 - RNA, 14 nt, Shigella flexneri 2a str. 301
cuaccgccagccag

SEQ ID NO: 3943163 - RNA, 14 nt, Shigella flexneri 2a str. 301
cuaccgcuuugcca

SEQ ID NO: 3943164 - RNA, 16 nt, Shigella flexneri 2a str. 301
cuaccgggaugcugau

SEQ ID NO: 3943165 - RNA, 20 nt, Shigella flexneri 2a str. 301
cuaccgugcuguacagcagu

SEQ ID NO: 3943166 - RNA, 16 nt, Shigella flexneri 2a str. 301
cuaccguguucagcgu

SEQ ID NO: 3943167 - RNA, 17 nt, Shigella flexneri 2a str. 301
cuaccuaaggaauccag

SEQ ID NO: 3943168 - RNA, 14 nt, Shigella flexneri 2a str. 301
cuaccugccgccac

SEQ ID NO: 3943169 - RNA, 22 nt, Shigella flexneri 2a str. 301
cuaccuuaacgguaucuuucca

SEQ ID NO: 3943170 - RNA, 13 nt, Shigella flexneri 2a str. 301
cuaccuucuuccc

SEQ ID NO: 3943171 - RNA, 19 nt, Shigella flexneri 2a str. 301
cuacgcagggauauuucac

SEQ ID NO: 3943172 - RNA, 19 nt, Shigella flexneri 2a str. 301
cuacgcgcaauauccugcg

SEQ ID NO: 3943173 - RNA, 16 nt, Shigella flexneri 2a str. 301
cuacgcgcccgcgcag

SEQ ID NO: 3943174 - RNA, 17 nt, Shigella flexneri 2a str. 301
cuacgcguuaaagagcc

SEQ ID NO: 3943175 - RNA, 18 nt, Shigella flexneri 2a str. 301
cuacgcucaucaggccua

SEQ ID NO: 3943176 - RNA, 13 nt, Shigella flexneri 2a str. 301
cuacgcuuaucag

SEQ ID NO: 3943177 - RNA, 18 nt, Shigella flexneri 2a str. 301
cuacgcuuaucaggccua

SEQ ID NO: 3943178 - RNA, 19 nt, Shigella flexneri 2a str. 301
cuacgcuuaucaggccuac

SEQ ID NO: 3943179 - RNA, 23 nt, Shigella flexneri 2a str. 301
cuacggacaguggcucuuguucg

SEQ ID NO: 3943180 - RNA, 14 nt, Shigella flexneri 2a str. 301
cuacggcaaaagaa

SEQ ID NO: 3943181 - RNA, 12 nt, Shigella flexneri 2a str. 301
cuacggcugaug

SEQ ID NO: 3943182 - RNA, 15 nt, Shigella flexneri 2a str. 301
cuacggucacgccac

SEQ ID NO: 3943183 - RNA, 23 nt, Shigella flexneri 2a str. 301
cuacguaggacagcguugccagc

SEQ ID NO: 3943184 - RNA, 16 nt, Shigella flexneri 2a str. 301
cuacgugcgcuaugug

SEQ ID NO: 3943185 - RNA, 19 nt, Shigella flexneri 2a str. 301
cuacgugcgcuauguguua

SEQ ID NO: 3943186 - RNA, 20 nt, Shigella flexneri 2a str. 301
cuacguuucuggugugcagc

SEQ ID NO: 3943187 - RNA, 21 nt, Shigella flexneri 2a str. 301
cuacuaugauuuuccugagga

SEQ ID NO: 3943188 - RNA, 16 nt, Shigella flexneri 2a str. 301
cuacuauggaacgcuc

SEQ ID NO: 3943189 - RNA, 20 nt, Shigella flexneri 2a str. 301
cuacuauggaacgcucaagc

SEQ ID NO: 3943190 - RNA, 21 nt, Shigella flexneri 2a str. 301
cuacucuauacaggauaauua

SEQ ID NO: 3943191 - RNA, 16 nt, Shigella flexneri 2a str. 301
cuacucugacccagua

SEQ ID NO: 3943192 - RNA, 14 nt, Shigella flexneri 2a str. 301
cuacugaaucccug

SEQ ID NO: 3943193 - RNA, 18 nt, Shigella flexneri 2a str. 301
cuacuggcaauccagcuc

SEQ ID NO: 3943194 - RNA, 11 nt, Shigella flexneri 2a str. 301
cuacuucuucg

SEQ ID NO: 3943195 - RNA, 20 nt, Shigella flexneri 2a str. 301
cuacuucuucuucgcugcag

SEQ ID NO: 3943196 - RNA, 22 nt, Shigella flexneri 2a str. 301
cuacuuugcgagucugcuccag

SEQ ID NO: 3943197 - RNA, 21 nt, Shigella flexneri 2a str. 301
cuacuuuuccagguuauuuua

SEQ ID NO: 3943198 - RNA, 21 nt, Shigella flexneri 2a str. 301
cuacuuuuuaauucaggaaau

SEQ ID NO: 3943199 - RNA, 14 nt, Shigella flexneri 2a str. 301
cuacuuuuuuaaga

SEQ ID NO: 3943200 - RNA, 18 nt, Shigella flexneri 2a str. 301
cuacuuuuuucacccaca

SEQ ID NO: 3943201 - RNA, 21 nt, Shigella flexneri 2a str. 301
cuacuuuuuucacccacacuu

SEQ ID NO: 3943202 - RNA, 23 nt, Shigella flexneri 2a str. 301
cuagacagcgacucucugagcca

SEQ ID NO: 3943203 - RNA, 14 nt, Shigella flexneri 2a str. 301
cuagacgaugaaaa

SEQ ID NO: 3943204 - RNA, 15 nt, Shigella flexneri 2a str. 301
cuagagcaucaugaa

SEQ ID NO: 3943205 - RNA, 24 nt, Shigella flexneri 2a str. 301
cuagagcaucaugaauauauaauu

SEQ ID NO: 3943206 - RNA, 22 nt, Shigella flexneri 2a str. 301
cuagaugugcaguuccugcaac

SEQ ID NO: 3943207 - RNA, 15 nt, Shigella flexneri 2a str. 301
cuagccucagguguu

SEQ ID NO: 3943208 - RNA, 14 nt, Shigella flexneri 2a str. 301
cuagccugcucccu

SEQ ID NO: 3943209 - RNA, 15 nt, Shigella flexneri 2a str. 301
cuagccugcucccuu

SEQ ID NO: 3943210 - RNA, 15 nt, Shigella flexneri 2a str. 301
cuagcggcuuuuuac

SEQ ID NO: 3943211 - RNA, 19 nt, Shigella flexneri 2a str. 301
cuagcuggcucgacaaaau

SEQ ID NO: 3943212 - RNA, 19 nt, Shigella flexneri 2a str. 301
cuaggaagccuuccgcaaa

SEQ ID NO: 3943213 - RNA, 22 nt, Shigella flexneri 2a str. 301
cuaggacgcacaucgcugugcu

SEQ ID NO: 3943214 - RNA, 18 nt, Shigella flexneri 2a str. 301
cuaguuuugccgacuggc

SEQ ID NO: 3943215 - RNA, 14 nt, Shigella flexneri 2a str. 301
cuauaaaaaaaccg

SEQ ID NO: 3943216 - RNA, 14 nt, Shigella flexneri 2a str. 301
cuauaacaaaacug

SEQ ID NO: 3943217 - RNA, 21 nt, Shigella flexneri 2a str. 301
cuauaaguguaaaauucuaca

SEQ ID NO: 3943218 - RNA, 23 nt, Shigella flexneri 2a str. 301
cuauaauugcuuuuuuccauaag

SEQ ID NO: 3943219 - RNA, 14 nt, Shigella flexneri 2a str. 301
cuauaccccacccc

SEQ ID NO: 3943220 - RNA, 22 nt, Shigella flexneri 2a str. 301
cuauacuuuugccgaauucaua

SEQ ID NO: 3943221 - RNA, 16 nt, Shigella flexneri 2a str. 301
cuauagauuauuugcg

SEQ ID NO: 3943222 - RNA, 18 nt, Shigella flexneri 2a str. 301
cuauagugaggcuauucc

SEQ ID NO: 3943223 - RNA, 14 nt, Shigella flexneri 2a str. 301
cuauauacaaucac

SEQ ID NO: 3943224 - RNA, 22 nt, Shigella flexneri 2a str. 301
cuauauuacgagucacaaacau

SEQ ID NO: 3943225 - RNA, 21 nt, Shigella flexneri 2a str. 301
cuaucacgccaccagcaacag

SEQ ID NO: 3943226 - RNA, 23 nt, Shigella flexneri 2a str. 301
cuaucacgccaccagcaacagcg

SEQ ID NO: 3943227 - RNA, 20 nt, Shigella flexneri 2a str. 301
cuaucagaccuacaaaaccu

SEQ ID NO: 3943228 - RNA, 23 nt, Shigella flexneri 2a str. 301
cuaucagaccuacaaaaccugca

SEQ ID NO: 3943229 - RNA, 13 nt, Shigella flexneri 2a str. 301
cuaucauacucau

SEQ ID NO: 3943230 - RNA, 20 nt, Shigella flexneri 2a str. 301
cuauccacgucgacaacucc

SEQ ID NO: 3943231 - RNA, 11 nt, Shigella flexneri 2a str. 301
cuauccagcuc

SEQ ID NO: 3943232 - RNA, 14 nt, Shigella flexneri 2a str. 301
cuauccggcauaca

SEQ ID NO: 3943233 - RNA, 20 nt, Shigella flexneri 2a str. 301
cuauccugguuauuucacuu

SEQ ID NO: 3943234 - RNA, 14 nt, Shigella flexneri 2a str. 301
cuaucgccaucagg

SEQ ID NO: 3943235 - RNA, 20 nt, Shigella flexneri 2a str. 301
cuaucgcugauauacccuuc

SEQ ID NO: 3943236 - RNA, 17 nt, Shigella flexneri 2a str. 301
cuaucucuuuaccuucg

SEQ ID NO: 3943237 - RNA, 18 nt, Shigella flexneri 2a str. 301
cuaucugcugcuugcggu

SEQ ID NO: 3943238 - RNA, 15 nt, Shigella flexneri 2a str. 301
cuaucuucgauaaac

SEQ ID NO: 3943239 - RNA, 15 nt, Shigella flexneri 2a str. 301
cuaucuuucaacagu

SEQ ID NO: 3943240 - RNA, 17 nt, Shigella flexneri 2a str. 301
cuaugaaaauaaaugug

SEQ ID NO: 3943241 - RNA, 18 nt, Shigella flexneri 2a str. 301
cuaugaacacgaucucac

SEQ ID NO: 3943242 - RNA, 14 nt, Shigella flexneri 2a str. 301
cuaugauuuuccug

SEQ ID NO: 3943243 - RNA, 22 nt, Shigella flexneri 2a str. 301
cuaugcaacaacugaaaaaaaa

SEQ ID NO: 3943244 - RNA, 16 nt, Shigella flexneri 2a str. 301
cuauggcuggcaauac

SEQ ID NO: 3943245 - RNA, 16 nt, Shigella flexneri 2a str. 301
cuauguaauccugaug

SEQ ID NO: 3943246 - RNA, 17 nt, Shigella flexneri 2a str. 301
cuaugucgcauccggca

SEQ ID NO: 3943247 - RNA, 18 nt, Shigella flexneri 2a str. 301
cuauuaaaaagcuucuca

SEQ ID NO: 3943248 - RNA, 20 nt, Shigella flexneri 2a str. 301
cuauuaaaaagcuucucaga

SEQ ID NO: 3943249 - RNA, 22 nt, Shigella flexneri 2a str. 301
cuauuaaagaaaguaaucuaua

SEQ ID NO: 3943250 - RNA, 24 nt, Shigella flexneri 2a str. 301
cuauuaagcuuuccggcaucacau

SEQ ID NO: 3943251 - RNA, 13 nt, Shigella flexneri 2a str. 301
cuauuacgcacac

SEQ ID NO: 3943252 - RNA, 22 nt, Shigella flexneri 2a str. 301
cuauucaccgcaucaauauuaa

SEQ ID NO: 3943253 - RNA, 12 nt, Shigella flexneri 2a str. 301
cuauucagcagu

SEQ ID NO: 3943254 - RNA, 17 nt, Shigella flexneri 2a str. 301
cuauucagcucuuccuu

SEQ ID NO: 3943255 - RNA, 11 nt, Shigella flexneri 2a str. 301
cuauucaucaa

SEQ ID NO: 3943256 - RNA, 12 nt, Shigella flexneri 2a str. 301
cuauuccacgca

SEQ ID NO: 3943257 - RNA, 19 nt, Shigella flexneri 2a str. 301
cuauuccguuacucuccgg

SEQ ID NO: 3943258 - RNA, 20 nt, Shigella flexneri 2a str. 301
cuauuccguuacucuccgga

SEQ ID NO: 3943259 - RNA, 17 nt, Shigella flexneri 2a str. 301
cuauucuuauaaagaaa

SEQ ID NO: 3943260 - RNA, 19 nt, Shigella flexneri 2a str. 301
cuauugcgcuaaaaaguuc

SEQ ID NO: 3943261 - RNA, 21 nt, Shigella flexneri 2a str. 301
cuauuguaguuggaugacauu

SEQ ID NO: 3943262 - RNA, 17 nt, Shigella flexneri 2a str. 301
cuauuguugauaaggaa

SEQ ID NO: 3943263 - RNA, 17 nt, Shigella flexneri 2a str. 301
cuauuucaauaugauaa

SEQ ID NO: 3943264 - RNA, 19 nt, Shigella flexneri 2a str. 301
cuauuuccaccucccccuu

SEQ ID NO: 3943265 - RNA, 19 nt, Shigella flexneri 2a str. 301
cuauuucgucgcuaacggu

SEQ ID NO: 3943266 - RNA, 20 nt, Shigella flexneri 2a str. 301
cuauuuuuggaggugaaggu

SEQ ID NO: 3943267 - RNA, 23 nt, Shigella flexneri 2a str. 301
cuauuuuuuugauaaucuucuuc

SEQ ID NO: 3943268 - RNA, 18 nt, Shigella flexneri 2a str. 301
cucaaaaauaaucaucuc

SEQ ID NO: 3943269 - RNA, 13 nt, Shigella flexneri 2a str. 301
cucaaaacaacac

SEQ ID NO: 3943270 - RNA, 11 nt, Shigella flexneri 2a str. 301
cucaaaacuac

SEQ ID NO: 3943271 - RNA, 13 nt, Shigella flexneri 2a str. 301
cucaaaacuacaa

SEQ ID NO: 3943272 - RNA, 23 nt, Shigella flexneri 2a str. 301
cucaaaauuucuccuucacucua

SEQ ID NO: 3943273 - RNA, 22 nt, Shigella flexneri 2a str. 301
cucaaacacgccgauaucgcug

SEQ ID NO: 3943274 - RNA, 16 nt, Shigella flexneri 2a str. 301
cucaaaccaauggcau

SEQ ID NO: 3943275 - RNA, 19 nt, Shigella flexneri 2a str. 301
cucaaaccauuucugcgag

SEQ ID NO: 3943276 - RNA, 15 nt, Shigella flexneri 2a str. 301
cucaaaccauuuugc

SEQ ID NO: 3943277 - RNA, 17 nt, Shigella flexneri 2a str. 301
cucaaaccggcuccaga

SEQ ID NO: 3943278 - RNA, 22 nt, Shigella flexneri 2a str. 301
cucaaagacgcgguaaaagccc

SEQ ID NO: 3943279 - RNA, 15 nt, Shigella flexneri 2a str. 301
cucaaagccgaauuu

SEQ ID NO: 3943280 - RNA, 22 nt, Shigella flexneri 2a str. 301
cucaaagucgagaugaaacucg

SEQ ID NO: 3943281 - RNA, 21 nt, Shigella flexneri 2a str. 301
cucaacaggcccaacuguuga

SEQ ID NO: 3943282 - RNA, 22 nt, Shigella flexneri 2a str. 301
cucaacaggcccaacuguugau

SEQ ID NO: 3943283 - RNA, 14 nt, Shigella flexneri 2a str. 301
cucaacccuuucca

SEQ ID NO: 3943284 - RNA, 16 nt, Shigella flexneri 2a str. 301
cucaacccuuuccagc

SEQ ID NO: 3943285 - RNA, 13 nt, Shigella flexneri 2a str. 301
cucaaccgcuucu

SEQ ID NO: 3943286 - RNA, 18 nt, Shigella flexneri 2a str. 301
cucaaccgcuucuuucuc

SEQ ID NO: 3943287 - RNA, 15 nt, Shigella flexneri 2a str. 301
cucaaccuuuccuug

SEQ ID NO: 3943288 - RNA, 16 nt, Shigella flexneri 2a str. 301
cucaagaaagguugag

SEQ ID NO: 3943289 - RNA, 16 nt, Shigella flexneri 2a str. 301
cucaagcacccgccgc

SEQ ID NO: 3943290 - RNA, 22 nt, Shigella flexneri 2a str. 301
cucaagcaguugguuaaucuuu

SEQ ID NO: 3943291 - RNA, 22 nt, Shigella flexneri 2a str. 301
cucaagcguugcuucacgcggg

SEQ ID NO: 3943292 - RNA, 21 nt, Shigella flexneri 2a str. 301
cucaaguugcgaaagcgagca

SEQ ID NO: 3943293 - RNA, 15 nt, Shigella flexneri 2a str. 301
cucaauacaacccac

SEQ ID NO: 3943294 - RNA, 17 nt, Shigella flexneri 2a str. 301
cucaauaucaucauuug

SEQ ID NO: 3943295 - RNA, 15 nt, Shigella flexneri 2a str. 301
cucaauauccugacc

SEQ ID NO: 3943296 - RNA, 13 nt, Shigella flexneri 2a str. 301
cucaaucaaaaga

SEQ ID NO: 3943297 - RNA, 17 nt, Shigella flexneri 2a str. 301
cucaaucucuuuuucca

SEQ ID NO: 3943298 - RNA, 18 nt, Shigella flexneri 2a str. 301
cucaaucucuuuuuccac

SEQ ID NO: 3943299 - RNA, 20 nt, Shigella flexneri 2a str. 301
cucaaucugauagugaucca

SEQ ID NO: 3943300 - RNA, 13 nt, Shigella flexneri 2a str. 301
cucaaucuucacg

SEQ ID NO: 3943301 - RNA, 21 nt, Shigella flexneri 2a str. 301
cucaaugagcaccuuuuuucu

SEQ ID NO: 3943302 - RNA, 21 nt, Shigella flexneri 2a str. 301
cucaaugagccggaccucuuu

SEQ ID NO: 3943303 - RNA, 14 nt, Shigella flexneri 2a str. 301
cucaaugccugaug

SEQ ID NO: 3943304 - RNA, 13 nt, Shigella flexneri 2a str. 301
cucaaugcgcuga

SEQ ID NO: 3943305 - RNA, 23 nt, Shigella flexneri 2a str. 301
cucaaugcggcggcgcaccggcc

SEQ ID NO: 3943306 - RNA, 18 nt, Shigella flexneri 2a str. 301
cucaaugguguuuuccac

SEQ ID NO: 3943307 - RNA, 19 nt, Shigella flexneri 2a str. 301
cucaaugguguuuuccacc

SEQ ID NO: 3943308 - RNA, 13 nt, Shigella flexneri 2a str. 301
cucaauuaacauu

SEQ ID NO: 3943309 - RNA, 21 nt, Shigella flexneri 2a str. 301
cucaauuaacauugcaagauu

SEQ ID NO: 3943310 - RNA, 22 nt, Shigella flexneri 2a str. 301
cucaauugacaguuuauuuucu

SEQ ID NO: 3943311 - RNA, 16 nt, Shigella flexneri 2a str. 301
cucacagaguauuucc

SEQ ID NO: 3943312 - RNA, 19 nt, Shigella flexneri 2a str. 301
cucacagaguauuuccagc

SEQ ID NO: 3943313 - RNA, 23 nt, Shigella flexneri 2a str. 301
cucacagaguauuuccagcucaa

SEQ ID NO: 3943314 - RNA, 21 nt, Shigella flexneri 2a str. 301
cucacagggcucuuaagcacc

SEQ ID NO: 3943315 - RNA, 21 nt, Shigella flexneri 2a str. 301
cucacaucaugcgucaccaac

SEQ ID NO: 3943316 - RNA, 22 nt, Shigella flexneri 2a str. 301
cucacaucaugcgucaccaaca

SEQ ID NO: 3943317 - RNA, 20 nt, Shigella flexneri 2a str. 301
cucaccacgcuccaucaugu

SEQ ID NO: 3943318 - RNA, 13 nt, Shigella flexneri 2a str. 301
cucaccagccgcg

SEQ ID NO: 3943319 - RNA, 13 nt, Shigella flexneri 2a str. 301
cucaccaucaagu

SEQ ID NO: 3943320 - RNA, 16 nt, Shigella flexneri 2a str. 301
cucacccgcuucauaa

SEQ ID NO: 3943321 - RNA, 19 nt, Shigella flexneri 2a str. 301
cucacccuaacccucuccc

SEQ ID NO: 3943322 - RNA, 18 nt, Shigella flexneri 2a str. 301
cucaccgaugaucgccau

SEQ ID NO: 3943323 - RNA, 20 nt, Shigella flexneri 2a str. 301
cucaccgccauauuuaaaga

SEQ ID NO: 3943324 - RNA, 20 nt, Shigella flexneri 2a str. 301
cucaccgguaaagucagcgu

SEQ ID NO: 3943325 - RNA, 13 nt, Shigella flexneri 2a str. 301
cucaccguugcca

SEQ ID NO: 3943326 - RNA, 20 nt, Shigella flexneri 2a str. 301
cucaccguugccaaccugaa

SEQ ID NO: 3943327 - RNA, 19 nt, Shigella flexneri 2a str. 301
cucaccuauguggaaacag

SEQ ID NO: 3943328 - RNA, 15 nt, Shigella flexneri 2a str. 301
cucacgaucacagca

SEQ ID NO: 3943329 - RNA, 20 nt, Shigella flexneri 2a str. 301
cucacgaucacagcagucca

SEQ ID NO: 3943330 - RNA, 14 nt, Shigella flexneri 2a str. 301
cucacgcagcggcg

SEQ ID NO: 3943331 - RNA, 21 nt, Shigella flexneri 2a str. 301
cucacgcagggugugcuccag

SEQ ID NO: 3943332 - RNA, 14 nt, Shigella flexneri 2a str. 301
cucacgcauccucu

SEQ ID NO: 3943333 - RNA, 19 nt, Shigella flexneri 2a str. 301
cucacgccguuaacuucac

SEQ ID NO: 3943334 - RNA, 16 nt, Shigella flexneri 2a str. 301
cucacgcgcugccucu

SEQ ID NO: 3943335 - RNA, 18 nt, Shigella flexneri 2a str. 301
cucacuacggcucaguaa

SEQ ID NO: 3943336 - RNA, 21 nt, Shigella flexneri 2a str. 301
cucacuauccgccccauuuuu

SEQ ID NO: 3943337 - RNA, 15 nt, Shigella flexneri 2a str. 301
cucacuaucgcugag

SEQ ID NO: 3943338 - RNA, 20 nt, Shigella flexneri 2a str. 301
cucacucaucacuccccgca

SEQ ID NO: 3943339 - RNA, 12 nt, Shigella flexneri 2a str. 301
cucacuccagcc

SEQ ID NO: 3943340 - RNA, 20 nt, Shigella flexneri 2a str. 301
cucacugcgaaguuuuuccg

SEQ ID NO: 3943341 - RNA, 15 nt, Shigella flexneri 2a str. 301
cucacuguucacuuu

SEQ ID NO: 3943342 - RNA, 21 nt, Shigella flexneri 2a str. 301
cucacuguucacuuuugcugc

SEQ ID NO: 3943343 - RNA, 13 nt, Shigella flexneri 2a str. 301
cucacuuuuccgc

SEQ ID NO: 3943344 - RNA, 14 nt, Shigella flexneri 2a str. 301
cucacuuuuccgcc

SEQ ID NO: 3943345 - RNA, 17 nt, Shigella flexneri 2a str. 301
cucagaaucacgccaac

SEQ ID NO: 3943346 - RNA, 16 nt, Shigella flexneri 2a str. 301
cucagaccauauuccc

SEQ ID NO: 3943347 - RNA, 14 nt, Shigella flexneri 2a str. 301
cucagacucucauu

SEQ ID NO: 3943348 - RNA, 23 nt, Shigella flexneri 2a str. 301
cucagauucagauuaugucgcuc

SEQ ID NO: 3943349 - RNA, 15 nt, Shigella flexneri 2a str. 301
cucagcaacuuccug

SEQ ID NO: 3943350 - RNA, 16 nt, Shigella flexneri 2a str. 301
cucagcacaccauaaa

SEQ ID NO: 3943351 - RNA, 15 nt, Shigella flexneri 2a str. 301
cucagcagacugaua

SEQ ID NO: 3943352 - RNA, 22 nt, Shigella flexneri 2a str. 301
cucagcauggaaauguuccggc

SEQ ID NO: 3943353 - RNA, 19 nt, Shigella flexneri 2a str. 301
cucagccaaauccagcgca

SEQ ID NO: 3943354 - RNA, 15 nt, Shigella flexneri 2a str. 301
cucagcccacaucca

SEQ ID NO: 3943355 - RNA, 16 nt, Shigella flexneri 2a str. 301
cucagcgccugcugca

SEQ ID NO: 3943356 - RNA, 13 nt, Shigella flexneri 2a str. 301
cucagcuucagau

SEQ ID NO: 3943357 - RNA, 13 nt, Shigella flexneri 2a str. 301
cucaggaauagcg

SEQ ID NO: 3943358 - RNA, 23 nt, Shigella flexneri 2a str. 301
cucaggaauagcggcaagcccag

SEQ ID NO: 3943359 - RNA, 19 nt, Shigella flexneri 2a str. 301
cucaggacguuuucagcca

SEQ ID NO: 3943360 - RNA, 15 nt, Shigella flexneri 2a str. 301
cucaggcacuucuuc

SEQ ID NO: 3943361 - RNA, 18 nt, Shigella flexneri 2a str. 301
cucaggcaguacgcggcg

SEQ ID NO: 3943362 - RNA, 19 nt, Shigella flexneri 2a str. 301
cucaggccgauuucaugaa

SEQ ID NO: 3943363 - RNA, 16 nt, Shigella flexneri 2a str. 301
cucaggccuacaaaau

SEQ ID NO: 3943364 - RNA, 19 nt, Shigella flexneri 2a str. 301
cucaggccuacaaaaucuu

SEQ ID NO: 3943365 - RNA, 15 nt, Shigella flexneri 2a str. 301
cucaggcgcacgccg

SEQ ID NO: 3943366 - RNA, 23 nt, Shigella flexneri 2a str. 301
cucaggcgcacgccgacaaagau

SEQ ID NO: 3943367 - RNA, 13 nt, Shigella flexneri 2a str. 301
cucagguucaacc

SEQ ID NO: 3943368 - RNA, 14 nt, Shigella flexneri 2a str. 301
cucaguacaggccg

SEQ ID NO: 3943369 - RNA, 17 nt, Shigella flexneri 2a str. 301
cucagugaccgaaccug

SEQ ID NO: 3943370 - RNA, 14 nt, Shigella flexneri 2a str. 301
cucaguuaaucgcg

SEQ ID NO: 3943371 - RNA, 19 nt, Shigella flexneri 2a str. 301
cucaguugguuagagcaca

SEQ ID NO: 3943372 - RNA, 18 nt, Shigella flexneri 2a str. 301
cucauaaaaccauuuguu

SEQ ID NO: 3943373 - RNA, 18 nt, Shigella flexneri 2a str. 301
cucauaaauucaaagugu

SEQ ID NO: 3943374 - RNA, 18 nt, Shigella flexneri 2a str. 301
cucauacaccagcggcac

SEQ ID NO: 3943375 - RNA, 19 nt, Shigella flexneri 2a str. 301
cucauaccuuccacuuuca

SEQ ID NO: 3943376 - RNA, 15 nt, Shigella flexneri 2a str. 301
cucauagcgcccuuu

SEQ ID NO: 3943377 - RNA, 14 nt, Shigella flexneri 2a str. 301
cucauaugcagcau

SEQ ID NO: 3943378 - RNA, 19 nt, Shigella flexneri 2a str. 301
cucauauuccugcauugcu

SEQ ID NO: 3943379 - RNA, 15 nt, Shigella flexneri 2a str. 301
cucaucaacguuuuu

SEQ ID NO: 3943380 - RNA, 18 nt, Shigella flexneri 2a str. 301
cucaucaagcuguucuuc

SEQ ID NO: 3943381 - RNA, 9 nt, Shigella flexneri 2a str. 301
cucaucaau

SEQ ID NO: 3943382 - RNA, 23 nt, Shigella flexneri 2a str. 301
cucaucaauaccugguccuucau

SEQ ID NO: 3943383 - RNA, 15 nt, Shigella flexneri 2a str. 301
cucaucaccaucagg

SEQ ID NO: 3943384 - RNA, 19 nt, Shigella flexneri 2a str. 301
cucaucagcgguaaaacgc

SEQ ID NO: 3943385 - RNA, 13 nt, Shigella flexneri 2a str. 301
cucaucagcgucg

SEQ ID NO: 3943386 - RNA, 12 nt, Shigella flexneri 2a str. 301
cucaucaggccu

SEQ ID NO: 3943387 - RNA, 18 nt, Shigella flexneri 2a str. 301
cucaucaggccuacaaaa

SEQ ID NO: 3943388 - RNA, 18 nt, Shigella flexneri 2a str. 301
cucauccauaaauaccug

SEQ ID NO: 3943389 - RNA, 12 nt, Shigella flexneri 2a str. 301
cucauccaucaa

SEQ ID NO: 3943390 - RNA, 14 nt, Shigella flexneri 2a str. 301
cucauccaucaaau

SEQ ID NO: 3943391 - RNA, 19 nt, Shigella flexneri 2a str. 301
cucauccgguguggcaugg

SEQ ID NO: 3943392 - RNA, 14 nt, Shigella flexneri 2a str. 301
cucaucgccgccaa

SEQ ID NO: 3943393 - RNA, 14 nt, Shigella flexneri 2a str. 301
cucaucggcauaca

SEQ ID NO: 3943394 - RNA, 21 nt, Shigella flexneri 2a str. 301
cucaucguugcgaucgaccug

SEQ ID NO: 3943395 - RNA, 15 nt, Shigella flexneri 2a str. 301
cucaucuuccaccac

SEQ ID NO: 3943396 - RNA, 18 nt, Shigella flexneri 2a str. 301
cucaucuuccaccacguc

SEQ ID NO: 3943397 - RNA, 17 nt, Shigella flexneri 2a str. 301
cucaucuuugaaaucac

SEQ ID NO: 3943398 - RNA, 15 nt, Shigella flexneri 2a str. 301
cucaugcaucaggac

SEQ ID NO: 3943399 - RNA, 19 nt, Shigella flexneri 2a str. 301
cucaugcaucaggaccugc

SEQ ID NO: 3943400 - RNA, 18 nt, Shigella flexneri 2a str. 301
cucaugggaccgcuacca

SEQ ID NO: 3943401 - RNA, 20 nt, Shigella flexneri 2a str. 301
cucaugggaccgcuaccacg

SEQ ID NO: 3943402 - RNA, 17 nt, Shigella flexneri 2a str. 301
cucaugggucugcggau

SEQ ID NO: 3943403 - RNA, 21 nt, Shigella flexneri 2a str. 301
cucauuaagacuguaaauaaa

SEQ ID NO: 3943404 - RNA, 12 nt, Shigella flexneri 2a str. 301
cucauugccagu

SEQ ID NO: 3943405 - RNA, 22 nt, Shigella flexneri 2a str. 301
cuccaaggucuccgcccagcgu

SEQ ID NO: 3943406 - RNA, 20 nt, Shigella flexneri 2a str. 301
cuccacaagaaugccugcca

SEQ ID NO: 3943407 - RNA, 13 nt, Shigella flexneri 2a str. 301
cuccacaccggca

SEQ ID NO: 3943408 - RNA, 21 nt, Shigella flexneri 2a str. 301
cuccacaccggcaccauggcu

SEQ ID NO: 3943409 - RNA, 20 nt, Shigella flexneri 2a str. 301
cuccaccucauuaagaugca

SEQ ID NO: 3943410 - RNA, 11 nt, Shigella flexneri 2a str. 301
cuccaccugag

SEQ ID NO: 3943411 - RNA, 17 nt, Shigella flexneri 2a str. 301
cuccaccuugcggaaac

SEQ ID NO: 3943412 - RNA, 23 nt, Shigella flexneri 2a str. 301
cuccaccuugcggaaacugucaa

SEQ ID NO: 3943413 - RNA, 19 nt, Shigella flexneri 2a str. 301
cuccacgauguucugagcg

SEQ ID NO: 3943414 - RNA, 17 nt, Shigella flexneri 2a str. 301
cuccacgcccagcgcag

SEQ ID NO: 3943415 - RNA, 20 nt, Shigella flexneri 2a str. 301
cuccacgcccagcgcaggaa

SEQ ID NO: 3943416 - RNA, 12 nt, Shigella flexneri 2a str. 301
cuccacgcugca

SEQ ID NO: 3943417 - RNA, 15 nt, Shigella flexneri 2a str. 301
cuccacgcugcaucg

SEQ ID NO: 3943418 - RNA, 20 nt, Shigella flexneri 2a str. 301
cuccacgcugcaucgccaau

SEQ ID NO: 3943419 - RNA, 21 nt, Shigella flexneri 2a str. 301
cuccacgcuuaacaacccguu

SEQ ID NO: 3943420 - RNA, 16 nt, Shigella flexneri 2a str. 301
cuccacuauaaaaaaa

SEQ ID NO: 3943421 - RNA, 14 nt, Shigella flexneri 2a str. 301
cuccacugaagacg

SEQ ID NO: 3943422 - RNA, 13 nt, Shigella flexneri 2a str. 301
cuccacuuccugc

SEQ ID NO: 3943423 - RNA, 14 nt, Shigella flexneri 2a str. 301
cuccacuuccugcc

SEQ ID NO: 3943424 - RNA, 17 nt, Shigella flexneri 2a str. 301
cuccacuuccugccagu

SEQ ID NO: 3943425 - RNA, 13 nt, Shigella flexneri 2a str. 301
cuccacuuuuaca

SEQ ID NO: 3943426 - RNA, 22 nt, Shigella flexneri 2a str. 301
cuccacuuuuacaugcgcgaca

SEQ ID NO: 3943427 - RNA, 22 nt, Shigella flexneri 2a str. 301
cuccagauccauaagguccucc

SEQ ID NO: 3943428 - RNA, 23 nt, Shigella flexneri 2a str. 301
cuccagauccauaagguccucca

SEQ ID NO: 3943429 - RNA, 23 nt, Shigella flexneri 2a str. 301
cuccagauuaccagcgacaucac

SEQ ID NO: 3943430 - RNA, 20 nt, Shigella flexneri 2a str. 301
cuccagauuacuuaacuuau

SEQ ID NO: 3943431 - RNA, 22 nt, Shigella flexneri 2a str. 301
cuccagauuacuuaacuuauau

SEQ ID NO: 3943432 - RNA, 17 nt, Shigella flexneri 2a str. 301
cuccagcaauaacauua

SEQ ID NO: 3943433 - RNA, 12 nt, Shigella flexneri 2a str. 301
cuccagcaaugu

SEQ ID NO: 3943434 - RNA, 13 nt, Shigella flexneri 2a str. 301
cuccagcagacca

SEQ ID NO: 3943435 - RNA, 13 nt, Shigella flexneri 2a str. 301
cuccagccagagc

SEQ ID NO: 3943436 - RNA, 15 nt, Shigella flexneri 2a str. 301
cuccagcccgcgucg

SEQ ID NO: 3943437 - RNA, 14 nt, Shigella flexneri 2a str. 301
cuccagcgcaauug

SEQ ID NO: 3943438 - RNA, 11 nt, Shigella flexneri 2a str. 301
cuccagcgcca

SEQ ID NO: 3943439 - RNA, 11 nt, Shigella flexneri 2a str. 301
cuccagcgccg

SEQ ID NO: 3943440 - RNA, 13 nt, Shigella flexneri 2a str. 301
cuccagcgccgca

SEQ ID NO: 3943441 - RNA, 13 nt, Shigella flexneri 2a str. 301
cuccagcgccgcc

SEQ ID NO: 3943442 - RNA, 20 nt, Shigella flexneri 2a str. 301
cuccagcgccgccagaauca

SEQ ID NO: 3943443 - RNA, 22 nt, Shigella flexneri 2a str. 301
cuccagcgcgucugcgcccagc

SEQ ID NO: 3943444 - RNA, 19 nt, Shigella flexneri 2a str. 301
cuccagcgggcgaaucaac

SEQ ID NO: 3943445 - RNA, 13 nt, Shigella flexneri 2a str. 301
cuccagcuauaac

SEQ ID NO: 3943446 - RNA, 16 nt, Shigella flexneri 2a str. 301
cuccagcucugauauu

SEQ ID NO: 3943447 - RNA, 23 nt, Shigella flexneri 2a str. 301
cuccaggaguuccgggucaucca

SEQ ID NO: 3943448 - RNA, 13 nt, Shigella flexneri 2a str. 301
cuccagguccucc

SEQ ID NO: 3943449 - RNA, 22 nt, Shigella flexneri 2a str. 301
cuccagguccuccuguaccuuc

SEQ ID NO: 3943450 - RNA, 15 nt, Shigella flexneri 2a str. 301
cuccagugcauccag

SEQ ID NO: 3943451 - RNA, 21 nt, Shigella flexneri 2a str. 301
cuccauacaucuucaucaucc

SEQ ID NO: 3943452 - RNA, 14 nt, Shigella flexneri 2a str. 301
cuccauacuuccac

SEQ ID NO: 3943453 - RNA, 22 nt, Shigella flexneri 2a str. 301
cuccauaugaacggaaccgacg

SEQ ID NO: 3943454 - RNA, 18 nt, Shigella flexneri 2a str. 301
cuccauccagcaacaaca

SEQ ID NO: 3943455 - RNA, 22 nt, Shigella flexneri 2a str. 301
cuccauccgggaucacaucaua

SEQ ID NO: 3943456 - RNA, 22 nt, Shigella flexneri 2a str. 301
cuccaugagaagcugaaaucau

SEQ ID NO: 3943457 - RNA, 20 nt, Shigella flexneri 2a str. 301
cuccaugggagaacgaugcu

SEQ ID NO: 3943458 - RNA, 18 nt, Shigella flexneri 2a str. 301
cuccauguccagcuugau

SEQ ID NO: 3943459 - RNA, 15 nt, Shigella flexneri 2a str. 301
cuccauuaccuggau

SEQ ID NO: 3943460 - RNA, 13 nt, Shigella flexneri 2a str. 301
cuccauugaagag

SEQ ID NO: 3943461 - RNA, 15 nt, Shigella flexneri 2a str. 301
cuccauugaauuuua

SEQ ID NO: 3943462 - RNA, 19 nt, Shigella flexneri 2a str. 301
cucccacggaauagaaccu

SEQ ID NO: 3943463 - RNA, 15 nt, Shigella flexneri 2a str. 301
cucccagccucccau

SEQ ID NO: 3943464 - RNA, 21 nt, Shigella flexneri 2a str. 301
cucccaguaaccacgcagcgu

SEQ ID NO: 3943465 - RNA, 14 nt, Shigella flexneri 2a str. 301
cuccccagaaucca

SEQ ID NO: 3943466 - RNA, 18 nt, Shigella flexneri 2a str. 301
cuccccagaauccaggaa

SEQ ID NO: 3943467 - RNA, 19 nt, Shigella flexneri 2a str. 301
cuccccagggaacauuucu

SEQ ID NO: 3943468 - RNA, 16 nt, Shigella flexneri 2a str. 301
cuccccccaacaugac

SEQ ID NO: 3943469 - RNA, 13 nt, Shigella flexneri 2a str. 301
cuccccccucuga

SEQ ID NO: 3943470 - RNA, 14 nt, Shigella flexneri 2a str. 301
cuccccccucugau

SEQ ID NO: 3943471 - RNA, 23 nt, Shigella flexneri 2a str. 301
cuccccgcauuuacucucaucaa

SEQ ID NO: 3943472 - RNA, 17 nt, Shigella flexneri 2a str. 301
cuccccgccguugcucu

SEQ ID NO: 3943473 - RNA, 14 nt, Shigella flexneri 2a str. 301
cuccccugcaaucc

SEQ ID NO: 3943474 - RNA, 18 nt, Shigella flexneri 2a str. 301
cuccccuuucuuauuuuu

SEQ ID NO: 3943475 - RNA, 18 nt, Shigella flexneri 2a str. 301
cucccgaaugaccgcccc

SEQ ID NO: 3943476 - RNA, 20 nt, Shigella flexneri 2a str. 301
cucccgaaugaccgccccug

SEQ ID NO: 3943477 - RNA, 12 nt, Shigella flexneri 2a str. 301
cucccgauaacc

SEQ ID NO: 3943478 - RNA, 21 nt, Shigella flexneri 2a str. 301
cucccgauaaccuucuucauu

SEQ ID NO: 3943479 - RNA, 17 nt, Shigella flexneri 2a str. 301
cucccgcaggagcgccg

SEQ ID NO: 3943480 - RNA, 17 nt, Shigella flexneri 2a str. 301
cucccggauaucccagc

SEQ ID NO: 3943481 - RNA, 14 nt, Shigella flexneri 2a str. 301
cucccgguagguga

SEQ ID NO: 3943482 - RNA, 15 nt, Shigella flexneri 2a str. 301
cucccgucgcccaca

SEQ ID NO: 3943483 - RNA, 18 nt, Shigella flexneri 2a str. 301
cucccguucauucaacuu

SEQ ID NO: 3943484 - RNA, 22 nt, Shigella flexneri 2a str. 301
cucccguuccugguuuuccaga

SEQ ID NO: 3943485 - RNA, 16 nt, Shigella flexneri 2a str. 301
cucccguuucccuguc

SEQ ID NO: 3943486 - RNA, 23 nt, Shigella flexneri 2a str. 301
cucccucgucggugguggucccu

SEQ ID NO: 3943487 - RNA, 14 nt, Shigella flexneri 2a str. 301
cucccugccuccau

SEQ ID NO: 3943488 - RNA, 19 nt, Shigella flexneri 2a str. 301
cucccuggcccaucgccag

SEQ ID NO: 3943489 - RNA, 16 nt, Shigella flexneri 2a str. 301
cucccuguaucccagu

SEQ ID NO: 3943490 - RNA, 13 nt, Shigella flexneri 2a str. 301
cucccuuaaaaaa

SEQ ID NO: 3943491 - RNA, 13 nt, Shigella flexneri 2a str. 301
cuccgaccagaag

SEQ ID NO: 3943492 - RNA, 15 nt, Shigella flexneri 2a str. 301
cuccgaccagaagcg

SEQ ID NO: 3943493 - RNA, 10 nt, Shigella flexneri 2a str. 301
cuccgcaaug

SEQ ID NO: 3943494 - RNA, 23 nt, Shigella flexneri 2a str. 301
cuccgccccggcaauaaaacagg

SEQ ID NO: 3943495 - RNA, 16 nt, Shigella flexneri 2a str. 301
cuccgccgcaucuucc

SEQ ID NO: 3943496 - RNA, 20 nt, Shigella flexneri 2a str. 301
cuccgccggaaucaacggca

SEQ ID NO: 3943497 - RNA, 18 nt, Shigella flexneri 2a str. 301
cuccgccugugcgcguca

SEQ ID NO: 3943498 - RNA, 19 nt, Shigella flexneri 2a str. 301
cuccgcgccgcgguacagc

SEQ ID NO: 3943499 - RNA, 21 nt, Shigella flexneri 2a str. 301
cuccgcguucaauacgcaguu

SEQ ID NO: 3943500 - RNA, 19 nt, Shigella flexneri 2a str. 301
cuccgcucucaaucucuuu

SEQ ID NO: 3943501 - RNA, 15 nt, Shigella flexneri 2a str. 301
cuccgcugagacgcg

SEQ ID NO: 3943502 - RNA, 18 nt, Shigella flexneri 2a str. 301
cuccgcuggagcggggaa

SEQ ID NO: 3943503 - RNA, 21 nt, Shigella flexneri 2a str. 301
cuccgcuucgguaagcaaagc

SEQ ID NO: 3943504 - RNA, 18 nt, Shigella flexneri 2a str. 301
cuccggcagccaggcaau

SEQ ID NO: 3943505 - RNA, 15 nt, Shigella flexneri 2a str. 301
cuccggcagcugcuc

SEQ ID NO: 3943506 - RNA, 13 nt, Shigella flexneri 2a str. 301
cuccggccagagc

SEQ ID NO: 3943507 - RNA, 24 nt, Shigella flexneri 2a str. 301
cuccggcgcguugaugccgugcag

SEQ ID NO: 3943508 - RNA, 21 nt, Shigella flexneri 2a str. 301
cuccggcguuuuggccgugaa

SEQ ID NO: 3943509 - RNA, 22 nt, Shigella flexneri 2a str. 301
cuccgggaaaacgcuggcagca

SEQ ID NO: 3943510 - RNA, 16 nt, Shigella flexneri 2a str. 301
cuccgggcgcaccagu

SEQ ID NO: 3943511 - RNA, 18 nt, Shigella flexneri 2a str. 301
cuccgucaacguuaacuu

SEQ ID NO: 3943512 - RNA, 14 nt, Shigella flexneri 2a str. 301
cuccgucagcacgc

SEQ ID NO: 3943513 - RNA, 20 nt, Shigella flexneri 2a str. 301
cuccgucaucuuuaacgugg

SEQ ID NO: 3943514 - RNA, 16 nt, Shigella flexneri 2a str. 301
cuccguuaucacagca

SEQ ID NO: 3943515 - RNA, 20 nt, Shigella flexneri 2a str. 301
cuccuauuguugauaaggaa

SEQ ID NO: 3943516 - RNA, 16 nt, Shigella flexneri 2a str. 301
cuccucaacaaucguc

SEQ ID NO: 3943517 - RNA, 21 nt, Shigella flexneri 2a str. 301
cuccucaguuucgacgccuuc

SEQ ID NO: 3943518 - RNA, 18 nt, Shigella flexneri 2a str. 301
cuccucgcgaaucuccac

SEQ ID NO: 3943519 - RNA, 18 nt, Shigella flexneri 2a str. 301
cuccucugacuggacucg

SEQ ID NO: 3943520 - RNA, 14 nt, Shigella flexneri 2a str. 301
cuccucuucacguu

SEQ ID NO: 3943521 - RNA, 14 nt, Shigella flexneri 2a str. 301
cuccugaaacaauu

SEQ ID NO: 3943522 - RNA, 22 nt, Shigella flexneri 2a str. 301
cuccugacgaucauauuguucc

SEQ ID NO: 3943523 - RNA, 21 nt, Shigella flexneri 2a str. 301
cuccugacgcgguguuuuaac

SEQ ID NO: 3943524 - RNA, 19 nt, Shigella flexneri 2a str. 301
cuccugcaacagguugcgc

SEQ ID NO: 3943525 - RNA, 20 nt, Shigella flexneri 2a str. 301
cuccugccaauacaaaauuu

SEQ ID NO: 3943526 - RNA, 21 nt, Shigella flexneri 2a str. 301
cuccugccaccacugcaauga

SEQ ID NO: 3943527 - RNA, 20 nt, Shigella flexneri 2a str. 301
cuccugcgccucuccacacg

SEQ ID NO: 3943528 - RNA, 14 nt, Shigella flexneri 2a str. 301
cuccugcggcugca

SEQ ID NO: 3943529 - RNA, 15 nt, Shigella flexneri 2a str. 301
cuccuggaucacaau

SEQ ID NO: 3943530 - RNA, 18 nt, Shigella flexneri 2a str. 301
cuccuggcgguuaauaau

SEQ ID NO: 3943531 - RNA, 23 nt, Shigella flexneri 2a str. 301
cuccuggcgguuaauaaugauuu

SEQ ID NO: 3943532 - RNA, 22 nt, Shigella flexneri 2a str. 301
cuccuguaucgucacugguuca

SEQ ID NO: 3943533 - RNA, 13 nt, Shigella flexneri 2a str. 301
cuccugucuuccc

SEQ ID NO: 3943534 - RNA, 14 nt, Shigella flexneri 2a str. 301
cuccugucuucccu

SEQ ID NO: 3943535 - RNA, 16 nt, Shigella flexneri 2a str. 301
cuccugucuucccugc

SEQ ID NO: 3943536 - RNA, 18 nt, Shigella flexneri 2a str. 301
cuccugucuucccugcug

SEQ ID NO: 3943537 - RNA, 14 nt, Shigella flexneri 2a str. 301
cuccuguucugcgc

SEQ ID NO: 3943538 - RNA, 18 nt, Shigella flexneri 2a str. 301
cuccuguucugcgcgcca

SEQ ID NO: 3943539 - RNA, 14 nt, Shigella flexneri 2a str. 301
cuccuguucugugc

SEQ ID NO: 3943540 - RNA, 14 nt, Shigella flexneri 2a str. 301
cuccuuccugaaau

SEQ ID NO: 3943541 - RNA, 19 nt, Shigella flexneri 2a str. 301
cuccuuucugagcaucaca

SEQ ID NO: 3943542 - RNA, 15 nt, Shigella flexneri 2a str. 301
cucgaacauccccac

SEQ ID NO: 3943543 - RNA, 16 nt, Shigella flexneri 2a str. 301
cucgaacgccucugca

SEQ ID NO: 3943544 - RNA, 23 nt, Shigella flexneri 2a str. 301
cucgacuguggcgcgaccaaugu

SEQ ID NO: 3943545 - RNA, 15 nt, Shigella flexneri 2a str. 301
cucgagaaauuuuua

SEQ ID NO: 3943546 - RNA, 13 nt, Shigella flexneri 2a str. 301
cucgaguccuucc

SEQ ID NO: 3943547 - RNA, 14 nt, Shigella flexneri 2a str. 301
cucgaguccuucca

SEQ ID NO: 3943548 - RNA, 17 nt, Shigella flexneri 2a str. 301
cucgaguccuuccaggu

SEQ ID NO: 3943549 - RNA, 18 nt, Shigella flexneri 2a str. 301
cucgaguccuuccagguc

SEQ ID NO: 3943550 - RNA, 22 nt, Shigella flexneri 2a str. 301
cucgauaacacgguaaugacuc

SEQ ID NO: 3943551 - RNA, 22 nt, Shigella flexneri 2a str. 301
cucgauaccagauuaauuauug

SEQ ID NO: 3943552 - RNA, 24 nt, Shigella flexneri 2a str. 301
cucgauacgacacgccuccuggcu

SEQ ID NO: 3943553 - RNA, 16 nt, Shigella flexneri 2a str. 301
cucgcaagccacgccg

SEQ ID NO: 3943554 - RNA, 16 nt, Shigella flexneri 2a str. 301
cucgcagucaacaagc

SEQ ID NO: 3943555 - RNA, 20 nt, Shigella flexneri 2a str. 301
cucgcagucaacaagcaaau

SEQ ID NO: 3943556 - RNA, 16 nt, Shigella flexneri 2a str. 301
cucgcaucagggcgcu

SEQ ID NO: 3943557 - RNA, 18 nt, Shigella flexneri 2a str. 301
cucgccacgucacucuuu

SEQ ID NO: 3943558 - RNA, 19 nt, Shigella flexneri 2a str. 301
cucgccacuaaagccugcu

SEQ ID NO: 3943559 - RNA, 21 nt, Shigella flexneri 2a str. 301
cucgccagaccgcagaagccg

SEQ ID NO: 3943560 - RNA, 11 nt, Shigella flexneri 2a str. 301
cucgccagcac

SEQ ID NO: 3943561 - RNA, 15 nt, Shigella flexneri 2a str. 301
cucgccagccaccau

SEQ ID NO: 3943562 - RNA, 19 nt, Shigella flexneri 2a str. 301
cucgccagcgauucccguu

SEQ ID NO: 3943563 - RNA, 17 nt, Shigella flexneri 2a str. 301
cucgcccagaucaccaa

SEQ ID NO: 3943564 - RNA, 21 nt, Shigella flexneri 2a str. 301
cucgcccauuuuucaugaucu

SEQ ID NO: 3943565 - RNA, 23 nt, Shigella flexneri 2a str. 301
cucgcccauuuuucaugaucuuu

SEQ ID NO: 3943566 - RNA, 13 nt, Shigella flexneri 2a str. 301
cucgcccccuugg

SEQ ID NO: 3943567 - RNA, 21 nt, Shigella flexneri 2a str. 301
cucgccccgagaaaaauagca

SEQ ID NO: 3943568 - RNA, 14 nt, Shigella flexneri 2a str. 301
cucgccccuccggg

SEQ ID NO: 3943569 - RNA, 15 nt, Shigella flexneri 2a str. 301
cucgccgcagagauc

SEQ ID NO: 3943570 - RNA, 15 nt, Shigella flexneri 2a str. 301
cucgcgaaccgccug

SEQ ID NO: 3943571 - RNA, 22 nt, Shigella flexneri 2a str. 301
cucgcgaaccgccuggcgcugc

SEQ ID NO: 3943572 - RNA, 20 nt, Shigella flexneri 2a str. 301
cucgcgaaucuccacgccuu

SEQ ID NO: 3943573 - RNA, 15 nt, Shigella flexneri 2a str. 301
cucgcgagaacggcg

SEQ ID NO: 3943574 - RNA, 14 nt, Shigella flexneri 2a str. 301
cucgcgccgcaucc

SEQ ID NO: 3943575 - RNA, 13 nt, Shigella flexneri 2a str. 301
cucgcgcucuucu

SEQ ID NO: 3943576 - RNA, 15 nt, Shigella flexneri 2a str. 301
cucgcgcucuucuuc

SEQ ID NO: 3943577 - RNA, 17 nt, Shigella flexneri 2a str. 301
cucgcggacugccuggc

SEQ ID NO: 3943578 - RNA, 11 nt, Shigella flexneri 2a str. 301
cucgcggcgga

SEQ ID NO: 3943579 - RNA, 21 nt, Shigella flexneri 2a str. 301
cucgcguucgauggcgcgcca

SEQ ID NO: 3943580 - RNA, 18 nt, Shigella flexneri 2a str. 301
cucgcguucuguugccgc

SEQ ID NO: 3943581 - RNA, 14 nt, Shigella flexneri 2a str. 301
cucgcuccagugcc

SEQ ID NO: 3943582 - RNA, 19 nt, Shigella flexneri 2a str. 301
cucgcuccauuccaucgcc

SEQ ID NO: 3943583 - RNA, 19 nt, Shigella flexneri 2a str. 301
cucgcucgagagagaaaau

SEQ ID NO: 3943584 - RNA, 13 nt, Shigella flexneri 2a str. 301
cucgcugccagca

SEQ ID NO: 3943585 - RNA, 17 nt, Shigella flexneri 2a str. 301
cucgcuguggcagcguu

SEQ ID NO: 3943586 - RNA, 14 nt, Shigella flexneri 2a str. 301
cucggauaaggcuu

SEQ ID NO: 3943587 - RNA, 20 nt, Shigella flexneri 2a str. 301
cucggcgagcaacgcagcgg

SEQ ID NO: 3943588 - RNA, 14 nt, Shigella flexneri 2a str. 301
cucggcgcggaugc

SEQ ID NO: 3943589 - RNA, 19 nt, Shigella flexneri 2a str. 301
cucggcggcuggcuggaug

SEQ ID NO: 3943590 - RNA, 14 nt, Shigella flexneri 2a str. 301
cucggcuauuuccg

SEQ ID NO: 3943591 - RNA, 23 nt, Shigella flexneri 2a str. 301
cucggcugacgauaccaggugug

SEQ ID NO: 3943592 - RNA, 17 nt, Shigella flexneri 2a str. 301
cucgggaaggcccuucc

SEQ ID NO: 3943593 - RNA, 21 nt, Shigella flexneri 2a str. 301
cucgggaaggcccuuccccuu

SEQ ID NO: 3943594 - RNA, 20 nt, Shigella flexneri 2a str. 301
cucgguaaaacuaacgccag

SEQ ID NO: 3943595 - RNA, 20 nt, Shigella flexneri 2a str. 301
cucgguaaaaucaacgccgc

SEQ ID NO: 3943596 - RNA, 19 nt, Shigella flexneri 2a str. 301
cucggucacugacaccagc

SEQ ID NO: 3943597 - RNA, 19 nt, Shigella flexneri 2a str. 301
cucggucuggacagacugg

SEQ ID NO: 3943598 - RNA, 17 nt, Shigella flexneri 2a str. 301
cucgguuugcggcagga

SEQ ID NO: 3943599 - RNA, 22 nt, Shigella flexneri 2a str. 301
cucgguuuugcgguauuuguau

SEQ ID NO: 3943600 - RNA, 17 nt, Shigella flexneri 2a str. 301
cucguaaugcuccggcu

SEQ ID NO: 3943601 - RNA, 23 nt, Shigella flexneri 2a str. 301
cucguacuccaucucgccauccu

SEQ ID NO: 3943602 - RNA, 19 nt, Shigella flexneri 2a str. 301
cucguagcugguaccuuga

SEQ ID NO: 3943603 - RNA, 21 nt, Shigella flexneri 2a str. 301
cucguagguuucugccagcgu

SEQ ID NO: 3943604 - RNA, 23 nt, Shigella flexneri 2a str. 301
cucguauuccgcguuacccauuc

SEQ ID NO: 3943605 - RNA, 21 nt, Shigella flexneri 2a str. 301
cucgucgcgacgaccacccac

SEQ ID NO: 3943606 - RNA, 12 nt, Shigella flexneri 2a str. 301
cucgucgcgcac

SEQ ID NO: 3943607 - RNA, 23 nt, Shigella flexneri 2a str. 301
cucgucggcgguuuucaucaucc

SEQ ID NO: 3943608 - RNA, 21 nt, Shigella flexneri 2a str. 301
cucgucgguaauuucacaagu

SEQ ID NO: 3943609 - RNA, 22 nt, Shigella flexneri 2a str. 301
cucgucgguaauuucacaaguu

SEQ ID NO: 3943610 - RNA, 18 nt, Shigella flexneri 2a str. 301
cucguuagacggcgcugc

SEQ ID NO: 3943611 - RNA, 14 nt, Shigella flexneri 2a str. 301
cucguucacauauu

SEQ ID NO: 3943612 - RNA, 23 nt, Shigella flexneri 2a str. 301
cucguucacauauugcagcuucu

SEQ ID NO: 3943613 - RNA, 19 nt, Shigella flexneri 2a str. 301
cucguugacgaccaggccg

SEQ ID NO: 3943614 - RNA, 23 nt, Shigella flexneri 2a str. 301
cucguugaucacccacaucagcg

SEQ ID NO: 3943615 - RNA, 22 nt, Shigella flexneri 2a str. 301
cucguugccugcgaagcucuuu

SEQ ID NO: 3943616 - RNA, 16 nt, Shigella flexneri 2a str. 301
cucguuggucaucacu

SEQ ID NO: 3943617 - RNA, 13 nt, Shigella flexneri 2a str. 301
cucuaaaaucauc

SEQ ID NO: 3943618 - RNA, 14 nt, Shigella flexneri 2a str. 301
cucuaaaaucauca

SEQ ID NO: 3943619 - RNA, 16 nt, Shigella flexneri 2a str. 301
cucuacaauauccuca

SEQ ID NO: 3943620 - RNA, 21 nt, Shigella flexneri 2a str. 301
cucuacaauauccucaagcgu

SEQ ID NO: 3943621 - RNA, 13 nt, Shigella flexneri 2a str. 301
cucuacaccaacg

SEQ ID NO: 3943622 - RNA, 16 nt, Shigella flexneri 2a str. 301
cucuacagcgcccgcc

SEQ ID NO: 3943623 - RNA, 14 nt, Shigella flexneri 2a str. 301
cucuauacaggaua

SEQ ID NO: 3943624 - RNA, 22 nt, Shigella flexneri 2a str. 301
cucuaucuguuugccagucugg

SEQ ID NO: 3943625 - RNA, 17 nt, Shigella flexneri 2a str. 301
cucuauggcaccuguug

SEQ ID NO: 3943626 - RNA, 18 nt, Shigella flexneri 2a str. 301
cucuauuccaccaucauu

SEQ ID NO: 3943627 - RNA, 17 nt, Shigella flexneri 2a str. 301
cucuauucuuaaaauag

SEQ ID NO: 3943628 - RNA, 13 nt, Shigella flexneri 2a str. 301
cucucaaaccccg

SEQ ID NO: 3943629 - RNA, 18 nt, Shigella flexneri 2a str. 301
cucucaaccgagagggcu

SEQ ID NO: 3943630 - RNA, 19 nt, Shigella flexneri 2a str. 301
cucucaccacgcuccauca

SEQ ID NO: 3943631 - RNA, 23 nt, Shigella flexneri 2a str. 301
cucucagcacaccauaaaacaaa

SEQ ID NO: 3943632 - RNA, 15 nt, Shigella flexneri 2a str. 301
cucucagucuuuccc

SEQ ID NO: 3943633 - RNA, 15 nt, Shigella flexneri 2a str. 301
cucucaucacuacag

SEQ ID NO: 3943634 - RNA, 21 nt, Shigella flexneri 2a str. 301
cucucccgaaugaccgccccu

SEQ ID NO: 3943635 - RNA, 14 nt, Shigella flexneri 2a str. 301
cucuccguaggcca

SEQ ID NO: 3943636 - RNA, 14 nt, Shigella flexneri 2a str. 301
cucuccugccaguu

SEQ ID NO: 3943637 - RNA, 23 nt, Shigella flexneri 2a str. 301
cucuccuguuuaauaugcaauuc

SEQ ID NO: 3943638 - RNA, 12 nt, Shigella flexneri 2a str. 301
cucuccuuuacc

SEQ ID NO: 3943639 - RNA, 11 nt, Shigella flexneri 2a str. 301
cucuccuuucg

SEQ ID NO: 3943640 - RNA, 14 nt, Shigella flexneri 2a str. 301
cucucgacccgaca

SEQ ID NO: 3943641 - RNA, 17 nt, Shigella flexneri 2a str. 301
cucucgaucgauaggaa

SEQ ID NO: 3943642 - RNA, 14 nt, Shigella flexneri 2a str. 301
cucucgccagcacu

SEQ ID NO: 3943643 - RNA, 22 nt, Shigella flexneri 2a str. 301
cucucgccccuucuucuacugc

SEQ ID NO: 3943644 - RNA, 14 nt, Shigella flexneri 2a str. 301
cucucgggcaguaa

SEQ ID NO: 3943645 - RNA, 17 nt, Shigella flexneri 2a str. 301
cucucgggcaguaaauc

SEQ ID NO: 3943646 - RNA, 21 nt, Shigella flexneri 2a str. 301
cucucgggcaguaaaucaaua

SEQ ID NO: 3943647 - RNA, 19 nt, Shigella flexneri 2a str. 301
cucucuccguuaucacagc

SEQ ID NO: 3943648 - RNA, 13 nt, Shigella flexneri 2a str. 301
cucucugcuauuc

SEQ ID NO: 3943649 - RNA, 13 nt, Shigella flexneri 2a str. 301
cucucuuccaguu

SEQ ID NO: 3943650 - RNA, 12 nt, Shigella flexneri 2a str. 301
cucucuucgcug

SEQ ID NO: 3943651 - RNA, 11 nt, Shigella flexneri 2a str. 301
cucucuuucuc

SEQ ID NO: 3943652 - RNA, 18 nt, Shigella flexneri 2a str. 301
cucucuuucuccagcgua

SEQ ID NO: 3943653 - RNA, 16 nt, Shigella flexneri 2a str. 301
cucugaccugccgcag

SEQ ID NO: 3943654 - RNA, 20 nt, Shigella flexneri 2a str. 301
cucugacgcgcauacucucc

SEQ ID NO: 3943655 - RNA, 21 nt, Shigella flexneri 2a str. 301
cucugacgcgcauacucuccu

SEQ ID NO: 3943656 - RNA, 17 nt, Shigella flexneri 2a str. 301
cucugagaauaaauaca

SEQ ID NO: 3943657 - RNA, 15 nt, Shigella flexneri 2a str. 301
cucugaugacugaug

SEQ ID NO: 3943658 - RNA, 15 nt, Shigella flexneri 2a str. 301
cucugauuacccuuc

SEQ ID NO: 3943659 - RNA, 15 nt, Shigella flexneri 2a str. 301
cucugcaaauauuaa

SEQ ID NO: 3943660 - RNA, 16 nt, Shigella flexneri 2a str. 301
cucugcaaucaccacu

SEQ ID NO: 3943661 - RNA, 20 nt, Shigella flexneri 2a str. 301
cucugcaaucaccacugcca

SEQ ID NO: 3943662 - RNA, 12 nt, Shigella flexneri 2a str. 301
cucugccagcaa

SEQ ID NO: 3943663 - RNA, 15 nt, Shigella flexneri 2a str. 301
cucugccgcaauggc

SEQ ID NO: 3943664 - RNA, 23 nt, Shigella flexneri 2a str. 301
cucugccguaccaucgccagccc

SEQ ID NO: 3943665 - RNA, 14 nt, Shigella flexneri 2a str. 301
cucugcgcuuugug

SEQ ID NO: 3943666 - RNA, 19 nt, Shigella flexneri 2a str. 301
cucugcggcggacaaaguu

SEQ ID NO: 3943667 - RNA, 17 nt, Shigella flexneri 2a str. 301
cucugcuaauuuaucga

SEQ ID NO: 3943668 - RNA, 19 nt, Shigella flexneri 2a str. 301
cucugcucccggcaaugcg

SEQ ID NO: 3943669 - RNA, 12 nt, Shigella flexneri 2a str. 301
cucugcugccac

SEQ ID NO: 3943670 - RNA, 23 nt, Shigella flexneri 2a str. 301
cucugcuguaguuguucaacagu

SEQ ID NO: 3943671 - RNA, 17 nt, Shigella flexneri 2a str. 301
cucuggauuuauauaaa

SEQ ID NO: 3943672 - RNA, 21 nt, Shigella flexneri 2a str. 301
cucuggauuuauauaaauaua

SEQ ID NO: 3943673 - RNA, 14 nt, Shigella flexneri 2a str. 301
cucuggcacaugca

SEQ ID NO: 3943674 - RNA, 13 nt, Shigella flexneri 2a str. 301
cucuggcaggcuu

SEQ ID NO: 3943675 - RNA, 23 nt, Shigella flexneri 2a str. 301
cucuggcggagcucccaggcucc

SEQ ID NO: 3943676 - RNA, 20 nt, Shigella flexneri 2a str. 301
cucugggagauuaccucgac

SEQ ID NO: 3943677 - RNA, 21 nt, Shigella flexneri 2a str. 301
cucuggucugccauaauauug

SEQ ID NO: 3943678 - RNA, 15 nt, Shigella flexneri 2a str. 301
cucugguguucuuuu

SEQ ID NO: 3943679 - RNA, 17 nt, Shigella flexneri 2a str. 301
cucugguuuuacaacgu

SEQ ID NO: 3943680 - RNA, 17 nt, Shigella flexneri 2a str. 301
cucuguaaacuccuuuc

SEQ ID NO: 3943681 - RNA, 19 nt, Shigella flexneri 2a str. 301
cucuguaauugaaggcuua

SEQ ID NO: 3943682 - RNA, 13 nt, Shigella flexneri 2a str. 301
cucuguaauugga

SEQ ID NO: 3943683 - RNA, 14 nt, Shigella flexneri 2a str. 301
cucuguuuccagau

SEQ ID NO: 3943684 - RNA, 21 nt, Shigella flexneri 2a str. 301
cucuuaaaugcacaauaauau

SEQ ID NO: 3943685 - RNA, 18 nt, Shigella flexneri 2a str. 301
cucuuaaugcaggcagca

SEQ ID NO: 3943686 - RNA, 14 nt, Shigella flexneri 2a str. 301
cucuuacgccgcca

SEQ ID NO: 3943687 - RNA, 22 nt, Shigella flexneri 2a str. 301
cucuucaacacacugaauaaaa

SEQ ID NO: 3943688 - RNA, 16 nt, Shigella flexneri 2a str. 301
cucuucaacuucagca

SEQ ID NO: 3943689 - RNA, 18 nt, Shigella flexneri 2a str. 301
cucuucaacuucagcagc

SEQ ID NO: 3943690 - RNA, 15 nt, Shigella flexneri 2a str. 301
cucuucaauggucag

SEQ ID NO: 3943691 - RNA, 18 nt, Shigella flexneri 2a str. 301
cucuucaauggucagcca

SEQ ID NO: 3943692 - RNA, 17 nt, Shigella flexneri 2a str. 301
cucuucaauuaacaaca

SEQ ID NO: 3943693 - RNA, 11 nt, Shigella flexneri 2a str. 301
cucuucacacc

SEQ ID NO: 3943694 - RNA, 17 nt, Shigella flexneri 2a str. 301
cucuucaccgguacgga

SEQ ID NO: 3943695 - RNA, 18 nt, Shigella flexneri 2a str. 301
cucuucacgcccgcccca

SEQ ID NO: 3943696 - RNA, 18 nt, Shigella flexneri 2a str. 301
cucuucagcaaucucuuc

SEQ ID NO: 3943697 - RNA, 16 nt, Shigella flexneri 2a str. 301
cucuucauacgcggca

SEQ ID NO: 3943698 - RNA, 18 nt, Shigella flexneri 2a str. 301
cucuucaucgcuaaaaua

SEQ ID NO: 3943699 - RNA, 15 nt, Shigella flexneri 2a str. 301
cucuucaugccucgu

SEQ ID NO: 3943700 - RNA, 20 nt, Shigella flexneri 2a str. 301
cucuucauuaaaccagugcc

SEQ ID NO: 3943701 - RNA, 14 nt, Shigella flexneri 2a str. 301
cucuucauuaccuu

SEQ ID NO: 3943702 - RNA, 19 nt, Shigella flexneri 2a str. 301
cucuucauuaccuucaaca

SEQ ID NO: 3943703 - RNA, 21 nt, Shigella flexneri 2a str. 301
cucuuccacauuuuccaucac

SEQ ID NO: 3943704 - RNA, 22 nt, Shigella flexneri 2a str. 301
cucuuccaggcauuaaauccug

SEQ ID NO: 3943705 - RNA, 21 nt, Shigella flexneri 2a str. 301
cucuuccauuucaucgccagc

SEQ ID NO: 3943706 - RNA, 16 nt, Shigella flexneri 2a str. 301
cucuuccggcaccaca

SEQ ID NO: 3943707 - RNA, 14 nt, Shigella flexneri 2a str. 301
cucuuccggcgucg

SEQ ID NO: 3943708 - RNA, 17 nt, Shigella flexneri 2a str. 301
cucuucgguuggcauca

SEQ ID NO: 3943709 - RNA, 12 nt, Shigella flexneri 2a str. 301
cucuucuccuug

SEQ ID NO: 3943710 - RNA, 14 nt, Shigella flexneri 2a str. 301
cucuucugccuguc

SEQ ID NO: 3943711 - RNA, 16 nt, Shigella flexneri 2a str. 301
cucuucugccugucca

SEQ ID NO: 3943712 - RNA, 22 nt, Shigella flexneri 2a str. 301
cucuucugcuuugcccacgcuu

SEQ ID NO: 3943713 - RNA, 14 nt, Shigella flexneri 2a str. 301
cucuucuuccggca

SEQ ID NO: 3943714 - RNA, 21 nt, Shigella flexneri 2a str. 301
cucuucuucgcgauaaaucag

SEQ ID NO: 3943715 - RNA, 22 nt, Shigella flexneri 2a str. 301
cucuugcuccacaagcuccggc

SEQ ID NO: 3943716 - RNA, 22 nt, Shigella flexneri 2a str. 301
cucuugcuggcauuacaagaau

SEQ ID NO: 3943717 - RNA, 21 nt, Shigella flexneri 2a str. 301
cucuuguaaauuucccacucu

SEQ ID NO: 3943718 - RNA, 15 nt, Shigella flexneri 2a str. 301
cucuuuaaaaaguaa

SEQ ID NO: 3943719 - RNA, 18 nt, Shigella flexneri 2a str. 301
cucuuuaaaaaguaaaac

SEQ ID NO: 3943720 - RNA, 13 nt, Shigella flexneri 2a str. 301
cucuuuaaacaga

SEQ ID NO: 3943721 - RNA, 18 nt, Shigella flexneri 2a str. 301
cucuuuagcauucagagu

SEQ ID NO: 3943722 - RNA, 23 nt, Shigella flexneri 2a str. 301
cucuuucccggcaaucaccgcca

SEQ ID NO: 3943723 - RNA, 18 nt, Shigella flexneri 2a str. 301
cucuuucuaugagaaaau

SEQ ID NO: 3943724 - RNA, 16 nt, Shigella flexneri 2a str. 301
cucuuucuucagcacg

SEQ ID NO: 3943725 - RNA, 21 nt, Shigella flexneri 2a str. 301
cucuuugaacagccagaagcc

SEQ ID NO: 3943726 - RNA, 16 nt, Shigella flexneri 2a str. 301
cucuuugaugaaacau

SEQ ID NO: 3943727 - RNA, 20 nt, Shigella flexneri 2a str. 301
cucuuuugacgcccccaaac

SEQ ID NO: 3943728 - RNA, 16 nt, Shigella flexneri 2a str. 301
cucuuuuuuguucagu

SEQ ID NO: 3943729 - RNA, 19 nt, Shigella flexneri 2a str. 301
cugaaaaaaaauuacaaaa

SEQ ID NO: 3943730 - RNA, 21 nt, Shigella flexneri 2a str. 301
cugaaaaaaaauuacaaaaag

SEQ ID NO: 3943731 - RNA, 16 nt, Shigella flexneri 2a str. 301
cugaaaaaacaaauau

SEQ ID NO: 3943732 - RNA, 21 nt, Shigella flexneri 2a str. 301
cugaaaagcgggcugagacug

SEQ ID NO: 3943733 - RNA, 22 nt, Shigella flexneri 2a str. 301
cugaaaaugaaagcccuugccg

SEQ ID NO: 3943734 - RNA, 14 nt, Shigella flexneri 2a str. 301
cugaaaauggcgcu

SEQ ID NO: 3943735 - RNA, 20 nt, Shigella flexneri 2a str. 301
cugaaacaauuuaccgaccu

SEQ ID NO: 3943736 - RNA, 22 nt, Shigella flexneri 2a str. 301
cugaaaccgugcaucuguuggu

SEQ ID NO: 3943737 - RNA, 24 nt, Shigella flexneri 2a str. 301
cugaaacgucacccaggagaugcc

SEQ ID NO: 3943738 - RNA, 19 nt, Shigella flexneri 2a str. 301
cugaaacucgaccagcagc

SEQ ID NO: 3943739 - RNA, 20 nt, Shigella flexneri 2a str. 301
cugaaacucgcguaaaucca

SEQ ID NO: 3943740 - RNA, 20 nt, Shigella flexneri 2a str. 301
cugaaagaagcggugaaaaa

SEQ ID NO: 3943741 - RNA, 19 nt, Shigella flexneri 2a str. 301
cugaaagcgccgggaaugc

SEQ ID NO: 3943742 - RNA, 12 nt, Shigella flexneri 2a str. 301
cugaaagcugaa

SEQ ID NO: 3943743 - RNA, 17 nt, Shigella flexneri 2a str. 301
cugaaagggcaaauaau

SEQ ID NO: 3943744 - RNA, 20 nt, Shigella flexneri 2a str. 301
cugaaaguacuucacaauca

SEQ ID NO: 3943745 - RNA, 22 nt, Shigella flexneri 2a str. 301
cugaaaguacuucacaaucagc

SEQ ID NO: 3943746 - RNA, 18 nt, Shigella flexneri 2a str. 301
cugaaauacagacuccac

SEQ ID NO: 3943747 - RNA, 21 nt, Shigella flexneri 2a str. 301
cugaaauagaauggcaucaga

SEQ ID NO: 3943748 - RNA, 11 nt, Shigella flexneri 2a str. 301
cugaaaucauc

SEQ ID NO: 3943749 - RNA, 19 nt, Shigella flexneri 2a str. 301
cugaaauguuugcaauaaa

SEQ ID NO: 3943750 - RNA, 22 nt, Shigella flexneri 2a str. 301
cugaaauuacaggcaguaacca

SEQ ID NO: 3943751 - RNA, 21 nt, Shigella flexneri 2a str. 301
cugaaauuccugagaggauga

SEQ ID NO: 3943752 - RNA, 13 nt, Shigella flexneri 2a str. 301
cugaaauuuaucg

SEQ ID NO: 3943753 - RNA, 12 nt, Shigella flexneri 2a str. 301
cugaacaaaaaa

SEQ ID NO: 3943754 - RNA, 22 nt, Shigella flexneri 2a str. 301
cugaacaacaguuuuaucucca

SEQ ID NO: 3943755 - RNA, 14 nt, Shigella flexneri 2a str. 301
cugaacaagcaaga

SEQ ID NO: 3943756 - RNA, 17 nt, Shigella flexneri 2a str. 301
cugaacaagcaagagug

SEQ ID NO: 3943757 - RNA, 11 nt, Shigella flexneri 2a str. 301
cugaacagcuu

SEQ ID NO: 3943758 - RNA, 17 nt, Shigella flexneri 2a str. 301
cugaacagcuuuuuccu

SEQ ID NO: 3943759 - RNA, 23 nt, Shigella flexneri 2a str. 301
cugaacauuguuauucuccuuca

SEQ ID NO: 3943760 - RNA, 19 nt, Shigella flexneri 2a str. 301
cugaaccagacugcacaug

SEQ ID NO: 3943761 - RNA, 19 nt, Shigella flexneri 2a str. 301
cugaaccaucgacguccaa

SEQ ID NO: 3943762 - RNA, 16 nt, Shigella flexneri 2a str. 301
cugaaccgaaauggcu

SEQ ID NO: 3943763 - RNA, 21 nt, Shigella flexneri 2a str. 301
cugaacgacaaauucaggaaa

SEQ ID NO: 3943764 - RNA, 15 nt, Shigella flexneri 2a str. 301
cugaacgccacgcuc

SEQ ID NO: 3943765 - RNA, 23 nt, Shigella flexneri 2a str. 301
cugaacgccacgcucacucauca

SEQ ID NO: 3943766 - RNA, 22 nt, Shigella flexneri 2a str. 301
cugaacgugcucugcgccgccu

SEQ ID NO: 3943767 - RNA, 19 nt, Shigella flexneri 2a str. 301
cugaacguugcgcuucccg

SEQ ID NO: 3943768 - RNA, 21 nt, Shigella flexneri 2a str. 301
cugaacucgacgcccuggaag

SEQ ID NO: 3943769 - RNA, 16 nt, Shigella flexneri 2a str. 301
cugaacugaacaaaaa

SEQ ID NO: 3943770 - RNA, 16 nt, Shigella flexneri 2a str. 301
cugaacugauugccac

SEQ ID NO: 3943771 - RNA, 19 nt, Shigella flexneri 2a str. 301
cugaacugauugccacccu

SEQ ID NO: 3943772 - RNA, 20 nt, Shigella flexneri 2a str. 301
cugaagaaguaaaacagucg

SEQ ID NO: 3943773 - RNA, 15 nt, Shigella flexneri 2a str. 301
cugaagaucaacguc

SEQ ID NO: 3943774 - RNA, 17 nt, Shigella flexneri 2a str. 301
cugaagauugaacagca

SEQ ID NO: 3943775 - RNA, 21 nt, Shigella flexneri 2a str. 301
cugaagauugaacagcagaac

SEQ ID NO: 3943776 - RNA, 14 nt, Shigella flexneri 2a str. 301
cugaagcaguuuca

SEQ ID NO: 3943777 - RNA, 21 nt, Shigella flexneri 2a str. 301
cugaagcaguuucaccagcag

SEQ ID NO: 3943778 - RNA, 19 nt, Shigella flexneri 2a str. 301
cugaagcaguuuugccuuc

SEQ ID NO: 3943779 - RNA, 22 nt, Shigella flexneri 2a str. 301
cugaagcauugccgaacgggua

SEQ ID NO: 3943780 - RNA, 14 nt, Shigella flexneri 2a str. 301
cugaaggacgccag

SEQ ID NO: 3943781 - RNA, 14 nt, Shigella flexneri 2a str. 301
cugaaggcgcauug

SEQ ID NO: 3943782 - RNA, 15 nt, Shigella flexneri 2a str. 301
cugaaggcugccggg

SEQ ID NO: 3943783 - RNA, 18 nt, Shigella flexneri 2a str. 301
cugaaggucuucgguaag

SEQ ID NO: 3943784 - RNA, 23 nt, Shigella flexneri 2a str. 301
cugaaguaagaaauaacgccgga

SEQ ID NO: 3943785 - RNA, 19 nt, Shigella flexneri 2a str. 301
cugaauaaacucaccaaau

SEQ ID NO: 3943786 - RNA, 19 nt, Shigella flexneri 2a str. 301
cugaauaacaccagccaga

SEQ ID NO: 3943787 - RNA, 20 nt, Shigella flexneri 2a str. 301
cugaauaacaccagccagaa

SEQ ID NO: 3943788 - RNA, 19 nt, Shigella flexneri 2a str. 301
cugaauaacuggcgcgaca

SEQ ID NO: 3943789 - RNA, 14 nt, Shigella flexneri 2a str. 301
cugaauacgcaccg

SEQ ID NO: 3943790 - RNA, 12 nt, Shigella flexneri 2a str. 301
cugaauacgcug

SEQ ID NO: 3943791 - RNA, 17 nt, Shigella flexneri 2a str. 301
cugaauaucacgggcgc

SEQ ID NO: 3943792 - RNA, 15 nt, Shigella flexneri 2a str. 301
cugaauaucuuucuc

SEQ ID NO: 3943793 - RNA, 23 nt, Shigella flexneri 2a str. 301
cugaauaugagucguaaacaacu

SEQ ID NO: 3943794 - RNA, 20 nt, Shigella flexneri 2a str. 301
cugaauauucggcuccagau

SEQ ID NO: 3943795 - RNA, 24 nt, Shigella flexneri 2a str. 301
cugaauauucggcuccagauuacu

SEQ ID NO: 3943796 - RNA, 16 nt, Shigella flexneri 2a str. 301
cugaaucacgccgccc

SEQ ID NO: 3943797 - RNA, 18 nt, Shigella flexneri 2a str. 301
cugaauccaucuguaucc

SEQ ID NO: 3943798 - RNA, 15 nt, Shigella flexneri 2a str. 301
cugaaugccacaucc

SEQ ID NO: 3943799 - RNA, 16 nt, Shigella flexneri 2a str. 301
cugaaugcucugaggc

SEQ ID NO: 3943800 - RNA, 23 nt, Shigella flexneri 2a str. 301
cugaauggcgauuucacaagacu

SEQ ID NO: 3943801 - RNA, 12 nt, Shigella flexneri 2a str. 301
cugaauuuaucg

SEQ ID NO: 3943802 - RNA, 21 nt, Shigella flexneri 2a str. 301
cugaauuucagcgccugauac

SEQ ID NO: 3943803 - RNA, 18 nt, Shigella flexneri 2a str. 301
cugaauuucaucaccagc

SEQ ID NO: 3943804 - RNA, 15 nt, Shigella flexneri 2a str. 301
cugaauuugaccuug

SEQ ID NO: 3943805 - RNA, 14 nt, Shigella flexneri 2a str. 301
cugaauuugcucca

SEQ ID NO: 3943806 - RNA, 16 nt, Shigella flexneri 2a str. 301
cugaauuugcuccaga

SEQ ID NO: 3943807 - RNA, 13 nt, Shigella flexneri 2a str. 301
cugacaaaucaug

SEQ ID NO: 3943808 - RNA, 20 nt, Shigella flexneri 2a str. 301
cugacaacgcugaauggcga

SEQ ID NO: 3943809 - RNA, 23 nt, Shigella flexneri 2a str. 301
cugacaaucgcugcggcaauaau

SEQ ID NO: 3943810 - RNA, 18 nt, Shigella flexneri 2a str. 301
cugacacaggcagcaauc

SEQ ID NO: 3943811 - RNA, 21 nt, Shigella flexneri 2a str. 301
cugacagaaguaaucuacugc

SEQ ID NO: 3943812 - RNA, 21 nt, Shigella flexneri 2a str. 301
cugacagauguaaacuuuuuc

SEQ ID NO: 3943813 - RNA, 19 nt, Shigella flexneri 2a str. 301
cugacagcgcgcgccgcca

SEQ ID NO: 3943814 - RNA, 21 nt, Shigella flexneri 2a str. 301
cugacagggugagcagggcac

SEQ ID NO: 3943815 - RNA, 13 nt, Shigella flexneri 2a str. 301
cugacauaaacac

SEQ ID NO: 3943816 - RNA, 13 nt, Shigella flexneri 2a str. 301
cugacauagucau

SEQ ID NO: 3943817 - RNA, 19 nt, Shigella flexneri 2a str. 301
cugacauauuuuuguugaa

SEQ ID NO: 3943818 - RNA, 17 nt, Shigella flexneri 2a str. 301
cugacauuaucagacac

SEQ ID NO: 3943819 - RNA, 19 nt, Shigella flexneri 2a str. 301
cugacauuuuggacaaugc

SEQ ID NO: 3943820 - RNA, 18 nt, Shigella flexneri 2a str. 301
cugacauuuuuacuccuu

SEQ ID NO: 3943821 - RNA, 15 nt, Shigella flexneri 2a str. 301
cugaccaaagccccg

SEQ ID NO: 3943822 - RNA, 13 nt, Shigella flexneri 2a str. 301
cugaccaccacca

SEQ ID NO: 3943823 - RNA, 13 nt, Shigella flexneri 2a str. 301
cugaccaccaccg

SEQ ID NO: 3943824 - RNA, 14 nt, Shigella flexneri 2a str. 301
cugaccaccagcac

SEQ ID NO: 3943825 - RNA, 15 nt, Shigella flexneri 2a str. 301
cugaccaccagcacg

SEQ ID NO: 3943826 - RNA, 17 nt, Shigella flexneri 2a str. 301
cugaccaccagcacgcu

SEQ ID NO: 3943827 - RNA, 12 nt, Shigella flexneri 2a str. 301
cugaccaccaua

SEQ ID NO: 3943828 - RNA, 13 nt, Shigella flexneri 2a str. 301
cugaccacggcca

SEQ ID NO: 3943829 - RNA, 19 nt, Shigella flexneri 2a str. 301
cugaccacggccacagcca

SEQ ID NO: 3943830 - RNA, 15 nt, Shigella flexneri 2a str. 301
cugaccacuucggua

SEQ ID NO: 3943831 - RNA, 23 nt, Shigella flexneri 2a str. 301
cugaccacuucgguacccagacg

SEQ ID NO: 3943832 - RNA, 16 nt, Shigella flexneri 2a str. 301
cugaccagacuggagc

SEQ ID NO: 3943833 - RNA, 20 nt, Shigella flexneri 2a str. 301
cugaccauaacccgcuucca

SEQ ID NO: 3943834 - RNA, 13 nt, Shigella flexneri 2a str. 301
cugacccagcaag

SEQ ID NO: 3943835 - RNA, 14 nt, Shigella flexneri 2a str. 301
cugacccuugaugu

SEQ ID NO: 3943836 - RNA, 15 nt, Shigella flexneri 2a str. 301
cugaccgcacacccc

SEQ ID NO: 3943837 - RNA, 23 nt, Shigella flexneri 2a str. 301
cugaccgcccgcuaugagcagau

SEQ ID NO: 3943838 - RNA, 17 nt, Shigella flexneri 2a str. 301
cugaccgguugcuggau

SEQ ID NO: 3943839 - RNA, 16 nt, Shigella flexneri 2a str. 301
cugaccguaggccgga

SEQ ID NO: 3943840 - RNA, 20 nt, Shigella flexneri 2a str. 301
cugaccgucaccccauugaa

SEQ ID NO: 3943841 - RNA, 13 nt, Shigella flexneri 2a str. 301
cugaccgucgccu

SEQ ID NO: 3943842 - RNA, 20 nt, Shigella flexneri 2a str. 301
cugaccgugcgggcgaaagc

SEQ ID NO: 3943843 - RNA, 20 nt, Shigella flexneri 2a str. 301
cugaccugaauuaaugccuc

SEQ ID NO: 3943844 - RNA, 17 nt, Shigella flexneri 2a str. 301
cugaccugcccaaucau

SEQ ID NO: 3943845 - RNA, 20 nt, Shigella flexneri 2a str. 301
cugaccugcggcaccagcgg

SEQ ID NO: 3943846 - RNA, 14 nt, Shigella flexneri 2a str. 301
cugaccuucuucag

SEQ ID NO: 3943847 - RNA, 13 nt, Shigella flexneri 2a str. 301
cugaccuuuuuuc

SEQ ID NO: 3943848 - RNA, 15 nt, Shigella flexneri 2a str. 301
cugaccuuuuuucag

SEQ ID NO: 3943849 - RNA, 20 nt, Shigella flexneri 2a str. 301
cugacgaaucaaauaaaaau

SEQ ID NO: 3943850 - RNA, 18 nt, Shigella flexneri 2a str. 301
cugacgaccaaugacagc

SEQ ID NO: 3943851 - RNA, 21 nt, Shigella flexneri 2a str. 301
cugacgaccaaugacagccag

SEQ ID NO: 3943852 - RNA, 16 nt, Shigella flexneri 2a str. 301
cugacgaggcgucagc

SEQ ID NO: 3943853 - RNA, 21 nt, Shigella flexneri 2a str. 301
cugacgaggcgucagcguucc

SEQ ID NO: 3943854 - RNA, 22 nt, Shigella flexneri 2a str. 301
cugacgaggcgucagcguucca

SEQ ID NO: 3943855 - RNA, 21 nt, Shigella flexneri 2a str. 301
cugacgccaccauucaccaag

SEQ ID NO: 3943856 - RNA, 20 nt, Shigella flexneri 2a str. 301
cugacgcgucuuaucuggcc

SEQ ID NO: 3943857 - RNA, 21 nt, Shigella flexneri 2a str. 301
cugacgcucucuacgcccugu

SEQ ID NO: 3943858 - RNA, 23 nt, Shigella flexneri 2a str. 301
cugacgcuggguuucgccugcca

SEQ ID NO: 3943859 - RNA, 19 nt, Shigella flexneri 2a str. 301
cugacgcuuaucuucugua

SEQ ID NO: 3943860 - RNA, 20 nt, Shigella flexneri 2a str. 301
cugacggaaaucaugcaaca

SEQ ID NO: 3943861 - RNA, 16 nt, Shigella flexneri 2a str. 301
cugacggaucuguucc

SEQ ID NO: 3943862 - RNA, 20 nt, Shigella flexneri 2a str. 301
cugacggccguugugacuuu

SEQ ID NO: 3943863 - RNA, 13 nt, Shigella flexneri 2a str. 301
cugacggccuucg

SEQ ID NO: 3943864 - RNA, 19 nt, Shigella flexneri 2a str. 301
cugacggccuucggugcga

SEQ ID NO: 3943865 - RNA, 19 nt, Shigella flexneri 2a str. 301
cugacggcgauaaaucuca

SEQ ID NO: 3943866 - RNA, 16 nt, Shigella flexneri 2a str. 301
cugacggcguucuuua

SEQ ID NO: 3943867 - RNA, 19 nt, Shigella flexneri 2a str. 301
cugacggugauacagcaaa

SEQ ID NO: 3943868 - RNA, 14 nt, Shigella flexneri 2a str. 301
cugacguaacgacc

SEQ ID NO: 3943869 - RNA, 13 nt, Shigella flexneri 2a str. 301
cugacguagcagc

SEQ ID NO: 3943870 - RNA, 14 nt, Shigella flexneri 2a str. 301
cugacgugauuuag

SEQ ID NO: 3943871 - RNA, 23 nt, Shigella flexneri 2a str. 301
cugacgugcgcaaacuucuucag

SEQ ID NO: 3943872 - RNA, 23 nt, Shigella flexneri 2a str. 301
cugacguuaagaaaacggaagcu

SEQ ID NO: 3943873 - RNA, 20 nt, Shigella flexneri 2a str. 301
cugacguugcuguuuuucgu

SEQ ID NO: 3943874 - RNA, 14 nt, Shigella flexneri 2a str. 301
cugacguuguucag

SEQ ID NO: 3943875 - RNA, 20 nt, Shigella flexneri 2a str. 301
cugacuagaugugcaguucc

SEQ ID NO: 3943876 - RNA, 24 nt, Shigella flexneri 2a str. 301
cugacuagaugugcaguuccugca

SEQ ID NO: 3943877 - RNA, 14 nt, Shigella flexneri 2a str. 301
cugacuauauaaau

SEQ ID NO: 3943878 - RNA, 16 nt, Shigella flexneri 2a str. 301
cugacugacgugauga

SEQ ID NO: 3943879 - RNA, 19 nt, Shigella flexneri 2a str. 301
cugacugauaacgcggcag

SEQ ID NO: 3943880 - RNA, 18 nt, Shigella flexneri 2a str. 301
cugacugccggaugcauc

SEQ ID NO: 3943881 - RNA, 14 nt, Shigella flexneri 2a str. 301
cugacugcgccacu

SEQ ID NO: 3943882 - RNA, 15 nt, Shigella flexneri 2a str. 301
cugacugcgggcgaa

SEQ ID NO: 3943883 - RNA, 20 nt, Shigella flexneri 2a str. 301
cugacuggacucgaaccagu

SEQ ID NO: 3943884 - RNA, 16 nt, Shigella flexneri 2a str. 301
cugacugucgcagcca

SEQ ID NO: 3943885 - RNA, 21 nt, Shigella flexneri 2a str. 301
cugacuguguuagccuggaag

SEQ ID NO: 3943886 - RNA, 22 nt, Shigella flexneri 2a str. 301
cugacuguguuagccuggaagu

SEQ ID NO: 3943887 - RNA, 15 nt, Shigella flexneri 2a str. 301
cugacuguuccagca

SEQ ID NO: 3943888 - RNA, 16 nt, Shigella flexneri 2a str. 301
cugacuguuccagcac

SEQ ID NO: 3943889 - RNA, 14 nt, Shigella flexneri 2a str. 301
cugacuuccacuuc

SEQ ID NO: 3943890 - RNA, 16 nt, Shigella flexneri 2a str. 301
cugacuuccacuuccu

SEQ ID NO: 3943891 - RNA, 18 nt, Shigella flexneri 2a str. 301
cugacuucucugggagau

SEQ ID NO: 3943892 - RNA, 15 nt, Shigella flexneri 2a str. 301
cugacuuuauaccuu

SEQ ID NO: 3943893 - RNA, 14 nt, Shigella flexneri 2a str. 301
cugacuuugcccca

SEQ ID NO: 3943894 - RNA, 20 nt, Shigella flexneri 2a str. 301
cugacuuugccccagcggga

SEQ ID NO: 3943895 - RNA, 15 nt, Shigella flexneri 2a str. 301
cugagaaaaagcgaa

SEQ ID NO: 3943896 - RNA, 14 nt, Shigella flexneri 2a str. 301
cugagaaacucagu

SEQ ID NO: 3943897 - RNA, 19 nt, Shigella flexneri 2a str. 301
cugagaaacucaguugauu

SEQ ID NO: 3943898 - RNA, 22 nt, Shigella flexneri 2a str. 301
cugagaacaagauugccugaug

SEQ ID NO: 3943899 - RNA, 15 nt, Shigella flexneri 2a str. 301
cugagaagcuggaag

SEQ ID NO: 3943900 - RNA, 17 nt, Shigella flexneri 2a str. 301
cugagaauuccggcaga

SEQ ID NO: 3943901 - RNA, 14 nt, Shigella flexneri 2a str. 301
cugagacgcgcuug

SEQ ID NO: 3943902 - RNA, 14 nt, Shigella flexneri 2a str. 301
cugagagaaaaaaa

SEQ ID NO: 3943903 - RNA, 15 nt, Shigella flexneri 2a str. 301
cugagagaaaaaaaa

SEQ ID NO: 3943904 - RNA, 20 nt, Shigella flexneri 2a str. 301
cugagauggcuucaucccag

SEQ ID NO: 3943905 - RNA, 14 nt, Shigella flexneri 2a str. 301
cugagcaucacaua

SEQ ID NO: 3943906 - RNA, 22 nt, Shigella flexneri 2a str. 301
cugagcaucacauaaucgaaaa

SEQ ID NO: 3943907 - RNA, 18 nt, Shigella flexneri 2a str. 301
cugagcaugaugccugau

SEQ ID NO: 3943908 - RNA, 18 nt, Shigella flexneri 2a str. 301
cugagccaaacgcccagc

SEQ ID NO: 3943909 - RNA, 14 nt, Shigella flexneri 2a str. 301
cugagccagugccg

SEQ ID NO: 3943910 - RNA, 17 nt, Shigella flexneri 2a str. 301
cugagccaguuuuucuu

SEQ ID NO: 3943911 - RNA, 13 nt, Shigella flexneri 2a str. 301
cugagccugccau

SEQ ID NO: 3943912 - RNA, 23 nt, Shigella flexneri 2a str. 301
cugagcgaagauuucguuuucua

SEQ ID NO: 3943913 - RNA, 20 nt, Shigella flexneri 2a str. 301
cugagcgauaaaaucagaaa

SEQ ID NO: 3943914 - RNA, 17 nt, Shigella flexneri 2a str. 301
cugagcggcgggcuuua

SEQ ID NO: 3943915 - RNA, 19 nt, Shigella flexneri 2a str. 301
cugagcggcgggcuuuaau

SEQ ID NO: 3943916 - RNA, 20 nt, Shigella flexneri 2a str. 301
cugagcgugccccugaauaa

SEQ ID NO: 3943917 - RNA, 22 nt, Shigella flexneri 2a str. 301
cugagcgugccccugaauaauc

SEQ ID NO: 3943918 - RNA, 12 nt, Shigella flexneri 2a str. 301
cugagcuggcag

SEQ ID NO: 3943919 - RNA, 13 nt, Shigella flexneri 2a str. 301
cugagcuucuuca

SEQ ID NO: 3943920 - RNA, 22 nt, Shigella flexneri 2a str. 301
cugagcuucuucaaaaaaguca

SEQ ID NO: 3943921 - RNA, 13 nt, Shigella flexneri 2a str. 301
cugaggcaauaau

SEQ ID NO: 3943922 - RNA, 15 nt, Shigella flexneri 2a str. 301
cugaggcaauaauga

SEQ ID NO: 3943923 - RNA, 16 nt, Shigella flexneri 2a str. 301
cugaggcaauaaugac

SEQ ID NO: 3943924 - RNA, 13 nt, Shigella flexneri 2a str. 301
cugaggccgccac

SEQ ID NO: 3943925 - RNA, 17 nt, Shigella flexneri 2a str. 301
cugaggcugaugacaaa

SEQ ID NO: 3943926 - RNA, 13 nt, Shigella flexneri 2a str. 301
cugaggcugucau

SEQ ID NO: 3943927 - RNA, 17 nt, Shigella flexneri 2a str. 301
cugagggauccccagaa

SEQ ID NO: 3943928 - RNA, 15 nt, Shigella flexneri 2a str. 301
cugaguaauaacuuc

SEQ ID NO: 3943929 - RNA, 21 nt, Shigella flexneri 2a str. 301
cugaguaauuaauacgccaga

SEQ ID NO: 3943930 - RNA, 14 nt, Shigella flexneri 2a str. 301
cugagucagaaacu

SEQ ID NO: 3943931 - RNA, 22 nt, Shigella flexneri 2a str. 301
cugagucgggugcagcgacagg

SEQ ID NO: 3943932 - RNA, 14 nt, Shigella flexneri 2a str. 301
cugagugacgcgcu

SEQ ID NO: 3943933 - RNA, 23 nt, Shigella flexneri 2a str. 301
cugagugauacguaaaccacuga

SEQ ID NO: 3943934 - RNA, 18 nt, Shigella flexneri 2a str. 301
cugaguuuaacggacacu

SEQ ID NO: 3943935 - RNA, 12 nt, Shigella flexneri 2a str. 301
cugauaaaaaac

SEQ ID NO: 3943936 - RNA, 14 nt, Shigella flexneri 2a str. 301
cugauaaacaagcg

SEQ ID NO: 3943937 - RNA, 13 nt, Shigella flexneri 2a str. 301
cugauaaaucccg

SEQ ID NO: 3943938 - RNA, 17 nt, Shigella flexneri 2a str. 301
cugauaacgcggcagca

SEQ ID NO: 3943939 - RNA, 17 nt, Shigella flexneri 2a str. 301
cugauaacgugcagcuu

SEQ ID NO: 3943940 - RNA, 19 nt, Shigella flexneri 2a str. 301
cugauaacgugcagcuuuc

SEQ ID NO: 3943941 - RNA, 14 nt, Shigella flexneri 2a str. 301
cugauaacuucacu

SEQ ID NO: 3943942 - RNA, 20 nt, Shigella flexneri 2a str. 301
cugauaagacgcgccagcgu

SEQ ID NO: 3943943 - RNA, 19 nt, Shigella flexneri 2a str. 301
cugauaagcccagcgacca

SEQ ID NO: 3943944 - RNA, 22 nt, Shigella flexneri 2a str. 301
cugauaauaaauaacagugccg

SEQ ID NO: 3943945 - RNA, 19 nt, Shigella flexneri 2a str. 301
cugauaauccagacuauuu

SEQ ID NO: 3943946 - RNA, 23 nt, Shigella flexneri 2a str. 301
cugauaauccagacuauuugaca

SEQ ID NO: 3943947 - RNA, 20 nt, Shigella flexneri 2a str. 301
cugauaaucggggauaagaa

SEQ ID NO: 3943948 - RNA, 24 nt, Shigella flexneri 2a str. 301
cugauaauggcguauuucacagua

SEQ ID NO: 3943949 - RNA, 18 nt, Shigella flexneri 2a str. 301
cugauacagccaaaucau

SEQ ID NO: 3943950 - RNA, 14 nt, Shigella flexneri 2a str. 301
cugauacauagcac

SEQ ID NO: 3943951 - RNA, 15 nt, Shigella flexneri 2a str. 301
cugauacuaaugcca

SEQ ID NO: 3943952 - RNA, 23 nt, Shigella flexneri 2a str. 301
cugauacuccaugaguaacaguc

SEQ ID NO: 3943953 - RNA, 14 nt, Shigella flexneri 2a str. 301
cugauacugaaugu

SEQ ID NO: 3943954 - RNA, 14 nt, Shigella flexneri 2a str. 301
cugauacugcuccg

SEQ ID NO: 3943955 - RNA, 15 nt, Shigella flexneri 2a str. 301
cugauaggauuucug

SEQ ID NO: 3943956 - RNA, 16 nt, Shigella flexneri 2a str. 301
cugauagugcugccau

SEQ ID NO: 3943957 - RNA, 15 nt, Shigella flexneri 2a str. 301
cugauaguuaaaauu

SEQ ID NO: 3943958 - RNA, 16 nt, Shigella flexneri 2a str. 301
cugauaucucaccaga

SEQ ID NO: 3943959 - RNA, 17 nt, Shigella flexneri 2a str. 301
cugauauggugguaacu

SEQ ID NO: 3943960 - RNA, 18 nt, Shigella flexneri 2a str. 301
cugauauuaagcagacgg

SEQ ID NO: 3943961 - RNA, 16 nt, Shigella flexneri 2a str. 301
cugauauucgacacca

SEQ ID NO: 3943962 - RNA, 16 nt, Shigella flexneri 2a str. 301
cugaucaauauagaua

SEQ ID NO: 3943963 - RNA, 18 nt, Shigella flexneri 2a str. 301
cugaucaaucacuucucc

SEQ ID NO: 3943964 - RNA, 20 nt, Shigella flexneri 2a str. 301
cugaucaaucacuucuccgg

SEQ ID NO: 3943965 - RNA, 22 nt, Shigella flexneri 2a str. 301
cugauccacaguugcucaauca

SEQ ID NO: 3943966 - RNA, 14 nt, Shigella flexneri 2a str. 301
cugauccaucgucu

SEQ ID NO: 3943967 - RNA, 15 nt, Shigella flexneri 2a str. 301
cugaucccaguuuuc

SEQ ID NO: 3943968 - RNA, 22 nt, Shigella flexneri 2a str. 301
cugaucccgauggucagcuuca

SEQ ID NO: 3943969 - RNA, 13 nt, Shigella flexneri 2a str. 301
cugauccgcuucg

SEQ ID NO: 3943970 - RNA, 11 nt, Shigella flexneri 2a str. 301
cugauccugca

SEQ ID NO: 3943971 - RNA, 12 nt, Shigella flexneri 2a str. 301
cugauccugcac

SEQ ID NO: 3943972 - RNA, 18 nt, Shigella flexneri 2a str. 301
cugaucgacaaaaucccg

SEQ ID NO: 3943973 - RNA, 21 nt, Shigella flexneri 2a str. 301
cugaucgauaaauucguuuuc

SEQ ID NO: 3943974 - RNA, 16 nt, Shigella flexneri 2a str. 301
cugaucguccugcggu

SEQ ID NO: 3943975 - RNA, 15 nt, Shigella flexneri 2a str. 301
cugaucgugccagga

SEQ ID NO: 3943976 - RNA, 20 nt, Shigella flexneri 2a str. 301
cugaugaacgcgcaggucau

SEQ ID NO: 3943977 - RNA, 17 nt, Shigella flexneri 2a str. 301
cugaugaagacagaccu

SEQ ID NO: 3943978 - RNA, 16 nt, Shigella flexneri 2a str. 301
cugaugaauaaauaca

SEQ ID NO: 3943979 - RNA, 22 nt, Shigella flexneri 2a str. 301
cugaugaauaaauacauugcag

SEQ ID NO: 3943980 - RNA, 15 nt, Shigella flexneri 2a str. 301
cugaugaaugguugu

SEQ ID NO: 3943981 - RNA, 16 nt, Shigella flexneri 2a str. 301
cugaugacaaacacaa

SEQ ID NO: 3943982 - RNA, 18 nt, Shigella flexneri 2a str. 301
cugaugacaaacacaaaa

SEQ ID NO: 3943983 - RNA, 20 nt, Shigella flexneri 2a str. 301
cugaugacaaacacaaaacu

SEQ ID NO: 3943984 - RNA, 21 nt, Shigella flexneri 2a str. 301
cugaugacaaacacaaaacug

SEQ ID NO: 3943985 - RNA, 18 nt, Shigella flexneri 2a str. 301
cugaugacgcgcuagugc

SEQ ID NO: 3943986 - RNA, 22 nt, Shigella flexneri 2a str. 301
cugaugacgcgcuagugcauug

SEQ ID NO: 3943987 - RNA, 21 nt, Shigella flexneri 2a str. 301
cugaugacuaaagucuaaaaa

SEQ ID NO: 3943988 - RNA, 15 nt, Shigella flexneri 2a str. 301
cugaugauauuuuuc

SEQ ID NO: 3943989 - RNA, 16 nt, Shigella flexneri 2a str. 301
cugaugauauuuuucc

SEQ ID NO: 3943990 - RNA, 18 nt, Shigella flexneri 2a str. 301
cugaugcacgauaacguc

SEQ ID NO: 3943991 - RNA, 15 nt, Shigella flexneri 2a str. 301
cugaugcgacacugu

SEQ ID NO: 3943992 - RNA, 15 nt, Shigella flexneri 2a str. 301
cugaugcgacgcuga

SEQ ID NO: 3943993 - RNA, 22 nt, Shigella flexneri 2a str. 301
cugaugcgacgcugauagcguc

SEQ ID NO: 3943994 - RNA, 22 nt, Shigella flexneri 2a str. 301
cugaugcgacgcuggcgcgucu

SEQ ID NO: 3943995 - RNA, 21 nt, Shigella flexneri 2a str. 301
cugaugcgcuaugcuuaucag

SEQ ID NO: 3943996 - RNA, 19 nt, Shigella flexneri 2a str. 301
cugaugcgcugggcaacaa

SEQ ID NO: 3943997 - RNA, 23 nt, Shigella flexneri 2a str. 301
cugaugcugugaauauucauuuc

SEQ ID NO: 3943998 - RNA, 18 nt, Shigella flexneri 2a str. 301
cugauggaauuucaucau

SEQ ID NO: 3943999 - RNA, 22 nt, Shigella flexneri 2a str. 301
cugauggaauuucaucaucacg

SEQ ID NO: 3944000 - RNA, 16 nt, Shigella flexneri 2a str. 301
cugauggacauucucc

SEQ ID NO: 3944001 - RNA, 19 nt, Shigella flexneri 2a str. 301
cugauggcccaucgucaca

SEQ ID NO: 3944002 - RNA, 21 nt, Shigella flexneri 2a str. 301
cugauggcggcugguuaaaua

SEQ ID NO: 3944003 - RNA, 23 nt, Shigella flexneri 2a str. 301
cugauggcuguuuucagcaccag

SEQ ID NO: 3944004 - RNA, 16 nt, Shigella flexneri 2a str. 301
cugaugggaugggcau

SEQ ID NO: 3944005 - RNA, 21 nt, Shigella flexneri 2a str. 301
cugaugguugugcuaacucau

SEQ ID NO: 3944006 - RNA, 20 nt, Shigella flexneri 2a str. 301
cugauguaaucaacuccgcc

SEQ ID NO: 3944007 - RNA, 18 nt, Shigella flexneri 2a str. 301
cugaugugauccaucagg

SEQ ID NO: 3944008 - RNA, 14 nt, Shigella flexneri 2a str. 301
cugaugugaugccc

SEQ ID NO: 3944009 - RNA, 14 nt, Shigella flexneri 2a str. 301
cugauguucgccag

SEQ ID NO: 3944010 - RNA, 15 nt, Shigella flexneri 2a str. 301
cugauguucgccaga

SEQ ID NO: 3944011 - RNA, 18 nt, Shigella flexneri 2a str. 301
cugauuacccuucgcccu

SEQ ID NO: 3944012 - RNA, 20 nt, Shigella flexneri 2a str. 301
cugauuaccuuccugccaga

SEQ ID NO: 3944013 - RNA, 20 nt, Shigella flexneri 2a str. 301
cugauuacgcaccgggcagg

SEQ ID NO: 3944014 - RNA, 19 nt, Shigella flexneri 2a str. 301
cugauucaaaaccgguucu

SEQ ID NO: 3944015 - RNA, 20 nt, Shigella flexneri 2a str. 301
cugauucaaaaccgguucug

SEQ ID NO: 3944016 - RNA, 14 nt, Shigella flexneri 2a str. 301
cugauucagauaau

SEQ ID NO: 3944017 - RNA, 19 nt, Shigella flexneri 2a str. 301
cugauucaugaacuguaca

SEQ ID NO: 3944018 - RNA, 13 nt, Shigella flexneri 2a str. 301
cugauucgucaau

SEQ ID NO: 3944019 - RNA, 16 nt, Shigella flexneri 2a str. 301
cugauucgucaauauc

SEQ ID NO: 3944020 - RNA, 17 nt, Shigella flexneri 2a str. 301
cugauucugauccugca

SEQ ID NO: 3944021 - RNA, 17 nt, Shigella flexneri 2a str. 301
cugauugaacuguggcg

SEQ ID NO: 3944022 - RNA, 18 nt, Shigella flexneri 2a str. 301
cugauugaccgccagcgc

SEQ ID NO: 3944023 - RNA, 23 nt, Shigella flexneri 2a str. 301
cugauugacgcguucgcuaaaga

SEQ ID NO: 3944024 - RNA, 23 nt, Shigella flexneri 2a str. 301
cugauugauucaggguaugaaug

SEQ ID NO: 3944025 - RNA, 13 nt, Shigella flexneri 2a str. 301
cugauugcauaau

SEQ ID NO: 3944026 - RNA, 20 nt, Shigella flexneri 2a str. 301
cugauugccacccugcggcu

SEQ ID NO: 3944027 - RNA, 17 nt, Shigella flexneri 2a str. 301
cugauuguuaacaacgu

SEQ ID NO: 3944028 - RNA, 22 nt, Shigella flexneri 2a str. 301
cugauuuaaccaacaauaaaau

SEQ ID NO: 3944029 - RNA, 23 nt, Shigella flexneri 2a str. 301
cugauuuaaccaacaauaaaauu

SEQ ID NO: 3944030 - RNA, 15 nt, Shigella flexneri 2a str. 301
cugauuuauagauuu

SEQ ID NO: 3944031 - RNA, 19 nt, Shigella flexneri 2a str. 301
cugauuuauagauuuacua

SEQ ID NO: 3944032 - RNA, 21 nt, Shigella flexneri 2a str. 301
cugauuugauaaugccagccu

SEQ ID NO: 3944033 - RNA, 15 nt, Shigella flexneri 2a str. 301
cugauuuucaucuuc

SEQ ID NO: 3944034 - RNA, 12 nt, Shigella flexneri 2a str. 301
cugauuuuccuc

SEQ ID NO: 3944035 - RNA, 13 nt, Shigella flexneri 2a str. 301
cugauuuuccucc

SEQ ID NO: 3944036 - RNA, 17 nt, Shigella flexneri 2a str. 301
cugauuuugcaacaacu

SEQ ID NO: 3944037 - RNA, 15 nt, Shigella flexneri 2a str. 301
cugcaaaaagcaggu

SEQ ID NO: 3944038 - RNA, 20 nt, Shigella flexneri 2a str. 301
cugcaaaaagcagguuuuac

SEQ ID NO: 3944039 - RNA, 22 nt, Shigella flexneri 2a str. 301
cugcaaaauaccaauaaucaau

SEQ ID NO: 3944040 - RNA, 19 nt, Shigella flexneri 2a str. 301
cugcaaaauagccaaucau

SEQ ID NO: 3944041 - RNA, 15 nt, Shigella flexneri 2a str. 301
cugcaaacgacguau

SEQ ID NO: 3944042 - RNA, 16 nt, Shigella flexneri 2a str. 301
cugcaaagcauuuuuu

SEQ ID NO: 3944043 - RNA, 21 nt, Shigella flexneri 2a str. 301
cugcaaagcauuuuuucacau

SEQ ID NO: 3944044 - RNA, 16 nt, Shigella flexneri 2a str. 301
cugcaaauauuaauaa

SEQ ID NO: 3944045 - RNA, 17 nt, Shigella flexneri 2a str. 301
cugcaaauauuaauaau

SEQ ID NO: 3944046 - RNA, 20 nt, Shigella flexneri 2a str. 301
cugcaaaucgaucucaauga

SEQ ID NO: 3944047 - RNA, 22 nt, Shigella flexneri 2a str. 301
cugcaaaucugcgccuacggca

SEQ ID NO: 3944048 - RNA, 14 nt, Shigella flexneri 2a str. 301
cugcaaauuauuug

SEQ ID NO: 3944049 - RNA, 13 nt, Shigella flexneri 2a str. 301
cugcaacagcugu

SEQ ID NO: 3944050 - RNA, 12 nt, Shigella flexneri 2a str. 301
cugcaaccagau

SEQ ID NO: 3944051 - RNA, 23 nt, Shigella flexneri 2a str. 301
cugcaaccauuugugcuggcaaa

SEQ ID NO: 3944052 - RNA, 15 nt, Shigella flexneri 2a str. 301
cugcaacgucuuccc

SEQ ID NO: 3944053 - RNA, 13 nt, Shigella flexneri 2a str. 301
cugcaacugcgcg

SEQ ID NO: 3944054 - RNA, 16 nt, Shigella flexneri 2a str. 301
cugcaacuucucuuuc

SEQ ID NO: 3944055 - RNA, 16 nt, Shigella flexneri 2a str. 301
cugcaaggccauccgc

SEQ ID NO: 3944056 - RNA, 22 nt, Shigella flexneri 2a str. 301
cugcaaggccauccgcugcggu

SEQ ID NO: 3944057 - RNA, 14 nt, Shigella flexneri 2a str. 301
cugcaaucaccacu

SEQ ID NO: 3944058 - RNA, 19 nt, Shigella flexneri 2a str. 301
cugcaaugcugcgaucagu

SEQ ID NO: 3944059 - RNA, 16 nt, Shigella flexneri 2a str. 301
cugcaaugucaucagc

SEQ ID NO: 3944060 - RNA, 18 nt, Shigella flexneri 2a str. 301
cugcacaaauagccagca

SEQ ID NO: 3944061 - RNA, 16 nt, Shigella flexneri 2a str. 301
cugcacaccaaccgcu

SEQ ID NO: 3944062 - RNA, 19 nt, Shigella flexneri 2a str. 301
cugcacaccaaccgcuucc

SEQ ID NO: 3944063 - RNA, 14 nt, Shigella flexneri 2a str. 301
cugcaccaggcggg

SEQ ID NO: 3944064 - RNA, 13 nt, Shigella flexneri 2a str. 301
cugcaccauugcu

SEQ ID NO: 3944065 - RNA, 17 nt, Shigella flexneri 2a str. 301
cugcaccauugcugccg

SEQ ID NO: 3944066 - RNA, 19 nt, Shigella flexneri 2a str. 301
cugcaccauugcugccgcc

SEQ ID NO: 3944067 - RNA, 15 nt, Shigella flexneri 2a str. 301
cugcaccgauaauac

SEQ ID NO: 3944068 - RNA, 17 nt, Shigella flexneri 2a str. 301
cugcaccgauaauacac

SEQ ID NO: 3944069 - RNA, 14 nt, Shigella flexneri 2a str. 301
cugcacgccaggau

SEQ ID NO: 3944070 - RNA, 17 nt, Shigella flexneri 2a str. 301
cugcacgccaucuggcu

SEQ ID NO: 3944071 - RNA, 18 nt, Shigella flexneri 2a str. 301
cugcacgccaucuggcug

SEQ ID NO: 3944072 - RNA, 19 nt, Shigella flexneri 2a str. 301
cugcacggcuucccacguc

SEQ ID NO: 3944073 - RNA, 24 nt, Shigella flexneri 2a str. 301
cugcacggcuucccacgucagacc

SEQ ID NO: 3944074 - RNA, 21 nt, Shigella flexneri 2a str. 301
cugcacuuugugucagcgcca

SEQ ID NO: 3944075 - RNA, 18 nt, Shigella flexneri 2a str. 301
cugcagauuaugccugau

SEQ ID NO: 3944076 - RNA, 19 nt, Shigella flexneri 2a str. 301
cugcagcagccugcgcuuc

SEQ ID NO: 3944077 - RNA, 20 nt, Shigella flexneri 2a str. 301
cugcagcagccugcgcuucu

SEQ ID NO: 3944078 - RNA, 23 nt, Shigella flexneri 2a str. 301
cugcagcagccugcgcuucuuuu

SEQ ID NO: 3944079 - RNA, 15 nt, Shigella flexneri 2a str. 301
cugcagcaucaccgg

SEQ ID NO: 3944080 - RNA, 18 nt, Shigella flexneri 2a str. 301
cugcagccagggucaaca

SEQ ID NO: 3944081 - RNA, 23 nt, Shigella flexneri 2a str. 301
cugcagcgcggcgagagcuuucg

SEQ ID NO: 3944082 - RNA, 17 nt, Shigella flexneri 2a str. 301
cugcagcgucacucgcu

SEQ ID NO: 3944083 - RNA, 22 nt, Shigella flexneri 2a str. 301
cugcagcuccaguuucuuuugc

SEQ ID NO: 3944084 - RNA, 16 nt, Shigella flexneri 2a str. 301
cugcaggaccauacug

SEQ ID NO: 3944085 - RNA, 15 nt, Shigella flexneri 2a str. 301
cugcagguauugcuu

SEQ ID NO: 3944086 - RNA, 20 nt, Shigella flexneri 2a str. 301
cugcagguauugcuucucag

SEQ ID NO: 3944087 - RNA, 14 nt, Shigella flexneri 2a str. 301
cugcagugaaauua

SEQ ID NO: 3944088 - RNA, 18 nt, Shigella flexneri 2a str. 301
cugcagugaaauuaaacu

SEQ ID NO: 3944089 - RNA, 15 nt, Shigella flexneri 2a str. 301
cugcagugcaaugac

SEQ ID NO: 3944090 - RNA, 17 nt, Shigella flexneri 2a str. 301
cugcagugcaaugacuc

SEQ ID NO: 3944091 - RNA, 21 nt, Shigella flexneri 2a str. 301
cugcagugcacgaaccagaga

SEQ ID NO: 3944092 - RNA, 13 nt, Shigella flexneri 2a str. 301
cugcauacaaaua

SEQ ID NO: 3944093 - RNA, 16 nt, Shigella flexneri 2a str. 301
cugcauacgacgugcc

SEQ ID NO: 3944094 - RNA, 22 nt, Shigella flexneri 2a str. 301
cugcauacguuucaccagcacu

SEQ ID NO: 3944095 - RNA, 13 nt, Shigella flexneri 2a str. 301
cugcaucaaccaa

SEQ ID NO: 3944096 - RNA, 13 nt, Shigella flexneri 2a str. 301
cugcaucaccauc

SEQ ID NO: 3944097 - RNA, 19 nt, Shigella flexneri 2a str. 301
cugcaucagcgccuuacca

SEQ ID NO: 3944098 - RNA, 16 nt, Shigella flexneri 2a str. 301
cugcauccgccaucca

SEQ ID NO: 3944099 - RNA, 19 nt, Shigella flexneri 2a str. 301
cugcauccgccauccacca

SEQ ID NO: 3944100 - RNA, 14 nt, Shigella flexneri 2a str. 301
cugcaucuccggcg

SEQ ID NO: 3944101 - RNA, 22 nt, Shigella flexneri 2a str. 301
cugcaucuuccguggaacaaaa

SEQ ID NO: 3944102 - RNA, 16 nt, Shigella flexneri 2a str. 301
cugcauggugccgcca

SEQ ID NO: 3944103 - RNA, 17 nt, Shigella flexneri 2a str. 301
cugcauggugccgccaa

SEQ ID NO: 3944104 - RNA, 18 nt, Shigella flexneri 2a str. 301
cugcauguaaccuaauuu

SEQ ID NO: 3944105 - RNA, 17 nt, Shigella flexneri 2a str. 301
cugcauuauccagcgaa

SEQ ID NO: 3944106 - RNA, 14 nt, Shigella flexneri 2a str. 301
cugcauucaccagu

SEQ ID NO: 3944107 - RNA, 13 nt, Shigella flexneri 2a str. 301
cugcauugucgga

SEQ ID NO: 3944108 - RNA, 16 nt, Shigella flexneri 2a str. 301
cugcauuugccccugu

SEQ ID NO: 3944109 - RNA, 19 nt, Shigella flexneri 2a str. 301
cugcauuugccccuguuga

SEQ ID NO: 3944110 - RNA, 18 nt, Shigella flexneri 2a str. 301
cugccaaacgcucccugc

SEQ ID NO: 3944111 - RNA, 20 nt, Shigella flexneri 2a str. 301
cugccaaacgcucccugcca

SEQ ID NO: 3944112 - RNA, 11 nt, Shigella flexneri 2a str. 301
cugccaccagu

SEQ ID NO: 3944113 - RNA, 12 nt, Shigella flexneri 2a str. 301
cugccaccagua

SEQ ID NO: 3944114 - RNA, 22 nt, Shigella flexneri 2a str. 301
cugccacgguaugacccagcgc

SEQ ID NO: 3944115 - RNA, 19 nt, Shigella flexneri 2a str. 301
cugccagaaaucggccuuc

SEQ ID NO: 3944116 - RNA, 15 nt, Shigella flexneri 2a str. 301
cugccagaaccgcuu

SEQ ID NO: 3944117 - RNA, 23 nt, Shigella flexneri 2a str. 301
cugccagaaggauugaucaauuc

SEQ ID NO: 3944118 - RNA, 18 nt, Shigella flexneri 2a str. 301
cugccagaggagccauca

SEQ ID NO: 3944119 - RNA, 19 nt, Shigella flexneri 2a str. 301
cugccagaggagccaucac

SEQ ID NO: 3944120 - RNA, 12 nt, Shigella flexneri 2a str. 301
cugccagaugca

SEQ ID NO: 3944121 - RNA, 14 nt, Shigella flexneri 2a str. 301
cugccagcaaauag

SEQ ID NO: 3944122 - RNA, 12 nt, Shigella flexneri 2a str. 301
cugccagccagg

SEQ ID NO: 3944123 - RNA, 14 nt, Shigella flexneri 2a str. 301
cugccagccauaaa

SEQ ID NO: 3944124 - RNA, 15 nt, Shigella flexneri 2a str. 301
cugccagccauaaau

SEQ ID NO: 3944125 - RNA, 13 nt, Shigella flexneri 2a str. 301
cugccagccaucu

SEQ ID NO: 3944126 - RNA, 13 nt, Shigella flexneri 2a str. 301
cugccagcccgcc

SEQ ID NO: 3944127 - RNA, 15 nt, Shigella flexneri 2a str. 301
cugccagccgccgcu

SEQ ID NO: 3944128 - RNA, 17 nt, Shigella flexneri 2a str. 301
cugccagcgccgacagc

SEQ ID NO: 3944129 - RNA, 17 nt, Shigella flexneri 2a str. 301
cugccagcgugagggaa

SEQ ID NO: 3944130 - RNA, 12 nt, Shigella flexneri 2a str. 301
cugccagcucuc

SEQ ID NO: 3944131 - RNA, 15 nt, Shigella flexneri 2a str. 301
cugccagcucucaga

SEQ ID NO: 3944132 - RNA, 23 nt, Shigella flexneri 2a str. 301
cugccagcugcucauagcggcug

SEQ ID NO: 3944133 - RNA, 14 nt, Shigella flexneri 2a str. 301
cugccagcugcugu

SEQ ID NO: 3944134 - RNA, 21 nt, Shigella flexneri 2a str. 301
cugccagcuugcgauccugca

SEQ ID NO: 3944135 - RNA, 18 nt, Shigella flexneri 2a str. 301
cugccaguaaagcagcga

SEQ ID NO: 3944136 - RNA, 20 nt, Shigella flexneri 2a str. 301
cugccaguaaagcagcgaag

SEQ ID NO: 3944137 - RNA, 15 nt, Shigella flexneri 2a str. 301
cugccagugcugcuu

SEQ ID NO: 3944138 - RNA, 17 nt, Shigella flexneri 2a str. 301
cugccaguuauagcgca

SEQ ID NO: 3944139 - RNA, 20 nt, Shigella flexneri 2a str. 301
cugccaguuauagcgcagac

SEQ ID NO: 3944140 - RNA, 22 nt, Shigella flexneri 2a str. 301
cugccaguuguugcugaauuug

SEQ ID NO: 3944141 - RNA, 23 nt, Shigella flexneri 2a str. 301
cugccauaaacgguuucagcagc

SEQ ID NO: 3944142 - RNA, 21 nt, Shigella flexneri 2a str. 301
cugccauccguaauuuuuacu

SEQ ID NO: 3944143 - RNA, 19 nt, Shigella flexneri 2a str. 301
cugccauuggcaggcucug

SEQ ID NO: 3944144 - RNA, 14 nt, Shigella flexneri 2a str. 301
cugcccacgcgcac

SEQ ID NO: 3944145 - RNA, 17 nt, Shigella flexneri 2a str. 301
cugcccacgcgcacgcu

SEQ ID NO: 3944146 - RNA, 13 nt, Shigella flexneri 2a str. 301
cugcccacuccag

SEQ ID NO: 3944147 - RNA, 15 nt, Shigella flexneri 2a str. 301
cugcccacuccagcu

SEQ ID NO: 3944148 - RNA, 23 nt, Shigella flexneri 2a str. 301
cugcccaguugugaugauuuugu

SEQ ID NO: 3944149 - RNA, 17 nt, Shigella flexneri 2a str. 301
cugcccccgcucuucca

SEQ ID NO: 3944150 - RNA, 13 nt, Shigella flexneri 2a str. 301
cugcccgcaccca

SEQ ID NO: 3944151 - RNA, 19 nt, Shigella flexneri 2a str. 301
cugcccguugccaggaccg

SEQ ID NO: 3944152 - RNA, 20 nt, Shigella flexneri 2a str. 301
cugcccucuuuagcauucag

SEQ ID NO: 3944153 - RNA, 18 nt, Shigella flexneri 2a str. 301
cugcccuugccaacgcaa

SEQ ID NO: 3944154 - RNA, 15 nt, Shigella flexneri 2a str. 301
cugccgaccaucugu

SEQ ID NO: 3944155 - RNA, 15 nt, Shigella flexneri 2a str. 301
cugccgauggcacaa

SEQ ID NO: 3944156 - RNA, 15 nt, Shigella flexneri 2a str. 301
cugccgcaaacgaca

SEQ ID NO: 3944157 - RNA, 22 nt, Shigella flexneri 2a str. 301
cugccgcaauggccguuccggc

SEQ ID NO: 3944158 - RNA, 15 nt, Shigella flexneri 2a str. 301
cugccgcacggacaa

SEQ ID NO: 3944159 - RNA, 20 nt, Shigella flexneri 2a str. 301
cugccgcacuuugagcagcu

SEQ ID NO: 3944160 - RNA, 16 nt, Shigella flexneri 2a str. 301
cugccgcagauauuga

SEQ ID NO: 3944161 - RNA, 16 nt, Shigella flexneri 2a str. 301
cugccgcaguuucuga

SEQ ID NO: 3944162 - RNA, 14 nt, Shigella flexneri 2a str. 301
cugccgccaccaug

SEQ ID NO: 3944163 - RNA, 16 nt, Shigella flexneri 2a str. 301
cugccgccuuaaaccu

SEQ ID NO: 3944164 - RNA, 21 nt, Shigella flexneri 2a str. 301
cugccgcgcacgucagccucg

SEQ ID NO: 3944165 - RNA, 11 nt, Shigella flexneri 2a str. 301
cugccgcuuca

SEQ ID NO: 3944166 - RNA, 18 nt, Shigella flexneri 2a str. 301
cugccgcuucuucuucag

SEQ ID NO: 3944167 - RNA, 20 nt, Shigella flexneri 2a str. 301
cugccggaaccagccaggaa

SEQ ID NO: 3944168 - RNA, 15 nt, Shigella flexneri 2a str. 301
cugccggaacgugca

SEQ ID NO: 3944169 - RNA, 16 nt, Shigella flexneri 2a str. 301
cugccggaacgugcau

SEQ ID NO: 3944170 - RNA, 17 nt, Shigella flexneri 2a str. 301
cugccggaccaucuucc

SEQ ID NO: 3944171 - RNA, 20 nt, Shigella flexneri 2a str. 301
cugccggacguucgcccacu

SEQ ID NO: 3944172 - RNA, 20 nt, Shigella flexneri 2a str. 301
cugccggagcgccaccaccc

SEQ ID NO: 3944173 - RNA, 19 nt, Shigella flexneri 2a str. 301
cugccggagggauguggcc

SEQ ID NO: 3944174 - RNA, 11 nt, Shigella flexneri 2a str. 301
cugccggaugg

SEQ ID NO: 3944175 - RNA, 23 nt, Shigella flexneri 2a str. 301
cugccggggagauauuccccaga

SEQ ID NO: 3944176 - RNA, 19 nt, Shigella flexneri 2a str. 301
cugccgggguaaagcgcgg

SEQ ID NO: 3944177 - RNA, 15 nt, Shigella flexneri 2a str. 301
cugccggguucgcac

SEQ ID NO: 3944178 - RNA, 17 nt, Shigella flexneri 2a str. 301
cugccgguacuucacca

SEQ ID NO: 3944179 - RNA, 15 nt, Shigella flexneri 2a str. 301
cugccguacaggcag

SEQ ID NO: 3944180 - RNA, 16 nt, Shigella flexneri 2a str. 301
cugccguacaggcagc

SEQ ID NO: 3944181 - RNA, 19 nt, Shigella flexneri 2a str. 301
cugccguacaggcagcuua

SEQ ID NO: 3944182 - RNA, 21 nt, Shigella flexneri 2a str. 301
cugccguacaggcagcuuaga

SEQ ID NO: 3944183 - RNA, 23 nt, Shigella flexneri 2a str. 301
cugccguacaggcagcuuagaaa

SEQ ID NO: 3944184 - RNA, 15 nt, Shigella flexneri 2a str. 301
cugccgucaauuuua

SEQ ID NO: 3944185 - RNA, 21 nt, Shigella flexneri 2a str. 301
cugccguccccaucaggaaac

SEQ ID NO: 3944186 - RNA, 14 nt, Shigella flexneri 2a str. 301
cugccguuaacccg

SEQ ID NO: 3944187 - RNA, 15 nt, Shigella flexneri 2a str. 301
cugccguuaacccgu

SEQ ID NO: 3944188 - RNA, 13 nt, Shigella flexneri 2a str. 301
cugccguugcugc

SEQ ID NO: 3944189 - RNA, 18 nt, Shigella flexneri 2a str. 301
cugccguugcuugaugca

SEQ ID NO: 3944190 - RNA, 13 nt, Shigella flexneri 2a str. 301
cugccucgcagag

SEQ ID NO: 3944191 - RNA, 15 nt, Shigella flexneri 2a str. 301
cugccucgcagaguu

SEQ ID NO: 3944192 - RNA, 14 nt, Shigella flexneri 2a str. 301
cugccucgcugaag

SEQ ID NO: 3944193 - RNA, 15 nt, Shigella flexneri 2a str. 301
cugccucgcugaagc

SEQ ID NO: 3944194 - RNA, 19 nt, Shigella flexneri 2a str. 301
cugccucgggauccaugca

SEQ ID NO: 3944195 - RNA, 21 nt, Shigella flexneri 2a str. 301
cugccucgggauccaugcacg

SEQ ID NO: 3944196 - RNA, 21 nt, Shigella flexneri 2a str. 301
cugccucucuucgcugcuggu

SEQ ID NO: 3944197 - RNA, 19 nt, Shigella flexneri 2a str. 301
cugccugacggaaaucaug

SEQ ID NO: 3944198 - RNA, 14 nt, Shigella flexneri 2a str. 301
cugccugauacuga

SEQ ID NO: 3944199 - RNA, 17 nt, Shigella flexneri 2a str. 301
cugccugauccugggcu

SEQ ID NO: 3944200 - RNA, 15 nt, Shigella flexneri 2a str. 301
cugccugaugcgcuc

SEQ ID NO: 3944201 - RNA, 16 nt, Shigella flexneri 2a str. 301
cugccugcagcugcuc

SEQ ID NO: 3944202 - RNA, 15 nt, Shigella flexneri 2a str. 301
cugccuguacggcag

SEQ ID NO: 3944203 - RNA, 16 nt, Shigella flexneri 2a str. 301
cugccuguacggcagu

SEQ ID NO: 3944204 - RNA, 17 nt, Shigella flexneri 2a str. 301
cugccuuauccagcaga

SEQ ID NO: 3944205 - RNA, 21 nt, Shigella flexneri 2a str. 301
cugccuugaguuuuucauccc

SEQ ID NO: 3944206 - RNA, 17 nt, Shigella flexneri 2a str. 301
cugccuuucagcgcaug

SEQ ID NO: 3944207 - RNA, 19 nt, Shigella flexneri 2a str. 301
cugcgaaucgcuucauuua

SEQ ID NO: 3944208 - RNA, 21 nt, Shigella flexneri 2a str. 301
cugcgacagggaucucuucca

SEQ ID NO: 3944209 - RNA, 15 nt, Shigella flexneri 2a str. 301
cugcgacauauuccc

SEQ ID NO: 3944210 - RNA, 23 nt, Shigella flexneri 2a str. 301
cugcgacgcaaacgacgagcgcu

SEQ ID NO: 3944211 - RNA, 23 nt, Shigella flexneri 2a str. 301
cugcgagguuauccgccagcgcc

SEQ ID NO: 3944212 - RNA, 21 nt, Shigella flexneri 2a str. 301
cugcgauaguggaacaaagaa

SEQ ID NO: 3944213 - RNA, 14 nt, Shigella flexneri 2a str. 301
cugcgaugucugau

SEQ ID NO: 3944214 - RNA, 17 nt, Shigella flexneri 2a str. 301
cugcgauuuaacgccug

SEQ ID NO: 3944215 - RNA, 21 nt, Shigella flexneri 2a str. 301
cugcgcaacuuguugucuucu

SEQ ID NO: 3944216 - RNA, 20 nt, Shigella flexneri 2a str. 301
cugcgcacaagcccaugcac

SEQ ID NO: 3944217 - RNA, 23 nt, Shigella flexneri 2a str. 301
cugcgcacacacgcccagcucaa

SEQ ID NO: 3944218 - RNA, 13 nt, Shigella flexneri 2a str. 301
cugcgcagcggug

SEQ ID NO: 3944219 - RNA, 15 nt, Shigella flexneri 2a str. 301
cugcgcauuucccag

SEQ ID NO: 3944220 - RNA, 16 nt, Shigella flexneri 2a str. 301
cugcgcauuucccagc

SEQ ID NO: 3944221 - RNA, 20 nt, Shigella flexneri 2a str. 301
cugcgcauuucccagcaaga

SEQ ID NO: 3944222 - RNA, 13 nt, Shigella flexneri 2a str. 301
cugcgccaauacc

SEQ ID NO: 3944223 - RNA, 15 nt, Shigella flexneri 2a str. 301
cugcgccacuuccca

SEQ ID NO: 3944224 - RNA, 18 nt, Shigella flexneri 2a str. 301
cugcgccacuucccagcc

SEQ ID NO: 3944225 - RNA, 12 nt, Shigella flexneri 2a str. 301
cugcgccagacg

SEQ ID NO: 3944226 - RNA, 16 nt, Shigella flexneri 2a str. 301
cugcgccagcggcagu

SEQ ID NO: 3944227 - RNA, 19 nt, Shigella flexneri 2a str. 301
cugcgccccacaccaccau

SEQ ID NO: 3944228 - RNA, 13 nt, Shigella flexneri 2a str. 301
cugcgcccgcagc

SEQ ID NO: 3944229 - RNA, 14 nt, Shigella flexneri 2a str. 301
cugcgcccgcagcg

SEQ ID NO: 3944230 - RNA, 14 nt, Shigella flexneri 2a str. 301
cugcgcccgcccgc

SEQ ID NO: 3944231 - RNA, 17 nt, Shigella flexneri 2a str. 301
cugcgccgagcaauaaa

SEQ ID NO: 3944232 - RNA, 15 nt, Shigella flexneri 2a str. 301
cugcgccgccucugc

SEQ ID NO: 3944233 - RNA, 22 nt, Shigella flexneri 2a str. 301
cugcgccuuuuuucgccgcagc

SEQ ID NO: 3944234 - RNA, 16 nt, Shigella flexneri 2a str. 301
cugcgcgacucccuga

SEQ ID NO: 3944235 - RNA, 15 nt, Shigella flexneri 2a str. 301
cugcgcgccgccgcu

SEQ ID NO: 3944236 - RNA, 22 nt, Shigella flexneri 2a str. 301
cugcgcgucuuaucaggccugu

SEQ ID NO: 3944237 - RNA, 19 nt, Shigella flexneri 2a str. 301
cugcgcuaaacaggaucug

SEQ ID NO: 3944238 - RNA, 21 nt, Shigella flexneri 2a str. 301
cugcgcuaaacaggaucuggu

SEQ ID NO: 3944239 - RNA, 14 nt, Shigella flexneri 2a str. 301
cugcgcuauaucgc

SEQ ID NO: 3944240 - RNA, 15 nt, Shigella flexneri 2a str. 301
cugcgcucuucuggc

SEQ ID NO: 3944241 - RNA, 21 nt, Shigella flexneri 2a str. 301
cugcgcuggaacaacgcgcgu

SEQ ID NO: 3944242 - RNA, 19 nt, Shigella flexneri 2a str. 301
cugcgcuuacacacccggc

SEQ ID NO: 3944243 - RNA, 14 nt, Shigella flexneri 2a str. 301
cugcgcuuccugca

SEQ ID NO: 3944244 - RNA, 18 nt, Shigella flexneri 2a str. 301
cugcggaaucaccggcaa

SEQ ID NO: 3944245 - RNA, 21 nt, Shigella flexneri 2a str. 301
cugcggaauugccgguacagc

SEQ ID NO: 3944246 - RNA, 17 nt, Shigella flexneri 2a str. 301
cugcggacaaaacguga

SEQ ID NO: 3944247 - RNA, 16 nt, Shigella flexneri 2a str. 301
cugcggacgcaccgcg

SEQ ID NO: 3944248 - RNA, 14 nt, Shigella flexneri 2a str. 301
cugcggaucaaucg

SEQ ID NO: 3944249 - RNA, 19 nt, Shigella flexneri 2a str. 301
cugcggauccugagcaaac

SEQ ID NO: 3944250 - RNA, 19 nt, Shigella flexneri 2a str. 301
cugcggaugcgccauccag

SEQ ID NO: 3944251 - RNA, 16 nt, Shigella flexneri 2a str. 301
cugcggauuuccccac

SEQ ID NO: 3944252 - RNA, 17 nt, Shigella flexneri 2a str. 301
cugcggcaagaucgcga

SEQ ID NO: 3944253 - RNA, 13 nt, Shigella flexneri 2a str. 301
cugcggccagcag

SEQ ID NO: 3944254 - RNA, 13 nt, Shigella flexneri 2a str. 301
cugcggcucucag

SEQ ID NO: 3944255 - RNA, 12 nt, Shigella flexneri 2a str. 301
cugcggcugacc

SEQ ID NO: 3944256 - RNA, 13 nt, Shigella flexneri 2a str. 301
cugcggcugacca

SEQ ID NO: 3944257 - RNA, 19 nt, Shigella flexneri 2a str. 301
cugcgggaacauaugcaca

SEQ ID NO: 3944258 - RNA, 13 nt, Shigella flexneri 2a str. 301
cugcgggagcgcu

SEQ ID NO: 3944259 - RNA, 14 nt, Shigella flexneri 2a str. 301
cugcggguuagucu

SEQ ID NO: 3944260 - RNA, 17 nt, Shigella flexneri 2a str. 301
cugcggguuagucugca

SEQ ID NO: 3944261 - RNA, 15 nt, Shigella flexneri 2a str. 301
cugcggugacgcaac

SEQ ID NO: 3944262 - RNA, 13 nt, Shigella flexneri 2a str. 301
cugcguaauguuu

SEQ ID NO: 3944263 - RNA, 21 nt, Shigella flexneri 2a str. 301
cugcguaauguuuagagacgc

SEQ ID NO: 3944264 - RNA, 20 nt, Shigella flexneri 2a str. 301
cugcguagcucaucuucaua

SEQ ID NO: 3944265 - RNA, 11 nt, Shigella flexneri 2a str. 301
cugcguauuuc

SEQ ID NO: 3944266 - RNA, 14 nt, Shigella flexneri 2a str. 301
cugcguauuuccug

SEQ ID NO: 3944267 - RNA, 19 nt, Shigella flexneri 2a str. 301
cugcguauuuccugccaga

SEQ ID NO: 3944268 - RNA, 18 nt, Shigella flexneri 2a str. 301
cugcgucgcgcguaacau

SEQ ID NO: 3944269 - RNA, 14 nt, Shigella flexneri 2a str. 301
cugcgucgcuuucc

SEQ ID NO: 3944270 - RNA, 17 nt, Shigella flexneri 2a str. 301
cugcgugacuaaaaccc

SEQ ID NO: 3944271 - RNA, 17 nt, Shigella flexneri 2a str. 301
cugcgugccuaauuccg

SEQ ID NO: 3944272 - RNA, 19 nt, Shigella flexneri 2a str. 301
cugcgugguuuguuccgca

SEQ ID NO: 3944273 - RNA, 20 nt, Shigella flexneri 2a str. 301
cugcgugucggacggaauuu

SEQ ID NO: 3944274 - RNA, 14 nt, Shigella flexneri 2a str. 301
cugcguuccggcau

SEQ ID NO: 3944275 - RNA, 15 nt, Shigella flexneri 2a str. 301
cugcguuccggcaug

SEQ ID NO: 3944276 - RNA, 19 nt, Shigella flexneri 2a str. 301
cugcguuccggcaugauuc

SEQ ID NO: 3944277 - RNA, 20 nt, Shigella flexneri 2a str. 301
cugcguuccggcaugauuca

SEQ ID NO: 3944278 - RNA, 21 nt, Shigella flexneri 2a str. 301
cugcguuguaccaguucgcuu

SEQ ID NO: 3944279 - RNA, 15 nt, Shigella flexneri 2a str. 301
cugcguuucuggcuu

SEQ ID NO: 3944280 - RNA, 15 nt, Shigella flexneri 2a str. 301
cugcuaauauuuucg

SEQ ID NO: 3944281 - RNA, 21 nt, Shigella flexneri 2a str. 301
cugcuacggcaauucccagaa

SEQ ID NO: 3944282 - RNA, 22 nt, Shigella flexneri 2a str. 301
cugcuagggcgcguccggcguc

SEQ ID NO: 3944283 - RNA, 19 nt, Shigella flexneri 2a str. 301
cugcuauucaccagcaaau

SEQ ID NO: 3944284 - RNA, 16 nt, Shigella flexneri 2a str. 301
cugcucaaguaauaaa

SEQ ID NO: 3944285 - RNA, 12 nt, Shigella flexneri 2a str. 301
cugcucaaugga

SEQ ID NO: 3944286 - RNA, 15 nt, Shigella flexneri 2a str. 301
cugcucaaugucugu

SEQ ID NO: 3944287 - RNA, 21 nt, Shigella flexneri 2a str. 301
cugcucaguugcaucgucugu

SEQ ID NO: 3944288 - RNA, 14 nt, Shigella flexneri 2a str. 301
cugcucaucuggcg

SEQ ID NO: 3944289 - RNA, 16 nt, Shigella flexneri 2a str. 301
cugcuccagaaaauaa

SEQ ID NO: 3944290 - RNA, 13 nt, Shigella flexneri 2a str. 301
cugcuccagugca

SEQ ID NO: 3944291 - RNA, 15 nt, Shigella flexneri 2a str. 301
cugcuccagugcauc

SEQ ID NO: 3944292 - RNA, 17 nt, Shigella flexneri 2a str. 301
cugcuccauuagcccga

SEQ ID NO: 3944293 - RNA, 23 nt, Shigella flexneri 2a str. 301
cugcucccgaaccuuuucucaau

SEQ ID NO: 3944294 - RNA, 17 nt, Shigella flexneri 2a str. 301
cugcuccguaaaacuca

SEQ ID NO: 3944295 - RNA, 14 nt, Shigella flexneri 2a str. 301
cugcuccugcggcu

SEQ ID NO: 3944296 - RNA, 21 nt, Shigella flexneri 2a str. 301
cugcucgcagaaauaccccgc

SEQ ID NO: 3944297 - RNA, 23 nt, Shigella flexneri 2a str. 301
cugcucgcgguuaaguuccguga

SEQ ID NO: 3944298 - RNA, 16 nt, Shigella flexneri 2a str. 301
cugcucggucugcugg

SEQ ID NO: 3944299 - RNA, 18 nt, Shigella flexneri 2a str. 301
cugcucggucugcugggc

SEQ ID NO: 3944300 - RNA, 15 nt, Shigella flexneri 2a str. 301
cugcucgucagccgg

SEQ ID NO: 3944301 - RNA, 16 nt, Shigella flexneri 2a str. 301
cugcucguucagcacu

SEQ ID NO: 3944302 - RNA, 15 nt, Shigella flexneri 2a str. 301
cugcucugccagacg

SEQ ID NO: 3944303 - RNA, 13 nt, Shigella flexneri 2a str. 301
cugcucuucagua

SEQ ID NO: 3944304 - RNA, 18 nt, Shigella flexneri 2a str. 301
cugcucuuucagcaccgc

SEQ ID NO: 3944305 - RNA, 23 nt, Shigella flexneri 2a str. 301
cugcugacgcagauccugauuua

SEQ ID NO: 3944306 - RNA, 19 nt, Shigella flexneri 2a str. 301
cugcugacggcacuaccau

SEQ ID NO: 3944307 - RNA, 22 nt, Shigella flexneri 2a str. 301
cugcugacggugauaaucaucc

SEQ ID NO: 3944308 - RNA, 16 nt, Shigella flexneri 2a str. 301
cugcugauccagcuuc

SEQ ID NO: 3944309 - RNA, 12 nt, Shigella flexneri 2a str. 301
cugcugaucgcc

SEQ ID NO: 3944310 - RNA, 23 nt, Shigella flexneri 2a str. 301
cugcugaugcgccgcuaacgucu

SEQ ID NO: 3944311 - RNA, 22 nt, Shigella flexneri 2a str. 301
cugcugauuauccgcaucacuc

SEQ ID NO: 3944312 - RNA, 23 nt, Shigella flexneri 2a str. 301
cugcugcacgcccugauaaauca

SEQ ID NO: 3944313 - RNA, 20 nt, Shigella flexneri 2a str. 301
cugcugccacauuccucugu

SEQ ID NO: 3944314 - RNA, 11 nt, Shigella flexneri 2a str. 301
cugcugccgcu

SEQ ID NO: 3944315 - RNA, 11 nt, Shigella flexneri 2a str. 301
cugcugcggcg

SEQ ID NO: 3944316 - RNA, 16 nt, Shigella flexneri 2a str. 301
cugcugcguuccggca

SEQ ID NO: 3944317 - RNA, 16 nt, Shigella flexneri 2a str. 301
cugcuggaucugcggg

SEQ ID NO: 3944318 - RNA, 11 nt, Shigella flexneri 2a str. 301
cugcuggccug

SEQ ID NO: 3944319 - RNA, 15 nt, Shigella flexneri 2a str. 301
cugcuggccuggcug

SEQ ID NO: 3944320 - RNA, 19 nt, Shigella flexneri 2a str. 301
cugcuggcgaaauugcuga

SEQ ID NO: 3944321 - RNA, 22 nt, Shigella flexneri 2a str. 301
cugcuggcuguaaaauuauccu

SEQ ID NO: 3944322 - RNA, 17 nt, Shigella flexneri 2a str. 301
cugcuggggccaauacc

SEQ ID NO: 3944323 - RNA, 19 nt, Shigella flexneri 2a str. 301
cugcuggggccaauaccug

SEQ ID NO: 3944324 - RNA, 22 nt, Shigella flexneri 2a str. 301
cugcuggggccaauaccuguca

SEQ ID NO: 3944325 - RNA, 14 nt, Shigella flexneri 2a str. 301
cugcugguucugcg

SEQ ID NO: 3944326 - RNA, 19 nt, Shigella flexneri 2a str. 301
cugcuguuuuuucaggccc

SEQ ID NO: 3944327 - RNA, 17 nt, Shigella flexneri 2a str. 301
cugcuuaaaccauucca

SEQ ID NO: 3944328 - RNA, 15 nt, Shigella flexneri 2a str. 301
cugcuuaaauuucuu

SEQ ID NO: 3944329 - RNA, 16 nt, Shigella flexneri 2a str. 301
cugcuuaacugcgcuu

SEQ ID NO: 3944330 - RNA, 12 nt, Shigella flexneri 2a str. 301
cugcuuaauauu

SEQ ID NO: 3944331 - RNA, 22 nt, Shigella flexneri 2a str. 301
cugcuuacaggcugguuucucu

SEQ ID NO: 3944332 - RNA, 19 nt, Shigella flexneri 2a str. 301
cugcuuaguaaaaauagug

SEQ ID NO: 3944333 - RNA, 15 nt, Shigella flexneri 2a str. 301
cugcuuauagcgcau

SEQ ID NO: 3944334 - RNA, 17 nt, Shigella flexneri 2a str. 301
cugcuuaucaucacgca

SEQ ID NO: 3944335 - RNA, 20 nt, Shigella flexneri 2a str. 301
cugcuuaucgcccugcucca

SEQ ID NO: 3944336 - RNA, 20 nt, Shigella flexneri 2a str. 301
cugcuucacgcccagaucca

SEQ ID NO: 3944337 - RNA, 22 nt, Shigella flexneri 2a str. 301
cugcuucagccgcacuuuuuaa

SEQ ID NO: 3944338 - RNA, 24 nt, Shigella flexneri 2a str. 301
cugcuuccuuaaucccuggauuug

SEQ ID NO: 3944339 - RNA, 14 nt, Shigella flexneri 2a str. 301
cugcuucggucaga

SEQ ID NO: 3944340 - RNA, 15 nt, Shigella flexneri 2a str. 301
cugcuucggucagca

SEQ ID NO: 3944341 - RNA, 14 nt, Shigella flexneri 2a str. 301
cugcuucugccugg

SEQ ID NO: 3944342 - RNA, 21 nt, Shigella flexneri 2a str. 301
cugcuugaacgcaccgccacc

SEQ ID NO: 3944343 - RNA, 16 nt, Shigella flexneri 2a str. 301
cugcuugcccagcaaa

SEQ ID NO: 3944344 - RNA, 17 nt, Shigella flexneri 2a str. 301
cugcuugcccagcaaaa

SEQ ID NO: 3944345 - RNA, 17 nt, Shigella flexneri 2a str. 301
cugcuuguuccacuuca

SEQ ID NO: 3944346 - RNA, 18 nt, Shigella flexneri 2a str. 301
cugcuuguuccacuucau

SEQ ID NO: 3944347 - RNA, 15 nt, Shigella flexneri 2a str. 301
cugcuuuacgccagg

SEQ ID NO: 3944348 - RNA, 16 nt, Shigella flexneri 2a str. 301
cugcuuuaucagauca

SEQ ID NO: 3944349 - RNA, 17 nt, Shigella flexneri 2a str. 301
cugcuuuccgcuggcgu

SEQ ID NO: 3944350 - RNA, 20 nt, Shigella flexneri 2a str. 301
cugcuuucucccaguugugg

SEQ ID NO: 3944351 - RNA, 12 nt, Shigella flexneri 2a str. 301
cugcuuugccca

SEQ ID NO: 3944352 - RNA, 23 nt, Shigella flexneri 2a str. 301
cugcuuugcccacgcuuuucauc

SEQ ID NO: 3944353 - RNA, 22 nt, Shigella flexneri 2a str. 301
cugcuuuucccuccacuccggu

SEQ ID NO: 3944354 - RNA, 14 nt, Shigella flexneri 2a str. 301
cuggaaaaagugcc

SEQ ID NO: 3944355 - RNA, 19 nt, Shigella flexneri 2a str. 301
cuggaaaaccuucuuccug

SEQ ID NO: 3944356 - RNA, 13 nt, Shigella flexneri 2a str. 301
cuggaaagagaaa

SEQ ID NO: 3944357 - RNA, 17 nt, Shigella flexneri 2a str. 301
cuggaaagagaaaaccc

SEQ ID NO: 3944358 - RNA, 15 nt, Shigella flexneri 2a str. 301
cuggaaaucaauggu

SEQ ID NO: 3944359 - RNA, 16 nt, Shigella flexneri 2a str. 301
cuggaaaucaaugguc

SEQ ID NO: 3944360 - RNA, 17 nt, Shigella flexneri 2a str. 301
cuggaacagccggaugu

SEQ ID NO: 3944361 - RNA, 13 nt, Shigella flexneri 2a str. 301
cuggaaccacagc

SEQ ID NO: 3944362 - RNA, 15 nt, Shigella flexneri 2a str. 301
cuggaacgaacccga

SEQ ID NO: 3944363 - RNA, 13 nt, Shigella flexneri 2a str. 301
cuggaacgcuucu

SEQ ID NO: 3944364 - RNA, 18 nt, Shigella flexneri 2a str. 301
cuggaacuggcugccagc

SEQ ID NO: 3944365 - RNA, 14 nt, Shigella flexneri 2a str. 301
cuggaacuggcugu

SEQ ID NO: 3944366 - RNA, 20 nt, Shigella flexneri 2a str. 301
cuggaagagcgacaaucccu

SEQ ID NO: 3944367 - RNA, 21 nt, Shigella flexneri 2a str. 301
cuggaagaguuuguugagaug

SEQ ID NO: 3944368 - RNA, 23 nt, Shigella flexneri 2a str. 301
cuggaagcuggauuaacgcuggg

SEQ ID NO: 3944369 - RNA, 17 nt, Shigella flexneri 2a str. 301
cuggaaggguugaaaua

SEQ ID NO: 3944370 - RNA, 22 nt, Shigella flexneri 2a str. 301
cuggaagguaaggauaaaaaag

SEQ ID NO: 3944371 - RNA, 16 nt, Shigella flexneri 2a str. 301
cuggaauggaaacagc

SEQ ID NO: 3944372 - RNA, 19 nt, Shigella flexneri 2a str. 301
cuggaauuaagaauguuaa

SEQ ID NO: 3944373 - RNA, 22 nt, Shigella flexneri 2a str. 301
cuggaauuccuuucccuauuuu

SEQ ID NO: 3944374 - RNA, 22 nt, Shigella flexneri 2a str. 301
cuggacaacauuccugcugacg

SEQ ID NO: 3944375 - RNA, 18 nt, Shigella flexneri 2a str. 301
cuggacaacuucugaugu

SEQ ID NO: 3944376 - RNA, 16 nt, Shigella flexneri 2a str. 301
cuggaccauauuagcc

SEQ ID NO: 3944377 - RNA, 20 nt, Shigella flexneri 2a str. 301
cuggacguugcguugcagca

SEQ ID NO: 3944378 - RNA, 22 nt, Shigella flexneri 2a str. 301
cuggacguugcguugcagcagg

SEQ ID NO: 3944379 - RNA, 23 nt, Shigella flexneri 2a str. 301
cuggacguugcguugcagcagga

SEQ ID NO: 3944380 - RNA, 19 nt, Shigella flexneri 2a str. 301
cuggacguuugauuuuuaa

SEQ ID NO: 3944381 - RNA, 21 nt, Shigella flexneri 2a str. 301
cuggacucccagaacaacccg

SEQ ID NO: 3944382 - RNA, 16 nt, Shigella flexneri 2a str. 301
cuggacuugaaccagc

SEQ ID NO: 3944383 - RNA, 15 nt, Shigella flexneri 2a str. 301
cuggagcaaaaagcg

SEQ ID NO: 3944384 - RNA, 16 nt, Shigella flexneri 2a str. 301
cuggaguggugaaaca

SEQ ID NO: 3944385 - RNA, 23 nt, Shigella flexneri 2a str. 301
cuggaguuaaauuaauaaucaca

SEQ ID NO: 3944386 - RNA, 22 nt, Shigella flexneri 2a str. 301
cuggauaaggcguucacgccgc

SEQ ID NO: 3944387 - RNA, 18 nt, Shigella flexneri 2a str. 301
cuggauaaucacaauggu

SEQ ID NO: 3944388 - RNA, 21 nt, Shigella flexneri 2a str. 301
cuggauaaucacaauggucaa

SEQ ID NO: 3944389 - RNA, 15 nt, Shigella flexneri 2a str. 301
cuggauaaugaaguc

SEQ ID NO: 3944390 - RNA, 16 nt, Shigella flexneri 2a str. 301
cuggauagagcucauu

SEQ ID NO: 3944391 - RNA, 15 nt, Shigella flexneri 2a str. 301
cuggaucagacgcag

SEQ ID NO: 3944392 - RNA, 18 nt, Shigella flexneri 2a str. 301
cuggaugaaaaaauccca

SEQ ID NO: 3944393 - RNA, 13 nt, Shigella flexneri 2a str. 301
cuggaugaacaua

SEQ ID NO: 3944394 - RNA, 13 nt, Shigella flexneri 2a str. 301
cuggaugccagcg

SEQ ID NO: 3944395 - RNA, 17 nt, Shigella flexneri 2a str. 301
cuggauuaacgcugggg

SEQ ID NO: 3944396 - RNA, 16 nt, Shigella flexneri 2a str. 301
cuggauuacaaauaaa

SEQ ID NO: 3944397 - RNA, 15 nt, Shigella flexneri 2a str. 301
cuggauuucaauaac

SEQ ID NO: 3944398 - RNA, 22 nt, Shigella flexneri 2a str. 301
cuggauuucaauaacuccaucu

SEQ ID NO: 3944399 - RNA, 15 nt, Shigella flexneri 2a str. 301
cuggauuugugucag

SEQ ID NO: 3944400 - RNA, 13 nt, Shigella flexneri 2a str. 301
cuggcaaaaauaa

SEQ ID NO: 3944401 - RNA, 15 nt, Shigella flexneri 2a str. 301
cuggcaaacgucagc

SEQ ID NO: 3944402 - RNA, 21 nt, Shigella flexneri 2a str. 301
cuggcaagaucggugccgcca

SEQ ID NO: 3944403 - RNA, 15 nt, Shigella flexneri 2a str. 301
cuggcaagcugcugu

SEQ ID NO: 3944404 - RNA, 14 nt, Shigella flexneri 2a str. 301
cuggcaaucgccag

SEQ ID NO: 3944405 - RNA, 13 nt, Shigella flexneri 2a str. 301
cuggcaaugaccc

SEQ ID NO: 3944406 - RNA, 14 nt, Shigella flexneri 2a str. 301
cuggcacaacucgg

SEQ ID NO: 3944407 - RNA, 14 nt, Shigella flexneri 2a str. 301
cuggcaccaccugg

SEQ ID NO: 3944408 - RNA, 20 nt, Shigella flexneri 2a str. 301
cuggcaccuguaccagcccg

SEQ ID NO: 3944409 - RNA, 16 nt, Shigella flexneri 2a str. 301
cuggcacgaccuggca

SEQ ID NO: 3944410 - RNA, 14 nt, Shigella flexneri 2a str. 301
cuggcacugggauc

SEQ ID NO: 3944411 - RNA, 21 nt, Shigella flexneri 2a str. 301
cuggcagagaaagaaacgcca

SEQ ID NO: 3944412 - RNA, 19 nt, Shigella flexneri 2a str. 301
cuggcagauaaauuacugc

SEQ ID NO: 3944413 - RNA, 15 nt, Shigella flexneri 2a str. 301
cuggcagauccugaa

SEQ ID NO: 3944414 - RNA, 19 nt, Shigella flexneri 2a str. 301
cuggcaguggaauauaauu

SEQ ID NO: 3944415 - RNA, 23 nt, Shigella flexneri 2a str. 301
cuggcaucaccgcgaaauaauca

SEQ ID NO: 3944416 - RNA, 16 nt, Shigella flexneri 2a str. 301
cuggcaugcuguccag

SEQ ID NO: 3944417 - RNA, 21 nt, Shigella flexneri 2a str. 301
cuggcauuacggcauaacgcc

SEQ ID NO: 3944418 - RNA, 21 nt, Shigella flexneri 2a str. 301
cuggccacaaaccuuaaaugg

SEQ ID NO: 3944419 - RNA, 16 nt, Shigella flexneri 2a str. 301
cuggccauuucugcca

SEQ ID NO: 3944420 - RNA, 18 nt, Shigella flexneri 2a str. 301
cuggccauuucugccagu

SEQ ID NO: 3944421 - RNA, 15 nt, Shigella flexneri 2a str. 301
cuggcccaucgccag

SEQ ID NO: 3944422 - RNA, 16 nt, Shigella flexneri 2a str. 301
cuggcccaugccaguu

SEQ ID NO: 3944423 - RNA, 18 nt, Shigella flexneri 2a str. 301
cuggcccggaauggugcu

SEQ ID NO: 3944424 - RNA, 21 nt, Shigella flexneri 2a str. 301
cuggccuauuaugacuccagc

SEQ ID NO: 3944425 - RNA, 14 nt, Shigella flexneri 2a str. 301
cuggccuggcuggu

SEQ ID NO: 3944426 - RNA, 18 nt, Shigella flexneri 2a str. 301
cuggccuuuaauaugcca

SEQ ID NO: 3944427 - RNA, 17 nt, Shigella flexneri 2a str. 301
cuggcgaaccaggaaga

SEQ ID NO: 3944428 - RNA, 18 nt, Shigella flexneri 2a str. 301
cuggcgaacccaaccgug

SEQ ID NO: 3944429 - RNA, 17 nt, Shigella flexneri 2a str. 301
cuggcgaacgugcagga

SEQ ID NO: 3944430 - RNA, 17 nt, Shigella flexneri 2a str. 301
cuggcgaacucuuccgg

SEQ ID NO: 3944431 - RNA, 17 nt, Shigella flexneri 2a str. 301
cuggcgaaucaggaccg

SEQ ID NO: 3944432 - RNA, 14 nt, Shigella flexneri 2a str. 301
cuggcgacagcgaa

SEQ ID NO: 3944433 - RNA, 14 nt, Shigella flexneri 2a str. 301
cuggcgagauccgg

SEQ ID NO: 3944434 - RNA, 24 nt, Shigella flexneri 2a str. 301
cuggcgagcauuaauacaccgcug

SEQ ID NO: 3944435 - RNA, 16 nt, Shigella flexneri 2a str. 301
cuggcgagcgccagca

SEQ ID NO: 3944436 - RNA, 19 nt, Shigella flexneri 2a str. 301
cuggcgauauugccgcgau

SEQ ID NO: 3944437 - RNA, 13 nt, Shigella flexneri 2a str. 301
cuggcgaugcccc

SEQ ID NO: 3944438 - RNA, 14 nt, Shigella flexneri 2a str. 301
cuggcgauugucau

SEQ ID NO: 3944439 - RNA, 11 nt, Shigella flexneri 2a str. 301
cuggcgcacaa

SEQ ID NO: 3944440 - RNA, 20 nt, Shigella flexneri 2a str. 301
cuggcgcacguucugucgcu

SEQ ID NO: 3944441 - RNA, 12 nt, Shigella flexneri 2a str. 301
cuggcgcagcaa

SEQ ID NO: 3944442 - RNA, 13 nt, Shigella flexneri 2a str. 301
cuggcgcagcugc

SEQ ID NO: 3944443 - RNA, 18 nt, Shigella flexneri 2a str. 301
cuggcgcaggugauacug

SEQ ID NO: 3944444 - RNA, 19 nt, Shigella flexneri 2a str. 301
cuggcgcauuaacggcaag

SEQ ID NO: 3944445 - RNA, 16 nt, Shigella flexneri 2a str. 301
cuggcgcgaacagcac

SEQ ID NO: 3944446 - RNA, 22 nt, Shigella flexneri 2a str. 301
cuggcgcgaacagcacaucagc

SEQ ID NO: 3944447 - RNA, 21 nt, Shigella flexneri 2a str. 301
cuggcgcgaauagcuucuuca

SEQ ID NO: 3944448 - RNA, 15 nt, Shigella flexneri 2a str. 301
cuggcgcgacgcagg

SEQ ID NO: 3944449 - RNA, 11 nt, Shigella flexneri 2a str. 301
cuggcgcgcuc

SEQ ID NO: 3944450 - RNA, 20 nt, Shigella flexneri 2a str. 301
cuggcgcucaccauuuccgg

SEQ ID NO: 3944451 - RNA, 17 nt, Shigella flexneri 2a str. 301
cuggcggcaaugaaagc

SEQ ID NO: 3944452 - RNA, 12 nt, Shigella flexneri 2a str. 301
cuggcggcagca

SEQ ID NO: 3944453 - RNA, 14 nt, Shigella flexneri 2a str. 301
cuggcggcagcagg

SEQ ID NO: 3944454 - RNA, 13 nt, Shigella flexneri 2a str. 301
cuggcggcagugu

SEQ ID NO: 3944455 - RNA, 17 nt, Shigella flexneri 2a str. 301
cuggcgggaaguauugc

SEQ ID NO: 3944456 - RNA, 20 nt, Shigella flexneri 2a str. 301
cuggcgggaauaaaagccag

SEQ ID NO: 3944457 - RNA, 15 nt, Shigella flexneri 2a str. 301
cuggcguaacagcaa

SEQ ID NO: 3944458 - RNA, 16 nt, Shigella flexneri 2a str. 301
cuggcguacagagggc

SEQ ID NO: 3944459 - RNA, 17 nt, Shigella flexneri 2a str. 301
cuggcguacagagggca

SEQ ID NO: 3944460 - RNA, 19 nt, Shigella flexneri 2a str. 301
cuggcguacagagggcagg

SEQ ID NO: 3944461 - RNA, 16 nt, Shigella flexneri 2a str. 301
cuggcguacccaucaa

SEQ ID NO: 3944462 - RNA, 19 nt, Shigella flexneri 2a str. 301
cuggcguagccggugccga

SEQ ID NO: 3944463 - RNA, 15 nt, Shigella flexneri 2a str. 301
cuggcgucaaagcug

SEQ ID NO: 3944464 - RNA, 17 nt, Shigella flexneri 2a str. 301
cuggcgucaaagcugcu

SEQ ID NO: 3944465 - RNA, 16 nt, Shigella flexneri 2a str. 301
cuggcgucacgccgac

SEQ ID NO: 3944466 - RNA, 21 nt, Shigella flexneri 2a str. 301
cuggcgucacgccgaccagac

SEQ ID NO: 3944467 - RNA, 23 nt, Shigella flexneri 2a str. 301
cuggcgucacgccgaccagaccg

SEQ ID NO: 3944468 - RNA, 15 nt, Shigella flexneri 2a str. 301
cuggcgucugggcgu

SEQ ID NO: 3944469 - RNA, 17 nt, Shigella flexneri 2a str. 301
cuggcgugggcaucgau

SEQ ID NO: 3944470 - RNA, 14 nt, Shigella flexneri 2a str. 301
cuggcguguuucau

SEQ ID NO: 3944471 - RNA, 22 nt, Shigella flexneri 2a str. 301
cuggcguuucucgccacuaaag

SEQ ID NO: 3944472 - RNA, 14 nt, Shigella flexneri 2a str. 301
cuggcuaagaagcc

SEQ ID NO: 3944473 - RNA, 23 nt, Shigella flexneri 2a str. 301
cuggcuaagaagccuuuaucugg

SEQ ID NO: 3944474 - RNA, 14 nt, Shigella flexneri 2a str. 301
cuggcuaagccacc

SEQ ID NO: 3944475 - RNA, 15 nt, Shigella flexneri 2a str. 301
cuggcucguggcuga

SEQ ID NO: 3944476 - RNA, 14 nt, Shigella flexneri 2a str. 301
cuggcucugcacua

SEQ ID NO: 3944477 - RNA, 23 nt, Shigella flexneri 2a str. 301
cuggcugacauaaacaccagcaa

SEQ ID NO: 3944478 - RNA, 23 nt, Shigella flexneri 2a str. 301
cuggcugacggugaugaucgcgc

SEQ ID NO: 3944479 - RNA, 21 nt, Shigella flexneri 2a str. 301
cuggcugagcaaacaguucug

SEQ ID NO: 3944480 - RNA, 23 nt, Shigella flexneri 2a str. 301
cuggcugagcaaacaguucugca

SEQ ID NO: 3944481 - RNA, 17 nt, Shigella flexneri 2a str. 301
cuggcugcgcucugacu

SEQ ID NO: 3944482 - RNA, 15 nt, Shigella flexneri 2a str. 301
cuggcuggcaucuug

SEQ ID NO: 3944483 - RNA, 15 nt, Shigella flexneri 2a str. 301
cuggcugggcgucau

SEQ ID NO: 3944484 - RNA, 16 nt, Shigella flexneri 2a str. 301
cuggcuggugacgcgc

SEQ ID NO: 3944485 - RNA, 23 nt, Shigella flexneri 2a str. 301
cuggcuguaaaauuauccucuuc

SEQ ID NO: 3944486 - RNA, 19 nt, Shigella flexneri 2a str. 301
cuggcugucgaucuccggc

SEQ ID NO: 3944487 - RNA, 13 nt, Shigella flexneri 2a str. 301
cuggcuucccggc

SEQ ID NO: 3944488 - RNA, 16 nt, Shigella flexneri 2a str. 301
cugggaaaccuggaua

SEQ ID NO: 3944489 - RNA, 16 nt, Shigella flexneri 2a str. 301
cugggaaaucaccacc

SEQ ID NO: 3944490 - RNA, 19 nt, Shigella flexneri 2a str. 301
cugggaaaucaccaccagc

SEQ ID NO: 3944491 - RNA, 22 nt, Shigella flexneri 2a str. 301
cugggaaaucaccaccagcacc

SEQ ID NO: 3944492 - RNA, 20 nt, Shigella flexneri 2a str. 301
cugggagaacggacccgcga

SEQ ID NO: 3944493 - RNA, 17 nt, Shigella flexneri 2a str. 301
cugggaugaaagugaug

SEQ ID NO: 3944494 - RNA, 17 nt, Shigella flexneri 2a str. 301
cugggauggcaaaaccu

SEQ ID NO: 3944495 - RNA, 20 nt, Shigella flexneri 2a str. 301
cugggcaaaaucaucacucc

SEQ ID NO: 3944496 - RNA, 14 nt, Shigella flexneri 2a str. 301
cugggcaacaaaac

SEQ ID NO: 3944497 - RNA, 16 nt, Shigella flexneri 2a str. 301
cugggcaauggugaac

SEQ ID NO: 3944498 - RNA, 17 nt, Shigella flexneri 2a str. 301
cugggcaauggugaacu

SEQ ID NO: 3944499 - RNA, 18 nt, Shigella flexneri 2a str. 301
cugggcauugaaggcagc

SEQ ID NO: 3944500 - RNA, 19 nt, Shigella flexneri 2a str. 301
cugggcauugaaggcagca

SEQ ID NO: 3944501 - RNA, 14 nt, Shigella flexneri 2a str. 301
cugggccugcauau

SEQ ID NO: 3944502 - RNA, 17 nt, Shigella flexneri 2a str. 301
cugggccugcauaucgg

SEQ ID NO: 3944503 - RNA, 15 nt, Shigella flexneri 2a str. 301
cugggcgaaacagag

SEQ ID NO: 3944504 - RNA, 18 nt, Shigella flexneri 2a str. 301
cugggcgaagguggcgga

SEQ ID NO: 3944505 - RNA, 16 nt, Shigella flexneri 2a str. 301
cugggcgauuuccuuc

SEQ ID NO: 3944506 - RNA, 23 nt, Shigella flexneri 2a str. 301
cugggcggucuuguuacuggcua

SEQ ID NO: 3944507 - RNA, 17 nt, Shigella flexneri 2a str. 301
cugggcuucauccagca

SEQ ID NO: 3944508 - RNA, 23 nt, Shigella flexneri 2a str. 301
cugggcuucauccagcagugacu

SEQ ID NO: 3944509 - RNA, 16 nt, Shigella flexneri 2a str. 301
cuggggauagaaacag

SEQ ID NO: 3944510 - RNA, 22 nt, Shigella flexneri 2a str. 301
cuggggauagaaacagucugga

SEQ ID NO: 3944511 - RNA, 18 nt, Shigella flexneri 2a str. 301
cuggggcuugccagagca

SEQ ID NO: 3944512 - RNA, 17 nt, Shigella flexneri 2a str. 301
cuggggguucaucacca

SEQ ID NO: 3944513 - RNA, 14 nt, Shigella flexneri 2a str. 301
cugggguaccugga

SEQ ID NO: 3944514 - RNA, 15 nt, Shigella flexneri 2a str. 301
cugggguaccuggau

SEQ ID NO: 3944515 - RNA, 20 nt, Shigella flexneri 2a str. 301
cuggguaaaaauagggugcg

SEQ ID NO: 3944516 - RNA, 12 nt, Shigella flexneri 2a str. 301
cuggguaacacc

SEQ ID NO: 3944517 - RNA, 21 nt, Shigella flexneri 2a str. 301
cuggguuggguucacuuuccc

SEQ ID NO: 3944518 - RNA, 15 nt, Shigella flexneri 2a str. 301
cuggguuucgccugc

SEQ ID NO: 3944519 - RNA, 20 nt, Shigella flexneri 2a str. 301
cuggguuucgccugccagau

SEQ ID NO: 3944520 - RNA, 16 nt, Shigella flexneri 2a str. 301
cugguaaaccuuccac

SEQ ID NO: 3944521 - RNA, 21 nt, Shigella flexneri 2a str. 301
cugguaaccgaccuucacgcu

SEQ ID NO: 3944522 - RNA, 14 nt, Shigella flexneri 2a str. 301
cugguaaucaccac

SEQ ID NO: 3944523 - RNA, 14 nt, Shigella flexneri 2a str. 301
cugguaccagcacc

SEQ ID NO: 3944524 - RNA, 15 nt, Shigella flexneri 2a str. 301
cugguaccagcaccg

SEQ ID NO: 3944525 - RNA, 21 nt, Shigella flexneri 2a str. 301
cugguacgauucgcccgcagc

SEQ ID NO: 3944526 - RNA, 17 nt, Shigella flexneri 2a str. 301
cugguacuggugcaaaa

SEQ ID NO: 3944527 - RNA, 19 nt, Shigella flexneri 2a str. 301
cugguagcgggugaagaga

SEQ ID NO: 3944528 - RNA, 14 nt, Shigella flexneri 2a str. 301
cugguaguccagga

SEQ ID NO: 3944529 - RNA, 21 nt, Shigella flexneri 2a str. 301
cugguaguccaggaugugcgu

SEQ ID NO: 3944530 - RNA, 17 nt, Shigella flexneri 2a str. 301
cugguaguuguacaacu

SEQ ID NO: 3944531 - RNA, 21 nt, Shigella flexneri 2a str. 301
cugguaguuguacaacugcuu

SEQ ID NO: 3944532 - RNA, 20 nt, Shigella flexneri 2a str. 301
cuggucaguuucagccagga

SEQ ID NO: 3944533 - RNA, 21 nt, Shigella flexneri 2a str. 301
cuggucaugaaccugccgccu

SEQ ID NO: 3944534 - RNA, 16 nt, Shigella flexneri 2a str. 301
cugguccuucaucuuc

SEQ ID NO: 3944535 - RNA, 18 nt, Shigella flexneri 2a str. 301
cugguccuucaucuucaa

SEQ ID NO: 3944536 - RNA, 14 nt, Shigella flexneri 2a str. 301
cuggucgcgaugcu

SEQ ID NO: 3944537 - RNA, 21 nt, Shigella flexneri 2a str. 301
cuggucggcaaacugcugaug

SEQ ID NO: 3944538 - RNA, 20 nt, Shigella flexneri 2a str. 301
cuggucugaaucaacaccgg

SEQ ID NO: 3944539 - RNA, 22 nt, Shigella flexneri 2a str. 301
cuggucugacgcugaauacgca

SEQ ID NO: 3944540 - RNA, 17 nt, Shigella flexneri 2a str. 301
cuggugaccugggaaau

SEQ ID NO: 3944541 - RNA, 19 nt, Shigella flexneri 2a str. 301
cuggugacuuuugcccggc

SEQ ID NO: 3944542 - RNA, 21 nt, Shigella flexneri 2a str. 301
cuggugauugcaccgacuggc

SEQ ID NO: 3944543 - RNA, 20 nt, Shigella flexneri 2a str. 301
cuggugcaaaaccugguugg

SEQ ID NO: 3944544 - RNA, 22 nt, Shigella flexneri 2a str. 301
cuggugcaauuucagcguccug

SEQ ID NO: 3944545 - RNA, 15 nt, Shigella flexneri 2a str. 301
cuggugcagcggcuc

SEQ ID NO: 3944546 - RNA, 21 nt, Shigella flexneri 2a str. 301
cuggugccaagcuccagcauc

SEQ ID NO: 3944547 - RNA, 17 nt, Shigella flexneri 2a str. 301
cuggugcuaacagcaau

SEQ ID NO: 3944548 - RNA, 14 nt, Shigella flexneri 2a str. 301
cuggugcugaaaga

SEQ ID NO: 3944549 - RNA, 17 nt, Shigella flexneri 2a str. 301
cugguggaaaggacagu

SEQ ID NO: 3944550 - RNA, 17 nt, Shigella flexneri 2a str. 301
cugguggacaauacgcg

SEQ ID NO: 3944551 - RNA, 14 nt, Shigella flexneri 2a str. 301
cuggugggcggcgu

SEQ ID NO: 3944552 - RNA, 20 nt, Shigella flexneri 2a str. 301
cugguggugcgugcggcaaa

SEQ ID NO: 3944553 - RNA, 16 nt, Shigella flexneri 2a str. 301
cugguguaucugcugu

SEQ ID NO: 3944554 - RNA, 17 nt, Shigella flexneri 2a str. 301
cugguguauuguuggca

SEQ ID NO: 3944555 - RNA, 22 nt, Shigella flexneri 2a str. 301
cuggugucagcgugacuggcag

SEQ ID NO: 3944556 - RNA, 19 nt, Shigella flexneri 2a str. 301
cugguguucggcauucugc

SEQ ID NO: 3944557 - RNA, 23 nt, Shigella flexneri 2a str. 301
cugguguucuuuuacgcuaccau

SEQ ID NO: 3944558 - RNA, 20 nt, Shigella flexneri 2a str. 301
cugguguugaaaccgcuggg

SEQ ID NO: 3944559 - RNA, 23 nt, Shigella flexneri 2a str. 301
cugguuaccggcauauccaccac

SEQ ID NO: 3944560 - RNA, 16 nt, Shigella flexneri 2a str. 301
cugguuauauuucccc

SEQ ID NO: 3944561 - RNA, 23 nt, Shigella flexneri 2a str. 301
cugguuauauuuccccuguugca

SEQ ID NO: 3944562 - RNA, 16 nt, Shigella flexneri 2a str. 301
cugguucccaacaaca

SEQ ID NO: 3944563 - RNA, 17 nt, Shigella flexneri 2a str. 301
cugguucccaacaacag

SEQ ID NO: 3944564 - RNA, 16 nt, Shigella flexneri 2a str. 301
cugguuccugacuccu

SEQ ID NO: 3944565 - RNA, 17 nt, Shigella flexneri 2a str. 301
cugguuccugacuccug

SEQ ID NO: 3944566 - RNA, 15 nt, Shigella flexneri 2a str. 301
cugguucugcggguu

SEQ ID NO: 3944567 - RNA, 12 nt, Shigella flexneri 2a str. 301
cugguucuugcu

SEQ ID NO: 3944568 - RNA, 18 nt, Shigella flexneri 2a str. 301
cugguugauucauggcau

SEQ ID NO: 3944569 - RNA, 16 nt, Shigella flexneri 2a str. 301
cugguuuccgcuguug

SEQ ID NO: 3944570 - RNA, 22 nt, Shigella flexneri 2a str. 301
cugguuucggcguucauccugc

SEQ ID NO: 3944571 - RNA, 14 nt, Shigella flexneri 2a str. 301
cugguuugccacgu

SEQ ID NO: 3944572 - RNA, 20 nt, Shigella flexneri 2a str. 301
cugguuuucagcgaaacagc

SEQ ID NO: 3944573 - RNA, 15 nt, Shigella flexneri 2a str. 301
cugguuuugaacagc

SEQ ID NO: 3944574 - RNA, 21 nt, Shigella flexneri 2a str. 301
cugguuuuucgauuuaaauga

SEQ ID NO: 3944575 - RNA, 19 nt, Shigella flexneri 2a str. 301
cugguuuuucugaaaacug

SEQ ID NO: 3944576 - RNA, 22 nt, Shigella flexneri 2a str. 301
cuguaaaacgcgcccucagccc

SEQ ID NO: 3944577 - RNA, 14 nt, Shigella flexneri 2a str. 301
cuguaaaaggcgcc

SEQ ID NO: 3944578 - RNA, 19 nt, Shigella flexneri 2a str. 301
cuguaaaaggcgccauuuu

SEQ ID NO: 3944579 - RNA, 20 nt, Shigella flexneri 2a str. 301
cuguaaaaggcgccauuuuc

SEQ ID NO: 3944580 - RNA, 20 nt, Shigella flexneri 2a str. 301
cuguaaaauuauccucuuca

SEQ ID NO: 3944581 - RNA, 19 nt, Shigella flexneri 2a str. 301
cuguaaaugcugcuccagc

SEQ ID NO: 3944582 - RNA, 21 nt, Shigella flexneri 2a str. 301
cuguaacaaggugaaucaagc

SEQ ID NO: 3944583 - RNA, 15 nt, Shigella flexneri 2a str. 301
cuguaaccagcgcag

SEQ ID NO: 3944584 - RNA, 21 nt, Shigella flexneri 2a str. 301
cuguaacggagguacaaccgc

SEQ ID NO: 3944585 - RNA, 21 nt, Shigella flexneri 2a str. 301
cuguaacggugucguauucuc

SEQ ID NO: 3944586 - RNA, 21 nt, Shigella flexneri 2a str. 301
cuguaacguugcugcgccgag

SEQ ID NO: 3944587 - RNA, 14 nt, Shigella flexneri 2a str. 301
cuguaauccucuuu

SEQ ID NO: 3944588 - RNA, 13 nt, Shigella flexneri 2a str. 301
cuguaaugagaau

SEQ ID NO: 3944589 - RNA, 22 nt, Shigella flexneri 2a str. 301
cuguaaugucaucucuggcacg

SEQ ID NO: 3944590 - RNA, 23 nt, Shigella flexneri 2a str. 301
cuguaauugagaaccacaaugaa

SEQ ID NO: 3944591 - RNA, 12 nt, Shigella flexneri 2a str. 301
cuguaauugccg

SEQ ID NO: 3944592 - RNA, 19 nt, Shigella flexneri 2a str. 301
cuguaauuucacaccauca

SEQ ID NO: 3944593 - RNA, 17 nt, Shigella flexneri 2a str. 301
cuguacaggcuccugua

SEQ ID NO: 3944594 - RNA, 14 nt, Shigella flexneri 2a str. 301
cuguaccacaaccu

SEQ ID NO: 3944595 - RNA, 12 nt, Shigella flexneri 2a str. 301
cuguaccaccag

SEQ ID NO: 3944596 - RNA, 21 nt, Shigella flexneri 2a str. 301
cuguaccaccagaaucgccag

SEQ ID NO: 3944597 - RNA, 14 nt, Shigella flexneri 2a str. 301
cuguaccagcccgc

SEQ ID NO: 3944598 - RNA, 16 nt, Shigella flexneri 2a str. 301
cuguaccagcccgccu

SEQ ID NO: 3944599 - RNA, 21 nt, Shigella flexneri 2a str. 301
cuguaccagcggcuuccagca

SEQ ID NO: 3944600 - RNA, 16 nt, Shigella flexneri 2a str. 301
cuguaccccugauaau

SEQ ID NO: 3944601 - RNA, 12 nt, Shigella flexneri 2a str. 301
cuguaccugguu

SEQ ID NO: 3944602 - RNA, 19 nt, Shigella flexneri 2a str. 301
cuguaccuucagcggcagc

SEQ ID NO: 3944603 - RNA, 11 nt, Shigella flexneri 2a str. 301
cuguacggcag

SEQ ID NO: 3944604 - RNA, 15 nt, Shigella flexneri 2a str. 301
cuguacggcagugaa

SEQ ID NO: 3944605 - RNA, 17 nt, Shigella flexneri 2a str. 301
cuguacgguaauggcaa

SEQ ID NO: 3944606 - RNA, 13 nt, Shigella flexneri 2a str. 301
cuguacuuccugu

SEQ ID NO: 3944607 - RNA, 17 nt, Shigella flexneri 2a str. 301
cuguacuugagcccugg

SEQ ID NO: 3944608 - RNA, 23 nt, Shigella flexneri 2a str. 301
cuguagauaaaacacucuuuuug

SEQ ID NO: 3944609 - RNA, 19 nt, Shigella flexneri 2a str. 301
cuguaggccagauaagacg

SEQ ID NO: 3944610 - RNA, 18 nt, Shigella flexneri 2a str. 301
cuguaguacaaauuuuag

SEQ ID NO: 3944611 - RNA, 18 nt, Shigella flexneri 2a str. 301
cuguaguuguuaauguga

SEQ ID NO: 3944612 - RNA, 16 nt, Shigella flexneri 2a str. 301
cuguauacgcauauca

SEQ ID NO: 3944613 - RNA, 14 nt, Shigella flexneri 2a str. 301
cuguaucaggcuga

SEQ ID NO: 3944614 - RNA, 20 nt, Shigella flexneri 2a str. 301
cuguaucaggcugaaaaucu

SEQ ID NO: 3944615 - RNA, 13 nt, Shigella flexneri 2a str. 301
cuguaucccagcc

SEQ ID NO: 3944616 - RNA, 14 nt, Shigella flexneri 2a str. 301
cuguaucccagccc

SEQ ID NO: 3944617 - RNA, 23 nt, Shigella flexneri 2a str. 301
cuguaucccaguucgauuuccca

SEQ ID NO: 3944618 - RNA, 16 nt, Shigella flexneri 2a str. 301
cuguaucgucacuggu

SEQ ID NO: 3944619 - RNA, 18 nt, Shigella flexneri 2a str. 301
cuguauggccuggaagcu

SEQ ID NO: 3944620 - RNA, 14 nt, Shigella flexneri 2a str. 301
cuguauuacagagg

SEQ ID NO: 3944621 - RNA, 14 nt, Shigella flexneri 2a str. 301
cuguauuugucuca

SEQ ID NO: 3944622 - RNA, 11 nt, Shigella flexneri 2a str. 301
cugucaacugc

SEQ ID NO: 3944623 - RNA, 13 nt, Shigella flexneri 2a str. 301
cugucaauaaacg

SEQ ID NO: 3944624 - RNA, 21 nt, Shigella flexneri 2a str. 301
cugucaauaagugcuuuagcc

SEQ ID NO: 3944625 - RNA, 14 nt, Shigella flexneri 2a str. 301
cugucacccggcaa

SEQ ID NO: 3944626 - RNA, 17 nt, Shigella flexneri 2a str. 301
cugucagguaacaagcc

SEQ ID NO: 3944627 - RNA, 15 nt, Shigella flexneri 2a str. 301
cugucaguucaccau

SEQ ID NO: 3944628 - RNA, 13 nt, Shigella flexneri 2a str. 301
cugucauaacaca

SEQ ID NO: 3944629 - RNA, 14 nt, Shigella flexneri 2a str. 301
cugucauauuaucu

SEQ ID NO: 3944630 - RNA, 16 nt, Shigella flexneri 2a str. 301
cugucauuacgggcaa

SEQ ID NO: 3944631 - RNA, 19 nt, Shigella flexneri 2a str. 301
cuguccaaauccuucagca

SEQ ID NO: 3944632 - RNA, 22 nt, Shigella flexneri 2a str. 301
cuguccaaauccuucagcaacu

SEQ ID NO: 3944633 - RNA, 12 nt, Shigella flexneri 2a str. 301
cuguccacaccc

SEQ ID NO: 3944634 - RNA, 15 nt, Shigella flexneri 2a str. 301
cuguccaccacgcug

SEQ ID NO: 3944635 - RNA, 15 nt, Shigella flexneri 2a str. 301
cuguccagcacgccg

SEQ ID NO: 3944636 - RNA, 20 nt, Shigella flexneri 2a str. 301
cuguccauaccggacuccag

SEQ ID NO: 3944637 - RNA, 16 nt, Shigella flexneri 2a str. 301
cuguccgcuucaccac

SEQ ID NO: 3944638 - RNA, 18 nt, Shigella flexneri 2a str. 301
cuguccgcuucaccaccg

SEQ ID NO: 3944639 - RNA, 13 nt, Shigella flexneri 2a str. 301
cuguccggcacca

SEQ ID NO: 3944640 - RNA, 21 nt, Shigella flexneri 2a str. 301
cuguccugagugggcgucagc

SEQ ID NO: 3944641 - RNA, 23 nt, Shigella flexneri 2a str. 301
cugucgacaaagccgcaggcgug

SEQ ID NO: 3944642 - RNA, 13 nt, Shigella flexneri 2a str. 301
cugucgaggccaa

SEQ ID NO: 3944643 - RNA, 16 nt, Shigella flexneri 2a str. 301
cugucgauaaacucau

SEQ ID NO: 3944644 - RNA, 18 nt, Shigella flexneri 2a str. 301
cugucgcagcgugcucuc

SEQ ID NO: 3944645 - RNA, 17 nt, Shigella flexneri 2a str. 301
cugucggacgcugucac

SEQ ID NO: 3944646 - RNA, 20 nt, Shigella flexneri 2a str. 301
cugucggcaaaucaauagug

SEQ ID NO: 3944647 - RNA, 15 nt, Shigella flexneri 2a str. 301
cugucggcgguaagc

SEQ ID NO: 3944648 - RNA, 14 nt, Shigella flexneri 2a str. 301
cugucgggcagcgu

SEQ ID NO: 3944649 - RNA, 17 nt, Shigella flexneri 2a str. 301
cugucggguaagcgcca

SEQ ID NO: 3944650 - RNA, 20 nt, Shigella flexneri 2a str. 301
cugucggguaagcgccacaa

SEQ ID NO: 3944651 - RNA, 17 nt, Shigella flexneri 2a str. 301
cugucgggugcuuuuuu

SEQ ID NO: 3944652 - RNA, 20 nt, Shigella flexneri 2a str. 301
cugucgguuuguacucuucc

SEQ ID NO: 3944653 - RNA, 16 nt, Shigella flexneri 2a str. 301
cugucuaauggugaac

SEQ ID NO: 3944654 - RNA, 12 nt, Shigella flexneri 2a str. 301
cugucuaccagc

SEQ ID NO: 3944655 - RNA, 14 nt, Shigella flexneri 2a str. 301
cugucuaccagcac

SEQ ID NO: 3944656 - RNA, 21 nt, Shigella flexneri 2a str. 301
cugucucauuguguacauccu

SEQ ID NO: 3944657 - RNA, 14 nt, Shigella flexneri 2a str. 301
cugucuccacuaua

SEQ ID NO: 3944658 - RNA, 17 nt, Shigella flexneri 2a str. 301
cugucuccacuauaaaa

SEQ ID NO: 3944659 - RNA, 19 nt, Shigella flexneri 2a str. 301
cugucuccacuauaaaaaa

SEQ ID NO: 3944660 - RNA, 17 nt, Shigella flexneri 2a str. 301
cugucuccggcauccag

SEQ ID NO: 3944661 - RNA, 12 nt, Shigella flexneri 2a str. 301
cugucugcuucu

SEQ ID NO: 3944662 - RNA, 22 nt, Shigella flexneri 2a str. 301
cugucugcuucugccugggccu

SEQ ID NO: 3944663 - RNA, 21 nt, Shigella flexneri 2a str. 301
cugucuuaacgcaccaugcac

SEQ ID NO: 3944664 - RNA, 12 nt, Shigella flexneri 2a str. 301
cugucuucccug

SEQ ID NO: 3944665 - RNA, 12 nt, Shigella flexneri 2a str. 301
cugucuuccugu

SEQ ID NO: 3944666 - RNA, 18 nt, Shigella flexneri 2a str. 301
cugugaacucaggcugcc

SEQ ID NO: 3944667 - RNA, 17 nt, Shigella flexneri 2a str. 301
cugugacaacacuucau

SEQ ID NO: 3944668 - RNA, 18 nt, Shigella flexneri 2a str. 301
cugugacaacacuucaua

SEQ ID NO: 3944669 - RNA, 19 nt, Shigella flexneri 2a str. 301
cugugacaacacuucauag

SEQ ID NO: 3944670 - RNA, 19 nt, Shigella flexneri 2a str. 301
cugugacagcagcggcaga

SEQ ID NO: 3944671 - RNA, 17 nt, Shigella flexneri 2a str. 301
cugugacgacuuuuucc

SEQ ID NO: 3944672 - RNA, 16 nt, Shigella flexneri 2a str. 301
cugugcaaucgccgcu

SEQ ID NO: 3944673 - RNA, 18 nt, Shigella flexneri 2a str. 301
cugugcagccaaaaauga

SEQ ID NO: 3944674 - RNA, 23 nt, Shigella flexneri 2a str. 301
cugugcauuuggcgcaucgguca

SEQ ID NO: 3944675 - RNA, 18 nt, Shigella flexneri 2a str. 301
cugugccacggcuuugca

SEQ ID NO: 3944676 - RNA, 15 nt, Shigella flexneri 2a str. 301
cugugccgcugacau

SEQ ID NO: 3944677 - RNA, 14 nt, Shigella flexneri 2a str. 301
cugugccggaaggg

SEQ ID NO: 3944678 - RNA, 19 nt, Shigella flexneri 2a str. 301
cugugcucugggccaugau

SEQ ID NO: 3944679 - RNA, 11 nt, Shigella flexneri 2a str. 301
cugugcugccg

SEQ ID NO: 3944680 - RNA, 20 nt, Shigella flexneri 2a str. 301
cugugcugguacuggugcaa

SEQ ID NO: 3944681 - RNA, 21 nt, Shigella flexneri 2a str. 301
cugugcuuuacaccaugccac

SEQ ID NO: 3944682 - RNA, 16 nt, Shigella flexneri 2a str. 301
cuguggaacaucaccc

SEQ ID NO: 3944683 - RNA, 15 nt, Shigella flexneri 2a str. 301
cugugguagcggcuc

SEQ ID NO: 3944684 - RNA, 16 nt, Shigella flexneri 2a str. 301
cuguggugucuuucuc

SEQ ID NO: 3944685 - RNA, 21 nt, Shigella flexneri 2a str. 301
cuguguaaugaauggaguugu

SEQ ID NO: 3944686 - RNA, 20 nt, Shigella flexneri 2a str. 301
cugugucaggccggcauaua

SEQ ID NO: 3944687 - RNA, 16 nt, Shigella flexneri 2a str. 301
cuguguggccugcuuu

SEQ ID NO: 3944688 - RNA, 17 nt, Shigella flexneri 2a str. 301
cuguguuuaugccggau

SEQ ID NO: 3944689 - RNA, 21 nt, Shigella flexneri 2a str. 301
cuguuaagaagggcuggccaa

SEQ ID NO: 3944690 - RNA, 17 nt, Shigella flexneri 2a str. 301
cuguuaaggaaauccug

SEQ ID NO: 3944691 - RNA, 19 nt, Shigella flexneri 2a str. 301
cuguuaauguuguaagcuu

SEQ ID NO: 3944692 - RNA, 16 nt, Shigella flexneri 2a str. 301
cuguuaccccugcggc

SEQ ID NO: 3944693 - RNA, 20 nt, Shigella flexneri 2a str. 301
cuguuacgccagaacagcua

SEQ ID NO: 3944694 - RNA, 15 nt, Shigella flexneri 2a str. 301
cuguuacucaacuga

SEQ ID NO: 3944695 - RNA, 14 nt, Shigella flexneri 2a str. 301
cuguuacugucggc

SEQ ID NO: 3944696 - RNA, 16 nt, Shigella flexneri 2a str. 301
cuguucacuuuugcug

SEQ ID NO: 3944697 - RNA, 11 nt, Shigella flexneri 2a str. 301
cuguucagcaa

SEQ ID NO: 3944698 - RNA, 14 nt, Shigella flexneri 2a str. 301
cuguucauagccac

SEQ ID NO: 3944699 - RNA, 16 nt, Shigella flexneri 2a str. 301
cuguucaucgacagaa

SEQ ID NO: 3944700 - RNA, 21 nt, Shigella flexneri 2a str. 301
cuguuccagacgcugcauuga

SEQ ID NO: 3944701 - RNA, 11 nt, Shigella flexneri 2a str. 301
cuguuccagca

SEQ ID NO: 3944702 - RNA, 15 nt, Shigella flexneri 2a str. 301
cuguuccuaucuuca

SEQ ID NO: 3944703 - RNA, 20 nt, Shigella flexneri 2a str. 301
cuguucugccguccagccgg

SEQ ID NO: 3944704 - RNA, 18 nt, Shigella flexneri 2a str. 301
cuguucuggcguaacagc

SEQ ID NO: 3944705 - RNA, 21 nt, Shigella flexneri 2a str. 301
cuguucuuuuaacgcaugcac

SEQ ID NO: 3944706 - RNA, 15 nt, Shigella flexneri 2a str. 301
cuguugaaauuauug

SEQ ID NO: 3944707 - RNA, 21 nt, Shigella flexneri 2a str. 301
cuguugacguccagcccuucu

SEQ ID NO: 3944708 - RNA, 21 nt, Shigella flexneri 2a str. 301
cuguugcaagacgaugacauu

SEQ ID NO: 3944709 - RNA, 20 nt, Shigella flexneri 2a str. 301
cuguugcccaugcuucugca

SEQ ID NO: 3944710 - RNA, 17 nt, Shigella flexneri 2a str. 301
cuguugccugcacucag

SEQ ID NO: 3944711 - RNA, 18 nt, Shigella flexneri 2a str. 301
cuguugccugcacucagg

SEQ ID NO: 3944712 - RNA, 15 nt, Shigella flexneri 2a str. 301
cuguugcugaagaaa

SEQ ID NO: 3944713 - RNA, 19 nt, Shigella flexneri 2a str. 301
cuguuggugccagauagcc

SEQ ID NO: 3944714 - RNA, 12 nt, Shigella flexneri 2a str. 301
cuguugguucag

SEQ ID NO: 3944715 - RNA, 15 nt, Shigella flexneri 2a str. 301
cuguugguucagugg

SEQ ID NO: 3944716 - RNA, 19 nt, Shigella flexneri 2a str. 301
cuguugucugaaugauaac

SEQ ID NO: 3944717 - RNA, 19 nt, Shigella flexneri 2a str. 301
cuguugucuuuccagacuc

SEQ ID NO: 3944718 - RNA, 13 nt, Shigella flexneri 2a str. 301
cuguugugaugca

SEQ ID NO: 3944719 - RNA, 16 nt, Shigella flexneri 2a str. 301
cuguuuaaccgcuuca

SEQ ID NO: 3944720 - RNA, 16 nt, Shigella flexneri 2a str. 301
cuguuuagccgcuucu

SEQ ID NO: 3944721 - RNA, 15 nt, Shigella flexneri 2a str. 301
cuguuuaucuuccca

SEQ ID NO: 3944722 - RNA, 17 nt, Shigella flexneri 2a str. 301
cuguuuaucuucccagc

SEQ ID NO: 3944723 - RNA, 19 nt, Shigella flexneri 2a str. 301
cuguuuaucuucccagcgc

SEQ ID NO: 3944724 - RNA, 18 nt, Shigella flexneri 2a str. 301
cuguuucaggaacaccgc

SEQ ID NO: 3944725 - RNA, 14 nt, Shigella flexneri 2a str. 301
cuguuucuggauga

SEQ ID NO: 3944726 - RNA, 21 nt, Shigella flexneri 2a str. 301
cuguuucuggaugauccuggc

SEQ ID NO: 3944727 - RNA, 20 nt, Shigella flexneri 2a str. 301
cuguuugcgucagcuucaga

SEQ ID NO: 3944728 - RNA, 19 nt, Shigella flexneri 2a str. 301
cuguuuuaccugcgccggu

SEQ ID NO: 3944729 - RNA, 16 nt, Shigella flexneri 2a str. 301
cuuaaaaaccagagaa

SEQ ID NO: 3944730 - RNA, 17 nt, Shigella flexneri 2a str. 301
cuuaaacaguacgagag

SEQ ID NO: 3944731 - RNA, 22 nt, Shigella flexneri 2a str. 301
cuuaaacaguacgagagaagag

SEQ ID NO: 3944732 - RNA, 17 nt, Shigella flexneri 2a str. 301
cuuaaaggggugaaaaa

SEQ ID NO: 3944733 - RNA, 19 nt, Shigella flexneri 2a str. 301
cuuaaaggggugaaaaaaa

SEQ ID NO: 3944734 - RNA, 21 nt, Shigella flexneri 2a str. 301
cuuaaaggggugaaaaaaacu

SEQ ID NO: 3944735 - RNA, 21 nt, Shigella flexneri 2a str. 301
cuuaaaugcacccgccagaga

SEQ ID NO: 3944736 - RNA, 12 nt, Shigella flexneri 2a str. 301
cuuaaauggccc

SEQ ID NO: 3944737 - RNA, 15 nt, Shigella flexneri 2a str. 301
cuuaaauuaagaagu

SEQ ID NO: 3944738 - RNA, 22 nt, Shigella flexneri 2a str. 301
cuuaaauuucuuaccacugccg

SEQ ID NO: 3944739 - RNA, 12 nt, Shigella flexneri 2a str. 301
cuuaacacugag

SEQ ID NO: 3944740 - RNA, 19 nt, Shigella flexneri 2a str. 301
cuuaacauccaucgccagc

SEQ ID NO: 3944741 - RNA, 18 nt, Shigella flexneri 2a str. 301
cuuaacgcgggcuucuuc

SEQ ID NO: 3944742 - RNA, 20 nt, Shigella flexneri 2a str. 301
cuuaacgcgggcuucuucuu

SEQ ID NO: 3944743 - RNA, 20 nt, Shigella flexneri 2a str. 301
cuuaacggcgaaaaauauuu

SEQ ID NO: 3944744 - RNA, 15 nt, Shigella flexneri 2a str. 301
cuuaacucgcugaau

SEQ ID NO: 3944745 - RNA, 17 nt, Shigella flexneri 2a str. 301
cuuaacucgcugaauaa

SEQ ID NO: 3944746 - RNA, 14 nt, Shigella flexneri 2a str. 301
cuuaacucuuccug

SEQ ID NO: 3944747 - RNA, 21 nt, Shigella flexneri 2a str. 301
cuuaacuguaugcaugcagcg

SEQ ID NO: 3944748 - RNA, 18 nt, Shigella flexneri 2a str. 301
cuuaacugucgcugaagu

SEQ ID NO: 3944749 - RNA, 20 nt, Shigella flexneri 2a str. 301
cuuaacuucgcagcuuauuu

SEQ ID NO: 3944750 - RNA, 22 nt, Shigella flexneri 2a str. 301
cuuaagccgcuguguguaggcc

SEQ ID NO: 3944751 - RNA, 14 nt, Shigella flexneri 2a str. 301
cuuaaggucacaga

SEQ ID NO: 3944752 - RNA, 18 nt, Shigella flexneri 2a str. 301
cuuaaucaauugcaggaa

SEQ ID NO: 3944753 - RNA, 17 nt, Shigella flexneri 2a str. 301
cuuaaucagaauuuuuc

SEQ ID NO: 3944754 - RNA, 15 nt, Shigella flexneri 2a str. 301
cuuaaucagacuggc

SEQ ID NO: 3944755 - RNA, 16 nt, Shigella flexneri 2a str. 301
cuuaaucaucaaugcc

SEQ ID NO: 3944756 - RNA, 14 nt, Shigella flexneri 2a str. 301
cuuaaucgcuucuu

SEQ ID NO: 3944757 - RNA, 12 nt, Shigella flexneri 2a str. 301
cuuaaucugcca

SEQ ID NO: 3944758 - RNA, 14 nt, Shigella flexneri 2a str. 301
cuuaaucugccaga

SEQ ID NO: 3944759 - RNA, 19 nt, Shigella flexneri 2a str. 301
cuuaaucugccagaaggau

SEQ ID NO: 3944760 - RNA, 22 nt, Shigella flexneri 2a str. 301
cuuaaugaaucaucguucauau

SEQ ID NO: 3944761 - RNA, 20 nt, Shigella flexneri 2a str. 301
cuuaaugcaggcagcacugc

SEQ ID NO: 3944762 - RNA, 19 nt, Shigella flexneri 2a str. 301
cuuaaugcccaucucuucu

SEQ ID NO: 3944763 - RNA, 21 nt, Shigella flexneri 2a str. 301
cuuaaugcccaucucuucuuc

SEQ ID NO: 3944764 - RNA, 17 nt, Shigella flexneri 2a str. 301
cuuaauugcgcaacuga

SEQ ID NO: 3944765 - RNA, 22 nt, Shigella flexneri 2a str. 301
cuuacaaguaagcgucgucuca

SEQ ID NO: 3944766 - RNA, 15 nt, Shigella flexneri 2a str. 301
cuuacacucaaauau

SEQ ID NO: 3944767 - RNA, 20 nt, Shigella flexneri 2a str. 301
cuuacacucaaauaucuaua

SEQ ID NO: 3944768 - RNA, 24 nt, Shigella flexneri 2a str. 301
cuuacagaaaugguaaagaaggca

SEQ ID NO: 3944769 - RNA, 21 nt, Shigella flexneri 2a str. 301
cuuaccacagacaaaauccug

SEQ ID NO: 3944770 - RNA, 17 nt, Shigella flexneri 2a str. 301
cuuaccgcgucuuauca

SEQ ID NO: 3944771 - RNA, 20 nt, Shigella flexneri 2a str. 301
cuuaccggucccuucaaucu

SEQ ID NO: 3944772 - RNA, 23 nt, Shigella flexneri 2a str. 301
cuuaccguuuacgcuuuccagca

SEQ ID NO: 3944773 - RNA, 14 nt, Shigella flexneri 2a str. 301
cuuaccuucacgaa

SEQ ID NO: 3944774 - RNA, 17 nt, Shigella flexneri 2a str. 301
cuuacgcaacugccagu

SEQ ID NO: 3944775 - RNA, 13 nt, Shigella flexneri 2a str. 301
cuuacgcgucaga

SEQ ID NO: 3944776 - RNA, 13 nt, Shigella flexneri 2a str. 301
cuuacggauaauu

SEQ ID NO: 3944777 - RNA, 19 nt, Shigella flexneri 2a str. 301
cuuacggcacuccucuuca

SEQ ID NO: 3944778 - RNA, 17 nt, Shigella flexneri 2a str. 301
cuuacggcugcggaugu

SEQ ID NO: 3944779 - RNA, 16 nt, Shigella flexneri 2a str. 301
cuuacggcuuuuaauc

SEQ ID NO: 3944780 - RNA, 17 nt, Shigella flexneri 2a str. 301
cuuacguaauuuauaau

SEQ ID NO: 3944781 - RNA, 20 nt, Shigella flexneri 2a str. 301
cuuacguuacccagcacgga

SEQ ID NO: 3944782 - RNA, 22 nt, Shigella flexneri 2a str. 301
cuuacucauaaauacuccauaa

SEQ ID NO: 3944783 - RNA, 22 nt, Shigella flexneri 2a str. 301
cuuacucauuaaugcacuucca

SEQ ID NO: 3944784 - RNA, 16 nt, Shigella flexneri 2a str. 301
cuuagcaacaggccag

SEQ ID NO: 3944785 - RNA, 14 nt, Shigella flexneri 2a str. 301
cuuagccuguguca

SEQ ID NO: 3944786 - RNA, 15 nt, Shigella flexneri 2a str. 301
cuuaggggacauuua

SEQ ID NO: 3944787 - RNA, 16 nt, Shigella flexneri 2a str. 301
cuuaggggacauuuag

SEQ ID NO: 3944788 - RNA, 17 nt, Shigella flexneri 2a str. 301
cuuagguaaugacucca

SEQ ID NO: 3944789 - RNA, 20 nt, Shigella flexneri 2a str. 301
cuuauaaaccacgcaauaaa

SEQ ID NO: 3944790 - RNA, 16 nt, Shigella flexneri 2a str. 301
cuuauaaagaaaaucu

SEQ ID NO: 3944791 - RNA, 17 nt, Shigella flexneri 2a str. 301
cuuauaaagaaaaucug

SEQ ID NO: 3944792 - RNA, 18 nt, Shigella flexneri 2a str. 301
cuuauaaagaaaaucuga

SEQ ID NO: 3944793 - RNA, 21 nt, Shigella flexneri 2a str. 301
cuuauaaagaaaaucugaauu

SEQ ID NO: 3944794 - RNA, 18 nt, Shigella flexneri 2a str. 301
cuuauaaggaaccuccau

SEQ ID NO: 3944795 - RNA, 13 nt, Shigella flexneri 2a str. 301
cuuauaagucuca

SEQ ID NO: 3944796 - RNA, 20 nt, Shigella flexneri 2a str. 301
cuuauacggcuggauuucgc

SEQ ID NO: 3944797 - RNA, 22 nt, Shigella flexneri 2a str. 301
cuuauauauuaaucaucauuaa

SEQ ID NO: 3944798 - RNA, 13 nt, Shigella flexneri 2a str. 301
cuuaucaaucuca

SEQ ID NO: 3944799 - RNA, 17 nt, Shigella flexneri 2a str. 301
cuuaucaaucucagcaa

SEQ ID NO: 3944800 - RNA, 11 nt, Shigella flexneri 2a str. 301
cuuaucaggcc

SEQ ID NO: 3944801 - RNA, 12 nt, Shigella flexneri 2a str. 301
cuuaucaggccu

SEQ ID NO: 3944802 - RNA, 19 nt, Shigella flexneri 2a str. 301
cuuaucaggccuacaaguc

SEQ ID NO: 3944803 - RNA, 20 nt, Shigella flexneri 2a str. 301
cuuaucaggccuaccaauaa

SEQ ID NO: 3944804 - RNA, 23 nt, Shigella flexneri 2a str. 301
cuuaucaggccuguggugauuca

SEQ ID NO: 3944805 - RNA, 17 nt, Shigella flexneri 2a str. 301
cuuaucaugccuacaua

SEQ ID NO: 3944806 - RNA, 22 nt, Shigella flexneri 2a str. 301
cuuauccgacauuucugcugcc

SEQ ID NO: 3944807 - RNA, 17 nt, Shigella flexneri 2a str. 301
cuuauccgaccuacaaa

SEQ ID NO: 3944808 - RNA, 19 nt, Shigella flexneri 2a str. 301
cuuauccggccuacaaaau

SEQ ID NO: 3944809 - RNA, 18 nt, Shigella flexneri 2a str. 301
cuuaucgcccugcuccag

SEQ ID NO: 3944810 - RNA, 20 nt, Shigella flexneri 2a str. 301
cuuaucgcccugcuccagca

SEQ ID NO: 3944811 - RNA, 11 nt, Shigella flexneri 2a str. 301
cuuaucuggcc

SEQ ID NO: 3944812 - RNA, 22 nt, Shigella flexneri 2a str. 301
cuuauggcucgccauccaguga

SEQ ID NO: 3944813 - RNA, 13 nt, Shigella flexneri 2a str. 301
cuuauguugcuua

SEQ ID NO: 3944814 - RNA, 16 nt, Shigella flexneri 2a str. 301
cuuauuaacuucccac

SEQ ID NO: 3944815 - RNA, 18 nt, Shigella flexneri 2a str. 301
cuuauucaaucucuucac

SEQ ID NO: 3944816 - RNA, 19 nt, Shigella flexneri 2a str. 301
cuuauucuucaacaauuga

SEQ ID NO: 3944817 - RNA, 13 nt, Shigella flexneri 2a str. 301
cuuauugaagcuc

SEQ ID NO: 3944818 - RNA, 13 nt, Shigella flexneri 2a str. 301
cuucaaacgcuga

SEQ ID NO: 3944819 - RNA, 19 nt, Shigella flexneri 2a str. 301
cuucaaauagugccuggcu

SEQ ID NO: 3944820 - RNA, 21 nt, Shigella flexneri 2a str. 301
cuucaaaucgacgcgugaaaa

SEQ ID NO: 3944821 - RNA, 16 nt, Shigella flexneri 2a str. 301
cuucaacacuggcaaa

SEQ ID NO: 3944822 - RNA, 14 nt, Shigella flexneri 2a str. 301
cuucaaccacauuc

SEQ ID NO: 3944823 - RNA, 23 nt, Shigella flexneri 2a str. 301
cuucaaccgucgcgcccuccugc

SEQ ID NO: 3944824 - RNA, 18 nt, Shigella flexneri 2a str. 301
cuucaacgauuucucagc

SEQ ID NO: 3944825 - RNA, 14 nt, Shigella flexneri 2a str. 301
cuucaacgcaagaa

SEQ ID NO: 3944826 - RNA, 18 nt, Shigella flexneri 2a str. 301
cuucaagccaggcuuuaa

SEQ ID NO: 3944827 - RNA, 19 nt, Shigella flexneri 2a str. 301
cuucaaguguggccgccag

SEQ ID NO: 3944828 - RNA, 20 nt, Shigella flexneri 2a str. 301
cuucaaguguggccgccagu

SEQ ID NO: 3944829 - RNA, 19 nt, Shigella flexneri 2a str. 301
cuucaauagcaguccauua

SEQ ID NO: 3944830 - RNA, 12 nt, Shigella flexneri 2a str. 301
cuucaaucaaua

SEQ ID NO: 3944831 - RNA, 13 nt, Shigella flexneri 2a str. 301
cuucaaucaauaa

SEQ ID NO: 3944832 - RNA, 13 nt, Shigella flexneri 2a str. 301
cuucaaucgccac

SEQ ID NO: 3944833 - RNA, 16 nt, Shigella flexneri 2a str. 301
cuucaaucgccaccac

SEQ ID NO: 3944834 - RNA, 12 nt, Shigella flexneri 2a str. 301
cuucaaugcugc

SEQ ID NO: 3944835 - RNA, 14 nt, Shigella flexneri 2a str. 301
cuucaauggucagc

SEQ ID NO: 3944836 - RNA, 16 nt, Shigella flexneri 2a str. 301
cuucacaaaggcuugc

SEQ ID NO: 3944837 - RNA, 16 nt, Shigella flexneri 2a str. 301
cuucacaaucagcgcg

SEQ ID NO: 3944838 - RNA, 19 nt, Shigella flexneri 2a str. 301
cuucacacacuuuuauuaa

SEQ ID NO: 3944839 - RNA, 12 nt, Shigella flexneri 2a str. 301
cuucacacugau

SEQ ID NO: 3944840 - RNA, 21 nt, Shigella flexneri 2a str. 301
cuucacacugaugacaggcua

SEQ ID NO: 3944841 - RNA, 18 nt, Shigella flexneri 2a str. 301
cuucacagaaggccagga

SEQ ID NO: 3944842 - RNA, 12 nt, Shigella flexneri 2a str. 301
cuucacaggccg

SEQ ID NO: 3944843 - RNA, 12 nt, Shigella flexneri 2a str. 301
cuucaccagcag

SEQ ID NO: 3944844 - RNA, 16 nt, Shigella flexneri 2a str. 301
cuucacccgcagcacg

SEQ ID NO: 3944845 - RNA, 22 nt, Shigella flexneri 2a str. 301
cuucacccucacgcauucucuu

SEQ ID NO: 3944846 - RNA, 20 nt, Shigella flexneri 2a str. 301
cuucaccgauauccgccagg

SEQ ID NO: 3944847 - RNA, 19 nt, Shigella flexneri 2a str. 301
cuucaccgcuaaagcgguu

SEQ ID NO: 3944848 - RNA, 18 nt, Shigella flexneri 2a str. 301
cuucaccuuucagaacgg

SEQ ID NO: 3944849 - RNA, 15 nt, Shigella flexneri 2a str. 301
cuucacgcaguuuau

SEQ ID NO: 3944850 - RNA, 15 nt, Shigella flexneri 2a str. 301
cuucacgcccagauc

SEQ ID NO: 3944851 - RNA, 17 nt, Shigella flexneri 2a str. 301
cuucacgcccgccccag

SEQ ID NO: 3944852 - RNA, 20 nt, Shigella flexneri 2a str. 301
cuucacgcuaauaccggaug

SEQ ID NO: 3944853 - RNA, 21 nt, Shigella flexneri 2a str. 301
cuucacgcuuugcaggcuggu

SEQ ID NO: 3944854 - RNA, 23 nt, Shigella flexneri 2a str. 301
cuucacggcugcuaauauuuucg

SEQ ID NO: 3944855 - RNA, 13 nt, Shigella flexneri 2a str. 301
cuucacguuuuuc

SEQ ID NO: 3944856 - RNA, 20 nt, Shigella flexneri 2a str. 301
cuucacucuauagucuuuuc

SEQ ID NO: 3944857 - RNA, 17 nt, Shigella flexneri 2a str. 301
cuucacucucaccacgc

SEQ ID NO: 3944858 - RNA, 13 nt, Shigella flexneri 2a str. 301
cuucacucucuuu

SEQ ID NO: 3944859 - RNA, 14 nt, Shigella flexneri 2a str. 301
cuucacucucuuuu

SEQ ID NO: 3944860 - RNA, 17 nt, Shigella flexneri 2a str. 301
cuucacugacauugccu

SEQ ID NO: 3944861 - RNA, 14 nt, Shigella flexneri 2a str. 301
cuucacuggcgaca

SEQ ID NO: 3944862 - RNA, 15 nt, Shigella flexneri 2a str. 301
cuucacuuuugccag

SEQ ID NO: 3944863 - RNA, 16 nt, Shigella flexneri 2a str. 301
cuucacuuuugccaga

SEQ ID NO: 3944864 - RNA, 23 nt, Shigella flexneri 2a str. 301
cuucagaauauucgaaaucuguu

SEQ ID NO: 3944865 - RNA, 15 nt, Shigella flexneri 2a str. 301
cuucagacuccugaa

SEQ ID NO: 3944866 - RNA, 17 nt, Shigella flexneri 2a str. 301
cuucagauucagcgucg

SEQ ID NO: 3944867 - RNA, 14 nt, Shigella flexneri 2a str. 301
cuucagcaacaaaa

SEQ ID NO: 3944868 - RNA, 15 nt, Shigella flexneri 2a str. 301
cuucagcaacaaaau

SEQ ID NO: 3944869 - RNA, 17 nt, Shigella flexneri 2a str. 301
cuucagcaacaaaaugg

SEQ ID NO: 3944870 - RNA, 18 nt, Shigella flexneri 2a str. 301
cuucagcaacaaaauggc

SEQ ID NO: 3944871 - RNA, 14 nt, Shigella flexneri 2a str. 301
cuucagcagcccau

SEQ ID NO: 3944872 - RNA, 14 nt, Shigella flexneri 2a str. 301
cuucagcaguucag

SEQ ID NO: 3944873 - RNA, 23 nt, Shigella flexneri 2a str. 301
cuucagccaguuuuucagcgcca

SEQ ID NO: 3944874 - RNA, 23 nt, Shigella flexneri 2a str. 301
cuucagcccuuuaauggcuuuca

SEQ ID NO: 3944875 - RNA, 17 nt, Shigella flexneri 2a str. 301
cuucagccgcaaaccug

SEQ ID NO: 3944876 - RNA, 21 nt, Shigella flexneri 2a str. 301
cuucagccggaauaaucagau

SEQ ID NO: 3944877 - RNA, 22 nt, Shigella flexneri 2a str. 301
cuucagcgcuaccgccgaucuc

SEQ ID NO: 3944878 - RNA, 15 nt, Shigella flexneri 2a str. 301
cuucagcggcagcuu

SEQ ID NO: 3944879 - RNA, 16 nt, Shigella flexneri 2a str. 301
cuucagcguaucccag

SEQ ID NO: 3944880 - RNA, 19 nt, Shigella flexneri 2a str. 301
cuucagcguccauccacag

SEQ ID NO: 3944881 - RNA, 14 nt, Shigella flexneri 2a str. 301
cuucagcucccgcu

SEQ ID NO: 3944882 - RNA, 21 nt, Shigella flexneri 2a str. 301
cuucaggauguacgucauccg

SEQ ID NO: 3944883 - RNA, 14 nt, Shigella flexneri 2a str. 301
cuucaggcccugcu

SEQ ID NO: 3944884 - RNA, 20 nt, Shigella flexneri 2a str. 301
cuucaggcccugcuguuuuu

SEQ ID NO: 3944885 - RNA, 20 nt, Shigella flexneri 2a str. 301
cuucaggugcccaacauacu

SEQ ID NO: 3944886 - RNA, 16 nt, Shigella flexneri 2a str. 301
cuucagucaggcgauu

SEQ ID NO: 3944887 - RNA, 23 nt, Shigella flexneri 2a str. 301
cuucagucaggcgauuguuuaga

SEQ ID NO: 3944888 - RNA, 13 nt, Shigella flexneri 2a str. 301
cuucagucgccag

SEQ ID NO: 3944889 - RNA, 14 nt, Shigella flexneri 2a str. 301
cuucagucgccagc

SEQ ID NO: 3944890 - RNA, 18 nt, Shigella flexneri 2a str. 301
cuucagucgccagcgcca

SEQ ID NO: 3944891 - RNA, 16 nt, Shigella flexneri 2a str. 301
cuucaguuccgcugca

SEQ ID NO: 3944892 - RNA, 14 nt, Shigella flexneri 2a str. 301
cuucaguugccugg

SEQ ID NO: 3944893 - RNA, 19 nt, Shigella flexneri 2a str. 301
cuucaguugccugggugca

SEQ ID NO: 3944894 - RNA, 20 nt, Shigella flexneri 2a str. 301
cuucaguugcgccugauaau

SEQ ID NO: 3944895 - RNA, 16 nt, Shigella flexneri 2a str. 301
cuucauagugcgcggu

SEQ ID NO: 3944896 - RNA, 15 nt, Shigella flexneri 2a str. 301
cuucaucacgaugca

SEQ ID NO: 3944897 - RNA, 16 nt, Shigella flexneri 2a str. 301
cuucaucacgcagcgu

SEQ ID NO: 3944898 - RNA, 21 nt, Shigella flexneri 2a str. 301
cuucaucacgcagcgucagca

SEQ ID NO: 3944899 - RNA, 14 nt, Shigella flexneri 2a str. 301
cuucaucauccucu

SEQ ID NO: 3944900 - RNA, 22 nt, Shigella flexneri 2a str. 301
cuucaucauccuuugggcauuu

SEQ ID NO: 3944901 - RNA, 19 nt, Shigella flexneri 2a str. 301
cuucaucaucgcagauuuc

SEQ ID NO: 3944902 - RNA, 14 nt, Shigella flexneri 2a str. 301
cuucauccagcagu

SEQ ID NO: 3944903 - RNA, 15 nt, Shigella flexneri 2a str. 301
cuucauccagcagug

SEQ ID NO: 3944904 - RNA, 14 nt, Shigella flexneri 2a str. 301
cuucauccgccccg

SEQ ID NO: 3944905 - RNA, 17 nt, Shigella flexneri 2a str. 301
cuucaucgauacugcuc

SEQ ID NO: 3944906 - RNA, 13 nt, Shigella flexneri 2a str. 301
cuucaucgcccac

SEQ ID NO: 3944907 - RNA, 22 nt, Shigella flexneri 2a str. 301
cuucaucgccguugcggguggc

SEQ ID NO: 3944908 - RNA, 19 nt, Shigella flexneri 2a str. 301
cuucaugaguuccacuggu

SEQ ID NO: 3944909 - RNA, 20 nt, Shigella flexneri 2a str. 301
cuucaugcagcauggucagg

SEQ ID NO: 3944910 - RNA, 18 nt, Shigella flexneri 2a str. 301
cuucaugcgcagcauaau

SEQ ID NO: 3944911 - RNA, 17 nt, Shigella flexneri 2a str. 301
cuucauggggaugcuga

SEQ ID NO: 3944912 - RNA, 16 nt, Shigella flexneri 2a str. 301
cuucauuaaccacgau

SEQ ID NO: 3944913 - RNA, 20 nt, Shigella flexneri 2a str. 301
cuucauucgcgccagauggc

SEQ ID NO: 3944914 - RNA, 20 nt, Shigella flexneri 2a str. 301
cuucauugaacgggugauuu

SEQ ID NO: 3944915 - RNA, 15 nt, Shigella flexneri 2a str. 301
cuucauugcucucuu

SEQ ID NO: 3944916 - RNA, 12 nt, Shigella flexneri 2a str. 301
cuucauuggcgc

SEQ ID NO: 3944917 - RNA, 16 nt, Shigella flexneri 2a str. 301
cuucauuugccagcuu

SEQ ID NO: 3944918 - RNA, 16 nt, Shigella flexneri 2a str. 301
cuuccacaauggcaua

SEQ ID NO: 3944919 - RNA, 18 nt, Shigella flexneri 2a str. 301
cuuccacaccacuuccga

SEQ ID NO: 3944920 - RNA, 13 nt, Shigella flexneri 2a str. 301
cuuccaccacuuc

SEQ ID NO: 3944921 - RNA, 17 nt, Shigella flexneri 2a str. 301
cuuccaccacuuccugc

SEQ ID NO: 3944922 - RNA, 14 nt, Shigella flexneri 2a str. 301
cuuccaccagcggc

SEQ ID NO: 3944923 - RNA, 23 nt, Shigella flexneri 2a str. 301
cuuccaccuggaaccaggcgcga

SEQ ID NO: 3944924 - RNA, 13 nt, Shigella flexneri 2a str. 301
cuuccacgccugc

SEQ ID NO: 3944925 - RNA, 16 nt, Shigella flexneri 2a str. 301
cuuccagaauaaacaa

SEQ ID NO: 3944926 - RNA, 21 nt, Shigella flexneri 2a str. 301
cuuccagacucugaaacucga

SEQ ID NO: 3944927 - RNA, 22 nt, Shigella flexneri 2a str. 301
cuuccagagcagcgaauuucuc

SEQ ID NO: 3944928 - RNA, 14 nt, Shigella flexneri 2a str. 301
cuuccagauucagu

SEQ ID NO: 3944929 - RNA, 11 nt, Shigella flexneri 2a str. 301
cuuccagcaga

SEQ ID NO: 3944930 - RNA, 19 nt, Shigella flexneri 2a str. 301
cuuccagcagaccagcaau

SEQ ID NO: 3944931 - RNA, 19 nt, Shigella flexneri 2a str. 301
cuuccagcagaccuucugc

SEQ ID NO: 3944932 - RNA, 20 nt, Shigella flexneri 2a str. 301
cuuccagcagaccuucugcc

SEQ ID NO: 3944933 - RNA, 15 nt, Shigella flexneri 2a str. 301
cuuccagcggcaggc

SEQ ID NO: 3944934 - RNA, 18 nt, Shigella flexneri 2a str. 301
cuuccagcguucgccaaa

SEQ ID NO: 3944935 - RNA, 13 nt, Shigella flexneri 2a str. 301
cuuccagcuccag

SEQ ID NO: 3944936 - RNA, 17 nt, Shigella flexneri 2a str. 301
cuuccagcuccagccgc

SEQ ID NO: 3944937 - RNA, 22 nt, Shigella flexneri 2a str. 301
cuuccaggcucauaccuuccac

SEQ ID NO: 3944938 - RNA, 18 nt, Shigella flexneri 2a str. 301
cuuccaggucaaccuagc

SEQ ID NO: 3944939 - RNA, 18 nt, Shigella flexneri 2a str. 301
cuuccagucgccugcuuu

SEQ ID NO: 3944940 - RNA, 12 nt, Shigella flexneri 2a str. 301
cuuccagugccu

SEQ ID NO: 3944941 - RNA, 14 nt, Shigella flexneri 2a str. 301
cuuccaguuccggc

SEQ ID NO: 3944942 - RNA, 14 nt, Shigella flexneri 2a str. 301
cuuccauacagcuc

SEQ ID NO: 3944943 - RNA, 19 nt, Shigella flexneri 2a str. 301
cuuccauguguuuaucuau

SEQ ID NO: 3944944 - RNA, 17 nt, Shigella flexneri 2a str. 301
cuuccauugagaaagcc

SEQ ID NO: 3944945 - RNA, 20 nt, Shigella flexneri 2a str. 301
cuuccauugagaaagcccug

SEQ ID NO: 3944946 - RNA, 22 nt, Shigella flexneri 2a str. 301
cuuccauugagaaagcccuggc

SEQ ID NO: 3944947 - RNA, 14 nt, Shigella flexneri 2a str. 301
cuuccauugccgcu

SEQ ID NO: 3944948 - RNA, 20 nt, Shigella flexneri 2a str. 301
cuuccauugccgcuuuccag

SEQ ID NO: 3944949 - RNA, 22 nt, Shigella flexneri 2a str. 301
cuucccaaagaucuccucacca

SEQ ID NO: 3944950 - RNA, 20 nt, Shigella flexneri 2a str. 301
cuucccaauugcacauauuu

SEQ ID NO: 3944951 - RNA, 22 nt, Shigella flexneri 2a str. 301
cuucccaauugcacauauuuuu

SEQ ID NO: 3944952 - RNA, 15 nt, Shigella flexneri 2a str. 301
cuucccacgucagac

SEQ ID NO: 3944953 - RNA, 13 nt, Shigella flexneri 2a str. 301
cuucccagcgcag

SEQ ID NO: 3944954 - RNA, 19 nt, Shigella flexneri 2a str. 301
cuucccagguuucaaugcc

SEQ ID NO: 3944955 - RNA, 12 nt, Shigella flexneri 2a str. 301
cuuccccgagcg

SEQ ID NO: 3944956 - RNA, 15 nt, Shigella flexneri 2a str. 301
cuuccccgcagccca

SEQ ID NO: 3944957 - RNA, 17 nt, Shigella flexneri 2a str. 301
cuuccccgcuucagccc

SEQ ID NO: 3944958 - RNA, 17 nt, Shigella flexneri 2a str. 301
cuuccccguucugccag

SEQ ID NO: 3944959 - RNA, 18 nt, Shigella flexneri 2a str. 301
cuuccccguucugccagu

SEQ ID NO: 3944960 - RNA, 17 nt, Shigella flexneri 2a str. 301
cuucccgcauccagaaa

SEQ ID NO: 3944961 - RNA, 15 nt, Shigella flexneri 2a str. 301
cuucccggcaaucgc

SEQ ID NO: 3944962 - RNA, 21 nt, Shigella flexneri 2a str. 301
cuucccgggucgcgacugcca

SEQ ID NO: 3944963 - RNA, 18 nt, Shigella flexneri 2a str. 301
cuuccgcaauacagccag

SEQ ID NO: 3944964 - RNA, 21 nt, Shigella flexneri 2a str. 301
cuuccgcaauacagccagcca

SEQ ID NO: 3944965 - RNA, 22 nt, Shigella flexneri 2a str. 301
cuuccgcaauacagccagccag

SEQ ID NO: 3944966 - RNA, 14 nt, Shigella flexneri 2a str. 301
cuuccgcgaaggcg

SEQ ID NO: 3944967 - RNA, 18 nt, Shigella flexneri 2a str. 301
cuuccgcgccaaacauuu

SEQ ID NO: 3944968 - RNA, 17 nt, Shigella flexneri 2a str. 301
cuuccgcugacagcgcg

SEQ ID NO: 3944969 - RNA, 13 nt, Shigella flexneri 2a str. 301
cuuccggcagacc

SEQ ID NO: 3944970 - RNA, 15 nt, Shigella flexneri 2a str. 301
cuuccggcguggcgu

SEQ ID NO: 3944971 - RNA, 20 nt, Shigella flexneri 2a str. 301
cuuccgggauuucccggcac

SEQ ID NO: 3944972 - RNA, 17 nt, Shigella flexneri 2a str. 301
cuuccgguuacgccacc

SEQ ID NO: 3944973 - RNA, 14 nt, Shigella flexneri 2a str. 301
cuuccgucacaggc

SEQ ID NO: 3944974 - RNA, 19 nt, Shigella flexneri 2a str. 301
cuuccgucagaccaccggu

SEQ ID NO: 3944975 - RNA, 16 nt, Shigella flexneri 2a str. 301
cuuccucaaccacuuu

SEQ ID NO: 3944976 - RNA, 20 nt, Shigella flexneri 2a str. 301
cuuccucaauuaacauugca

SEQ ID NO: 3944977 - RNA, 22 nt, Shigella flexneri 2a str. 301
cuuccuccagcgguuuaucaau

SEQ ID NO: 3944978 - RNA, 18 nt, Shigella flexneri 2a str. 301
cuuccugaacucgccagc

SEQ ID NO: 3944979 - RNA, 21 nt, Shigella flexneri 2a str. 301
cuuccugcaacgagugcaucu

SEQ ID NO: 3944980 - RNA, 23 nt, Shigella flexneri 2a str. 301
cuuccugcaacgagugcaucugg

SEQ ID NO: 3944981 - RNA, 19 nt, Shigella flexneri 2a str. 301
cuuccugccagauccagug

SEQ ID NO: 3944982 - RNA, 19 nt, Shigella flexneri 2a str. 301
cuuccugcggcagacgcuc

SEQ ID NO: 3944983 - RNA, 16 nt, Shigella flexneri 2a str. 301
cuuccuuaagccgcug

SEQ ID NO: 3944984 - RNA, 17 nt, Shigella flexneri 2a str. 301
cuuccuuaaucccugga

SEQ ID NO: 3944985 - RNA, 20 nt, Shigella flexneri 2a str. 301
cuuccuuaugcuaagccgug

SEQ ID NO: 3944986 - RNA, 14 nt, Shigella flexneri 2a str. 301
cuuccuucagcucc

SEQ ID NO: 3944987 - RNA, 18 nt, Shigella flexneri 2a str. 301
cuuccuucagcucccgcu

SEQ ID NO: 3944988 - RNA, 18 nt, Shigella flexneri 2a str. 301
cuuccuugcguacaccaa

SEQ ID NO: 3944989 - RNA, 18 nt, Shigella flexneri 2a str. 301
cuuccuugcuaagcccuc

SEQ ID NO: 3944990 - RNA, 16 nt, Shigella flexneri 2a str. 301
cuuccuuuuuuauuua

SEQ ID NO: 3944991 - RNA, 21 nt, Shigella flexneri 2a str. 301
cuucgaagaucucgguaacga

SEQ ID NO: 3944992 - RNA, 15 nt, Shigella flexneri 2a str. 301
cuucgaaugccgcag

SEQ ID NO: 3944993 - RNA, 21 nt, Shigella flexneri 2a str. 301
cuucgaaugccgcagcacccu

SEQ ID NO: 3944994 - RNA, 17 nt, Shigella flexneri 2a str. 301
cuucgacguuauuuacc

SEQ ID NO: 3944995 - RNA, 16 nt, Shigella flexneri 2a str. 301
cuucgaguacauccac

SEQ ID NO: 3944996 - RNA, 16 nt, Shigella flexneri 2a str. 301
cuucgauaaaagccau

SEQ ID NO: 3944997 - RNA, 19 nt, Shigella flexneri 2a str. 301
cuucgauauugacgaucuc

SEQ ID NO: 3944998 - RNA, 15 nt, Shigella flexneri 2a str. 301
cuucgauccagugau

SEQ ID NO: 3944999 - RNA, 16 nt, Shigella flexneri 2a str. 301
cuucgaucuugccgcu

SEQ ID NO: 3945000 - RNA, 18 nt, Shigella flexneri 2a str. 301
cuucgauguguugcaaau

SEQ ID NO: 3945001 - RNA, 12 nt, Shigella flexneri 2a str. 301
cuucgcaaaaaa

SEQ ID NO: 3945002 - RNA, 17 nt, Shigella flexneri 2a str. 301
cuucgcacacacugcuu

SEQ ID NO: 3945003 - RNA, 22 nt, Shigella flexneri 2a str. 301
cuucgccagacguugauaacca

SEQ ID NO: 3945004 - RNA, 23 nt, Shigella flexneri 2a str. 301
cuucgccauugaaaccgcugccu

SEQ ID NO: 3945005 - RNA, 22 nt, Shigella flexneri 2a str. 301
cuucgcccuucgggucguugcc

SEQ ID NO: 3945006 - RNA, 13 nt, Shigella flexneri 2a str. 301
cuucgccgccgcu

SEQ ID NO: 3945007 - RNA, 12 nt, Shigella flexneri 2a str. 301
cuucgccugccu

SEQ ID NO: 3945008 - RNA, 21 nt, Shigella flexneri 2a str. 301
cuucgccuuucaguucaacgg

SEQ ID NO: 3945009 - RNA, 18 nt, Shigella flexneri 2a str. 301
cuucgcgaacacccgacg

SEQ ID NO: 3945010 - RNA, 20 nt, Shigella flexneri 2a str. 301
cuucgcgaacacccgacgug

SEQ ID NO: 3945011 - RNA, 14 nt, Shigella flexneri 2a str. 301
cuucgcgcaccaac

SEQ ID NO: 3945012 - RNA, 16 nt, Shigella flexneri 2a str. 301
cuucgcggaauuucag

SEQ ID NO: 3945013 - RNA, 22 nt, Shigella flexneri 2a str. 301
cuucgcggacaucguccagcuu

SEQ ID NO: 3945014 - RNA, 14 nt, Shigella flexneri 2a str. 301
cuucgcgguaauga

SEQ ID NO: 3945015 - RNA, 18 nt, Shigella flexneri 2a str. 301
cuucgcucccuagaagga

SEQ ID NO: 3945016 - RNA, 15 nt, Shigella flexneri 2a str. 301
cuucgcugcagcucu

SEQ ID NO: 3945017 - RNA, 17 nt, Shigella flexneri 2a str. 301
cuucgcugcagcucugc

SEQ ID NO: 3945018 - RNA, 16 nt, Shigella flexneri 2a str. 301
cuucgcugcugguucu

SEQ ID NO: 3945019 - RNA, 22 nt, Shigella flexneri 2a str. 301
cuucgcuuaccaugccaacgcg

SEQ ID NO: 3945020 - RNA, 19 nt, Shigella flexneri 2a str. 301
cuucgcuuaucaggccuac

SEQ ID NO: 3945021 - RNA, 21 nt, Shigella flexneri 2a str. 301
cuucgcuucaccgacaucuuu

SEQ ID NO: 3945022 - RNA, 16 nt, Shigella flexneri 2a str. 301
cuucgcuuuacccugg

SEQ ID NO: 3945023 - RNA, 18 nt, Shigella flexneri 2a str. 301
cuucggacguuugccaug

SEQ ID NO: 3945024 - RNA, 19 nt, Shigella flexneri 2a str. 301
cuucggcggcguugcuuuu

SEQ ID NO: 3945025 - RNA, 22 nt, Shigella flexneri 2a str. 301
cuucgguagcagcuuucagcag

SEQ ID NO: 3945026 - RNA, 19 nt, Shigella flexneri 2a str. 301
cuucggucaccgucaugcc

SEQ ID NO: 3945027 - RNA, 14 nt, Shigella flexneri 2a str. 301
cuucggucagcacg

SEQ ID NO: 3945028 - RNA, 16 nt, Shigella flexneri 2a str. 301
cuucgguucaaguccc

SEQ ID NO: 3945029 - RNA, 15 nt, Shigella flexneri 2a str. 301
cuucguagacgcuuu

SEQ ID NO: 3945030 - RNA, 20 nt, Shigella flexneri 2a str. 301
cuucgucguaguaguucauc

SEQ ID NO: 3945031 - RNA, 18 nt, Shigella flexneri 2a str. 301
cuucgugcaggcauucag

SEQ ID NO: 3945032 - RNA, 22 nt, Shigella flexneri 2a str. 301
cuucguuaacgugucauaacug

SEQ ID NO: 3945033 - RNA, 18 nt, Shigella flexneri 2a str. 301
cuucguucaucucaaaca

SEQ ID NO: 3945034 - RNA, 19 nt, Shigella flexneri 2a str. 301
cuucguucaucucaaacac

SEQ ID NO: 3945035 - RNA, 17 nt, Shigella flexneri 2a str. 301
cuucguuuucagcuucg

SEQ ID NO: 3945036 - RNA, 18 nt, Shigella flexneri 2a str. 301
cuucuacaggcugcaucu

SEQ ID NO: 3945037 - RNA, 23 nt, Shigella flexneri 2a str. 301
cuucuaccuuaacgguaucuuuc

SEQ ID NO: 3945038 - RNA, 12 nt, Shigella flexneri 2a str. 301
cuucuaugccag

SEQ ID NO: 3945039 - RNA, 13 nt, Shigella flexneri 2a str. 301
cuucucaacacau

SEQ ID NO: 3945040 - RNA, 15 nt, Shigella flexneri 2a str. 301
cuucucaaucccuuu

SEQ ID NO: 3945041 - RNA, 17 nt, Shigella flexneri 2a str. 301
cuucucaaucccuuucu

SEQ ID NO: 3945042 - RNA, 21 nt, Shigella flexneri 2a str. 301
cuucucacccggaggaaagca

SEQ ID NO: 3945043 - RNA, 13 nt, Shigella flexneri 2a str. 301
cuucucagccaaa

SEQ ID NO: 3945044 - RNA, 19 nt, Shigella flexneri 2a str. 301
cuucucagcgguaaugguc

SEQ ID NO: 3945045 - RNA, 19 nt, Shigella flexneri 2a str. 301
cuucucccagccgcccugc

SEQ ID NO: 3945046 - RNA, 22 nt, Shigella flexneri 2a str. 301
cuucucgauaaaaccuuccuca

SEQ ID NO: 3945047 - RNA, 21 nt, Shigella flexneri 2a str. 301
cuucucgccagccucccagcc

SEQ ID NO: 3945048 - RNA, 17 nt, Shigella flexneri 2a str. 301
cuucucgcucuuguucu

SEQ ID NO: 3945049 - RNA, 20 nt, Shigella flexneri 2a str. 301
cuucucgucaaucugcucca

SEQ ID NO: 3945050 - RNA, 21 nt, Shigella flexneri 2a str. 301
cuucucuugcuggauuucccu

SEQ ID NO: 3945051 - RNA, 15 nt, Shigella flexneri 2a str. 301
cuucugaguucggca

SEQ ID NO: 3945052 - RNA, 15 nt, Shigella flexneri 2a str. 301
cuucugauguuguuu

SEQ ID NO: 3945053 - RNA, 19 nt, Shigella flexneri 2a str. 301
cuucugcaagcaucauaaa

SEQ ID NO: 3945054 - RNA, 16 nt, Shigella flexneri 2a str. 301
cuucugccagcugcug

SEQ ID NO: 3945055 - RNA, 13 nt, Shigella flexneri 2a str. 301
cuucugccgcuuc

SEQ ID NO: 3945056 - RNA, 16 nt, Shigella flexneri 2a str. 301
cuucugccuguccacc

SEQ ID NO: 3945057 - RNA, 22 nt, Shigella flexneri 2a str. 301
cuucugcuuugcccacgcuuuu

SEQ ID NO: 3945058 - RNA, 20 nt, Shigella flexneri 2a str. 301
cuucugcuuuggcugccgcc

SEQ ID NO: 3945059 - RNA, 22 nt, Shigella flexneri 2a str. 301
cuucugcuuuggcugccgccag

SEQ ID NO: 3945060 - RNA, 15 nt, Shigella flexneri 2a str. 301
cuucugguaacagcg

SEQ ID NO: 3945061 - RNA, 23 nt, Shigella flexneri 2a str. 301
cuucuggugauaggcguugcggg

SEQ ID NO: 3945062 - RNA, 19 nt, Shigella flexneri 2a str. 301
cuucugguuauauuucccc

SEQ ID NO: 3945063 - RNA, 21 nt, Shigella flexneri 2a str. 301
cuucugguugcgaaaaaauca

SEQ ID NO: 3945064 - RNA, 18 nt, Shigella flexneri 2a str. 301
cuucugguuucaguaauc

SEQ ID NO: 3945065 - RNA, 23 nt, Shigella flexneri 2a str. 301
cuucugguuuuucugaaaacugu

SEQ ID NO: 3945066 - RNA, 15 nt, Shigella flexneri 2a str. 301
cuucuguaacuggaa

SEQ ID NO: 3945067 - RNA, 13 nt, Shigella flexneri 2a str. 301
cuucugucgcuuc

SEQ ID NO: 3945068 - RNA, 20 nt, Shigella flexneri 2a str. 301
cuucugucgggcaucacuau

SEQ ID NO: 3945069 - RNA, 18 nt, Shigella flexneri 2a str. 301
cuucugugauuccgccag

SEQ ID NO: 3945070 - RNA, 23 nt, Shigella flexneri 2a str. 301
cuucuuaaugcccaucucuucuu

SEQ ID NO: 3945071 - RNA, 16 nt, Shigella flexneri 2a str. 301
cuucuuccagcggcag

SEQ ID NO: 3945072 - RNA, 16 nt, Shigella flexneri 2a str. 301
cuucuucccaccauac

SEQ ID NO: 3945073 - RNA, 19 nt, Shigella flexneri 2a str. 301
cuucuucgucgucuucguc

SEQ ID NO: 3945074 - RNA, 12 nt, Shigella flexneri 2a str. 301
cuucuucugucg

SEQ ID NO: 3945075 - RNA, 21 nt, Shigella flexneri 2a str. 301
cuucuucugucgggcaucacu

SEQ ID NO: 3945076 - RNA, 13 nt, Shigella flexneri 2a str. 301
cuucuucuuucag

SEQ ID NO: 3945077 - RNA, 18 nt, Shigella flexneri 2a str. 301
cuucuugcagcuuaauca

SEQ ID NO: 3945078 - RNA, 13 nt, Shigella flexneri 2a str. 301
cuucuuguaauuc

SEQ ID NO: 3945079 - RNA, 14 nt, Shigella flexneri 2a str. 301
cuucuuuaugaauc

SEQ ID NO: 3945080 - RNA, 12 nt, Shigella flexneri 2a str. 301
cuucuuuauuga

SEQ ID NO: 3945081 - RNA, 20 nt, Shigella flexneri 2a str. 301
cuucuuuuuaccuucauuug

SEQ ID NO: 3945082 - RNA, 20 nt, Shigella flexneri 2a str. 301
cuugaaaauuauaucuuauu

SEQ ID NO: 3945083 - RNA, 12 nt, Shigella flexneri 2a str. 301
cuugaaaccaga

SEQ ID NO: 3945084 - RNA, 15 nt, Shigella flexneri 2a str. 301
cuugaagugucuggu

SEQ ID NO: 3945085 - RNA, 20 nt, Shigella flexneri 2a str. 301
cuugaauaaauuggcugggg

SEQ ID NO: 3945086 - RNA, 21 nt, Shigella flexneri 2a str. 301
cuugaauaaauuggcuggggu

SEQ ID NO: 3945087 - RNA, 21 nt, Shigella flexneri 2a str. 301
cuugacgcgucuuaucaggcc

SEQ ID NO: 3945088 - RNA, 23 nt, Shigella flexneri 2a str. 301
cuugacgcgucuuaucaggccua

SEQ ID NO: 3945089 - RNA, 22 nt, Shigella flexneri 2a str. 301
cuugacgcugauuuuuuuucaa

SEQ ID NO: 3945090 - RNA, 21 nt, Shigella flexneri 2a str. 301
cuugacgugucuuaucaggcc

SEQ ID NO: 3945091 - RNA, 16 nt, Shigella flexneri 2a str. 301
cuugagacauuguuuc

SEQ ID NO: 3945092 - RNA, 18 nt, Shigella flexneri 2a str. 301
cuugagcaggagcagcag

SEQ ID NO: 3945093 - RNA, 21 nt, Shigella flexneri 2a str. 301
cuugagcgcagucuggcggcu

SEQ ID NO: 3945094 - RNA, 23 nt, Shigella flexneri 2a str. 301
cuugaguuuuucaucccucucau

SEQ ID NO: 3945095 - RNA, 22 nt, Shigella flexneri 2a str. 301
cuugauaaagaucgaucauuuu

SEQ ID NO: 3945096 - RNA, 17 nt, Shigella flexneri 2a str. 301
cuugauauaaaucccag

SEQ ID NO: 3945097 - RNA, 13 nt, Shigella flexneri 2a str. 301
cuugaugaaaaaa

SEQ ID NO: 3945098 - RNA, 14 nt, Shigella flexneri 2a str. 301
cuugaugcacuggg

SEQ ID NO: 3945099 - RNA, 13 nt, Shigella flexneri 2a str. 301
cuugauuauuucc

SEQ ID NO: 3945100 - RNA, 17 nt, Shigella flexneri 2a str. 301
cuugauucuguucagua

SEQ ID NO: 3945101 - RNA, 23 nt, Shigella flexneri 2a str. 301
cuugcaacuccggcgaaaauccc

SEQ ID NO: 3945102 - RNA, 21 nt, Shigella flexneri 2a str. 301
cuugcaagaucgcgcaucagc

SEQ ID NO: 3945103 - RNA, 16 nt, Shigella flexneri 2a str. 301
cuugcaauaguuucag

SEQ ID NO: 3945104 - RNA, 16 nt, Shigella flexneri 2a str. 301
cuugcaaucuuuagca

SEQ ID NO: 3945105 - RNA, 20 nt, Shigella flexneri 2a str. 301
cuugcaccggcgacauccca

SEQ ID NO: 3945106 - RNA, 15 nt, Shigella flexneri 2a str. 301
cuugcagcgucuuau

SEQ ID NO: 3945107 - RNA, 12 nt, Shigella flexneri 2a str. 301
cuugcagcuccu

SEQ ID NO: 3945108 - RNA, 23 nt, Shigella flexneri 2a str. 301
cuugcauagcuucgaaguuuuca

SEQ ID NO: 3945109 - RNA, 17 nt, Shigella flexneri 2a str. 301
cuugcaucguguaauuc

SEQ ID NO: 3945110 - RNA, 12 nt, Shigella flexneri 2a str. 301
cuugccagccau

SEQ ID NO: 3945111 - RNA, 20 nt, Shigella flexneri 2a str. 301
cuugccauuccacaaaaacc

SEQ ID NO: 3945112 - RNA, 21 nt, Shigella flexneri 2a str. 301
cuugcccagcaaaaagcgggc

SEQ ID NO: 3945113 - RNA, 23 nt, Shigella flexneri 2a str. 301
cuugcccaggugugucucaaguc

SEQ ID NO: 3945114 - RNA, 13 nt, Shigella flexneri 2a str. 301
cuugccccuuccc

SEQ ID NO: 3945115 - RNA, 13 nt, Shigella flexneri 2a str. 301
cuugccgcaaaac

SEQ ID NO: 3945116 - RNA, 18 nt, Shigella flexneri 2a str. 301
cuugccgcaaaacccagg

SEQ ID NO: 3945117 - RNA, 15 nt, Shigella flexneri 2a str. 301
cuugccgcgucuuau

SEQ ID NO: 3945118 - RNA, 17 nt, Shigella flexneri 2a str. 301
cuugccgcgucuuauca

SEQ ID NO: 3945119 - RNA, 19 nt, Shigella flexneri 2a str. 301
cuugccggacaugcugccu

SEQ ID NO: 3945120 - RNA, 22 nt, Shigella flexneri 2a str. 301
cuugccggacaugcugccucca

SEQ ID NO: 3945121 - RNA, 14 nt, Shigella flexneri 2a str. 301
cuugcgacucagcc

SEQ ID NO: 3945122 - RNA, 15 nt, Shigella flexneri 2a str. 301
cuugcgcgcaaucag

SEQ ID NO: 3945123 - RNA, 20 nt, Shigella flexneri 2a str. 301
cuugcgcgcaaucagcaccg

SEQ ID NO: 3945124 - RNA, 22 nt, Shigella flexneri 2a str. 301
cuugcgcggauggccucugcca

SEQ ID NO: 3945125 - RNA, 14 nt, Shigella flexneri 2a str. 301
cuugcggaaacugu

SEQ ID NO: 3945126 - RNA, 23 nt, Shigella flexneri 2a str. 301
cuugcggaagcaaccggugucau

SEQ ID NO: 3945127 - RNA, 15 nt, Shigella flexneri 2a str. 301
cuugcggacccggcg

SEQ ID NO: 3945128 - RNA, 17 nt, Shigella flexneri 2a str. 301
cuugcggacccggcgga

SEQ ID NO: 3945129 - RNA, 19 nt, Shigella flexneri 2a str. 301
cuugcguacaccaacauca

SEQ ID NO: 3945130 - RNA, 20 nt, Shigella flexneri 2a str. 301
cuugcgucauccagcacuug

SEQ ID NO: 3945131 - RNA, 16 nt, Shigella flexneri 2a str. 301
cuugcgucgccaguuu

SEQ ID NO: 3945132 - RNA, 20 nt, Shigella flexneri 2a str. 301
cuugcucaaugaguucgcgc

SEQ ID NO: 3945133 - RNA, 14 nt, Shigella flexneri 2a str. 301
cuugcucauccgga

SEQ ID NO: 3945134 - RNA, 14 nt, Shigella flexneri 2a str. 301
cuugcuccacguuc

SEQ ID NO: 3945135 - RNA, 20 nt, Shigella flexneri 2a str. 301
cuugcuccacguucagagag

SEQ ID NO: 3945136 - RNA, 12 nt, Shigella flexneri 2a str. 301
cuugcugauaac

SEQ ID NO: 3945137 - RNA, 17 nt, Shigella flexneri 2a str. 301
cuugcugauaacgugca

SEQ ID NO: 3945138 - RNA, 19 nt, Shigella flexneri 2a str. 301
cuugcugauaacgugcagc

SEQ ID NO: 3945139 - RNA, 18 nt, Shigella flexneri 2a str. 301
cuugcugauacuccucau

SEQ ID NO: 3945140 - RNA, 20 nt, Shigella flexneri 2a str. 301
cuugcugauacuccucauug

SEQ ID NO: 3945141 - RNA, 16 nt, Shigella flexneri 2a str. 301
cuugcugaugcacgca

SEQ ID NO: 3945142 - RNA, 15 nt, Shigella flexneri 2a str. 301
cuugcugcuccagcg

SEQ ID NO: 3945143 - RNA, 21 nt, Shigella flexneri 2a str. 301
cuugcugcuccagcgggcgaa

SEQ ID NO: 3945144 - RNA, 17 nt, Shigella flexneri 2a str. 301
cuugcuggacuugaacc

SEQ ID NO: 3945145 - RNA, 15 nt, Shigella flexneri 2a str. 301
cuugcuuaaaauccc

SEQ ID NO: 3945146 - RNA, 18 nt, Shigella flexneri 2a str. 301
cuuggauauuuuaaucag

SEQ ID NO: 3945147 - RNA, 13 nt, Shigella flexneri 2a str. 301
cuuggcacugacg

SEQ ID NO: 3945148 - RNA, 18 nt, Shigella flexneri 2a str. 301
cuuggcagagcaacauac

SEQ ID NO: 3945149 - RNA, 19 nt, Shigella flexneri 2a str. 301
cuuggcauuaaacagccaa

SEQ ID NO: 3945150 - RNA, 22 nt, Shigella flexneri 2a str. 301
cuuggcgggcaacguuccagca

SEQ ID NO: 3945151 - RNA, 13 nt, Shigella flexneri 2a str. 301
cuugguucuccaa

SEQ ID NO: 3945152 - RNA, 18 nt, Shigella flexneri 2a str. 301
cuuguaaauuucccacuc

SEQ ID NO: 3945153 - RNA, 19 nt, Shigella flexneri 2a str. 301
cuuguaacagaguauccaa

SEQ ID NO: 3945154 - RNA, 19 nt, Shigella flexneri 2a str. 301
cuuguaacgcaucaaucaa

SEQ ID NO: 3945155 - RNA, 22 nt, Shigella flexneri 2a str. 301
cuuguacccuuaacucuuccug

SEQ ID NO: 3945156 - RNA, 16 nt, Shigella flexneri 2a str. 301
cuuguacggcuccgcc

SEQ ID NO: 3945157 - RNA, 19 nt, Shigella flexneri 2a str. 301
cuuguacggcuccgcccca

SEQ ID NO: 3945158 - RNA, 17 nt, Shigella flexneri 2a str. 301
cuuguaggaaucaggca

SEQ ID NO: 3945159 - RNA, 16 nt, Shigella flexneri 2a str. 301
cuuguaggccugauaa

SEQ ID NO: 3945160 - RNA, 18 nt, Shigella flexneri 2a str. 301
cuugucacuucugccucu

SEQ ID NO: 3945161 - RNA, 16 nt, Shigella flexneri 2a str. 301
cuugucaugcagcucc

SEQ ID NO: 3945162 - RNA, 15 nt, Shigella flexneri 2a str. 301
cuugucgucccaggc

SEQ ID NO: 3945163 - RNA, 13 nt, Shigella flexneri 2a str. 301
cuugucuacgccu

SEQ ID NO: 3945164 - RNA, 22 nt, Shigella flexneri 2a str. 301
cuugucugagccgaaaaagaga

SEQ ID NO: 3945165 - RNA, 13 nt, Shigella flexneri 2a str. 301
cuugucuuuauua

SEQ ID NO: 3945166 - RNA, 17 nt, Shigella flexneri 2a str. 301
cuugugccaguucaggu

SEQ ID NO: 3945167 - RNA, 15 nt, Shigella flexneri 2a str. 301
cuugugcucaauuga

SEQ ID NO: 3945168 - RNA, 16 nt, Shigella flexneri 2a str. 301
cuuguuaccugaugca

SEQ ID NO: 3945169 - RNA, 22 nt, Shigella flexneri 2a str. 301
cuuguucgaagaguuccaacgc

SEQ ID NO: 3945170 - RNA, 18 nt, Shigella flexneri 2a str. 301
cuuguucucgcgcuucau

SEQ ID NO: 3945171 - RNA, 13 nt, Shigella flexneri 2a str. 301
cuuguugaacagg

SEQ ID NO: 3945172 - RNA, 15 nt, Shigella flexneri 2a str. 301
cuuguugcaacaaaa

SEQ ID NO: 3945173 - RNA, 16 nt, Shigella flexneri 2a str. 301
cuuuaaaaaaagcauu

SEQ ID NO: 3945174 - RNA, 17 nt, Shigella flexneri 2a str. 301
cuuuaaaaaaagcauuu

SEQ ID NO: 3945175 - RNA, 14 nt, Shigella flexneri 2a str. 301
cuuuaaaaaguaaa

SEQ ID NO: 3945176 - RNA, 21 nt, Shigella flexneri 2a str. 301
cuuuaaacacgcgaccaaagg

SEQ ID NO: 3945177 - RNA, 13 nt, Shigella flexneri 2a str. 301
cuuuaaaggccag

SEQ ID NO: 3945178 - RNA, 21 nt, Shigella flexneri 2a str. 301
cuuuaaauaccuuacacucaa

SEQ ID NO: 3945179 - RNA, 17 nt, Shigella flexneri 2a str. 301
cuuuaaauugcguaaag

SEQ ID NO: 3945180 - RNA, 22 nt, Shigella flexneri 2a str. 301
cuuuaaccuuugcgguuaaaaa

SEQ ID NO: 3945181 - RNA, 22 nt, Shigella flexneri 2a str. 301
cuuuaacugccgcacauuuccc

SEQ ID NO: 3945182 - RNA, 23 nt, Shigella flexneri 2a str. 301
cuuuaaguucagccaguugaucu

SEQ ID NO: 3945183 - RNA, 17 nt, Shigella flexneri 2a str. 301
cuuuaaugcaucagcca

SEQ ID NO: 3945184 - RNA, 21 nt, Shigella flexneri 2a str. 301
cuuuaaugccacauuagauaa

SEQ ID NO: 3945185 - RNA, 23 nt, Shigella flexneri 2a str. 301
cuuuaaugccacauuagauaaaa

SEQ ID NO: 3945186 - RNA, 16 nt, Shigella flexneri 2a str. 301
cuuuaauuauccccuc

SEQ ID NO: 3945187 - RNA, 22 nt, Shigella flexneri 2a str. 301
cuuuaauuggaauacauauauu

SEQ ID NO: 3945188 - RNA, 15 nt, Shigella flexneri 2a str. 301
cuuuaauuuugugca

SEQ ID NO: 3945189 - RNA, 16 nt, Shigella flexneri 2a str. 301
cuuuaccaccgucaaa

SEQ ID NO: 3945190 - RNA, 14 nt, Shigella flexneri 2a str. 301
cuuuacccagcgga

SEQ ID NO: 3945191 - RNA, 17 nt, Shigella flexneri 2a str. 301
cuuuaccgcgaccacca

SEQ ID NO: 3945192 - RNA, 18 nt, Shigella flexneri 2a str. 301
cuuuaccgcgaccaccac

SEQ ID NO: 3945193 - RNA, 14 nt, Shigella flexneri 2a str. 301
cuuuaccucgaaaa

SEQ ID NO: 3945194 - RNA, 23 nt, Shigella flexneri 2a str. 301
cuuuaccucgaaaaccacuccug

SEQ ID NO: 3945195 - RNA, 11 nt, Shigella flexneri 2a str. 301
cuuuaccuuca

SEQ ID NO: 3945196 - RNA, 16 nt, Shigella flexneri 2a str. 301
cuuuacgaagaaagca

SEQ ID NO: 3945197 - RNA, 20 nt, Shigella flexneri 2a str. 301
cuuuacgaucaucacguugg

SEQ ID NO: 3945198 - RNA, 13 nt, Shigella flexneri 2a str. 301
cuuuacgcaaaau

SEQ ID NO: 3945199 - RNA, 19 nt, Shigella flexneri 2a str. 301
cuuuacgcaaaaucagcaa

SEQ ID NO: 3945200 - RNA, 14 nt, Shigella flexneri 2a str. 301
cuuuacgcuuaucc

SEQ ID NO: 3945201 - RNA, 18 nt, Shigella flexneri 2a str. 301
cuuuacggcgcgucagau

SEQ ID NO: 3945202 - RNA, 15 nt, Shigella flexneri 2a str. 301
cuuuacugacugucc

SEQ ID NO: 3945203 - RNA, 23 nt, Shigella flexneri 2a str. 301
cuuuacuguuccgauaaguucag

SEQ ID NO: 3945204 - RNA, 18 nt, Shigella flexneri 2a str. 301
cuuuagccgguuuuucaa

SEQ ID NO: 3945205 - RNA, 15 nt, Shigella flexneri 2a str. 301
cuuuagggcuggcuu

SEQ ID NO: 3945206 - RNA, 18 nt, Shigella flexneri 2a str. 301
cuuuauagguggcaaaga

SEQ ID NO: 3945207 - RNA, 20 nt, Shigella flexneri 2a str. 301
cuuuauagugugcaaucacu

SEQ ID NO: 3945208 - RNA, 15 nt, Shigella flexneri 2a str. 301
cuuuaucaccaauga

SEQ ID NO: 3945209 - RNA, 15 nt, Shigella flexneri 2a str. 301
cuuuaucccuggugg

SEQ ID NO: 3945210 - RNA, 13 nt, Shigella flexneri 2a str. 301
cuuuauccugacu

SEQ ID NO: 3945211 - RNA, 14 nt, Shigella flexneri 2a str. 301
cuuuauccugccca

SEQ ID NO: 3945212 - RNA, 18 nt, Shigella flexneri 2a str. 301
cuuuaucgccgcuggaaa

SEQ ID NO: 3945213 - RNA, 23 nt, Shigella flexneri 2a str. 301
cuuuaucugauuugauaaugcca

SEQ ID NO: 3945214 - RNA, 21 nt, Shigella flexneri 2a str. 301
cuuuaucugccggacuuaagg

SEQ ID NO: 3945215 - RNA, 17 nt, Shigella flexneri 2a str. 301
cuuuaugacgaucgcag

SEQ ID NO: 3945216 - RNA, 13 nt, Shigella flexneri 2a str. 301
cuuuaugcagcuc

SEQ ID NO: 3945217 - RNA, 13 nt, Shigella flexneri 2a str. 301
cuuuaugcugaag

SEQ ID NO: 3945218 - RNA, 17 nt, Shigella flexneri 2a str. 301
cuuuaugugcuucuacc

SEQ ID NO: 3945219 - RNA, 13 nt, Shigella flexneri 2a str. 301
cuuucaacaaccu

SEQ ID NO: 3945220 - RNA, 22 nt, Shigella flexneri 2a str. 301
cuuucaacagguuaacuccccc

SEQ ID NO: 3945221 - RNA, 19 nt, Shigella flexneri 2a str. 301
cuuucaacguagccugcca

SEQ ID NO: 3945222 - RNA, 21 nt, Shigella flexneri 2a str. 301
cuuucaaugcuuuuugcauuu

SEQ ID NO: 3945223 - RNA, 14 nt, Shigella flexneri 2a str. 301
cuuucacaaaaaua

SEQ ID NO: 3945224 - RNA, 23 nt, Shigella flexneri 2a str. 301
cuuucaccaucgcgaucaucagu

SEQ ID NO: 3945225 - RNA, 16 nt, Shigella flexneri 2a str. 301
cuuucaccgccugauc

SEQ ID NO: 3945226 - RNA, 16 nt, Shigella flexneri 2a str. 301
cuuucaccucuucauu

SEQ ID NO: 3945227 - RNA, 18 nt, Shigella flexneri 2a str. 301
cuuucacgaacacagugg

SEQ ID NO: 3945228 - RNA, 20 nt, Shigella flexneri 2a str. 301
cuuucacgcccaguccgcuc

SEQ ID NO: 3945229 - RNA, 16 nt, Shigella flexneri 2a str. 301
cuuucacgcgcugacc

SEQ ID NO: 3945230 - RNA, 22 nt, Shigella flexneri 2a str. 301
cuuucacgcgcugaccuucuuc

SEQ ID NO: 3945231 - RNA, 20 nt, Shigella flexneri 2a str. 301
cuuucacggccacucugccu

SEQ ID NO: 3945232 - RNA, 20 nt, Shigella flexneri 2a str. 301
cuuucacgucaggaucgugc

SEQ ID NO: 3945233 - RNA, 21 nt, Shigella flexneri 2a str. 301
cuuucacuauuucuuuguaga

SEQ ID NO: 3945234 - RNA, 15 nt, Shigella flexneri 2a str. 301
cuuucagaaucaggu

SEQ ID NO: 3945235 - RNA, 20 nt, Shigella flexneri 2a str. 301
cuuucagauguuccgccauu

SEQ ID NO: 3945236 - RNA, 17 nt, Shigella flexneri 2a str. 301
cuuucagcaccagcccg

SEQ ID NO: 3945237 - RNA, 13 nt, Shigella flexneri 2a str. 301
cuuucagcaccgc

SEQ ID NO: 3945238 - RNA, 13 nt, Shigella flexneri 2a str. 301
cuuucagcacuua

SEQ ID NO: 3945239 - RNA, 21 nt, Shigella flexneri 2a str. 301
cuuucagcaguucagucagca

SEQ ID NO: 3945240 - RNA, 21 nt, Shigella flexneri 2a str. 301
cuuucauaugauaggcuucca

SEQ ID NO: 3945241 - RNA, 18 nt, Shigella flexneri 2a str. 301
cuuucauuucaauaaauu

SEQ ID NO: 3945242 - RNA, 18 nt, Shigella flexneri 2a str. 301
cuuuccaacuguaccagc

SEQ ID NO: 3945243 - RNA, 15 nt, Shigella flexneri 2a str. 301
cuuuccagcgucagu

SEQ ID NO: 3945244 - RNA, 14 nt, Shigella flexneri 2a str. 301
cuuuccaggcauca

SEQ ID NO: 3945245 - RNA, 18 nt, Shigella flexneri 2a str. 301
cuuuccagguggugcagg

SEQ ID NO: 3945246 - RNA, 18 nt, Shigella flexneri 2a str. 301
cuuuccauaccggcugca

SEQ ID NO: 3945247 - RNA, 16 nt, Shigella flexneri 2a str. 301
cuuuccaucuuuccuc

SEQ ID NO: 3945248 - RNA, 19 nt, Shigella flexneri 2a str. 301
cuuuccaugccaucugcca

SEQ ID NO: 3945249 - RNA, 20 nt, Shigella flexneri 2a str. 301
cuuuccaugccaucugccag

SEQ ID NO: 3945250 - RNA, 20 nt, Shigella flexneri 2a str. 301
cuuucccgcgcccgugcauc

SEQ ID NO: 3945251 - RNA, 16 nt, Shigella flexneri 2a str. 301
cuuucccggcaaucac

SEQ ID NO: 3945252 - RNA, 14 nt, Shigella flexneri 2a str. 301
cuuucccuggcgcu

SEQ ID NO: 3945253 - RNA, 18 nt, Shigella flexneri 2a str. 301
cuuucccuucacucugcu

SEQ ID NO: 3945254 - RNA, 16 nt, Shigella flexneri 2a str. 301
cuuuccggcagaagca

SEQ ID NO: 3945255 - RNA, 21 nt, Shigella flexneri 2a str. 301
cuuuccggcagaagcaaucau

SEQ ID NO: 3945256 - RNA, 13 nt, Shigella flexneri 2a str. 301
cuuuccuccuguc

SEQ ID NO: 3945257 - RNA, 22 nt, Shigella flexneri 2a str. 301
cuuuccuggucggcaaacugcu

SEQ ID NO: 3945258 - RNA, 18 nt, Shigella flexneri 2a str. 301
cuuuccuuaacuccucgc

SEQ ID NO: 3945259 - RNA, 20 nt, Shigella flexneri 2a str. 301
cuuuccuuaacuccucgccu

SEQ ID NO: 3945260 - RNA, 23 nt, Shigella flexneri 2a str. 301
cuuucgacagcgauuccaguucg

SEQ ID NO: 3945261 - RNA, 18 nt, Shigella flexneri 2a str. 301
cuuucgacggcaucagaa

SEQ ID NO: 3945262 - RNA, 23 nt, Shigella flexneri 2a str. 301
cuuucgacggcaucagaaacaca

SEQ ID NO: 3945263 - RNA, 16 nt, Shigella flexneri 2a str. 301
cuuucgcaauaaucau

SEQ ID NO: 3945264 - RNA, 22 nt, Shigella flexneri 2a str. 301
cuuucgcagauucggcaugaua

SEQ ID NO: 3945265 - RNA, 18 nt, Shigella flexneri 2a str. 301
cuuucgcauuagcagccc

SEQ ID NO: 3945266 - RNA, 18 nt, Shigella flexneri 2a str. 301
cuuucgcccagcguugca

SEQ ID NO: 3945267 - RNA, 14 nt, Shigella flexneri 2a str. 301
cuuucgcggcagga

SEQ ID NO: 3945268 - RNA, 20 nt, Shigella flexneri 2a str. 301
cuuucgcuaaggucaccagu

SEQ ID NO: 3945269 - RNA, 17 nt, Shigella flexneri 2a str. 301
cuuucgcuuaacgccca

SEQ ID NO: 3945270 - RNA, 15 nt, Shigella flexneri 2a str. 301
cuuucgcuucaacca

SEQ ID NO: 3945271 - RNA, 14 nt, Shigella flexneri 2a str. 301
cuuucgcuucaagu

SEQ ID NO: 3945272 - RNA, 17 nt, Shigella flexneri 2a str. 301
cuuucgcuuuaucgccu

SEQ ID NO: 3945273 - RNA, 19 nt, Shigella flexneri 2a str. 301
cuuucggaaagaucgccac

SEQ ID NO: 3945274 - RNA, 13 nt, Shigella flexneri 2a str. 301
cuuucggaucggc

SEQ ID NO: 3945275 - RNA, 22 nt, Shigella flexneri 2a str. 301
cuuucggccaugggcgcgauaa

SEQ ID NO: 3945276 - RNA, 18 nt, Shigella flexneri 2a str. 301
cuuucguacgagcucuuc

SEQ ID NO: 3945277 - RNA, 16 nt, Shigella flexneri 2a str. 301
cuuucguuaaauucuu

SEQ ID NO: 3945278 - RNA, 17 nt, Shigella flexneri 2a str. 301
cuuucucauuuuuuaaa

SEQ ID NO: 3945279 - RNA, 19 nt, Shigella flexneri 2a str. 301
cuuucucccgaaaaaccug

SEQ ID NO: 3945280 - RNA, 13 nt, Shigella flexneri 2a str. 301
cuuucucgcggca

SEQ ID NO: 3945281 - RNA, 21 nt, Shigella flexneri 2a str. 301
cuuucugaacugaacaaaaaa

SEQ ID NO: 3945282 - RNA, 22 nt, Shigella flexneri 2a str. 301
cuuucugaaggauuagccggau

SEQ ID NO: 3945283 - RNA, 23 nt, Shigella flexneri 2a str. 301
cuuucugagauucaauuauagua

SEQ ID NO: 3945284 - RNA, 23 nt, Shigella flexneri 2a str. 301
cuuucugcaauuaaggucggcuu

SEQ ID NO: 3945285 - RNA, 18 nt, Shigella flexneri 2a str. 301
cuuucugcauccguucuu

SEQ ID NO: 3945286 - RNA, 23 nt, Shigella flexneri 2a str. 301
cuuucugcgauagcagcagauau

SEQ ID NO: 3945287 - RNA, 15 nt, Shigella flexneri 2a str. 301
cuuucugcgcaaugc

SEQ ID NO: 3945288 - RNA, 16 nt, Shigella flexneri 2a str. 301
cuuucuggcacgaccu

SEQ ID NO: 3945289 - RNA, 23 nt, Shigella flexneri 2a str. 301
cuuucugggaugaucaccugcau

SEQ ID NO: 3945290 - RNA, 21 nt, Shigella flexneri 2a str. 301
cuuucuuaaacuucacuuccc

SEQ ID NO: 3945291 - RNA, 16 nt, Shigella flexneri 2a str. 301
cuuucuuaaauuaaga

SEQ ID NO: 3945292 - RNA, 17 nt, Shigella flexneri 2a str. 301
cuuucuuaaauuaagaa

SEQ ID NO: 3945293 - RNA, 21 nt, Shigella flexneri 2a str. 301
cuuucuuaccccugauuuugu

SEQ ID NO: 3945294 - RNA, 20 nt, Shigella flexneri 2a str. 301
cuuucuucaaccaggcggau

SEQ ID NO: 3945295 - RNA, 14 nt, Shigella flexneri 2a str. 301
cuuucuucagccgu

SEQ ID NO: 3945296 - RNA, 11 nt, Shigella flexneri 2a str. 301
cuuucuucugg

SEQ ID NO: 3945297 - RNA, 23 nt, Shigella flexneri 2a str. 301
cuuucuuuuuguugcgcugaaac

SEQ ID NO: 3945298 - RNA, 21 nt, Shigella flexneri 2a str. 301
cuuugaaaauaacaucgccag

SEQ ID NO: 3945299 - RNA, 12 nt, Shigella flexneri 2a str. 301
cuuugaauaucu

SEQ ID NO: 3945300 - RNA, 18 nt, Shigella flexneri 2a str. 301
cuuugaauaucuccucug

SEQ ID NO: 3945301 - RNA, 16 nt, Shigella flexneri 2a str. 301
cuuugacauguugcug

SEQ ID NO: 3945302 - RNA, 21 nt, Shigella flexneri 2a str. 301
cuuugacauguugcugaccuu

SEQ ID NO: 3945303 - RNA, 19 nt, Shigella flexneri 2a str. 301
cuuugacgaugcuccacuc

SEQ ID NO: 3945304 - RNA, 16 nt, Shigella flexneri 2a str. 301
cuuugacuacgacgcc

SEQ ID NO: 3945305 - RNA, 23 nt, Shigella flexneri 2a str. 301
cuuugagcaucaaacuuuuaaau

SEQ ID NO: 3945306 - RNA, 19 nt, Shigella flexneri 2a str. 301
cuuugauugaagaaaucag

SEQ ID NO: 3945307 - RNA, 13 nt, Shigella flexneri 2a str. 301
cuuugcaccccaa

SEQ ID NO: 3945308 - RNA, 13 nt, Shigella flexneri 2a str. 301
cuuugcaggcugg

SEQ ID NO: 3945309 - RNA, 17 nt, Shigella flexneri 2a str. 301
cuuugcagguucugcuc

SEQ ID NO: 3945310 - RNA, 17 nt, Shigella flexneri 2a str. 301
cuuugccaaaaugcugg

SEQ ID NO: 3945311 - RNA, 23 nt, Shigella flexneri 2a str. 301
cuuugcccacgcuuuucaucaga

SEQ ID NO: 3945312 - RNA, 19 nt, Shigella flexneri 2a str. 301
cuuugcccgcagauccagu

SEQ ID NO: 3945313 - RNA, 24 nt, Shigella flexneri 2a str. 301
cuuugcccgcagauccagugcuca

SEQ ID NO: 3945314 - RNA, 20 nt, Shigella flexneri 2a str. 301
cuuugccgucagccacuucu

SEQ ID NO: 3945315 - RNA, 21 nt, Shigella flexneri 2a str. 301
cuuugccgugaacaauuucag

SEQ ID NO: 3945316 - RNA, 14 nt, Shigella flexneri 2a str. 301
cuuugccuccccaa

SEQ ID NO: 3945317 - RNA, 11 nt, Shigella flexneri 2a str. 301
cuuugccuggc

SEQ ID NO: 3945318 - RNA, 23 nt, Shigella flexneri 2a str. 301
cuuugcgaacgcguucacugccg

SEQ ID NO: 3945319 - RNA, 21 nt, Shigella flexneri 2a str. 301
cuuugcgagucugcuccagaa

SEQ ID NO: 3945320 - RNA, 14 nt, Shigella flexneri 2a str. 301
cuuugcuacagccu

SEQ ID NO: 3945321 - RNA, 23 nt, Shigella flexneri 2a str. 301
cuuugcugauacuccaugaguaa

SEQ ID NO: 3945322 - RNA, 20 nt, Shigella flexneri 2a str. 301
cuuugcuuuguaaagcgcca

SEQ ID NO: 3945323 - RNA, 13 nt, Shigella flexneri 2a str. 301
cuuuggcaaaccg

SEQ ID NO: 3945324 - RNA, 15 nt, Shigella flexneri 2a str. 301
cuuuggccgcucggg

SEQ ID NO: 3945325 - RNA, 17 nt, Shigella flexneri 2a str. 301
cuuuggguugccgccaa

SEQ ID NO: 3945326 - RNA, 16 nt, Shigella flexneri 2a str. 301
cuuuguauuuauuuuc

SEQ ID NO: 3945327 - RNA, 22 nt, Shigella flexneri 2a str. 301
cuuugucgauaauauugagcac

SEQ ID NO: 3945328 - RNA, 13 nt, Shigella flexneri 2a str. 301
cuuugucuucaau

SEQ ID NO: 3945329 - RNA, 14 nt, Shigella flexneri 2a str. 301
cuuugugcuucagu

SEQ ID NO: 3945330 - RNA, 16 nt, Shigella flexneri 2a str. 301
cuuuguguugcugaac

SEQ ID NO: 3945331 - RNA, 19 nt, Shigella flexneri 2a str. 301
cuuuguuacccccauccac

SEQ ID NO: 3945332 - RNA, 21 nt, Shigella flexneri 2a str. 301
cuuuguuacccccauccacgc

SEQ ID NO: 3945333 - RNA, 17 nt, Shigella flexneri 2a str. 301
cuuuguuagcgaauaaa

SEQ ID NO: 3945334 - RNA, 14 nt, Shigella flexneri 2a str. 301
cuuuguucugaauc

SEQ ID NO: 3945335 - RNA, 22 nt, Shigella flexneri 2a str. 301
cuuuuaauaauucaaaaaccug

SEQ ID NO: 3945336 - RNA, 16 nt, Shigella flexneri 2a str. 301
cuuuuaaugcuuuaaa

SEQ ID NO: 3945337 - RNA, 17 nt, Shigella flexneri 2a str. 301
cuuuuacagcgccagaa

SEQ ID NO: 3945338 - RNA, 20 nt, Shigella flexneri 2a str. 301
cuuuuacaucuacaaaaaac

SEQ ID NO: 3945339 - RNA, 20 nt, Shigella flexneri 2a str. 301
cuuuuacaugcgcgacaaaa

SEQ ID NO: 3945340 - RNA, 21 nt, Shigella flexneri 2a str. 301
cuuuuacaugcgcgacaaaaa

SEQ ID NO: 3945341 - RNA, 23 nt, Shigella flexneri 2a str. 301
cuuuuaccagcgccugcgcggca

SEQ ID NO: 3945342 - RNA, 14 nt, Shigella flexneri 2a str. 301
cuuuuacucucugg

SEQ ID NO: 3945343 - RNA, 16 nt, Shigella flexneri 2a str. 301
cuuuuagcucgcgguu

SEQ ID NO: 3945344 - RNA, 11 nt, Shigella flexneri 2a str. 301
cuuuuaucugu

SEQ ID NO: 3945345 - RNA, 20 nt, Shigella flexneri 2a str. 301
cuuuuauuauuacuuauccc

SEQ ID NO: 3945346 - RNA, 14 nt, Shigella flexneri 2a str. 301
cuuuuauuuaaccg

SEQ ID NO: 3945347 - RNA, 21 nt, Shigella flexneri 2a str. 301
cuuuucaacaaauucuggcac

SEQ ID NO: 3945348 - RNA, 20 nt, Shigella flexneri 2a str. 301
cuuuucaggcuagccgccag

SEQ ID NO: 3945349 - RNA, 22 nt, Shigella flexneri 2a str. 301
cuuuucaguuggcugacaaagu

SEQ ID NO: 3945350 - RNA, 21 nt, Shigella flexneri 2a str. 301
cuuuucaucagguuggaucaa

SEQ ID NO: 3945351 - RNA, 17 nt, Shigella flexneri 2a str. 301
cuuuucaucgcaucgau

SEQ ID NO: 3945352 - RNA, 15 nt, Shigella flexneri 2a str. 301
cuuuuccauaucaag

SEQ ID NO: 3945353 - RNA, 18 nt, Shigella flexneri 2a str. 301
cuuuuccauaucaagcau

SEQ ID NO: 3945354 - RNA, 13 nt, Shigella flexneri 2a str. 301
cuuuucccagcgc

SEQ ID NO: 3945355 - RNA, 14 nt, Shigella flexneri 2a str. 301
cuuuucccuccacu

SEQ ID NO: 3945356 - RNA, 15 nt, Shigella flexneri 2a str. 301
cuuuuccgaaccgga

SEQ ID NO: 3945357 - RNA, 16 nt, Shigella flexneri 2a str. 301
cuuuuccgccucauca

SEQ ID NO: 3945358 - RNA, 18 nt, Shigella flexneri 2a str. 301
cuuuuccucucaugagca

SEQ ID NO: 3945359 - RNA, 23 nt, Shigella flexneri 2a str. 301
cuuuucgccaccggcaaucugcu

SEQ ID NO: 3945360 - RNA, 20 nt, Shigella flexneri 2a str. 301
cuuuucgcccuggacaacau

SEQ ID NO: 3945361 - RNA, 13 nt, Shigella flexneri 2a str. 301
cuuuucucaauca

SEQ ID NO: 3945362 - RNA, 16 nt, Shigella flexneri 2a str. 301
cuuuucugaaguacac

SEQ ID NO: 3945363 - RNA, 21 nt, Shigella flexneri 2a str. 301
cuuuucugaaguacacauaaa

SEQ ID NO: 3945364 - RNA, 23 nt, Shigella flexneri 2a str. 301
cuuuucuuucgcccaauaaaaaa

SEQ ID NO: 3945365 - RNA, 16 nt, Shigella flexneri 2a str. 301
cuuuugacuuugccga

SEQ ID NO: 3945366 - RNA, 14 nt, Shigella flexneri 2a str. 301
cuuuugauacuucc

SEQ ID NO: 3945367 - RNA, 12 nt, Shigella flexneri 2a str. 301
cuuuugccagaa

SEQ ID NO: 3945368 - RNA, 17 nt, Shigella flexneri 2a str. 301
cuuuugccagaauagcg

SEQ ID NO: 3945369 - RNA, 22 nt, Shigella flexneri 2a str. 301
cuuuuggcaaagguucaagcag

SEQ ID NO: 3945370 - RNA, 22 nt, Shigella flexneri 2a str. 301
cuuuuggcgcguuccccuguug

SEQ ID NO: 3945371 - RNA, 22 nt, Shigella flexneri 2a str. 301
cuuuugggcguaagaugacauu

SEQ ID NO: 3945372 - RNA, 18 nt, Shigella flexneri 2a str. 301
cuuuuggugcuuuugcug

SEQ ID NO: 3945373 - RNA, 15 nt, Shigella flexneri 2a str. 301
cuuuuguuucccgau

SEQ ID NO: 3945374 - RNA, 19 nt, Shigella flexneri 2a str. 301
cuuuuguuuguucuucucg

SEQ ID NO: 3945375 - RNA, 22 nt, Shigella flexneri 2a str. 301
cuuuuuaaacgaauaguuucag

SEQ ID NO: 3945376 - RNA, 18 nt, Shigella flexneri 2a str. 301
cuuuuuaugucauuaacc

SEQ ID NO: 3945377 - RNA, 19 nt, Shigella flexneri 2a str. 301
cuuuuucaagcucaaaaua

SEQ ID NO: 3945378 - RNA, 19 nt, Shigella flexneri 2a str. 301
cuuuuucaauuccauuucc

SEQ ID NO: 3945379 - RNA, 21 nt, Shigella flexneri 2a str. 301
cuuuuucaauuccauuucccu

SEQ ID NO: 3945380 - RNA, 21 nt, Shigella flexneri 2a str. 301
cuuuuucaugcuauuccuuga

SEQ ID NO: 3945381 - RNA, 20 nt, Shigella flexneri 2a str. 301
cuuuuuccaguccacguuca

SEQ ID NO: 3945382 - RNA, 17 nt, Shigella flexneri 2a str. 301
cuuuuucgaucacuuuu

SEQ ID NO: 3945383 - RNA, 20 nt, Shigella flexneri 2a str. 301
cuuuuucucccuuaaaaaau

SEQ ID NO: 3945384 - RNA, 20 nt, Shigella flexneri 2a str. 301
cuuuuugaacggugaugcuc

SEQ ID NO: 3945385 - RNA, 15 nt, Shigella flexneri 2a str. 301
cuuuuugguucaucg

SEQ ID NO: 3945386 - RNA, 17 nt, Shigella flexneri 2a str. 301
cuuuuuguaauuuuuuu

SEQ ID NO: 3945387 - RNA, 12 nt, Shigella flexneri 2a str. 301
cuuuuuuaaaca

SEQ ID NO: 3945388 - RNA, 18 nt, Shigella flexneri 2a str. 301
cuuuuuuaagauccaguu

SEQ ID NO: 3945389 - RNA, 16 nt, Shigella flexneri 2a str. 301
cuuuuuuacaucauca

SEQ ID NO: 3945390 - RNA, 20 nt, Shigella flexneri 2a str. 301
cuuuuuucaauucucuaauc

SEQ ID NO: 3945391 - RNA, 21 nt, Shigella flexneri 2a str. 301
cuuuuuucaugggugccagau

SEQ ID NO: 3945392 - RNA, 20 nt, Shigella flexneri 2a str. 301
cuuuuuuccagcacacccau

SEQ ID NO: 3945393 - RNA, 20 nt, Shigella flexneri 2a str. 301
cuuuuuugagcagcauuacc

SEQ ID NO: 3945394 - RNA, 21 nt, Shigella flexneri 2a str. 301
cuuuuuugguuauccagcaac

SEQ ID NO: 3945395 - RNA, 16 nt, Shigella flexneri 2a str. 301
cuuuuuuugccccaga

SEQ ID NO: 3945396 - RNA, 22 nt, Shigella flexneri 2a str. 301
cuuuuuuuugccaaauaucuua

SEQ ID NO: 3945397 - RNA, 21 nt, Shigella flexneri 2a str. 301
gaaaaaaaauuacaaaaagug

SEQ ID NO: 3945398 - RNA, 12 nt, Shigella flexneri 2a str. 301
gaaaaaaacugc

SEQ ID NO: 3945399 - RNA, 12 nt, Shigella flexneri 2a str. 301
gaaaaaacaaau

SEQ ID NO: 3945400 - RNA, 13 nt, Shigella flexneri 2a str. 301
gaaaaaaccagaa

SEQ ID NO: 3945401 - RNA, 14 nt, Shigella flexneri 2a str. 301
gaaaaaaucccacu

SEQ ID NO: 3945402 - RNA, 18 nt, Shigella flexneri 2a str. 301
gaaaaaccaaucucccag

SEQ ID NO: 3945403 - RNA, 16 nt, Shigella flexneri 2a str. 301
gaaaaaccagacagca

SEQ ID NO: 3945404 - RNA, 19 nt, Shigella flexneri 2a str. 301
gaaaaaccguguuuaugaa

SEQ ID NO: 3945405 - RNA, 18 nt, Shigella flexneri 2a str. 301
gaaaaaccuccggcguuu

SEQ ID NO: 3945406 - RNA, 22 nt, Shigella flexneri 2a str. 301
gaaaaacgggucgccagaaggu

SEQ ID NO: 3945407 - RNA, 12 nt, Shigella flexneri 2a str. 301
gaaaaacugccc

SEQ ID NO: 3945408 - RNA, 18 nt, Shigella flexneri 2a str. 301
gaaaaagagcagcugauu

SEQ ID NO: 3945409 - RNA, 13 nt, Shigella flexneri 2a str. 301
gaaaaagagcauc

SEQ ID NO: 3945410 - RNA, 15 nt, Shigella flexneri 2a str. 301
gaaaaagagcaucag

SEQ ID NO: 3945411 - RNA, 22 nt, Shigella flexneri 2a str. 301
gaaaaaguugcacgccaggcac

SEQ ID NO: 3945412 - RNA, 18 nt, Shigella flexneri 2a str. 301
gaaaaauaacgacgaagc

SEQ ID NO: 3945413 - RNA, 13 nt, Shigella flexneri 2a str. 301
gaaaaauagcauu

SEQ ID NO: 3945414 - RNA, 22 nt, Shigella flexneri 2a str. 301
gaaaaaucaauauuuucaaucu

SEQ ID NO: 3945415 - RNA, 23 nt, Shigella flexneri 2a str. 301
gaaaaaugaauaccaagucucaa

SEQ ID NO: 3945416 - RNA, 20 nt, Shigella flexneri 2a str. 301
gaaaacaauguucaucugca

SEQ ID NO: 3945417 - RNA, 12 nt, Shigella flexneri 2a str. 301
gaaaacagcgca

SEQ ID NO: 3945418 - RNA, 23 nt, Shigella flexneri 2a str. 301
gaaaacagcgcaccagaaacaau

SEQ ID NO: 3945419 - RNA, 13 nt, Shigella flexneri 2a str. 301
gaaaacagcggcc

SEQ ID NO: 3945420 - RNA, 14 nt, Shigella flexneri 2a str. 301
gaaaaccacuccug

SEQ ID NO: 3945421 - RNA, 15 nt, Shigella flexneri 2a str. 301
gaaaaccgaugcagu

SEQ ID NO: 3945422 - RNA, 22 nt, Shigella flexneri 2a str. 301
gaaaaccggacugaaaguacuu

SEQ ID NO: 3945423 - RNA, 22 nt, Shigella flexneri 2a str. 301
gaaaaccgguacagaaucugaa

SEQ ID NO: 3945424 - RNA, 14 nt, Shigella flexneri 2a str. 301
gaaaacgaaagcgc

SEQ ID NO: 3945425 - RNA, 15 nt, Shigella flexneri 2a str. 301
gaaaacgaaagcgcc

SEQ ID NO: 3945426 - RNA, 15 nt, Shigella flexneri 2a str. 301
gaaaacgaauacugg

SEQ ID NO: 3945427 - RNA, 14 nt, Shigella flexneri 2a str. 301
gaaaacgaauugca

SEQ ID NO: 3945428 - RNA, 17 nt, Shigella flexneri 2a str. 301
gaaaacgcauaccaguc

SEQ ID NO: 3945429 - RNA, 18 nt, Shigella flexneri 2a str. 301
gaaaacgccacauccggc

SEQ ID NO: 3945430 - RNA, 23 nt, Shigella flexneri 2a str. 301
gaaaacgccggagugaaaauucu

SEQ ID NO: 3945431 - RNA, 18 nt, Shigella flexneri 2a str. 301
gaaaacgcuggcagcauu

SEQ ID NO: 3945432 - RNA, 22 nt, Shigella flexneri 2a str. 301
gaaaacgucaugguuauuucac

SEQ ID NO: 3945433 - RNA, 22 nt, Shigella flexneri 2a str. 301
gaaaacuaaccuuacaaguaag

SEQ ID NO: 3945434 - RNA, 20 nt, Shigella flexneri 2a str. 301
gaaaagcaaaagauggaaaa

SEQ ID NO: 3945435 - RNA, 14 nt, Shigella flexneri 2a str. 301
gaaaagcaccuguc

SEQ ID NO: 3945436 - RNA, 14 nt, Shigella flexneri 2a str. 301
gaaaagccaaugaa

SEQ ID NO: 3945437 - RNA, 18 nt, Shigella flexneri 2a str. 301
gaaaagccggaauguacu

SEQ ID NO: 3945438 - RNA, 19 nt, Shigella flexneri 2a str. 301
gaaaagcgagaguuacagc

SEQ ID NO: 3945439 - RNA, 17 nt, Shigella flexneri 2a str. 301
gaaaagcguuacgacug

SEQ ID NO: 3945440 - RNA, 16 nt, Shigella flexneri 2a str. 301
gaaaagcuucuuccuc

SEQ ID NO: 3945441 - RNA, 16 nt, Shigella flexneri 2a str. 301
gaaaagguagaauaag

SEQ ID NO: 3945442 - RNA, 21 nt, Shigella flexneri 2a str. 301
gaaaagguucgggagcaggcc

SEQ ID NO: 3945443 - RNA, 16 nt, Shigella flexneri 2a str. 301
gaaaaguuacgguuaa

SEQ ID NO: 3945444 - RNA, 16 nt, Shigella flexneri 2a str. 301
gaaaauaaaaaacauu

SEQ ID NO: 3945445 - RNA, 17 nt, Shigella flexneri 2a str. 301
gaaaauaaaauguacau

SEQ ID NO: 3945446 - RNA, 19 nt, Shigella flexneri 2a str. 301
gaaaauaaauguguuuuua

SEQ ID NO: 3945447 - RNA, 18 nt, Shigella flexneri 2a str. 301
gaaaauaauccgcuguaa

SEQ ID NO: 3945448 - RNA, 20 nt, Shigella flexneri 2a str. 301
gaaaauagacguucuucuuc

SEQ ID NO: 3945449 - RNA, 12 nt, Shigella flexneri 2a str. 301
gaaaauaucggu

SEQ ID NO: 3945450 - RNA, 13 nt, Shigella flexneri 2a str. 301
gaaaaucaccauu

SEQ ID NO: 3945451 - RNA, 14 nt, Shigella flexneri 2a str. 301
gaaaaucagcauca

SEQ ID NO: 3945452 - RNA, 21 nt, Shigella flexneri 2a str. 301
gaaaaucucaauguauucccg

SEQ ID NO: 3945453 - RNA, 17 nt, Shigella flexneri 2a str. 301
gaaaaucucauaucccc

SEQ ID NO: 3945454 - RNA, 20 nt, Shigella flexneri 2a str. 301
gaaaaucugaauuguuuuuc

SEQ ID NO: 3945455 - RNA, 14 nt, Shigella flexneri 2a str. 301
gaaaaucugcggga

SEQ ID NO: 3945456 - RNA, 14 nt, Shigella flexneri 2a str. 301
gaaaaucuucucuc

SEQ ID NO: 3945457 - RNA, 23 nt, Shigella flexneri 2a str. 301
gaaaaugaguauucaguaugacu

SEQ ID NO: 3945458 - RNA, 23 nt, Shigella flexneri 2a str. 301
gaaaaugcccauggcaagaauaa

SEQ ID NO: 3945459 - RNA, 18 nt, Shigella flexneri 2a str. 301
gaaaauggccagccagca

SEQ ID NO: 3945460 - RNA, 19 nt, Shigella flexneri 2a str. 301
gaaaauggcggaggauuuc

SEQ ID NO: 3945461 - RNA, 19 nt, Shigella flexneri 2a str. 301
gaaaaugggagcugggagu

SEQ ID NO: 3945462 - RNA, 13 nt, Shigella flexneri 2a str. 301
gaaaauuauaucu

SEQ ID NO: 3945463 - RNA, 14 nt, Shigella flexneri 2a str. 301
gaaacaacaccgug

SEQ ID NO: 3945464 - RNA, 20 nt, Shigella flexneri 2a str. 301
gaaacaacguggaacaaaua

SEQ ID NO: 3945465 - RNA, 16 nt, Shigella flexneri 2a str. 301
gaaacacacuuuccag

SEQ ID NO: 3945466 - RNA, 12 nt, Shigella flexneri 2a str. 301
gaaacaccagaa

SEQ ID NO: 3945467 - RNA, 19 nt, Shigella flexneri 2a str. 301
gaaacagcaccauccgccc

SEQ ID NO: 3945468 - RNA, 19 nt, Shigella flexneri 2a str. 301
gaaacaggggcuggaagau

SEQ ID NO: 3945469 - RNA, 20 nt, Shigella flexneri 2a str. 301
gaaaccaacuccagcggcgc

SEQ ID NO: 3945470 - RNA, 16 nt, Shigella flexneri 2a str. 301
gaaaccacccaccgca

SEQ ID NO: 3945471 - RNA, 16 nt, Shigella flexneri 2a str. 301
gaaaccacugcaacag

SEQ ID NO: 3945472 - RNA, 19 nt, Shigella flexneri 2a str. 301
gaaacccgcugccaucgca

SEQ ID NO: 3945473 - RNA, 13 nt, Shigella flexneri 2a str. 301
gaaaccgaaguug

SEQ ID NO: 3945474 - RNA, 23 nt, Shigella flexneri 2a str. 301
gaaaccgacuuacuuauuucugu

SEQ ID NO: 3945475 - RNA, 14 nt, Shigella flexneri 2a str. 301
gaaaccuggauauu

SEQ ID NO: 3945476 - RNA, 20 nt, Shigella flexneri 2a str. 301
gaaaccuugcauagcuucga

SEQ ID NO: 3945477 - RNA, 20 nt, Shigella flexneri 2a str. 301
gaaaccuugugcacgcgcuu

SEQ ID NO: 3945478 - RNA, 24 nt, Shigella flexneri 2a str. 301
gaaacgaaccauaaaaucacaggu

SEQ ID NO: 3945479 - RNA, 21 nt, Shigella flexneri 2a str. 301
gaaacgaugguugucacugca

SEQ ID NO: 3945480 - RNA, 22 nt, Shigella flexneri 2a str. 301
gaaacgccaccauuuuacgucc

SEQ ID NO: 3945481 - RNA, 23 nt, Shigella flexneri 2a str. 301
gaaacggagaucgagcgcgagca

SEQ ID NO: 3945482 - RNA, 23 nt, Shigella flexneri 2a str. 301
gaaacucacgcagggugugcucc

SEQ ID NO: 3945483 - RNA, 16 nt, Shigella flexneri 2a str. 301
gaaacucgcugccagc

SEQ ID NO: 3945484 - RNA, 18 nt, Shigella flexneri 2a str. 301
gaaacucgcugccagcac

SEQ ID NO: 3945485 - RNA, 18 nt, Shigella flexneri 2a str. 301
gaaacugacuguuucacc

SEQ ID NO: 3945486 - RNA, 14 nt, Shigella flexneri 2a str. 301
gaaacugauaauuu

SEQ ID NO: 3945487 - RNA, 13 nt, Shigella flexneri 2a str. 301
gaaacuggcccuc

SEQ ID NO: 3945488 - RNA, 21 nt, Shigella flexneri 2a str. 301
gaaacugucaauaaacgccug

SEQ ID NO: 3945489 - RNA, 12 nt, Shigella flexneri 2a str. 301
gaaacuuauuca

SEQ ID NO: 3945490 - RNA, 18 nt, Shigella flexneri 2a str. 301
gaaacuucacaucaccau

SEQ ID NO: 3945491 - RNA, 21 nt, Shigella flexneri 2a str. 301
gaaagaagcccacgagcaaaa

SEQ ID NO: 3945492 - RNA, 22 nt, Shigella flexneri 2a str. 301
gaaagaagcuuuccacgcaggc

SEQ ID NO: 3945493 - RNA, 22 nt, Shigella flexneri 2a str. 301
gaaagacgguuaaugcguuuug

SEQ ID NO: 3945494 - RNA, 16 nt, Shigella flexneri 2a str. 301
gaaagagcgucuggaa

SEQ ID NO: 3945495 - RNA, 21 nt, Shigella flexneri 2a str. 301
gaaagagcgucuggaagaagu

SEQ ID NO: 3945496 - RNA, 14 nt, Shigella flexneri 2a str. 301
gaaagaggcggaua

SEQ ID NO: 3945497 - RNA, 22 nt, Shigella flexneri 2a str. 301
gaaagcaaugaaauucauuuga

SEQ ID NO: 3945498 - RNA, 20 nt, Shigella flexneri 2a str. 301
gaaagcaauuaacagugaca

SEQ ID NO: 3945499 - RNA, 16 nt, Shigella flexneri 2a str. 301
gaaagcaccugcgcag

SEQ ID NO: 3945500 - RNA, 20 nt, Shigella flexneri 2a str. 301
gaaagcaccugcgcaggcau

SEQ ID NO: 3945501 - RNA, 23 nt, Shigella flexneri 2a str. 301
gaaagcagcauguagaugccggu

SEQ ID NO: 3945502 - RNA, 16 nt, Shigella flexneri 2a str. 301
gaaagccccaccagca

SEQ ID NO: 3945503 - RNA, 17 nt, Shigella flexneri 2a str. 301
gaaagcccuugccgaug

SEQ ID NO: 3945504 - RNA, 18 nt, Shigella flexneri 2a str. 301
gaaagcgagcaguacagc

SEQ ID NO: 3945505 - RNA, 21 nt, Shigella flexneri 2a str. 301
gaaagcgccaucaaugugcug

SEQ ID NO: 3945506 - RNA, 20 nt, Shigella flexneri 2a str. 301
gaaagcggaucaguuccagc

SEQ ID NO: 3945507 - RNA, 23 nt, Shigella flexneri 2a str. 301
gaaagcggaucaguuccagcagc

SEQ ID NO: 3945508 - RNA, 19 nt, Shigella flexneri 2a str. 301
gaaagcgggugaaggugcc

SEQ ID NO: 3945509 - RNA, 20 nt, Shigella flexneri 2a str. 301
gaaagcguauccaucacuaa

SEQ ID NO: 3945510 - RNA, 23 nt, Shigella flexneri 2a str. 301
gaaagcguuuaugcgcauugcca

SEQ ID NO: 3945511 - RNA, 16 nt, Shigella flexneri 2a str. 301
gaaagcuugcgucgcc

SEQ ID NO: 3945512 - RNA, 12 nt, Shigella flexneri 2a str. 301
gaaaggcgcggu

SEQ ID NO: 3945513 - RNA, 15 nt, Shigella flexneri 2a str. 301
gaaagggcaaauaau

SEQ ID NO: 3945514 - RNA, 18 nt, Shigella flexneri 2a str. 301
gaaaguaaaccaccaguc

SEQ ID NO: 3945515 - RNA, 15 nt, Shigella flexneri 2a str. 301
gaaagucauggcaaa

SEQ ID NO: 3945516 - RNA, 17 nt, Shigella flexneri 2a str. 301
gaaagucguaggccuga

SEQ ID NO: 3945517 - RNA, 16 nt, Shigella flexneri 2a str. 301
gaaagugacagcccgg

SEQ ID NO: 3945518 - RNA, 15 nt, Shigella flexneri 2a str. 301
gaaagugaguuuugc

SEQ ID NO: 3945519 - RNA, 22 nt, Shigella flexneri 2a str. 301
gaaagugccggauguuugcauc

SEQ ID NO: 3945520 - RNA, 20 nt, Shigella flexneri 2a str. 301
gaaaguggaaaaauaacaaa

SEQ ID NO: 3945521 - RNA, 16 nt, Shigella flexneri 2a str. 301
gaaagugguguucuuu

SEQ ID NO: 3945522 - RNA, 17 nt, Shigella flexneri 2a str. 301
gaaaguguaaagcaggu

SEQ ID NO: 3945523 - RNA, 20 nt, Shigella flexneri 2a str. 301
gaaauaaaaaaaguauuuuu

SEQ ID NO: 3945524 - RNA, 19 nt, Shigella flexneri 2a str. 301
gaaauaaaaauaagaaaga

SEQ ID NO: 3945525 - RNA, 14 nt, Shigella flexneri 2a str. 301
gaaauaaaccgcgc

SEQ ID NO: 3945526 - RNA, 15 nt, Shigella flexneri 2a str. 301
gaaauaaucaccuga

SEQ ID NO: 3945527 - RNA, 21 nt, Shigella flexneri 2a str. 301
gaaauaaucgggaauacagaa

SEQ ID NO: 3945528 - RNA, 17 nt, Shigella flexneri 2a str. 301
gaaauacguaggccuga

SEQ ID NO: 3945529 - RNA, 18 nt, Shigella flexneri 2a str. 301
gaaauagaacaguuacgc

SEQ ID NO: 3945530 - RNA, 18 nt, Shigella flexneri 2a str. 301
gaaauagagaaaguaaac

SEQ ID NO: 3945531 - RNA, 23 nt, Shigella flexneri 2a str. 301
gaaauaguugcauuccaguccac

SEQ ID NO: 3945532 - RNA, 12 nt, Shigella flexneri 2a str. 301
gaaauauauccu

SEQ ID NO: 3945533 - RNA, 14 nt, Shigella flexneri 2a str. 301
gaaauauauucccc

SEQ ID NO: 3945534 - RNA, 20 nt, Shigella flexneri 2a str. 301
gaaauaucggcgucguugua

SEQ ID NO: 3945535 - RNA, 21 nt, Shigella flexneri 2a str. 301
gaaauauggcucugcggcgga

SEQ ID NO: 3945536 - RNA, 12 nt, Shigella flexneri 2a str. 301
gaaaucaaguua

SEQ ID NO: 3945537 - RNA, 16 nt, Shigella flexneri 2a str. 301
gaaaucaccaccagca

SEQ ID NO: 3945538 - RNA, 21 nt, Shigella flexneri 2a str. 301
gaaaucaccaccagcaccgcg

SEQ ID NO: 3945539 - RNA, 15 nt, Shigella flexneri 2a str. 301
gaaaucaccaccgca

SEQ ID NO: 3945540 - RNA, 20 nt, Shigella flexneri 2a str. 301
gaaaucagcagcuuugcccg

SEQ ID NO: 3945541 - RNA, 18 nt, Shigella flexneri 2a str. 301
gaaaucagcuuuggugaa

SEQ ID NO: 3945542 - RNA, 19 nt, Shigella flexneri 2a str. 301
gaaaucagcuuuggugaaa

SEQ ID NO: 3945543 - RNA, 15 nt, Shigella flexneri 2a str. 301
gaaaucauucaauac

SEQ ID NO: 3945544 - RNA, 16 nt, Shigella flexneri 2a str. 301
gaaauccaggucagca

SEQ ID NO: 3945545 - RNA, 22 nt, Shigella flexneri 2a str. 301
gaaauccggcaccugucagacu

SEQ ID NO: 3945546 - RNA, 22 nt, Shigella flexneri 2a str. 301
gaaauccgguucauggucgcca

SEQ ID NO: 3945547 - RNA, 21 nt, Shigella flexneri 2a str. 301
gaaauccugccgcaguuucug

SEQ ID NO: 3945548 - RNA, 14 nt, Shigella flexneri 2a str. 301
gaaaucgaucauca

SEQ ID NO: 3945549 - RNA, 14 nt, Shigella flexneri 2a str. 301
gaaaucuccagaua

SEQ ID NO: 3945550 - RNA, 13 nt, Shigella flexneri 2a str. 301
gaaaucugacucu

SEQ ID NO: 3945551 - RNA, 17 nt, Shigella flexneri 2a str. 301
gaaaucugauauaccgc

SEQ ID NO: 3945552 - RNA, 17 nt, Shigella flexneri 2a str. 301
gaaaucugaucguguaa

SEQ ID NO: 3945553 - RNA, 17 nt, Shigella flexneri 2a str. 301
gaaaugaaaaaauagaa

SEQ ID NO: 3945554 - RNA, 21 nt, Shigella flexneri 2a str. 301
gaaaugagauauuucagagcu

SEQ ID NO: 3945555 - RNA, 18 nt, Shigella flexneri 2a str. 301
gaaaugccaaauauuucu

SEQ ID NO: 3945556 - RNA, 15 nt, Shigella flexneri 2a str. 301
gaaaugccaguaacu

SEQ ID NO: 3945557 - RNA, 19 nt, Shigella flexneri 2a str. 301
gaaauggcccaaaaggcag

SEQ ID NO: 3945558 - RNA, 21 nt, Shigella flexneri 2a str. 301
gaaauggcccaaaaggcagcg

SEQ ID NO: 3945559 - RNA, 13 nt, Shigella flexneri 2a str. 301
gaaauggcguuag

SEQ ID NO: 3945560 - RNA, 21 nt, Shigella flexneri 2a str. 301
gaaauggcguuagucaugaaa

SEQ ID NO: 3945561 - RNA, 23 nt, Shigella flexneri 2a str. 301
gaaauggcguuagucaugaaaua

SEQ ID NO: 3945562 - RNA, 15 nt, Shigella flexneri 2a str. 301
gaaaugguaaagaag

SEQ ID NO: 3945563 - RNA, 21 nt, Shigella flexneri 2a str. 301
gaaauggugugcaugguguuc

SEQ ID NO: 3945564 - RNA, 13 nt, Shigella flexneri 2a str. 301
gaaauuaccgcaa

SEQ ID NO: 3945565 - RNA, 18 nt, Shigella flexneri 2a str. 301
gaaauuaccgcaccacca

SEQ ID NO: 3945566 - RNA, 12 nt, Shigella flexneri 2a str. 301
gaaauuauuucu

SEQ ID NO: 3945567 - RNA, 19 nt, Shigella flexneri 2a str. 301
gaaauuauuucuuuuacau

SEQ ID NO: 3945568 - RNA, 14 nt, Shigella flexneri 2a str. 301
gaaauucagcgucg

SEQ ID NO: 3945569 - RNA, 15 nt, Shigella flexneri 2a str. 301
gaaauuccagcggca

SEQ ID NO: 3945570 - RNA, 13 nt, Shigella flexneri 2a str. 301
gaaauuccugaga

SEQ ID NO: 3945571 - RNA, 18 nt, Shigella flexneri 2a str. 301
gaaauugaaaaaccagac

SEQ ID NO: 3945572 - RNA, 21 nt, Shigella flexneri 2a str. 301
gaaauuguaaacgaguuaagc

SEQ ID NO: 3945573 - RNA, 19 nt, Shigella flexneri 2a str. 301
gaaauuuaucgcauauccu

SEQ ID NO: 3945574 - RNA, 15 nt, Shigella flexneri 2a str. 301
gaaauuuccugagca

SEQ ID NO: 3945575 - RNA, 16 nt, Shigella flexneri 2a str. 301
gaaauuucuuccucgu

SEQ ID NO: 3945576 - RNA, 13 nt, Shigella flexneri 2a str. 301
gaacaaaaaagag

SEQ ID NO: 3945577 - RNA, 14 nt, Shigella flexneri 2a str. 301
gaacaaaaucuuaa

SEQ ID NO: 3945578 - RNA, 16 nt, Shigella flexneri 2a str. 301
gaacaaauaaauagau

SEQ ID NO: 3945579 - RNA, 15 nt, Shigella flexneri 2a str. 301
gaacaacaagaagcg

SEQ ID NO: 3945580 - RNA, 22 nt, Shigella flexneri 2a str. 301
gaacaacccggcgaaagagcug

SEQ ID NO: 3945581 - RNA, 23 nt, Shigella flexneri 2a str. 301
gaacaacccuaaagcacccagca

SEQ ID NO: 3945582 - RNA, 21 nt, Shigella flexneri 2a str. 301
gaacaacgcgcgucugauauu

SEQ ID NO: 3945583 - RNA, 13 nt, Shigella flexneri 2a str. 301
gaacaagcaagag

SEQ ID NO: 3945584 - RNA, 16 nt, Shigella flexneri 2a str. 301
gaacaauacaggacgc

SEQ ID NO: 3945585 - RNA, 15 nt, Shigella flexneri 2a str. 301
gaacaauuaacccgc

SEQ ID NO: 3945586 - RNA, 13 nt, Shigella flexneri 2a str. 301
gaacacagugguu

SEQ ID NO: 3945587 - RNA, 12 nt, Shigella flexneri 2a str. 301
gaacaccagcag

SEQ ID NO: 3945588 - RNA, 13 nt, Shigella flexneri 2a str. 301
gaacaccauaaug

SEQ ID NO: 3945589 - RNA, 22 nt, Shigella flexneri 2a str. 301
gaacacccgacgugcagcaucg

SEQ ID NO: 3945590 - RNA, 23 nt, Shigella flexneri 2a str. 301
gaacacccgacgugcagcaucga

SEQ ID NO: 3945591 - RNA, 22 nt, Shigella flexneri 2a str. 301
gaacaccguaccaucguaagcg

SEQ ID NO: 3945592 - RNA, 15 nt, Shigella flexneri 2a str. 301
gaacacgaucucacg

SEQ ID NO: 3945593 - RNA, 19 nt, Shigella flexneri 2a str. 301
gaacacggaucaggcggcu

SEQ ID NO: 3945594 - RNA, 23 nt, Shigella flexneri 2a str. 301
gaacacgguaguuaaacuuucau

SEQ ID NO: 3945595 - RNA, 15 nt, Shigella flexneri 2a str. 301
gaacacucuuccagu

SEQ ID NO: 3945596 - RNA, 17 nt, Shigella flexneri 2a str. 301
gaacacucuuccagucg

SEQ ID NO: 3945597 - RNA, 24 nt, Shigella flexneri 2a str. 301
gaacacucuuccagucgccugcuu

SEQ ID NO: 3945598 - RNA, 22 nt, Shigella flexneri 2a str. 301
gaacacuucuucugucgggcau

SEQ ID NO: 3945599 - RNA, 17 nt, Shigella flexneri 2a str. 301
gaacagaagaaagcaau

SEQ ID NO: 3945600 - RNA, 18 nt, Shigella flexneri 2a str. 301
gaacagaauguuugccau

SEQ ID NO: 3945601 - RNA, 13 nt, Shigella flexneri 2a str. 301
gaacagaccagca

SEQ ID NO: 3945602 - RNA, 14 nt, Shigella flexneri 2a str. 301
gaacagaccaguaa

SEQ ID NO: 3945603 - RNA, 18 nt, Shigella flexneri 2a str. 301
gaacagcacaucagccag

SEQ ID NO: 3945604 - RNA, 21 nt, Shigella flexneri 2a str. 301
gaacagccacuggugagcggu

SEQ ID NO: 3945605 - RNA, 17 nt, Shigella flexneri 2a str. 301
gaacagccggaugucug

SEQ ID NO: 3945606 - RNA, 20 nt, Shigella flexneri 2a str. 301
gaacagccugugccugagcc

SEQ ID NO: 3945607 - RNA, 20 nt, Shigella flexneri 2a str. 301
gaacagcgccagacaaacca

SEQ ID NO: 3945608 - RNA, 21 nt, Shigella flexneri 2a str. 301
gaacaggucgagaacaacggc

SEQ ID NO: 3945609 - RNA, 14 nt, Shigella flexneri 2a str. 301
gaacagugccaugc

SEQ ID NO: 3945610 - RNA, 15 nt, Shigella flexneri 2a str. 301
gaacaguucagcagc

SEQ ID NO: 3945611 - RNA, 16 nt, Shigella flexneri 2a str. 301
gaacaguucagcagca

SEQ ID NO: 3945612 - RNA, 21 nt, Shigella flexneri 2a str. 301
gaacaguucagcagcacuaca

SEQ ID NO: 3945613 - RNA, 22 nt, Shigella flexneri 2a str. 301
gaacaguucagcagcacuacac

SEQ ID NO: 3945614 - RNA, 15 nt, Shigella flexneri 2a str. 301
gaacauacacaagcc

SEQ ID NO: 3945615 - RNA, 17 nt, Shigella flexneri 2a str. 301
gaacaucaauccaaaca

SEQ ID NO: 3945616 - RNA, 22 nt, Shigella flexneri 2a str. 301
gaacaucaauccaaacauggca

SEQ ID NO: 3945617 - RNA, 15 nt, Shigella flexneri 2a str. 301
gaacaucacugcaaa

SEQ ID NO: 3945618 - RNA, 12 nt, Shigella flexneri 2a str. 301
gaacaucgccau

SEQ ID NO: 3945619 - RNA, 16 nt, Shigella flexneri 2a str. 301
gaacaucucuucccau

SEQ ID NO: 3945620 - RNA, 12 nt, Shigella flexneri 2a str. 301
gaacaucugccc

SEQ ID NO: 3945621 - RNA, 15 nt, Shigella flexneri 2a str. 301
gaacauuacuuuccg

SEQ ID NO: 3945622 - RNA, 16 nt, Shigella flexneri 2a str. 301
gaacauuacuuuccgu

SEQ ID NO: 3945623 - RNA, 19 nt, Shigella flexneri 2a str. 301
gaacauuauuuuugcgaca

SEQ ID NO: 3945624 - RNA, 15 nt, Shigella flexneri 2a str. 301
gaacauuuaccgcaa

SEQ ID NO: 3945625 - RNA, 18 nt, Shigella flexneri 2a str. 301
gaaccaaacagcgccaga

SEQ ID NO: 3945626 - RNA, 17 nt, Shigella flexneri 2a str. 301
gaaccacaaugaagaaa

SEQ ID NO: 3945627 - RNA, 21 nt, Shigella flexneri 2a str. 301
gaaccaccgaugcacagcacg

SEQ ID NO: 3945628 - RNA, 22 nt, Shigella flexneri 2a str. 301
gaaccacggaauaaccagcgaa

SEQ ID NO: 3945629 - RNA, 20 nt, Shigella flexneri 2a str. 301
gaaccagacugcacauggcg

SEQ ID NO: 3945630 - RNA, 16 nt, Shigella flexneri 2a str. 301
gaaccagagaaucugc

SEQ ID NO: 3945631 - RNA, 17 nt, Shigella flexneri 2a str. 301
gaaccagagaaucugcg

SEQ ID NO: 3945632 - RNA, 16 nt, Shigella flexneri 2a str. 301
gaaccagugaauacug

SEQ ID NO: 3945633 - RNA, 18 nt, Shigella flexneri 2a str. 301
gaaccagugcuccaccuu

SEQ ID NO: 3945634 - RNA, 13 nt, Shigella flexneri 2a str. 301
gaaccaucaccuc

SEQ ID NO: 3945635 - RNA, 13 nt, Shigella flexneri 2a str. 301
gaaccaugcaauu

SEQ ID NO: 3945636 - RNA, 23 nt, Shigella flexneri 2a str. 301
gaaccaugcaauuaccgccacca

SEQ ID NO: 3945637 - RNA, 17 nt, Shigella flexneri 2a str. 301
gaaccaugucaucaauu

SEQ ID NO: 3945638 - RNA, 21 nt, Shigella flexneri 2a str. 301
gaaccauuauccgucagccac

SEQ ID NO: 3945639 - RNA, 22 nt, Shigella flexneri 2a str. 301
gaacccaaccgugaggccaccg

SEQ ID NO: 3945640 - RNA, 19 nt, Shigella flexneri 2a str. 301
gaacccacgguacucauca

SEQ ID NO: 3945641 - RNA, 16 nt, Shigella flexneri 2a str. 301
gaaccgacgauuaaac

SEQ ID NO: 3945642 - RNA, 21 nt, Shigella flexneri 2a str. 301
gaaccgauaguauggagcagg

SEQ ID NO: 3945643 - RNA, 15 nt, Shigella flexneri 2a str. 301
gaaccgccccacccc

SEQ ID NO: 3945644 - RNA, 15 nt, Shigella flexneri 2a str. 301
gaaccgccuggcgcu

SEQ ID NO: 3945645 - RNA, 19 nt, Shigella flexneri 2a str. 301
gaaccgcugucacccggca

SEQ ID NO: 3945646 - RNA, 15 nt, Shigella flexneri 2a str. 301
gaaccggaccagcaa

SEQ ID NO: 3945647 - RNA, 15 nt, Shigella flexneri 2a str. 301
gaaccggacgauccc

SEQ ID NO: 3945648 - RNA, 15 nt, Shigella flexneri 2a str. 301
gaaccguaaaagccu

SEQ ID NO: 3945649 - RNA, 15 nt, Shigella flexneri 2a str. 301
gaaccguaaacagau

SEQ ID NO: 3945650 - RNA, 22 nt, Shigella flexneri 2a str. 301
gaaccguaggccguauccggca

SEQ ID NO: 3945651 - RNA, 19 nt, Shigella flexneri 2a str. 301
gaaccuccauguccagcuu

SEQ ID NO: 3945652 - RNA, 17 nt, Shigella flexneri 2a str. 301
gaaccucgcggcugccc

SEQ ID NO: 3945653 - RNA, 18 nt, Shigella flexneri 2a str. 301
gaaccugugacagcagcg

SEQ ID NO: 3945654 - RNA, 19 nt, Shigella flexneri 2a str. 301
gaaccugugacagcagcgg

SEQ ID NO: 3945655 - RNA, 15 nt, Shigella flexneri 2a str. 301
gaaccuguuuucacc

SEQ ID NO: 3945656 - RNA, 21 nt, Shigella flexneri 2a str. 301
gaaccuuccauguugguaucg

SEQ ID NO: 3945657 - RNA, 18 nt, Shigella flexneri 2a str. 301
gaaccuuuaucacuguga

SEQ ID NO: 3945658 - RNA, 17 nt, Shigella flexneri 2a str. 301
gaacgaccaguucacac

SEQ ID NO: 3945659 - RNA, 13 nt, Shigella flexneri 2a str. 301
gaacgagaaaagc

SEQ ID NO: 3945660 - RNA, 16 nt, Shigella flexneri 2a str. 301
gaacgagaaaaugacg

SEQ ID NO: 3945661 - RNA, 20 nt, Shigella flexneri 2a str. 301
gaacgagaaaaugacgauga

SEQ ID NO: 3945662 - RNA, 19 nt, Shigella flexneri 2a str. 301
gaacgauuuuagcaaacug

SEQ ID NO: 3945663 - RNA, 19 nt, Shigella flexneri 2a str. 301
gaacgcaaucaaauaccac

SEQ ID NO: 3945664 - RNA, 15 nt, Shigella flexneri 2a str. 301
gaacgcagcgucuca

SEQ ID NO: 3945665 - RNA, 13 nt, Shigella flexneri 2a str. 301
gaacgccaguuca

SEQ ID NO: 3945666 - RNA, 16 nt, Shigella flexneri 2a str. 301
gaacgccauaaaaguc

SEQ ID NO: 3945667 - RNA, 20 nt, Shigella flexneri 2a str. 301
gaacgccuguguccuguuga

SEQ ID NO: 3945668 - RNA, 17 nt, Shigella flexneri 2a str. 301
gaacgccuuauccgccc

SEQ ID NO: 3945669 - RNA, 16 nt, Shigella flexneri 2a str. 301
gaacgccuuaucuggc

SEQ ID NO: 3945670 - RNA, 20 nt, Shigella flexneri 2a str. 301
gaacgcggcccaggcggcgu

SEQ ID NO: 3945671 - RNA, 17 nt, Shigella flexneri 2a str. 301
gaacgcguaucuuuaua

SEQ ID NO: 3945672 - RNA, 17 nt, Shigella flexneri 2a str. 301
gaacgcguucacugccg

SEQ ID NO: 3945673 - RNA, 18 nt, Shigella flexneri 2a str. 301
gaacgcguucacugccgu

SEQ ID NO: 3945674 - RNA, 19 nt, Shigella flexneri 2a str. 301
gaacggauagagcgcggcg

SEQ ID NO: 3945675 - RNA, 20 nt, Shigella flexneri 2a str. 301
gaacggauaucgagaaucac

SEQ ID NO: 3945676 - RNA, 15 nt, Shigella flexneri 2a str. 301
gaacggauucaguga

SEQ ID NO: 3945677 - RNA, 15 nt, Shigella flexneri 2a str. 301
gaacggcagagaaac

SEQ ID NO: 3945678 - RNA, 23 nt, Shigella flexneri 2a str. 301
gaacggcagauccaaaccgacug

SEQ ID NO: 3945679 - RNA, 21 nt, Shigella flexneri 2a str. 301
gaacggcgcaccagaauaccu

SEQ ID NO: 3945680 - RNA, 21 nt, Shigella flexneri 2a str. 301
gaacggcgcgguuuccaccuu

SEQ ID NO: 3945681 - RNA, 13 nt, Shigella flexneri 2a str. 301
gaacggcggcggc

SEQ ID NO: 3945682 - RNA, 20 nt, Shigella flexneri 2a str. 301
gaacgggagaaacccggcca

SEQ ID NO: 3945683 - RNA, 18 nt, Shigella flexneri 2a str. 301
gaacgggauugccagcau

SEQ ID NO: 3945684 - RNA, 20 nt, Shigella flexneri 2a str. 301
gaacgguaacaggaagcagc

SEQ ID NO: 3945685 - RNA, 15 nt, Shigella flexneri 2a str. 301
gaacgguaagaacaa

SEQ ID NO: 3945686 - RNA, 21 nt, Shigella flexneri 2a str. 301
gaacgguaagaacaagcaaac

SEQ ID NO: 3945687 - RNA, 15 nt, Shigella flexneri 2a str. 301
gaacgguccuuacca

SEQ ID NO: 3945688 - RNA, 23 nt, Shigella flexneri 2a str. 301
gaacggugaaaacccuauuuuug

SEQ ID NO: 3945689 - RNA, 19 nt, Shigella flexneri 2a str. 301
gaacguaacaguacaauau

SEQ ID NO: 3945690 - RNA, 21 nt, Shigella flexneri 2a str. 301
gaacgucgucgugaagcagag

SEQ ID NO: 3945691 - RNA, 15 nt, Shigella flexneri 2a str. 301
gaacgugacacgcag

SEQ ID NO: 3945692 - RNA, 17 nt, Shigella flexneri 2a str. 301
gaacgugcaaaaucaaa

SEQ ID NO: 3945693 - RNA, 13 nt, Shigella flexneri 2a str. 301
gaacgugcauauu

SEQ ID NO: 3945694 - RNA, 16 nt, Shigella flexneri 2a str. 301
gaacguguaggccuga

SEQ ID NO: 3945695 - RNA, 22 nt, Shigella flexneri 2a str. 301
gaacguuacaaucugcgcugga

SEQ ID NO: 3945696 - RNA, 22 nt, Shigella flexneri 2a str. 301
gaacuacggcaaaagaauauca

SEQ ID NO: 3945697 - RNA, 15 nt, Shigella flexneri 2a str. 301
gaacucacagggcug

SEQ ID NO: 3945698 - RNA, 15 nt, Shigella flexneri 2a str. 301
gaacucaggcugcca

SEQ ID NO: 3945699 - RNA, 22 nt, Shigella flexneri 2a str. 301
gaacucaggcugccagaucauc

SEQ ID NO: 3945700 - RNA, 18 nt, Shigella flexneri 2a str. 301
gaacuccagcccggaaga

SEQ ID NO: 3945701 - RNA, 22 nt, Shigella flexneri 2a str. 301
gaacucgacgcccuggaagaaa

SEQ ID NO: 3945702 - RNA, 20 nt, Shigella flexneri 2a str. 301
gaacucgaggauaaauuuuc

SEQ ID NO: 3945703 - RNA, 12 nt, Shigella flexneri 2a str. 301
gaacucgccagc

SEQ ID NO: 3945704 - RNA, 20 nt, Shigella flexneri 2a str. 301
gaacucgcugcgcggcagcu

SEQ ID NO: 3945705 - RNA, 22 nt, Shigella flexneri 2a str. 301
gaacucguucagcgcauuccag

SEQ ID NO: 3945706 - RNA, 17 nt, Shigella flexneri 2a str. 301
gaacucuucuuccggca

SEQ ID NO: 3945707 - RNA, 18 nt, Shigella flexneri 2a str. 301
gaacugaacaaaaaagag

SEQ ID NO: 3945708 - RNA, 11 nt, Shigella flexneri 2a str. 301
gaacugacagc

SEQ ID NO: 3945709 - RNA, 19 nt, Shigella flexneri 2a str. 301
gaacugaccgugcgggcga

SEQ ID NO: 3945710 - RNA, 19 nt, Shigella flexneri 2a str. 301
gaacugacuuccacuuccu

SEQ ID NO: 3945711 - RNA, 21 nt, Shigella flexneri 2a str. 301
gaacugauaacgcauuucaug

SEQ ID NO: 3945712 - RNA, 14 nt, Shigella flexneri 2a str. 301
gaacugauugccac

SEQ ID NO: 3945713 - RNA, 14 nt, Shigella flexneri 2a str. 301
gaacugcaacucac

SEQ ID NO: 3945714 - RNA, 17 nt, Shigella flexneri 2a str. 301
gaacugcaacucaccuu

SEQ ID NO: 3945715 - RNA, 14 nt, Shigella flexneri 2a str. 301
gaacuggcaggaaa

SEQ ID NO: 3945716 - RNA, 15 nt, Shigella flexneri 2a str. 301
gaacuggcaggaaac

SEQ ID NO: 3945717 - RNA, 16 nt, Shigella flexneri 2a str. 301
gaacuggcguguuuca

SEQ ID NO: 3945718 - RNA, 19 nt, Shigella flexneri 2a str. 301
gaacuggcguguuucauua

SEQ ID NO: 3945719 - RNA, 15 nt, Shigella flexneri 2a str. 301
gaacuggcugccagc

SEQ ID NO: 3945720 - RNA, 11 nt, Shigella flexneri 2a str. 301
gaacuggcugu

SEQ ID NO: 3945721 - RNA, 18 nt, Shigella flexneri 2a str. 301
gaacugggccugcauauc

SEQ ID NO: 3945722 - RNA, 12 nt, Shigella flexneri 2a str. 301
gaacuggucugc

SEQ ID NO: 3945723 - RNA, 23 nt, Shigella flexneri 2a str. 301
gaacuguggcgcgaagcccucaa

SEQ ID NO: 3945724 - RNA, 20 nt, Shigella flexneri 2a str. 301
gaacuucauaugcgccagac

SEQ ID NO: 3945725 - RNA, 16 nt, Shigella flexneri 2a str. 301
gaacuucgcagccgug

SEQ ID NO: 3945726 - RNA, 22 nt, Shigella flexneri 2a str. 301
gaacuucgccauuuucugccgc

SEQ ID NO: 3945727 - RNA, 21 nt, Shigella flexneri 2a str. 301
gaacuugacgaucugcuacag

SEQ ID NO: 3945728 - RNA, 17 nt, Shigella flexneri 2a str. 301
gaacuugcucauccgga

SEQ ID NO: 3945729 - RNA, 19 nt, Shigella flexneri 2a str. 301
gaacuuugcugcaaugaag

SEQ ID NO: 3945730 - RNA, 19 nt, Shigella flexneri 2a str. 301
gaacuuuuugauagccacu

SEQ ID NO: 3945731 - RNA, 15 nt, Shigella flexneri 2a str. 301
gaagaaaaacuggcg

SEQ ID NO: 3945732 - RNA, 14 nt, Shigella flexneri 2a str. 301
gaagaaaccgauga

SEQ ID NO: 3945733 - RNA, 11 nt, Shigella flexneri 2a str. 301
gaagaaaucag

SEQ ID NO: 3945734 - RNA, 12 nt, Shigella flexneri 2a str. 301
gaagaaaucagu

SEQ ID NO: 3945735 - RNA, 22 nt, Shigella flexneri 2a str. 301
gaagaagcguuccauugggcug

SEQ ID NO: 3945736 - RNA, 14 nt, Shigella flexneri 2a str. 301
gaagaauuugcccu

SEQ ID NO: 3945737 - RNA, 19 nt, Shigella flexneri 2a str. 301
gaagaauuuguaggccgga

SEQ ID NO: 3945738 - RNA, 22 nt, Shigella flexneri 2a str. 301
gaagacaaccaaaaucaggccg

SEQ ID NO: 3945739 - RNA, 14 nt, Shigella flexneri 2a str. 301
gaagacacauugcg

SEQ ID NO: 3945740 - RNA, 21 nt, Shigella flexneri 2a str. 301
gaagacaucgcagggaucauc

SEQ ID NO: 3945741 - RNA, 19 nt, Shigella flexneri 2a str. 301
gaagaccugccagaacaac

SEQ ID NO: 3945742 - RNA, 14 nt, Shigella flexneri 2a str. 301
gaagacgcagcaug

SEQ ID NO: 3945743 - RNA, 15 nt, Shigella flexneri 2a str. 301
gaagagaacgucgca

SEQ ID NO: 3945744 - RNA, 13 nt, Shigella flexneri 2a str. 301
gaagagacaaaaa

SEQ ID NO: 3945745 - RNA, 20 nt, Shigella flexneri 2a str. 301
gaagagacaaaaaaggugcu

SEQ ID NO: 3945746 - RNA, 14 nt, Shigella flexneri 2a str. 301
gaagaguaaaaaaa

SEQ ID NO: 3945747 - RNA, 20 nt, Shigella flexneri 2a str. 301
gaagaguuucgggauggcgu

SEQ ID NO: 3945748 - RNA, 22 nt, Shigella flexneri 2a str. 301
gaagauacccgcgaggcgcaua

SEQ ID NO: 3945749 - RNA, 23 nt, Shigella flexneri 2a str. 301
gaagaucagaaauuuccugagca

SEQ ID NO: 3945750 - RNA, 19 nt, Shigella flexneri 2a str. 301
gaagaucguggagaacaau

SEQ ID NO: 3945751 - RNA, 14 nt, Shigella flexneri 2a str. 301
gaagaugaaaaacg

SEQ ID NO: 3945752 - RNA, 15 nt, Shigella flexneri 2a str. 301
gaagauuugcagauc

SEQ ID NO: 3945753 - RNA, 14 nt, Shigella flexneri 2a str. 301
gaagauuuugcugu

SEQ ID NO: 3945754 - RNA, 16 nt, Shigella flexneri 2a str. 301
gaagcaaaauaaccgg

SEQ ID NO: 3945755 - RNA, 15 nt, Shigella flexneri 2a str. 301
gaagcaaaccaggcc

SEQ ID NO: 3945756 - RNA, 23 nt, Shigella flexneri 2a str. 301
gaagcaacaguaauaaugcccau

SEQ ID NO: 3945757 - RNA, 21 nt, Shigella flexneri 2a str. 301
gaagcaaccggugucaucauc

SEQ ID NO: 3945758 - RNA, 13 nt, Shigella flexneri 2a str. 301
gaagcaagcauua

SEQ ID NO: 3945759 - RNA, 20 nt, Shigella flexneri 2a str. 301
gaagcaauccauaccagcac

SEQ ID NO: 3945760 - RNA, 22 nt, Shigella flexneri 2a str. 301
gaagcacugcaucaaugccgga

SEQ ID NO: 3945761 - RNA, 12 nt, Shigella flexneri 2a str. 301
gaagcagagcag

SEQ ID NO: 3945762 - RNA, 20 nt, Shigella flexneri 2a str. 301
gaagcagaucuggaagcagg

SEQ ID NO: 3945763 - RNA, 19 nt, Shigella flexneri 2a str. 301
gaagcaguuucaccagcag

SEQ ID NO: 3945764 - RNA, 20 nt, Shigella flexneri 2a str. 301
gaagcaguuucaccagcagu

SEQ ID NO: 3945765 - RNA, 17 nt, Shigella flexneri 2a str. 301
gaagcauugcgccugca

SEQ ID NO: 3945766 - RNA, 19 nt, Shigella flexneri 2a str. 301
gaagcauugcgccugcagg

SEQ ID NO: 3945767 - RNA, 18 nt, Shigella flexneri 2a str. 301
gaagccaccgcgccacga

SEQ ID NO: 3945768 - RNA, 19 nt, Shigella flexneri 2a str. 301
gaagccaccgcgccacgac

SEQ ID NO: 3945769 - RNA, 22 nt, Shigella flexneri 2a str. 301
gaagcccaguaccgccagugca

SEQ ID NO: 3945770 - RNA, 22 nt, Shigella flexneri 2a str. 301
gaagcccauuucaguauugagc

SEQ ID NO: 3945771 - RNA, 16 nt, Shigella flexneri 2a str. 301
gaagcccucaaacaac

SEQ ID NO: 3945772 - RNA, 16 nt, Shigella flexneri 2a str. 301
gaagccgaucgugcua

SEQ ID NO: 3945773 - RNA, 17 nt, Shigella flexneri 2a str. 301
gaagccgugccacaggc

SEQ ID NO: 3945774 - RNA, 13 nt, Shigella flexneri 2a str. 301
gaagccugcgaug

SEQ ID NO: 3945775 - RNA, 21 nt, Shigella flexneri 2a str. 301
gaagccuuccgcaaacaggcg

SEQ ID NO: 3945776 - RNA, 15 nt, Shigella flexneri 2a str. 301
gaagcgaugguggug

SEQ ID NO: 3945777 - RNA, 20 nt, Shigella flexneri 2a str. 301
gaagcgauggugguggggga

SEQ ID NO: 3945778 - RNA, 14 nt, Shigella flexneri 2a str. 301
gaagcgcauggcgu

SEQ ID NO: 3945779 - RNA, 13 nt, Shigella flexneri 2a str. 301
gaagcgccuucga

SEQ ID NO: 3945780 - RNA, 12 nt, Shigella flexneri 2a str. 301
gaagcgcgugcu

SEQ ID NO: 3945781 - RNA, 13 nt, Shigella flexneri 2a str. 301
gaagcgcgugcua

SEQ ID NO: 3945782 - RNA, 13 nt, Shigella flexneri 2a str. 301
gaagcggaaauca

SEQ ID NO: 3945783 - RNA, 17 nt, Shigella flexneri 2a str. 301
gaagcggcacugcucuu

SEQ ID NO: 3945784 - RNA, 20 nt, Shigella flexneri 2a str. 301
gaagcggccgucagaucgcc

SEQ ID NO: 3945785 - RNA, 20 nt, Shigella flexneri 2a str. 301
gaagcgggggagucgcuggu

SEQ ID NO: 3945786 - RNA, 23 nt, Shigella flexneri 2a str. 301
gaagcgggggagucgcugguuaa

SEQ ID NO: 3945787 - RNA, 23 nt, Shigella flexneri 2a str. 301
gaagcucguuguuuaugccggau

SEQ ID NO: 3945788 - RNA, 14 nt, Shigella flexneri 2a str. 301
gaagcugaaaucau

SEQ ID NO: 3945789 - RNA, 19 nt, Shigella flexneri 2a str. 301
gaagcugacgacgaagaaa

SEQ ID NO: 3945790 - RNA, 22 nt, Shigella flexneri 2a str. 301
gaagcuggauuaacgcugggga

SEQ ID NO: 3945791 - RNA, 17 nt, Shigella flexneri 2a str. 301
gaagcuggcagaaguug

SEQ ID NO: 3945792 - RNA, 15 nt, Shigella flexneri 2a str. 301
gaagcuggucagcau

SEQ ID NO: 3945793 - RNA, 16 nt, Shigella flexneri 2a str. 301
gaagcuggucagcauc

SEQ ID NO: 3945794 - RNA, 15 nt, Shigella flexneri 2a str. 301
gaagcuuuccacgca

SEQ ID NO: 3945795 - RNA, 20 nt, Shigella flexneri 2a str. 301
gaagcuuuccacgcaggcau

SEQ ID NO: 3945796 - RNA, 14 nt, Shigella flexneri 2a str. 301
gaaggaaaauacag

SEQ ID NO: 3945797 - RNA, 15 nt, Shigella flexneri 2a str. 301
gaaggaauuuuacag

SEQ ID NO: 3945798 - RNA, 16 nt, Shigella flexneri 2a str. 301
gaaggauuagccggau

SEQ ID NO: 3945799 - RNA, 15 nt, Shigella flexneri 2a str. 301
gaaggauucgaaccu

SEQ ID NO: 3945800 - RNA, 20 nt, Shigella flexneri 2a str. 301
gaaggcaaacuucucgccau

SEQ ID NO: 3945801 - RNA, 20 nt, Shigella flexneri 2a str. 301
gaaggcgcacugauucauga

SEQ ID NO: 3945802 - RNA, 16 nt, Shigella flexneri 2a str. 301
gaaggcgcauugcugg

SEQ ID NO: 3945803 - RNA, 11 nt, Shigella flexneri 2a str. 301
gaaggcugccg

SEQ ID NO: 3945804 - RNA, 16 nt, Shigella flexneri 2a str. 301
gaaggcuuauaaggaa

SEQ ID NO: 3945805 - RNA, 20 nt, Shigella flexneri 2a str. 301
gaagggauugugcaggcgcu

SEQ ID NO: 3945806 - RNA, 22 nt, Shigella flexneri 2a str. 301
gaagggcuggccaauuggcugg

SEQ ID NO: 3945807 - RNA, 22 nt, Shigella flexneri 2a str. 301
gaagggggauuacguagcacaa

SEQ ID NO: 3945808 - RNA, 19 nt, Shigella flexneri 2a str. 301
gaagggucuuuuaaauccu

SEQ ID NO: 3945809 - RNA, 14 nt, Shigella flexneri 2a str. 301
gaaggguuggugaa

SEQ ID NO: 3945810 - RNA, 18 nt, Shigella flexneri 2a str. 301
gaagguaaagaagguaag

SEQ ID NO: 3945811 - RNA, 21 nt, Shigella flexneri 2a str. 301
gaagguaaggauaaaaaaggg

SEQ ID NO: 3945812 - RNA, 14 nt, Shigella flexneri 2a str. 301
gaaggucagguuug

SEQ ID NO: 3945813 - RNA, 19 nt, Shigella flexneri 2a str. 301
gaaggugaaauugucggcg

SEQ ID NO: 3945814 - RNA, 20 nt, Shigella flexneri 2a str. 301
gaaggugccucccguuuugc

SEQ ID NO: 3945815 - RNA, 21 nt, Shigella flexneri 2a str. 301
gaagguucaagacgaauaccu

SEQ ID NO: 3945816 - RNA, 21 nt, Shigella flexneri 2a str. 301
gaagguuucugcauuauccag

SEQ ID NO: 3945817 - RNA, 17 nt, Shigella flexneri 2a str. 301
gaaguaaacgccgagcu

SEQ ID NO: 3945818 - RNA, 13 nt, Shigella flexneri 2a str. 301
gaaguaaauaucu

SEQ ID NO: 3945819 - RNA, 14 nt, Shigella flexneri 2a str. 301
gaaguaauaaucaa

SEQ ID NO: 3945820 - RNA, 17 nt, Shigella flexneri 2a str. 301
gaaguaauaaucaacgc

SEQ ID NO: 3945821 - RNA, 14 nt, Shigella flexneri 2a str. 301
gaaguacagcccag

SEQ ID NO: 3945822 - RNA, 18 nt, Shigella flexneri 2a str. 301
gaaguacagcccaggcac

SEQ ID NO: 3945823 - RNA, 17 nt, Shigella flexneri 2a str. 301
gaaguaccaauggcaau

SEQ ID NO: 3945824 - RNA, 15 nt, Shigella flexneri 2a str. 301
gaaguacuccugcuc

SEQ ID NO: 3945825 - RNA, 16 nt, Shigella flexneri 2a str. 301
gaaguagccuucauca

SEQ ID NO: 3945826 - RNA, 14 nt, Shigella flexneri 2a str. 301
gaaguaguugcugu

SEQ ID NO: 3945827 - RNA, 18 nt, Shigella flexneri 2a str. 301
gaaguaucguuaauuccu

SEQ ID NO: 3945828 - RNA, 19 nt, Shigella flexneri 2a str. 301
gaaguaucguuaauuccuc

SEQ ID NO: 3945829 - RNA, 20 nt, Shigella flexneri 2a str. 301
gaaguauuggugaguccuga

SEQ ID NO: 3945830 - RNA, 18 nt, Shigella flexneri 2a str. 301
gaagucguucagaucuuu

SEQ ID NO: 3945831 - RNA, 16 nt, Shigella flexneri 2a str. 301
gaaguggacgaacagu

SEQ ID NO: 3945832 - RNA, 19 nt, Shigella flexneri 2a str. 301
gaaguggcacaggcaauag

SEQ ID NO: 3945833 - RNA, 15 nt, Shigella flexneri 2a str. 301
gaaguggcguucagc

SEQ ID NO: 3945834 - RNA, 21 nt, Shigella flexneri 2a str. 301
gaagugugguuugucauuggc

SEQ ID NO: 3945835 - RNA, 18 nt, Shigella flexneri 2a str. 301
gaaguucaggguuaaauc

SEQ ID NO: 3945836 - RNA, 15 nt, Shigella flexneri 2a str. 301
gaaguuccagggcag

SEQ ID NO: 3945837 - RNA, 11 nt, Shigella flexneri 2a str. 301
gaaguugcguc

SEQ ID NO: 3945838 - RNA, 16 nt, Shigella flexneri 2a str. 301
gaaguugcucaagcug

SEQ ID NO: 3945839 - RNA, 16 nt, Shigella flexneri 2a str. 301
gaaguuguagcuggcu

SEQ ID NO: 3945840 - RNA, 18 nt, Shigella flexneri 2a str. 301
gaaguuguccaugugcug

SEQ ID NO: 3945841 - RNA, 16 nt, Shigella flexneri 2a str. 301
gaaguuuaauucuuug

SEQ ID NO: 3945842 - RNA, 15 nt, Shigella flexneri 2a str. 301
gaaguuuuccucagu

SEQ ID NO: 3945843 - RNA, 19 nt, Shigella flexneri 2a str. 301
gaaguuuugucgcugauuu

SEQ ID NO: 3945844 - RNA, 20 nt, Shigella flexneri 2a str. 301
gaauaaaacagaaaccgagg

SEQ ID NO: 3945845 - RNA, 16 nt, Shigella flexneri 2a str. 301
gaauaaaacaggcagc

SEQ ID NO: 3945846 - RNA, 13 nt, Shigella flexneri 2a str. 301
gaauaaacgccau

SEQ ID NO: 3945847 - RNA, 15 nt, Shigella flexneri 2a str. 301
gaauaacaccagcca

SEQ ID NO: 3945848 - RNA, 13 nt, Shigella flexneri 2a str. 301
gaauaaccgguuc

SEQ ID NO: 3945849 - RNA, 21 nt, Shigella flexneri 2a str. 301
gaauaaccucuuucuuugcau

SEQ ID NO: 3945850 - RNA, 13 nt, Shigella flexneri 2a str. 301
gaauaacggcaga

SEQ ID NO: 3945851 - RNA, 19 nt, Shigella flexneri 2a str. 301
gaauaagacuggcaaauga

SEQ ID NO: 3945852 - RNA, 21 nt, Shigella flexneri 2a str. 301
gaauaagacuggcaaaugaca

SEQ ID NO: 3945853 - RNA, 15 nt, Shigella flexneri 2a str. 301
gaauaagcugcguga

SEQ ID NO: 3945854 - RNA, 13 nt, Shigella flexneri 2a str. 301
gaauaaucagaug

SEQ ID NO: 3945855 - RNA, 13 nt, Shigella flexneri 2a str. 301
gaauaaucagcaa

SEQ ID NO: 3945856 - RNA, 14 nt, Shigella flexneri 2a str. 301
gaauaauccccaua

SEQ ID NO: 3945857 - RNA, 15 nt, Shigella flexneri 2a str. 301
gaauaauccccauau

SEQ ID NO: 3945858 - RNA, 22 nt, Shigella flexneri 2a str. 301
gaauaauccccauaucaggcac

SEQ ID NO: 3945859 - RNA, 15 nt, Shigella flexneri 2a str. 301
gaauaauccgcccgg

SEQ ID NO: 3945860 - RNA, 17 nt, Shigella flexneri 2a str. 301
gaauaaucguaaucagc

SEQ ID NO: 3945861 - RNA, 17 nt, Shigella flexneri 2a str. 301
gaauaaugcaaaaaggc

SEQ ID NO: 3945862 - RNA, 17 nt, Shigella flexneri 2a str. 301
gaauaauuucauuuacu

SEQ ID NO: 3945863 - RNA, 13 nt, Shigella flexneri 2a str. 301
gaauacagaacag

SEQ ID NO: 3945864 - RNA, 20 nt, Shigella flexneri 2a str. 301
gaauaccccauggagaaaau

SEQ ID NO: 3945865 - RNA, 21 nt, Shigella flexneri 2a str. 301
gaauaccccauggagaaaaug

SEQ ID NO: 3945866 - RNA, 13 nt, Shigella flexneri 2a str. 301
gaauaccgacauc

SEQ ID NO: 3945867 - RNA, 21 nt, Shigella flexneri 2a str. 301
gaauaccggcgucccaucggc

SEQ ID NO: 3945868 - RNA, 18 nt, Shigella flexneri 2a str. 301
gaauaccguauucaacga

SEQ ID NO: 3945869 - RNA, 13 nt, Shigella flexneri 2a str. 301
gaauaccuucuuc

SEQ ID NO: 3945870 - RNA, 17 nt, Shigella flexneri 2a str. 301
gaauaccuugcugcucc

SEQ ID NO: 3945871 - RNA, 21 nt, Shigella flexneri 2a str. 301
gaauacgcuggcgcgccgccu

SEQ ID NO: 3945872 - RNA, 23 nt, Shigella flexneri 2a str. 301
gaauagucccuucgguagcagcu

SEQ ID NO: 3945873 - RNA, 14 nt, Shigella flexneri 2a str. 301
gaauaguuucagcc

SEQ ID NO: 3945874 - RNA, 19 nt, Shigella flexneri 2a str. 301
gaauaguuuccgcuucugc

SEQ ID NO: 3945875 - RNA, 14 nt, Shigella flexneri 2a str. 301
gaauauaagucagg

SEQ ID NO: 3945876 - RNA, 17 nt, Shigella flexneri 2a str. 301
gaauauauaauuaaaaa

SEQ ID NO: 3945877 - RNA, 19 nt, Shigella flexneri 2a str. 301
gaauauauaauuaaaaaua

SEQ ID NO: 3945878 - RNA, 20 nt, Shigella flexneri 2a str. 301
gaauauauaauuaaaaauag

SEQ ID NO: 3945879 - RNA, 14 nt, Shigella flexneri 2a str. 301
gaauauaucagccu

SEQ ID NO: 3945880 - RNA, 21 nt, Shigella flexneri 2a str. 301
gaauaucauugccgguuggcg

SEQ ID NO: 3945881 - RNA, 20 nt, Shigella flexneri 2a str. 301
gaauaucguucaagagacug

SEQ ID NO: 3945882 - RNA, 23 nt, Shigella flexneri 2a str. 301
gaauaucugcuccguaaaacuca

SEQ ID NO: 3945883 - RNA, 21 nt, Shigella flexneri 2a str. 301
gaauaucuucaaccgucacca

SEQ ID NO: 3945884 - RNA, 19 nt, Shigella flexneri 2a str. 301
gaauaucuuucucgcggca

SEQ ID NO: 3945885 - RNA, 17 nt, Shigella flexneri 2a str. 301
gaauaugaacaugaaaa

SEQ ID NO: 3945886 - RNA, 23 nt, Shigella flexneri 2a str. 301
gaauaugaacaugaaaaaacugg

SEQ ID NO: 3945887 - RNA, 19 nt, Shigella flexneri 2a str. 301
gaauaugacagcgccgacu

SEQ ID NO: 3945888 - RNA, 20 nt, Shigella flexneri 2a str. 301
gaauaugcgccacaccacug

SEQ ID NO: 3945889 - RNA, 13 nt, Shigella flexneri 2a str. 301
gaauauggcggcg

SEQ ID NO: 3945890 - RNA, 17 nt, Shigella flexneri 2a str. 301
gaauauggcggcggcuu

SEQ ID NO: 3945891 - RNA, 18 nt, Shigella flexneri 2a str. 301
gaauaugucgcgccaggc

SEQ ID NO: 3945892 - RNA, 16 nt, Shigella flexneri 2a str. 301
gaauauguuuuugcag

SEQ ID NO: 3945893 - RNA, 20 nt, Shigella flexneri 2a str. 301
gaauauugccgaagaccaga

SEQ ID NO: 3945894 - RNA, 15 nt, Shigella flexneri 2a str. 301
gaauauuucaccggu

SEQ ID NO: 3945895 - RNA, 16 nt, Shigella flexneri 2a str. 301
gaauauuuccaguuca

SEQ ID NO: 3945896 - RNA, 19 nt, Shigella flexneri 2a str. 301
gaaucaaaaucaucaucuu

SEQ ID NO: 3945897 - RNA, 19 nt, Shigella flexneri 2a str. 301
gaaucaaauaaaaauaccc

SEQ ID NO: 3945898 - RNA, 16 nt, Shigella flexneri 2a str. 301
gaaucaaccaugguuu

SEQ ID NO: 3945899 - RNA, 16 nt, Shigella flexneri 2a str. 301
gaaucaaucagagcca

SEQ ID NO: 3945900 - RNA, 16 nt, Shigella flexneri 2a str. 301
gaaucaaucgccccuu

SEQ ID NO: 3945901 - RNA, 22 nt, Shigella flexneri 2a str. 301
gaaucaccgccacgcccuccug

SEQ ID NO: 3945902 - RNA, 14 nt, Shigella flexneri 2a str. 301
gaaucaccucuuuu

SEQ ID NO: 3945903 - RNA, 16 nt, Shigella flexneri 2a str. 301
gaaucacguaggccug

SEQ ID NO: 3945904 - RNA, 17 nt, Shigella flexneri 2a str. 301
gaaucacucaucaugca

SEQ ID NO: 3945905 - RNA, 16 nt, Shigella flexneri 2a str. 301
gaaucacuucaucgcc

SEQ ID NO: 3945906 - RNA, 19 nt, Shigella flexneri 2a str. 301
gaaucacuucaucgccguu

SEQ ID NO: 3945907 - RNA, 18 nt, Shigella flexneri 2a str. 301
gaaucagaugugcuucug

SEQ ID NO: 3945908 - RNA, 14 nt, Shigella flexneri 2a str. 301
gaaucagcaguuca

SEQ ID NO: 3945909 - RNA, 23 nt, Shigella flexneri 2a str. 301
gaaucaggaaccacaaccacuuu

SEQ ID NO: 3945910 - RNA, 23 nt, Shigella flexneri 2a str. 301
gaaucaggcaggucuuucaccug

SEQ ID NO: 3945911 - RNA, 19 nt, Shigella flexneri 2a str. 301
gaaucaguaggugcaagca

SEQ ID NO: 3945912 - RNA, 21 nt, Shigella flexneri 2a str. 301
gaaucauaaauacaaggccaa

SEQ ID NO: 3945913 - RNA, 22 nt, Shigella flexneri 2a str. 301
gaaucaugguuuauuucccaga

SEQ ID NO: 3945914 - RNA, 18 nt, Shigella flexneri 2a str. 301
gaauccgcaccaacucca

SEQ ID NO: 3945915 - RNA, 21 nt, Shigella flexneri 2a str. 301
gaauccgcaccaacuccacuu

SEQ ID NO: 3945916 - RNA, 22 nt, Shigella flexneri 2a str. 301
gaauccggugccuuaccgcuug

SEQ ID NO: 3945917 - RNA, 16 nt, Shigella flexneri 2a str. 301
gaaucgcaaagccgau

SEQ ID NO: 3945918 - RNA, 23 nt, Shigella flexneri 2a str. 301
gaaucgccagcaucggcagcgcc

SEQ ID NO: 3945919 - RNA, 13 nt, Shigella flexneri 2a str. 301
gaaucgcuguuga

SEQ ID NO: 3945920 - RNA, 21 nt, Shigella flexneri 2a str. 301
gaaucgguccaccacguacca

SEQ ID NO: 3945921 - RNA, 20 nt, Shigella flexneri 2a str. 301
gaaucgucggaauggcaucu

SEQ ID NO: 3945922 - RNA, 14 nt, Shigella flexneri 2a str. 301
gaaucuaagauccc

SEQ ID NO: 3945923 - RNA, 21 nt, Shigella flexneri 2a str. 301
gaaucucugcgcuauccagcg

SEQ ID NO: 3945924 - RNA, 13 nt, Shigella flexneri 2a str. 301
gaaucucuucuuc

SEQ ID NO: 3945925 - RNA, 15 nt, Shigella flexneri 2a str. 301
gaaucugaaggaugu

SEQ ID NO: 3945926 - RNA, 15 nt, Shigella flexneri 2a str. 301
gaaucuuuucaucgc

SEQ ID NO: 3945927 - RNA, 16 nt, Shigella flexneri 2a str. 301
gaaugacgacguacca

SEQ ID NO: 3945928 - RNA, 19 nt, Shigella flexneri 2a str. 301
gaaugacgacguaccagcg

SEQ ID NO: 3945929 - RNA, 24 nt, Shigella flexneri 2a str. 301
gaaugacgacguaccagcgucgga

SEQ ID NO: 3945930 - RNA, 15 nt, Shigella flexneri 2a str. 301
gaaugagcaucuacu

SEQ ID NO: 3945931 - RNA, 18 nt, Shigella flexneri 2a str. 301
gaaugaggaucagccgcu

SEQ ID NO: 3945932 - RNA, 14 nt, Shigella flexneri 2a str. 301
gaaugaucagcggu

SEQ ID NO: 3945933 - RNA, 22 nt, Shigella flexneri 2a str. 301
gaaugaucagcgguuuugccag

SEQ ID NO: 3945934 - RNA, 14 nt, Shigella flexneri 2a str. 301
gaaugcagcuccac

SEQ ID NO: 3945935 - RNA, 17 nt, Shigella flexneri 2a str. 301
gaaugccaaauccggca

SEQ ID NO: 3945936 - RNA, 16 nt, Shigella flexneri 2a str. 301
gaaugccaauuucccg

SEQ ID NO: 3945937 - RNA, 15 nt, Shigella flexneri 2a str. 301
gaaugcccugcggcu

SEQ ID NO: 3945938 - RNA, 12 nt, Shigella flexneri 2a str. 301
gaaugccggaau

SEQ ID NO: 3945939 - RNA, 16 nt, Shigella flexneri 2a str. 301
gaaugccggaaucaga

SEQ ID NO: 3945940 - RNA, 18 nt, Shigella flexneri 2a str. 301
gaaugccggaaucagaau

SEQ ID NO: 3945941 - RNA, 16 nt, Shigella flexneri 2a str. 301
gaaugccuuauccgau

SEQ ID NO: 3945942 - RNA, 16 nt, Shigella flexneri 2a str. 301
gaaugcgaaaauccuc

SEQ ID NO: 3945943 - RNA, 15 nt, Shigella flexneri 2a str. 301
gaaugcgauggcaaa

SEQ ID NO: 3945944 - RNA, 18 nt, Shigella flexneri 2a str. 301
gaaugcgcaacgccguaa

SEQ ID NO: 3945945 - RNA, 19 nt, Shigella flexneri 2a str. 301
gaaugcgguuaaaccgaaa

SEQ ID NO: 3945946 - RNA, 20 nt, Shigella flexneri 2a str. 301
gaaugcucaguaggcugacg

SEQ ID NO: 3945947 - RNA, 15 nt, Shigella flexneri 2a str. 301
gaauggaaacagcac

SEQ ID NO: 3945948 - RNA, 17 nt, Shigella flexneri 2a str. 301
gaauggaaacagcacca

SEQ ID NO: 3945949 - RNA, 18 nt, Shigella flexneri 2a str. 301
gaauggcaucuacgcucu

SEQ ID NO: 3945950 - RNA, 20 nt, Shigella flexneri 2a str. 301
gaauggcaucuacgcucucu

SEQ ID NO: 3945951 - RNA, 20 nt, Shigella flexneri 2a str. 301
gaauggcaucugauaagccc

SEQ ID NO: 3945952 - RNA, 22 nt, Shigella flexneri 2a str. 301
gaauggucaaugguggcaaucu

SEQ ID NO: 3945953 - RNA, 13 nt, Shigella flexneri 2a str. 301
gaauggucgggcu

SEQ ID NO: 3945954 - RNA, 14 nt, Shigella flexneri 2a str. 301
gaauggugaccugc

SEQ ID NO: 3945955 - RNA, 15 nt, Shigella flexneri 2a str. 301
gaaugucguuuccau

SEQ ID NO: 3945956 - RNA, 15 nt, Shigella flexneri 2a str. 301
gaauguggcaaugag

SEQ ID NO: 3945957 - RNA, 21 nt, Shigella flexneri 2a str. 301
gaauguggcaaugagugguga

SEQ ID NO: 3945958 - RNA, 14 nt, Shigella flexneri 2a str. 301
gaauuaaugccucu

SEQ ID NO: 3945959 - RNA, 13 nt, Shigella flexneri 2a str. 301
gaauuaaugguga

SEQ ID NO: 3945960 - RNA, 21 nt, Shigella flexneri 2a str. 301
gaauuaugcagccuucauuca

SEQ ID NO: 3945961 - RNA, 17 nt, Shigella flexneri 2a str. 301
gaauucaaauccuucag

SEQ ID NO: 3945962 - RNA, 15 nt, Shigella flexneri 2a str. 301
gaauucacgccgcau

SEQ ID NO: 3945963 - RNA, 18 nt, Shigella flexneri 2a str. 301
gaauucacucuauaccgc

SEQ ID NO: 3945964 - RNA, 22 nt, Shigella flexneri 2a str. 301
gaauuccggcagagaaagcaaa

SEQ ID NO: 3945965 - RNA, 19 nt, Shigella flexneri 2a str. 301
gaauuccggggcuuuugaa

SEQ ID NO: 3945966 - RNA, 20 nt, Shigella flexneri 2a str. 301
gaauuccguaagcgacuuug

SEQ ID NO: 3945967 - RNA, 15 nt, Shigella flexneri 2a str. 301
gaauucgacuuucuc

SEQ ID NO: 3945968 - RNA, 17 nt, Shigella flexneri 2a str. 301
gaauucgacuuucucug

SEQ ID NO: 3945969 - RNA, 21 nt, Shigella flexneri 2a str. 301
gaauucgcugaauaccgauuc

SEQ ID NO: 3945970 - RNA, 14 nt, Shigella flexneri 2a str. 301
gaauugagaugacg

SEQ ID NO: 3945971 - RNA, 12 nt, Shigella flexneri 2a str. 301
gaauugauucau

SEQ ID NO: 3945972 - RNA, 21 nt, Shigella flexneri 2a str. 301
gaauugauuuucgaaaaaaaa

SEQ ID NO: 3945973 - RNA, 18 nt, Shigella flexneri 2a str. 301
gaauugcagauaccacau

SEQ ID NO: 3945974 - RNA, 23 nt, Shigella flexneri 2a str. 301
gaauugcugcgcccgcagcggcg

SEQ ID NO: 3945975 - RNA, 21 nt, Shigella flexneri 2a str. 301
gaauuguuuggacgaauuagc

SEQ ID NO: 3945976 - RNA, 10 nt, Shigella flexneri 2a str. 301
gaauuuaccc

SEQ ID NO: 3945977 - RNA, 16 nt, Shigella flexneri 2a str. 301
gaauuucagcgccuga

SEQ ID NO: 3945978 - RNA, 14 nt, Shigella flexneri 2a str. 301
gaauuucaucacca

SEQ ID NO: 3945979 - RNA, 17 nt, Shigella flexneri 2a str. 301
gaauuucaucaccagcu

SEQ ID NO: 3945980 - RNA, 16 nt, Shigella flexneri 2a str. 301
gaauuucgccuuucug

SEQ ID NO: 3945981 - RNA, 18 nt, Shigella flexneri 2a str. 301
gaauuucucgugccacca

SEQ ID NO: 3945982 - RNA, 14 nt, Shigella flexneri 2a str. 301
gaauuugcgccguu

SEQ ID NO: 3945983 - RNA, 16 nt, Shigella flexneri 2a str. 301
gaauuugcuccagaaa

SEQ ID NO: 3945984 - RNA, 16 nt, Shigella flexneri 2a str. 301
gaauuuguaggccgga

SEQ ID NO: 3945985 - RNA, 21 nt, Shigella flexneri 2a str. 301
gaauuugucgauuuccaucuc

SEQ ID NO: 3945986 - RNA, 15 nt, Shigella flexneri 2a str. 301
gaauuuuccuucgga

SEQ ID NO: 3945987 - RNA, 14 nt, Shigella flexneri 2a str. 301
gaauuuuuccguug

SEQ ID NO: 3945988 - RNA, 19 nt, Shigella flexneri 2a str. 301
gaauuuuuccguugcugau

SEQ ID NO: 3945989 - RNA, 22 nt, Shigella flexneri 2a str. 301
gaauuuuuuauagaccuuaauu

SEQ ID NO: 3945990 - RNA, 21 nt, Shigella flexneri 2a str. 301
gacaaaaaaggugcugaaacu

SEQ ID NO: 3945991 - RNA, 15 nt, Shigella flexneri 2a str. 301
gacaaaaauaccacc

SEQ ID NO: 3945992 - RNA, 20 nt, Shigella flexneri 2a str. 301
gacaaacaccgaaccagaga

SEQ ID NO: 3945993 - RNA, 17 nt, Shigella flexneri 2a str. 301
gacaaacauugcugcca

SEQ ID NO: 3945994 - RNA, 22 nt, Shigella flexneri 2a str. 301
gacaaacgcuguaauuaccagc

SEQ ID NO: 3945995 - RNA, 15 nt, Shigella flexneri 2a str. 301
gacaaaguacaacgc

SEQ ID NO: 3945996 - RNA, 23 nt, Shigella flexneri 2a str. 301
gacaaauccuucacuuuugccag

SEQ ID NO: 3945997 - RNA, 17 nt, Shigella flexneri 2a str. 301
gacaaauuccgaacaaa

SEQ ID NO: 3945998 - RNA, 19 nt, Shigella flexneri 2a str. 301
gacaacaaaacgggggcua

SEQ ID NO: 3945999 - RNA, 20 nt, Shigella flexneri 2a str. 301
gacaacaacaucacaccugc

SEQ ID NO: 3946000 - RNA, 13 nt, Shigella flexneri 2a str. 301
gacaacaucaucu

SEQ ID NO: 3946001 - RNA, 18 nt, Shigella flexneri 2a str. 301
gacaaccagcuucaacga

SEQ ID NO: 3946002 - RNA, 19 nt, Shigella flexneri 2a str. 301
gacaaccagcuucaacgau

SEQ ID NO: 3946003 - RNA, 21 nt, Shigella flexneri 2a str. 301
gacaaccugaccuuuuuucag

SEQ ID NO: 3946004 - RNA, 22 nt, Shigella flexneri 2a str. 301
gacaacgcaacgccgccggaag

SEQ ID NO: 3946005 - RNA, 18 nt, Shigella flexneri 2a str. 301
gacaacgccauauaaauu

SEQ ID NO: 3946006 - RNA, 20 nt, Shigella flexneri 2a str. 301
gacaacgccuuguucgcccu

SEQ ID NO: 3946007 - RNA, 17 nt, Shigella flexneri 2a str. 301
gacaacuuucaucagca

SEQ ID NO: 3946008 - RNA, 17 nt, Shigella flexneri 2a str. 301
gacaagcgucgcaucag

SEQ ID NO: 3946009 - RNA, 21 nt, Shigella flexneri 2a str. 301
gacaagcuuacguuacccagc

SEQ ID NO: 3946010 - RNA, 22 nt, Shigella flexneri 2a str. 301
gacaaggcaggcaucaaugaaa

SEQ ID NO: 3946011 - RNA, 23 nt, Shigella flexneri 2a str. 301
gacaaggcguugauuggcgcagg

SEQ ID NO: 3946012 - RNA, 23 nt, Shigella flexneri 2a str. 301
gacaauaauacccagcaccgcag

SEQ ID NO: 3946013 - RNA, 12 nt, Shigella flexneri 2a str. 301
gacaauaauauc

SEQ ID NO: 3946014 - RNA, 13 nt, Shigella flexneri 2a str. 301
gacaauaaucaac

SEQ ID NO: 3946015 - RNA, 15 nt, Shigella flexneri 2a str. 301
gacaaucacaucacu

SEQ ID NO: 3946016 - RNA, 17 nt, Shigella flexneri 2a str. 301
gacaaucaccaggucac

SEQ ID NO: 3946017 - RNA, 23 nt, Shigella flexneri 2a str. 301
gacaaucaccaggucaccagaca

SEQ ID NO: 3946018 - RNA, 13 nt, Shigella flexneri 2a str. 301
gacaaucagguaa

SEQ ID NO: 3946019 - RNA, 14 nt, Shigella flexneri 2a str. 301
gacaaucgccacuu

SEQ ID NO: 3946020 - RNA, 13 nt, Shigella flexneri 2a str. 301
gacaaucgccagu

SEQ ID NO: 3946021 - RNA, 15 nt, Shigella flexneri 2a str. 301
gacaaugcaguucca

SEQ ID NO: 3946022 - RNA, 13 nt, Shigella flexneri 2a str. 301
gacaauuugccca

SEQ ID NO: 3946023 - RNA, 18 nt, Shigella flexneri 2a str. 301
gacaauuuguuggcgaaa

SEQ ID NO: 3946024 - RNA, 18 nt, Shigella flexneri 2a str. 301
gacacaacaauucccagu

SEQ ID NO: 3946025 - RNA, 15 nt, Shigella flexneri 2a str. 301
gacacaacuggcgca

SEQ ID NO: 3946026 - RNA, 21 nt, Shigella flexneri 2a str. 301
gacacacgagaguuaguguua

SEQ ID NO: 3946027 - RNA, 16 nt, Shigella flexneri 2a str. 301
gacacacugaaccgcg

SEQ ID NO: 3946028 - RNA, 23 nt, Shigella flexneri 2a str. 301
gacacagauaccaaaaucggcaa

SEQ ID NO: 3946029 - RNA, 13 nt, Shigella flexneri 2a str. 301
gacacaggcagca

SEQ ID NO: 3946030 - RNA, 14 nt, Shigella flexneri 2a str. 301
gacacaggcagcaa

SEQ ID NO: 3946031 - RNA, 19 nt, Shigella flexneri 2a str. 301
gacacaguucuucaaaaau

SEQ ID NO: 3946032 - RNA, 20 nt, Shigella flexneri 2a str. 301
gacacaucaccuccagcgaa

SEQ ID NO: 3946033 - RNA, 15 nt, Shigella flexneri 2a str. 301
gacacaucuaaugcu

SEQ ID NO: 3946034 - RNA, 16 nt, Shigella flexneri 2a str. 301
gacaccagcacaucau

SEQ ID NO: 3946035 - RNA, 20 nt, Shigella flexneri 2a str. 301
gacacccucgaccaaaugaa

SEQ ID NO: 3946036 - RNA, 19 nt, Shigella flexneri 2a str. 301
gacaccguuaaauaacugg

SEQ ID NO: 3946037 - RNA, 18 nt, Shigella flexneri 2a str. 301
gacacgccuccuggcuca

SEQ ID NO: 3946038 - RNA, 16 nt, Shigella flexneri 2a str. 301
gacacggcguauacaa

SEQ ID NO: 3946039 - RNA, 20 nt, Shigella flexneri 2a str. 301
gacacggcguauacaagaac

SEQ ID NO: 3946040 - RNA, 22 nt, Shigella flexneri 2a str. 301
gacacgggaaaccaacuccagc

SEQ ID NO: 3946041 - RNA, 13 nt, Shigella flexneri 2a str. 301
gacacuccuuccu

SEQ ID NO: 3946042 - RNA, 22 nt, Shigella flexneri 2a str. 301
gacacugacgcgucuuaucugg

SEQ ID NO: 3946043 - RNA, 16 nt, Shigella flexneri 2a str. 301
gacacugcugauaauc

SEQ ID NO: 3946044 - RNA, 22 nt, Shigella flexneri 2a str. 301
gacacuguuagguccggauggc

SEQ ID NO: 3946045 - RNA, 19 nt, Shigella flexneri 2a str. 301
gacagaacggauaucgaga

SEQ ID NO: 3946046 - RNA, 21 nt, Shigella flexneri 2a str. 301
gacagaacucguucagcgcau

SEQ ID NO: 3946047 - RNA, 23 nt, Shigella flexneri 2a str. 301
gacagacgacgacgcgcgcgggu

SEQ ID NO: 3946048 - RNA, 20 nt, Shigella flexneri 2a str. 301
gacagagguggucgcagcgg

SEQ ID NO: 3946049 - RNA, 15 nt, Shigella flexneri 2a str. 301
gacagaugcucgcca

SEQ ID NO: 3946050 - RNA, 20 nt, Shigella flexneri 2a str. 301
gacagauucaugcugcggcu

SEQ ID NO: 3946051 - RNA, 22 nt, Shigella flexneri 2a str. 301
gacagauuuugccagcaugacu

SEQ ID NO: 3946052 - RNA, 18 nt, Shigella flexneri 2a str. 301
gacagcaaagugccccca

SEQ ID NO: 3946053 - RNA, 16 nt, Shigella flexneri 2a str. 301
gacagcaggcucagaa

SEQ ID NO: 3946054 - RNA, 18 nt, Shigella flexneri 2a str. 301
gacagcagguugcgugca

SEQ ID NO: 3946055 - RNA, 20 nt, Shigella flexneri 2a str. 301
gacagcaucauaguggguuu

SEQ ID NO: 3946056 - RNA, 18 nt, Shigella flexneri 2a str. 301
gacagcaucguccgccag

SEQ ID NO: 3946057 - RNA, 12 nt, Shigella flexneri 2a str. 301
gacagcaugggg

SEQ ID NO: 3946058 - RNA, 20 nt, Shigella flexneri 2a str. 301
gacagccauccgucauccau

SEQ ID NO: 3946059 - RNA, 20 nt, Shigella flexneri 2a str. 301
gacagcccggcauguuucaa

SEQ ID NO: 3946060 - RNA, 17 nt, Shigella flexneri 2a str. 301
gacagccgaaaagguag

SEQ ID NO: 3946061 - RNA, 19 nt, Shigella flexneri 2a str. 301
gacagcgauuaccauuuca

SEQ ID NO: 3946062 - RNA, 23 nt, Shigella flexneri 2a str. 301
gacagcgauuaccauuucaccgu

SEQ ID NO: 3946063 - RNA, 15 nt, Shigella flexneri 2a str. 301
gacagcgauuccagu

SEQ ID NO: 3946064 - RNA, 14 nt, Shigella flexneri 2a str. 301
gacagcgccgcuuu

SEQ ID NO: 3946065 - RNA, 20 nt, Shigella flexneri 2a str. 301
gacagcucguuaaucagaau

SEQ ID NO: 3946066 - RNA, 19 nt, Shigella flexneri 2a str. 301
gacaggcggcccagugaau

SEQ ID NO: 3946067 - RNA, 14 nt, Shigella flexneri 2a str. 301
gacagggaucucuu

SEQ ID NO: 3946068 - RNA, 19 nt, Shigella flexneri 2a str. 301
gacaggucagcgccuggcu

SEQ ID NO: 3946069 - RNA, 14 nt, Shigella flexneri 2a str. 301
gacaggugaugcau

SEQ ID NO: 3946070 - RNA, 13 nt, Shigella flexneri 2a str. 301
gacaguaaaguuu

SEQ ID NO: 3946071 - RNA, 19 nt, Shigella flexneri 2a str. 301
gacaguagccuuuaucugu

SEQ ID NO: 3946072 - RNA, 19 nt, Shigella flexneri 2a str. 301
gacaguaucaucauuauua

SEQ ID NO: 3946073 - RNA, 15 nt, Shigella flexneri 2a str. 301
gacaguccccucgcc

SEQ ID NO: 3946074 - RNA, 22 nt, Shigella flexneri 2a str. 301
gacaguccccucgccccuccgg

SEQ ID NO: 3946075 - RNA, 17 nt, Shigella flexneri 2a str. 301
gacaguguuauucccaa

SEQ ID NO: 3946076 - RNA, 16 nt, Shigella flexneri 2a str. 301
gacaguuauuaucuga

SEQ ID NO: 3946077 - RNA, 22 nt, Shigella flexneri 2a str. 301
gacaguugcugcgugaccgcca

SEQ ID NO: 3946078 - RNA, 17 nt, Shigella flexneri 2a str. 301
gacaguuucaccugcug

SEQ ID NO: 3946079 - RNA, 15 nt, Shigella flexneri 2a str. 301
gacaguuugccuuca

SEQ ID NO: 3946080 - RNA, 17 nt, Shigella flexneri 2a str. 301
gacauaaacaccagcaa

SEQ ID NO: 3946081 - RNA, 22 nt, Shigella flexneri 2a str. 301
gacauaaccacucaccgccguu

SEQ ID NO: 3946082 - RNA, 21 nt, Shigella flexneri 2a str. 301
gacauaagcgcaugaucguuc

SEQ ID NO: 3946083 - RNA, 14 nt, Shigella flexneri 2a str. 301
gacauacagaucgu

SEQ ID NO: 3946084 - RNA, 16 nt, Shigella flexneri 2a str. 301
gacauaguagccagcc

SEQ ID NO: 3946085 - RNA, 16 nt, Shigella flexneri 2a str. 301
gacauagucaucaucu

SEQ ID NO: 3946086 - RNA, 14 nt, Shigella flexneri 2a str. 301
gacauauaaccggc

SEQ ID NO: 3946087 - RNA, 13 nt, Shigella flexneri 2a str. 301
gacauaugcuuaa

SEQ ID NO: 3946088 - RNA, 12 nt, Shigella flexneri 2a str. 301
gacauauuuuug

SEQ ID NO: 3946089 - RNA, 16 nt, Shigella flexneri 2a str. 301
gacaucaagaaaugca

SEQ ID NO: 3946090 - RNA, 12 nt, Shigella flexneri 2a str. 301
gacaucaucgcc

SEQ ID NO: 3946091 - RNA, 14 nt, Shigella flexneri 2a str. 301
gacauccaugcacu

SEQ ID NO: 3946092 - RNA, 15 nt, Shigella flexneri 2a str. 301
gacaucgccacggca

SEQ ID NO: 3946093 - RNA, 14 nt, Shigella flexneri 2a str. 301
gacaucgugcuggu

SEQ ID NO: 3946094 - RNA, 17 nt, Shigella flexneri 2a str. 301
gacaucugcaauuugug

SEQ ID NO: 3946095 - RNA, 20 nt, Shigella flexneri 2a str. 301
gacaugcgguucacgcgcca

SEQ ID NO: 3946096 - RNA, 19 nt, Shigella flexneri 2a str. 301
gacauggcccagcccacug

SEQ ID NO: 3946097 - RNA, 20 nt, Shigella flexneri 2a str. 301
gacauggugcgauuaagaua

SEQ ID NO: 3946098 - RNA, 14 nt, Shigella flexneri 2a str. 301
gacauguggauuaa

SEQ ID NO: 3946099 - RNA, 14 nt, Shigella flexneri 2a str. 301
gacauguugcugac

SEQ ID NO: 3946100 - RNA, 15 nt, Shigella flexneri 2a str. 301
gacauguugcugacc

SEQ ID NO: 3946101 - RNA, 14 nt, Shigella flexneri 2a str. 301
gacauguuuuccag

SEQ ID NO: 3946102 - RNA, 17 nt, Shigella flexneri 2a str. 301
gacauuacgcauuugcg

SEQ ID NO: 3946103 - RNA, 18 nt, Shigella flexneri 2a str. 301
gacauuacggauuaaaua

SEQ ID NO: 3946104 - RNA, 16 nt, Shigella flexneri 2a str. 301
gacauucaccucacga

SEQ ID NO: 3946105 - RNA, 15 nt, Shigella flexneri 2a str. 301
gacauuccguuugcu

SEQ ID NO: 3946106 - RNA, 15 nt, Shigella flexneri 2a str. 301
gacauucugacuggu

SEQ ID NO: 3946107 - RNA, 13 nt, Shigella flexneri 2a str. 301
gacauugaaggau

SEQ ID NO: 3946108 - RNA, 18 nt, Shigella flexneri 2a str. 301
gacauuguuuccauaugu

SEQ ID NO: 3946109 - RNA, 16 nt, Shigella flexneri 2a str. 301
gaccaaagaaugacac

SEQ ID NO: 3946110 - RNA, 20 nt, Shigella flexneri 2a str. 301
gaccaaaggcgaugcuguau

SEQ ID NO: 3946111 - RNA, 18 nt, Shigella flexneri 2a str. 301
gaccaauaaacgccaggu

SEQ ID NO: 3946112 - RNA, 20 nt, Shigella flexneri 2a str. 301
gaccaauaacgcuuuucuca

SEQ ID NO: 3946113 - RNA, 14 nt, Shigella flexneri 2a str. 301
gaccaaucaccacu

SEQ ID NO: 3946114 - RNA, 13 nt, Shigella flexneri 2a str. 301
gaccaauccagcc

SEQ ID NO: 3946115 - RNA, 15 nt, Shigella flexneri 2a str. 301
gaccaauccgccagc

SEQ ID NO: 3946116 - RNA, 13 nt, Shigella flexneri 2a str. 301
gaccaaucgcggg

SEQ ID NO: 3946117 - RNA, 13 nt, Shigella flexneri 2a str. 301
gaccaccagcacg

SEQ ID NO: 3946118 - RNA, 14 nt, Shigella flexneri 2a str. 301
gaccaccagcacgc

SEQ ID NO: 3946119 - RNA, 19 nt, Shigella flexneri 2a str. 301
gaccaccauauucgccacc

SEQ ID NO: 3946120 - RNA, 17 nt, Shigella flexneri 2a str. 301
gaccaccgaaugcgccu

SEQ ID NO: 3946121 - RNA, 20 nt, Shigella flexneri 2a str. 301
gaccaccgaccaucccacca

SEQ ID NO: 3946122 - RNA, 13 nt, Shigella flexneri 2a str. 301
gaccaccgcgcua

SEQ ID NO: 3946123 - RNA, 20 nt, Shigella flexneri 2a str. 301
gaccaccgguuuuaucgagc

SEQ ID NO: 3946124 - RNA, 16 nt, Shigella flexneri 2a str. 301
gaccacggacaugaac

SEQ ID NO: 3946125 - RNA, 14 nt, Shigella flexneri 2a str. 301
gaccacgggcuuau

SEQ ID NO: 3946126 - RNA, 23 nt, Shigella flexneri 2a str. 301
gaccacuuuccucaucagaaaga

SEQ ID NO: 3946127 - RNA, 19 nt, Shigella flexneri 2a str. 301
gaccagaaacgccaccauu

SEQ ID NO: 3946128 - RNA, 19 nt, Shigella flexneri 2a str. 301
gaccagaauaagucuggca

SEQ ID NO: 3946129 - RNA, 17 nt, Shigella flexneri 2a str. 301
gaccagagcugauacgg

SEQ ID NO: 3946130 - RNA, 20 nt, Shigella flexneri 2a str. 301
gaccagaucggucagugcca

SEQ ID NO: 3946131 - RNA, 13 nt, Shigella flexneri 2a str. 301
gaccagaugcgac

SEQ ID NO: 3946132 - RNA, 22 nt, Shigella flexneri 2a str. 301
gaccagaugcgacguaaaaacu

SEQ ID NO: 3946133 - RNA, 15 nt, Shigella flexneri 2a str. 301
gaccagcaacaaaua

SEQ ID NO: 3946134 - RNA, 17 nt, Shigella flexneri 2a str. 301
gaccagcaacaaauaac

SEQ ID NO: 3946135 - RNA, 16 nt, Shigella flexneri 2a str. 301
gaccagcagcauuuca

SEQ ID NO: 3946136 - RNA, 16 nt, Shigella flexneri 2a str. 301
gaccagcaucccggca

SEQ ID NO: 3946137 - RNA, 18 nt, Shigella flexneri 2a str. 301
gaccagcaucccggcagc

SEQ ID NO: 3946138 - RNA, 13 nt, Shigella flexneri 2a str. 301
gaccagcauucca

SEQ ID NO: 3946139 - RNA, 23 nt, Shigella flexneri 2a str. 301
gaccagccgauuuuaaugcggca

SEQ ID NO: 3946140 - RNA, 22 nt, Shigella flexneri 2a str. 301
gaccagcgauaaaaauccgcca

SEQ ID NO: 3946141 - RNA, 17 nt, Shigella flexneri 2a str. 301
gaccagcgucgcaucag

SEQ ID NO: 3946142 - RNA, 13 nt, Shigella flexneri 2a str. 301
gaccagcuaccac

SEQ ID NO: 3946143 - RNA, 19 nt, Shigella flexneri 2a str. 301
gaccagcugccgacgccag

SEQ ID NO: 3946144 - RNA, 20 nt, Shigella flexneri 2a str. 301
gaccaggauuugauggucuc

SEQ ID NO: 3946145 - RNA, 16 nt, Shigella flexneri 2a str. 301
gaccaggccaucagca

SEQ ID NO: 3946146 - RNA, 19 nt, Shigella flexneri 2a str. 301
gaccaggccaucagcagcg

SEQ ID NO: 3946147 - RNA, 20 nt, Shigella flexneri 2a str. 301
gaccaggccaucagcagcgg

SEQ ID NO: 3946148 - RNA, 20 nt, Shigella flexneri 2a str. 301
gaccagggcgucaccuugcc

SEQ ID NO: 3946149 - RNA, 15 nt, Shigella flexneri 2a str. 301
gaccaguaccaccgc

SEQ ID NO: 3946150 - RNA, 22 nt, Shigella flexneri 2a str. 301
gaccaguuuuuucaccagcgcu

SEQ ID NO: 3946151 - RNA, 12 nt, Shigella flexneri 2a str. 301
gaccauaaaagg

SEQ ID NO: 3946152 - RNA, 19 nt, Shigella flexneri 2a str. 301
gaccauaaauauggugaaa

SEQ ID NO: 3946153 - RNA, 13 nt, Shigella flexneri 2a str. 301
gaccauaacccgc

SEQ ID NO: 3946154 - RNA, 18 nt, Shigella flexneri 2a str. 301
gaccauacagcagcaacg

SEQ ID NO: 3946155 - RNA, 17 nt, Shigella flexneri 2a str. 301
gaccauauuagccgcca

SEQ ID NO: 3946156 - RNA, 18 nt, Shigella flexneri 2a str. 301
gaccaucuuccagcauca

SEQ ID NO: 3946157 - RNA, 21 nt, Shigella flexneri 2a str. 301
gaccauugccaguaacagaac

SEQ ID NO: 3946158 - RNA, 18 nt, Shigella flexneri 2a str. 301
gacccagcaccaguacca

SEQ ID NO: 3946159 - RNA, 16 nt, Shigella flexneri 2a str. 301
gacccagccagacgcc

SEQ ID NO: 3946160 - RNA, 18 nt, Shigella flexneri 2a str. 301
gacccagccagacgccag

SEQ ID NO: 3946161 - RNA, 22 nt, Shigella flexneri 2a str. 301
gacccauuuugccgguucccaa

SEQ ID NO: 3946162 - RNA, 20 nt, Shigella flexneri 2a str. 301
gacccgacagaugcucgcca

SEQ ID NO: 3946163 - RNA, 14 nt, Shigella flexneri 2a str. 301
gacccgcagccagc

SEQ ID NO: 3946164 - RNA, 15 nt, Shigella flexneri 2a str. 301
gacccgcagccagca

SEQ ID NO: 3946165 - RNA, 15 nt, Shigella flexneri 2a str. 301
gacccggaauaaaug

SEQ ID NO: 3946166 - RNA, 20 nt, Shigella flexneri 2a str. 301
gacccugcguugucgcagug

SEQ ID NO: 3946167 - RNA, 19 nt, Shigella flexneri 2a str. 301
gacccugcucuuucagcac

SEQ ID NO: 3946168 - RNA, 23 nt, Shigella flexneri 2a str. 301
gacccugcucuuucagcaccgcg

SEQ ID NO: 3946169 - RNA, 16 nt, Shigella flexneri 2a str. 301
gaccgauaaugauccc

SEQ ID NO: 3946170 - RNA, 18 nt, Shigella flexneri 2a str. 301
gaccgauggguucagaau

SEQ ID NO: 3946171 - RNA, 17 nt, Shigella flexneri 2a str. 301
gaccgauugauucccaa

SEQ ID NO: 3946172 - RNA, 14 nt, Shigella flexneri 2a str. 301
gaccgcagaagccg

SEQ ID NO: 3946173 - RNA, 14 nt, Shigella flexneri 2a str. 301
gaccgccaccggcc

SEQ ID NO: 3946174 - RNA, 12 nt, Shigella flexneri 2a str. 301
gaccgccaggca

SEQ ID NO: 3946175 - RNA, 16 nt, Shigella flexneri 2a str. 301
gaccgcccgcuaugag

SEQ ID NO: 3946176 - RNA, 18 nt, Shigella flexneri 2a str. 301
gaccggaaaagguguuca

SEQ ID NO: 3946177 - RNA, 14 nt, Shigella flexneri 2a str. 301
gaccggacugacuc

SEQ ID NO: 3946178 - RNA, 17 nt, Shigella flexneri 2a str. 301
gaccggcaaccagcacc

SEQ ID NO: 3946179 - RNA, 22 nt, Shigella flexneri 2a str. 301
gaccggcaaucgcgccagaaca

SEQ ID NO: 3946180 - RNA, 15 nt, Shigella flexneri 2a str. 301
gaccgggcgcggcug

SEQ ID NO: 3946181 - RNA, 16 nt, Shigella flexneri 2a str. 301
gaccguccaggcgguc

SEQ ID NO: 3946182 - RNA, 17 nt, Shigella flexneri 2a str. 301
gaccgucgccuucaacg

SEQ ID NO: 3946183 - RNA, 13 nt, Shigella flexneri 2a str. 301
gaccgucuuucau

SEQ ID NO: 3946184 - RNA, 19 nt, Shigella flexneri 2a str. 301
gaccgugaucguggccaug

SEQ ID NO: 3946185 - RNA, 22 nt, Shigella flexneri 2a str. 301
gaccgugcgggcgaaagcagaa

SEQ ID NO: 3946186 - RNA, 22 nt, Shigella flexneri 2a str. 301
gaccguuagcauauugcaggcu

SEQ ID NO: 3946187 - RNA, 18 nt, Shigella flexneri 2a str. 301
gaccguuccauucaaacg

SEQ ID NO: 3946188 - RNA, 17 nt, Shigella flexneri 2a str. 301
gaccguucgccagguca

SEQ ID NO: 3946189 - RNA, 15 nt, Shigella flexneri 2a str. 301
gaccguuuucaccag

SEQ ID NO: 3946190 - RNA, 18 nt, Shigella flexneri 2a str. 301
gaccuaaacguuuaaaaa

SEQ ID NO: 3946191 - RNA, 16 nt, Shigella flexneri 2a str. 301
gaccuacaaaaccugc

SEQ ID NO: 3946192 - RNA, 19 nt, Shigella flexneri 2a str. 301
gaccuacaaaaccugcacg

SEQ ID NO: 3946193 - RNA, 20 nt, Shigella flexneri 2a str. 301
gaccuacaaaaccugcacgu

SEQ ID NO: 3946194 - RNA, 18 nt, Shigella flexneri 2a str. 301
gaccuacgcgcccgcgca

SEQ ID NO: 3946195 - RNA, 14 nt, Shigella flexneri 2a str. 301
gaccuagcaaacua

SEQ ID NO: 3946196 - RNA, 23 nt, Shigella flexneri 2a str. 301
gaccucuuaaugcaggcagcacu

SEQ ID NO: 3946197 - RNA, 16 nt, Shigella flexneri 2a str. 301
gaccugaaaccgccuu

SEQ ID NO: 3946198 - RNA, 18 nt, Shigella flexneri 2a str. 301
gaccugaauuugcuccag

SEQ ID NO: 3946199 - RNA, 19 nt, Shigella flexneri 2a str. 301
gaccugaauuugcuccaga

SEQ ID NO: 3946200 - RNA, 16 nt, Shigella flexneri 2a str. 301
gaccugacuguuccag

SEQ ID NO: 3946201 - RNA, 18 nt, Shigella flexneri 2a str. 301
gaccugacuguuccagca

SEQ ID NO: 3946202 - RNA, 16 nt, Shigella flexneri 2a str. 301
gaccugauuuugcaac

SEQ ID NO: 3946203 - RNA, 19 nt, Shigella flexneri 2a str. 301
gaccugcaaauucaauaaa

SEQ ID NO: 3946204 - RNA, 19 nt, Shigella flexneri 2a str. 301
gaccugcccaaucaugaac

SEQ ID NO: 3946205 - RNA, 18 nt, Shigella flexneri 2a str. 301
gaccugccgcagauauug

SEQ ID NO: 3946206 - RNA, 20 nt, Shigella flexneri 2a str. 301
gaccugcgucaccacaucca

SEQ ID NO: 3946207 - RNA, 21 nt, Shigella flexneri 2a str. 301
gaccugcgucaccacauccag

SEQ ID NO: 3946208 - RNA, 16 nt, Shigella flexneri 2a str. 301
gaccuggcgcuucacu

SEQ ID NO: 3946209 - RNA, 18 nt, Shigella flexneri 2a str. 301
gaccugggaaauccaaca

SEQ ID NO: 3946210 - RNA, 17 nt, Shigella flexneri 2a str. 301
gaccuguaaaguacaau

SEQ ID NO: 3946211 - RNA, 20 nt, Shigella flexneri 2a str. 301
gaccuguaccuucagcggca

SEQ ID NO: 3946212 - RNA, 20 nt, Shigella flexneri 2a str. 301
gaccugucggggccagcgca

SEQ ID NO: 3946213 - RNA, 21 nt, Shigella flexneri 2a str. 301
gaccugucggggccagcgcau

SEQ ID NO: 3946214 - RNA, 18 nt, Shigella flexneri 2a str. 301
gaccuguugcccaugcuu

SEQ ID NO: 3946215 - RNA, 17 nt, Shigella flexneri 2a str. 301
gaccuucugaauaauga

SEQ ID NO: 3946216 - RNA, 15 nt, Shigella flexneri 2a str. 301
gaccuucugccagac

SEQ ID NO: 3946217 - RNA, 17 nt, Shigella flexneri 2a str. 301
gaccuugucaugcagcu

SEQ ID NO: 3946218 - RNA, 17 nt, Shigella flexneri 2a str. 301
gacgaaaaaucaauaaa

SEQ ID NO: 3946219 - RNA, 17 nt, Shigella flexneri 2a str. 301
gacgaaagucugggccg

SEQ ID NO: 3946220 - RNA, 15 nt, Shigella flexneri 2a str. 301
gacgaacuucacggu

SEQ ID NO: 3946221 - RNA, 18 nt, Shigella flexneri 2a str. 301
gacgaauaccuucuuccu

SEQ ID NO: 3946222 - RNA, 12 nt, Shigella flexneri 2a str. 301
gacgacaccauc

SEQ ID NO: 3946223 - RNA, 13 nt, Shigella flexneri 2a str. 301
gacgacaccaucu

SEQ ID NO: 3946224 - RNA, 14 nt, Shigella flexneri 2a str. 301
gacgacgaagaaac

SEQ ID NO: 3946225 - RNA, 15 nt, Shigella flexneri 2a str. 301
gacgacgacgcgcgc

SEQ ID NO: 3946226 - RNA, 15 nt, Shigella flexneri 2a str. 301
gacgacgguuuccac

SEQ ID NO: 3946227 - RNA, 15 nt, Shigella flexneri 2a str. 301
gacgacuuuuuccau

SEQ ID NO: 3946228 - RNA, 13 nt, Shigella flexneri 2a str. 301
gacgagcgcuggu

SEQ ID NO: 3946229 - RNA, 14 nt, Shigella flexneri 2a str. 301
gacgaggcgcuggc

SEQ ID NO: 3946230 - RNA, 23 nt, Shigella flexneri 2a str. 301
gacgauagauagagaaguaaccg

SEQ ID NO: 3946231 - RNA, 12 nt, Shigella flexneri 2a str. 301
gacgaucaccac

SEQ ID NO: 3946232 - RNA, 19 nt, Shigella flexneri 2a str. 301
gacgaucaccacaccguca

SEQ ID NO: 3946233 - RNA, 19 nt, Shigella flexneri 2a str. 301
gacgaugaccgcaucaaug

SEQ ID NO: 3946234 - RNA, 23 nt, Shigella flexneri 2a str. 301
gacgaugguuuuuggguucagca

SEQ ID NO: 3946235 - RNA, 15 nt, Shigella flexneri 2a str. 301
gacgauugugcuggu

SEQ ID NO: 3946236 - RNA, 17 nt, Shigella flexneri 2a str. 301
gacgauugugcugguga

SEQ ID NO: 3946237 - RNA, 22 nt, Shigella flexneri 2a str. 301
gacgcaaaacgcgcucacugca

SEQ ID NO: 3946238 - RNA, 21 nt, Shigella flexneri 2a str. 301
gacgcacaucgcugugcugcu

SEQ ID NO: 3946239 - RNA, 17 nt, Shigella flexneri 2a str. 301
gacgcacuuucgcuuua

SEQ ID NO: 3946240 - RNA, 23 nt, Shigella flexneri 2a str. 301
gacgcagaccaaagucaaacugg

SEQ ID NO: 3946241 - RNA, 22 nt, Shigella flexneri 2a str. 301
gacgcaggaugcaauuguugag

SEQ ID NO: 3946242 - RNA, 21 nt, Shigella flexneri 2a str. 301
gacgcaggcgcgcuguggugu

SEQ ID NO: 3946243 - RNA, 13 nt, Shigella flexneri 2a str. 301
gacgcagucaugc

SEQ ID NO: 3946244 - RNA, 14 nt, Shigella flexneri 2a str. 301
gacgcauugauaau

SEQ ID NO: 3946245 - RNA, 12 nt, Shigella flexneri 2a str. 301
gacgcauugcau

SEQ ID NO: 3946246 - RNA, 16 nt, Shigella flexneri 2a str. 301
gacgccacaaucugau

SEQ ID NO: 3946247 - RNA, 16 nt, Shigella flexneri 2a str. 301
gacgccacuggcuggg

SEQ ID NO: 3946248 - RNA, 12 nt, Shigella flexneri 2a str. 301
gacgccagcgcu

SEQ ID NO: 3946249 - RNA, 14 nt, Shigella flexneri 2a str. 301
gacgcccacgcggu

SEQ ID NO: 3946250 - RNA, 14 nt, Shigella flexneri 2a str. 301
gacgcccccaaacu

SEQ ID NO: 3946251 - RNA, 21 nt, Shigella flexneri 2a str. 301
gacgccccggccuugccuguu

SEQ ID NO: 3946252 - RNA, 21 nt, Shigella flexneri 2a str. 301
gacgcccguuaaccgcucugc

SEQ ID NO: 3946253 - RNA, 18 nt, Shigella flexneri 2a str. 301
gacgcccugcgcugguga

SEQ ID NO: 3946254 - RNA, 21 nt, Shigella flexneri 2a str. 301
gacgccgccggugucgcaccu

SEQ ID NO: 3946255 - RNA, 14 nt, Shigella flexneri 2a str. 301
gacgccgucaaaac

SEQ ID NO: 3946256 - RNA, 19 nt, Shigella flexneri 2a str. 301
gacgccgucaaaacgcgac

SEQ ID NO: 3946257 - RNA, 15 nt, Shigella flexneri 2a str. 301
gacgccuucagcgau

SEQ ID NO: 3946258 - RNA, 15 nt, Shigella flexneri 2a str. 301
gacgcgacaagcguc

SEQ ID NO: 3946259 - RNA, 19 nt, Shigella flexneri 2a str. 301
gacgcgaccggcgucgcau

SEQ ID NO: 3946260 - RNA, 17 nt, Shigella flexneri 2a str. 301
gacgcgcagcgucgcau

SEQ ID NO: 3946261 - RNA, 17 nt, Shigella flexneri 2a str. 301
gacgcgcaucacgacaa

SEQ ID NO: 3946262 - RNA, 13 nt, Shigella flexneri 2a str. 301
gacgcgccagcac

SEQ ID NO: 3946263 - RNA, 14 nt, Shigella flexneri 2a str. 301
gacgcgccagcacc

SEQ ID NO: 3946264 - RNA, 23 nt, Shigella flexneri 2a str. 301
gacgcgccagcgucgcaucaggc

SEQ ID NO: 3946265 - RNA, 20 nt, Shigella flexneri 2a str. 301
gacgcgcuagcuucaggugu

SEQ ID NO: 3946266 - RNA, 13 nt, Shigella flexneri 2a str. 301
gacgcgggcagca

SEQ ID NO: 3946267 - RNA, 16 nt, Shigella flexneri 2a str. 301
gacgcgguaaaagccc

SEQ ID NO: 3946268 - RNA, 17 nt, Shigella flexneri 2a str. 301
gacgcgguaaaagccca

SEQ ID NO: 3946269 - RNA, 20 nt, Shigella flexneri 2a str. 301
gacgcgguagcacgucaucu

SEQ ID NO: 3946270 - RNA, 17 nt, Shigella flexneri 2a str. 301
gacgcgguauuggugaa

SEQ ID NO: 3946271 - RNA, 12 nt, Shigella flexneri 2a str. 301
gacgcgucagug

SEQ ID NO: 3946272 - RNA, 12 nt, Shigella flexneri 2a str. 301
gacgcgucuuau

SEQ ID NO: 3946273 - RNA, 23 nt, Shigella flexneri 2a str. 301
gacgcgugccuaacaauucgcca

SEQ ID NO: 3946274 - RNA, 19 nt, Shigella flexneri 2a str. 301
gacgcguggagagucauca

SEQ ID NO: 3946275 - RNA, 13 nt, Shigella flexneri 2a str. 301
gacgcguuagcau

SEQ ID NO: 3946276 - RNA, 20 nt, Shigella flexneri 2a str. 301
gacgcuccaguguggccaga

SEQ ID NO: 3946277 - RNA, 22 nt, Shigella flexneri 2a str. 301
gacgcugaugucagcacuucca

SEQ ID NO: 3946278 - RNA, 23 nt, Shigella flexneri 2a str. 301
gacgcugaugucagcacuuccag

SEQ ID NO: 3946279 - RNA, 15 nt, Shigella flexneri 2a str. 301
gacgcugcgccgacc

SEQ ID NO: 3946280 - RNA, 15 nt, Shigella flexneri 2a str. 301
gacgcuggcuuugcc

SEQ ID NO: 3946281 - RNA, 16 nt, Shigella flexneri 2a str. 301
gacgcugucaccugcg

SEQ ID NO: 3946282 - RNA, 17 nt, Shigella flexneri 2a str. 301
gacgcuguuguuuuuuc

SEQ ID NO: 3946283 - RNA, 21 nt, Shigella flexneri 2a str. 301
gacggaacuucauaugcgcca

SEQ ID NO: 3946284 - RNA, 19 nt, Shigella flexneri 2a str. 301
gacggaauauugaugacgc

SEQ ID NO: 3946285 - RNA, 19 nt, Shigella flexneri 2a str. 301
gacggacguccggugauau

SEQ ID NO: 3946286 - RNA, 20 nt, Shigella flexneri 2a str. 301
gacggacguccggugauauc

SEQ ID NO: 3946287 - RNA, 19 nt, Shigella flexneri 2a str. 301
gacggaucuguuccgccag

SEQ ID NO: 3946288 - RNA, 16 nt, Shigella flexneri 2a str. 301
gacggcagcgaagggu

SEQ ID NO: 3946289 - RNA, 14 nt, Shigella flexneri 2a str. 301
gacggcaucgccau

SEQ ID NO: 3946290 - RNA, 20 nt, Shigella flexneri 2a str. 301
gacggccagucauugagcuu

SEQ ID NO: 3946291 - RNA, 14 nt, Shigella flexneri 2a str. 301
gacggcugauaugc

SEQ ID NO: 3946292 - RNA, 20 nt, Shigella flexneri 2a str. 301
gacggcugauaugccagacu

SEQ ID NO: 3946293 - RNA, 15 nt, Shigella flexneri 2a str. 301
gacggcuuagcgcau

SEQ ID NO: 3946294 - RNA, 17 nt, Shigella flexneri 2a str. 301
gacgggauagcucaaug

SEQ ID NO: 3946295 - RNA, 23 nt, Shigella flexneri 2a str. 301
gacgggcauuucgucuugcagga

SEQ ID NO: 3946296 - RNA, 21 nt, Shigella flexneri 2a str. 301
gacgggcuaaucgucaucagc

SEQ ID NO: 3946297 - RNA, 18 nt, Shigella flexneri 2a str. 301
gacgguaaaccacgccag

SEQ ID NO: 3946298 - RNA, 17 nt, Shigella flexneri 2a str. 301
gacgguuuuacgcuccc

SEQ ID NO: 3946299 - RNA, 16 nt, Shigella flexneri 2a str. 301
gacguaaagaagaugu

SEQ ID NO: 3946300 - RNA, 16 nt, Shigella flexneri 2a str. 301
gacguccggcgcugca

SEQ ID NO: 3946301 - RNA, 17 nt, Shigella flexneri 2a str. 301
gacgucgcgaauggccu

SEQ ID NO: 3946302 - RNA, 18 nt, Shigella flexneri 2a str. 301
gacgucucaaucaccacc

SEQ ID NO: 3946303 - RNA, 23 nt, Shigella flexneri 2a str. 301
gacgugcguaccauuaucaccaa

SEQ ID NO: 3946304 - RNA, 18 nt, Shigella flexneri 2a str. 301
gacguguuuucaccggcg

SEQ ID NO: 3946305 - RNA, 18 nt, Shigella flexneri 2a str. 301
gacguuaacuacaaucac

SEQ ID NO: 3946306 - RNA, 17 nt, Shigella flexneri 2a str. 301
gacguuaauaaaauuua

SEQ ID NO: 3946307 - RNA, 15 nt, Shigella flexneri 2a str. 301
gacguucaccgucac

SEQ ID NO: 3946308 - RNA, 12 nt, Shigella flexneri 2a str. 301
gacguucagcca

SEQ ID NO: 3946309 - RNA, 17 nt, Shigella flexneri 2a str. 301
gacguucaugccggucg

SEQ ID NO: 3946310 - RNA, 13 nt, Shigella flexneri 2a str. 301
gacguucugccaa

SEQ ID NO: 3946311 - RNA, 22 nt, Shigella flexneri 2a str. 301
gacguugauucacuuucugaag

SEQ ID NO: 3946312 - RNA, 22 nt, Shigella flexneri 2a str. 301
gacguuuuagccauaaacgggc

SEQ ID NO: 3946313 - RNA, 11 nt, Shigella flexneri 2a str. 301
gacuaaaaccc

SEQ ID NO: 3946314 - RNA, 16 nt, Shigella flexneri 2a str. 301
gacuaauacaccauca

SEQ ID NO: 3946315 - RNA, 23 nt, Shigella flexneri 2a str. 301
gacuacgacgccaagaaagagcg

SEQ ID NO: 3946316 - RNA, 23 nt, Shigella flexneri 2a str. 301
gacuauauaaauuacccuuuauu

SEQ ID NO: 3946317 - RNA, 16 nt, Shigella flexneri 2a str. 301
gacuaucgacgauaau

SEQ ID NO: 3946318 - RNA, 14 nt, Shigella flexneri 2a str. 301
gacuauuacucaac

SEQ ID NO: 3946319 - RNA, 20 nt, Shigella flexneri 2a str. 301
gacuauuaugaauuuacucu

SEQ ID NO: 3946320 - RNA, 15 nt, Shigella flexneri 2a str. 301
gacuauucagcucuu

SEQ ID NO: 3946321 - RNA, 13 nt, Shigella flexneri 2a str. 301
gacuauuucuuca

SEQ ID NO: 3946322 - RNA, 13 nt, Shigella flexneri 2a str. 301
gacuauuugacac

SEQ ID NO: 3946323 - RNA, 19 nt, Shigella flexneri 2a str. 301
gacucaaaccccgcagcaa

SEQ ID NO: 3946324 - RNA, 18 nt, Shigella flexneri 2a str. 301
gacucaauggcauccgcc

SEQ ID NO: 3946325 - RNA, 14 nt, Shigella flexneri 2a str. 301
gacuccaacuuacu

SEQ ID NO: 3946326 - RNA, 15 nt, Shigella flexneri 2a str. 301
gacuccagcgccagc

SEQ ID NO: 3946327 - RNA, 19 nt, Shigella flexneri 2a str. 301
gacuccaggcguuuugcag

SEQ ID NO: 3946328 - RNA, 15 nt, Shigella flexneri 2a str. 301
gacuccaguuuguuc

SEQ ID NO: 3946329 - RNA, 21 nt, Shigella flexneri 2a str. 301
gacuccuguaucgucacuggu

SEQ ID NO: 3946330 - RNA, 19 nt, Shigella flexneri 2a str. 301
gacucgccauuaacauuaa

SEQ ID NO: 3946331 - RNA, 15 nt, Shigella flexneri 2a str. 301
gacucucauuuuuca

SEQ ID NO: 3946332 - RNA, 17 nt, Shigella flexneri 2a str. 301
gacucuuacucuuucaa

SEQ ID NO: 3946333 - RNA, 18 nt, Shigella flexneri 2a str. 301
gacugaaaguacuucaca

SEQ ID NO: 3946334 - RNA, 20 nt, Shigella flexneri 2a str. 301
gacugaaaguacuucacaau

SEQ ID NO: 3946335 - RNA, 12 nt, Shigella flexneri 2a str. 301
gacugaauacgc

SEQ ID NO: 3946336 - RNA, 17 nt, Shigella flexneri 2a str. 301
gacugaauacgcuggcg

SEQ ID NO: 3946337 - RNA, 19 nt, Shigella flexneri 2a str. 301
gacugaauacgcuggcgcg

SEQ ID NO: 3946338 - RNA, 11 nt, Shigella flexneri 2a str. 301
gacugacuccg

SEQ ID NO: 3946339 - RNA, 19 nt, Shigella flexneri 2a str. 301
gacugauaacgcggcagca

SEQ ID NO: 3946340 - RNA, 17 nt, Shigella flexneri 2a str. 301
gacugaugacaaacaca

SEQ ID NO: 3946341 - RNA, 13 nt, Shigella flexneri 2a str. 301
gacugaugcuuuc

SEQ ID NO: 3946342 - RNA, 15 nt, Shigella flexneri 2a str. 301
gacugaugcuuuccg

SEQ ID NO: 3946343 - RNA, 20 nt, Shigella flexneri 2a str. 301
gacugaugugauccaucagg

SEQ ID NO: 3946344 - RNA, 21 nt, Shigella flexneri 2a str. 301
gacugaugugauccaucaggu

SEQ ID NO: 3946345 - RNA, 22 nt, Shigella flexneri 2a str. 301
gacugauguguaggucgcauag

SEQ ID NO: 3946346 - RNA, 14 nt, Shigella flexneri 2a str. 301
gacugcaaaaagca

SEQ ID NO: 3946347 - RNA, 17 nt, Shigella flexneri 2a str. 301
gacugcagcggucacau

SEQ ID NO: 3946348 - RNA, 15 nt, Shigella flexneri 2a str. 301
gacugccccaguucc

SEQ ID NO: 3946349 - RNA, 22 nt, Shigella flexneri 2a str. 301
gacugcgagaaguucugcagcc

SEQ ID NO: 3946350 - RNA, 18 nt, Shigella flexneri 2a str. 301
gacugcgccacuucccag

SEQ ID NO: 3946351 - RNA, 13 nt, Shigella flexneri 2a str. 301
gacugcuccugua

SEQ ID NO: 3946352 - RNA, 21 nt, Shigella flexneri 2a str. 301
gacugcuuuuacaaaaucuuc

SEQ ID NO: 3946353 - RNA, 21 nt, Shigella flexneri 2a str. 301
gacuggaaacucacgccagca

SEQ ID NO: 3946354 - RNA, 13 nt, Shigella flexneri 2a str. 301
gacuggaaaucaa

SEQ ID NO: 3946355 - RNA, 14 nt, Shigella flexneri 2a str. 301
gacuggaaaucaaa

SEQ ID NO: 3946356 - RNA, 18 nt, Shigella flexneri 2a str. 301
gacuggaaaucaaaaaca

SEQ ID NO: 3946357 - RNA, 18 nt, Shigella flexneri 2a str. 301
gacuggaauaagccaaau

SEQ ID NO: 3946358 - RNA, 16 nt, Shigella flexneri 2a str. 301
gacuggcgagauccgg

SEQ ID NO: 3946359 - RNA, 15 nt, Shigella flexneri 2a str. 301
gacuggcggugauug

SEQ ID NO: 3946360 - RNA, 20 nt, Shigella flexneri 2a str. 301
gacuggcucuuuuucggggc

SEQ ID NO: 3946361 - RNA, 21 nt, Shigella flexneri 2a str. 301
gacugggucaguauggaucaa

SEQ ID NO: 3946362 - RNA, 20 nt, Shigella flexneri 2a str. 301
gacugguuuugaacagcggu

SEQ ID NO: 3946363 - RNA, 19 nt, Shigella flexneri 2a str. 301
gacuguacagauccgccau

SEQ ID NO: 3946364 - RNA, 20 nt, Shigella flexneri 2a str. 301
gacuguacagauccgccauu

SEQ ID NO: 3946365 - RNA, 14 nt, Shigella flexneri 2a str. 301
gacuguaggccgga

SEQ ID NO: 3946366 - RNA, 12 nt, Shigella flexneri 2a str. 301
gacugucagaug

SEQ ID NO: 3946367 - RNA, 18 nt, Shigella flexneri 2a str. 301
gacugucagaugcggcuu

SEQ ID NO: 3946368 - RNA, 12 nt, Shigella flexneri 2a str. 301
gacuguuccagc

SEQ ID NO: 3946369 - RNA, 17 nt, Shigella flexneri 2a str. 301
gacuuauaagucucaga

SEQ ID NO: 3946370 - RNA, 22 nt, Shigella flexneri 2a str. 301
gacuucaaaaauaaguugccac

SEQ ID NO: 3946371 - RNA, 17 nt, Shigella flexneri 2a str. 301
gacuucaugcgcagcau

SEQ ID NO: 3946372 - RNA, 13 nt, Shigella flexneri 2a str. 301
gacuuccacuucc

SEQ ID NO: 3946373 - RNA, 16 nt, Shigella flexneri 2a str. 301
gacuuccacuuccugc

SEQ ID NO: 3946374 - RNA, 14 nt, Shigella flexneri 2a str. 301
gacuucccucccgu

SEQ ID NO: 3946375 - RNA, 12 nt, Shigella flexneri 2a str. 301
gacuuccgggau

SEQ ID NO: 3946376 - RNA, 12 nt, Shigella flexneri 2a str. 301
gacuucugcuuu

SEQ ID NO: 3946377 - RNA, 15 nt, Shigella flexneri 2a str. 301
gacuucugcuuucau

SEQ ID NO: 3946378 - RNA, 21 nt, Shigella flexneri 2a str. 301
gacuucuucauucauccgccg

SEQ ID NO: 3946379 - RNA, 14 nt, Shigella flexneri 2a str. 301
gacuugaaccagcg

SEQ ID NO: 3946380 - RNA, 23 nt, Shigella flexneri 2a str. 301
gacuugcucaggaguaaacuuuc

SEQ ID NO: 3946381 - RNA, 20 nt, Shigella flexneri 2a str. 301
gacuuucguuugaaaacugg

SEQ ID NO: 3946382 - RNA, 20 nt, Shigella flexneri 2a str. 301
gacuuucuccgcauccggca

SEQ ID NO: 3946383 - RNA, 17 nt, Shigella flexneri 2a str. 301
gacuuugaaagcguuua

SEQ ID NO: 3946384 - RNA, 21 nt, Shigella flexneri 2a str. 301
gacuuugacauguugcugacc

SEQ ID NO: 3946385 - RNA, 12 nt, Shigella flexneri 2a str. 301
gacuuuucaagu

SEQ ID NO: 3946386 - RNA, 15 nt, Shigella flexneri 2a str. 301
gacuuuugcccggca

SEQ ID NO: 3946387 - RNA, 17 nt, Shigella flexneri 2a str. 301
gacuuuugcccggcaug

SEQ ID NO: 3946388 - RNA, 23 nt, Shigella flexneri 2a str. 301
gacuuuuuccaguccacguucaa

SEQ ID NO: 3946389 - RNA, 15 nt, Shigella flexneri 2a str. 301
gacuuuuuccugcuc

SEQ ID NO: 3946390 - RNA, 22 nt, Shigella flexneri 2a str. 301
gacuuuuuccugcucaaugucu

SEQ ID NO: 3946391 - RNA, 22 nt, Shigella flexneri 2a str. 301
gagaaaaaaaagcauccgauga

SEQ ID NO: 3946392 - RNA, 19 nt, Shigella flexneri 2a str. 301
gagaaaaugccgcacauca

SEQ ID NO: 3946393 - RNA, 18 nt, Shigella flexneri 2a str. 301
gagaaaccacaucaaucc

SEQ ID NO: 3946394 - RNA, 16 nt, Shigella flexneri 2a str. 301
gagaaagaaacgccau

SEQ ID NO: 3946395 - RNA, 20 nt, Shigella flexneri 2a str. 301
gagaaaguaaaccaccaguc

SEQ ID NO: 3946396 - RNA, 23 nt, Shigella flexneri 2a str. 301
gagaaaguaaaccaccaguccuu

SEQ ID NO: 3946397 - RNA, 14 nt, Shigella flexneri 2a str. 301
gagaaauaccaccc

SEQ ID NO: 3946398 - RNA, 19 nt, Shigella flexneri 2a str. 301
gagaacaagauugccugau

SEQ ID NO: 3946399 - RNA, 11 nt, Shigella flexneri 2a str. 301
gagaacagaua

SEQ ID NO: 3946400 - RNA, 16 nt, Shigella flexneri 2a str. 301
gagaacagcaguuguu

SEQ ID NO: 3946401 - RNA, 18 nt, Shigella flexneri 2a str. 301
gagaaccacaaugaagaa

SEQ ID NO: 3946402 - RNA, 14 nt, Shigella flexneri 2a str. 301
gagaacgacauggc

SEQ ID NO: 3946403 - RNA, 20 nt, Shigella flexneri 2a str. 301
gagaacgacauggcccagcc

SEQ ID NO: 3946404 - RNA, 20 nt, Shigella flexneri 2a str. 301
gagaacgaccaucagcugcc

SEQ ID NO: 3946405 - RNA, 22 nt, Shigella flexneri 2a str. 301
gagaacggacccgcgaucgccu

SEQ ID NO: 3946406 - RNA, 17 nt, Shigella flexneri 2a str. 301
gagaacggcgcaccaga

SEQ ID NO: 3946407 - RNA, 14 nt, Shigella flexneri 2a str. 301
gagaacugaaccaa

SEQ ID NO: 3946408 - RNA, 13 nt, Shigella flexneri 2a str. 301
gagaagcaccgcc

SEQ ID NO: 3946409 - RNA, 16 nt, Shigella flexneri 2a str. 301
gagaagccaccgcgcc

SEQ ID NO: 3946410 - RNA, 17 nt, Shigella flexneri 2a str. 301
gagaagccaccgcgcca

SEQ ID NO: 3946411 - RNA, 14 nt, Shigella flexneri 2a str. 301
gagaagcgguuaaa

SEQ ID NO: 3946412 - RNA, 17 nt, Shigella flexneri 2a str. 301
gagaagcugcugccgcu

SEQ ID NO: 3946413 - RNA, 22 nt, Shigella flexneri 2a str. 301
gagaagucggcuuuuagcgaca

SEQ ID NO: 3946414 - RNA, 19 nt, Shigella flexneri 2a str. 301
gagaauaagcgcagcugcu

SEQ ID NO: 3946415 - RNA, 22 nt, Shigella flexneri 2a str. 301
gagaauaagcgcagcugcuauu

SEQ ID NO: 3946416 - RNA, 13 nt, Shigella flexneri 2a str. 301
gagaaucacgucg

SEQ ID NO: 3946417 - RNA, 18 nt, Shigella flexneri 2a str. 301
gagaaucgauaugucuuu

SEQ ID NO: 3946418 - RNA, 18 nt, Shigella flexneri 2a str. 301
gagaaucguacucaccag

SEQ ID NO: 3946419 - RNA, 14 nt, Shigella flexneri 2a str. 301
gagaaugaaagguc

SEQ ID NO: 3946420 - RNA, 19 nt, Shigella flexneri 2a str. 301
gagaauggggucagcaggu

SEQ ID NO: 3946421 - RNA, 16 nt, Shigella flexneri 2a str. 301
gagaauuccggcagag

SEQ ID NO: 3946422 - RNA, 14 nt, Shigella flexneri 2a str. 301
gagacaaucgccac

SEQ ID NO: 3946423 - RNA, 20 nt, Shigella flexneri 2a str. 301
gagacagcuuagacagcgcc

SEQ ID NO: 3946424 - RNA, 21 nt, Shigella flexneri 2a str. 301
gagacagcuuagacagcgccg

SEQ ID NO: 3946425 - RNA, 23 nt, Shigella flexneri 2a str. 301
gagacauugugugaaaucagcac

SEQ ID NO: 3946426 - RNA, 18 nt, Shigella flexneri 2a str. 301
gagacgagcauaaaaguu

SEQ ID NO: 3946427 - RNA, 14 nt, Shigella flexneri 2a str. 301
gagacucaaacccc

SEQ ID NO: 3946428 - RNA, 12 nt, Shigella flexneri 2a str. 301
gagagaaaaaaa

SEQ ID NO: 3946429 - RNA, 13 nt, Shigella flexneri 2a str. 301
gagagaagaaacg

SEQ ID NO: 3946430 - RNA, 13 nt, Shigella flexneri 2a str. 301
gagagaagccaga

SEQ ID NO: 3946431 - RNA, 13 nt, Shigella flexneri 2a str. 301
gagagagaaaaua

SEQ ID NO: 3946432 - RNA, 15 nt, Shigella flexneri 2a str. 301
gagagcaugaaauga

SEQ ID NO: 3946433 - RNA, 19 nt, Shigella flexneri 2a str. 301
gagagccggacugacauua

SEQ ID NO: 3946434 - RNA, 17 nt, Shigella flexneri 2a str. 301
gagaggcgugccaggua

SEQ ID NO: 3946435 - RNA, 20 nt, Shigella flexneri 2a str. 301
gagaggcgugccagguagug

SEQ ID NO: 3946436 - RNA, 22 nt, Shigella flexneri 2a str. 301
gagaggcugaaggcgcuccccu

SEQ ID NO: 3946437 - RNA, 19 nt, Shigella flexneri 2a str. 301
gagaggguuagggugaggg

SEQ ID NO: 3946438 - RNA, 19 nt, Shigella flexneri 2a str. 301
gagaguacugccgggaaga

SEQ ID NO: 3946439 - RNA, 16 nt, Shigella flexneri 2a str. 301
gagauaaccacguuca

SEQ ID NO: 3946440 - RNA, 22 nt, Shigella flexneri 2a str. 301
gagauaaccacguucauuucau

SEQ ID NO: 3946441 - RNA, 14 nt, Shigella flexneri 2a str. 301
gagauacaggccac

SEQ ID NO: 3946442 - RNA, 17 nt, Shigella flexneri 2a str. 301
gagauacaucaccgcca

SEQ ID NO: 3946443 - RNA, 20 nt, Shigella flexneri 2a str. 301
gagauagaaugccaaguaau

SEQ ID NO: 3946444 - RNA, 14 nt, Shigella flexneri 2a str. 301
gagauaucgccagg

SEQ ID NO: 3946445 - RNA, 12 nt, Shigella flexneri 2a str. 301
gagauauucccc

SEQ ID NO: 3946446 - RNA, 15 nt, Shigella flexneri 2a str. 301
gagauauuccccaga

SEQ ID NO: 3946447 - RNA, 16 nt, Shigella flexneri 2a str. 301
gagauauuccccagac

SEQ ID NO: 3946448 - RNA, 15 nt, Shigella flexneri 2a str. 301
gagaucacgccacaa

SEQ ID NO: 3946449 - RNA, 19 nt, Shigella flexneri 2a str. 301
gagaucauccaugauaauu

SEQ ID NO: 3946450 - RNA, 13 nt, Shigella flexneri 2a str. 301
gagaucggccagc

SEQ ID NO: 3946451 - RNA, 23 nt, Shigella flexneri 2a str. 301
gagaucuuuaucaaucaccgcuu

SEQ ID NO: 3946452 - RNA, 18 nt, Shigella flexneri 2a str. 301
gagaugacgccacuggcu

SEQ ID NO: 3946453 - RNA, 18 nt, Shigella flexneri 2a str. 301
gagaugcggaaauaucgg

SEQ ID NO: 3946454 - RNA, 16 nt, Shigella flexneri 2a str. 301
gagauguccccugcgg

SEQ ID NO: 3946455 - RNA, 21 nt, Shigella flexneri 2a str. 301
gagauuacuuuauuuauauca

SEQ ID NO: 3946456 - RNA, 18 nt, Shigella flexneri 2a str. 301
gagauucgguaaccaucc

SEQ ID NO: 3946457 - RNA, 21 nt, Shigella flexneri 2a str. 301
gagauuggucaguaagccuuu

SEQ ID NO: 3946458 - RNA, 16 nt, Shigella flexneri 2a str. 301
gagauuugcuccagcg

SEQ ID NO: 3946459 - RNA, 20 nt, Shigella flexneri 2a str. 301
gagcaaaaaaccgccauuca

SEQ ID NO: 3946460 - RNA, 19 nt, Shigella flexneri 2a str. 301
gagcaaacaguucugcagc

SEQ ID NO: 3946461 - RNA, 12 nt, Shigella flexneri 2a str. 301
gagcaaauaaaa

SEQ ID NO: 3946462 - RNA, 15 nt, Shigella flexneri 2a str. 301
gagcaacagaguugc

SEQ ID NO: 3946463 - RNA, 20 nt, Shigella flexneri 2a str. 301
gagcaacagaguugccacua

SEQ ID NO: 3946464 - RNA, 16 nt, Shigella flexneri 2a str. 301
gagcaaggcauaggcu

SEQ ID NO: 3946465 - RNA, 17 nt, Shigella flexneri 2a str. 301
gagcaaggcauaggcuu

SEQ ID NO: 3946466 - RNA, 21 nt, Shigella flexneri 2a str. 301
gagcaauagacaguucuuccu

SEQ ID NO: 3946467 - RNA, 22 nt, Shigella flexneri 2a str. 301
gagcaauuuuuugcgccagcgc

SEQ ID NO: 3946468 - RNA, 14 nt, Shigella flexneri 2a str. 301
gagcacaugcagug

SEQ ID NO: 3946469 - RNA, 19 nt, Shigella flexneri 2a str. 301
gagcaccaucgcugauugc

SEQ ID NO: 3946470 - RNA, 21 nt, Shigella flexneri 2a str. 301
gagcaccgcgugcgcggcagc

SEQ ID NO: 3946471 - RNA, 16 nt, Shigella flexneri 2a str. 301
gagcaccuuuuuucug

SEQ ID NO: 3946472 - RNA, 22 nt, Shigella flexneri 2a str. 301
gagcacgacuuucucuucaucu

SEQ ID NO: 3946473 - RNA, 21 nt, Shigella flexneri 2a str. 301
gagcacgcaagguuucaguaa

SEQ ID NO: 3946474 - RNA, 19 nt, Shigella flexneri 2a str. 301
gagcacugcgcccgccagc

SEQ ID NO: 3946475 - RNA, 20 nt, Shigella flexneri 2a str. 301
gagcacugcgcccgccagca

SEQ ID NO: 3946476 - RNA, 21 nt, Shigella flexneri 2a str. 301
gagcacugcgcccgccagcau

SEQ ID NO: 3946477 - RNA, 17 nt, Shigella flexneri 2a str. 301
gagcacuuuucugguca

SEQ ID NO: 3946478 - RNA, 17 nt, Shigella flexneri 2a str. 301
gagcagauacugaugaa

SEQ ID NO: 3946479 - RNA, 13 nt, Shigella flexneri 2a str. 301
gagcagcacaaug

SEQ ID NO: 3946480 - RNA, 16 nt, Shigella flexneri 2a str. 301
gagcagcacgcaguga

SEQ ID NO: 3946481 - RNA, 17 nt, Shigella flexneri 2a str. 301
gagcagcagucaggcgc

SEQ ID NO: 3946482 - RNA, 14 nt, Shigella flexneri 2a str. 301
gagcagcauuaccu

SEQ ID NO: 3946483 - RNA, 17 nt, Shigella flexneri 2a str. 301
gagcagcauuaccugcc

SEQ ID NO: 3946484 - RNA, 17 nt, Shigella flexneri 2a str. 301
gagcaggagcagcaggu

SEQ ID NO: 3946485 - RNA, 18 nt, Shigella flexneri 2a str. 301
gagcaggcguuaaaacag

SEQ ID NO: 3946486 - RNA, 15 nt, Shigella flexneri 2a str. 301
gagcaggcugcacug

SEQ ID NO: 3946487 - RNA, 19 nt, Shigella flexneri 2a str. 301
gagcaguacagccgccaga

SEQ ID NO: 3946488 - RNA, 21 nt, Shigella flexneri 2a str. 301
gagcaguagcgucgccagcag

SEQ ID NO: 3946489 - RNA, 23 nt, Shigella flexneri 2a str. 301
gagcauaucgacgaaccauuucg

SEQ ID NO: 3946490 - RNA, 18 nt, Shigella flexneri 2a str. 301
gagcaucgcccaggcgac

SEQ ID NO: 3946491 - RNA, 15 nt, Shigella flexneri 2a str. 301
gagcaucugcaaaau

SEQ ID NO: 3946492 - RNA, 16 nt, Shigella flexneri 2a str. 301
gagcaugaugccugau

SEQ ID NO: 3946493 - RNA, 17 nt, Shigella flexneri 2a str. 301
gagcaugcuccggccuu

SEQ ID NO: 3946494 - RNA, 18 nt, Shigella flexneri 2a str. 301
gagcaugguaacgcccca

SEQ ID NO: 3946495 - RNA, 14 nt, Shigella flexneri 2a str. 301
gagcauugccgccc

SEQ ID NO: 3946496 - RNA, 12 nt, Shigella flexneri 2a str. 301
gagccagucagu

SEQ ID NO: 3946497 - RNA, 21 nt, Shigella flexneri 2a str. 301
gagccauugcccgaugcgcaa

SEQ ID NO: 3946498 - RNA, 14 nt, Shigella flexneri 2a str. 301
gagcccagaugccg

SEQ ID NO: 3946499 - RNA, 22 nt, Shigella flexneri 2a str. 301
gagcccaucacaauggcacaaa

SEQ ID NO: 3946500 - RNA, 15 nt, Shigella flexneri 2a str. 301
gagccgauauccgga

SEQ ID NO: 3946501 - RNA, 12 nt, Shigella flexneri 2a str. 301
gagccgcaguaa

SEQ ID NO: 3946502 - RNA, 14 nt, Shigella flexneri 2a str. 301
gagccgcuggcggu

SEQ ID NO: 3946503 - RNA, 17 nt, Shigella flexneri 2a str. 301
gagccggaugccucucc

SEQ ID NO: 3946504 - RNA, 17 nt, Shigella flexneri 2a str. 301
gagccugaauaaacgcc

SEQ ID NO: 3946505 - RNA, 19 nt, Shigella flexneri 2a str. 301
gagccugccaauggcaggc

SEQ ID NO: 3946506 - RNA, 18 nt, Shigella flexneri 2a str. 301
gagcgauaacccagcgca

SEQ ID NO: 3946507 - RNA, 15 nt, Shigella flexneri 2a str. 301
gagcgauuaucgcca

SEQ ID NO: 3946508 - RNA, 14 nt, Shigella flexneri 2a str. 301
gagcgccaccaccc

SEQ ID NO: 3946509 - RNA, 13 nt, Shigella flexneri 2a str. 301
gagcgccaccauc

SEQ ID NO: 3946510 - RNA, 16 nt, Shigella flexneri 2a str. 301
gagcgccagccauuca

SEQ ID NO: 3946511 - RNA, 19 nt, Shigella flexneri 2a str. 301
gagcgccauaaacagggcu

SEQ ID NO: 3946512 - RNA, 17 nt, Shigella flexneri 2a str. 301
gagcgccccagaccuga

SEQ ID NO: 3946513 - RNA, 15 nt, Shigella flexneri 2a str. 301
gagcgcgagcaggcc

SEQ ID NO: 3946514 - RNA, 17 nt, Shigella flexneri 2a str. 301
gagcgcgguauugccug

SEQ ID NO: 3946515 - RNA, 22 nt, Shigella flexneri 2a str. 301
gagcgcuuuuuuccugccgcua

SEQ ID NO: 3946516 - RNA, 20 nt, Shigella flexneri 2a str. 301
gagcggcaaugaauauucca

SEQ ID NO: 3946517 - RNA, 13 nt, Shigella flexneri 2a str. 301
gagcggccagggc

SEQ ID NO: 3946518 - RNA, 19 nt, Shigella flexneri 2a str. 301
gagcgggacaacaaacgca

SEQ ID NO: 3946519 - RNA, 13 nt, Shigella flexneri 2a str. 301
gagcgguuaacac

SEQ ID NO: 3946520 - RNA, 19 nt, Shigella flexneri 2a str. 301
gagcguauccagcauaccu

SEQ ID NO: 3946521 - RNA, 23 nt, Shigella flexneri 2a str. 301
gagcguauccagcauaccuucca

SEQ ID NO: 3946522 - RNA, 18 nt, Shigella flexneri 2a str. 301
gagcgucauauagccgcc

SEQ ID NO: 3946523 - RNA, 18 nt, Shigella flexneri 2a str. 301
gagcgucuggaagaagua

SEQ ID NO: 3946524 - RNA, 22 nt, Shigella flexneri 2a str. 301
gagcguuucaaaaacaaagaac

SEQ ID NO: 3946525 - RNA, 20 nt, Shigella flexneri 2a str. 301
gagcuaccggauuuuuuuuc

SEQ ID NO: 3946526 - RNA, 13 nt, Shigella flexneri 2a str. 301
gagcuaucucccu

SEQ ID NO: 3946527 - RNA, 14 nt, Shigella flexneri 2a str. 301
gagcuccagguccu

SEQ ID NO: 3946528 - RNA, 14 nt, Shigella flexneri 2a str. 301
gagcugauuuccgg

SEQ ID NO: 3946529 - RNA, 13 nt, Shigella flexneri 2a str. 301
gagcugcaaggca

SEQ ID NO: 3946530 - RNA, 15 nt, Shigella flexneri 2a str. 301
gagcugcucgucagc

SEQ ID NO: 3946531 - RNA, 19 nt, Shigella flexneri 2a str. 301
gagcuggaaguuacucaaa

SEQ ID NO: 3946532 - RNA, 18 nt, Shigella flexneri 2a str. 301
gagcugguaaccgcggcu

SEQ ID NO: 3946533 - RNA, 21 nt, Shigella flexneri 2a str. 301
gagcuuauuuguugagcugga

SEQ ID NO: 3946534 - RNA, 14 nt, Shigella flexneri 2a str. 301
gagcuucggcggcg

SEQ ID NO: 3946535 - RNA, 15 nt, Shigella flexneri 2a str. 301
gagcuugauccuaca

SEQ ID NO: 3946536 - RNA, 21 nt, Shigella flexneri 2a str. 301
gagcuugugcaccagcuggcu

SEQ ID NO: 3946537 - RNA, 20 nt, Shigella flexneri 2a str. 301
gagcuuuguucaugccggau

SEQ ID NO: 3946538 - RNA, 22 nt, Shigella flexneri 2a str. 301
gagcuuuuuuaauguggcuggg

SEQ ID NO: 3946539 - RNA, 23 nt, Shigella flexneri 2a str. 301
gagcuuuuuuaauguggcugggg

SEQ ID NO: 3946540 - RNA, 13 nt, Shigella flexneri 2a str. 301
gaggaagcgcagc

SEQ ID NO: 3946541 - RNA, 21 nt, Shigella flexneri 2a str. 301
gaggaagcgcagcagcgcgcc

SEQ ID NO: 3946542 - RNA, 22 nt, Shigella flexneri 2a str. 301
gaggaaggcacguacaugcagg

SEQ ID NO: 3946543 - RNA, 16 nt, Shigella flexneri 2a str. 301
gaggaagugaguauca

SEQ ID NO: 3946544 - RNA, 22 nt, Shigella flexneri 2a str. 301
gaggaauugauucaucaagcau

SEQ ID NO: 3946545 - RNA, 16 nt, Shigella flexneri 2a str. 301
gaggacguucaccguc

SEQ ID NO: 3946546 - RNA, 23 nt, Shigella flexneri 2a str. 301
gaggagagugcaaugaaaaaccg

SEQ ID NO: 3946547 - RNA, 18 nt, Shigella flexneri 2a str. 301
gaggauaugcaucaugaa

SEQ ID NO: 3946548 - RNA, 15 nt, Shigella flexneri 2a str. 301
gaggaugcacucgca

SEQ ID NO: 3946549 - RNA, 21 nt, Shigella flexneri 2a str. 301
gaggauguuacaaccuccucc

SEQ ID NO: 3946550 - RNA, 18 nt, Shigella flexneri 2a str. 301
gaggauucgaaccucgga

SEQ ID NO: 3946551 - RNA, 23 nt, Shigella flexneri 2a str. 301
gaggauucgaaccucggaaugcc

SEQ ID NO: 3946552 - RNA, 15 nt, Shigella flexneri 2a str. 301
gaggauuucuccccc

SEQ ID NO: 3946553 - RNA, 19 nt, Shigella flexneri 2a str. 301
gaggauuucuccccccucu

SEQ ID NO: 3946554 - RNA, 16 nt, Shigella flexneri 2a str. 301
gaggcaaccagcacgc

SEQ ID NO: 3946555 - RNA, 13 nt, Shigella flexneri 2a str. 301
gaggccaaaacca

SEQ ID NO: 3946556 - RNA, 21 nt, Shigella flexneri 2a str. 301
gaggccaaaaccacagugacc

SEQ ID NO: 3946557 - RNA, 17 nt, Shigella flexneri 2a str. 301
gaggccaauuuggcugc

SEQ ID NO: 3946558 - RNA, 20 nt, Shigella flexneri 2a str. 301
gaggccgcggcucaggcgca

SEQ ID NO: 3946559 - RNA, 20 nt, Shigella flexneri 2a str. 301
gaggcggggccaauugcugu

SEQ ID NO: 3946560 - RNA, 15 nt, Shigella flexneri 2a str. 301
gaggcguuucaacuc

SEQ ID NO: 3946561 - RNA, 18 nt, Shigella flexneri 2a str. 301
gaggcuagcggcuuuuua

SEQ ID NO: 3946562 - RNA, 16 nt, Shigella flexneri 2a str. 301
gaggcugaccccaacc

SEQ ID NO: 3946563 - RNA, 19 nt, Shigella flexneri 2a str. 301
gaggcugaccccaaccgcc

SEQ ID NO: 3946564 - RNA, 15 nt, Shigella flexneri 2a str. 301
gaggcuuauccggca

SEQ ID NO: 3946565 - RNA, 20 nt, Shigella flexneri 2a str. 301
gagggaaacggagcaaaaaa

SEQ ID NO: 3946566 - RNA, 18 nt, Shigella flexneri 2a str. 301
gagggaauccagcaauaa

SEQ ID NO: 3946567 - RNA, 13 nt, Shigella flexneri 2a str. 301
gagggagcguccu

SEQ ID NO: 3946568 - RNA, 17 nt, Shigella flexneri 2a str. 301
gagggaggauuucuccc

SEQ ID NO: 3946569 - RNA, 18 nt, Shigella flexneri 2a str. 301
gagggaucgacagauccc

SEQ ID NO: 3946570 - RNA, 19 nt, Shigella flexneri 2a str. 301
gagggcgauuauccgccag

SEQ ID NO: 3946571 - RNA, 19 nt, Shigella flexneri 2a str. 301
gaggggcugacgcaacugg

SEQ ID NO: 3946572 - RNA, 19 nt, Shigella flexneri 2a str. 301
gaggguaaacaacaugcua

SEQ ID NO: 3946573 - RNA, 14 nt, Shigella flexneri 2a str. 301
gagguaaaaccuga

SEQ ID NO: 3946574 - RNA, 17 nt, Shigella flexneri 2a str. 301
gagguacaaccaucccu

SEQ ID NO: 3946575 - RNA, 21 nt, Shigella flexneri 2a str. 301
gagguacacaacaugcagccc

SEQ ID NO: 3946576 - RNA, 15 nt, Shigella flexneri 2a str. 301
gagguacgcccagcg

SEQ ID NO: 3946577 - RNA, 18 nt, Shigella flexneri 2a str. 301
gagguacgcuccagcagg

SEQ ID NO: 3946578 - RNA, 16 nt, Shigella flexneri 2a str. 301
gagguaggcagucaua

SEQ ID NO: 3946579 - RNA, 12 nt, Shigella flexneri 2a str. 301
gaggucacgucc

SEQ ID NO: 3946580 - RNA, 19 nt, Shigella flexneri 2a str. 301
gagguuaauauuuucgcca

SEQ ID NO: 3946581 - RNA, 14 nt, Shigella flexneri 2a str. 301
gagguuaaugaucg

SEQ ID NO: 3946582 - RNA, 20 nt, Shigella flexneri 2a str. 301
gagguuggcucaucaagcac

SEQ ID NO: 3946583 - RNA, 22 nt, Shigella flexneri 2a str. 301
gagguuggcucaucaagcacaa

SEQ ID NO: 3946584 - RNA, 16 nt, Shigella flexneri 2a str. 301
gaguaaaaaaacauca

SEQ ID NO: 3946585 - RNA, 17 nt, Shigella flexneri 2a str. 301
gaguaaaaaaacaucau

SEQ ID NO: 3946586 - RNA, 15 nt, Shigella flexneri 2a str. 301
gaguaaaaauauuuc

SEQ ID NO: 3946587 - RNA, 19 nt, Shigella flexneri 2a str. 301
gaguaaaauaacagcggca

SEQ ID NO: 3946588 - RNA, 13 nt, Shigella flexneri 2a str. 301
gaguaaagcccgc

SEQ ID NO: 3946589 - RNA, 23 nt, Shigella flexneri 2a str. 301
gaguaaagcccgccaucgcccau

SEQ ID NO: 3946590 - RNA, 16 nt, Shigella flexneri 2a str. 301
gaguaaauugcaaacc

SEQ ID NO: 3946591 - RNA, 11 nt, Shigella flexneri 2a str. 301
gaguaauauau

SEQ ID NO: 3946592 - RNA, 12 nt, Shigella flexneri 2a str. 301
gaguaaucacau

SEQ ID NO: 3946593 - RNA, 12 nt, Shigella flexneri 2a str. 301
gaguaaucaggc

SEQ ID NO: 3946594 - RNA, 15 nt, Shigella flexneri 2a str. 301
gaguaaugccaguca

SEQ ID NO: 3946595 - RNA, 12 nt, Shigella flexneri 2a str. 301
gaguacauccac

SEQ ID NO: 3946596 - RNA, 15 nt, Shigella flexneri 2a str. 301
gaguaguuauauucc

SEQ ID NO: 3946597 - RNA, 12 nt, Shigella flexneri 2a str. 301
gaguaucugcug

SEQ ID NO: 3946598 - RNA, 17 nt, Shigella flexneri 2a str. 301
gaguaugcgcgucagag

SEQ ID NO: 3946599 - RNA, 16 nt, Shigella flexneri 2a str. 301
gaguauuuccagcuca

SEQ ID NO: 3946600 - RNA, 21 nt, Shigella flexneri 2a str. 301
gagucaagggugucggcacac

SEQ ID NO: 3946601 - RNA, 19 nt, Shigella flexneri 2a str. 301
gagucaauuucugcaaaau

SEQ ID NO: 3946602 - RNA, 14 nt, Shigella flexneri 2a str. 301
gagucacaaacauc

SEQ ID NO: 3946603 - RNA, 19 nt, Shigella flexneri 2a str. 301
gagucacaaacaucaugcc

SEQ ID NO: 3946604 - RNA, 19 nt, Shigella flexneri 2a str. 301
gagucacucgacagcaccg

SEQ ID NO: 3946605 - RNA, 20 nt, Shigella flexneri 2a str. 301
gagucacuuuacgaccagcc

SEQ ID NO: 3946606 - RNA, 19 nt, Shigella flexneri 2a str. 301
gagucauucuccagaucuu

SEQ ID NO: 3946607 - RNA, 15 nt, Shigella flexneri 2a str. 301
gaguccuuccagguc

SEQ ID NO: 3946608 - RNA, 16 nt, Shigella flexneri 2a str. 301
gaguccuuccagguca

SEQ ID NO: 3946609 - RNA, 20 nt, Shigella flexneri 2a str. 301
gagucgggucgccguaagca

SEQ ID NO: 3946610 - RNA, 22 nt, Shigella flexneri 2a str. 301
gagucgucgauaucgaugacgc

SEQ ID NO: 3946611 - RNA, 12 nt, Shigella flexneri 2a str. 301
gagucuugcugg

SEQ ID NO: 3946612 - RNA, 19 nt, Shigella flexneri 2a str. 301
gagugaaaaugccucagag

SEQ ID NO: 3946613 - RNA, 11 nt, Shigella flexneri 2a str. 301
gagugaacacg

SEQ ID NO: 3946614 - RNA, 19 nt, Shigella flexneri 2a str. 301
gagugaccgccaauaaccg

SEQ ID NO: 3946615 - RNA, 23 nt, Shigella flexneri 2a str. 301
gagugauacguaaaccacugaca

SEQ ID NO: 3946616 - RNA, 17 nt, Shigella flexneri 2a str. 301
gagugcagcaugcaccc

SEQ ID NO: 3946617 - RNA, 17 nt, Shigella flexneri 2a str. 301
gagugccgaagaacaua

SEQ ID NO: 3946618 - RNA, 19 nt, Shigella flexneri 2a str. 301
gagugccgaagaacauaaa

SEQ ID NO: 3946619 - RNA, 20 nt, Shigella flexneri 2a str. 301
gagugccuugcugaccgcca

SEQ ID NO: 3946620 - RNA, 18 nt, Shigella flexneri 2a str. 301
gaguggaguccagcgccu

SEQ ID NO: 3946621 - RNA, 18 nt, Shigella flexneri 2a str. 301
gaguggauuaucuucacc

SEQ ID NO: 3946622 - RNA, 17 nt, Shigella flexneri 2a str. 301
gaguggcgaaauuggua

SEQ ID NO: 3946623 - RNA, 18 nt, Shigella flexneri 2a str. 301
gagugguuagagcacaga

SEQ ID NO: 3946624 - RNA, 13 nt, Shigella flexneri 2a str. 301
gaguguuccucug

SEQ ID NO: 3946625 - RNA, 19 nt, Shigella flexneri 2a str. 301
gaguuaaauuaauaaucac

SEQ ID NO: 3946626 - RNA, 16 nt, Shigella flexneri 2a str. 301
gaguucaggcgcugca

SEQ ID NO: 3946627 - RNA, 21 nt, Shigella flexneri 2a str. 301
gaguucauauaauuccacgcc

SEQ ID NO: 3946628 - RNA, 15 nt, Shigella flexneri 2a str. 301
gaguucauuaagcug

SEQ ID NO: 3946629 - RNA, 19 nt, Shigella flexneri 2a str. 301
gaguucccggcagggaagc

SEQ ID NO: 3946630 - RNA, 12 nt, Shigella flexneri 2a str. 301
gaguugcagauu

SEQ ID NO: 3946631 - RNA, 19 nt, Shigella flexneri 2a str. 301
gaguugcuccacugcucac

SEQ ID NO: 3946632 - RNA, 13 nt, Shigella flexneri 2a str. 301
gaguuuccaucag

SEQ ID NO: 3946633 - RNA, 15 nt, Shigella flexneri 2a str. 301
gaguuucucgccaga

SEQ ID NO: 3946634 - RNA, 16 nt, Shigella flexneri 2a str. 301
gaguuugccgcugucc

SEQ ID NO: 3946635 - RNA, 15 nt, Shigella flexneri 2a str. 301
gaguuuggugccacg

SEQ ID NO: 3946636 - RNA, 16 nt, Shigella flexneri 2a str. 301
gaguuuucaguaccgc

SEQ ID NO: 3946637 - RNA, 16 nt, Shigella flexneri 2a str. 301
gaguuuuucaguccac

SEQ ID NO: 3946638 - RNA, 12 nt, Shigella flexneri 2a str. 301
gauaaaaaaccc

SEQ ID NO: 3946639 - RNA, 21 nt, Shigella flexneri 2a str. 301
gauaaaaauaccgagcagcca

SEQ ID NO: 3946640 - RNA, 12 nt, Shigella flexneri 2a str. 301
gauaaaaccuuc

SEQ ID NO: 3946641 - RNA, 21 nt, Shigella flexneri 2a str. 301
gauaaaaccuuccucaccguu

SEQ ID NO: 3946642 - RNA, 14 nt, Shigella flexneri 2a str. 301
gauaaaacgacacc

SEQ ID NO: 3946643 - RNA, 21 nt, Shigella flexneri 2a str. 301
gauaaaacucucaucuuugaa

SEQ ID NO: 3946644 - RNA, 16 nt, Shigella flexneri 2a str. 301
gauaaaacuucccgug

SEQ ID NO: 3946645 - RNA, 16 nt, Shigella flexneri 2a str. 301
gauaaaagccaucccu

SEQ ID NO: 3946646 - RNA, 19 nt, Shigella flexneri 2a str. 301
gauaaaagccaucccugua

SEQ ID NO: 3946647 - RNA, 18 nt, Shigella flexneri 2a str. 301
gauaaaauacacuuuaau

SEQ ID NO: 3946648 - RNA, 15 nt, Shigella flexneri 2a str. 301
gauaaaaucccauaa

SEQ ID NO: 3946649 - RNA, 21 nt, Shigella flexneri 2a str. 301
gauaaaaucccauaagugcgu

SEQ ID NO: 3946650 - RNA, 15 nt, Shigella flexneri 2a str. 301
gauaaacaguuucgc

SEQ ID NO: 3946651 - RNA, 20 nt, Shigella flexneri 2a str. 301
gauaaacaucgggacaugau

SEQ ID NO: 3946652 - RNA, 19 nt, Shigella flexneri 2a str. 301
gauaaaccuccagcaucag

SEQ ID NO: 3946653 - RNA, 21 nt, Shigella flexneri 2a str. 301
gauaaacguauaguggaauug

SEQ ID NO: 3946654 - RNA, 20 nt, Shigella flexneri 2a str. 301
gauaaagcacugucuaacaa

SEQ ID NO: 3946655 - RNA, 14 nt, Shigella flexneri 2a str. 301
gauaaagcauaccg

SEQ ID NO: 3946656 - RNA, 21 nt, Shigella flexneri 2a str. 301
gauaaagcccccgcaacauug

SEQ ID NO: 3946657 - RNA, 13 nt, Shigella flexneri 2a str. 301
gauaaagcugggu

SEQ ID NO: 3946658 - RNA, 16 nt, Shigella flexneri 2a str. 301
gauaaaggucaucaca

SEQ ID NO: 3946659 - RNA, 18 nt, Shigella flexneri 2a str. 301
gauaaaguuagagccagg

SEQ ID NO: 3946660 - RNA, 18 nt, Shigella flexneri 2a str. 301
gauaaauaacuuuuaucu

SEQ ID NO: 3946661 - RNA, 22 nt, Shigella flexneri 2a str. 301
gauaaaucccgccgcuucacca

SEQ ID NO: 3946662 - RNA, 12 nt, Shigella flexneri 2a str. 301
gauaaaucucau

SEQ ID NO: 3946663 - RNA, 15 nt, Shigella flexneri 2a str. 301
gauaaaucuccauuu

SEQ ID NO: 3946664 - RNA, 18 nt, Shigella flexneri 2a str. 301
gauaaaucuccauuucau

SEQ ID NO: 3946665 - RNA, 12 nt, Shigella flexneri 2a str. 301
gauaaauuacug

SEQ ID NO: 3946666 - RNA, 20 nt, Shigella flexneri 2a str. 301
gauaaauucguuuucgcgcu

SEQ ID NO: 3946667 - RNA, 15 nt, Shigella flexneri 2a str. 301
gauaaauuuaaaacu

SEQ ID NO: 3946668 - RNA, 17 nt, Shigella flexneri 2a str. 301
gauaacacgguaaugac

SEQ ID NO: 3946669 - RNA, 17 nt, Shigella flexneri 2a str. 301
gauaacccggcggcgga

SEQ ID NO: 3946670 - RNA, 15 nt, Shigella flexneri 2a str. 301
gauaaccgcaccuuc

SEQ ID NO: 3946671 - RNA, 13 nt, Shigella flexneri 2a str. 301
gauaaccuucuuc

SEQ ID NO: 3946672 - RNA, 21 nt, Shigella flexneri 2a str. 301
gauaaccuucuucauuaugaa

SEQ ID NO: 3946673 - RNA, 16 nt, Shigella flexneri 2a str. 301
gauaacguuauauccc

SEQ ID NO: 3946674 - RNA, 14 nt, Shigella flexneri 2a str. 301
gauaacguuccggg

SEQ ID NO: 3946675 - RNA, 21 nt, Shigella flexneri 2a str. 301
gauaacguugaugcaggcagu

SEQ ID NO: 3946676 - RNA, 16 nt, Shigella flexneri 2a str. 301
gauaacucaaaaauaa

SEQ ID NO: 3946677 - RNA, 19 nt, Shigella flexneri 2a str. 301
gauaagacgcgccagcguc

SEQ ID NO: 3946678 - RNA, 14 nt, Shigella flexneri 2a str. 301
gauaagacgcguca

SEQ ID NO: 3946679 - RNA, 17 nt, Shigella flexneri 2a str. 301
gauaagaugcuacaaca

SEQ ID NO: 3946680 - RNA, 18 nt, Shigella flexneri 2a str. 301
gauaagaugguuauccag

SEQ ID NO: 3946681 - RNA, 19 nt, Shigella flexneri 2a str. 301
gauaagaugguuauccagc

SEQ ID NO: 3946682 - RNA, 13 nt, Shigella flexneri 2a str. 301
gauaagcaacgcg

SEQ ID NO: 3946683 - RNA, 15 nt, Shigella flexneri 2a str. 301
gauaagccccaguuc

SEQ ID NO: 3946684 - RNA, 23 nt, Shigella flexneri 2a str. 301
gauaagcguagcgcaucaggcaa

SEQ ID NO: 3946685 - RNA, 17 nt, Shigella flexneri 2a str. 301
gauaaggaauucacgcc

SEQ ID NO: 3946686 - RNA, 18 nt, Shigella flexneri 2a str. 301
gauaaggcaacgccccuu

SEQ ID NO: 3946687 - RNA, 22 nt, Shigella flexneri 2a str. 301
gauaaggcgcugaaggcacaga

SEQ ID NO: 3946688 - RNA, 14 nt, Shigella flexneri 2a str. 301
gauaaguuaacccc

SEQ ID NO: 3946689 - RNA, 19 nt, Shigella flexneri 2a str. 301
gauaaguuaaccccaguaa

SEQ ID NO: 3946690 - RNA, 15 nt, Shigella flexneri 2a str. 301
gauaaguucaaguuu

SEQ ID NO: 3946691 - RNA, 15 nt, Shigella flexneri 2a str. 301
gauaauaauguguuc

SEQ ID NO: 3946692 - RNA, 22 nt, Shigella flexneri 2a str. 301
gauaauacacuaacagaacaau

SEQ ID NO: 3946693 - RNA, 23 nt, Shigella flexneri 2a str. 301
gauaauauugaugcacaccaucg

SEQ ID NO: 3946694 - RNA, 17 nt, Shigella flexneri 2a str. 301
gauaauauuuaucuucc

SEQ ID NO: 3946695 - RNA, 16 nt, Shigella flexneri 2a str. 301
gauaaucaacaaacca

SEQ ID NO: 3946696 - RNA, 16 nt, Shigella flexneri 2a str. 301
gauaaucaacgcgccg

SEQ ID NO: 3946697 - RNA, 12 nt, Shigella flexneri 2a str. 301
gauaauccacgc

SEQ ID NO: 3946698 - RNA, 18 nt, Shigella flexneri 2a str. 301
gauaauccaggacauauc

SEQ ID NO: 3946699 - RNA, 18 nt, Shigella flexneri 2a str. 301
gauaauccaucacuucau

SEQ ID NO: 3946700 - RNA, 21 nt, Shigella flexneri 2a str. 301
gauaauccgguuuacccgcuu

SEQ ID NO: 3946701 - RNA, 21 nt, Shigella flexneri 2a str. 301
gauaaucguauucuggcuucg

SEQ ID NO: 3946702 - RNA, 11 nt, Shigella flexneri 2a str. 301
gauaaucucaa

SEQ ID NO: 3946703 - RNA, 22 nt, Shigella flexneri 2a str. 301
gauaaugccguuuggcaaauac

SEQ ID NO: 3946704 - RNA, 13 nt, Shigella flexneri 2a str. 301
gauaauggcuguu

SEQ ID NO: 3946705 - RNA, 17 nt, Shigella flexneri 2a str. 301
gauaauuaaucuuucua

SEQ ID NO: 3946706 - RNA, 20 nt, Shigella flexneri 2a str. 301
gauaauuagugcugcuggaa

SEQ ID NO: 3946707 - RNA, 18 nt, Shigella flexneri 2a str. 301
gauaauuucacugccuuu

SEQ ID NO: 3946708 - RNA, 16 nt, Shigella flexneri 2a str. 301
gauaauuuuuucuucc

SEQ ID NO: 3946709 - RNA, 17 nt, Shigella flexneri 2a str. 301
gauaauuuuuucuucca

SEQ ID NO: 3946710 - RNA, 23 nt, Shigella flexneri 2a str. 301
gauacaacugccgcgccugaauc

SEQ ID NO: 3946711 - RNA, 20 nt, Shigella flexneri 2a str. 301
gauacacaccgagcguggcg

SEQ ID NO: 3946712 - RNA, 14 nt, Shigella flexneri 2a str. 301
gauacaguuuuugc

SEQ ID NO: 3946713 - RNA, 20 nt, Shigella flexneri 2a str. 301
gauaccaaaauggcgcagga

SEQ ID NO: 3946714 - RNA, 16 nt, Shigella flexneri 2a str. 301
gauaccaccagugcca

SEQ ID NO: 3946715 - RNA, 17 nt, Shigella flexneri 2a str. 301
gauaccacccgcaguga

SEQ ID NO: 3946716 - RNA, 13 nt, Shigella flexneri 2a str. 301
gauacccaucauc

SEQ ID NO: 3946717 - RNA, 22 nt, Shigella flexneri 2a str. 301
gauaccgcacgcucaaagacgc

SEQ ID NO: 3946718 - RNA, 18 nt, Shigella flexneri 2a str. 301
gauaccgccgcacaauac

SEQ ID NO: 3946719 - RNA, 13 nt, Shigella flexneri 2a str. 301
gauaccuaacauu

SEQ ID NO: 3946720 - RNA, 22 nt, Shigella flexneri 2a str. 301
gauacgaccguuccauucaaac

SEQ ID NO: 3946721 - RNA, 17 nt, Shigella flexneri 2a str. 301
gauacgagagccggaag

SEQ ID NO: 3946722 - RNA, 15 nt, Shigella flexneri 2a str. 301
gauacgcccuggaua

SEQ ID NO: 3946723 - RNA, 19 nt, Shigella flexneri 2a str. 301
gauacgcugcacaauugcc

SEQ ID NO: 3946724 - RNA, 20 nt, Shigella flexneri 2a str. 301
gauacgcugcacaauugcca

SEQ ID NO: 3946725 - RNA, 17 nt, Shigella flexneri 2a str. 301
gauacgcuugccggaca

SEQ ID NO: 3946726 - RNA, 20 nt, Shigella flexneri 2a str. 301
gauacggaauaucgcuggcc

SEQ ID NO: 3946727 - RNA, 16 nt, Shigella flexneri 2a str. 301
gauacggcccagaccc

SEQ ID NO: 3946728 - RNA, 18 nt, Shigella flexneri 2a str. 301
gauacguaauucaucguc

SEQ ID NO: 3946729 - RNA, 18 nt, Shigella flexneri 2a str. 301
gauacguccaccccagca

SEQ ID NO: 3946730 - RNA, 20 nt, Shigella flexneri 2a str. 301
gauacguccaccccagcaga

SEQ ID NO: 3946731 - RNA, 14 nt, Shigella flexneri 2a str. 301
gauacguugccgua

SEQ ID NO: 3946732 - RNA, 15 nt, Shigella flexneri 2a str. 301
gauacguugccguau

SEQ ID NO: 3946733 - RNA, 19 nt, Shigella flexneri 2a str. 301
gauacucaagcagccaggu

SEQ ID NO: 3946734 - RNA, 15 nt, Shigella flexneri 2a str. 301
gauacugaauguaug

SEQ ID NO: 3946735 - RNA, 21 nt, Shigella flexneri 2a str. 301
gauacugcccaccgacgcagu

SEQ ID NO: 3946736 - RNA, 20 nt, Shigella flexneri 2a str. 301
gauagaacaucucuucccau

SEQ ID NO: 3946737 - RNA, 18 nt, Shigella flexneri 2a str. 301
gauagaaugccaaguaau

SEQ ID NO: 3946738 - RNA, 17 nt, Shigella flexneri 2a str. 301
gauagagagcagucagg

SEQ ID NO: 3946739 - RNA, 16 nt, Shigella flexneri 2a str. 301
gauagagcaaccaccu

SEQ ID NO: 3946740 - RNA, 16 nt, Shigella flexneri 2a str. 301
gauagauauucuccag

SEQ ID NO: 3946741 - RNA, 22 nt, Shigella flexneri 2a str. 301
gauagauuuauuuauuauuaaa

SEQ ID NO: 3946742 - RNA, 19 nt, Shigella flexneri 2a str. 301
gauagcacgacguuucuuu

SEQ ID NO: 3946743 - RNA, 18 nt, Shigella flexneri 2a str. 301
gauagcacgucacggacu

SEQ ID NO: 3946744 - RNA, 18 nt, Shigella flexneri 2a str. 301
gauagcagaaaacucacg

SEQ ID NO: 3946745 - RNA, 14 nt, Shigella flexneri 2a str. 301
gauagcagcagaua

SEQ ID NO: 3946746 - RNA, 15 nt, Shigella flexneri 2a str. 301
gauagcaucuuccag

SEQ ID NO: 3946747 - RNA, 21 nt, Shigella flexneri 2a str. 301
gauagccagguuuaccagcag

SEQ ID NO: 3946748 - RNA, 16 nt, Shigella flexneri 2a str. 301
gauagcgcacgcgcuu

SEQ ID NO: 3946749 - RNA, 19 nt, Shigella flexneri 2a str. 301
gauagcguagcgccucagg

SEQ ID NO: 3946750 - RNA, 18 nt, Shigella flexneri 2a str. 301
gauagcucgggcgauaau

SEQ ID NO: 3946751 - RNA, 12 nt, Shigella flexneri 2a str. 301
gauagcugguga

SEQ ID NO: 3946752 - RNA, 14 nt, Shigella flexneri 2a str. 301
gauaggcaccgcca

SEQ ID NO: 3946753 - RNA, 16 nt, Shigella flexneri 2a str. 301
gauagucaugaugacg

SEQ ID NO: 3946754 - RNA, 16 nt, Shigella flexneri 2a str. 301
gauagugauccaucag

SEQ ID NO: 3946755 - RNA, 20 nt, Shigella flexneri 2a str. 301
gauagugcugccaucuucuu

SEQ ID NO: 3946756 - RNA, 18 nt, Shigella flexneri 2a str. 301
gauaguguugguaaauaa

SEQ ID NO: 3946757 - RNA, 17 nt, Shigella flexneri 2a str. 301
gauaguguuuuauguuc

SEQ ID NO: 3946758 - RNA, 17 nt, Shigella flexneri 2a str. 301
gauauaaaaauccgccu

SEQ ID NO: 3946759 - RNA, 17 nt, Shigella flexneri 2a str. 301
gauauaaaccugagaac

SEQ ID NO: 3946760 - RNA, 22 nt, Shigella flexneri 2a str. 301
gauauaaacggucuacauugcu

SEQ ID NO: 3946761 - RNA, 13 nt, Shigella flexneri 2a str. 301
gauauaaauucca

SEQ ID NO: 3946762 - RNA, 20 nt, Shigella flexneri 2a str. 301
gauauaauuaaacaccguug

SEQ ID NO: 3946763 - RNA, 13 nt, Shigella flexneri 2a str. 301
gauauacccgcca

SEQ ID NO: 3946764 - RNA, 23 nt, Shigella flexneri 2a str. 301
gauaucaaaacgcucugagcugc

SEQ ID NO: 3946765 - RNA, 13 nt, Shigella flexneri 2a str. 301
gauaucaccacca

SEQ ID NO: 3946766 - RNA, 21 nt, Shigella flexneri 2a str. 301
gauaucauuaaaguuaucgcc

SEQ ID NO: 3946767 - RNA, 19 nt, Shigella flexneri 2a str. 301
gauauccacccgcagccau

SEQ ID NO: 3946768 - RNA, 15 nt, Shigella flexneri 2a str. 301
gauauccaccuccag

SEQ ID NO: 3946769 - RNA, 19 nt, Shigella flexneri 2a str. 301
gauauccacugucaaaucc

SEQ ID NO: 3946770 - RNA, 13 nt, Shigella flexneri 2a str. 301
gauauccagcgcc

SEQ ID NO: 3946771 - RNA, 14 nt, Shigella flexneri 2a str. 301
gauauccagcgccg

SEQ ID NO: 3946772 - RNA, 23 nt, Shigella flexneri 2a str. 301
gauaucccagcugccgccaggcu

SEQ ID NO: 3946773 - RNA, 13 nt, Shigella flexneri 2a str. 301
gauauccgccagg

SEQ ID NO: 3946774 - RNA, 21 nt, Shigella flexneri 2a str. 301
gauaucgaccacuuuaaccag

SEQ ID NO: 3946775 - RNA, 19 nt, Shigella flexneri 2a str. 301
gauaucgauaaagaacgca

SEQ ID NO: 3946776 - RNA, 17 nt, Shigella flexneri 2a str. 301
gauaucgauguccugac

SEQ ID NO: 3946777 - RNA, 18 nt, Shigella flexneri 2a str. 301
gauaucgccaggccagcc

SEQ ID NO: 3946778 - RNA, 13 nt, Shigella flexneri 2a str. 301
gauaucgccgguu

SEQ ID NO: 3946779 - RNA, 13 nt, Shigella flexneri 2a str. 301
gauaucgcuggca

SEQ ID NO: 3946780 - RNA, 16 nt, Shigella flexneri 2a str. 301
gauaucggaggccugu

SEQ ID NO: 3946781 - RNA, 16 nt, Shigella flexneri 2a str. 301
gauaucuacaaaacca

SEQ ID NO: 3946782 - RNA, 23 nt, Shigella flexneri 2a str. 301
gauaucuacaaaaccacacuucu

SEQ ID NO: 3946783 - RNA, 14 nt, Shigella flexneri 2a str. 301
gauaugcagcagcc

SEQ ID NO: 3946784 - RNA, 13 nt, Shigella flexneri 2a str. 301
gauaugcaucaug

SEQ ID NO: 3946785 - RNA, 18 nt, Shigella flexneri 2a str. 301
gauaugcaucaugaaaac

SEQ ID NO: 3946786 - RNA, 16 nt, Shigella flexneri 2a str. 301
gauaugcgagcaccug

SEQ ID NO: 3946787 - RNA, 19 nt, Shigella flexneri 2a str. 301
gauauggucaaugauuucu

SEQ ID NO: 3946788 - RNA, 15 nt, Shigella flexneri 2a str. 301
gauauguugugggag

SEQ ID NO: 3946789 - RNA, 20 nt, Shigella flexneri 2a str. 301
gauauucaggcguugaaaaa

SEQ ID NO: 3946790 - RNA, 16 nt, Shigella flexneri 2a str. 301
gauauucaguaaugaa

SEQ ID NO: 3946791 - RNA, 16 nt, Shigella flexneri 2a str. 301
gauauucaucuccagc

SEQ ID NO: 3946792 - RNA, 20 nt, Shigella flexneri 2a str. 301
gauauucaucuccagcacgu

SEQ ID NO: 3946793 - RNA, 13 nt, Shigella flexneri 2a str. 301
gauauucaugcag

SEQ ID NO: 3946794 - RNA, 16 nt, Shigella flexneri 2a str. 301
gauauuccccagacga

SEQ ID NO: 3946795 - RNA, 23 nt, Shigella flexneri 2a str. 301
gauauuccccagacgagagugac

SEQ ID NO: 3946796 - RNA, 16 nt, Shigella flexneri 2a str. 301
gauauuccugaauggu

SEQ ID NO: 3946797 - RNA, 16 nt, Shigella flexneri 2a str. 301
gauauucuccagcuuc

SEQ ID NO: 3946798 - RNA, 20 nt, Shigella flexneri 2a str. 301
gauauugauucaucucuucu

SEQ ID NO: 3946799 - RNA, 15 nt, Shigella flexneri 2a str. 301
gauauugccaccugc

SEQ ID NO: 3946800 - RNA, 15 nt, Shigella flexneri 2a str. 301
gauauuguaggcccg

SEQ ID NO: 3946801 - RNA, 22 nt, Shigella flexneri 2a str. 301
gauauuguuuagcuucugcgug

SEQ ID NO: 3946802 - RNA, 23 nt, Shigella flexneri 2a str. 301
gauauuucaccagcgcacgcagg

SEQ ID NO: 3946803 - RNA, 21 nt, Shigella flexneri 2a str. 301
gauauuuucccaacgugacca

SEQ ID NO: 3946804 - RNA, 18 nt, Shigella flexneri 2a str. 301
gauauuuuuauggcaggu

SEQ ID NO: 3946805 - RNA, 14 nt, Shigella flexneri 2a str. 301
gaucaaauaaccgg

SEQ ID NO: 3946806 - RNA, 14 nt, Shigella flexneri 2a str. 301
gaucaacacaucca

SEQ ID NO: 3946807 - RNA, 16 nt, Shigella flexneri 2a str. 301
gaucaacacauccagu

SEQ ID NO: 3946808 - RNA, 22 nt, Shigella flexneri 2a str. 301
gaucaaccgcuacauacuuaaa

SEQ ID NO: 3946809 - RNA, 23 nt, Shigella flexneri 2a str. 301
gaucaaccgcuacauacuuaaau

SEQ ID NO: 3946810 - RNA, 20 nt, Shigella flexneri 2a str. 301
gaucaagcaacauaaccuga

SEQ ID NO: 3946811 - RNA, 17 nt, Shigella flexneri 2a str. 301
gaucaagccccagcagg

SEQ ID NO: 3946812 - RNA, 19 nt, Shigella flexneri 2a str. 301
gaucaaggcauauaccaca

SEQ ID NO: 3946813 - RNA, 13 nt, Shigella flexneri 2a str. 301
gaucaaucggcgc

SEQ ID NO: 3946814 - RNA, 13 nt, Shigella flexneri 2a str. 301
gaucaauuucaca

SEQ ID NO: 3946815 - RNA, 20 nt, Shigella flexneri 2a str. 301
gaucacagcaguccagcgcg

SEQ ID NO: 3946816 - RNA, 21 nt, Shigella flexneri 2a str. 301
gaucacauccaguacgccuuc

SEQ ID NO: 3946817 - RNA, 14 nt, Shigella flexneri 2a str. 301
gaucaccacaccgu

SEQ ID NO: 3946818 - RNA, 19 nt, Shigella flexneri 2a str. 301
gaucaccaguccaucggca

SEQ ID NO: 3946819 - RNA, 17 nt, Shigella flexneri 2a str. 301
gaucaccgcagaagcga

SEQ ID NO: 3946820 - RNA, 21 nt, Shigella flexneri 2a str. 301
gaucacguacacaacgcggca

SEQ ID NO: 3946821 - RNA, 17 nt, Shigella flexneri 2a str. 301
gaucagaguugaaaaac

SEQ ID NO: 3946822 - RNA, 11 nt, Shigella flexneri 2a str. 301
gaucagcaucc

SEQ ID NO: 3946823 - RNA, 19 nt, Shigella flexneri 2a str. 301
gaucagcauccauaucgcc

SEQ ID NO: 3946824 - RNA, 12 nt, Shigella flexneri 2a str. 301
gaucagcauuuc

SEQ ID NO: 3946825 - RNA, 13 nt, Shigella flexneri 2a str. 301
gaucagcauuucg

SEQ ID NO: 3946826 - RNA, 13 nt, Shigella flexneri 2a str. 301
gaucagcgguggu

SEQ ID NO: 3946827 - RNA, 13 nt, Shigella flexneri 2a str. 301
gaucagcgguuuu

SEQ ID NO: 3946828 - RNA, 18 nt, Shigella flexneri 2a str. 301
gaucagcgguuuugccag

SEQ ID NO: 3946829 - RNA, 16 nt, Shigella flexneri 2a str. 301
gaucaguuccagcagc

SEQ ID NO: 3946830 - RNA, 18 nt, Shigella flexneri 2a str. 301
gaucaguuucagaaaaag

SEQ ID NO: 3946831 - RNA, 22 nt, Shigella flexneri 2a str. 301
gaucauagagcacggcauccca

SEQ ID NO: 3946832 - RNA, 11 nt, Shigella flexneri 2a str. 301
gaucaucagca

SEQ ID NO: 3946833 - RNA, 15 nt, Shigella flexneri 2a str. 301
gaucaucauccagca

SEQ ID NO: 3946834 - RNA, 19 nt, Shigella flexneri 2a str. 301
gaucaucauuacguucuua

SEQ ID NO: 3946835 - RNA, 14 nt, Shigella flexneri 2a str. 301
gaucaucggccaga

SEQ ID NO: 3946836 - RNA, 19 nt, Shigella flexneri 2a str. 301
gaucaugccgcaauugucu

SEQ ID NO: 3946837 - RNA, 16 nt, Shigella flexneri 2a str. 301
gaucauucaccagccc

SEQ ID NO: 3946838 - RNA, 13 nt, Shigella flexneri 2a str. 301
gaucauuuccggu

SEQ ID NO: 3946839 - RNA, 14 nt, Shigella flexneri 2a str. 301
gaucauuuccgguu

SEQ ID NO: 3946840 - RNA, 16 nt, Shigella flexneri 2a str. 301
gauccagcucuucuuc

SEQ ID NO: 3946841 - RNA, 18 nt, Shigella flexneri 2a str. 301
gauccagcucuucuucac

SEQ ID NO: 3946842 - RNA, 16 nt, Shigella flexneri 2a str. 301
gauccaggaacagaag

SEQ ID NO: 3946843 - RNA, 17 nt, Shigella flexneri 2a str. 301
gauccaggagcuccagg

SEQ ID NO: 3946844 - RNA, 15 nt, Shigella flexneri 2a str. 301
gauccaguggcugug

SEQ ID NO: 3946845 - RNA, 16 nt, Shigella flexneri 2a str. 301
gauccaguuacccagc

SEQ ID NO: 3946846 - RNA, 21 nt, Shigella flexneri 2a str. 301
gauccauacucuuucccggca

SEQ ID NO: 3946847 - RNA, 16 nt, Shigella flexneri 2a str. 301
gaucccagagcgggca

SEQ ID NO: 3946848 - RNA, 19 nt, Shigella flexneri 2a str. 301
gauccccgcuuccugcagc

SEQ ID NO: 3946849 - RNA, 14 nt, Shigella flexneri 2a str. 301
gaucccucuuucug

SEQ ID NO: 3946850 - RNA, 17 nt, Shigella flexneri 2a str. 301
gaucccuucgccgccgc

SEQ ID NO: 3946851 - RNA, 22 nt, Shigella flexneri 2a str. 301
gauccgcgauaagucuuugacu

SEQ ID NO: 3946852 - RNA, 20 nt, Shigella flexneri 2a str. 301
gauccggaucccaccagacg

SEQ ID NO: 3946853 - RNA, 16 nt, Shigella flexneri 2a str. 301
gauccgggcauauuuc

SEQ ID NO: 3946854 - RNA, 18 nt, Shigella flexneri 2a str. 301
gauccgggcauauuuccg

SEQ ID NO: 3946855 - RNA, 21 nt, Shigella flexneri 2a str. 301
gauccgggcuaaucgucaucg

SEQ ID NO: 3946856 - RNA, 17 nt, Shigella flexneri 2a str. 301
gauccuacacauacuua

SEQ ID NO: 3946857 - RNA, 17 nt, Shigella flexneri 2a str. 301
gauccugagccaguuuu

SEQ ID NO: 3946858 - RNA, 21 nt, Shigella flexneri 2a str. 301
gauccugauacagaccgcgca

SEQ ID NO: 3946859 - RNA, 15 nt, Shigella flexneri 2a str. 301
gauccugauccugca

SEQ ID NO: 3946860 - RNA, 22 nt, Shigella flexneri 2a str. 301
gauccugauuuaacaucuccac

SEQ ID NO: 3946861 - RNA, 16 nt, Shigella flexneri 2a str. 301
gauccugcacuuucag

SEQ ID NO: 3946862 - RNA, 21 nt, Shigella flexneri 2a str. 301
gauccugcacuuucagcacgu

SEQ ID NO: 3946863 - RNA, 23 nt, Shigella flexneri 2a str. 301
gauccuguuggccaacccgcgug

SEQ ID NO: 3946864 - RNA, 15 nt, Shigella flexneri 2a str. 301
gauccuuuuucccaa

SEQ ID NO: 3946865 - RNA, 14 nt, Shigella flexneri 2a str. 301
gaucgaacagcagc

SEQ ID NO: 3946866 - RNA, 17 nt, Shigella flexneri 2a str. 301
gaucgacagcgggugca

SEQ ID NO: 3946867 - RNA, 18 nt, Shigella flexneri 2a str. 301
gaucgacgcguccaggcu

SEQ ID NO: 3946868 - RNA, 18 nt, Shigella flexneri 2a str. 301
gaucgagcgcgagcaggc

SEQ ID NO: 3946869 - RNA, 14 nt, Shigella flexneri 2a str. 301
gaucgccaaagaaa

SEQ ID NO: 3946870 - RNA, 13 nt, Shigella flexneri 2a str. 301
gaucgccacugcu

SEQ ID NO: 3946871 - RNA, 14 nt, Shigella flexneri 2a str. 301
gaucgccacugcug

SEQ ID NO: 3946872 - RNA, 13 nt, Shigella flexneri 2a str. 301
gaucgccagcagg

SEQ ID NO: 3946873 - RNA, 13 nt, Shigella flexneri 2a str. 301
gaucgccagguua

SEQ ID NO: 3946874 - RNA, 13 nt, Shigella flexneri 2a str. 301
gaucgccauauuu

SEQ ID NO: 3946875 - RNA, 22 nt, Shigella flexneri 2a str. 301
gaucgccccggaagcaucaaac

SEQ ID NO: 3946876 - RNA, 13 nt, Shigella flexneri 2a str. 301
gaucgccgccgga

SEQ ID NO: 3946877 - RNA, 15 nt, Shigella flexneri 2a str. 301
gaucgcgaccgccuu

SEQ ID NO: 3946878 - RNA, 19 nt, Shigella flexneri 2a str. 301
gaucgcgccaaucagcgca

SEQ ID NO: 3946879 - RNA, 17 nt, Shigella flexneri 2a str. 301
gaucgcggcauuaccgg

SEQ ID NO: 3946880 - RNA, 11 nt, Shigella flexneri 2a str. 301
gaucgcucauc

SEQ ID NO: 3946881 - RNA, 18 nt, Shigella flexneri 2a str. 301
gaucgcuucggucugcgg

SEQ ID NO: 3946882 - RNA, 20 nt, Shigella flexneri 2a str. 301
gaucgcuuucgcuuucucuu

SEQ ID NO: 3946883 - RNA, 18 nt, Shigella flexneri 2a str. 301
gaucggacuucaugcgca

SEQ ID NO: 3946884 - RNA, 16 nt, Shigella flexneri 2a str. 301
gaucggcaagugccug

SEQ ID NO: 3946885 - RNA, 23 nt, Shigella flexneri 2a str. 301
gaucggcaaucacgcccgccaga

SEQ ID NO: 3946886 - RNA, 13 nt, Shigella flexneri 2a str. 301
gaucggcaaugag

SEQ ID NO: 3946887 - RNA, 15 nt, Shigella flexneri 2a str. 301
gaucggcaggcaggu

SEQ ID NO: 3946888 - RNA, 17 nt, Shigella flexneri 2a str. 301
gaucgggucaccgccga

SEQ ID NO: 3946889 - RNA, 14 nt, Shigella flexneri 2a str. 301
gaucgucagguuuu

SEQ ID NO: 3946890 - RNA, 14 nt, Shigella flexneri 2a str. 301
gaucgugagcguau

SEQ ID NO: 3946891 - RNA, 14 nt, Shigella flexneri 2a str. 301
gaucgugcucgaca

SEQ ID NO: 3946892 - RNA, 18 nt, Shigella flexneri 2a str. 301
gaucguguaacguacugc

SEQ ID NO: 3946893 - RNA, 15 nt, Shigella flexneri 2a str. 301
gaucgugugccacca

SEQ ID NO: 3946894 - RNA, 13 nt, Shigella flexneri 2a str. 301
gaucguguggcgg

SEQ ID NO: 3946895 - RNA, 14 nt, Shigella flexneri 2a str. 301
gaucguugaccuga

SEQ ID NO: 3946896 - RNA, 16 nt, Shigella flexneri 2a str. 301
gaucuaccgcuucccu

SEQ ID NO: 3946897 - RNA, 20 nt, Shigella flexneri 2a str. 301
gaucuaugucgcauccggca

SEQ ID NO: 3946898 - RNA, 16 nt, Shigella flexneri 2a str. 301
gaucuccgccugauua

SEQ ID NO: 3946899 - RNA, 14 nt, Shigella flexneri 2a str. 301
gaucucgucagcau

SEQ ID NO: 3946900 - RNA, 15 nt, Shigella flexneri 2a str. 301
gaucucuucgccugc

SEQ ID NO: 3946901 - RNA, 12 nt, Shigella flexneri 2a str. 301
gaucugcggguu

SEQ ID NO: 3946902 - RNA, 21 nt, Shigella flexneri 2a str. 301
gaucuggaauggaaacagcac

SEQ ID NO: 3946903 - RNA, 15 nt, Shigella flexneri 2a str. 301
gaucugguaucccgu

SEQ ID NO: 3946904 - RNA, 16 nt, Shigella flexneri 2a str. 301
gaucugguaucgccac

SEQ ID NO: 3946905 - RNA, 14 nt, Shigella flexneri 2a str. 301
gaucuguuuaucac

SEQ ID NO: 3946906 - RNA, 21 nt, Shigella flexneri 2a str. 301
gaucuucauagauagccagca

SEQ ID NO: 3946907 - RNA, 14 nt, Shigella flexneri 2a str. 301
gaucuuccgcguca

SEQ ID NO: 3946908 - RNA, 14 nt, Shigella flexneri 2a str. 301
gaucuuucugugca

SEQ ID NO: 3946909 - RNA, 17 nt, Shigella flexneri 2a str. 301
gaucuuugccagaucgc

SEQ ID NO: 3946910 - RNA, 22 nt, Shigella flexneri 2a str. 301
gaugaaaaaaccagaaagggaa

SEQ ID NO: 3946911 - RNA, 21 nt, Shigella flexneri 2a str. 301
gaugaaauagacauuacgcau

SEQ ID NO: 3946912 - RNA, 16 nt, Shigella flexneri 2a str. 301
gaugaaauaguugcau

SEQ ID NO: 3946913 - RNA, 14 nt, Shigella flexneri 2a str. 301
gaugaacauaaucu

SEQ ID NO: 3946914 - RNA, 16 nt, Shigella flexneri 2a str. 301
gaugaacuacggcaaa

SEQ ID NO: 3946915 - RNA, 20 nt, Shigella flexneri 2a str. 301
gaugaagaacucaaagcggu

SEQ ID NO: 3946916 - RNA, 14 nt, Shigella flexneri 2a str. 301
gaugaaucaccaca

SEQ ID NO: 3946917 - RNA, 16 nt, Shigella flexneri 2a str. 301
gaugacagacuccgcu

SEQ ID NO: 3946918 - RNA, 15 nt, Shigella flexneri 2a str. 301
gaugacauuaucugg

SEQ ID NO: 3946919 - RNA, 16 nt, Shigella flexneri 2a str. 301
gaugacgccacuggcu

SEQ ID NO: 3946920 - RNA, 17 nt, Shigella flexneri 2a str. 301
gaugacgccacuggcug

SEQ ID NO: 3946921 - RNA, 23 nt, Shigella flexneri 2a str. 301
gaugagcaaauccgcacucaucu

SEQ ID NO: 3946922 - RNA, 12 nt, Shigella flexneri 2a str. 301
gaugagcaucgu

SEQ ID NO: 3946923 - RNA, 23 nt, Shigella flexneri 2a str. 301
gaugaggcaccuguaguguguug

SEQ ID NO: 3946924 - RNA, 17 nt, Shigella flexneri 2a str. 301
gaugagguggugcgaug

SEQ ID NO: 3946925 - RNA, 16 nt, Shigella flexneri 2a str. 301
gaugaguuaagaagau

SEQ ID NO: 3946926 - RNA, 17 nt, Shigella flexneri 2a str. 301
gaugaguugaaaaccuc

SEQ ID NO: 3946927 - RNA, 13 nt, Shigella flexneri 2a str. 301
gaugauaaaucca

SEQ ID NO: 3946928 - RNA, 22 nt, Shigella flexneri 2a str. 301
gaugauaaccccgcaauuucau

SEQ ID NO: 3946929 - RNA, 17 nt, Shigella flexneri 2a str. 301
gaugauaguuuucuaug

SEQ ID NO: 3946930 - RNA, 14 nt, Shigella flexneri 2a str. 301
gaugauauggucaa

SEQ ID NO: 3946931 - RNA, 15 nt, Shigella flexneri 2a str. 301
gaugauauguagacg

SEQ ID NO: 3946932 - RNA, 14 nt, Shigella flexneri 2a str. 301
gaugaucaacagca

SEQ ID NO: 3946933 - RNA, 19 nt, Shigella flexneri 2a str. 301
gaugaucaacagcaucauc

SEQ ID NO: 3946934 - RNA, 23 nt, Shigella flexneri 2a str. 301
gaugaucaacagcaucaucgcaa

SEQ ID NO: 3946935 - RNA, 14 nt, Shigella flexneri 2a str. 301
gaugaucaccugca

SEQ ID NO: 3946936 - RNA, 20 nt, Shigella flexneri 2a str. 301
gaugaucauccggcuuuuuu

SEQ ID NO: 3946937 - RNA, 21 nt, Shigella flexneri 2a str. 301
gaugaucgcggcauuaccggc

SEQ ID NO: 3946938 - RNA, 16 nt, Shigella flexneri 2a str. 301
gaugaugcuguagcug

SEQ ID NO: 3946939 - RNA, 16 nt, Shigella flexneri 2a str. 301
gaugauuacgcgcuca

SEQ ID NO: 3946940 - RNA, 21 nt, Shigella flexneri 2a str. 301
gaugauuugguggcccuugcu

SEQ ID NO: 3946941 - RNA, 14 nt, Shigella flexneri 2a str. 301
gaugcaacuguuuu

SEQ ID NO: 3946942 - RNA, 14 nt, Shigella flexneri 2a str. 301
gaugcacagaaccg

SEQ ID NO: 3946943 - RNA, 15 nt, Shigella flexneri 2a str. 301
gaugcacagcacgcu

SEQ ID NO: 3946944 - RNA, 15 nt, Shigella flexneri 2a str. 301
gaugcagcaucaugu

SEQ ID NO: 3946945 - RNA, 16 nt, Shigella flexneri 2a str. 301
gaugcagcguaaaccc

SEQ ID NO: 3946946 - RNA, 14 nt, Shigella flexneri 2a str. 301
gaugcaggccacca

SEQ ID NO: 3946947 - RNA, 17 nt, Shigella flexneri 2a str. 301
gaugcaggcccagcggu

SEQ ID NO: 3946948 - RNA, 15 nt, Shigella flexneri 2a str. 301
gaugcaucagucacg

SEQ ID NO: 3946949 - RNA, 16 nt, Shigella flexneri 2a str. 301
gaugcaugauccggca

SEQ ID NO: 3946950 - RNA, 17 nt, Shigella flexneri 2a str. 301
gaugccacaaacuggcu

SEQ ID NO: 3946951 - RNA, 23 nt, Shigella flexneri 2a str. 301
gaugccagaaagcguauccauca

SEQ ID NO: 3946952 - RNA, 18 nt, Shigella flexneri 2a str. 301
gaugccagcgaagaagug

SEQ ID NO: 3946953 - RNA, 21 nt, Shigella flexneri 2a str. 301
gaugccagcgagguacaacca

SEQ ID NO: 3946954 - RNA, 18 nt, Shigella flexneri 2a str. 301
gaugccaguauuaccggc

SEQ ID NO: 3946955 - RNA, 23 nt, Shigella flexneri 2a str. 301
gaugccaguauuaccggcagagu

SEQ ID NO: 3946956 - RNA, 13 nt, Shigella flexneri 2a str. 301
gaugcccccagca

SEQ ID NO: 3946957 - RNA, 16 nt, Shigella flexneri 2a str. 301
gaugcccccagcagcg

SEQ ID NO: 3946958 - RNA, 21 nt, Shigella flexneri 2a str. 301
gaugcccgacuugagcgcagu

SEQ ID NO: 3946959 - RNA, 13 nt, Shigella flexneri 2a str. 301
gaugccgccagac

SEQ ID NO: 3946960 - RNA, 19 nt, Shigella flexneri 2a str. 301
gaugccgccguagaaaaug

SEQ ID NO: 3946961 - RNA, 21 nt, Shigella flexneri 2a str. 301
gaugccggaaucaaccauggu

SEQ ID NO: 3946962 - RNA, 21 nt, Shigella flexneri 2a str. 301
gaugccgggacgaucggcgag

SEQ ID NO: 3946963 - RNA, 21 nt, Shigella flexneri 2a str. 301
gaugccgucuuugucggugga

SEQ ID NO: 3946964 - RNA, 15 nt, Shigella flexneri 2a str. 301
gaugccugaugcggc

SEQ ID NO: 3946965 - RNA, 17 nt, Shigella flexneri 2a str. 301
gaugccuugugggccug

SEQ ID NO: 3946966 - RNA, 23 nt, Shigella flexneri 2a str. 301
gaugccuugugggccugaaagcu

SEQ ID NO: 3946967 - RNA, 18 nt, Shigella flexneri 2a str. 301
gaugcgacuugucaucau

SEQ ID NO: 3946968 - RNA, 22 nt, Shigella flexneri 2a str. 301
gaugcgaucgcgaauaugcugg

SEQ ID NO: 3946969 - RNA, 13 nt, Shigella flexneri 2a str. 301
gaugcgccagcau

SEQ ID NO: 3946970 - RNA, 16 nt, Shigella flexneri 2a str. 301
gaugcgccagcauccg

SEQ ID NO: 3946971 - RNA, 19 nt, Shigella flexneri 2a str. 301
gaugcgcccuugcaggcga

SEQ ID NO: 3946972 - RNA, 17 nt, Shigella flexneri 2a str. 301
gaugcgcuacgcucauc

SEQ ID NO: 3946973 - RNA, 20 nt, Shigella flexneri 2a str. 301
gaugcggcgaaaacgccuua

SEQ ID NO: 3946974 - RNA, 14 nt, Shigella flexneri 2a str. 301
gaugcggcggacgu

SEQ ID NO: 3946975 - RNA, 12 nt, Shigella flexneri 2a str. 301
gaugcggcguaa

SEQ ID NO: 3946976 - RNA, 15 nt, Shigella flexneri 2a str. 301
gaugcggcguaaacg

SEQ ID NO: 3946977 - RNA, 20 nt, Shigella flexneri 2a str. 301
gaugcggcguaaacgccuua

SEQ ID NO: 3946978 - RNA, 20 nt, Shigella flexneri 2a str. 301
gaugcggcguaaaugccuua

SEQ ID NO: 3946979 - RNA, 15 nt, Shigella flexneri 2a str. 301
gaugcggcgugaacg

SEQ ID NO: 3946980 - RNA, 20 nt, Shigella flexneri 2a str. 301
gaugcggcgugaacgccuua

SEQ ID NO: 3946981 - RNA, 21 nt, Shigella flexneri 2a str. 301
gaugcggcgugaacgccuuau

SEQ ID NO: 3946982 - RNA, 20 nt, Shigella flexneri 2a str. 301
gaugcggcgugaaugccuua

SEQ ID NO: 3946983 - RNA, 20 nt, Shigella flexneri 2a str. 301
gaugcggcgugaccgccuua

SEQ ID NO: 3946984 - RNA, 20 nt, Shigella flexneri 2a str. 301
gaugcggcguuaacgccuua

SEQ ID NO: 3946985 - RNA, 18 nt, Shigella flexneri 2a str. 301
gaugcgggucaggccagg

SEQ ID NO: 3946986 - RNA, 17 nt, Shigella flexneri 2a str. 301
gaugcgguaaccuggca

SEQ ID NO: 3946987 - RNA, 16 nt, Shigella flexneri 2a str. 301
gaugcggugcaagcac

SEQ ID NO: 3946988 - RNA, 22 nt, Shigella flexneri 2a str. 301
gaugcggugcaagcaccuuauc

SEQ ID NO: 3946989 - RNA, 13 nt, Shigella flexneri 2a str. 301
gaugcguucaccu

SEQ ID NO: 3946990 - RNA, 21 nt, Shigella flexneri 2a str. 301
gaugcuccacgcugcaucgcc

SEQ ID NO: 3946991 - RNA, 15 nt, Shigella flexneri 2a str. 301
gaugcuccuggcgaa

SEQ ID NO: 3946992 - RNA, 13 nt, Shigella flexneri 2a str. 301
gaugcucucauca

SEQ ID NO: 3946993 - RNA, 17 nt, Shigella flexneri 2a str. 301
gaugcucuuuucugaag

SEQ ID NO: 3946994 - RNA, 16 nt, Shigella flexneri 2a str. 301
gaugcuguugcuccuu

SEQ ID NO: 3946995 - RNA, 17 nt, Shigella flexneri 2a str. 301
gaugcuuugaccucccg

SEQ ID NO: 3946996 - RNA, 18 nt, Shigella flexneri 2a str. 301
gauggaagaaaccagcgu

SEQ ID NO: 3946997 - RNA, 15 nt, Shigella flexneri 2a str. 301
gauggagauuuuccg

SEQ ID NO: 3946998 - RNA, 18 nt, Shigella flexneri 2a str. 301
gauggcaaaagugauauu

SEQ ID NO: 3946999 - RNA, 17 nt, Shigella flexneri 2a str. 301
gauggcaaaugcagcau

SEQ ID NO: 3947000 - RNA, 17 nt, Shigella flexneri 2a str. 301
gauggcaagcggugcga

SEQ ID NO: 3947001 - RNA, 19 nt, Shigella flexneri 2a str. 301
gauggcaauauguggcuug

SEQ ID NO: 3947002 - RNA, 16 nt, Shigella flexneri 2a str. 301
gauggcaauuuucacu

SEQ ID NO: 3947003 - RNA, 18 nt, Shigella flexneri 2a str. 301
gauggcagugcgccauau

SEQ ID NO: 3947004 - RNA, 19 nt, Shigella flexneri 2a str. 301
gauggcauaccauccggca

SEQ ID NO: 3947005 - RNA, 20 nt, Shigella flexneri 2a str. 301
gauggcaucaccaucgggcc

SEQ ID NO: 3947006 - RNA, 15 nt, Shigella flexneri 2a str. 301
gauggcauucucacu

SEQ ID NO: 3947007 - RNA, 13 nt, Shigella flexneri 2a str. 301
gauggcccggcgg

SEQ ID NO: 3947008 - RNA, 22 nt, Shigella flexneri 2a str. 301
gauggccgguuuguuauccacc

SEQ ID NO: 3947009 - RNA, 18 nt, Shigella flexneri 2a str. 301
gauggcgcaaugccaucc

SEQ ID NO: 3947010 - RNA, 19 nt, Shigella flexneri 2a str. 301
gauggcgcgcagaaagagg

SEQ ID NO: 3947011 - RNA, 21 nt, Shigella flexneri 2a str. 301
gauggcgcgcggcaggaagug

SEQ ID NO: 3947012 - RNA, 16 nt, Shigella flexneri 2a str. 301
gauggcgggacagcau

SEQ ID NO: 3947013 - RNA, 18 nt, Shigella flexneri 2a str. 301
gauggcguagcagcagcg

SEQ ID NO: 3947014 - RNA, 16 nt, Shigella flexneri 2a str. 301
gauggcuacguucugc

SEQ ID NO: 3947015 - RNA, 21 nt, Shigella flexneri 2a str. 301
gauggcuauuacuuuaagccu

SEQ ID NO: 3947016 - RNA, 19 nt, Shigella flexneri 2a str. 301
gauggcugggguaccugga

SEQ ID NO: 3947017 - RNA, 20 nt, Shigella flexneri 2a str. 301
gauggcuguuuucagcacca

SEQ ID NO: 3947018 - RNA, 23 nt, Shigella flexneri 2a str. 301
gaugggcaguugcgcgcgcaccu

SEQ ID NO: 3947019 - RNA, 23 nt, Shigella flexneri 2a str. 301
gaugggcguuuucuaccagguuu

SEQ ID NO: 3947020 - RNA, 18 nt, Shigella flexneri 2a str. 301
gaugguacuucaaucgcc

SEQ ID NO: 3947021 - RNA, 23 nt, Shigella flexneri 2a str. 301
gaugguacuucaaucgccaccac

SEQ ID NO: 3947022 - RNA, 17 nt, Shigella flexneri 2a str. 301
gaugguauuguccugca

SEQ ID NO: 3947023 - RNA, 14 nt, Shigella flexneri 2a str. 301
gauggucgucaauc

SEQ ID NO: 3947024 - RNA, 20 nt, Shigella flexneri 2a str. 301
gauggucugguuuacugcug

SEQ ID NO: 3947025 - RNA, 22 nt, Shigella flexneri 2a str. 301
gauggugcaaauugcaccaucc

SEQ ID NO: 3947026 - RNA, 12 nt, Shigella flexneri 2a str. 301
gauggugguggg

SEQ ID NO: 3947027 - RNA, 23 nt, Shigella flexneri 2a str. 301
gaugguguuggcaaucagcggca

SEQ ID NO: 3947028 - RNA, 18 nt, Shigella flexneri 2a str. 301
gaugguuauccagcuuca

SEQ ID NO: 3947029 - RNA, 23 nt, Shigella flexneri 2a str. 301
gauguaaucaacuccgccagcaa

SEQ ID NO: 3947030 - RNA, 17 nt, Shigella flexneri 2a str. 301
gauguaauuaagcgcaa

SEQ ID NO: 3947031 - RNA, 22 nt, Shigella flexneri 2a str. 301
gaugucagcacuuccagcuccg

SEQ ID NO: 3947032 - RNA, 19 nt, Shigella flexneri 2a str. 301
gaugucgagguacgcucca

SEQ ID NO: 3947033 - RNA, 16 nt, Shigella flexneri 2a str. 301
gaugucgcuuccauug

SEQ ID NO: 3947034 - RNA, 18 nt, Shigella flexneri 2a str. 301
gaugucggcauaaagcug

SEQ ID NO: 3947035 - RNA, 21 nt, Shigella flexneri 2a str. 301
gaugucggggccagaacaaac

SEQ ID NO: 3947036 - RNA, 14 nt, Shigella flexneri 2a str. 301
gaugugaacccuga

SEQ ID NO: 3947037 - RNA, 18 nt, Shigella flexneri 2a str. 301
gaugugaacuugcucauc

SEQ ID NO: 3947038 - RNA, 14 nt, Shigella flexneri 2a str. 301
gaugugauccauca

SEQ ID NO: 3947039 - RNA, 15 nt, Shigella flexneri 2a str. 301
gaugugauccaucag

SEQ ID NO: 3947040 - RNA, 17 nt, Shigella flexneri 2a str. 301
gaugugcaguuccugca

SEQ ID NO: 3947041 - RNA, 18 nt, Shigella flexneri 2a str. 301
gaugugcaguuccugcaa

SEQ ID NO: 3947042 - RNA, 16 nt, Shigella flexneri 2a str. 301
gaugugccggauagcg

SEQ ID NO: 3947043 - RNA, 20 nt, Shigella flexneri 2a str. 301
gaugugcgguggcuucgccu

SEQ ID NO: 3947044 - RNA, 20 nt, Shigella flexneri 2a str. 301
gaugugcuucaucagacgcu

SEQ ID NO: 3947045 - RNA, 22 nt, Shigella flexneri 2a str. 301
gauguguuccgcaaucaaauga

SEQ ID NO: 3947046 - RNA, 18 nt, Shigella flexneri 2a str. 301
gauguucccccagccaga

SEQ ID NO: 3947047 - RNA, 19 nt, Shigella flexneri 2a str. 301
gauguugucauuacaacaa

SEQ ID NO: 3947048 - RNA, 14 nt, Shigella flexneri 2a str. 301
gauguuugagcuaa

SEQ ID NO: 3947049 - RNA, 18 nt, Shigella flexneri 2a str. 301
gauguuuucugccucugc

SEQ ID NO: 3947050 - RNA, 15 nt, Shigella flexneri 2a str. 301
gauuaaaaucagaau

SEQ ID NO: 3947051 - RNA, 20 nt, Shigella flexneri 2a str. 301
gauuaaaggaaggucaucca

SEQ ID NO: 3947052 - RNA, 16 nt, Shigella flexneri 2a str. 301
gauuaaauucaccagu

SEQ ID NO: 3947053 - RNA, 13 nt, Shigella flexneri 2a str. 301
gauuaacagcgcc

SEQ ID NO: 3947054 - RNA, 22 nt, Shigella flexneri 2a str. 301
gauuaacuggggcaaaugguuu

SEQ ID NO: 3947055 - RNA, 22 nt, Shigella flexneri 2a str. 301
gauuaauaaaauuauccagcuu

SEQ ID NO: 3947056 - RNA, 15 nt, Shigella flexneri 2a str. 301
gauuaauaaauuuua

SEQ ID NO: 3947057 - RNA, 19 nt, Shigella flexneri 2a str. 301
gauuacacaaauccagcac

SEQ ID NO: 3947058 - RNA, 22 nt, Shigella flexneri 2a str. 301
gauuacacaaauccagcaccgu

SEQ ID NO: 3947059 - RNA, 21 nt, Shigella flexneri 2a str. 301
gauuacauggacgaaaucuac

SEQ ID NO: 3947060 - RNA, 21 nt, Shigella flexneri 2a str. 301
gauuaccaauaucaaauaaaa

SEQ ID NO: 3947061 - RNA, 12 nt, Shigella flexneri 2a str. 301
gauuacgcaccg

SEQ ID NO: 3947062 - RNA, 19 nt, Shigella flexneri 2a str. 301
gauuacguagcacaaucaa

SEQ ID NO: 3947063 - RNA, 14 nt, Shigella flexneri 2a str. 301
gauuacgucuuuac

SEQ ID NO: 3947064 - RNA, 22 nt, Shigella flexneri 2a str. 301
gauuacucgccuuucacacgcu

SEQ ID NO: 3947065 - RNA, 21 nt, Shigella flexneri 2a str. 301
gauuacugcaaacucaucgcc

SEQ ID NO: 3947066 - RNA, 19 nt, Shigella flexneri 2a str. 301
gauuacuguacagauccgc

SEQ ID NO: 3947067 - RNA, 22 nt, Shigella flexneri 2a str. 301
gauuacuguacagauccgccau

SEQ ID NO: 3947068 - RNA, 14 nt, Shigella flexneri 2a str. 301
gauuacuuccuuca

SEQ ID NO: 3947069 - RNA, 13 nt, Shigella flexneri 2a str. 301
gauuacuuuauuu

SEQ ID NO: 3947070 - RNA, 23 nt, Shigella flexneri 2a str. 301
gauuagccuucaugcgacgacgg

SEQ ID NO: 3947071 - RNA, 22 nt, Shigella flexneri 2a str. 301
gauuaguauugcggaacggcag

SEQ ID NO: 3947072 - RNA, 17 nt, Shigella flexneri 2a str. 301
gauuagucuuuaucugc

SEQ ID NO: 3947073 - RNA, 15 nt, Shigella flexneri 2a str. 301
gauuauccaugccac

SEQ ID NO: 3947074 - RNA, 12 nt, Shigella flexneri 2a str. 301
gauuaucuucac

SEQ ID NO: 3947075 - RNA, 16 nt, Shigella flexneri 2a str. 301
gauuaucuucgcacuu

SEQ ID NO: 3947076 - RNA, 14 nt, Shigella flexneri 2a str. 301
gauuaugaucgcca

SEQ ID NO: 3947077 - RNA, 22 nt, Shigella flexneri 2a str. 301
gauuauggaucaguguacuuau

SEQ ID NO: 3947078 - RNA, 16 nt, Shigella flexneri 2a str. 301
gauuaugucaucaucg

SEQ ID NO: 3947079 - RNA, 20 nt, Shigella flexneri 2a str. 301
gauuauucgggaucugaugg

SEQ ID NO: 3947080 - RNA, 20 nt, Shigella flexneri 2a str. 301
gauuauugauauccaccucc

SEQ ID NO: 3947081 - RNA, 22 nt, Shigella flexneri 2a str. 301
gauuauuggacgguaaaaagaa

SEQ ID NO: 3947082 - RNA, 23 nt, Shigella flexneri 2a str. 301
gauuauuucgcugcggauuguca

SEQ ID NO: 3947083 - RNA, 15 nt, Shigella flexneri 2a str. 301
gauucacaguuaagu

SEQ ID NO: 3947084 - RNA, 16 nt, Shigella flexneri 2a str. 301
gauucacauccggcca

SEQ ID NO: 3947085 - RNA, 17 nt, Shigella flexneri 2a str. 301
gauucacuuucugaagg

SEQ ID NO: 3947086 - RNA, 12 nt, Shigella flexneri 2a str. 301
gauucagcaccg

SEQ ID NO: 3947087 - RNA, 18 nt, Shigella flexneri 2a str. 301
gauucagccacauuugcg

SEQ ID NO: 3947088 - RNA, 20 nt, Shigella flexneri 2a str. 301
gauucauacagcggccagcc

SEQ ID NO: 3947089 - RNA, 22 nt, Shigella flexneri 2a str. 301
gauucauccguuucccuguuca

SEQ ID NO: 3947090 - RNA, 23 nt, Shigella flexneri 2a str. 301
gauucauccguuucucuguucag

SEQ ID NO: 3947091 - RNA, 18 nt, Shigella flexneri 2a str. 301
gauucaucucuucuuccg

SEQ ID NO: 3947092 - RNA, 21 nt, Shigella flexneri 2a str. 301
gauucaugcggguauucaucc

SEQ ID NO: 3947093 - RNA, 19 nt, Shigella flexneri 2a str. 301
gauucaugcugcggcuguc

SEQ ID NO: 3947094 - RNA, 15 nt, Shigella flexneri 2a str. 301
gauuccacucauuaa

SEQ ID NO: 3947095 - RNA, 14 nt, Shigella flexneri 2a str. 301
gauucccccaggcc

SEQ ID NO: 3947096 - RNA, 13 nt, Shigella flexneri 2a str. 301
gauucccgggcac

SEQ ID NO: 3947097 - RNA, 15 nt, Shigella flexneri 2a str. 301
gauuccgccgccauu

SEQ ID NO: 3947098 - RNA, 24 nt, Shigella flexneri 2a str. 301
gauuccugcgcuuccagcuccauc

SEQ ID NO: 3947099 - RNA, 13 nt, Shigella flexneri 2a str. 301
gauucgcccgcag

SEQ ID NO: 3947100 - RNA, 21 nt, Shigella flexneri 2a str. 301
gauucgccugaacaugcccuu

SEQ ID NO: 3947101 - RNA, 13 nt, Shigella flexneri 2a str. 301
gauucgcucacga

SEQ ID NO: 3947102 - RNA, 15 nt, Shigella flexneri 2a str. 301
gauucggcaaucacc

SEQ ID NO: 3947103 - RNA, 15 nt, Shigella flexneri 2a str. 301
gauucggcaugauag

SEQ ID NO: 3947104 - RNA, 16 nt, Shigella flexneri 2a str. 301
gauucggcaugauagc

SEQ ID NO: 3947105 - RNA, 16 nt, Shigella flexneri 2a str. 301
gauucggccaguaacc

SEQ ID NO: 3947106 - RNA, 21 nt, Shigella flexneri 2a str. 301
gauucggcgcaaugauaucgc

SEQ ID NO: 3947107 - RNA, 21 nt, Shigella flexneri 2a str. 301
gauucggguucauguucagau

SEQ ID NO: 3947108 - RNA, 23 nt, Shigella flexneri 2a str. 301
gauucgucaauaucgagacgggc

SEQ ID NO: 3947109 - RNA, 22 nt, Shigella flexneri 2a str. 301
gauucguuuuucuucagcagcc

SEQ ID NO: 3947110 - RNA, 14 nt, Shigella flexneri 2a str. 301
gauucuggcguuaa

SEQ ID NO: 3947111 - RNA, 16 nt, Shigella flexneri 2a str. 301
gauucuucgaugaugc

SEQ ID NO: 3947112 - RNA, 13 nt, Shigella flexneri 2a str. 301
gauugaagaaauc

SEQ ID NO: 3947113 - RNA, 17 nt, Shigella flexneri 2a str. 301
gauugaccgccagcgcc

SEQ ID NO: 3947114 - RNA, 19 nt, Shigella flexneri 2a str. 301
gauugaucucuaaggcaug

SEQ ID NO: 3947115 - RNA, 13 nt, Shigella flexneri 2a str. 301
gauugauuuauca

SEQ ID NO: 3947116 - RNA, 22 nt, Shigella flexneri 2a str. 301
gauugcagacaaagugagcuuu

SEQ ID NO: 3947117 - RNA, 21 nt, Shigella flexneri 2a str. 301
gauugcauaaugguggagugg

SEQ ID NO: 3947118 - RNA, 13 nt, Shigella flexneri 2a str. 301
gauugccacccug

SEQ ID NO: 3947119 - RNA, 16 nt, Shigella flexneri 2a str. 301
gauugccgcgagaacu

SEQ ID NO: 3947120 - RNA, 19 nt, Shigella flexneri 2a str. 301
gauugccggaauggugcuu

SEQ ID NO: 3947121 - RNA, 17 nt, Shigella flexneri 2a str. 301
gauugccuuccaccaga

SEQ ID NO: 3947122 - RNA, 19 nt, Shigella flexneri 2a str. 301
gauugcgaauauguacuuu

SEQ ID NO: 3947123 - RNA, 15 nt, Shigella flexneri 2a str. 301
gauugcucaacgccg

SEQ ID NO: 3947124 - RNA, 17 nt, Shigella flexneri 2a str. 301
gauugcuucaguugccu

SEQ ID NO: 3947125 - RNA, 22 nt, Shigella flexneri 2a str. 301
gauuggcaucgggaugcugguu

SEQ ID NO: 3947126 - RNA, 15 nt, Shigella flexneri 2a str. 301
gauugggauuaaagc

SEQ ID NO: 3947127 - RNA, 18 nt, Shigella flexneri 2a str. 301
gauuggucgcucgcgccg

SEQ ID NO: 3947128 - RNA, 14 nt, Shigella flexneri 2a str. 301
gauuguagaaaauc

SEQ ID NO: 3947129 - RNA, 16 nt, Shigella flexneri 2a str. 301
gauuguauugauugcu

SEQ ID NO: 3947130 - RNA, 17 nt, Shigella flexneri 2a str. 301
gauugucauucgccuga

SEQ ID NO: 3947131 - RNA, 18 nt, Shigella flexneri 2a str. 301
gauugucguuguacaaca

SEQ ID NO: 3947132 - RNA, 18 nt, Shigella flexneri 2a str. 301
gauugugacacgcgcgca

SEQ ID NO: 3947133 - RNA, 18 nt, Shigella flexneri 2a str. 301
gauugugugauacuucuu

SEQ ID NO: 3947134 - RNA, 13 nt, Shigella flexneri 2a str. 301
gauuguuaaucac

SEQ ID NO: 3947135 - RNA, 14 nt, Shigella flexneri 2a str. 301
gauuguucgcaccg

SEQ ID NO: 3947136 - RNA, 22 nt, Shigella flexneri 2a str. 301
gauuguuucuucgauggcuggg

SEQ ID NO: 3947137 - RNA, 14 nt, Shigella flexneri 2a str. 301
gauuuaacaucucc

SEQ ID NO: 3947138 - RNA, 16 nt, Shigella flexneri 2a str. 301
gauuuaacaucuccac

SEQ ID NO: 3947139 - RNA, 13 nt, Shigella flexneri 2a str. 301
gauuuaaugccaa

SEQ ID NO: 3947140 - RNA, 17 nt, Shigella flexneri 2a str. 301
gauuuaccguuaagcug

SEQ ID NO: 3947141 - RNA, 14 nt, Shigella flexneri 2a str. 301
gauuuacuauuauu

SEQ ID NO: 3947142 - RNA, 14 nt, Shigella flexneri 2a str. 301
gauuuauaaaagaa

SEQ ID NO: 3947143 - RNA, 16 nt, Shigella flexneri 2a str. 301
gauuuaugauauuuuu

SEQ ID NO: 3947144 - RNA, 21 nt, Shigella flexneri 2a str. 301
gauuuauguaccgucaucgcc

SEQ ID NO: 3947145 - RNA, 19 nt, Shigella flexneri 2a str. 301
gauuucauaacugauggca

SEQ ID NO: 3947146 - RNA, 19 nt, Shigella flexneri 2a str. 301
gauuucaucgcccaggcaa

SEQ ID NO: 3947147 - RNA, 14 nt, Shigella flexneri 2a str. 301
gauuucaugaagcu

SEQ ID NO: 3947148 - RNA, 12 nt, Shigella flexneri 2a str. 301
gauuuccagcuc

SEQ ID NO: 3947149 - RNA, 13 nt, Shigella flexneri 2a str. 301
gauuucccggcac

SEQ ID NO: 3947150 - RNA, 22 nt, Shigella flexneri 2a str. 301
gauuuccguuaaccuaaagccu

SEQ ID NO: 3947151 - RNA, 13 nt, Shigella flexneri 2a str. 301
gauuuccuucagc

SEQ ID NO: 3947152 - RNA, 19 nt, Shigella flexneri 2a str. 301
gauuucguagacugcagcg

SEQ ID NO: 3947153 - RNA, 20 nt, Shigella flexneri 2a str. 301
gauuucguugugucgccagc

SEQ ID NO: 3947154 - RNA, 16 nt, Shigella flexneri 2a str. 301
gauuucuccccccucu

SEQ ID NO: 3947155 - RNA, 17 nt, Shigella flexneri 2a str. 301
gauuugcggaaguaguu

SEQ ID NO: 3947156 - RNA, 23 nt, Shigella flexneri 2a str. 301
gauuugcggaaguaguucaucaa

SEQ ID NO: 3947157 - RNA, 18 nt, Shigella flexneri 2a str. 301
gauuugcucccgcaguga

SEQ ID NO: 3947158 - RNA, 19 nt, Shigella flexneri 2a str. 301
gauuugguucggucacggc

SEQ ID NO: 3947159 - RNA, 19 nt, Shigella flexneri 2a str. 301
gauuugucgccugcaucac

SEQ ID NO: 3947160 - RNA, 20 nt, Shigella flexneri 2a str. 301
gauuugugcacgugccagau

SEQ ID NO: 3947161 - RNA, 19 nt, Shigella flexneri 2a str. 301
gauuuuaauaaaucacgcu

SEQ ID NO: 3947162 - RNA, 17 nt, Shigella flexneri 2a str. 301
gauuuucaccagcaucg

SEQ ID NO: 3947163 - RNA, 15 nt, Shigella flexneri 2a str. 301
gauuuucaucuucuu

SEQ ID NO: 3947164 - RNA, 19 nt, Shigella flexneri 2a str. 301
gauuuucuacuucuuucac

SEQ ID NO: 3947165 - RNA, 12 nt, Shigella flexneri 2a str. 301
gauuuucugcuc

SEQ ID NO: 3947166 - RNA, 13 nt, Shigella flexneri 2a str. 301
gauuuugcaauaa

SEQ ID NO: 3947167 - RNA, 14 nt, Shigella flexneri 2a str. 301
gauuuugcaauaau

SEQ ID NO: 3947168 - RNA, 14 nt, Shigella flexneri 2a str. 301
gauuuugccagcau

SEQ ID NO: 3947169 - RNA, 17 nt, Shigella flexneri 2a str. 301
gauuuuuaauagagaua

SEQ ID NO: 3947170 - RNA, 14 nt, Shigella flexneri 2a str. 301
gauuuuucugcucg

SEQ ID NO: 3947171 - RNA, 18 nt, Shigella flexneri 2a str. 301
gauuuuuuauaguacuuc

SEQ ID NO: 3947172 - RNA, 19 nt, Shigella flexneri 2a str. 301
gauuuuuuccaacaggcga

SEQ ID NO: 3947173 - RNA, 16 nt, Shigella flexneri 2a str. 301
gauuuuuuuauuuuuu

SEQ ID NO: 3947174 - RNA, 19 nt, Shigella flexneri 2a str. 301
gauuuuuuuucaaccuaaa

SEQ ID NO: 3947175 - RNA, 16 nt, Shigella flexneri 2a str. 301
gcaaaaaaccaucccu

SEQ ID NO: 3947176 - RNA, 13 nt, Shigella flexneri 2a str. 301
gcaaaaaaggcgu

SEQ ID NO: 3947177 - RNA, 12 nt, Shigella flexneri 2a str. 301
gcaaaaacgcau

SEQ ID NO: 3947178 - RNA, 20 nt, Shigella flexneri 2a str. 301
gcaaaaacuuccauguguuu

SEQ ID NO: 3947179 - RNA, 16 nt, Shigella flexneri 2a str. 301
gcaaaaauaaggcgga

SEQ ID NO: 3947180 - RNA, 13 nt, Shigella flexneri 2a str. 301
gcaaaaauuugcg

SEQ ID NO: 3947181 - RNA, 14 nt, Shigella flexneri 2a str. 301
gcaaaacacccgca

SEQ ID NO: 3947182 - RNA, 19 nt, Shigella flexneri 2a str. 301
gcaaaaccaucaauccacu

SEQ ID NO: 3947183 - RNA, 14 nt, Shigella flexneri 2a str. 301
gcaaaacccaggcu

SEQ ID NO: 3947184 - RNA, 20 nt, Shigella flexneri 2a str. 301
gcaaaaccucuuccagcaga

SEQ ID NO: 3947185 - RNA, 15 nt, Shigella flexneri 2a str. 301
gcaaaauacaugacc

SEQ ID NO: 3947186 - RNA, 11 nt, Shigella flexneri 2a str. 301
gcaaaauaggu

SEQ ID NO: 3947187 - RNA, 12 nt, Shigella flexneri 2a str. 301
gcaaaauaggua

SEQ ID NO: 3947188 - RNA, 19 nt, Shigella flexneri 2a str. 301
gcaaaauagucaucucuuc

SEQ ID NO: 3947189 - RNA, 13 nt, Shigella flexneri 2a str. 301
gcaaaaucaccau

SEQ ID NO: 3947190 - RNA, 15 nt, Shigella flexneri 2a str. 301
gcaaaaucaccauca

SEQ ID NO: 3947191 - RNA, 18 nt, Shigella flexneri 2a str. 301
gcaaaaucccacugccaa

SEQ ID NO: 3947192 - RNA, 18 nt, Shigella flexneri 2a str. 301
gcaaaaucguaagcagga

SEQ ID NO: 3947193 - RNA, 22 nt, Shigella flexneri 2a str. 301
gcaaaaugcaucggcauaauca

SEQ ID NO: 3947194 - RNA, 14 nt, Shigella flexneri 2a str. 301
gcaaaauuagcucg

SEQ ID NO: 3947195 - RNA, 20 nt, Shigella flexneri 2a str. 301
gcaaaauuuucauugccgca

SEQ ID NO: 3947196 - RNA, 18 nt, Shigella flexneri 2a str. 301
gcaaaauuuuuuugcacc

SEQ ID NO: 3947197 - RNA, 17 nt, Shigella flexneri 2a str. 301
gcaaacaggugcuccag

SEQ ID NO: 3947198 - RNA, 18 nt, Shigella flexneri 2a str. 301
gcaaacaguaacccggca

SEQ ID NO: 3947199 - RNA, 17 nt, Shigella flexneri 2a str. 301
gcaaacaguucugcagc

SEQ ID NO: 3947200 - RNA, 18 nt, Shigella flexneri 2a str. 301
gcaaacaguucugcagcg

SEQ ID NO: 3947201 - RNA, 17 nt, Shigella flexneri 2a str. 301
gcaaacaucggcuuauu

SEQ ID NO: 3947202 - RNA, 14 nt, Shigella flexneri 2a str. 301
gcaaacaucgggau

SEQ ID NO: 3947203 - RNA, 19 nt, Shigella flexneri 2a str. 301
gcaaacauggaaaccauca

SEQ ID NO: 3947204 - RNA, 22 nt, Shigella flexneri 2a str. 301
gcaaacauggaaaccaucaucu

SEQ ID NO: 3947205 - RNA, 14 nt, Shigella flexneri 2a str. 301
gcaaaccaaaccaa

SEQ ID NO: 3947206 - RNA, 17 nt, Shigella flexneri 2a str. 301
gcaaaccagacgcgcgu

SEQ ID NO: 3947207 - RNA, 18 nt, Shigella flexneri 2a str. 301
gcaaaccaggccgguaac

SEQ ID NO: 3947208 - RNA, 23 nt, Shigella flexneri 2a str. 301
gcaaaccaugacgcacuuucgcu

SEQ ID NO: 3947209 - RNA, 18 nt, Shigella flexneri 2a str. 301
gcaaaccgccagcuaggc

SEQ ID NO: 3947210 - RNA, 15 nt, Shigella flexneri 2a str. 301
gcaaaccucaggaau

SEQ ID NO: 3947211 - RNA, 16 nt, Shigella flexneri 2a str. 301
gcaaaccugcaaugau

SEQ ID NO: 3947212 - RNA, 14 nt, Shigella flexneri 2a str. 301
gcaaaccuggcaac

SEQ ID NO: 3947213 - RNA, 14 nt, Shigella flexneri 2a str. 301
gcaaacgaaagcag

SEQ ID NO: 3947214 - RNA, 15 nt, Shigella flexneri 2a str. 301
gcaaacgccaccugu

SEQ ID NO: 3947215 - RNA, 16 nt, Shigella flexneri 2a str. 301
gcaaacguaaaacugc

SEQ ID NO: 3947216 - RNA, 16 nt, Shigella flexneri 2a str. 301
gcaaacuacaaaucca

SEQ ID NO: 3947217 - RNA, 19 nt, Shigella flexneri 2a str. 301
gcaaacucugagagaucuu

SEQ ID NO: 3947218 - RNA, 11 nt, Shigella flexneri 2a str. 301
gcaaacugagu

SEQ ID NO: 3947219 - RNA, 15 nt, Shigella flexneri 2a str. 301
gcaaacugaguggag

SEQ ID NO: 3947220 - RNA, 21 nt, Shigella flexneri 2a str. 301
gcaaacuucuucaguuuuucc

SEQ ID NO: 3947221 - RNA, 15 nt, Shigella flexneri 2a str. 301
gcaaagagagaagcc

SEQ ID NO: 3947222 - RNA, 12 nt, Shigella flexneri 2a str. 301
gcaaagcaggcc

SEQ ID NO: 3947223 - RNA, 11 nt, Shigella flexneri 2a str. 301
gcaaagcccac

SEQ ID NO: 3947224 - RNA, 10 nt, Shigella flexneri 2a str. 301
gcaaagcgac

SEQ ID NO: 3947225 - RNA, 16 nt, Shigella flexneri 2a str. 301
gcaaagcggucuucug

SEQ ID NO: 3947226 - RNA, 21 nt, Shigella flexneri 2a str. 301
gcaaagcgugcaaauauacau

SEQ ID NO: 3947227 - RNA, 15 nt, Shigella flexneri 2a str. 301
gcaaaggaauggucg

SEQ ID NO: 3947228 - RNA, 22 nt, Shigella flexneri 2a str. 301
gcaaaggcguuauacugcggca

SEQ ID NO: 3947229 - RNA, 14 nt, Shigella flexneri 2a str. 301
gcaaagguuuuacc

SEQ ID NO: 3947230 - RNA, 15 nt, Shigella flexneri 2a str. 301
gcaaaguaauaauga

SEQ ID NO: 3947231 - RNA, 19 nt, Shigella flexneri 2a str. 301
gcaaaguaauaaugaucag

SEQ ID NO: 3947232 - RNA, 15 nt, Shigella flexneri 2a str. 301
gcaaaguagagcgaa

SEQ ID NO: 3947233 - RNA, 17 nt, Shigella flexneri 2a str. 301
gcaaaguagagcgaaac

SEQ ID NO: 3947234 - RNA, 16 nt, Shigella flexneri 2a str. 301
gcaaagugaauacaga

SEQ ID NO: 3947235 - RNA, 19 nt, Shigella flexneri 2a str. 301
gcaaagugaauacagaaca

SEQ ID NO: 3947236 - RNA, 22 nt, Shigella flexneri 2a str. 301
gcaaaguggcgcagagccugaa

SEQ ID NO: 3947237 - RNA, 17 nt, Shigella flexneri 2a str. 301
gcaaaguuugugaucuu

SEQ ID NO: 3947238 - RNA, 15 nt, Shigella flexneri 2a str. 301
gcaaauaacguaaaa

SEQ ID NO: 3947239 - RNA, 17 nt, Shigella flexneri 2a str. 301
gcaaauacaguugcgcc

SEQ ID NO: 3947240 - RNA, 17 nt, Shigella flexneri 2a str. 301
gcaaauacccaaaaaau

SEQ ID NO: 3947241 - RNA, 19 nt, Shigella flexneri 2a str. 301
gcaaauacccaaaaaauag

SEQ ID NO: 3947242 - RNA, 12 nt, Shigella flexneri 2a str. 301
gcaaauaccgga

SEQ ID NO: 3947243 - RNA, 19 nt, Shigella flexneri 2a str. 301
gcaaauagaugcugcgcuu

SEQ ID NO: 3947244 - RNA, 12 nt, Shigella flexneri 2a str. 301
gcaaauauuaau

SEQ ID NO: 3947245 - RNA, 14 nt, Shigella flexneri 2a str. 301
gcaaauauuaauaa

SEQ ID NO: 3947246 - RNA, 15 nt, Shigella flexneri 2a str. 301
gcaaauauugcauug

SEQ ID NO: 3947247 - RNA, 12 nt, Shigella flexneri 2a str. 301
gcaaaucaccac

SEQ ID NO: 3947248 - RNA, 17 nt, Shigella flexneri 2a str. 301
gcaaaucacgcugcuga

SEQ ID NO: 3947249 - RNA, 19 nt, Shigella flexneri 2a str. 301
gcaaaucacgcugcugauu

SEQ ID NO: 3947250 - RNA, 17 nt, Shigella flexneri 2a str. 301
gcaaauccacguuccag

SEQ ID NO: 3947251 - RNA, 21 nt, Shigella flexneri 2a str. 301
gcaaauccacguuccagaucu

SEQ ID NO: 3947252 - RNA, 15 nt, Shigella flexneri 2a str. 301
gcaaaucccaucggu

SEQ ID NO: 3947253 - RNA, 15 nt, Shigella flexneri 2a str. 301
gcaaauccgcacuca

SEQ ID NO: 3947254 - RNA, 23 nt, Shigella flexneri 2a str. 301
gcaaaucgacgccacaaucugau

SEQ ID NO: 3947255 - RNA, 18 nt, Shigella flexneri 2a str. 301
gcaaaucgcugaauaucu

SEQ ID NO: 3947256 - RNA, 23 nt, Shigella flexneri 2a str. 301
gcaaaucguauccggcauuauca

SEQ ID NO: 3947257 - RNA, 15 nt, Shigella flexneri 2a str. 301
gcaaaugaugcacca

SEQ ID NO: 3947258 - RNA, 16 nt, Shigella flexneri 2a str. 301
gcaaaugaugcaccac

SEQ ID NO: 3947259 - RNA, 11 nt, Shigella flexneri 2a str. 301
gcaaaugccag

SEQ ID NO: 3947260 - RNA, 14 nt, Shigella flexneri 2a str. 301
gcaaaugccagaua

SEQ ID NO: 3947261 - RNA, 13 nt, Shigella flexneri 2a str. 301
gcaaaugcggaga

SEQ ID NO: 3947262 - RNA, 14 nt, Shigella flexneri 2a str. 301
gcaaauguggcggu

SEQ ID NO: 3947263 - RNA, 23 nt, Shigella flexneri 2a str. 301
gcaaauuauuugcguagucugac

SEQ ID NO: 3947264 - RNA, 16 nt, Shigella flexneri 2a str. 301
gcaaauucauuaccaa

SEQ ID NO: 3947265 - RNA, 21 nt, Shigella flexneri 2a str. 301
gcaaauucucuauuucacccg

SEQ ID NO: 3947266 - RNA, 14 nt, Shigella flexneri 2a str. 301
gcaaauugacuaca

SEQ ID NO: 3947267 - RNA, 19 nt, Shigella flexneri 2a str. 301
gcaaauugaggaucugcgc

SEQ ID NO: 3947268 - RNA, 15 nt, Shigella flexneri 2a str. 301
gcaaauuuauuaucu

SEQ ID NO: 3947269 - RNA, 19 nt, Shigella flexneri 2a str. 301
gcaacaaaacguagaaacc

SEQ ID NO: 3947270 - RNA, 13 nt, Shigella flexneri 2a str. 301
gcaacaaaauggc

SEQ ID NO: 3947271 - RNA, 12 nt, Shigella flexneri 2a str. 301
gcaacaaacgcg

SEQ ID NO: 3947272 - RNA, 12 nt, Shigella flexneri 2a str. 301
gcaacaacagcg

SEQ ID NO: 3947273 - RNA, 14 nt, Shigella flexneri 2a str. 301
gcaacaacagcgcg

SEQ ID NO: 3947274 - RNA, 16 nt, Shigella flexneri 2a str. 301
gcaacaacugaaaaaa

SEQ ID NO: 3947275 - RNA, 17 nt, Shigella flexneri 2a str. 301
gcaacaaucgggaaaau

SEQ ID NO: 3947276 - RNA, 20 nt, Shigella flexneri 2a str. 301
gcaacaaugccacgccacag

SEQ ID NO: 3947277 - RNA, 14 nt, Shigella flexneri 2a str. 301
gcaacaauggcauu

SEQ ID NO: 3947278 - RNA, 17 nt, Shigella flexneri 2a str. 301
gcaacacaaucagacgc

SEQ ID NO: 3947279 - RNA, 15 nt, Shigella flexneri 2a str. 301
gcaacacgccagcgu

SEQ ID NO: 3947280 - RNA, 15 nt, Shigella flexneri 2a str. 301
gcaacagaguugcca

SEQ ID NO: 3947281 - RNA, 15 nt, Shigella flexneri 2a str. 301
gcaacagcaccagca

SEQ ID NO: 3947282 - RNA, 12 nt, Shigella flexneri 2a str. 301
gcaacaggcugu

SEQ ID NO: 3947283 - RNA, 15 nt, Shigella flexneri 2a str. 301
gcaacagguugcgcu

SEQ ID NO: 3947284 - RNA, 13 nt, Shigella flexneri 2a str. 301
gcaacauaccgga

SEQ ID NO: 3947285 - RNA, 15 nt, Shigella flexneri 2a str. 301
gcaacauaggcugcu

SEQ ID NO: 3947286 - RNA, 23 nt, Shigella flexneri 2a str. 301
gcaacauauuccgcaccugccag

SEQ ID NO: 3947287 - RNA, 23 nt, Shigella flexneri 2a str. 301
gcaacaucaaauuacagcaccuu

SEQ ID NO: 3947288 - RNA, 16 nt, Shigella flexneri 2a str. 301
gcaacaugcuggccuu

SEQ ID NO: 3947289 - RNA, 14 nt, Shigella flexneri 2a str. 301
gcaacauguugaau

SEQ ID NO: 3947290 - RNA, 19 nt, Shigella flexneri 2a str. 301
gcaaccaacgccagcagca

SEQ ID NO: 3947291 - RNA, 18 nt, Shigella flexneri 2a str. 301
gcaaccacaaaacacucu

SEQ ID NO: 3947292 - RNA, 14 nt, Shigella flexneri 2a str. 301
gcaaccacacccac

SEQ ID NO: 3947293 - RNA, 17 nt, Shigella flexneri 2a str. 301
gcaaccagcaggcuggu

SEQ ID NO: 3947294 - RNA, 15 nt, Shigella flexneri 2a str. 301
gcaaccagcggcugc

SEQ ID NO: 3947295 - RNA, 18 nt, Shigella flexneri 2a str. 301
gcaaccagcggcugcuga

SEQ ID NO: 3947296 - RNA, 14 nt, Shigella flexneri 2a str. 301
gcaacccgccaggu

SEQ ID NO: 3947297 - RNA, 21 nt, Shigella flexneri 2a str. 301
gcaaccgcauccagauucuca

SEQ ID NO: 3947298 - RNA, 23 nt, Shigella flexneri 2a str. 301
gcaaccgcugagcgauaaaauca

SEQ ID NO: 3947299 - RNA, 16 nt, Shigella flexneri 2a str. 301
gcaaccggcgcggcag

SEQ ID NO: 3947300 - RNA, 17 nt, Shigella flexneri 2a str. 301
gcaaccgguaaagaaga

SEQ ID NO: 3947301 - RNA, 22 nt, Shigella flexneri 2a str. 301
gcaaccguucggaaaaauauau

SEQ ID NO: 3947302 - RNA, 15 nt, Shigella flexneri 2a str. 301
gcaaccuaaaccaaa

SEQ ID NO: 3947303 - RNA, 15 nt, Shigella flexneri 2a str. 301
gcaaccuuuugcgcu

SEQ ID NO: 3947304 - RNA, 21 nt, Shigella flexneri 2a str. 301
gcaacgaaaggugaaguggug

SEQ ID NO: 3947305 - RNA, 22 nt, Shigella flexneri 2a str. 301
gcaacgaaguaauaaucaacgc

SEQ ID NO: 3947306 - RNA, 13 nt, Shigella flexneri 2a str. 301
gcaacgaccagaa

SEQ ID NO: 3947307 - RNA, 22 nt, Shigella flexneri 2a str. 301
gcaacgacgguaaaccacgcca

SEQ ID NO: 3947308 - RNA, 23 nt, Shigella flexneri 2a str. 301
gcaacgacgguaaaccacgccag

SEQ ID NO: 3947309 - RNA, 20 nt, Shigella flexneri 2a str. 301
gcaacgccccuucugccgca

SEQ ID NO: 3947310 - RNA, 17 nt, Shigella flexneri 2a str. 301
gcaacgccgccggaagu

SEQ ID NO: 3947311 - RNA, 17 nt, Shigella flexneri 2a str. 301
gcaacgccguaagcgcg

SEQ ID NO: 3947312 - RNA, 20 nt, Shigella flexneri 2a str. 301
gcaacgccguaagcgcggag

SEQ ID NO: 3947313 - RNA, 22 nt, Shigella flexneri 2a str. 301
gcaacgccuuugucgggcaggc

SEQ ID NO: 3947314 - RNA, 23 nt, Shigella flexneri 2a str. 301
gcaacgccuuugucgggcaggcu

SEQ ID NO: 3947315 - RNA, 13 nt, Shigella flexneri 2a str. 301
gcaacgcgcguga

SEQ ID NO: 3947316 - RNA, 13 nt, Shigella flexneri 2a str. 301
gcaacgcggcggu

SEQ ID NO: 3947317 - RNA, 15 nt, Shigella flexneri 2a str. 301
gcaacgcggcgguga

SEQ ID NO: 3947318 - RNA, 21 nt, Shigella flexneri 2a str. 301
gcaacgcuucguagaagccau

SEQ ID NO: 3947319 - RNA, 17 nt, Shigella flexneri 2a str. 301
gcaacggacgaccgauu

SEQ ID NO: 3947320 - RNA, 14 nt, Shigella flexneri 2a str. 301
gcaacggugcggcu

SEQ ID NO: 3947321 - RNA, 20 nt, Shigella flexneri 2a str. 301
gcaacgguugcggaacccag

SEQ ID NO: 3947322 - RNA, 15 nt, Shigella flexneri 2a str. 301
gcaacgucaguaacc

SEQ ID NO: 3947323 - RNA, 18 nt, Shigella flexneri 2a str. 301
gcaacguccugagcauuu

SEQ ID NO: 3947324 - RNA, 15 nt, Shigella flexneri 2a str. 301
gcaacguccugcaac

SEQ ID NO: 3947325 - RNA, 23 nt, Shigella flexneri 2a str. 301
gcaacgucggaaaccgcuuugcc

SEQ ID NO: 3947326 - RNA, 20 nt, Shigella flexneri 2a str. 301
gcaacguguuuguucaacga

SEQ ID NO: 3947327 - RNA, 14 nt, Shigella flexneri 2a str. 301
gcaacguuccagca

SEQ ID NO: 3947328 - RNA, 20 nt, Shigella flexneri 2a str. 301
gcaacguuguuccuuccagc

SEQ ID NO: 3947329 - RNA, 14 nt, Shigella flexneri 2a str. 301
gcaacuaccagcag

SEQ ID NO: 3947330 - RNA, 15 nt, Shigella flexneri 2a str. 301
gcaacuaccagcagu

SEQ ID NO: 3947331 - RNA, 13 nt, Shigella flexneri 2a str. 301
gcaacucaaucgc

SEQ ID NO: 3947332 - RNA, 17 nt, Shigella flexneri 2a str. 301
gcaacuccaucaagcua

SEQ ID NO: 3947333 - RNA, 13 nt, Shigella flexneri 2a str. 301
gcaacucgaugcu

SEQ ID NO: 3947334 - RNA, 19 nt, Shigella flexneri 2a str. 301
gcaacucuuuuuccugcug

SEQ ID NO: 3947335 - RNA, 13 nt, Shigella flexneri 2a str. 301
gcaacugacggca

SEQ ID NO: 3947336 - RNA, 19 nt, Shigella flexneri 2a str. 301
gcaacugacugacuucaac

SEQ ID NO: 3947337 - RNA, 16 nt, Shigella flexneri 2a str. 301
gcaacugacuggcucu

SEQ ID NO: 3947338 - RNA, 18 nt, Shigella flexneri 2a str. 301
gcaacugaggcaauaaug

SEQ ID NO: 3947339 - RNA, 21 nt, Shigella flexneri 2a str. 301
gcaacugauggcccaucguca

SEQ ID NO: 3947340 - RNA, 12 nt, Shigella flexneri 2a str. 301
gcaacugauuua

SEQ ID NO: 3947341 - RNA, 14 nt, Shigella flexneri 2a str. 301
gcaacugcgcggca

SEQ ID NO: 3947342 - RNA, 14 nt, Shigella flexneri 2a str. 301
gcaacugcgcugca

SEQ ID NO: 3947343 - RNA, 13 nt, Shigella flexneri 2a str. 301
gcaacugcggcgc

SEQ ID NO: 3947344 - RNA, 18 nt, Shigella flexneri 2a str. 301
gcaacugcggcgcaagcg

SEQ ID NO: 3947345 - RNA, 18 nt, Shigella flexneri 2a str. 301
gcaacugcugcgguugaa

SEQ ID NO: 3947346 - RNA, 22 nt, Shigella flexneri 2a str. 301
gcaacuguaacgcagaagguua

SEQ ID NO: 3947347 - RNA, 22 nt, Shigella flexneri 2a str. 301
gcaacuuaaucaucaaugccag

SEQ ID NO: 3947348 - RNA, 12 nt, Shigella flexneri 2a str. 301
gcaacuucucuu

SEQ ID NO: 3947349 - RNA, 18 nt, Shigella flexneri 2a str. 301
gcaacuucucuuucggca

SEQ ID NO: 3947350 - RNA, 23 nt, Shigella flexneri 2a str. 301
gcaacuucucuuucggcagugcc

SEQ ID NO: 3947351 - RNA, 20 nt, Shigella flexneri 2a str. 301
gcaacuuuucaacaaauucu

SEQ ID NO: 3947352 - RNA, 22 nt, Shigella flexneri 2a str. 301
gcaagaaauaccgaagaguaac

SEQ ID NO: 3947353 - RNA, 13 nt, Shigella flexneri 2a str. 301
gcaagaaaugaca

SEQ ID NO: 3947354 - RNA, 15 nt, Shigella flexneri 2a str. 301
gcaagaccgcgacca

SEQ ID NO: 3947355 - RNA, 17 nt, Shigella flexneri 2a str. 301
gcaagacgaaaaaugaa

SEQ ID NO: 3947356 - RNA, 21 nt, Shigella flexneri 2a str. 301
gcaagacgaugacauuaucug

SEQ ID NO: 3947357 - RNA, 14 nt, Shigella flexneri 2a str. 301
gcaagagcaaauaa

SEQ ID NO: 3947358 - RNA, 21 nt, Shigella flexneri 2a str. 301
gcaagaggguuauuuguucag

SEQ ID NO: 3947359 - RNA, 19 nt, Shigella flexneri 2a str. 301
gcaagaucgcgcaucagcu

SEQ ID NO: 3947360 - RNA, 16 nt, Shigella flexneri 2a str. 301
gcaagaucgcucauca

SEQ ID NO: 3947361 - RNA, 23 nt, Shigella flexneri 2a str. 301
gcaagaucgcucaucagcuccgg

SEQ ID NO: 3947362 - RNA, 15 nt, Shigella flexneri 2a str. 301
gcaagaugaauaaug

SEQ ID NO: 3947363 - RNA, 16 nt, Shigella flexneri 2a str. 301
gcaagauuccagugcc

SEQ ID NO: 3947364 - RNA, 20 nt, Shigella flexneri 2a str. 301
gcaagauuuuguaggucgga

SEQ ID NO: 3947365 - RNA, 11 nt, Shigella flexneri 2a str. 301
gcaagcaaaug

SEQ ID NO: 3947366 - RNA, 15 nt, Shigella flexneri 2a str. 301
gcaagcaggucggcu

SEQ ID NO: 3947367 - RNA, 15 nt, Shigella flexneri 2a str. 301
gcaagccacaauaaa

SEQ ID NO: 3947368 - RNA, 15 nt, Shigella flexneri 2a str. 301
gcaagccagguuuug

SEQ ID NO: 3947369 - RNA, 23 nt, Shigella flexneri 2a str. 301
gcaagccaucguuaauuaacgcg

SEQ ID NO: 3947370 - RNA, 17 nt, Shigella flexneri 2a str. 301
gcaagcccagcacccag

SEQ ID NO: 3947371 - RNA, 20 nt, Shigella flexneri 2a str. 301
gcaagcccagcacccaguaa

SEQ ID NO: 3947372 - RNA, 12 nt, Shigella flexneri 2a str. 301
gcaagcccagcc

SEQ ID NO: 3947373 - RNA, 14 nt, Shigella flexneri 2a str. 301
gcaagccgcuaaca

SEQ ID NO: 3947374 - RNA, 18 nt, Shigella flexneri 2a str. 301
gcaagcgcugagacgcgc

SEQ ID NO: 3947375 - RNA, 12 nt, Shigella flexneri 2a str. 301
gcaagcggcggc

SEQ ID NO: 3947376 - RNA, 16 nt, Shigella flexneri 2a str. 301
gcaagcggcggcaaug

SEQ ID NO: 3947377 - RNA, 18 nt, Shigella flexneri 2a str. 301
gcaagcggcggcaauggc

SEQ ID NO: 3947378 - RNA, 22 nt, Shigella flexneri 2a str. 301
gcaagcgggguaaaugccauca

SEQ ID NO: 3947379 - RNA, 21 nt, Shigella flexneri 2a str. 301
gcaagcguuugagcaugguaa

SEQ ID NO: 3947380 - RNA, 17 nt, Shigella flexneri 2a str. 301
gcaaggaaagccacugu

SEQ ID NO: 3947381 - RNA, 17 nt, Shigella flexneri 2a str. 301
gcaaggcaaucugcucu

SEQ ID NO: 3947382 - RNA, 21 nt, Shigella flexneri 2a str. 301
gcaaggcgagcgcggcuggcu

SEQ ID NO: 3947383 - RNA, 13 nt, Shigella flexneri 2a str. 301
gcaaggcgcgggu

SEQ ID NO: 3947384 - RNA, 20 nt, Shigella flexneri 2a str. 301
gcaaggcgcggguuucaaca

SEQ ID NO: 3947385 - RNA, 19 nt, Shigella flexneri 2a str. 301
gcaaggcuauucagcaguu

SEQ ID NO: 3947386 - RNA, 20 nt, Shigella flexneri 2a str. 301
gcaaggcuuucacgucagga

SEQ ID NO: 3947387 - RNA, 16 nt, Shigella flexneri 2a str. 301
gcaagggcaucguaau

SEQ ID NO: 3947388 - RNA, 15 nt, Shigella flexneri 2a str. 301
gcaagggccgcagcu

SEQ ID NO: 3947389 - RNA, 16 nt, Shigella flexneri 2a str. 301
gcaagggccgcagcuu

SEQ ID NO: 3947390 - RNA, 16 nt, Shigella flexneri 2a str. 301
gcaaggugaaagcaau

SEQ ID NO: 3947391 - RNA, 24 nt, Shigella flexneri 2a str. 301
gcaagguggucagacggaacaucu

SEQ ID NO: 3947392 - RNA, 12 nt, Shigella flexneri 2a str. 301
gcaagguugaag

SEQ ID NO: 3947393 - RNA, 23 nt, Shigella flexneri 2a str. 301
gcaaguaauaauaucuccagcua

SEQ ID NO: 3947394 - RNA, 16 nt, Shigella flexneri 2a str. 301
gcaagucauuguccag

SEQ ID NO: 3947395 - RNA, 18 nt, Shigella flexneri 2a str. 301
gcaagucggcaucgccac

SEQ ID NO: 3947396 - RNA, 17 nt, Shigella flexneri 2a str. 301
gcaauaaacaugaugau

SEQ ID NO: 3947397 - RNA, 19 nt, Shigella flexneri 2a str. 301
gcaauaaagacauccgcca

SEQ ID NO: 3947398 - RNA, 13 nt, Shigella flexneri 2a str. 301
gcaauaacacgcg

SEQ ID NO: 3947399 - RNA, 13 nt, Shigella flexneri 2a str. 301
gcaauaacacgcu

SEQ ID NO: 3947400 - RNA, 22 nt, Shigella flexneri 2a str. 301
gcaauaacucuuugaugaaaca

SEQ ID NO: 3947401 - RNA, 22 nt, Shigella flexneri 2a str. 301
gcaauaauagccccaaccgaac

SEQ ID NO: 3947402 - RNA, 15 nt, Shigella flexneri 2a str. 301
gcaauaaucagaugg

SEQ ID NO: 3947403 - RNA, 20 nt, Shigella flexneri 2a str. 301
gcaauaauccccgccaggau

SEQ ID NO: 3947404 - RNA, 16 nt, Shigella flexneri 2a str. 301
gcaauaauuuacagcc

SEQ ID NO: 3947405 - RNA, 21 nt, Shigella flexneri 2a str. 301
gcaauacagguuucaaugcac

SEQ ID NO: 3947406 - RNA, 14 nt, Shigella flexneri 2a str. 301
gcaauaccaucacc

SEQ ID NO: 3947407 - RNA, 15 nt, Shigella flexneri 2a str. 301
gcaauaccauuuaca

SEQ ID NO: 3947408 - RNA, 17 nt, Shigella flexneri 2a str. 301
gcaauacccugacccag

SEQ ID NO: 3947409 - RNA, 19 nt, Shigella flexneri 2a str. 301
gcaauacccugacccagac

SEQ ID NO: 3947410 - RNA, 19 nt, Shigella flexneri 2a str. 301
gcaauaccgccguuaacac

SEQ ID NO: 3947411 - RNA, 15 nt, Shigella flexneri 2a str. 301
gcaauaccuggcgca

SEQ ID NO: 3947412 - RNA, 14 nt, Shigella flexneri 2a str. 301
gcaauacguuucau

SEQ ID NO: 3947413 - RNA, 13 nt, Shigella flexneri 2a str. 301
gcaauacuggcag

SEQ ID NO: 3947414 - RNA, 13 nt, Shigella flexneri 2a str. 301
gcaauagaauaag

SEQ ID NO: 3947415 - RNA, 19 nt, Shigella flexneri 2a str. 301
gcaauagacaguucuuccu

SEQ ID NO: 3947416 - RNA, 20 nt, Shigella flexneri 2a str. 301
gcaauagauugaauuagcaa

SEQ ID NO: 3947417 - RNA, 15 nt, Shigella flexneri 2a str. 301
gcaauagcacugcuu

SEQ ID NO: 3947418 - RNA, 20 nt, Shigella flexneri 2a str. 301
gcaauauauugaauuugcau

SEQ ID NO: 3947419 - RNA, 16 nt, Shigella flexneri 2a str. 301
gcaauaucgcggcaca

SEQ ID NO: 3947420 - RNA, 13 nt, Shigella flexneri 2a str. 301
gcaauaugcgccg

SEQ ID NO: 3947421 - RNA, 14 nt, Shigella flexneri 2a str. 301
gcaauauuacuuca

SEQ ID NO: 3947422 - RNA, 20 nt, Shigella flexneri 2a str. 301
gcaauauucauuaaaacuga

SEQ ID NO: 3947423 - RNA, 16 nt, Shigella flexneri 2a str. 301
gcaauauucuuuugca

SEQ ID NO: 3947424 - RNA, 18 nt, Shigella flexneri 2a str. 301
gcaauauucuuuugcagc

SEQ ID NO: 3947425 - RNA, 18 nt, Shigella flexneri 2a str. 301
gcaauauuuuguugcaua

SEQ ID NO: 3947426 - RNA, 23 nt, Shigella flexneri 2a str. 301
gcaaucaaauaccaccagcgaaa

SEQ ID NO: 3947427 - RNA, 13 nt, Shigella flexneri 2a str. 301
gcaaucacaucac

SEQ ID NO: 3947428 - RNA, 12 nt, Shigella flexneri 2a str. 301
gcaaucaccacc

SEQ ID NO: 3947429 - RNA, 16 nt, Shigella flexneri 2a str. 301
gcaaucacugccagaa

SEQ ID NO: 3947430 - RNA, 20 nt, Shigella flexneri 2a str. 301
gcaaucacugccagaauagc

SEQ ID NO: 3947431 - RNA, 23 nt, Shigella flexneri 2a str. 301
gcaaucacugccagaauagccgc

SEQ ID NO: 3947432 - RNA, 14 nt, Shigella flexneri 2a str. 301
gcaaucacuuccuc

SEQ ID NO: 3947433 - RNA, 22 nt, Shigella flexneri 2a str. 301
gcaaucacuuccucaagcguuu

SEQ ID NO: 3947434 - RNA, 22 nt, Shigella flexneri 2a str. 301
gcaaucagauaaaauacacuuu

SEQ ID NO: 3947435 - RNA, 17 nt, Shigella flexneri 2a str. 301
gcaaucauauucaccac

SEQ ID NO: 3947436 - RNA, 14 nt, Shigella flexneri 2a str. 301
gcaaucaucccagu

SEQ ID NO: 3947437 - RNA, 14 nt, Shigella flexneri 2a str. 301
gcaaucaucuugua

SEQ ID NO: 3947438 - RNA, 20 nt, Shigella flexneri 2a str. 301
gcaaucaucuuguaggccug

SEQ ID NO: 3947439 - RNA, 21 nt, Shigella flexneri 2a str. 301
gcaaucaucuuguaggccuga

SEQ ID NO: 3947440 - RNA, 17 nt, Shigella flexneri 2a str. 301
gcaaucauucccagacc

SEQ ID NO: 3947441 - RNA, 19 nt, Shigella flexneri 2a str. 301
gcaauccaccauuggcgca

SEQ ID NO: 3947442 - RNA, 20 nt, Shigella flexneri 2a str. 301
gcaauccagcucuuuuccag

SEQ ID NO: 3947443 - RNA, 23 nt, Shigella flexneri 2a str. 301
gcaauccaguccaccugaccugc

SEQ ID NO: 3947444 - RNA, 23 nt, Shigella flexneri 2a str. 301
gcaauccauaacgcuccuacacc

SEQ ID NO: 3947445 - RNA, 16 nt, Shigella flexneri 2a str. 301
gcaauccuaaaucgcu

SEQ ID NO: 3947446 - RNA, 22 nt, Shigella flexneri 2a str. 301
gcaaucgaccaggccaucagca

SEQ ID NO: 3947447 - RNA, 15 nt, Shigella flexneri 2a str. 301
gcaaucgacgccguu

SEQ ID NO: 3947448 - RNA, 14 nt, Shigella flexneri 2a str. 301
gcaaucgagcccag

SEQ ID NO: 3947449 - RNA, 22 nt, Shigella flexneri 2a str. 301
gcaaucgagcccagaugccgga

SEQ ID NO: 3947450 - RNA, 18 nt, Shigella flexneri 2a str. 301
gcaaucgaguuugccgcu

SEQ ID NO: 3947451 - RNA, 16 nt, Shigella flexneri 2a str. 301
gcaaucgcauagccag

SEQ ID NO: 3947452 - RNA, 14 nt, Shigella flexneri 2a str. 301
gcaaucgccagcgg

SEQ ID NO: 3947453 - RNA, 16 nt, Shigella flexneri 2a str. 301
gcaaucgccagcggca

SEQ ID NO: 3947454 - RNA, 14 nt, Shigella flexneri 2a str. 301
gcaaucgcccagcg

SEQ ID NO: 3947455 - RNA, 16 nt, Shigella flexneri 2a str. 301
gcaaucggcugcaccu

SEQ ID NO: 3947456 - RNA, 20 nt, Shigella flexneri 2a str. 301
gcaaucggugcaaaugccag

SEQ ID NO: 3947457 - RNA, 18 nt, Shigella flexneri 2a str. 301
gcaaucguagcccagcuc

SEQ ID NO: 3947458 - RNA, 15 nt, Shigella flexneri 2a str. 301
gcaaucuccugcgca

SEQ ID NO: 3947459 - RNA, 16 nt, Shigella flexneri 2a str. 301
gcaaucugauugacau

SEQ ID NO: 3947460 - RNA, 17 nt, Shigella flexneri 2a str. 301
gcaaucuuaggggacau

SEQ ID NO: 3947461 - RNA, 18 nt, Shigella flexneri 2a str. 301
gcaaugaaauucauuuga

SEQ ID NO: 3947462 - RNA, 22 nt, Shigella flexneri 2a str. 301
gcaaugaaccgguaugaauuug

SEQ ID NO: 3947463 - RNA, 22 nt, Shigella flexneri 2a str. 301
gcaaugagagggcgauaaaucu

SEQ ID NO: 3947464 - RNA, 23 nt, Shigella flexneri 2a str. 301
gcaaugagagggcgauaaaucuc

SEQ ID NO: 3947465 - RNA, 14 nt, Shigella flexneri 2a str. 301
gcaaugaucucaau

SEQ ID NO: 3947466 - RNA, 13 nt, Shigella flexneri 2a str. 301
gcaaugcaggcac

SEQ ID NO: 3947467 - RNA, 12 nt, Shigella flexneri 2a str. 301
gcaaugcgcaca

SEQ ID NO: 3947468 - RNA, 18 nt, Shigella flexneri 2a str. 301
gcaaugcguagcugagca

SEQ ID NO: 3947469 - RNA, 14 nt, Shigella flexneri 2a str. 301
gcaaugcuuccugc

SEQ ID NO: 3947470 - RNA, 15 nt, Shigella flexneri 2a str. 301
gcaauggaaaaaguu

SEQ ID NO: 3947471 - RNA, 17 nt, Shigella flexneri 2a str. 301
gcaauggcuucauccac

SEQ ID NO: 3947472 - RNA, 20 nt, Shigella flexneri 2a str. 301
gcaauggucgcaucauuuaa

SEQ ID NO: 3947473 - RNA, 15 nt, Shigella flexneri 2a str. 301
gcaaugucaucagca

SEQ ID NO: 3947474 - RNA, 17 nt, Shigella flexneri 2a str. 301
gcaauguguggaugccu

SEQ ID NO: 3947475 - RNA, 14 nt, Shigella flexneri 2a str. 301
gcaauuaacaguga

SEQ ID NO: 3947476 - RNA, 16 nt, Shigella flexneri 2a str. 301
gcaauuacccaguaga

SEQ ID NO: 3947477 - RNA, 22 nt, Shigella flexneri 2a str. 301
gcaauuacccaguagacagcaa

SEQ ID NO: 3947478 - RNA, 20 nt, Shigella flexneri 2a str. 301
gcaauuaccgccaccaggaa

SEQ ID NO: 3947479 - RNA, 19 nt, Shigella flexneri 2a str. 301
gcaauuagcggcuggcugu

SEQ ID NO: 3947480 - RNA, 13 nt, Shigella flexneri 2a str. 301
gcaauucaauuaa

SEQ ID NO: 3947481 - RNA, 16 nt, Shigella flexneri 2a str. 301
gcaauucaccguaaua

SEQ ID NO: 3947482 - RNA, 16 nt, Shigella flexneri 2a str. 301
gcaauuccagcgccag

SEQ ID NO: 3947483 - RNA, 17 nt, Shigella flexneri 2a str. 301
gcaauuccagcgccagu

SEQ ID NO: 3947484 - RNA, 16 nt, Shigella flexneri 2a str. 301
gcaauuccggugacca

SEQ ID NO: 3947485 - RNA, 13 nt, Shigella flexneri 2a str. 301
gcaauucuuucuc

SEQ ID NO: 3947486 - RNA, 17 nt, Shigella flexneri 2a str. 301
gcaauugccagacaaca

SEQ ID NO: 3947487 - RNA, 17 nt, Shigella flexneri 2a str. 301
gcaauuggcgcaucaug

SEQ ID NO: 3947488 - RNA, 17 nt, Shigella flexneri 2a str. 301
gcaauugucgcagaagc

SEQ ID NO: 3947489 - RNA, 15 nt, Shigella flexneri 2a str. 301
gcaauuuccauugcu

SEQ ID NO: 3947490 - RNA, 18 nt, Shigella flexneri 2a str. 301
gcaauuuuuccugguucu

SEQ ID NO: 3947491 - RNA, 13 nt, Shigella flexneri 2a str. 301
gcaauuuuuugcg

SEQ ID NO: 3947492 - RNA, 20 nt, Shigella flexneri 2a str. 301
gcacaaacauccaucugcuu

SEQ ID NO: 3947493 - RNA, 21 nt, Shigella flexneri 2a str. 301
gcacaaagcgaugaugcugua

SEQ ID NO: 3947494 - RNA, 15 nt, Shigella flexneri 2a str. 301
gcacaaaguggcggc

SEQ ID NO: 3947495 - RNA, 16 nt, Shigella flexneri 2a str. 301
gcacaaauagccagca

SEQ ID NO: 3947496 - RNA, 15 nt, Shigella flexneri 2a str. 301
gcacaaauuugccgu

SEQ ID NO: 3947497 - RNA, 18 nt, Shigella flexneri 2a str. 301
gcacaaauuugccgucga

SEQ ID NO: 3947498 - RNA, 12 nt, Shigella flexneri 2a str. 301
gcacaacaggcu

SEQ ID NO: 3947499 - RNA, 16 nt, Shigella flexneri 2a str. 301
gcacaacucggcggcu

SEQ ID NO: 3947500 - RNA, 13 nt, Shigella flexneri 2a str. 301
gcacaagcccaug

SEQ ID NO: 3947501 - RNA, 16 nt, Shigella flexneri 2a str. 301
gcacaagcuaccagcc

SEQ ID NO: 3947502 - RNA, 16 nt, Shigella flexneri 2a str. 301
gcacaaguuguuuaca

SEQ ID NO: 3947503 - RNA, 17 nt, Shigella flexneri 2a str. 301
gcacaauacauagaaac

SEQ ID NO: 3947504 - RNA, 18 nt, Shigella flexneri 2a str. 301
gcacaauacauagaaacu

SEQ ID NO: 3947505 - RNA, 14 nt, Shigella flexneri 2a str. 301
gcacaaucacguca

SEQ ID NO: 3947506 - RNA, 14 nt, Shigella flexneri 2a str. 301
gcacaaugccugau

SEQ ID NO: 3947507 - RNA, 23 nt, Shigella flexneri 2a str. 301
gcacaaugccugaugcgacgcuu

SEQ ID NO: 3947508 - RNA, 23 nt, Shigella flexneri 2a str. 301
gcacaauggagcuaaacagcgcu

SEQ ID NO: 3947509 - RNA, 18 nt, Shigella flexneri 2a str. 301
gcacaauuaccugucgcc

SEQ ID NO: 3947510 - RNA, 18 nt, Shigella flexneri 2a str. 301
gcacacaagcguaagaga

SEQ ID NO: 3947511 - RNA, 13 nt, Shigella flexneri 2a str. 301
gcacacacaucac

SEQ ID NO: 3947512 - RNA, 11 nt, Shigella flexneri 2a str. 301
gcacacacugc

SEQ ID NO: 3947513 - RNA, 13 nt, Shigella flexneri 2a str. 301
gcacacacugcuu

SEQ ID NO: 3947514 - RNA, 16 nt, Shigella flexneri 2a str. 301
gcacacacugcuuaac

SEQ ID NO: 3947515 - RNA, 18 nt, Shigella flexneri 2a str. 301
gcacacagggcgcuagcc

SEQ ID NO: 3947516 - RNA, 20 nt, Shigella flexneri 2a str. 301
gcacaccccgcgcagcugag

SEQ ID NO: 3947517 - RNA, 17 nt, Shigella flexneri 2a str. 301
gcacaccgccgccgcca

SEQ ID NO: 3947518 - RNA, 12 nt, Shigella flexneri 2a str. 301
gcacacguuuca

SEQ ID NO: 3947519 - RNA, 17 nt, Shigella flexneri 2a str. 301
gcacacugguucccaac

SEQ ID NO: 3947520 - RNA, 21 nt, Shigella flexneri 2a str. 301
gcacacugguucccaacaaca

SEQ ID NO: 3947521 - RNA, 12 nt, Shigella flexneri 2a str. 301
gcacacuuagcc

SEQ ID NO: 3947522 - RNA, 21 nt, Shigella flexneri 2a str. 301
gcacagaacaaaauguuuaug

SEQ ID NO: 3947523 - RNA, 21 nt, Shigella flexneri 2a str. 301
gcacagacuuaauauugccgu

SEQ ID NO: 3947524 - RNA, 14 nt, Shigella flexneri 2a str. 301
gcacagaucgcacu

SEQ ID NO: 3947525 - RNA, 13 nt, Shigella flexneri 2a str. 301
gcacagaugcgac

SEQ ID NO: 3947526 - RNA, 17 nt, Shigella flexneri 2a str. 301
gcacagcacgcuuuuca

SEQ ID NO: 3947527 - RNA, 22 nt, Shigella flexneri 2a str. 301
gcacagcacgcuuuucagugcc

SEQ ID NO: 3947528 - RNA, 16 nt, Shigella flexneri 2a str. 301
gcacagcaggccaaga

SEQ ID NO: 3947529 - RNA, 16 nt, Shigella flexneri 2a str. 301
gcacagccagcgcugg

SEQ ID NO: 3947530 - RNA, 23 nt, Shigella flexneri 2a str. 301
gcacagcccgccgccauccugaa

SEQ ID NO: 3947531 - RNA, 23 nt, Shigella flexneri 2a str. 301
gcacaggcgcuggguaaagagcg

SEQ ID NO: 3947532 - RNA, 15 nt, Shigella flexneri 2a str. 301
gcacaguacgcgccc

SEQ ID NO: 3947533 - RNA, 20 nt, Shigella flexneri 2a str. 301
gcacaguacgcgcccgccgc

SEQ ID NO: 3947534 - RNA, 21 nt, Shigella flexneri 2a str. 301
gcacauaaaauggccguaaua

SEQ ID NO: 3947535 - RNA, 22 nt, Shigella flexneri 2a str. 301
gcacauaacucauacugagcaa

SEQ ID NO: 3947536 - RNA, 15 nt, Shigella flexneri 2a str. 301
gcacauagcgugaca

SEQ ID NO: 3947537 - RNA, 15 nt, Shigella flexneri 2a str. 301
gcacaucaauuugcc

SEQ ID NO: 3947538 - RNA, 22 nt, Shigella flexneri 2a str. 301
gcacaucaauuugcccaccggu

SEQ ID NO: 3947539 - RNA, 12 nt, Shigella flexneri 2a str. 301
gcacaucagcca

SEQ ID NO: 3947540 - RNA, 19 nt, Shigella flexneri 2a str. 301
gcacaucauacgggucauu

SEQ ID NO: 3947541 - RNA, 18 nt, Shigella flexneri 2a str. 301
gcacaucgcugugcugcu

SEQ ID NO: 3947542 - RNA, 21 nt, Shigella flexneri 2a str. 301
gcacauuagcgaccuucugaa

SEQ ID NO: 3947543 - RNA, 15 nt, Shigella flexneri 2a str. 301
gcacauucugacugg

SEQ ID NO: 3947544 - RNA, 16 nt, Shigella flexneri 2a str. 301
gcacauugugcgccau

SEQ ID NO: 3947545 - RNA, 23 nt, Shigella flexneri 2a str. 301
gcacauuucagaaaguauauaaa

SEQ ID NO: 3947546 - RNA, 20 nt, Shigella flexneri 2a str. 301
gcacauuucccggccacgca

SEQ ID NO: 3947547 - RNA, 12 nt, Shigella flexneri 2a str. 301
gcaccaaaagca

SEQ ID NO: 3947548 - RNA, 17 nt, Shigella flexneri 2a str. 301
gcaccaaacgggcaagc

SEQ ID NO: 3947549 - RNA, 14 nt, Shigella flexneri 2a str. 301
gcaccaaagcguuu

SEQ ID NO: 3947550 - RNA, 11 nt, Shigella flexneri 2a str. 301
gcaccaacaaa

SEQ ID NO: 3947551 - RNA, 13 nt, Shigella flexneri 2a str. 301
gcaccaacaaaua

SEQ ID NO: 3947552 - RNA, 21 nt, Shigella flexneri 2a str. 301
gcaccaacaaauagagauaga

SEQ ID NO: 3947553 - RNA, 22 nt, Shigella flexneri 2a str. 301
gcaccaacccuaacccaacauu

SEQ ID NO: 3947554 - RNA, 18 nt, Shigella flexneri 2a str. 301
gcaccaaucaccgccagc

SEQ ID NO: 3947555 - RNA, 15 nt, Shigella flexneri 2a str. 301
gcaccaauucaugag

SEQ ID NO: 3947556 - RNA, 18 nt, Shigella flexneri 2a str. 301
gcaccacauucugcaucg

SEQ ID NO: 3947557 - RNA, 20 nt, Shigella flexneri 2a str. 301
gcaccaccaaaaacgccaug

SEQ ID NO: 3947558 - RNA, 14 nt, Shigella flexneri 2a str. 301
gcaccaccagcagc

SEQ ID NO: 3947559 - RNA, 15 nt, Shigella flexneri 2a str. 301
gcaccaccagcagcu

SEQ ID NO: 3947560 - RNA, 19 nt, Shigella flexneri 2a str. 301
gcaccaccauugagguuga

SEQ ID NO: 3947561 - RNA, 22 nt, Shigella flexneri 2a str. 301
gcaccaccuggcuugccgggcc

SEQ ID NO: 3947562 - RNA, 23 nt, Shigella flexneri 2a str. 301
gcaccacuuccggcaacaaugcc

SEQ ID NO: 3947563 - RNA, 18 nt, Shigella flexneri 2a str. 301
gcaccacuuuacgggcaa

SEQ ID NO: 3947564 - RNA, 15 nt, Shigella flexneri 2a str. 301
gcaccagaaacaaua

SEQ ID NO: 3947565 - RNA, 21 nt, Shigella flexneri 2a str. 301
gcaccagaaaguuuuucaaca

SEQ ID NO: 3947566 - RNA, 22 nt, Shigella flexneri 2a str. 301
gcaccagaauaccuugcugcuc

SEQ ID NO: 3947567 - RNA, 13 nt, Shigella flexneri 2a str. 301
gcaccagcaacaa

SEQ ID NO: 3947568 - RNA, 14 nt, Shigella flexneri 2a str. 301
gcaccagcaacaag

SEQ ID NO: 3947569 - RNA, 22 nt, Shigella flexneri 2a str. 301
gcaccagccccuggaaaaagug

SEQ ID NO: 3947570 - RNA, 16 nt, Shigella flexneri 2a str. 301
gcaccagcggaaugca

SEQ ID NO: 3947571 - RNA, 15 nt, Shigella flexneri 2a str. 301
gcaccagcuccggca

SEQ ID NO: 3947572 - RNA, 23 nt, Shigella flexneri 2a str. 301
gcaccaggcaguuuauccagcca

SEQ ID NO: 3947573 - RNA, 18 nt, Shigella flexneri 2a str. 301
gcaccagggaaauaaucg

SEQ ID NO: 3947574 - RNA, 12 nt, Shigella flexneri 2a str. 301
gcaccaguaacg

SEQ ID NO: 3947575 - RNA, 15 nt, Shigella flexneri 2a str. 301
gcaccaguucacccu

SEQ ID NO: 3947576 - RNA, 21 nt, Shigella flexneri 2a str. 301
gcaccaguucgccguacugac

SEQ ID NO: 3947577 - RNA, 18 nt, Shigella flexneri 2a str. 301
gcaccaucaaaguuuuua

SEQ ID NO: 3947578 - RNA, 17 nt, Shigella flexneri 2a str. 301
gcaccauccgcccacac

SEQ ID NO: 3947579 - RNA, 22 nt, Shigella flexneri 2a str. 301
gcaccauguaggaguugcggcu

SEQ ID NO: 3947580 - RNA, 23 nt, Shigella flexneri 2a str. 301
gcaccaugucccggaacaggcag

SEQ ID NO: 3947581 - RNA, 11 nt, Shigella flexneri 2a str. 301
gcaccauucca

SEQ ID NO: 3947582 - RNA, 12 nt, Shigella flexneri 2a str. 301
gcacccagcaau

SEQ ID NO: 3947583 - RNA, 14 nt, Shigella flexneri 2a str. 301
gcacccgccagcgc

SEQ ID NO: 3947584 - RNA, 21 nt, Shigella flexneri 2a str. 301
gcacccgccguuagccagcgc

SEQ ID NO: 3947585 - RNA, 16 nt, Shigella flexneri 2a str. 301
gcacccgcgcuggcag

SEQ ID NO: 3947586 - RNA, 20 nt, Shigella flexneri 2a str. 301
gcacccucaacaacagcgau

SEQ ID NO: 3947587 - RNA, 14 nt, Shigella flexneri 2a str. 301
gcaccgaagcccau

SEQ ID NO: 3947588 - RNA, 15 nt, Shigella flexneri 2a str. 301
gcaccgaagcccauc

SEQ ID NO: 3947589 - RNA, 18 nt, Shigella flexneri 2a str. 301
gcaccgacacaaauggca

SEQ ID NO: 3947590 - RNA, 22 nt, Shigella flexneri 2a str. 301
gcaccgacguucagcgcaacuu

SEQ ID NO: 3947591 - RNA, 20 nt, Shigella flexneri 2a str. 301
gcaccgaggccaaaaccaca

SEQ ID NO: 3947592 - RNA, 17 nt, Shigella flexneri 2a str. 301
gcaccgauaauacacuu

SEQ ID NO: 3947593 - RNA, 21 nt, Shigella flexneri 2a str. 301
gcaccgauugccggaugcggc

SEQ ID NO: 3947594 - RNA, 18 nt, Shigella flexneri 2a str. 301
gcaccgcacagaccauca

SEQ ID NO: 3947595 - RNA, 13 nt, Shigella flexneri 2a str. 301
gcaccgcagagau

SEQ ID NO: 3947596 - RNA, 16 nt, Shigella flexneri 2a str. 301
gcaccgccaaccagcg

SEQ ID NO: 3947597 - RNA, 15 nt, Shigella flexneri 2a str. 301
gcaccgccaccaccg

SEQ ID NO: 3947598 - RNA, 18 nt, Shigella flexneri 2a str. 301
gcaccgcgacaaucaggu

SEQ ID NO: 3947599 - RNA, 23 nt, Shigella flexneri 2a str. 301
gcaccgcgcguuuaggcgcagga

SEQ ID NO: 3947600 - RNA, 19 nt, Shigella flexneri 2a str. 301
gcaccggucgacgaugggu

SEQ ID NO: 3947601 - RNA, 20 nt, Shigella flexneri 2a str. 301
gcaccguaucuucauugugc

SEQ ID NO: 3947602 - RNA, 21 nt, Shigella flexneri 2a str. 301
gcaccgucaccgguucggaca

SEQ ID NO: 3947603 - RNA, 21 nt, Shigella flexneri 2a str. 301
gcaccguuggcgcuggcggcu

SEQ ID NO: 3947604 - RNA, 14 nt, Shigella flexneri 2a str. 301
gcaccuaaagcgcg

SEQ ID NO: 3947605 - RNA, 14 nt, Shigella flexneri 2a str. 301
gcaccuacagccau

SEQ ID NO: 3947606 - RNA, 21 nt, Shigella flexneri 2a str. 301
gcaccuggggcuugccagagc

SEQ ID NO: 3947607 - RNA, 22 nt, Shigella flexneri 2a str. 301
gcaccuuacucaguuggugucc

SEQ ID NO: 3947608 - RNA, 16 nt, Shigella flexneri 2a str. 301
gcaccuuuaccacucc

SEQ ID NO: 3947609 - RNA, 18 nt, Shigella flexneri 2a str. 301
gcaccuuuacgccaggca

SEQ ID NO: 3947610 - RNA, 17 nt, Shigella flexneri 2a str. 301
gcaccuuuucaucaggu

SEQ ID NO: 3947611 - RNA, 14 nt, Shigella flexneri 2a str. 301
gcacgaaccagaga

SEQ ID NO: 3947612 - RNA, 19 nt, Shigella flexneri 2a str. 301
gcacgauuuguaggccgga

SEQ ID NO: 3947613 - RNA, 17 nt, Shigella flexneri 2a str. 301
gcacgcaggccacgaau

SEQ ID NO: 3947614 - RNA, 23 nt, Shigella flexneri 2a str. 301
gcacgcagugguuaacaaucaca

SEQ ID NO: 3947615 - RNA, 15 nt, Shigella flexneri 2a str. 301
gcacgccaucuggcu

SEQ ID NO: 3947616 - RNA, 15 nt, Shigella flexneri 2a str. 301
gcacgcccugauaaa

SEQ ID NO: 3947617 - RNA, 12 nt, Shigella flexneri 2a str. 301
gcacgcuggaga

SEQ ID NO: 3947618 - RNA, 14 nt, Shigella flexneri 2a str. 301
gcacgcuggcguca

SEQ ID NO: 3947619 - RNA, 22 nt, Shigella flexneri 2a str. 301
gcacggaaagcagcauacccac

SEQ ID NO: 3947620 - RNA, 22 nt, Shigella flexneri 2a str. 301
gcacggagauauccagcgccga

SEQ ID NO: 3947621 - RNA, 23 nt, Shigella flexneri 2a str. 301
gcacggcaggaucugcgcggcaa

SEQ ID NO: 3947622 - RNA, 13 nt, Shigella flexneri 2a str. 301
gcacggcauacuu

SEQ ID NO: 3947623 - RNA, 22 nt, Shigella flexneri 2a str. 301
gcacggucaggcuaaagaaaac

SEQ ID NO: 3947624 - RNA, 15 nt, Shigella flexneri 2a str. 301
gcacggugaagaagc

SEQ ID NO: 3947625 - RNA, 19 nt, Shigella flexneri 2a str. 301
gcacggugcaucuucacac

SEQ ID NO: 3947626 - RNA, 20 nt, Shigella flexneri 2a str. 301
gcacgguggucaggcgcgga

SEQ ID NO: 3947627 - RNA, 15 nt, Shigella flexneri 2a str. 301
gcacggugugcggca

SEQ ID NO: 3947628 - RNA, 18 nt, Shigella flexneri 2a str. 301
gcacgguuuuuccagcuc

SEQ ID NO: 3947629 - RNA, 22 nt, Shigella flexneri 2a str. 301
gcacguaccaugcgcaucaucg

SEQ ID NO: 3947630 - RNA, 23 nt, Shigella flexneri 2a str. 301
gcacguccgguggcauccgcaau

SEQ ID NO: 3947631 - RNA, 21 nt, Shigella flexneri 2a str. 301
gcacgucuuugccgcgcucuu

SEQ ID NO: 3947632 - RNA, 21 nt, Shigella flexneri 2a str. 301
gcacguuagaaacaaaaaaac

SEQ ID NO: 3947633 - RNA, 14 nt, Shigella flexneri 2a str. 301
gcacguucauccca

SEQ ID NO: 3947634 - RNA, 19 nt, Shigella flexneri 2a str. 301
gcacguugucagcaacugu

SEQ ID NO: 3947635 - RNA, 17 nt, Shigella flexneri 2a str. 301
gcacguuuugcggaugc

SEQ ID NO: 3947636 - RNA, 23 nt, Shigella flexneri 2a str. 301
gcacguuuugcggaugcagcgga

SEQ ID NO: 3947637 - RNA, 18 nt, Shigella flexneri 2a str. 301
gcacuaaguucugcccug

SEQ ID NO: 3947638 - RNA, 15 nt, Shigella flexneri 2a str. 301
gcacuacccaguaug

SEQ ID NO: 3947639 - RNA, 17 nt, Shigella flexneri 2a str. 301
gcacuacgcagggauau

SEQ ID NO: 3947640 - RNA, 17 nt, Shigella flexneri 2a str. 301
gcacuauacaaccagau

SEQ ID NO: 3947641 - RNA, 13 nt, Shigella flexneri 2a str. 301
gcacuaugugcca

SEQ ID NO: 3947642 - RNA, 18 nt, Shigella flexneri 2a str. 301
gcacucagguaacaggga

SEQ ID NO: 3947643 - RNA, 13 nt, Shigella flexneri 2a str. 301
gcacucgcagaca

SEQ ID NO: 3947644 - RNA, 16 nt, Shigella flexneri 2a str. 301
gcacucgcuggcacuc

SEQ ID NO: 3947645 - RNA, 16 nt, Shigella flexneri 2a str. 301
gcacugaaagccgcag

SEQ ID NO: 3947646 - RNA, 18 nt, Shigella flexneri 2a str. 301
gcacugaaagccgcaggc

SEQ ID NO: 3947647 - RNA, 16 nt, Shigella flexneri 2a str. 301
gcacugaaugccggau

SEQ ID NO: 3947648 - RNA, 12 nt, Shigella flexneri 2a str. 301
gcacugauucau

SEQ ID NO: 3947649 - RNA, 23 nt, Shigella flexneri 2a str. 301
gcacugauuuuuuccaacaggcg

SEQ ID NO: 3947650 - RNA, 17 nt, Shigella flexneri 2a str. 301
gcacugcaggcugaugg

SEQ ID NO: 3947651 - RNA, 19 nt, Shigella flexneri 2a str. 301
gcacugcaucaaugccgga

SEQ ID NO: 3947652 - RNA, 21 nt, Shigella flexneri 2a str. 301
gcacugccagaaucaagguga

SEQ ID NO: 3947653 - RNA, 14 nt, Shigella flexneri 2a str. 301
gcacugccgcaucg

SEQ ID NO: 3947654 - RNA, 16 nt, Shigella flexneri 2a str. 301
gcacugcgcccgccag

SEQ ID NO: 3947655 - RNA, 18 nt, Shigella flexneri 2a str. 301
gcacugcgcccgccagca

SEQ ID NO: 3947656 - RNA, 22 nt, Shigella flexneri 2a str. 301
gcacugcgcccgccagcaucgg

SEQ ID NO: 3947657 - RNA, 19 nt, Shigella flexneri 2a str. 301
gcacugcuuaaauuucuua

SEQ ID NO: 3947658 - RNA, 14 nt, Shigella flexneri 2a str. 301
gcacuggcgagcgc

SEQ ID NO: 3947659 - RNA, 18 nt, Shigella flexneri 2a str. 301
gcacuggcggcagcaggu

SEQ ID NO: 3947660 - RNA, 23 nt, Shigella flexneri 2a str. 301
gcacuggcuuuccagcgucaguu

SEQ ID NO: 3947661 - RNA, 18 nt, Shigella flexneri 2a str. 301
gcacugucuaacaacaug

SEQ ID NO: 3947662 - RNA, 15 nt, Shigella flexneri 2a str. 301
gcacuguuucgccag

SEQ ID NO: 3947663 - RNA, 16 nt, Shigella flexneri 2a str. 301
gcacuguuucgccagg

SEQ ID NO: 3947664 - RNA, 14 nt, Shigella flexneri 2a str. 301
gcacuuaauaccac

SEQ ID NO: 3947665 - RNA, 23 nt, Shigella flexneri 2a str. 301
gcacuuacagcaacgccuaaacu

SEQ ID NO: 3947666 - RNA, 14 nt, Shigella flexneri 2a str. 301
gcacuuaccuucac

SEQ ID NO: 3947667 - RNA, 14 nt, Shigella flexneri 2a str. 301
gcacuuacuuuccu

SEQ ID NO: 3947668 - RNA, 12 nt, Shigella flexneri 2a str. 301
gcacuucaacuu

SEQ ID NO: 3947669 - RNA, 14 nt, Shigella flexneri 2a str. 301
gcacuuccgcccau

SEQ ID NO: 3947670 - RNA, 18 nt, Shigella flexneri 2a str. 301
gcacuuccgcccaucgca

SEQ ID NO: 3947671 - RNA, 23 nt, Shigella flexneri 2a str. 301
gcacuuccgcccaucgcauaaca

SEQ ID NO: 3947672 - RNA, 15 nt, Shigella flexneri 2a str. 301
gcacuucuuccgggc

SEQ ID NO: 3947673 - RNA, 19 nt, Shigella flexneri 2a str. 301
gcacuucuuccuugaaaug

SEQ ID NO: 3947674 - RNA, 14 nt, Shigella flexneri 2a str. 301
gcacuugcagcucc

SEQ ID NO: 3947675 - RNA, 19 nt, Shigella flexneri 2a str. 301
gcacuugguucgacggcca

SEQ ID NO: 3947676 - RNA, 19 nt, Shigella flexneri 2a str. 301
gcacuuucgccugcggcgc

SEQ ID NO: 3947677 - RNA, 15 nt, Shigella flexneri 2a str. 301
gcagaaaaaccguaa

SEQ ID NO: 3947678 - RNA, 15 nt, Shigella flexneri 2a str. 301
gcagaaaaagaagcc

SEQ ID NO: 3947679 - RNA, 24 nt, Shigella flexneri 2a str. 301
gcagaaaaagagcaucagcagugc

SEQ ID NO: 3947680 - RNA, 17 nt, Shigella flexneri 2a str. 301
gcagaaauaccccgcca

SEQ ID NO: 3947681 - RNA, 22 nt, Shigella flexneri 2a str. 301
gcagaaauaccccgccagcaga

SEQ ID NO: 3947682 - RNA, 13 nt, Shigella flexneri 2a str. 301
gcagaacagaaca

SEQ ID NO: 3947683 - RNA, 20 nt, Shigella flexneri 2a str. 301
gcagaacauaaaaaccugua

SEQ ID NO: 3947684 - RNA, 14 nt, Shigella flexneri 2a str. 301
gcagaacaucagcu

SEQ ID NO: 3947685 - RNA, 12 nt, Shigella flexneri 2a str. 301
gcagaacaucca

SEQ ID NO: 3947686 - RNA, 20 nt, Shigella flexneri 2a str. 301
gcagaacggugcgaccaaac

SEQ ID NO: 3947687 - RNA, 13 nt, Shigella flexneri 2a str. 301
gcagaagcaauca

SEQ ID NO: 3947688 - RNA, 20 nt, Shigella flexneri 2a str. 301
gcagaagcaaucaucccagu

SEQ ID NO: 3947689 - RNA, 23 nt, Shigella flexneri 2a str. 301
gcagaagcgauaaccuucaccgu

SEQ ID NO: 3947690 - RNA, 17 nt, Shigella flexneri 2a str. 301
gcagaagcgcgugcuaa

SEQ ID NO: 3947691 - RNA, 15 nt, Shigella flexneri 2a str. 301
gcagaagcugcagga

SEQ ID NO: 3947692 - RNA, 20 nt, Shigella flexneri 2a str. 301
gcagaaguuguccaugugcu

SEQ ID NO: 3947693 - RNA, 20 nt, Shigella flexneri 2a str. 301
gcagaaugguaacaccagag

SEQ ID NO: 3947694 - RNA, 15 nt, Shigella flexneri 2a str. 301
gcagaaugguuucau

SEQ ID NO: 3947695 - RNA, 13 nt, Shigella flexneri 2a str. 301
gcagacaacccac

SEQ ID NO: 3947696 - RNA, 16 nt, Shigella flexneri 2a str. 301
gcagacaauaucggca

SEQ ID NO: 3947697 - RNA, 14 nt, Shigella flexneri 2a str. 301
gcagacacugcuga

SEQ ID NO: 3947698 - RNA, 14 nt, Shigella flexneri 2a str. 301
gcagacacuuuccc

SEQ ID NO: 3947699 - RNA, 17 nt, Shigella flexneri 2a str. 301
gcagacagccuaccaga

SEQ ID NO: 3947700 - RNA, 20 nt, Shigella flexneri 2a str. 301
gcagacaugacgcccggcaa

SEQ ID NO: 3947701 - RNA, 23 nt, Shigella flexneri 2a str. 301
gcagaccaaacucuucgacaauc

SEQ ID NO: 3947702 - RNA, 19 nt, Shigella flexneri 2a str. 301
gcagaccaauguuacgacc

SEQ ID NO: 3947703 - RNA, 21 nt, Shigella flexneri 2a str. 301
gcagaccugcuuuguucagcc

SEQ ID NO: 3947704 - RNA, 19 nt, Shigella flexneri 2a str. 301
gcagacgccacaaucucac

SEQ ID NO: 3947705 - RNA, 16 nt, Shigella flexneri 2a str. 301
gcagacgcucguuaaa

SEQ ID NO: 3947706 - RNA, 13 nt, Shigella flexneri 2a str. 301
gcagacggcuguc

SEQ ID NO: 3947707 - RNA, 17 nt, Shigella flexneri 2a str. 301
gcagacuggauugccag

SEQ ID NO: 3947708 - RNA, 20 nt, Shigella flexneri 2a str. 301
gcagagaaaauaucccguca

SEQ ID NO: 3947709 - RNA, 23 nt, Shigella flexneri 2a str. 301
gcagagaaaaugccgcacaucac

SEQ ID NO: 3947710 - RNA, 20 nt, Shigella flexneri 2a str. 301
gcagagaaacgccagcagca

SEQ ID NO: 3947711 - RNA, 17 nt, Shigella flexneri 2a str. 301
gcagagauacaggccac

SEQ ID NO: 3947712 - RNA, 20 nt, Shigella flexneri 2a str. 301
gcagagauacaggccaccgc

SEQ ID NO: 3947713 - RNA, 23 nt, Shigella flexneri 2a str. 301
gcagagaucauacagaugcugcu

SEQ ID NO: 3947714 - RNA, 19 nt, Shigella flexneri 2a str. 301
gcagagccugaauaaacgc

SEQ ID NO: 3947715 - RNA, 17 nt, Shigella flexneri 2a str. 301
gcagagucucuggcuuc

SEQ ID NO: 3947716 - RNA, 16 nt, Shigella flexneri 2a str. 301
gcagaguuuccaggcu

SEQ ID NO: 3947717 - RNA, 13 nt, Shigella flexneri 2a str. 301
gcagauaacccag

SEQ ID NO: 3947718 - RNA, 14 nt, Shigella flexneri 2a str. 301
gcagauaacccagc

SEQ ID NO: 3947719 - RNA, 16 nt, Shigella flexneri 2a str. 301
gcagauaacccagcag

SEQ ID NO: 3947720 - RNA, 23 nt, Shigella flexneri 2a str. 301
gcagauaacccagcagcccgagu

SEQ ID NO: 3947721 - RNA, 23 nt, Shigella flexneri 2a str. 301
gcagauaaucguauucuggcuuc

SEQ ID NO: 3947722 - RNA, 21 nt, Shigella flexneri 2a str. 301
gcagauacagccucuuuuuuc

SEQ ID NO: 3947723 - RNA, 17 nt, Shigella flexneri 2a str. 301
gcagauacauugccacc

SEQ ID NO: 3947724 - RNA, 18 nt, Shigella flexneri 2a str. 301
gcagauacauugccacca

SEQ ID NO: 3947725 - RNA, 14 nt, Shigella flexneri 2a str. 301
gcagauagcccgga

SEQ ID NO: 3947726 - RNA, 22 nt, Shigella flexneri 2a str. 301
gcagauauaaaaaauccccggc

SEQ ID NO: 3947727 - RNA, 17 nt, Shigella flexneri 2a str. 301
gcagauaucccgccagc

SEQ ID NO: 3947728 - RNA, 18 nt, Shigella flexneri 2a str. 301
gcagauauucaugcaggc

SEQ ID NO: 3947729 - RNA, 19 nt, Shigella flexneri 2a str. 301
gcagauauucguucagaua

SEQ ID NO: 3947730 - RNA, 14 nt, Shigella flexneri 2a str. 301
gcagauauugcacc

SEQ ID NO: 3947731 - RNA, 15 nt, Shigella flexneri 2a str. 301
gcagauccagugcuc

SEQ ID NO: 3947732 - RNA, 16 nt, Shigella flexneri 2a str. 301
gcagauccugaaauuc

SEQ ID NO: 3947733 - RNA, 18 nt, Shigella flexneri 2a str. 301
gcagauccugaaauuccu

SEQ ID NO: 3947734 - RNA, 14 nt, Shigella flexneri 2a str. 301
gcagauccugauuu

SEQ ID NO: 3947735 - RNA, 16 nt, Shigella flexneri 2a str. 301
gcagaucgaacacggu

SEQ ID NO: 3947736 - RNA, 12 nt, Shigella flexneri 2a str. 301
gcagaucgccaa

SEQ ID NO: 3947737 - RNA, 23 nt, Shigella flexneri 2a str. 301
gcagaucgcggcccaccuggcug

SEQ ID NO: 3947738 - RNA, 16 nt, Shigella flexneri 2a str. 301
gcagaucguuuuccug

SEQ ID NO: 3947739 - RNA, 15 nt, Shigella flexneri 2a str. 301
gcagaugaaaacgcu

SEQ ID NO: 3947740 - RNA, 19 nt, Shigella flexneri 2a str. 301
gcagaugaagcuggcaaag

SEQ ID NO: 3947741 - RNA, 20 nt, Shigella flexneri 2a str. 301
gcagaugaagcuggcaaagu

SEQ ID NO: 3947742 - RNA, 22 nt, Shigella flexneri 2a str. 301
gcagaugacuugccgcaaaacc

SEQ ID NO: 3947743 - RNA, 15 nt, Shigella flexneri 2a str. 301
gcagauuaugccgcu

SEQ ID NO: 3947744 - RNA, 15 nt, Shigella flexneri 2a str. 301
gcagauuaugccuga

SEQ ID NO: 3947745 - RNA, 21 nt, Shigella flexneri 2a str. 301
gcagauucguuugagaauucc

SEQ ID NO: 3947746 - RNA, 19 nt, Shigella flexneri 2a str. 301
gcagcaaccgguaaagaag

SEQ ID NO: 3947747 - RNA, 17 nt, Shigella flexneri 2a str. 301
gcagcaacgaugacauc

SEQ ID NO: 3947748 - RNA, 21 nt, Shigella flexneri 2a str. 301
gcagcaacgaugacaucgcag

SEQ ID NO: 3947749 - RNA, 15 nt, Shigella flexneri 2a str. 301
gcagcaacggcaguu

SEQ ID NO: 3947750 - RNA, 17 nt, Shigella flexneri 2a str. 301
gcagcaacucuuuuucc

SEQ ID NO: 3947751 - RNA, 19 nt, Shigella flexneri 2a str. 301
gcagcaacucuuuuuccug

SEQ ID NO: 3947752 - RNA, 14 nt, Shigella flexneri 2a str. 301
gcagcaagccaucg

SEQ ID NO: 3947753 - RNA, 19 nt, Shigella flexneri 2a str. 301
gcagcaagccaucguuaau

SEQ ID NO: 3947754 - RNA, 21 nt, Shigella flexneri 2a str. 301
gcagcaaggcuauucagcagu

SEQ ID NO: 3947755 - RNA, 23 nt, Shigella flexneri 2a str. 301
gcagcaaggcuauucagcaguuc

SEQ ID NO: 3947756 - RNA, 16 nt, Shigella flexneri 2a str. 301
gcagcaaucacugcca

SEQ ID NO: 3947757 - RNA, 19 nt, Shigella flexneri 2a str. 301
gcagcacccugaguuuuca

SEQ ID NO: 3947758 - RNA, 20 nt, Shigella flexneri 2a str. 301
gcagcacccugaguuuucag

SEQ ID NO: 3947759 - RNA, 20 nt, Shigella flexneri 2a str. 301
gcagcacuacaccccagcgu

SEQ ID NO: 3947760 - RNA, 14 nt, Shigella flexneri 2a str. 301
gcagcacugauaau

SEQ ID NO: 3947761 - RNA, 20 nt, Shigella flexneri 2a str. 301
gcagcagaaagcgacuuugc

SEQ ID NO: 3947762 - RNA, 14 nt, Shigella flexneri 2a str. 301
gcagcagagaaaau

SEQ ID NO: 3947763 - RNA, 19 nt, Shigella flexneri 2a str. 301
gcagcagagaaaauauccc

SEQ ID NO: 3947764 - RNA, 23 nt, Shigella flexneri 2a str. 301
gcagcagccaguuguugauaagc

SEQ ID NO: 3947765 - RNA, 22 nt, Shigella flexneri 2a str. 301
gcagcagccgguauccagcgcg

SEQ ID NO: 3947766 - RNA, 16 nt, Shigella flexneri 2a str. 301
gcaggcaucaucagau

SEQ ID NO: 3947767 - RNA, 14 nt, Shigella flexneri 2a str. 301
gcaggcaucggugc

SEQ ID NO: 3947768 - RNA, 13 nt, Shigella flexneri 2a str. 301
gcaggccggagac

SEQ ID NO: 3947769 - RNA, 20 nt, Shigella flexneri 2a str. 301
gcaggccggguuuucucccu

SEQ ID NO: 3947770 - RNA, 15 nt, Shigella flexneri 2a str. 301
gcaggccguggauca

SEQ ID NO: 3947771 - RNA, 15 nt, Shigella flexneri 2a str. 301
gcaggccugauaagc

SEQ ID NO: 3947772 - RNA, 20 nt, Shigella flexneri 2a str. 301
gcaggccugauaagcgcagc

SEQ ID NO: 3947773 - RNA, 17 nt, Shigella flexneri 2a str. 301
gcaggccuggguaaaaa

SEQ ID NO: 3947774 - RNA, 20 nt, Shigella flexneri 2a str. 301
gcaggcgauccuguucaaac

SEQ ID NO: 3947775 - RNA, 14 nt, Shigella flexneri 2a str. 301
gcaggcgcaauggc

SEQ ID NO: 3947776 - RNA, 17 nt, Shigella flexneri 2a str. 301
gcaggcgcaauggcgca

SEQ ID NO: 3947777 - RNA, 18 nt, Shigella flexneri 2a str. 301
gcaggcgcuuggcuucca

SEQ ID NO: 3947778 - RNA, 18 nt, Shigella flexneri 2a str. 301
gcaggcggauugcuucug

SEQ ID NO: 3947779 - RNA, 15 nt, Shigella flexneri 2a str. 301
gcaggcggcuucgca

SEQ ID NO: 3947780 - RNA, 19 nt, Shigella flexneri 2a str. 301
gcaggcgguggaagcaccu

SEQ ID NO: 3947781 - RNA, 23 nt, Shigella flexneri 2a str. 301
gcaggcuguuaccccugcggccg

SEQ ID NO: 3947782 - RNA, 21 nt, Shigella flexneri 2a str. 301
gcaggcuucaacacaggccgg

SEQ ID NO: 3947783 - RNA, 14 nt, Shigella flexneri 2a str. 301
gcaggcuucaauuu

SEQ ID NO: 3947784 - RNA, 14 nt, Shigella flexneri 2a str. 301
gcagggccaccagc

SEQ ID NO: 3947785 - RNA, 13 nt, Shigella flexneri 2a str. 301
gcaggggcgggga

SEQ ID NO: 3947786 - RNA, 19 nt, Shigella flexneri 2a str. 301
gcaggguggugacaccaug

SEQ ID NO: 3947787 - RNA, 14 nt, Shigella flexneri 2a str. 301
gcagguaaucugcc

SEQ ID NO: 3947788 - RNA, 18 nt, Shigella flexneri 2a str. 301
gcagguacgguacugaaa

SEQ ID NO: 3947789 - RNA, 14 nt, Shigella flexneri 2a str. 301
gcagguacuggaaa

SEQ ID NO: 3947790 - RNA, 14 nt, Shigella flexneri 2a str. 301
gcagguauaccgga

SEQ ID NO: 3947791 - RNA, 13 nt, Shigella flexneri 2a str. 301
gcagguuaccggu

SEQ ID NO: 3947792 - RNA, 17 nt, Shigella flexneri 2a str. 301
gcagguuccacggcaug

SEQ ID NO: 3947793 - RNA, 13 nt, Shigella flexneri 2a str. 301
gcagguuccgcau

SEQ ID NO: 3947794 - RNA, 13 nt, Shigella flexneri 2a str. 301
gcaguaaaccacc

SEQ ID NO: 3947795 - RNA, 16 nt, Shigella flexneri 2a str. 301
gcaguaaaccacccac

SEQ ID NO: 3947796 - RNA, 19 nt, Shigella flexneri 2a str. 301
gcaguaaaccacccaccag

SEQ ID NO: 3947797 - RNA, 21 nt, Shigella flexneri 2a str. 301
gcaguaaaccacccaccagcg

SEQ ID NO: 3947798 - RNA, 22 nt, Shigella flexneri 2a str. 301
gcaguaaaccgucagcaccagg

SEQ ID NO: 3947799 - RNA, 12 nt, Shigella flexneri 2a str. 301
gcaguaaaucgu

SEQ ID NO: 3947800 - RNA, 16 nt, Shigella flexneri 2a str. 301
gcaguacaguaccgaa

SEQ ID NO: 3947801 - RNA, 22 nt, Shigella flexneri 2a str. 301
gcaguagaucuuauaugcgucu

SEQ ID NO: 3947802 - RNA, 12 nt, Shigella flexneri 2a str. 301
gcaguagcugca

SEQ ID NO: 3947803 - RNA, 16 nt, Shigella flexneri 2a str. 301
gcaguaucagagauaa

SEQ ID NO: 3947804 - RNA, 14 nt, Shigella flexneri 2a str. 301
gcagucaacaagca

SEQ ID NO: 3947805 - RNA, 15 nt, Shigella flexneri 2a str. 301
gcagucaccagcauc

SEQ ID NO: 3947806 - RNA, 19 nt, Shigella flexneri 2a str. 301
gcagucaccugcggugcag

SEQ ID NO: 3947807 - RNA, 14 nt, Shigella flexneri 2a str. 301
gcagucaggcgcgc

SEQ ID NO: 3947808 - RNA, 14 nt, Shigella flexneri 2a str. 301
gcagucccuuuccc

SEQ ID NO: 3947809 - RNA, 15 nt, Shigella flexneri 2a str. 301
gcagucgcaacggcu

SEQ ID NO: 3947810 - RNA, 23 nt, Shigella flexneri 2a str. 301
gcagucuggacaaagagcuuuca

SEQ ID NO: 3947811 - RNA, 19 nt, Shigella flexneri 2a str. 301
gcagugaagucgggcagaa

SEQ ID NO: 3947812 - RNA, 14 nt, Shigella flexneri 2a str. 301
gcagugacucacga

SEQ ID NO: 3947813 - RNA, 14 nt, Shigella flexneri 2a str. 301
gcagugcauccagc

SEQ ID NO: 3947814 - RNA, 10 nt, Shigella flexneri 2a str. 301
gcagugccag

SEQ ID NO: 3947815 - RNA, 23 nt, Shigella flexneri 2a str. 301
gcagugccucacgaucacagcag

SEQ ID NO: 3947816 - RNA, 15 nt, Shigella flexneri 2a str. 301
gcaguggauaauaca

SEQ ID NO: 3947817 - RNA, 21 nt, Shigella flexneri 2a str. 301
gcaguggauaauacacuaaca

SEQ ID NO: 3947818 - RNA, 14 nt, Shigella flexneri 2a str. 301
gcaguggcaaccag

SEQ ID NO: 3947819 - RNA, 22 nt, Shigella flexneri 2a str. 301
gcaguggcuaagcaggcuggcu

SEQ ID NO: 3947820 - RNA, 12 nt, Shigella flexneri 2a str. 301
gcaguggcuucg

SEQ ID NO: 3947821 - RNA, 17 nt, Shigella flexneri 2a str. 301
gcagugggccagaaaaa

SEQ ID NO: 3947822 - RNA, 23 nt, Shigella flexneri 2a str. 301
gcaguggguaagccagaccaccc

SEQ ID NO: 3947823 - RNA, 15 nt, Shigella flexneri 2a str. 301
gcaguuaaacgccuu

SEQ ID NO: 3947824 - RNA, 16 nt, Shigella flexneri 2a str. 301
gcaguucccuacucuc

SEQ ID NO: 3947825 - RNA, 12 nt, Shigella flexneri 2a str. 301
gcaguuccugca

SEQ ID NO: 3947826 - RNA, 14 nt, Shigella flexneri 2a str. 301
gcaguucgacaaaa

SEQ ID NO: 3947827 - RNA, 21 nt, Shigella flexneri 2a str. 301
gcaguucgucgcguuugcccg

SEQ ID NO: 3947828 - RNA, 21 nt, Shigella flexneri 2a str. 301
gcaguucugccaggcuggcag

SEQ ID NO: 3947829 - RNA, 18 nt, Shigella flexneri 2a str. 301
gcaguuucauccuucauu

SEQ ID NO: 3947830 - RNA, 15 nt, Shigella flexneri 2a str. 301
gcaguuucugauacu

SEQ ID NO: 3947831 - RNA, 21 nt, Shigella flexneri 2a str. 301
gcaguuugcgguguguggcug

SEQ ID NO: 3947832 - RNA, 24 nt, Shigella flexneri 2a str. 301
gcaguuugguuaagucacgggcag

SEQ ID NO: 3947833 - RNA, 17 nt, Shigella flexneri 2a str. 301
gcaguuuuuccccugcc

SEQ ID NO: 3947834 - RNA, 12 nt, Shigella flexneri 2a str. 301
gcauaaaaauau

SEQ ID NO: 3947835 - RNA, 16 nt, Shigella flexneri 2a str. 301
gcauaaacaaagcgca

SEQ ID NO: 3947836 - RNA, 18 nt, Shigella flexneri 2a str. 301
gcauaaaccacagaccgg

SEQ ID NO: 3947837 - RNA, 13 nt, Shigella flexneri 2a str. 301
gcauaaacgccgu

SEQ ID NO: 3947838 - RNA, 15 nt, Shigella flexneri 2a str. 301
gcauaacagagcgaa

SEQ ID NO: 3947839 - RNA, 14 nt, Shigella flexneri 2a str. 301
gcauaacguaaugc

SEQ ID NO: 3947840 - RNA, 19 nt, Shigella flexneri 2a str. 301
gcauaacguugcagcguuu

SEQ ID NO: 3947841 - RNA, 13 nt, Shigella flexneri 2a str. 301
gcauaaucaccag

SEQ ID NO: 3947842 - RNA, 21 nt, Shigella flexneri 2a str. 301
gcauaaucaccaucagcagca

SEQ ID NO: 3947843 - RNA, 22 nt, Shigella flexneri 2a str. 301
gcauaaucaccaucagcagcaa

SEQ ID NO: 3947844 - RNA, 18 nt, Shigella flexneri 2a str. 301
gcauaauccacuuucuua

SEQ ID NO: 3947845 - RNA, 18 nt, Shigella flexneri 2a str. 301
gcauaauccugccgagau

SEQ ID NO: 3947846 - RNA, 17 nt, Shigella flexneri 2a str. 301
gcauaaucgcaacgccu

SEQ ID NO: 3947847 - RNA, 15 nt, Shigella flexneri 2a str. 301
gcauaaucggcuggg

SEQ ID NO: 3947848 - RNA, 22 nt, Shigella flexneri 2a str. 301
gcauaaucggcuggguuuccgg

SEQ ID NO: 3947849 - RNA, 17 nt, Shigella flexneri 2a str. 301
gcauaaugcagccaucc

SEQ ID NO: 3947850 - RNA, 13 nt, Shigella flexneri 2a str. 301
gcauaaugccuga

SEQ ID NO: 3947851 - RNA, 14 nt, Shigella flexneri 2a str. 301
gcauaaugccugau

SEQ ID NO: 3947852 - RNA, 23 nt, Shigella flexneri 2a str. 301
gcauaaugccugaugcgacgcuu

SEQ ID NO: 3947853 - RNA, 18 nt, Shigella flexneri 2a str. 301
gcauaauuucagcaagac

SEQ ID NO: 3947854 - RNA, 14 nt, Shigella flexneri 2a str. 301
gcauacaaauaagu

SEQ ID NO: 3947855 - RNA, 15 nt, Shigella flexneri 2a str. 301
gcauacaacgccaug

SEQ ID NO: 3947856 - RNA, 16 nt, Shigella flexneri 2a str. 301
gcauacaacgccauga

SEQ ID NO: 3947857 - RNA, 22 nt, Shigella flexneri 2a str. 301
gcauacagccagacaaucgaaa

SEQ ID NO: 3947858 - RNA, 14 nt, Shigella flexneri 2a str. 301
gcauacagccaggu

SEQ ID NO: 3947859 - RNA, 16 nt, Shigella flexneri 2a str. 301
gcauacaugcuuagca

SEQ ID NO: 3947860 - RNA, 17 nt, Shigella flexneri 2a str. 301
gcauacccagaacuauc

SEQ ID NO: 3947861 - RNA, 22 nt, Shigella flexneri 2a str. 301
gcauacccagaacuaucauacu

SEQ ID NO: 3947862 - RNA, 18 nt, Shigella flexneri 2a str. 301
gcauaccggacgacggca

SEQ ID NO: 3947863 - RNA, 13 nt, Shigella flexneri 2a str. 301
gcauaccuucaca

SEQ ID NO: 3947864 - RNA, 19 nt, Shigella flexneri 2a str. 301
gcauaccuucacagaaggc

SEQ ID NO: 3947865 - RNA, 24 nt, Shigella flexneri 2a str. 301
gcauaccuucacagaaggccagga

SEQ ID NO: 3947866 - RNA, 20 nt, Shigella flexneri 2a str. 301
gcauaccuuccagcgcguuc

SEQ ID NO: 3947867 - RNA, 18 nt, Shigella flexneri 2a str. 301
gcaucucgcgcucuucuu

SEQ ID NO: 3947868 - RNA, 16 nt, Shigella flexneri 2a str. 301
gcaucucuacagcgcc

SEQ ID NO: 3947869 - RNA, 12 nt, Shigella flexneri 2a str. 301
gcaucugaaacu

SEQ ID NO: 3947870 - RNA, 14 nt, Shigella flexneri 2a str. 301
gcaucugauaagcc

SEQ ID NO: 3947871 - RNA, 14 nt, Shigella flexneri 2a str. 301
gcaucugcccccgc

SEQ ID NO: 3947872 - RNA, 11 nt, Shigella flexneri 2a str. 301
gcaucuggaug

SEQ ID NO: 3947873 - RNA, 20 nt, Shigella flexneri 2a str. 301
gcaucugguaacccauccag

SEQ ID NO: 3947874 - RNA, 20 nt, Shigella flexneri 2a str. 301
gcaucugguaagugccacac

SEQ ID NO: 3947875 - RNA, 21 nt, Shigella flexneri 2a str. 301
gcaucuguuucgaucagcaau

SEQ ID NO: 3947876 - RNA, 17 nt, Shigella flexneri 2a str. 301
gcaucuuauccagcaac

SEQ ID NO: 3947877 - RNA, 13 nt, Shigella flexneri 2a str. 301
gcaucuuccagcg

SEQ ID NO: 3947878 - RNA, 21 nt, Shigella flexneri 2a str. 301
gcaucuuccguggaacaaaau

SEQ ID NO: 3947879 - RNA, 18 nt, Shigella flexneri 2a str. 301
gcaucuucgcccacggcu

SEQ ID NO: 3947880 - RNA, 20 nt, Shigella flexneri 2a str. 301
gcaucuucgcccacggcuac

SEQ ID NO: 3947881 - RNA, 20 nt, Shigella flexneri 2a str. 301
gcaucuucgcgccaauccag

SEQ ID NO: 3947882 - RNA, 19 nt, Shigella flexneri 2a str. 301
gcaucuucuucuaugccag

SEQ ID NO: 3947883 - RNA, 16 nt, Shigella flexneri 2a str. 301
gcaucuugaacgcaaa

SEQ ID NO: 3947884 - RNA, 16 nt, Shigella flexneri 2a str. 301
gcaugaaagcgaugcu

SEQ ID NO: 3947885 - RNA, 13 nt, Shigella flexneri 2a str. 301
gcaugaaaugaaa

SEQ ID NO: 3947886 - RNA, 15 nt, Shigella flexneri 2a str. 301
gcaugacacacucug

SEQ ID NO: 3947887 - RNA, 13 nt, Shigella flexneri 2a str. 301
gcaugacagcgcc

SEQ ID NO: 3947888 - RNA, 20 nt, Shigella flexneri 2a str. 301
gcaugacuuuguaggccgga

SEQ ID NO: 3947889 - RNA, 15 nt, Shigella flexneri 2a str. 301
gcaugauaagacgcg

SEQ ID NO: 3947890 - RNA, 15 nt, Shigella flexneri 2a str. 301
gcaugaucagcgcau

SEQ ID NO: 3947891 - RNA, 22 nt, Shigella flexneri 2a str. 301
gcaugaugacuugccuccagcg

SEQ ID NO: 3947892 - RNA, 17 nt, Shigella flexneri 2a str. 301
gcaugauuucgucaucc

SEQ ID NO: 3947893 - RNA, 20 nt, Shigella flexneri 2a str. 301
gcaugauuuuguaggccgga

SEQ ID NO: 3947894 - RNA, 15 nt, Shigella flexneri 2a str. 301
gcauggaaauguucc

SEQ ID NO: 3947895 - RNA, 16 nt, Shigella flexneri 2a str. 301
gcauggaucgccgcgg

SEQ ID NO: 3947896 - RNA, 16 nt, Shigella flexneri 2a str. 301
gcauggcaauaaccgc

SEQ ID NO: 3947897 - RNA, 16 nt, Shigella flexneri 2a str. 301
gcauggcaccugcgga

SEQ ID NO: 3947898 - RNA, 17 nt, Shigella flexneri 2a str. 301
gcauggcguccgucauc

SEQ ID NO: 3947899 - RNA, 12 nt, Shigella flexneri 2a str. 301
gcauggggagac

SEQ ID NO: 3947900 - RNA, 14 nt, Shigella flexneri 2a str. 301
gcaugguacccaau

SEQ ID NO: 3947901 - RNA, 14 nt, Shigella flexneri 2a str. 301
gcaugguaccgugu

SEQ ID NO: 3947902 - RNA, 18 nt, Shigella flexneri 2a str. 301
gcaugguuaacuccuucu

SEQ ID NO: 3947903 - RNA, 22 nt, Shigella flexneri 2a str. 301
gcaugguuccggcuuaaugcau

SEQ ID NO: 3947904 - RNA, 14 nt, Shigella flexneri 2a str. 301
gcauguagaugccg

SEQ ID NO: 3947905 - RNA, 14 nt, Shigella flexneri 2a str. 301
gcauguggcggcgc

SEQ ID NO: 3947906 - RNA, 12 nt, Shigella flexneri 2a str. 301
gcauguguaacc

SEQ ID NO: 3947907 - RNA, 14 nt, Shigella flexneri 2a str. 301
gcauguucagcuuu

SEQ ID NO: 3947908 - RNA, 19 nt, Shigella flexneri 2a str. 301
gcauguuccaguucgcgca

SEQ ID NO: 3947909 - RNA, 19 nt, Shigella flexneri 2a str. 301
gcauuaaaaacccgccaug

SEQ ID NO: 3947910 - RNA, 13 nt, Shigella flexneri 2a str. 301
gcauuaaacgcau

SEQ ID NO: 3947911 - RNA, 14 nt, Shigella flexneri 2a str. 301
gcauuaaccagucg

SEQ ID NO: 3947912 - RNA, 15 nt, Shigella flexneri 2a str. 301
gcauuaaccagucgg

SEQ ID NO: 3947913 - RNA, 18 nt, Shigella flexneri 2a str. 301
gcauuaaggcaagaaaau

SEQ ID NO: 3947914 - RNA, 20 nt, Shigella flexneri 2a str. 301
gcauuaaggcaagaaaauua

SEQ ID NO: 3947915 - RNA, 19 nt, Shigella flexneri 2a str. 301
gcauuaagggugaucagcc

SEQ ID NO: 3947916 - RNA, 17 nt, Shigella flexneri 2a str. 301
gcauuaauacaccgcug

SEQ ID NO: 3947917 - RNA, 18 nt, Shigella flexneri 2a str. 301
gcauuaaugcgcccagcg

SEQ ID NO: 3947918 - RNA, 21 nt, Shigella flexneri 2a str. 301
gcauuacgcucacugcaaaac

SEQ ID NO: 3947919 - RNA, 13 nt, Shigella flexneri 2a str. 301
gcauuacuacggu

SEQ ID NO: 3947920 - RNA, 21 nt, Shigella flexneri 2a str. 301
gcauuacugcuaucugccaga

SEQ ID NO: 3947921 - RNA, 22 nt, Shigella flexneri 2a str. 301
gcauuaggugcucaaugccuga

SEQ ID NO: 3947922 - RNA, 23 nt, Shigella flexneri 2a str. 301
gcauuaugagauugagcgauuua

SEQ ID NO: 3947923 - RNA, 23 nt, Shigella flexneri 2a str. 301
gcauucacgggcggcggcuuuca

SEQ ID NO: 3947924 - RNA, 21 nt, Shigella flexneri 2a str. 301
gcauucagacacgccgccaga

SEQ ID NO: 3947925 - RNA, 20 nt, Shigella flexneri 2a str. 301
gcauucagcaaggggcugau

SEQ ID NO: 3947926 - RNA, 20 nt, Shigella flexneri 2a str. 301
gcauucagugcaaaugccag

SEQ ID NO: 3947927 - RNA, 23 nt, Shigella flexneri 2a str. 301
gcauucagugcaaaugccagaua

SEQ ID NO: 3947928 - RNA, 17 nt, Shigella flexneri 2a str. 301
gcauucccgccagcggc

SEQ ID NO: 3947929 - RNA, 15 nt, Shigella flexneri 2a str. 301
gcauucgacauugaa

SEQ ID NO: 3947930 - RNA, 15 nt, Shigella flexneri 2a str. 301
gcauucgaguaacgu

SEQ ID NO: 3947931 - RNA, 16 nt, Shigella flexneri 2a str. 301
gcauucggugcucaau

SEQ ID NO: 3947932 - RNA, 23 nt, Shigella flexneri 2a str. 301
gcauucgucguauagaucacuuu

SEQ ID NO: 3947933 - RNA, 14 nt, Shigella flexneri 2a str. 301
gcauucucaucacc

SEQ ID NO: 3947934 - RNA, 16 nt, Shigella flexneri 2a str. 301
gcauucugcuggccug

SEQ ID NO: 3947935 - RNA, 18 nt, Shigella flexneri 2a str. 301
gcauucugcuggccuggc

SEQ ID NO: 3947936 - RNA, 22 nt, Shigella flexneri 2a str. 301
gcauucugcuggccuggcuggu

SEQ ID NO: 3947937 - RNA, 16 nt, Shigella flexneri 2a str. 301
gcauucuuuuucauua

SEQ ID NO: 3947938 - RNA, 20 nt, Shigella flexneri 2a str. 301
gcauugaacucuucuuccgg

SEQ ID NO: 3947939 - RNA, 13 nt, Shigella flexneri 2a str. 301
gcauugacaagcu

SEQ ID NO: 3947940 - RNA, 19 nt, Shigella flexneri 2a str. 301
gcauugacgccaaaauaac

SEQ ID NO: 3947941 - RNA, 14 nt, Shigella flexneri 2a str. 301
gcauugauaauguu

SEQ ID NO: 3947942 - RNA, 21 nt, Shigella flexneri 2a str. 301
gcauugcauuucgcuaccacc

SEQ ID NO: 3947943 - RNA, 16 nt, Shigella flexneri 2a str. 301
gcauugcgccugcagg

SEQ ID NO: 3947944 - RNA, 15 nt, Shigella flexneri 2a str. 301
gcauugcuaaugcug

SEQ ID NO: 3947945 - RNA, 19 nt, Shigella flexneri 2a str. 301
gcauugcucacuuccuuuu

SEQ ID NO: 3947946 - RNA, 17 nt, Shigella flexneri 2a str. 301
gcauuggagacugauga

SEQ ID NO: 3947947 - RNA, 13 nt, Shigella flexneri 2a str. 301
gcauuggcaaauu

SEQ ID NO: 3947948 - RNA, 14 nt, Shigella flexneri 2a str. 301
gcauugguugcugg

SEQ ID NO: 3947949 - RNA, 18 nt, Shigella flexneri 2a str. 301
gcauugguugcuggaaag

SEQ ID NO: 3947950 - RNA, 17 nt, Shigella flexneri 2a str. 301
gcauuguugaaaacgcg

SEQ ID NO: 3947951 - RNA, 19 nt, Shigella flexneri 2a str. 301
gcauuguuugcaaaaucaa

SEQ ID NO: 3947952 - RNA, 11 nt, Shigella flexneri 2a str. 301
gcauuuacucu

SEQ ID NO: 3947953 - RNA, 20 nt, Shigella flexneri 2a str. 301
gcauuuauggugcuaguuau

SEQ ID NO: 3947954 - RNA, 13 nt, Shigella flexneri 2a str. 301
gcauuuccauaaa

SEQ ID NO: 3947955 - RNA, 19 nt, Shigella flexneri 2a str. 301
gcauuuccgccaaucaaga

SEQ ID NO: 3947956 - RNA, 17 nt, Shigella flexneri 2a str. 301
gcauuuccgcugauuca

SEQ ID NO: 3947957 - RNA, 18 nt, Shigella flexneri 2a str. 301
gcauuuccgcugauucaa

SEQ ID NO: 3947958 - RNA, 23 nt, Shigella flexneri 2a str. 301
gcauuucgguauaaauaaacccu

SEQ ID NO: 3947959 - RNA, 17 nt, Shigella flexneri 2a str. 301
gcauuucgucuucauca

SEQ ID NO: 3947960 - RNA, 23 nt, Shigella flexneri 2a str. 301
gcauuucucacuuuucaccgcuu

SEQ ID NO: 3947961 - RNA, 15 nt, Shigella flexneri 2a str. 301
gcauuucugcgcaac

SEQ ID NO: 3947962 - RNA, 16 nt, Shigella flexneri 2a str. 301
gcauuugcaccgauug

SEQ ID NO: 3947963 - RNA, 18 nt, Shigella flexneri 2a str. 301
gcauuugcuccagacgcc

SEQ ID NO: 3947964 - RNA, 23 nt, Shigella flexneri 2a str. 301
gcauuugcuccagacgccagaug

SEQ ID NO: 3947965 - RNA, 23 nt, Shigella flexneri 2a str. 301
gcauuuggacacccuugccggau

SEQ ID NO: 3947966 - RNA, 16 nt, Shigella flexneri 2a str. 301
gcauuuguaggcagga

SEQ ID NO: 3947967 - RNA, 12 nt, Shigella flexneri 2a str. 301
gccaccugugca

SEQ ID NO: 3947968 - RNA, 14 nt, Shigella flexneri 2a str. 301
gccaccuuucuguu

SEQ ID NO: 3947969 - RNA, 22 nt, Shigella flexneri 2a str. 301
gccaccuuucuguuccauaauc

SEQ ID NO: 3947970 - RNA, 19 nt, Shigella flexneri 2a str. 301
gccacgaugauagccauua

SEQ ID NO: 3947971 - RNA, 23 nt, Shigella flexneri 2a str. 301
gccacgcacgccugcaucucuuc

SEQ ID NO: 3947972 - RNA, 19 nt, Shigella flexneri 2a str. 301
gccacgccacagccgagcg

SEQ ID NO: 3947973 - RNA, 15 nt, Shigella flexneri 2a str. 301
gccacgccacgcugc

SEQ ID NO: 3947974 - RNA, 20 nt, Shigella flexneri 2a str. 301
gccacgccuguaccagcggc

SEQ ID NO: 3947975 - RNA, 13 nt, Shigella flexneri 2a str. 301
gccacgcgucguc

SEQ ID NO: 3947976 - RNA, 21 nt, Shigella flexneri 2a str. 301
gccacgcguuugggccaaugc

SEQ ID NO: 3947977 - RNA, 15 nt, Shigella flexneri 2a str. 301
gccacgcugccgcgc

SEQ ID NO: 3947978 - RNA, 20 nt, Shigella flexneri 2a str. 301
gccacgcugccgcgcaggga

SEQ ID NO: 3947979 - RNA, 14 nt, Shigella flexneri 2a str. 301
gccacgcuggcccg

SEQ ID NO: 3947980 - RNA, 15 nt, Shigella flexneri 2a str. 301
gccacgcuucaaucu

SEQ ID NO: 3947981 - RNA, 14 nt, Shigella flexneri 2a str. 301
gccacggcgcagcu

SEQ ID NO: 3947982 - RNA, 15 nt, Shigella flexneri 2a str. 301
gccacgguauuugcc

SEQ ID NO: 3947983 - RNA, 19 nt, Shigella flexneri 2a str. 301
gccacguacauuaaacgcc

SEQ ID NO: 3947984 - RNA, 14 nt, Shigella flexneri 2a str. 301
gccacuaucgccau

SEQ ID NO: 3947985 - RNA, 22 nt, Shigella flexneri 2a str. 301
gccacucugacggcgcauccga

SEQ ID NO: 3947986 - RNA, 17 nt, Shigella flexneri 2a str. 301
gccacugcccgagaaca

SEQ ID NO: 3947987 - RNA, 13 nt, Shigella flexneri 2a str. 301
gccacugcgccau

SEQ ID NO: 3947988 - RNA, 14 nt, Shigella flexneri 2a str. 301
gccacugcggcuuu

SEQ ID NO: 3947989 - RNA, 13 nt, Shigella flexneri 2a str. 301
gccacuggcuggg

SEQ ID NO: 3947990 - RNA, 17 nt, Shigella flexneri 2a str. 301
gccacuguuccggagaa

SEQ ID NO: 3947991 - RNA, 21 nt, Shigella flexneri 2a str. 301
gccacuucggugcgguuacgu

SEQ ID NO: 3947992 - RNA, 17 nt, Shigella flexneri 2a str. 301
gccacuucuguuacucc

SEQ ID NO: 3947993 - RNA, 14 nt, Shigella flexneri 2a str. 301
gccacuucuuccag

SEQ ID NO: 3947994 - RNA, 18 nt, Shigella flexneri 2a str. 301
gccacuucuuccagcggc

SEQ ID NO: 3947995 - RNA, 23 nt, Shigella flexneri 2a str. 301
gccacuucuuccagcggcaggcc

SEQ ID NO: 3947996 - RNA, 18 nt, Shigella flexneri 2a str. 301
gccacuuucacgccgcca

SEQ ID NO: 3947997 - RNA, 21 nt, Shigella flexneri 2a str. 301
gccacuuuccuuagaagcacu

SEQ ID NO: 3947998 - RNA, 14 nt, Shigella flexneri 2a str. 301
gccacuuucggcag

SEQ ID NO: 3947999 - RNA, 16 nt, Shigella flexneri 2a str. 301
gccagaaaaaacguug

SEQ ID NO: 3948000 - RNA, 18 nt, Shigella flexneri 2a str. 301
gccagaaaaccuggcgca

SEQ ID NO: 3948001 - RNA, 16 nt, Shigella flexneri 2a str. 301
gccagaaacagugacc

SEQ ID NO: 3948002 - RNA, 21 nt, Shigella flexneri 2a str. 301
gccagaaaguacggccacugg

SEQ ID NO: 3948003 - RNA, 21 nt, Shigella flexneri 2a str. 301
gccagaaauccaggcccgcau

SEQ ID NO: 3948004 - RNA, 18 nt, Shigella flexneri 2a str. 301
gccagaaauggcccaaaa

SEQ ID NO: 3948005 - RNA, 21 nt, Shigella flexneri 2a str. 301
gccagaaauggcccaaaaggc

SEQ ID NO: 3948006 - RNA, 21 nt, Shigella flexneri 2a str. 301
gccagaacagcuacagcauca

SEQ ID NO: 3948007 - RNA, 23 nt, Shigella flexneri 2a str. 301
gccagaacugauaacgcauuuca

SEQ ID NO: 3948008 - RNA, 17 nt, Shigella flexneri 2a str. 301
gccagaauagccgcagc

SEQ ID NO: 3948009 - RNA, 14 nt, Shigella flexneri 2a str. 301
gccagaauagcgcc

SEQ ID NO: 3948010 - RNA, 14 nt, Shigella flexneri 2a str. 301
gccagaaucaccuc

SEQ ID NO: 3948011 - RNA, 23 nt, Shigella flexneri 2a str. 301
gccagaaucaccucuuuuuccac

SEQ ID NO: 3948012 - RNA, 15 nt, Shigella flexneri 2a str. 301
gccagacaaaccacg

SEQ ID NO: 3948013 - RNA, 17 nt, Shigella flexneri 2a str. 301
gccagacaaaccacgcc

SEQ ID NO: 3948014 - RNA, 16 nt, Shigella flexneri 2a str. 301
gccagacauuauaaau

SEQ ID NO: 3948015 - RNA, 17 nt, Shigella flexneri 2a str. 301
gccagaccaaacagcau

SEQ ID NO: 3948016 - RNA, 12 nt, Shigella flexneri 2a str. 301
gccagaccacug

SEQ ID NO: 3948017 - RNA, 14 nt, Shigella flexneri 2a str. 301
gccagaccacugcg

SEQ ID NO: 3948018 - RNA, 19 nt, Shigella flexneri 2a str. 301
gccagaccacugcgccgcu

SEQ ID NO: 3948019 - RNA, 19 nt, Shigella flexneri 2a str. 301
gccagaccuccguuuuucu

SEQ ID NO: 3948020 - RNA, 17 nt, Shigella flexneri 2a str. 301
gccagaccuuaucacaa

SEQ ID NO: 3948021 - RNA, 13 nt, Shigella flexneri 2a str. 301
gccagacucgcca

SEQ ID NO: 3948022 - RNA, 15 nt, Shigella flexneri 2a str. 301
gccagagaagcgacu

SEQ ID NO: 3948023 - RNA, 16 nt, Shigella flexneri 2a str. 301
gccagagagaacugcg

SEQ ID NO: 3948024 - RNA, 16 nt, Shigella flexneri 2a str. 301
gccagagcagcaacaa

SEQ ID NO: 3948025 - RNA, 19 nt, Shigella flexneri 2a str. 301
gccagagcagcaacaagcc

SEQ ID NO: 3948026 - RNA, 18 nt, Shigella flexneri 2a str. 301
gccagagcaucaguuaac

SEQ ID NO: 3948027 - RNA, 16 nt, Shigella flexneri 2a str. 301
gccagagcccaucaca

SEQ ID NO: 3948028 - RNA, 20 nt, Shigella flexneri 2a str. 301
gccagaggagccaucaccau

SEQ ID NO: 3948029 - RNA, 17 nt, Shigella flexneri 2a str. 301
gccagagugcguucacc

SEQ ID NO: 3948030 - RNA, 17 nt, Shigella flexneri 2a str. 301
gccagauaauggcuguu

SEQ ID NO: 3948031 - RNA, 18 nt, Shigella flexneri 2a str. 301
gccagauacaucagcgac

SEQ ID NO: 3948032 - RNA, 19 nt, Shigella flexneri 2a str. 301
gccagauacaucagcgaca

SEQ ID NO: 3948033 - RNA, 15 nt, Shigella flexneri 2a str. 301
gccagauagauugcg

SEQ ID NO: 3948034 - RNA, 16 nt, Shigella flexneri 2a str. 301
gccagauaguucgcga

SEQ ID NO: 3948035 - RNA, 21 nt, Shigella flexneri 2a str. 301
gccagaucgccugccgccagu

SEQ ID NO: 3948036 - RNA, 20 nt, Shigella flexneri 2a str. 301
gccagaucggccaucaguac

SEQ ID NO: 3948037 - RNA, 14 nt, Shigella flexneri 2a str. 301
gccagaugcagcgg

SEQ ID NO: 3948038 - RNA, 12 nt, Shigella flexneri 2a str. 301
gccagaugcgac

SEQ ID NO: 3948039 - RNA, 14 nt, Shigella flexneri 2a str. 301
gccagaugcggcgu

SEQ ID NO: 3948040 - RNA, 17 nt, Shigella flexneri 2a str. 301
gccagaugcggcgugaa

SEQ ID NO: 3948041 - RNA, 12 nt, Shigella flexneri 2a str. 301
gccagaugggau

SEQ ID NO: 3948042 - RNA, 18 nt, Shigella flexneri 2a str. 301
gccagauguugucucaga

SEQ ID NO: 3948043 - RNA, 22 nt, Shigella flexneri 2a str. 301
gccagauguugucucagcuuca

SEQ ID NO: 3948044 - RNA, 22 nt, Shigella flexneri 2a str. 301
gccagcaaaaucaccaucacaa

SEQ ID NO: 3948045 - RNA, 23 nt, Shigella flexneri 2a str. 301
gccagcaaaaugcauaaccgcag

SEQ ID NO: 3948046 - RNA, 17 nt, Shigella flexneri 2a str. 301
gccagcaacugacugac

SEQ ID NO: 3948047 - RNA, 22 nt, Shigella flexneri 2a str. 301
gccagcaagagcaaauaaaaca

SEQ ID NO: 3948048 - RNA, 18 nt, Shigella flexneri 2a str. 301
gccagcaaggcgcuaaaa

SEQ ID NO: 3948049 - RNA, 15 nt, Shigella flexneri 2a str. 301
gccagcaauccccag

SEQ ID NO: 3948050 - RNA, 18 nt, Shigella flexneri 2a str. 301
gccagcaauccccagaca

SEQ ID NO: 3948051 - RNA, 14 nt, Shigella flexneri 2a str. 301
gccagcaccagcaa

SEQ ID NO: 3948052 - RNA, 18 nt, Shigella flexneri 2a str. 301
gccagcacgaccgccauu

SEQ ID NO: 3948053 - RNA, 15 nt, Shigella flexneri 2a str. 301
gccagcagagcaaaa

SEQ ID NO: 3948054 - RNA, 22 nt, Shigella flexneri 2a str. 301
gccagcagagggauaucuuccc

SEQ ID NO: 3948055 - RNA, 14 nt, Shigella flexneri 2a str. 301
gccagcagcagcgu

SEQ ID NO: 3948056 - RNA, 18 nt, Shigella flexneri 2a str. 301
gccagcagcgaaucagcc

SEQ ID NO: 3948057 - RNA, 23 nt, Shigella flexneri 2a str. 301
gccagcagcgaaucagcccagcc

SEQ ID NO: 3948058 - RNA, 11 nt, Shigella flexneri 2a str. 301
gccagcaggaa

SEQ ID NO: 3948059 - RNA, 20 nt, Shigella flexneri 2a str. 301
gccagcagggcaaacagcac

SEQ ID NO: 3948060 - RNA, 21 nt, Shigella flexneri 2a str. 301
gccagcauaaucaccaucagc

SEQ ID NO: 3948061 - RNA, 23 nt, Shigella flexneri 2a str. 301
gccagcauaaucaccaucagcag

SEQ ID NO: 3948062 - RNA, 17 nt, Shigella flexneri 2a str. 301
gccagcaugcauaacag

SEQ ID NO: 3948063 - RNA, 22 nt, Shigella flexneri 2a str. 301
gccagcauuggcguuugaccaa

SEQ ID NO: 3948064 - RNA, 16 nt, Shigella flexneri 2a str. 301
gccagccacaggcuuu

SEQ ID NO: 3948065 - RNA, 11 nt, Shigella flexneri 2a str. 301
gccagccagaa

SEQ ID NO: 3948066 - RNA, 19 nt, Shigella flexneri 2a str. 301
gccagccauccgucaucca

SEQ ID NO: 3948067 - RNA, 19 nt, Shigella flexneri 2a str. 301
gccauauguguuugugcug

SEQ ID NO: 3948068 - RNA, 16 nt, Shigella flexneri 2a str. 301
gccauauucgcuuuca

SEQ ID NO: 3948069 - RNA, 19 nt, Shigella flexneri 2a str. 301
gccauauuguuucaacaca

SEQ ID NO: 3948070 - RNA, 17 nt, Shigella flexneri 2a str. 301
gccauauuuaaagaaga

SEQ ID NO: 3948071 - RNA, 18 nt, Shigella flexneri 2a str. 301
gccauauuuaaagaagag

SEQ ID NO: 3948072 - RNA, 15 nt, Shigella flexneri 2a str. 301
gccauauuucuccau

SEQ ID NO: 3948073 - RNA, 18 nt, Shigella flexneri 2a str. 301
gccauauuucuccauuag

SEQ ID NO: 3948074 - RNA, 18 nt, Shigella flexneri 2a str. 301
gccaucaaauagccccug

SEQ ID NO: 3948075 - RNA, 24 nt, Shigella flexneri 2a str. 301
gccaucaaauagccccugacuggu

SEQ ID NO: 3948076 - RNA, 20 nt, Shigella flexneri 2a str. 301
gccaucaaucacuuugcgcu

SEQ ID NO: 3948077 - RNA, 16 nt, Shigella flexneri 2a str. 301
gccaucaaucccaucu

SEQ ID NO: 3948078 - RNA, 21 nt, Shigella flexneri 2a str. 301
gccaucaauugcucacucccg

SEQ ID NO: 3948079 - RNA, 21 nt, Shigella flexneri 2a str. 301
gccaucaccaucguugcuaac

SEQ ID NO: 3948080 - RNA, 13 nt, Shigella flexneri 2a str. 301
gccaucagcagcg

SEQ ID NO: 3948081 - RNA, 23 nt, Shigella flexneri 2a str. 301
gccaucagggcggccgccagaaa

SEQ ID NO: 3948082 - RNA, 12 nt, Shigella flexneri 2a str. 301
gccaucauacga

SEQ ID NO: 3948083 - RNA, 15 nt, Shigella flexneri 2a str. 301
gccaucauccauucg

SEQ ID NO: 3948084 - RNA, 18 nt, Shigella flexneri 2a str. 301
gccaucaucccuacaggu

SEQ ID NO: 3948085 - RNA, 23 nt, Shigella flexneri 2a str. 301
gccaucaucccuacagguaaggu

SEQ ID NO: 3948086 - RNA, 17 nt, Shigella flexneri 2a str. 301
gccauccaccagugacu

SEQ ID NO: 3948087 - RNA, 17 nt, Shigella flexneri 2a str. 301
gccauccagugaaacgc

SEQ ID NO: 3948088 - RNA, 23 nt, Shigella flexneri 2a str. 301
gccauccauaauuacgcuguuca

SEQ ID NO: 3948089 - RNA, 22 nt, Shigella flexneri 2a str. 301
gccaucccuaccgcccgcgcgg

SEQ ID NO: 3948090 - RNA, 13 nt, Shigella flexneri 2a str. 301
gccauccgcguga

SEQ ID NO: 3948091 - RNA, 21 nt, Shigella flexneri 2a str. 301
gccauccgcgugacgcuggca

SEQ ID NO: 3948092 - RNA, 20 nt, Shigella flexneri 2a str. 301
gccauccgcugcgguaaggu

SEQ ID NO: 3948093 - RNA, 16 nt, Shigella flexneri 2a str. 301
gccauccgucauccau

SEQ ID NO: 3948094 - RNA, 19 nt, Shigella flexneri 2a str. 301
gccauccgucauccauacc

SEQ ID NO: 3948095 - RNA, 16 nt, Shigella flexneri 2a str. 301
gccauccuuacgcagc

SEQ ID NO: 3948096 - RNA, 21 nt, Shigella flexneri 2a str. 301
gccaucgacaacgccauauaa

SEQ ID NO: 3948097 - RNA, 19 nt, Shigella flexneri 2a str. 301
gccaucgaguaccccuugu

SEQ ID NO: 3948098 - RNA, 18 nt, Shigella flexneri 2a str. 301
gccaucgccacaccagua

SEQ ID NO: 3948099 - RNA, 15 nt, Shigella flexneri 2a str. 301
gccaucgccagcagc

SEQ ID NO: 3948100 - RNA, 22 nt, Shigella flexneri 2a str. 301
gccaucgccaggaacaacgaca

SEQ ID NO: 3948101 - RNA, 19 nt, Shigella flexneri 2a str. 301
gccaucgccugaucgccau

SEQ ID NO: 3948102 - RNA, 20 nt, Shigella flexneri 2a str. 301
gccaucgcguugucauacga

SEQ ID NO: 3948103 - RNA, 23 nt, Shigella flexneri 2a str. 301
gccaucgggaugccauuugccag

SEQ ID NO: 3948104 - RNA, 17 nt, Shigella flexneri 2a str. 301
gccaucugcagggcauc

SEQ ID NO: 3948105 - RNA, 21 nt, Shigella flexneri 2a str. 301
gccaucugccagcaagcgcac

SEQ ID NO: 3948106 - RNA, 15 nt, Shigella flexneri 2a str. 301
gccaucugccgauac

SEQ ID NO: 3948107 - RNA, 17 nt, Shigella flexneri 2a str. 301
gccaucuuucgcagauu

SEQ ID NO: 3948108 - RNA, 18 nt, Shigella flexneri 2a str. 301
gccaugaccgcuccgcca

SEQ ID NO: 3948109 - RNA, 15 nt, Shigella flexneri 2a str. 301
gccaugacuuucugg

SEQ ID NO: 3948110 - RNA, 23 nt, Shigella flexneri 2a str. 301
gccaugcaccugcuuccugaacu

SEQ ID NO: 3948111 - RNA, 12 nt, Shigella flexneri 2a str. 301
gccaugcauauc

SEQ ID NO: 3948112 - RNA, 17 nt, Shigella flexneri 2a str. 301
gccaugcccgugcugac

SEQ ID NO: 3948113 - RNA, 22 nt, Shigella flexneri 2a str. 301
gccaugcguuuuaccgccucgc

SEQ ID NO: 3948114 - RNA, 22 nt, Shigella flexneri 2a str. 301
gccaugcuuugcaucccagaaa

SEQ ID NO: 3948115 - RNA, 21 nt, Shigella flexneri 2a str. 301
gccauggcugcgauaguggaa

SEQ ID NO: 3948116 - RNA, 22 nt, Shigella flexneri 2a str. 301
gccaugguuugggcguuacagc

SEQ ID NO: 3948117 - RNA, 14 nt, Shigella flexneri 2a str. 301
gccauguuccagug

SEQ ID NO: 3948118 - RNA, 17 nt, Shigella flexneri 2a str. 301
gccauguuuaccaucug

SEQ ID NO: 3948119 - RNA, 20 nt, Shigella flexneri 2a str. 301
gccauguuuaccaucugcgc

SEQ ID NO: 3948120 - RNA, 21 nt, Shigella flexneri 2a str. 301
gccauguuuaccaucugcgcc

SEQ ID NO: 3948121 - RNA, 12 nt, Shigella flexneri 2a str. 301
gccauuaaacaa

SEQ ID NO: 3948122 - RNA, 13 nt, Shigella flexneri 2a str. 301
gccauuaaacgca

SEQ ID NO: 3948123 - RNA, 16 nt, Shigella flexneri 2a str. 301
gccauucacucuuuaa

SEQ ID NO: 3948124 - RNA, 15 nt, Shigella flexneri 2a str. 301
gccauugaccagcug

SEQ ID NO: 3948125 - RNA, 22 nt, Shigella flexneri 2a str. 301
gccauuggcauaaauaauaaga

SEQ ID NO: 3948126 - RNA, 12 nt, Shigella flexneri 2a str. 301
gccauuggcuuu

SEQ ID NO: 3948127 - RNA, 12 nt, Shigella flexneri 2a str. 301
gccauuuccagc

SEQ ID NO: 3948128 - RNA, 15 nt, Shigella flexneri 2a str. 301
gccauuuccagcgcu

SEQ ID NO: 3948129 - RNA, 18 nt, Shigella flexneri 2a str. 301
gccauuuccagcgcuuuc

SEQ ID NO: 3948130 - RNA, 20 nt, Shigella flexneri 2a str. 301
gccauuuccccaaucuucuc

SEQ ID NO: 3948131 - RNA, 14 nt, Shigella flexneri 2a str. 301
gccauuugauucac

SEQ ID NO: 3948132 - RNA, 12 nt, Shigella flexneri 2a str. 301
gccauuugccag

SEQ ID NO: 3948133 - RNA, 13 nt, Shigella flexneri 2a str. 301
gccauuuuaauca

SEQ ID NO: 3948134 - RNA, 17 nt, Shigella flexneri 2a str. 301
gccauuuugcaacgcuu

SEQ ID NO: 3948135 - RNA, 18 nt, Shigella flexneri 2a str. 301
gccauuuugcacauucca

SEQ ID NO: 3948136 - RNA, 16 nt, Shigella flexneri 2a str. 301
gccauuuugcgcggca

SEQ ID NO: 3948137 - RNA, 15 nt, Shigella flexneri 2a str. 301
gccauuuuucagacg

SEQ ID NO: 3948138 - RNA, 12 nt, Shigella flexneri 2a str. 301
gcccaaaccacc

SEQ ID NO: 3948139 - RNA, 20 nt, Shigella flexneri 2a str. 301
gcccaaaccacccagcagcg

SEQ ID NO: 3948140 - RNA, 18 nt, Shigella flexneri 2a str. 301
gcccaacaguagacaauu

SEQ ID NO: 3948141 - RNA, 23 nt, Shigella flexneri 2a str. 301
gcccaaccacggaguugaccagc

SEQ ID NO: 3948142 - RNA, 22 nt, Shigella flexneri 2a str. 301
gcccaacgcauaaucuguuuca

SEQ ID NO: 3948143 - RNA, 13 nt, Shigella flexneri 2a str. 301
gcccaacuguuga

SEQ ID NO: 3948144 - RNA, 15 nt, Shigella flexneri 2a str. 301
gcccaacuguugauc

SEQ ID NO: 3948145 - RNA, 21 nt, Shigella flexneri 2a str. 301
gcccaacuguugauccaggag

SEQ ID NO: 3948146 - RNA, 17 nt, Shigella flexneri 2a str. 301
gcccaaucaucgcggca

SEQ ID NO: 3948147 - RNA, 19 nt, Shigella flexneri 2a str. 301
gcccaaucaucgcggcaca

SEQ ID NO: 3948148 - RNA, 16 nt, Shigella flexneri 2a str. 301
gcccacaccagucagc

SEQ ID NO: 3948149 - RNA, 20 nt, Shigella flexneri 2a str. 301
gcccacaccagucagcgaac

SEQ ID NO: 3948150 - RNA, 21 nt, Shigella flexneri 2a str. 301
gcccacaucaacucugcaaug

SEQ ID NO: 3948151 - RNA, 13 nt, Shigella flexneri 2a str. 301
gcccaccaccagc

SEQ ID NO: 3948152 - RNA, 17 nt, Shigella flexneri 2a str. 301
gcccaccuacaccggca

SEQ ID NO: 3948153 - RNA, 18 nt, Shigella flexneri 2a str. 301
gcccacgccgcccagaga

SEQ ID NO: 3948154 - RNA, 23 nt, Shigella flexneri 2a str. 301
gcccacgcgcauucccagcgcgu

SEQ ID NO: 3948155 - RNA, 20 nt, Shigella flexneri 2a str. 301
gcccacggcguggcaucaau

SEQ ID NO: 3948156 - RNA, 23 nt, Shigella flexneri 2a str. 301
gcccacggcuaccguugcggcgu

SEQ ID NO: 3948157 - RNA, 13 nt, Shigella flexneri 2a str. 301
gcccacuccagcu

SEQ ID NO: 3948158 - RNA, 16 nt, Shigella flexneri 2a str. 301
gcccacuuucugcgca

SEQ ID NO: 3948159 - RNA, 17 nt, Shigella flexneri 2a str. 301
gcccacuuucugcgcaa

SEQ ID NO: 3948160 - RNA, 14 nt, Shigella flexneri 2a str. 301
gcccagaccagaau

SEQ ID NO: 3948161 - RNA, 17 nt, Shigella flexneri 2a str. 301
gcccagaccccagcucu

SEQ ID NO: 3948162 - RNA, 21 nt, Shigella flexneri 2a str. 301
gcccagcaaaaagcgggcgac

SEQ ID NO: 3948163 - RNA, 13 nt, Shigella flexneri 2a str. 301
gcccagccaguca

SEQ ID NO: 3948164 - RNA, 16 nt, Shigella flexneri 2a str. 301
gcccagcccccagcau

SEQ ID NO: 3948165 - RNA, 22 nt, Shigella flexneri 2a str. 301
gcccagccgaagggaaagagcg

SEQ ID NO: 3948166 - RNA, 19 nt, Shigella flexneri 2a str. 301
gcccggcaugacgccgggc

SEQ ID NO: 3948167 - RNA, 24 nt, Shigella flexneri 2a str. 301
gcccggcauucaccucugcggcaa

SEQ ID NO: 3948168 - RNA, 12 nt, Shigella flexneri 2a str. 301
gcccggcgaugg

SEQ ID NO: 3948169 - RNA, 18 nt, Shigella flexneri 2a str. 301
gcccggggagcaacagag

SEQ ID NO: 3948170 - RNA, 16 nt, Shigella flexneri 2a str. 301
gcccgguaaacguggu

SEQ ID NO: 3948171 - RNA, 18 nt, Shigella flexneri 2a str. 301
gcccgguaaacguggugc

SEQ ID NO: 3948172 - RNA, 22 nt, Shigella flexneri 2a str. 301
gcccggucaggugguccagcgu

SEQ ID NO: 3948173 - RNA, 18 nt, Shigella flexneri 2a str. 301
gcccggucgggugcucau

SEQ ID NO: 3948174 - RNA, 14 nt, Shigella flexneri 2a str. 301
gcccgguugcaguu

SEQ ID NO: 3948175 - RNA, 23 nt, Shigella flexneri 2a str. 301
gcccguaacgcucaaguacggca

SEQ ID NO: 3948176 - RNA, 16 nt, Shigella flexneri 2a str. 301
gcccguacgcuguggu

SEQ ID NO: 3948177 - RNA, 17 nt, Shigella flexneri 2a str. 301
gcccgucaugccgucgc

SEQ ID NO: 3948178 - RNA, 16 nt, Shigella flexneri 2a str. 301
gcccguccaucaacaa

SEQ ID NO: 3948179 - RNA, 22 nt, Shigella flexneri 2a str. 301
gcccguccaucaacaagcgaau

SEQ ID NO: 3948180 - RNA, 15 nt, Shigella flexneri 2a str. 301
gcccgugacucccac

SEQ ID NO: 3948181 - RNA, 19 nt, Shigella flexneri 2a str. 301
gcccguuaaccgcucugcg

SEQ ID NO: 3948182 - RNA, 15 nt, Shigella flexneri 2a str. 301
gcccguugccaggac

SEQ ID NO: 3948183 - RNA, 17 nt, Shigella flexneri 2a str. 301
gcccguuggcagaccgc

SEQ ID NO: 3948184 - RNA, 22 nt, Shigella flexneri 2a str. 301
gcccguuucucuuaaaugcaca

SEQ ID NO: 3948185 - RNA, 13 nt, Shigella flexneri 2a str. 301
gcccguuuugaga

SEQ ID NO: 3948186 - RNA, 20 nt, Shigella flexneri 2a str. 301
gcccuaaucgcugccgcgca

SEQ ID NO: 3948187 - RNA, 15 nt, Shigella flexneri 2a str. 301
gcccuacgcgguucu

SEQ ID NO: 3948188 - RNA, 20 nt, Shigella flexneri 2a str. 301
gcccuacuccgccuuugaaa

SEQ ID NO: 3948189 - RNA, 18 nt, Shigella flexneri 2a str. 301
gcccuaggcauagaaaaa

SEQ ID NO: 3948190 - RNA, 20 nt, Shigella flexneri 2a str. 301
gcccuaggcauagaaaaaga

SEQ ID NO: 3948191 - RNA, 14 nt, Shigella flexneri 2a str. 301
gcccucaaacaaca

SEQ ID NO: 3948192 - RNA, 17 nt, Shigella flexneri 2a str. 301
gcccucauuccuccccg

SEQ ID NO: 3948193 - RNA, 20 nt, Shigella flexneri 2a str. 301
gcccucauuccuccccgaaa

SEQ ID NO: 3948194 - RNA, 21 nt, Shigella flexneri 2a str. 301
gcccuccgguccgccguagcc

SEQ ID NO: 3948195 - RNA, 22 nt, Shigella flexneri 2a str. 301
gcccuccugauaacacagaggc

SEQ ID NO: 3948196 - RNA, 15 nt, Shigella flexneri 2a str. 301
gcccugaucgcugug

SEQ ID NO: 3948197 - RNA, 16 nt, Shigella flexneri 2a str. 301
gcccugauggcgcgcc

SEQ ID NO: 3948198 - RNA, 17 nt, Shigella flexneri 2a str. 301
gcccugcaaugucauca

SEQ ID NO: 3948199 - RNA, 17 nt, Shigella flexneri 2a str. 301
gcccugcccguugccag

SEQ ID NO: 3948200 - RNA, 20 nt, Shigella flexneri 2a str. 301
gcccugcggcugaccaccac

SEQ ID NO: 3948201 - RNA, 18 nt, Shigella flexneri 2a str. 301
gcccugcggcuggcacaa

SEQ ID NO: 3948202 - RNA, 14 nt, Shigella flexneri 2a str. 301
gcccugcgucgcac

SEQ ID NO: 3948203 - RNA, 14 nt, Shigella flexneri 2a str. 301
gcccugcuaugcaa

SEQ ID NO: 3948204 - RNA, 23 nt, Shigella flexneri 2a str. 301
gcccuggaagaaaaacuggcgca

SEQ ID NO: 3948205 - RNA, 18 nt, Shigella flexneri 2a str. 301
gcccuggacaacauuccu

SEQ ID NO: 3948206 - RNA, 19 nt, Shigella flexneri 2a str. 301
gcccuggauuucaauaacu

SEQ ID NO: 3948207 - RNA, 17 nt, Shigella flexneri 2a str. 301
gcccuggcucguggcug

SEQ ID NO: 3948208 - RNA, 19 nt, Shigella flexneri 2a str. 301
gcccuggguaccgagaaaa

SEQ ID NO: 3948209 - RNA, 17 nt, Shigella flexneri 2a str. 301
gcccugucgaggccaau

SEQ ID NO: 3948210 - RNA, 22 nt, Shigella flexneri 2a str. 301
gcccuguuugguugccagccac

SEQ ID NO: 3948211 - RNA, 22 nt, Shigella flexneri 2a str. 301
gcccuuaauuacguuuccgcua

SEQ ID NO: 3948212 - RNA, 22 nt, Shigella flexneri 2a str. 301
gcccuucggggcuaaugccagu

SEQ ID NO: 3948213 - RNA, 23 nt, Shigella flexneri 2a str. 301
gcccuucguaggcagcauccggc

SEQ ID NO: 3948214 - RNA, 23 nt, Shigella flexneri 2a str. 301
gcccuucuuucacuucagcaacg

SEQ ID NO: 3948215 - RNA, 19 nt, Shigella flexneri 2a str. 301
gcccuugccaacgcaaacg

SEQ ID NO: 3948216 - RNA, 14 nt, Shigella flexneri 2a str. 301
gcccuugcuucgcc

SEQ ID NO: 3948217 - RNA, 21 nt, Shigella flexneri 2a str. 301
gcccuuucagcgccuucagau

SEQ ID NO: 3948218 - RNA, 20 nt, Shigella flexneri 2a str. 301
gcccuuuccugacucagcau

SEQ ID NO: 3948219 - RNA, 22 nt, Shigella flexneri 2a str. 301
gcccuuucugcauccguucuuc

SEQ ID NO: 3948220 - RNA, 17 nt, Shigella flexneri 2a str. 301
gcccuuugcuggcauga

SEQ ID NO: 3948221 - RNA, 14 nt, Shigella flexneri 2a str. 301
gcccuuuucaccau

SEQ ID NO: 3948222 - RNA, 23 nt, Shigella flexneri 2a str. 301
gcccuuuuuucguaaguaagcaa

SEQ ID NO: 3948223 - RNA, 17 nt, Shigella flexneri 2a str. 301
gccgaacauauucgaua

SEQ ID NO: 3948224 - RNA, 14 nt, Shigella flexneri 2a str. 301
gccgaaccagugcu

SEQ ID NO: 3948225 - RNA, 16 nt, Shigella flexneri 2a str. 301
gccgaaccguaggccg

SEQ ID NO: 3948226 - RNA, 18 nt, Shigella flexneri 2a str. 301
gccgaaccguaggccgga

SEQ ID NO: 3948227 - RNA, 22 nt, Shigella flexneri 2a str. 301
gccgaacguacgcaauccucuu

SEQ ID NO: 3948228 - RNA, 15 nt, Shigella flexneri 2a str. 301
gccgaacguaggcug

SEQ ID NO: 3948229 - RNA, 17 nt, Shigella flexneri 2a str. 301
gccgaacguaggcugga

SEQ ID NO: 3948230 - RNA, 16 nt, Shigella flexneri 2a str. 301
gccgaacuuugcaccc

SEQ ID NO: 3948231 - RNA, 17 nt, Shigella flexneri 2a str. 301
gccgaacuuugcacccc

SEQ ID NO: 3948232 - RNA, 19 nt, Shigella flexneri 2a str. 301
gccgaacuuugcaccccaa

SEQ ID NO: 3948233 - RNA, 20 nt, Shigella flexneri 2a str. 301
gccgaagaacauaaacagcg

SEQ ID NO: 3948234 - RNA, 23 nt, Shigella flexneri 2a str. 301
gccgaagccguuagucaucauca

SEQ ID NO: 3948235 - RNA, 16 nt, Shigella flexneri 2a str. 301
gccgaagcgagcuuuu

SEQ ID NO: 3948236 - RNA, 18 nt, Shigella flexneri 2a str. 301
gccgaagcgcaguuuaau

SEQ ID NO: 3948237 - RNA, 19 nt, Shigella flexneri 2a str. 301
gccgaaugccacgacguuu

SEQ ID NO: 3948238 - RNA, 12 nt, Shigella flexneri 2a str. 301
gccgacagagcg

SEQ ID NO: 3948239 - RNA, 12 nt, Shigella flexneri 2a str. 301
gccgacagcagc

SEQ ID NO: 3948240 - RNA, 17 nt, Shigella flexneri 2a str. 301
gccgacagcaggcucag

SEQ ID NO: 3948241 - RNA, 13 nt, Shigella flexneri 2a str. 301
gccgaccagaccg

SEQ ID NO: 3948242 - RNA, 13 nt, Shigella flexneri 2a str. 301
gccgaccgcuuca

SEQ ID NO: 3948243 - RNA, 13 nt, Shigella flexneri 2a str. 301
gccgacggucagg

SEQ ID NO: 3948244 - RNA, 20 nt, Shigella flexneri 2a str. 301
gccgagacgagcauaaaagu

SEQ ID NO: 3948245 - RNA, 15 nt, Shigella flexneri 2a str. 301
gccgagcgccagcca

SEQ ID NO: 3948246 - RNA, 20 nt, Shigella flexneri 2a str. 301
gccgagcgggaucgccgcgu

SEQ ID NO: 3948247 - RNA, 14 nt, Shigella flexneri 2a str. 301
gccgagcuggaaca

SEQ ID NO: 3948248 - RNA, 16 nt, Shigella flexneri 2a str. 301
gccgaggauacagccg

SEQ ID NO: 3948249 - RNA, 15 nt, Shigella flexneri 2a str. 301
gccgaggcacagcag

SEQ ID NO: 3948250 - RNA, 20 nt, Shigella flexneri 2a str. 301
gccgaggcacagcaggccaa

SEQ ID NO: 3948251 - RNA, 16 nt, Shigella flexneri 2a str. 301
gccgaggcgcuggcag

SEQ ID NO: 3948252 - RNA, 20 nt, Shigella flexneri 2a str. 301
gccgaggugcucuccacgcu

SEQ ID NO: 3948253 - RNA, 22 nt, Shigella flexneri 2a str. 301
gccgagguuggcucaucaagca

SEQ ID NO: 3948254 - RNA, 23 nt, Shigella flexneri 2a str. 301
gccgauaacaccgauuuuguaaa

SEQ ID NO: 3948255 - RNA, 21 nt, Shigella flexneri 2a str. 301
gccgauaaucaacgcgccgcc

SEQ ID NO: 3948256 - RNA, 14 nt, Shigella flexneri 2a str. 301
gccgaucaucaucc

SEQ ID NO: 3948257 - RNA, 16 nt, Shigella flexneri 2a str. 301
gccgaucaucauccag

SEQ ID NO: 3948258 - RNA, 18 nt, Shigella flexneri 2a str. 301
gccgauccggacaugcug

SEQ ID NO: 3948259 - RNA, 14 nt, Shigella flexneri 2a str. 301
gccgaucgucuggg

SEQ ID NO: 3948260 - RNA, 15 nt, Shigella flexneri 2a str. 301
gccgaucgucugggc

SEQ ID NO: 3948261 - RNA, 23 nt, Shigella flexneri 2a str. 301
gccgaucucaccgaucaucacga

SEQ ID NO: 3948262 - RNA, 15 nt, Shigella flexneri 2a str. 301
gccgaugccagaaag

SEQ ID NO: 3948263 - RNA, 17 nt, Shigella flexneri 2a str. 301
gccgaugccagaaagcg

SEQ ID NO: 3948264 - RNA, 16 nt, Shigella flexneri 2a str. 301
gccgaugggcgccauu

SEQ ID NO: 3948265 - RNA, 17 nt, Shigella flexneri 2a str. 301
gccggaaucagaauccg

SEQ ID NO: 3948266 - RNA, 14 nt, Shigella flexneri 2a str. 301
gccggaauggugcu

SEQ ID NO: 3948267 - RNA, 15 nt, Shigella flexneri 2a str. 301
gccggaauuauccgg

SEQ ID NO: 3948268 - RNA, 22 nt, Shigella flexneri 2a str. 301
gccggaccaucuuccaguugca

SEQ ID NO: 3948269 - RNA, 14 nt, Shigella flexneri 2a str. 301
gccggaccccgcgc

SEQ ID NO: 3948270 - RNA, 16 nt, Shigella flexneri 2a str. 301
gccggaccccgcgcaa

SEQ ID NO: 3948271 - RNA, 23 nt, Shigella flexneri 2a str. 301
gccggacggcuguaaaugccgac

SEQ ID NO: 3948272 - RNA, 17 nt, Shigella flexneri 2a str. 301
gccggacguguuuucac

SEQ ID NO: 3948273 - RNA, 13 nt, Shigella flexneri 2a str. 301
gccggagccagcc

SEQ ID NO: 3948274 - RNA, 23 nt, Shigella flexneri 2a str. 301
gccggaggcaaguuuccuccggc

SEQ ID NO: 3948275 - RNA, 15 nt, Shigella flexneri 2a str. 301
gccggauaagacgcg

SEQ ID NO: 3948276 - RNA, 21 nt, Shigella flexneri 2a str. 301
gccggauaagcguaagcgcau

SEQ ID NO: 3948277 - RNA, 17 nt, Shigella flexneri 2a str. 301
gccggauaaggcgcucg

SEQ ID NO: 3948278 - RNA, 18 nt, Shigella flexneri 2a str. 301
gccggauaaggcguucgc

SEQ ID NO: 3948279 - RNA, 24 nt, Shigella flexneri 2a str. 301
gccggauaaggcguuuucgccgca

SEQ ID NO: 3948280 - RNA, 21 nt, Shigella flexneri 2a str. 301
gccggaugacacaucaccucc

SEQ ID NO: 3948281 - RNA, 21 nt, Shigella flexneri 2a str. 301
gccggaugacagacuccgccu

SEQ ID NO: 3948282 - RNA, 20 nt, Shigella flexneri 2a str. 301
gccggaugacagacuccgcu

SEQ ID NO: 3948283 - RNA, 15 nt, Shigella flexneri 2a str. 301
gccggaugcaucaca

SEQ ID NO: 3948284 - RNA, 22 nt, Shigella flexneri 2a str. 301
gccggaugcuguauguuccccu

SEQ ID NO: 3948285 - RNA, 20 nt, Shigella flexneri 2a str. 301
gccggauggaaacauccggc

SEQ ID NO: 3948286 - RNA, 16 nt, Shigella flexneri 2a str. 301
gccggaugucgcugcu

SEQ ID NO: 3948287 - RNA, 16 nt, Shigella flexneri 2a str. 301
gccggaugucuggaac

SEQ ID NO: 3948288 - RNA, 21 nt, Shigella flexneri 2a str. 301
gccggauuacccgcgcuucga

SEQ ID NO: 3948289 - RNA, 14 nt, Shigella flexneri 2a str. 301
gccggauuaugugg

SEQ ID NO: 3948290 - RNA, 23 nt, Shigella flexneri 2a str. 301
gccggauucacgccaaccagcug

SEQ ID NO: 3948291 - RNA, 20 nt, Shigella flexneri 2a str. 301
gccggauuugagaucggaaa

SEQ ID NO: 3948292 - RNA, 22 nt, Shigella flexneri 2a str. 301
gccggccagcgccaccaccagc

SEQ ID NO: 3948293 - RNA, 15 nt, Shigella flexneri 2a str. 301
gccgggaacuggcaa

SEQ ID NO: 3948294 - RNA, 21 nt, Shigella flexneri 2a str. 301
gccgggaagcucucuuccagu

SEQ ID NO: 3948295 - RNA, 18 nt, Shigella flexneri 2a str. 301
gccgggauuuauucccgg

SEQ ID NO: 3948296 - RNA, 14 nt, Shigella flexneri 2a str. 301
gccggggagauauu

SEQ ID NO: 3948297 - RNA, 19 nt, Shigella flexneri 2a str. 301
gccggggagauauucccca

SEQ ID NO: 3948298 - RNA, 15 nt, Shigella flexneri 2a str. 301
gccggggcgcggcgg

SEQ ID NO: 3948299 - RNA, 16 nt, Shigella flexneri 2a str. 301
gccgggguagaccgcg

SEQ ID NO: 3948300 - RNA, 17 nt, Shigella flexneri 2a str. 301
gccgguaaaucaccagc

SEQ ID NO: 3948301 - RNA, 21 nt, Shigella flexneri 2a str. 301
gccgguaacgcuuucucacca

SEQ ID NO: 3948302 - RNA, 18 nt, Shigella flexneri 2a str. 301
gccgguaacguccaucac

SEQ ID NO: 3948303 - RNA, 15 nt, Shigella flexneri 2a str. 301
gccgguacagccgga

SEQ ID NO: 3948304 - RNA, 20 nt, Shigella flexneri 2a str. 301
gccggucugguguaucugcu

SEQ ID NO: 3948305 - RNA, 16 nt, Shigella flexneri 2a str. 301
gccggugaccaucagc

SEQ ID NO: 3948306 - RNA, 19 nt, Shigella flexneri 2a str. 301
gccggugaccaucagcaug

SEQ ID NO: 3948307 - RNA, 14 nt, Shigella flexneri 2a str. 301
gccggugcaugauu

SEQ ID NO: 3948308 - RNA, 13 nt, Shigella flexneri 2a str. 301
gccgguggccuug

SEQ ID NO: 3948309 - RNA, 13 nt, Shigella flexneri 2a str. 301
gccgguuccagcu

SEQ ID NO: 3948310 - RNA, 12 nt, Shigella flexneri 2a str. 301
gccgguucccag

SEQ ID NO: 3948311 - RNA, 17 nt, Shigella flexneri 2a str. 301
gccgguugucaggaagc

SEQ ID NO: 3948312 - RNA, 22 nt, Shigella flexneri 2a str. 301
gccgguuuaucuccgcuggagc

SEQ ID NO: 3948313 - RNA, 20 nt, Shigella flexneri 2a str. 301
gccgguuugcgccgugcgaa

SEQ ID NO: 3948314 - RNA, 17 nt, Shigella flexneri 2a str. 301
gccgguuuugcaggaaa

SEQ ID NO: 3948315 - RNA, 19 nt, Shigella flexneri 2a str. 301
gccguaaaucccagugccu

SEQ ID NO: 3948316 - RNA, 18 nt, Shigella flexneri 2a str. 301
gccguaaaucccgccauu

SEQ ID NO: 3948317 - RNA, 20 nt, Shigella flexneri 2a str. 301
gccguaagcaaacagcgcaa

SEQ ID NO: 3948318 - RNA, 14 nt, Shigella flexneri 2a str. 301
gccguacaggcagc

SEQ ID NO: 3948319 - RNA, 15 nt, Shigella flexneri 2a str. 301
gccguacaggcagcu

SEQ ID NO: 3948320 - RNA, 22 nt, Shigella flexneri 2a str. 301
gccguacggcguaccgccgcga

SEQ ID NO: 3948321 - RNA, 15 nt, Shigella flexneri 2a str. 301
gccguagagcaccgg

SEQ ID NO: 3948322 - RNA, 18 nt, Shigella flexneri 2a str. 301
gccguagagcaccggcgg

SEQ ID NO: 3948323 - RNA, 18 nt, Shigella flexneri 2a str. 301
gccguaguuccacauaaa

SEQ ID NO: 3948324 - RNA, 15 nt, Shigella flexneri 2a str. 301
gccgucaccagcauc

SEQ ID NO: 3948325 - RNA, 20 nt, Shigella flexneri 2a str. 301
gccgucagccacuucuucca

SEQ ID NO: 3948326 - RNA, 23 nt, Shigella flexneri 2a str. 301
gccgucaggguugccauacagac

SEQ ID NO: 3948327 - RNA, 22 nt, Shigella flexneri 2a str. 301
gccgucauuguuaacgccgcgc

SEQ ID NO: 3948328 - RNA, 20 nt, Shigella flexneri 2a str. 301
gccguccugcguuucuucua

SEQ ID NO: 3948329 - RNA, 18 nt, Shigella flexneri 2a str. 301
gccgucgccacaaccagc

SEQ ID NO: 3948330 - RNA, 21 nt, Shigella flexneri 2a str. 301
gccgucguugagcaucugcaa

SEQ ID NO: 3948331 - RNA, 17 nt, Shigella flexneri 2a str. 301
gccgucugccccgccgc

SEQ ID NO: 3948332 - RNA, 18 nt, Shigella flexneri 2a str. 301
gccgugaacguggccaug

SEQ ID NO: 3948333 - RNA, 13 nt, Shigella flexneri 2a str. 301
gccgugaauuacu

SEQ ID NO: 3948334 - RNA, 15 nt, Shigella flexneri 2a str. 301
gccgugacgaaucag

SEQ ID NO: 3948335 - RNA, 15 nt, Shigella flexneri 2a str. 301
gccgugacugggugc

SEQ ID NO: 3948336 - RNA, 20 nt, Shigella flexneri 2a str. 301
gccgugcacuucugcgguga

SEQ ID NO: 3948337 - RNA, 12 nt, Shigella flexneri 2a str. 301
gccgugcgaaua

SEQ ID NO: 3948338 - RNA, 20 nt, Shigella flexneri 2a str. 301
gccguuauacaucgcuuucc

SEQ ID NO: 3948339 - RNA, 21 nt, Shigella flexneri 2a str. 301
gccguuauccugaucaagcac

SEQ ID NO: 3948340 - RNA, 13 nt, Shigella flexneri 2a str. 301
gccguucuucccg

SEQ ID NO: 3948341 - RNA, 15 nt, Shigella flexneri 2a str. 301
gccguugaucucucc

SEQ ID NO: 3948342 - RNA, 13 nt, Shigella flexneri 2a str. 301
gccguuguucucg

SEQ ID NO: 3948343 - RNA, 14 nt, Shigella flexneri 2a str. 301
gccguuuucaaagg

SEQ ID NO: 3948344 - RNA, 14 nt, Shigella flexneri 2a str. 301
gccguuuucgucaa

SEQ ID NO: 3948345 - RNA, 20 nt, Shigella flexneri 2a str. 301
gccguuuuuacccagcagca

SEQ ID NO: 3948346 - RNA, 17 nt, Shigella flexneri 2a str. 301
gccguuuuuuugacggu

SEQ ID NO: 3948347 - RNA, 19 nt, Shigella flexneri 2a str. 301
gccuaacaauucgccaggg

SEQ ID NO: 3948348 - RNA, 14 nt, Shigella flexneri 2a str. 301
gccuaacaccauca

SEQ ID NO: 3948349 - RNA, 18 nt, Shigella flexneri 2a str. 301
gccuaacgacaaaucaua

SEQ ID NO: 3948350 - RNA, 21 nt, Shigella flexneri 2a str. 301
gccuaauccagccuacaaauu

SEQ ID NO: 3948351 - RNA, 17 nt, Shigella flexneri 2a str. 301
gccuacaaaaucuauug

SEQ ID NO: 3948352 - RNA, 21 nt, Shigella flexneri 2a str. 301
gccuacaaaaucuauugcaac

SEQ ID NO: 3948353 - RNA, 20 nt, Shigella flexneri 2a str. 301
gccuacaacuccguugaaau

SEQ ID NO: 3948354 - RNA, 20 nt, Shigella flexneri 2a str. 301
gccuacaaguccguugaaaa

SEQ ID NO: 3948355 - RNA, 13 nt, Shigella flexneri 2a str. 301
gccuacaagucug

SEQ ID NO: 3948356 - RNA, 21 nt, Shigella flexneri 2a str. 301
gccuacacauuaucucaacac

SEQ ID NO: 3948357 - RNA, 19 nt, Shigella flexneri 2a str. 301
gccuacaggaaacgauucg

SEQ ID NO: 3948358 - RNA, 12 nt, Shigella flexneri 2a str. 301
gccuacaggauu

SEQ ID NO: 3948359 - RNA, 14 nt, Shigella flexneri 2a str. 301
gccuaccauaauca

SEQ ID NO: 3948360 - RNA, 23 nt, Shigella flexneri 2a str. 301
gccuacgacuuucuccgcauccg

SEQ ID NO: 3948361 - RNA, 16 nt, Shigella flexneri 2a str. 301
gccuacgugaggcauc

SEQ ID NO: 3948362 - RNA, 13 nt, Shigella flexneri 2a str. 301
gccuagaugcuca

SEQ ID NO: 3948363 - RNA, 21 nt, Shigella flexneri 2a str. 301
gccuauuaugacuccagcgcc

SEQ ID NO: 3948364 - RNA, 22 nt, Shigella flexneri 2a str. 301
gccucaacccuuuuuuaaacau

SEQ ID NO: 3948365 - RNA, 16 nt, Shigella flexneri 2a str. 301
gccugugucaggccgg

SEQ ID NO: 3948366 - RNA, 18 nt, Shigella flexneri 2a str. 301
gccuguuccagacgcugc

SEQ ID NO: 3948367 - RNA, 16 nt, Shigella flexneri 2a str. 301
gccuguucgccgccgc

SEQ ID NO: 3948368 - RNA, 19 nt, Shigella flexneri 2a str. 301
gccuguugugcgagcaaag

SEQ ID NO: 3948369 - RNA, 19 nt, Shigella flexneri 2a str. 301
gccuguuuauccaucacgc

SEQ ID NO: 3948370 - RNA, 13 nt, Shigella flexneri 2a str. 301
gccuuaaaaacca

SEQ ID NO: 3948371 - RNA, 18 nt, Shigella flexneri 2a str. 301
gccuuaccaauaccgcgu

SEQ ID NO: 3948372 - RNA, 22 nt, Shigella flexneri 2a str. 301
gccuuaccacucugaccugaca

SEQ ID NO: 3948373 - RNA, 15 nt, Shigella flexneri 2a str. 301
gccuuaccgcuuggc

SEQ ID NO: 3948374 - RNA, 21 nt, Shigella flexneri 2a str. 301
gccuuacucaccggcguuuca

SEQ ID NO: 3948375 - RNA, 15 nt, Shigella flexneri 2a str. 301
gccuuauccagcaga

SEQ ID NO: 3948376 - RNA, 14 nt, Shigella flexneri 2a str. 301
gccuuauccagccu

SEQ ID NO: 3948377 - RNA, 13 nt, Shigella flexneri 2a str. 301
gccuuauccggcc

SEQ ID NO: 3948378 - RNA, 14 nt, Shigella flexneri 2a str. 301
gccuuauccggccu

SEQ ID NO: 3948379 - RNA, 19 nt, Shigella flexneri 2a str. 301
gccuuauccggccuacgaa

SEQ ID NO: 3948380 - RNA, 19 nt, Shigella flexneri 2a str. 301
gccuuauccggccuacgau

SEQ ID NO: 3948381 - RNA, 13 nt, Shigella flexneri 2a str. 301
gccuuauccggcu

SEQ ID NO: 3948382 - RNA, 14 nt, Shigella flexneri 2a str. 301
gccuuauccggucu

SEQ ID NO: 3948383 - RNA, 14 nt, Shigella flexneri 2a str. 301
gccuuauccguccu

SEQ ID NO: 3948384 - RNA, 14 nt, Shigella flexneri 2a str. 301
gccuuauccugccu

SEQ ID NO: 3948385 - RNA, 14 nt, Shigella flexneri 2a str. 301
gccuuaucuggccu

SEQ ID NO: 3948386 - RNA, 23 nt, Shigella flexneri 2a str. 301
gccuuauugccugugacuuucug

SEQ ID NO: 3948387 - RNA, 18 nt, Shigella flexneri 2a str. 301
gccuucacggcuuuguca

SEQ ID NO: 3948388 - RNA, 17 nt, Shigella flexneri 2a str. 301
gccuucagguuuuucag

SEQ ID NO: 3948389 - RNA, 21 nt, Shigella flexneri 2a str. 301
gccuucagguuuuucagcugc

SEQ ID NO: 3948390 - RNA, 15 nt, Shigella flexneri 2a str. 301
gccuuccagcgaugc

SEQ ID NO: 3948391 - RNA, 18 nt, Shigella flexneri 2a str. 301
gccuuccgcaaacaggcg

SEQ ID NO: 3948392 - RNA, 21 nt, Shigella flexneri 2a str. 301
gccuuccgcaaacaggcgcag

SEQ ID NO: 3948393 - RNA, 12 nt, Shigella flexneri 2a str. 301
gccuuccgcuga

SEQ ID NO: 3948394 - RNA, 23 nt, Shigella flexneri 2a str. 301
gccuucgcaaaaaaccaucccug

SEQ ID NO: 3948395 - RNA, 15 nt, Shigella flexneri 2a str. 301
gccuucgccuuucag

SEQ ID NO: 3948396 - RNA, 18 nt, Shigella flexneri 2a str. 301
gccuucggcgucuccacc

SEQ ID NO: 3948397 - RNA, 19 nt, Shigella flexneri 2a str. 301
gccuucggcgucuccaccu

SEQ ID NO: 3948398 - RNA, 19 nt, Shigella flexneri 2a str. 301
gccuucgugcggcugcauc

SEQ ID NO: 3948399 - RNA, 20 nt, Shigella flexneri 2a str. 301
gccuucuccggcuuacaaca

SEQ ID NO: 3948400 - RNA, 15 nt, Shigella flexneri 2a str. 301
gccuucuucauccag

SEQ ID NO: 3948401 - RNA, 22 nt, Shigella flexneri 2a str. 301
gccuucuucgcccacuuucugc

SEQ ID NO: 3948402 - RNA, 20 nt, Shigella flexneri 2a str. 301
gccuugcgauuacgcucggc

SEQ ID NO: 3948403 - RNA, 21 nt, Shigella flexneri 2a str. 301
gccuugcgauuacgcucggca

SEQ ID NO: 3948404 - RNA, 22 nt, Shigella flexneri 2a str. 301
gccuugcggaaauuccagcggc

SEQ ID NO: 3948405 - RNA, 14 nt, Shigella flexneri 2a str. 301
gccuuguuucuuca

SEQ ID NO: 3948406 - RNA, 17 nt, Shigella flexneri 2a str. 301
gccuuuaccgccacagc

SEQ ID NO: 3948407 - RNA, 17 nt, Shigella flexneri 2a str. 301
gccuuuauuaaugacau

SEQ ID NO: 3948408 - RNA, 21 nt, Shigella flexneri 2a str. 301
gccuuuauuaaugacauucag

SEQ ID NO: 3948409 - RNA, 23 nt, Shigella flexneri 2a str. 301
gccuuucacgccgggaaauuuuu

SEQ ID NO: 3948410 - RNA, 19 nt, Shigella flexneri 2a str. 301
gccuuucgagaagcaagca

SEQ ID NO: 3948411 - RNA, 22 nt, Shigella flexneri 2a str. 301
gccuuucgagaagcaagcauua

SEQ ID NO: 3948412 - RNA, 18 nt, Shigella flexneri 2a str. 301
gccuuucggcgcagucac

SEQ ID NO: 3948413 - RNA, 12 nt, Shigella flexneri 2a str. 301
gccuuucucaga

SEQ ID NO: 3948414 - RNA, 13 nt, Shigella flexneri 2a str. 301
gccuuucucagaa

SEQ ID NO: 3948415 - RNA, 14 nt, Shigella flexneri 2a str. 301
gccuuucucagaga

SEQ ID NO: 3948416 - RNA, 20 nt, Shigella flexneri 2a str. 301
gccuuugaaaucgaacaggu

SEQ ID NO: 3948417 - RNA, 21 nt, Shigella flexneri 2a str. 301
gccuuugaaaucgaacagguu

SEQ ID NO: 3948418 - RNA, 13 nt, Shigella flexneri 2a str. 301
gccuuugaucuca

SEQ ID NO: 3948419 - RNA, 21 nt, Shigella flexneri 2a str. 301
gccuuuucaguuggcugacaa

SEQ ID NO: 3948420 - RNA, 13 nt, Shigella flexneri 2a str. 301
gccuuuuccagcg

SEQ ID NO: 3948421 - RNA, 21 nt, Shigella flexneri 2a str. 301
gccuuuuucagccgcaaacuc

SEQ ID NO: 3948422 - RNA, 22 nt, Shigella flexneri 2a str. 301
gccuuuuuuguacuccagcaga

SEQ ID NO: 3948423 - RNA, 16 nt, Shigella flexneri 2a str. 301
gcgaaaaccgguaaca

SEQ ID NO: 3948424 - RNA, 23 nt, Shigella flexneri 2a str. 301
gcgaaaauugguagaccagagcu

SEQ ID NO: 3948425 - RNA, 17 nt, Shigella flexneri 2a str. 301
gcgaaacagggcuggaa

SEQ ID NO: 3948426 - RNA, 19 nt, Shigella flexneri 2a str. 301
gcgaaaccuuugccgaugg

SEQ ID NO: 3948427 - RNA, 17 nt, Shigella flexneri 2a str. 301
gcgaaacgguguaaaaa

SEQ ID NO: 3948428 - RNA, 23 nt, Shigella flexneri 2a str. 301
gcgaaacugcccuacaaacuggu

SEQ ID NO: 3948429 - RNA, 11 nt, Shigella flexneri 2a str. 301
gcgaaagaaaa

SEQ ID NO: 3948430 - RNA, 12 nt, Shigella flexneri 2a str. 301
gcgaaagaaaag

SEQ ID NO: 3948431 - RNA, 21 nt, Shigella flexneri 2a str. 301
gcgaaagcagaaaaagaagcc

SEQ ID NO: 3948432 - RNA, 17 nt, Shigella flexneri 2a str. 301
gcgaaagcuggcacugg

SEQ ID NO: 3948433 - RNA, 14 nt, Shigella flexneri 2a str. 301
gcgaaaguaccauu

SEQ ID NO: 3948434 - RNA, 19 nt, Shigella flexneri 2a str. 301
gcgaaaucuuccggcgugg

SEQ ID NO: 3948435 - RNA, 14 nt, Shigella flexneri 2a str. 301
gcgaaauugcugac

SEQ ID NO: 3948436 - RNA, 14 nt, Shigella flexneri 2a str. 301
gcgaaauugguaga

SEQ ID NO: 3948437 - RNA, 19 nt, Shigella flexneri 2a str. 301
gcgaaauugguagacgcac

SEQ ID NO: 3948438 - RNA, 20 nt, Shigella flexneri 2a str. 301
gcgaacagcacaucagccag

SEQ ID NO: 3948439 - RNA, 21 nt, Shigella flexneri 2a str. 301
gcgaacauaaggaugcgggcg

SEQ ID NO: 3948440 - RNA, 15 nt, Shigella flexneri 2a str. 301
gcgaaccaggccgua

SEQ ID NO: 3948441 - RNA, 17 nt, Shigella flexneri 2a str. 301
gcgaaccgcugucaccc

SEQ ID NO: 3948442 - RNA, 18 nt, Shigella flexneri 2a str. 301
gcgaacggauagcgaugg

SEQ ID NO: 3948443 - RNA, 14 nt, Shigella flexneri 2a str. 301
gcgaacuaaacaac

SEQ ID NO: 3948444 - RNA, 13 nt, Shigella flexneri 2a str. 301
gcgaacucuuccg

SEQ ID NO: 3948445 - RNA, 12 nt, Shigella flexneri 2a str. 301
gcgaacugcgca

SEQ ID NO: 3948446 - RNA, 17 nt, Shigella flexneri 2a str. 301
gcgaagauacccgcgag

SEQ ID NO: 3948447 - RNA, 22 nt, Shigella flexneri 2a str. 301
gcgaagauacccgcgaggcgca

SEQ ID NO: 3948448 - RNA, 15 nt, Shigella flexneri 2a str. 301
gcgaagcuggucagc

SEQ ID NO: 3948449 - RNA, 19 nt, Shigella flexneri 2a str. 301
gcgaagcuggucagcaucg

SEQ ID NO: 3948450 - RNA, 16 nt, Shigella flexneri 2a str. 301
gcgaagggcugucggu

SEQ ID NO: 3948451 - RNA, 16 nt, Shigella flexneri 2a str. 301
gcgaaguucgccauca

SEQ ID NO: 3948452 - RNA, 16 nt, Shigella flexneri 2a str. 301
gcgaauaaaaagccua

SEQ ID NO: 3948453 - RNA, 21 nt, Shigella flexneri 2a str. 301
gcgaauaguuuccgcuucugc

SEQ ID NO: 3948454 - RNA, 22 nt, Shigella flexneri 2a str. 301
gcgaauaguuuccgcuucugcu

SEQ ID NO: 3948455 - RNA, 21 nt, Shigella flexneri 2a str. 301
gcgaauaugccguaaaaguac

SEQ ID NO: 3948456 - RNA, 15 nt, Shigella flexneri 2a str. 301
gcgaaucaacuccag

SEQ ID NO: 3948457 - RNA, 14 nt, Shigella flexneri 2a str. 301
gcgaaucgcuucau

SEQ ID NO: 3948458 - RNA, 18 nt, Shigella flexneri 2a str. 301
gcgaaugacaugcccggu

SEQ ID NO: 3948459 - RNA, 15 nt, Shigella flexneri 2a str. 301
gcgaaugaggcagca

SEQ ID NO: 3948460 - RNA, 18 nt, Shigella flexneri 2a str. 301
gcgaaugcguuucagcca

SEQ ID NO: 3948461 - RNA, 19 nt, Shigella flexneri 2a str. 301
gcgaauguuccaucaccag

SEQ ID NO: 3948462 - RNA, 14 nt, Shigella flexneri 2a str. 301
gcgacaaucccugc

SEQ ID NO: 3948463 - RNA, 12 nt, Shigella flexneri 2a str. 301
gcgacacaaucc

SEQ ID NO: 3948464 - RNA, 14 nt, Shigella flexneri 2a str. 301
gcgacaccagccau

SEQ ID NO: 3948465 - RNA, 12 nt, Shigella flexneri 2a str. 301
gcgaucuucccg

SEQ ID NO: 3948466 - RNA, 16 nt, Shigella flexneri 2a str. 301
gcgaugaccaaaaaca

SEQ ID NO: 3948467 - RNA, 13 nt, Shigella flexneri 2a str. 301
gcgaugaccgcca

SEQ ID NO: 3948468 - RNA, 22 nt, Shigella flexneri 2a str. 301
gcgaugaucgucacgaucgcgc

SEQ ID NO: 3948469 - RNA, 20 nt, Shigella flexneri 2a str. 301
gcgaugaugccaagccgaua

SEQ ID NO: 3948470 - RNA, 14 nt, Shigella flexneri 2a str. 301
gcgaugccaguaau

SEQ ID NO: 3948471 - RNA, 17 nt, Shigella flexneri 2a str. 301
gcgaugcccccagcagc

SEQ ID NO: 3948472 - RNA, 14 nt, Shigella flexneri 2a str. 301
gcgaugccuggcaa

SEQ ID NO: 3948473 - RNA, 15 nt, Shigella flexneri 2a str. 301
gcgaugccuggcaau

SEQ ID NO: 3948474 - RNA, 20 nt, Shigella flexneri 2a str. 301
gcgauggguuaacaucaugu

SEQ ID NO: 3948475 - RNA, 22 nt, Shigella flexneri 2a str. 301
gcgaugguacuucaaucgccac

SEQ ID NO: 3948476 - RNA, 13 nt, Shigella flexneri 2a str. 301
gcgaugguggugg

SEQ ID NO: 3948477 - RNA, 19 nt, Shigella flexneri 2a str. 301
gcgauguucaauaaaagca

SEQ ID NO: 3948478 - RNA, 15 nt, Shigella flexneri 2a str. 301
gcgauuaaacgccau

SEQ ID NO: 3948479 - RNA, 20 nt, Shigella flexneri 2a str. 301
gcgauuaaacgccauccggc

SEQ ID NO: 3948480 - RNA, 14 nt, Shigella flexneri 2a str. 301
gcgauuaagaaugc

SEQ ID NO: 3948481 - RNA, 21 nt, Shigella flexneri 2a str. 301
gcgauuaauaaaauuauccag

SEQ ID NO: 3948482 - RNA, 21 nt, Shigella flexneri 2a str. 301
gcgauuauuuauucccgccag

SEQ ID NO: 3948483 - RNA, 23 nt, Shigella flexneri 2a str. 301
gcgauuauuuauucccgccagau

SEQ ID NO: 3948484 - RNA, 18 nt, Shigella flexneri 2a str. 301
gcgauucauaugcgccag

SEQ ID NO: 3948485 - RNA, 19 nt, Shigella flexneri 2a str. 301
gcgauucauaugcgccagc

SEQ ID NO: 3948486 - RNA, 21 nt, Shigella flexneri 2a str. 301
gcgauucauaugcgccagcug

SEQ ID NO: 3948487 - RNA, 23 nt, Shigella flexneri 2a str. 301
gcgauucccguuuauggucgggu

SEQ ID NO: 3948488 - RNA, 14 nt, Shigella flexneri 2a str. 301
gcgauucgcccugc

SEQ ID NO: 3948489 - RNA, 15 nt, Shigella flexneri 2a str. 301
gcgauucggcuccgu

SEQ ID NO: 3948490 - RNA, 12 nt, Shigella flexneri 2a str. 301
gcgauugccgca

SEQ ID NO: 3948491 - RNA, 20 nt, Shigella flexneri 2a str. 301
gcgauugugacacgcgcgca

SEQ ID NO: 3948492 - RNA, 14 nt, Shigella flexneri 2a str. 301
gcgauuuaacgccu

SEQ ID NO: 3948493 - RNA, 23 nt, Shigella flexneri 2a str. 301
gcgauuucacaagacuguaaaua

SEQ ID NO: 3948494 - RNA, 12 nt, Shigella flexneri 2a str. 301
gcgauuuccuuc

SEQ ID NO: 3948495 - RNA, 13 nt, Shigella flexneri 2a str. 301
gcgauuuccuuca

SEQ ID NO: 3948496 - RNA, 15 nt, Shigella flexneri 2a str. 301
gcgcaaaauaccagc

SEQ ID NO: 3948497 - RNA, 19 nt, Shigella flexneri 2a str. 301
gcgcaaaauaccagcaauu

SEQ ID NO: 3948498 - RNA, 15 nt, Shigella flexneri 2a str. 301
gcgcaaacagugacc

SEQ ID NO: 3948499 - RNA, 13 nt, Shigella flexneri 2a str. 301
gcgcaaagaaacg

SEQ ID NO: 3948500 - RNA, 16 nt, Shigella flexneri 2a str. 301
gcgcaaaggccagcaa

SEQ ID NO: 3948501 - RNA, 18 nt, Shigella flexneri 2a str. 301
gcgcaaaggccagcaauc

SEQ ID NO: 3948502 - RNA, 18 nt, Shigella flexneri 2a str. 301
gcgcaaauccacguucca

SEQ ID NO: 3948503 - RNA, 15 nt, Shigella flexneri 2a str. 301
gcgcaaauugcuggu

SEQ ID NO: 3948504 - RNA, 22 nt, Shigella flexneri 2a str. 301
gcgcaacaaauaaaagcaaaaa

SEQ ID NO: 3948505 - RNA, 22 nt, Shigella flexneri 2a str. 301
gcgcaacauauuccgcaccugc

SEQ ID NO: 3948506 - RNA, 20 nt, Shigella flexneri 2a str. 301
gcgcaacccgugaagguugc

SEQ ID NO: 3948507 - RNA, 22 nt, Shigella flexneri 2a str. 301
gcgcaacccgugaagguugcgc

SEQ ID NO: 3948508 - RNA, 16 nt, Shigella flexneri 2a str. 301
gcgcaacuugcagauc

SEQ ID NO: 3948509 - RNA, 17 nt, Shigella flexneri 2a str. 301
gcgcaacuugugcucgu

SEQ ID NO: 3948510 - RNA, 16 nt, Shigella flexneri 2a str. 301
gcgcaagggccgcagc

SEQ ID NO: 3948511 - RNA, 22 nt, Shigella flexneri 2a str. 301
gcgcaauaccgauaucgccauu

SEQ ID NO: 3948512 - RNA, 22 nt, Shigella flexneri 2a str. 301
gcgcaauauccugcgcuuccug

SEQ ID NO: 3948513 - RNA, 20 nt, Shigella flexneri 2a str. 301
gcgcaauaugcggugccauu

SEQ ID NO: 3948514 - RNA, 16 nt, Shigella flexneri 2a str. 301
gcgcaauauucaagau

SEQ ID NO: 3948515 - RNA, 12 nt, Shigella flexneri 2a str. 301
gcgcaaucacca

SEQ ID NO: 3948516 - RNA, 15 nt, Shigella flexneri 2a str. 301
gcgcaaucagcaccg

SEQ ID NO: 3948517 - RNA, 19 nt, Shigella flexneri 2a str. 301
gcgcaaugccauccagcuu

SEQ ID NO: 3948518 - RNA, 20 nt, Shigella flexneri 2a str. 301
gcgcaauucccggaccguca

SEQ ID NO: 3948519 - RNA, 18 nt, Shigella flexneri 2a str. 301
gcgcacacacgcccagcu

SEQ ID NO: 3948520 - RNA, 18 nt, Shigella flexneri 2a str. 301
gcgcacauccgcgucggc

SEQ ID NO: 3948521 - RNA, 14 nt, Shigella flexneri 2a str. 301
gcgcaccagcguca

SEQ ID NO: 3948522 - RNA, 13 nt, Shigella flexneri 2a str. 301
gcgcaccgauaaa

SEQ ID NO: 3948523 - RNA, 22 nt, Shigella flexneri 2a str. 301
gcgcaccuuuaaugcaucagcc

SEQ ID NO: 3948524 - RNA, 18 nt, Shigella flexneri 2a str. 301
gcgcacuaugugccagcu

SEQ ID NO: 3948525 - RNA, 17 nt, Shigella flexneri 2a str. 301
gcgcacugucgccgcgg

SEQ ID NO: 3948526 - RNA, 18 nt, Shigella flexneri 2a str. 301
gcgcagaacauaaaaacc

SEQ ID NO: 3948527 - RNA, 18 nt, Shigella flexneri 2a str. 301
gcgcagaguuuccaggcu

SEQ ID NO: 3948528 - RNA, 19 nt, Shigella flexneri 2a str. 301
gcgcagaguuuccaggcug

SEQ ID NO: 3948529 - RNA, 23 nt, Shigella flexneri 2a str. 301
gcgcagauagagcgccugcagac

SEQ ID NO: 3948530 - RNA, 13 nt, Shigella flexneri 2a str. 301
gcgcagcacccag

SEQ ID NO: 3948531 - RNA, 18 nt, Shigella flexneri 2a str. 301
gcgcagcauaaucggcug

SEQ ID NO: 3948532 - RNA, 13 nt, Shigella flexneri 2a str. 301
gcgcagccagcgu

SEQ ID NO: 3948533 - RNA, 17 nt, Shigella flexneri 2a str. 301
gcgcagcugagaaaaag

SEQ ID NO: 3948534 - RNA, 22 nt, Shigella flexneri 2a str. 301
gcgcagcugcgcuucaauacgc

SEQ ID NO: 3948535 - RNA, 17 nt, Shigella flexneri 2a str. 301
gcgcaggagccacauag

SEQ ID NO: 3948536 - RNA, 20 nt, Shigella flexneri 2a str. 301
gcgcaggguuugcaucgcca

SEQ ID NO: 3948537 - RNA, 16 nt, Shigella flexneri 2a str. 301
gcgcaggucauccggc

SEQ ID NO: 3948538 - RNA, 18 nt, Shigella flexneri 2a str. 301
gcgcaggugauacugaca

SEQ ID NO: 3948539 - RNA, 14 nt, Shigella flexneri 2a str. 301
gcgcaguaccacgg

SEQ ID NO: 3948540 - RNA, 17 nt, Shigella flexneri 2a str. 301
gcgcagucaccagcauc

SEQ ID NO: 3948541 - RNA, 16 nt, Shigella flexneri 2a str. 301
gcgcagucuggcggcu

SEQ ID NO: 3948542 - RNA, 22 nt, Shigella flexneri 2a str. 301
gcgcagugugguuuucgcggcg

SEQ ID NO: 3948543 - RNA, 20 nt, Shigella flexneri 2a str. 301
gcgcaguucacgccagaagc

SEQ ID NO: 3948544 - RNA, 16 nt, Shigella flexneri 2a str. 301
gcgcaguucgcacacc

SEQ ID NO: 3948545 - RNA, 20 nt, Shigella flexneri 2a str. 301
gcgcaguuuaaucguugaug

SEQ ID NO: 3948546 - RNA, 14 nt, Shigella flexneri 2a str. 301
gcgcauaacugccg

SEQ ID NO: 3948547 - RNA, 12 nt, Shigella flexneri 2a str. 301
gcgcauauugcc

SEQ ID NO: 3948548 - RNA, 12 nt, Shigella flexneri 2a str. 301
gcgcaucaaagc

SEQ ID NO: 3948549 - RNA, 18 nt, Shigella flexneri 2a str. 301
gcgcaucaaagccaggca

SEQ ID NO: 3948550 - RNA, 19 nt, Shigella flexneri 2a str. 301
gcgcaucaaagccaggcag

SEQ ID NO: 3948551 - RNA, 19 nt, Shigella flexneri 2a str. 301
gcgcaucaggcaaugcuuc

SEQ ID NO: 3948552 - RNA, 13 nt, Shigella flexneri 2a str. 301
gcgcauccagcgu

SEQ ID NO: 3948553 - RNA, 19 nt, Shigella flexneri 2a str. 301
gcgcauccaguuccuucaa

SEQ ID NO: 3948554 - RNA, 16 nt, Shigella flexneri 2a str. 301
gcgcauccgacuuauc

SEQ ID NO: 3948555 - RNA, 22 nt, Shigella flexneri 2a str. 301
gcgcauccggcaccagcgcaca

SEQ ID NO: 3948556 - RNA, 18 nt, Shigella flexneri 2a str. 301
gcgcaucggucagaccca

SEQ ID NO: 3948557 - RNA, 19 nt, Shigella flexneri 2a str. 301
gcgcaucggucagacccag

SEQ ID NO: 3948558 - RNA, 18 nt, Shigella flexneri 2a str. 301
gcgcaucggucgaugaaa

SEQ ID NO: 3948559 - RNA, 17 nt, Shigella flexneri 2a str. 301
gcgcaucuuauccggcc

SEQ ID NO: 3948560 - RNA, 13 nt, Shigella flexneri 2a str. 301
gcgcauggcggca

SEQ ID NO: 3948561 - RNA, 13 nt, Shigella flexneri 2a str. 301
gcgcauguccgcu

SEQ ID NO: 3948562 - RNA, 17 nt, Shigella flexneri 2a str. 301
gcgcauguuggcgcggu

SEQ ID NO: 3948563 - RNA, 20 nt, Shigella flexneri 2a str. 301
gcgcauuaaaaacccgccau

SEQ ID NO: 3948564 - RNA, 16 nt, Shigella flexneri 2a str. 301
gcgcauuaagccauga

SEQ ID NO: 3948565 - RNA, 16 nt, Shigella flexneri 2a str. 301
gcgcgcggcaggaagu

SEQ ID NO: 3948566 - RNA, 13 nt, Shigella flexneri 2a str. 301
gcgcgcguaaauu

SEQ ID NO: 3948567 - RNA, 15 nt, Shigella flexneri 2a str. 301
gcgcgcucagcgcca

SEQ ID NO: 3948568 - RNA, 11 nt, Shigella flexneri 2a str. 301
gcgcgcuucgc

SEQ ID NO: 3948569 - RNA, 22 nt, Shigella flexneri 2a str. 301
gcgcggaaagcaccugcgcagg

SEQ ID NO: 3948570 - RNA, 18 nt, Shigella flexneri 2a str. 301
gcgcggauccacaccuga

SEQ ID NO: 3948571 - RNA, 20 nt, Shigella flexneri 2a str. 301
gcgcggauccacaccugacg

SEQ ID NO: 3948572 - RNA, 21 nt, Shigella flexneri 2a str. 301
gcgcggcaauuagcggccagc

SEQ ID NO: 3948573 - RNA, 14 nt, Shigella flexneri 2a str. 301
gcgcggcggguaac

SEQ ID NO: 3948574 - RNA, 18 nt, Shigella flexneri 2a str. 301
gcgcgguaaagcgcggca

SEQ ID NO: 3948575 - RNA, 20 nt, Shigella flexneri 2a str. 301
gcgcgguaaaguuuggcugu

SEQ ID NO: 3948576 - RNA, 19 nt, Shigella flexneri 2a str. 301
gcgcgguaucaccacccag

SEQ ID NO: 3948577 - RNA, 21 nt, Shigella flexneri 2a str. 301
gcgcggucauaaaauccguaa

SEQ ID NO: 3948578 - RNA, 14 nt, Shigella flexneri 2a str. 301
gcgcggugcugaaa

SEQ ID NO: 3948579 - RNA, 20 nt, Shigella flexneri 2a str. 301
gcgcgguuuguaggccggau

SEQ ID NO: 3948580 - RNA, 15 nt, Shigella flexneri 2a str. 301
gcgcguaaauaccuu

SEQ ID NO: 3948581 - RNA, 21 nt, Shigella flexneri 2a str. 301
gcgcguaaauaccuuccggcg

SEQ ID NO: 3948582 - RNA, 23 nt, Shigella flexneri 2a str. 301
gcgcguaaauaccuuccggcgua

SEQ ID NO: 3948583 - RNA, 13 nt, Shigella flexneri 2a str. 301
gcgcgucaacugu

SEQ ID NO: 3948584 - RNA, 14 nt, Shigella flexneri 2a str. 301
gcgcguccccugcc

SEQ ID NO: 3948585 - RNA, 12 nt, Shigella flexneri 2a str. 301
gcgcgugaagug

SEQ ID NO: 3948586 - RNA, 13 nt, Shigella flexneri 2a str. 301
gcgcguuaacucc

SEQ ID NO: 3948587 - RNA, 19 nt, Shigella flexneri 2a str. 301
gcgcguuguucaugccgga

SEQ ID NO: 3948588 - RNA, 19 nt, Shigella flexneri 2a str. 301
gcgcguuuuuuaugccgga

SEQ ID NO: 3948589 - RNA, 17 nt, Shigella flexneri 2a str. 301
gcgcuaaaagcauagcc

SEQ ID NO: 3948590 - RNA, 13 nt, Shigella flexneri 2a str. 301
gcgcuaacucauc

SEQ ID NO: 3948591 - RNA, 20 nt, Shigella flexneri 2a str. 301
gcgcuacgcucaucaggccu

SEQ ID NO: 3948592 - RNA, 20 nt, Shigella flexneri 2a str. 301
gcgcuacgcuuaucaggccu

SEQ ID NO: 3948593 - RNA, 21 nt, Shigella flexneri 2a str. 301
gcgcuacugaaucccugcgaa

SEQ ID NO: 3948594 - RNA, 14 nt, Shigella flexneri 2a str. 301
gcgcuagccucagg

SEQ ID NO: 3948595 - RNA, 21 nt, Shigella flexneri 2a str. 301
gcgcuagccucagguguuagu

SEQ ID NO: 3948596 - RNA, 21 nt, Shigella flexneri 2a str. 301
gcgcuagcuucagguguuagu

SEQ ID NO: 3948597 - RNA, 22 nt, Shigella flexneri 2a str. 301
gcgcuaucaaagggcaccggcg

SEQ ID NO: 3948598 - RNA, 23 nt, Shigella flexneri 2a str. 301
gcgcuaucaauacuuuccagcau

SEQ ID NO: 3948599 - RNA, 13 nt, Shigella flexneri 2a str. 301
gcgcuaucagcau

SEQ ID NO: 3948600 - RNA, 14 nt, Shigella flexneri 2a str. 301
gcgcuauccagcgc

SEQ ID NO: 3948601 - RNA, 21 nt, Shigella flexneri 2a str. 301
gcgcuauguuuaucaggccaa

SEQ ID NO: 3948602 - RNA, 19 nt, Shigella flexneri 2a str. 301
gcgcucacaccacagcagc

SEQ ID NO: 3948603 - RNA, 19 nt, Shigella flexneri 2a str. 301
gcgcucaccauuuccggag

SEQ ID NO: 3948604 - RNA, 15 nt, Shigella flexneri 2a str. 301
gcgcucagcgccaca

SEQ ID NO: 3948605 - RNA, 16 nt, Shigella flexneri 2a str. 301
gcgcucauuuucucuu

SEQ ID NO: 3948606 - RNA, 13 nt, Shigella flexneri 2a str. 301
gcgcuccaggagu

SEQ ID NO: 3948607 - RNA, 14 nt, Shigella flexneri 2a str. 301
gcgcucccgcagga

SEQ ID NO: 3948608 - RNA, 23 nt, Shigella flexneri 2a str. 301
gcgcucccgcaggagcgccgaau

SEQ ID NO: 3948609 - RNA, 15 nt, Shigella flexneri 2a str. 301
gcgcucgacuuuagu

SEQ ID NO: 3948610 - RNA, 22 nt, Shigella flexneri 2a str. 301
gcgcucgugccgcauccggcau

SEQ ID NO: 3948611 - RNA, 16 nt, Shigella flexneri 2a str. 301
gcgcucugcccaugcu

SEQ ID NO: 3948612 - RNA, 20 nt, Shigella flexneri 2a str. 301
gcgcucugguagauaagcaa

SEQ ID NO: 3948613 - RNA, 15 nt, Shigella flexneri 2a str. 301
gcgcugaaagaagcg

SEQ ID NO: 3948614 - RNA, 21 nt, Shigella flexneri 2a str. 301
gcgcugaaagaagcggugaaa

SEQ ID NO: 3948615 - RNA, 14 nt, Shigella flexneri 2a str. 301
gcgcugaacaucgu

SEQ ID NO: 3948616 - RNA, 20 nt, Shigella flexneri 2a str. 301
gcgcugaagaaaauggccag

SEQ ID NO: 3948617 - RNA, 14 nt, Shigella flexneri 2a str. 301
gcgcugaaggcaca

SEQ ID NO: 3948618 - RNA, 17 nt, Shigella flexneri 2a str. 301
gcgcugaaggcacagaa

SEQ ID NO: 3948619 - RNA, 20 nt, Shigella flexneri 2a str. 301
gcgcugaaggcacagaaaaa

SEQ ID NO: 3948620 - RNA, 16 nt, Shigella flexneri 2a str. 301
gcgcugaauguuugca

SEQ ID NO: 3948621 - RNA, 22 nt, Shigella flexneri 2a str. 301
gcgcugacauuacgcgcuucgu

SEQ ID NO: 3948622 - RNA, 23 nt, Shigella flexneri 2a str. 301
gcgcugacguuauugaucgccag

SEQ ID NO: 3948623 - RNA, 15 nt, Shigella flexneri 2a str. 301
gcgcugaugagcaaa

SEQ ID NO: 3948624 - RNA, 18 nt, Shigella flexneri 2a str. 301
gcgcugcgcuuaucaggc

SEQ ID NO: 3948625 - RNA, 15 nt, Shigella flexneri 2a str. 301
gcgcugcugcacaua

SEQ ID NO: 3948626 - RNA, 13 nt, Shigella flexneri 2a str. 301
gcgcuggcaaugg

SEQ ID NO: 3948627 - RNA, 22 nt, Shigella flexneri 2a str. 301
gcgcuggugacaucgccagaga

SEQ ID NO: 3948628 - RNA, 12 nt, Shigella flexneri 2a str. 301
gcgcuggugguc

SEQ ID NO: 3948629 - RNA, 21 nt, Shigella flexneri 2a str. 301
gcgcuuaaucaauugcaggaa

SEQ ID NO: 3948630 - RNA, 22 nt, Shigella flexneri 2a str. 301
gcgcuuaaucaauugcaggaag

SEQ ID NO: 3948631 - RNA, 16 nt, Shigella flexneri 2a str. 301
gcgcuuauagcgacca

SEQ ID NO: 3948632 - RNA, 14 nt, Shigella flexneri 2a str. 301
gcgcuuauccggcc

SEQ ID NO: 3948633 - RNA, 15 nt, Shigella flexneri 2a str. 301
gcgcuuauccggccc

SEQ ID NO: 3948634 - RNA, 14 nt, Shigella flexneri 2a str. 301
gcgcuuaucgccag

SEQ ID NO: 3948635 - RNA, 14 nt, Shigella flexneri 2a str. 301
gcgcuucaccaguu

SEQ ID NO: 3948636 - RNA, 14 nt, Shigella flexneri 2a str. 301
gcgcuuccagcucc

SEQ ID NO: 3948637 - RNA, 15 nt, Shigella flexneri 2a str. 301
gcgcuuccgucagac

SEQ ID NO: 3948638 - RNA, 12 nt, Shigella flexneri 2a str. 301
gcgcuuccugca

SEQ ID NO: 3948639 - RNA, 17 nt, Shigella flexneri 2a str. 301
gcgcuuccugcagcuuc

SEQ ID NO: 3948640 - RNA, 20 nt, Shigella flexneri 2a str. 301
gcgcuucgcuuaucaggccu

SEQ ID NO: 3948641 - RNA, 13 nt, Shigella flexneri 2a str. 301
gcgcuuucgccag

SEQ ID NO: 3948642 - RNA, 17 nt, Shigella flexneri 2a str. 301
gcgcuuuuuuccugccg

SEQ ID NO: 3948643 - RNA, 23 nt, Shigella flexneri 2a str. 301
gcggaaaagagaauaagcgcagc

SEQ ID NO: 3948644 - RNA, 16 nt, Shigella flexneri 2a str. 301
gcggaaagcaccugcg

SEQ ID NO: 3948645 - RNA, 23 nt, Shigella flexneri 2a str. 301
gcggaaauaucggcgucguugua

SEQ ID NO: 3948646 - RNA, 20 nt, Shigella flexneri 2a str. 301
gcggaaaucacgauugcugc

SEQ ID NO: 3948647 - RNA, 19 nt, Shigella flexneri 2a str. 301
gcggaaaucacgcaucacu

SEQ ID NO: 3948648 - RNA, 16 nt, Shigella flexneri 2a str. 301
gcggaaaucuccagau

SEQ ID NO: 3948649 - RNA, 22 nt, Shigella flexneri 2a str. 301
gcggaaauggccccgcuuacgc

SEQ ID NO: 3948650 - RNA, 15 nt, Shigella flexneri 2a str. 301
gcggaaauuaccgca

SEQ ID NO: 3948651 - RNA, 21 nt, Shigella flexneri 2a str. 301
gcggaacgcacuauacaacca

SEQ ID NO: 3948652 - RNA, 21 nt, Shigella flexneri 2a str. 301
gcggaagacccggcggcgcgc

SEQ ID NO: 3948653 - RNA, 19 nt, Shigella flexneri 2a str. 301
gcggaauugguagacgcgc

SEQ ID NO: 3948654 - RNA, 13 nt, Shigella flexneri 2a str. 301
gcggacaaccagc

SEQ ID NO: 3948655 - RNA, 15 nt, Shigella flexneri 2a str. 301
gcggacaaccagcuu

SEQ ID NO: 3948656 - RNA, 20 nt, Shigella flexneri 2a str. 301
gcggacaauaauaucuuuuu

SEQ ID NO: 3948657 - RNA, 23 nt, Shigella flexneri 2a str. 301
gcggacagccauccgucauccau

SEQ ID NO: 3948658 - RNA, 16 nt, Shigella flexneri 2a str. 301
gcggacgagagaguga

SEQ ID NO: 3948659 - RNA, 21 nt, Shigella flexneri 2a str. 301
gcggacgcacauagcgugaca

SEQ ID NO: 3948660 - RNA, 14 nt, Shigella flexneri 2a str. 301
gcggacgguucccu

SEQ ID NO: 3948661 - RNA, 13 nt, Shigella flexneri 2a str. 301
gcggacugaauac

SEQ ID NO: 3948662 - RNA, 20 nt, Shigella flexneri 2a str. 301
gcggacugaauacgcuggcg

SEQ ID NO: 3948663 - RNA, 16 nt, Shigella flexneri 2a str. 301
gcggagaguaaacggu

SEQ ID NO: 3948664 - RNA, 19 nt, Shigella flexneri 2a str. 301
gcggaggacguuaaagaaa

SEQ ID NO: 3948665 - RNA, 16 nt, Shigella flexneri 2a str. 301
gcgguaaacugcauga

SEQ ID NO: 3948666 - RNA, 20 nt, Shigella flexneri 2a str. 301
gcgguaaagcgcggcaguga

SEQ ID NO: 3948667 - RNA, 17 nt, Shigella flexneri 2a str. 301
gcgguaaaguuuggcug

SEQ ID NO: 3948668 - RNA, 20 nt, Shigella flexneri 2a str. 301
gcgguaaauuuuuugaucaa

SEQ ID NO: 3948669 - RNA, 15 nt, Shigella flexneri 2a str. 301
gcgguaaccuggcag

SEQ ID NO: 3948670 - RNA, 17 nt, Shigella flexneri 2a str. 301
gcgguacaccaaagcgg

SEQ ID NO: 3948671 - RNA, 19 nt, Shigella flexneri 2a str. 301
gcgguaguuucuccccaug

SEQ ID NO: 3948672 - RNA, 15 nt, Shigella flexneri 2a str. 301
gcgguaucaccaccc

SEQ ID NO: 3948673 - RNA, 16 nt, Shigella flexneri 2a str. 301
gcgguaucaccaccca

SEQ ID NO: 3948674 - RNA, 13 nt, Shigella flexneri 2a str. 301
gcggucaaccauc

SEQ ID NO: 3948675 - RNA, 14 nt, Shigella flexneri 2a str. 301
gcggucagcugcug

SEQ ID NO: 3948676 - RNA, 22 nt, Shigella flexneri 2a str. 301
gcggucauaaaauccguaaucg

SEQ ID NO: 3948677 - RNA, 17 nt, Shigella flexneri 2a str. 301
gcggucguaaucgcccg

SEQ ID NO: 3948678 - RNA, 16 nt, Shigella flexneri 2a str. 301
gcggugacguugucau

SEQ ID NO: 3948679 - RNA, 14 nt, Shigella flexneri 2a str. 301
gcggugagcguuuc

SEQ ID NO: 3948680 - RNA, 22 nt, Shigella flexneri 2a str. 301
gcggugaucccaauauagacaa

SEQ ID NO: 3948681 - RNA, 20 nt, Shigella flexneri 2a str. 301
gcggugccaucgauaaucac

SEQ ID NO: 3948682 - RNA, 21 nt, Shigella flexneri 2a str. 301
gcggugccauuaaaccaacaa

SEQ ID NO: 3948683 - RNA, 17 nt, Shigella flexneri 2a str. 301
gcggugcgaugccuggc

SEQ ID NO: 3948684 - RNA, 18 nt, Shigella flexneri 2a str. 301
gcgguguacccugcucgc

SEQ ID NO: 3948685 - RNA, 22 nt, Shigella flexneri 2a str. 301
gcgguguacccugcucgcugga

SEQ ID NO: 3948686 - RNA, 14 nt, Shigella flexneri 2a str. 301
gcggugucgccaga

SEQ ID NO: 3948687 - RNA, 16 nt, Shigella flexneri 2a str. 301
gcgguuaaauuccguu

SEQ ID NO: 3948688 - RNA, 18 nt, Shigella flexneri 2a str. 301
gcgguuacacaugcugcc

SEQ ID NO: 3948689 - RNA, 15 nt, Shigella flexneri 2a str. 301
gcgguucacgcgcca

SEQ ID NO: 3948690 - RNA, 20 nt, Shigella flexneri 2a str. 301
gcgguugguggcgguaacau

SEQ ID NO: 3948691 - RNA, 16 nt, Shigella flexneri 2a str. 301
gcgguuguucaagcau

SEQ ID NO: 3948692 - RNA, 18 nt, Shigella flexneri 2a str. 301
gcgguuugcgcauccagc

SEQ ID NO: 3948693 - RNA, 13 nt, Shigella flexneri 2a str. 301
gcguaaacgccuu

SEQ ID NO: 3948694 - RNA, 22 nt, Shigella flexneri 2a str. 301
gcguaaaggcggcagaacagaa

SEQ ID NO: 3948695 - RNA, 14 nt, Shigella flexneri 2a str. 301
gcguaaaucaaacc

SEQ ID NO: 3948696 - RNA, 23 nt, Shigella flexneri 2a str. 301
gcguaacggcucacgcccaucag

SEQ ID NO: 3948697 - RNA, 23 nt, Shigella flexneri 2a str. 301
gcguaauccugaaagcgugucau

SEQ ID NO: 3948698 - RNA, 21 nt, Shigella flexneri 2a str. 301
gcguaaugccugggcgauuuc

SEQ ID NO: 3948699 - RNA, 13 nt, Shigella flexneri 2a str. 301
gcguaauuugcga

SEQ ID NO: 3948700 - RNA, 13 nt, Shigella flexneri 2a str. 301
gcguacaccaaca

SEQ ID NO: 3948701 - RNA, 20 nt, Shigella flexneri 2a str. 301
gcguacauugccgacauggc

SEQ ID NO: 3948702 - RNA, 19 nt, Shigella flexneri 2a str. 301
gcguacuggcaaucgccag

SEQ ID NO: 3948703 - RNA, 16 nt, Shigella flexneri 2a str. 301
gcguagauucgaaaug

SEQ ID NO: 3948704 - RNA, 17 nt, Shigella flexneri 2a str. 301
gcguagcagcguuaaug

SEQ ID NO: 3948705 - RNA, 17 nt, Shigella flexneri 2a str. 301
gcguagccgauccgcgu

SEQ ID NO: 3948706 - RNA, 15 nt, Shigella flexneri 2a str. 301
gcguaguaaagccuu

SEQ ID NO: 3948707 - RNA, 16 nt, Shigella flexneri 2a str. 301
gcguagugcccgcagu

SEQ ID NO: 3948708 - RNA, 14 nt, Shigella flexneri 2a str. 301
gcguaucacggggg

SEQ ID NO: 3948709 - RNA, 17 nt, Shigella flexneri 2a str. 301
gcguauccagcauaccu

SEQ ID NO: 3948710 - RNA, 13 nt, Shigella flexneri 2a str. 301
gcguauccaucac

SEQ ID NO: 3948711 - RNA, 22 nt, Shigella flexneri 2a str. 301
gcguauccggcccguaaauuca

SEQ ID NO: 3948712 - RNA, 13 nt, Shigella flexneri 2a str. 301
gcguauccuccug

SEQ ID NO: 3948713 - RNA, 16 nt, Shigella flexneri 2a str. 301
gcguaucguaaaacgc

SEQ ID NO: 3948714 - RNA, 14 nt, Shigella flexneri 2a str. 301
gcguaucuguggcg

SEQ ID NO: 3948715 - RNA, 19 nt, Shigella flexneri 2a str. 301
gcguaugcagccaggccau

SEQ ID NO: 3948716 - RNA, 22 nt, Shigella flexneri 2a str. 301
gcguauucggcaagcguaacgu

SEQ ID NO: 3948717 - RNA, 22 nt, Shigella flexneri 2a str. 301
gcgucaacaacacucucugaag

SEQ ID NO: 3948718 - RNA, 19 nt, Shigella flexneri 2a str. 301
gcgucaagcgucgcaucag

SEQ ID NO: 3948719 - RNA, 22 nt, Shigella flexneri 2a str. 301
gcgucaaugccgcuucgagcug

SEQ ID NO: 3948720 - RNA, 19 nt, Shigella flexneri 2a str. 301
gcgucacgccgaccagacc

SEQ ID NO: 3948721 - RNA, 15 nt, Shigella flexneri 2a str. 301
gcgucagaaacaguu

SEQ ID NO: 3948722 - RNA, 16 nt, Shigella flexneri 2a str. 301
gcgucagcaacaugcc

SEQ ID NO: 3948723 - RNA, 16 nt, Shigella flexneri 2a str. 301
gcgucagcaccagaga

SEQ ID NO: 3948724 - RNA, 18 nt, Shigella flexneri 2a str. 301
gcgucagcauaaaaauau

SEQ ID NO: 3948725 - RNA, 16 nt, Shigella flexneri 2a str. 301
gcgucagcucacaaau

SEQ ID NO: 3948726 - RNA, 15 nt, Shigella flexneri 2a str. 301
gcgucagcuuucaga

SEQ ID NO: 3948727 - RNA, 14 nt, Shigella flexneri 2a str. 301
gcgucaggcgcgug

SEQ ID NO: 3948728 - RNA, 14 nt, Shigella flexneri 2a str. 301
gcgucaguuuuugc

SEQ ID NO: 3948729 - RNA, 17 nt, Shigella flexneri 2a str. 301
gcgucauugacgcuggc

SEQ ID NO: 3948730 - RNA, 21 nt, Shigella flexneri 2a str. 301
gcgucauuuucaucgcuuucu

SEQ ID NO: 3948731 - RNA, 22 nt, Shigella flexneri 2a str. 301
gcgucauuuucaucgcuuucuu

SEQ ID NO: 3948732 - RNA, 21 nt, Shigella flexneri 2a str. 301
gcguccacagccaacacauuu

SEQ ID NO: 3948733 - RNA, 14 nt, Shigella flexneri 2a str. 301
gcgucccaguaacg

SEQ ID NO: 3948734 - RNA, 13 nt, Shigella flexneri 2a str. 301
gcgucccaucggc

SEQ ID NO: 3948735 - RNA, 23 nt, Shigella flexneri 2a str. 301
gcguccccugcaauauuuugaau

SEQ ID NO: 3948736 - RNA, 14 nt, Shigella flexneri 2a str. 301
gcguccgccgauac

SEQ ID NO: 3948737 - RNA, 17 nt, Shigella flexneri 2a str. 301
gcguccgguaauuuuua

SEQ ID NO: 3948738 - RNA, 16 nt, Shigella flexneri 2a str. 301
gcguccguuuauuccg

SEQ ID NO: 3948739 - RNA, 18 nt, Shigella flexneri 2a str. 301
gcgucgacauagccaucc

SEQ ID NO: 3948740 - RNA, 20 nt, Shigella flexneri 2a str. 301
gcgucgacauagccaucccu

SEQ ID NO: 3948741 - RNA, 14 nt, Shigella flexneri 2a str. 301
gcgucgcauccgac

SEQ ID NO: 3948742 - RNA, 17 nt, Shigella flexneri 2a str. 301
gcgucgcauccggcacu

SEQ ID NO: 3948743 - RNA, 18 nt, Shigella flexneri 2a str. 301
gcgucgcugcucuucagu

SEQ ID NO: 3948744 - RNA, 14 nt, Shigella flexneri 2a str. 301
gcgucggaaccaca

SEQ ID NO: 3948745 - RNA, 19 nt, Shigella flexneri 2a str. 301
gcgucggcuuucagcgcga

SEQ ID NO: 3948746 - RNA, 17 nt, Shigella flexneri 2a str. 301
gcgucguucgcgccaac

SEQ ID NO: 3948747 - RNA, 21 nt, Shigella flexneri 2a str. 301
gcgucguucgcgccaacagcg

SEQ ID NO: 3948748 - RNA, 15 nt, Shigella flexneri 2a str. 301
gcgucguuguacaaa

SEQ ID NO: 3948749 - RNA, 14 nt, Shigella flexneri 2a str. 301
gcgucucaucuuua

SEQ ID NO: 3948750 - RNA, 19 nt, Shigella flexneri 2a str. 301
gcgucucuuuucguuuugg

SEQ ID NO: 3948751 - RNA, 18 nt, Shigella flexneri 2a str. 301
gcgucugcgugcggcggu

SEQ ID NO: 3948752 - RNA, 18 nt, Shigella flexneri 2a str. 301
gcgucuggcccaugccag

SEQ ID NO: 3948753 - RNA, 14 nt, Shigella flexneri 2a str. 301
gcgucuuaucaggc

SEQ ID NO: 3948754 - RNA, 20 nt, Shigella flexneri 2a str. 301
gcgucuuaucaggccuacaa

SEQ ID NO: 3948755 - RNA, 21 nt, Shigella flexneri 2a str. 301
gcgucuuaucaggccuacaag

SEQ ID NO: 3948756 - RNA, 16 nt, Shigella flexneri 2a str. 301
gcgucuuauccggccu

SEQ ID NO: 3948757 - RNA, 15 nt, Shigella flexneri 2a str. 301
gcgucuuaucuggcc

SEQ ID NO: 3948758 - RNA, 17 nt, Shigella flexneri 2a str. 301
gcgucuuaucuggccua

SEQ ID NO: 3948759 - RNA, 16 nt, Shigella flexneri 2a str. 301
gcgucuuccgugccug

SEQ ID NO: 3948760 - RNA, 13 nt, Shigella flexneri 2a str. 301
gcgugaacgccuu

SEQ ID NO: 3948761 - RNA, 23 nt, Shigella flexneri 2a str. 301
gcgugaacgccuuauccggccug

SEQ ID NO: 3948762 - RNA, 20 nt, Shigella flexneri 2a str. 301
gcgugaagugugcaaacgau

SEQ ID NO: 3948763 - RNA, 14 nt, Shigella flexneri 2a str. 301
gcgugaaucaacac

SEQ ID NO: 3948764 - RNA, 15 nt, Shigella flexneri 2a str. 301
gcgugaaucaacacc

SEQ ID NO: 3948765 - RNA, 22 nt, Shigella flexneri 2a str. 301
gcuaauuccagucguguuccgg

SEQ ID NO: 3948766 - RNA, 20 nt, Shigella flexneri 2a str. 301
gcuaauugcgaacugugcac

SEQ ID NO: 3948767 - RNA, 17 nt, Shigella flexneri 2a str. 301
gcuacaaaaaugcccga

SEQ ID NO: 3948768 - RNA, 15 nt, Shigella flexneri 2a str. 301
gcuacagccugguga

SEQ ID NO: 3948769 - RNA, 17 nt, Shigella flexneri 2a str. 301
gcuacaggguaaaaaga

SEQ ID NO: 3948770 - RNA, 13 nt, Shigella flexneri 2a str. 301
gcuacauaacgca

SEQ ID NO: 3948771 - RNA, 15 nt, Shigella flexneri 2a str. 301
gcuacauacuuaaau

SEQ ID NO: 3948772 - RNA, 17 nt, Shigella flexneri 2a str. 301
gcuacauacuuaaauaa

SEQ ID NO: 3948773 - RNA, 14 nt, Shigella flexneri 2a str. 301
gcuaccaccaaacg

SEQ ID NO: 3948774 - RNA, 20 nt, Shigella flexneri 2a str. 301
gcuacccugguuuccgcugu

SEQ ID NO: 3948775 - RNA, 15 nt, Shigella flexneri 2a str. 301
gcuaccgccagacca

SEQ ID NO: 3948776 - RNA, 15 nt, Shigella flexneri 2a str. 301
gcuaccgcccugagc

SEQ ID NO: 3948777 - RNA, 20 nt, Shigella flexneri 2a str. 301
gcuaccgcccugagcaucaa

SEQ ID NO: 3948778 - RNA, 21 nt, Shigella flexneri 2a str. 301
gcuaccgccgcaauccgccgu

SEQ ID NO: 3948779 - RNA, 14 nt, Shigella flexneri 2a str. 301
gcuaccggcaaacu

SEQ ID NO: 3948780 - RNA, 17 nt, Shigella flexneri 2a str. 301
gcuaccuugcucggcgc

SEQ ID NO: 3948781 - RNA, 23 nt, Shigella flexneri 2a str. 301
gcuacgaucgauaaccaucuucu

SEQ ID NO: 3948782 - RNA, 17 nt, Shigella flexneri 2a str. 301
gcuacgcagaaccagaa

SEQ ID NO: 3948783 - RNA, 13 nt, Shigella flexneri 2a str. 301
gcuacgccagcaa

SEQ ID NO: 3948784 - RNA, 17 nt, Shigella flexneri 2a str. 301
gcuacgccagcaagggu

SEQ ID NO: 3948785 - RNA, 21 nt, Shigella flexneri 2a str. 301
gcuacgcucaucaggccuaca

SEQ ID NO: 3948786 - RNA, 17 nt, Shigella flexneri 2a str. 301
gcuacgcuuaucaggcc

SEQ ID NO: 3948787 - RNA, 12 nt, Shigella flexneri 2a str. 301
gcuacggcauga

SEQ ID NO: 3948788 - RNA, 20 nt, Shigella flexneri 2a str. 301
gcuacggcguuucacuucug

SEQ ID NO: 3948789 - RNA, 20 nt, Shigella flexneri 2a str. 301
gcuacguucugcguaauguu

SEQ ID NO: 3948790 - RNA, 13 nt, Shigella flexneri 2a str. 301
gcuacugauaaua

SEQ ID NO: 3948791 - RNA, 17 nt, Shigella flexneri 2a str. 301
gcuacuggcaauccagc

SEQ ID NO: 3948792 - RNA, 19 nt, Shigella flexneri 2a str. 301
gcuacuggcaauccagcuc

SEQ ID NO: 3948793 - RNA, 16 nt, Shigella flexneri 2a str. 301
gcuacugucuaaaaua

SEQ ID NO: 3948794 - RNA, 16 nt, Shigella flexneri 2a str. 301
gcuacuucaaacaaaa

SEQ ID NO: 3948795 - RNA, 19 nt, Shigella flexneri 2a str. 301
gcuagcuggcucgacaaaa

SEQ ID NO: 3948796 - RNA, 13 nt, Shigella flexneri 2a str. 301
gcuagcuucaggu

SEQ ID NO: 3948797 - RNA, 14 nt, Shigella flexneri 2a str. 301
gcuauacagcagcc

SEQ ID NO: 3948798 - RNA, 14 nt, Shigella flexneri 2a str. 301
gcuauaucgcugau

SEQ ID NO: 3948799 - RNA, 16 nt, Shigella flexneri 2a str. 301
gcuauauuuugccgga

SEQ ID NO: 3948800 - RNA, 17 nt, Shigella flexneri 2a str. 301
gcuaucagcgccaccac

SEQ ID NO: 3948801 - RNA, 19 nt, Shigella flexneri 2a str. 301
gcuaucagcgccaccacaa

SEQ ID NO: 3948802 - RNA, 13 nt, Shigella flexneri 2a str. 301
gcuauccugguua

SEQ ID NO: 3948803 - RNA, 16 nt, Shigella flexneri 2a str. 301
gcuaucgaggcucuga

SEQ ID NO: 3948804 - RNA, 21 nt, Shigella flexneri 2a str. 301
gcuaucguccacgucaucaaa

SEQ ID NO: 3948805 - RNA, 14 nt, Shigella flexneri 2a str. 301
gcuaucuuucaaca

SEQ ID NO: 3948806 - RNA, 17 nt, Shigella flexneri 2a str. 301
gcuauuacgcacacuuu

SEQ ID NO: 3948807 - RNA, 13 nt, Shigella flexneri 2a str. 301
gcuauucagcagu

SEQ ID NO: 3948808 - RNA, 18 nt, Shigella flexneri 2a str. 301
gcuauucuuauaaagaaa

SEQ ID NO: 3948809 - RNA, 22 nt, Shigella flexneri 2a str. 301
gcuauugccgccaaaucggaac

SEQ ID NO: 3948810 - RNA, 16 nt, Shigella flexneri 2a str. 301
gcuauugcgccagccu

SEQ ID NO: 3948811 - RNA, 21 nt, Shigella flexneri 2a str. 301
gcuauuuaccacuacugcguc

SEQ ID NO: 3948812 - RNA, 17 nt, Shigella flexneri 2a str. 301
gcuauuugcccaccugc

SEQ ID NO: 3948813 - RNA, 12 nt, Shigella flexneri 2a str. 301
gcuauuugcgcc

SEQ ID NO: 3948814 - RNA, 20 nt, Shigella flexneri 2a str. 301
gcuauuuuuugcaggccaga

SEQ ID NO: 3948815 - RNA, 21 nt, Shigella flexneri 2a str. 301
gcuauuuuuugcaggccagau

SEQ ID NO: 3948816 - RNA, 18 nt, Shigella flexneri 2a str. 301
gcuauuuuuugcagugcu

SEQ ID NO: 3948817 - RNA, 23 nt, Shigella flexneri 2a str. 301
gcucaaaaauccagauuuauaaa

SEQ ID NO: 3948818 - RNA, 19 nt, Shigella flexneri 2a str. 301
gcucaaacggcguuuucuc

SEQ ID NO: 3948819 - RNA, 22 nt, Shigella flexneri 2a str. 301
gcucaaacuucgucacagcggc

SEQ ID NO: 3948820 - RNA, 18 nt, Shigella flexneri 2a str. 301
gcucaaagacgcgguaaa

SEQ ID NO: 3948821 - RNA, 22 nt, Shigella flexneri 2a str. 301
gcucaaagacgcgguaaaagcc

SEQ ID NO: 3948822 - RNA, 13 nt, Shigella flexneri 2a str. 301
gcucaaagauauu

SEQ ID NO: 3948823 - RNA, 20 nt, Shigella flexneri 2a str. 301
gcucaaaggcauuaaacgca

SEQ ID NO: 3948824 - RNA, 10 nt, Shigella flexneri 2a str. 301
gcucaaaucc

SEQ ID NO: 3948825 - RNA, 17 nt, Shigella flexneri 2a str. 301
gcucaaauccaucagac

SEQ ID NO: 3948826 - RNA, 14 nt, Shigella flexneri 2a str. 301
gcucaacaaaccgu

SEQ ID NO: 3948827 - RNA, 23 nt, Shigella flexneri 2a str. 301
gcucaacugccaguucccccugc

SEQ ID NO: 3948828 - RNA, 18 nt, Shigella flexneri 2a str. 301
gcucaagcguuucaucuu

SEQ ID NO: 3948829 - RNA, 17 nt, Shigella flexneri 2a str. 301
gcucaauaaaagaaauc

SEQ ID NO: 3948830 - RNA, 17 nt, Shigella flexneri 2a str. 301
gcucaauauccugaccu

SEQ ID NO: 3948831 - RNA, 23 nt, Shigella flexneri 2a str. 301
gcucaaucguaugaucauccgcc

SEQ ID NO: 3948832 - RNA, 18 nt, Shigella flexneri 2a str. 301
gcucaaugguguuuucca

SEQ ID NO: 3948833 - RNA, 15 nt, Shigella flexneri 2a str. 301
gcucaaugucuguca

SEQ ID NO: 3948834 - RNA, 14 nt, Shigella flexneri 2a str. 301
gcucaauuccccua

SEQ ID NO: 3948835 - RNA, 23 nt, Shigella flexneri 2a str. 301
gcucaauugacaguuuauuuucu

SEQ ID NO: 3948836 - RNA, 18 nt, Shigella flexneri 2a str. 301
gcucacagaguauuucca

SEQ ID NO: 3948837 - RNA, 23 nt, Shigella flexneri 2a str. 301
gcucaccaaaaccgagaagcagc

SEQ ID NO: 3948838 - RNA, 13 nt, Shigella flexneri 2a str. 301
gcucaccagcagc

SEQ ID NO: 3948839 - RNA, 14 nt, Shigella flexneri 2a str. 301
gcucaccgccagca

SEQ ID NO: 3948840 - RNA, 14 nt, Shigella flexneri 2a str. 301
gcucaccugacugu

SEQ ID NO: 3948841 - RNA, 15 nt, Shigella flexneri 2a str. 301
gcucaccugauacgc

SEQ ID NO: 3948842 - RNA, 17 nt, Shigella flexneri 2a str. 301
gcucacgcagcggcggc

SEQ ID NO: 3948843 - RNA, 18 nt, Shigella flexneri 2a str. 301
gcucacgcagcggcggca

SEQ ID NO: 3948844 - RNA, 15 nt, Shigella flexneri 2a str. 301
gcucacgcccaucag

SEQ ID NO: 3948845 - RNA, 16 nt, Shigella flexneri 2a str. 301
gcucacucaucacucc

SEQ ID NO: 3948846 - RNA, 19 nt, Shigella flexneri 2a str. 301
gcucacugcaaaacagguc

SEQ ID NO: 3948847 - RNA, 21 nt, Shigella flexneri 2a str. 301
gcucacuucgauccagugauu

SEQ ID NO: 3948848 - RNA, 23 nt, Shigella flexneri 2a str. 301
gcucagaaucacgccaacaaaca

SEQ ID NO: 3948849 - RNA, 16 nt, Shigella flexneri 2a str. 301
gcucagcgcauccugc

SEQ ID NO: 3948850 - RNA, 15 nt, Shigella flexneri 2a str. 301
gcucagcgccacauc

SEQ ID NO: 3948851 - RNA, 15 nt, Shigella flexneri 2a str. 301
gcucaggcgaugaaa

SEQ ID NO: 3948852 - RNA, 16 nt, Shigella flexneri 2a str. 301
gcucagucacuucaaa

SEQ ID NO: 3948853 - RNA, 21 nt, Shigella flexneri 2a str. 301
gcucagucggcgcuuuugcau

SEQ ID NO: 3948854 - RNA, 17 nt, Shigella flexneri 2a str. 301
gcucaguugcaucgucu

SEQ ID NO: 3948855 - RNA, 15 nt, Shigella flexneri 2a str. 301
gcucaguugguuaga

SEQ ID NO: 3948856 - RNA, 18 nt, Shigella flexneri 2a str. 301
gcucauaaaaucacgcgc

SEQ ID NO: 3948857 - RNA, 20 nt, Shigella flexneri 2a str. 301
gcucauaaaaucacgcgccu

SEQ ID NO: 3948858 - RNA, 15 nt, Shigella flexneri 2a str. 301
gcucauaaccgucca

SEQ ID NO: 3948859 - RNA, 13 nt, Shigella flexneri 2a str. 301
gcucauagccacu

SEQ ID NO: 3948860 - RNA, 23 nt, Shigella flexneri 2a str. 301
gcucauagggugugacgacacca

SEQ ID NO: 3948861 - RNA, 14 nt, Shigella flexneri 2a str. 301
gcucaucaagcaca

SEQ ID NO: 3948862 - RNA, 15 nt, Shigella flexneri 2a str. 301
gcucaucaagcuguu

SEQ ID NO: 3948863 - RNA, 16 nt, Shigella flexneri 2a str. 301
gcucaucagcccggca

SEQ ID NO: 3948864 - RNA, 12 nt, Shigella flexneri 2a str. 301
gcucaucagcgg

SEQ ID NO: 3948865 - RNA, 14 nt, Shigella flexneri 2a str. 301
gcucuuuuccagcc

SEQ ID NO: 3948866 - RNA, 22 nt, Shigella flexneri 2a str. 301
gcucuuuugacgcccccaaacu

SEQ ID NO: 3948867 - RNA, 22 nt, Shigella flexneri 2a str. 301
gcugaaagcgccgggaaugcca

SEQ ID NO: 3948868 - RNA, 18 nt, Shigella flexneri 2a str. 301
gcugaaagggcaaauaau

SEQ ID NO: 3948869 - RNA, 17 nt, Shigella flexneri 2a str. 301
gcugaaaucacagcggc

SEQ ID NO: 3948870 - RNA, 16 nt, Shigella flexneri 2a str. 301
gcugaaccguaggccg

SEQ ID NO: 3948871 - RNA, 18 nt, Shigella flexneri 2a str. 301
gcugaaccguaggccgua

SEQ ID NO: 3948872 - RNA, 17 nt, Shigella flexneri 2a str. 301
gcugaacgugcucugcg

SEQ ID NO: 3948873 - RNA, 16 nt, Shigella flexneri 2a str. 301
gcugaacucgacgccc

SEQ ID NO: 3948874 - RNA, 22 nt, Shigella flexneri 2a str. 301
gcugaacugauugccacccugc

SEQ ID NO: 3948875 - RNA, 18 nt, Shigella flexneri 2a str. 301
gcugaacuggcgaagccu

SEQ ID NO: 3948876 - RNA, 13 nt, Shigella flexneri 2a str. 301
gcugaacuuaugc

SEQ ID NO: 3948877 - RNA, 18 nt, Shigella flexneri 2a str. 301
gcugaagaaaauggccag

SEQ ID NO: 3948878 - RNA, 14 nt, Shigella flexneri 2a str. 301
gcugaauaccgauu

SEQ ID NO: 3948879 - RNA, 15 nt, Shigella flexneri 2a str. 301
gcugaauaucuuucu

SEQ ID NO: 3948880 - RNA, 21 nt, Shigella flexneri 2a str. 301
gcugaaucaacaggcgguaac

SEQ ID NO: 3948881 - RNA, 18 nt, Shigella flexneri 2a str. 301
gcugacaaaucagaggcu

SEQ ID NO: 3948882 - RNA, 20 nt, Shigella flexneri 2a str. 301
gcugacaacgcugaauggcg

SEQ ID NO: 3948883 - RNA, 17 nt, Shigella flexneri 2a str. 301
gcugacaggcgcugaug

SEQ ID NO: 3948884 - RNA, 18 nt, Shigella flexneri 2a str. 301
gcugacaggcgcugauga

SEQ ID NO: 3948885 - RNA, 20 nt, Shigella flexneri 2a str. 301
gcugacauaaacaccagcaa

SEQ ID NO: 3948886 - RNA, 14 nt, Shigella flexneri 2a str. 301
gcugaccaccaccg

SEQ ID NO: 3948887 - RNA, 20 nt, Shigella flexneri 2a str. 301
gcugaccagaauuuacccgc

SEQ ID NO: 3948888 - RNA, 22 nt, Shigella flexneri 2a str. 301
gcugaccagacuggagcacugc

SEQ ID NO: 3948889 - RNA, 20 nt, Shigella flexneri 2a str. 301
gcugaccccaaccgcccugc

SEQ ID NO: 3948890 - RNA, 18 nt, Shigella flexneri 2a str. 301
gcugaccguacccgcugc

SEQ ID NO: 3948891 - RNA, 20 nt, Shigella flexneri 2a str. 301
gcugaccgucaaagcgccag

SEQ ID NO: 3948892 - RNA, 15 nt, Shigella flexneri 2a str. 301
gcugacgcacuguug

SEQ ID NO: 3948893 - RNA, 15 nt, Shigella flexneri 2a str. 301
gcugacgcaucuucu

SEQ ID NO: 3948894 - RNA, 22 nt, Shigella flexneri 2a str. 301
gcugacggugauaaucauccca

SEQ ID NO: 3948895 - RNA, 15 nt, Shigella flexneri 2a str. 301
gcugacggugaugau

SEQ ID NO: 3948896 - RNA, 21 nt, Shigella flexneri 2a str. 301
gcugacgugauuuagcaccga

SEQ ID NO: 3948897 - RNA, 18 nt, Shigella flexneri 2a str. 301
gcugacguuaagaaaacg

SEQ ID NO: 3948898 - RNA, 17 nt, Shigella flexneri 2a str. 301
gcugacugucgcagcca

SEQ ID NO: 3948899 - RNA, 22 nt, Shigella flexneri 2a str. 301
gcugacugucgcagccagcgcg

SEQ ID NO: 3948900 - RNA, 17 nt, Shigella flexneri 2a str. 301
gcugacuuugauccagc

SEQ ID NO: 3948901 - RNA, 19 nt, Shigella flexneri 2a str. 301
gcugacuuugauccagcca

SEQ ID NO: 3948902 - RNA, 22 nt, Shigella flexneri 2a str. 301
gcugagauuuaugacaaacgca

SEQ ID NO: 3948903 - RNA, 21 nt, Shigella flexneri 2a str. 301
gcugagcaaacaguucugcag

SEQ ID NO: 3948904 - RNA, 14 nt, Shigella flexneri 2a str. 301
gcugaggcguuuca

SEQ ID NO: 3948905 - RNA, 18 nt, Shigella flexneri 2a str. 301
gcugaggcguuucaacuc

SEQ ID NO: 3948906 - RNA, 19 nt, Shigella flexneri 2a str. 301
gcugagggauccccagaaa

SEQ ID NO: 3948907 - RNA, 13 nt, Shigella flexneri 2a str. 301
gcugauaaacaag

SEQ ID NO: 3948908 - RNA, 15 nt, Shigella flexneri 2a str. 301
gcugauaaaucccgc

SEQ ID NO: 3948909 - RNA, 15 nt, Shigella flexneri 2a str. 301
gcugauaacaauauc

SEQ ID NO: 3948910 - RNA, 17 nt, Shigella flexneri 2a str. 301
gcugauaacaauaucaa

SEQ ID NO: 3948911 - RNA, 14 nt, Shigella flexneri 2a str. 301
gcugauaagacgca

SEQ ID NO: 3948912 - RNA, 19 nt, Shigella flexneri 2a str. 301
gcugauacuccaugaguaa

SEQ ID NO: 3948913 - RNA, 20 nt, Shigella flexneri 2a str. 301
gcugauauucgacaccaucu

SEQ ID NO: 3948914 - RNA, 13 nt, Shigella flexneri 2a str. 301
gcugauauuuauc

SEQ ID NO: 3948915 - RNA, 12 nt, Shigella flexneri 2a str. 301
gcugaugacgcg

SEQ ID NO: 3948916 - RNA, 12 nt, Shigella flexneri 2a str. 301
gcugaugagcaa

SEQ ID NO: 3948917 - RNA, 23 nt, Shigella flexneri 2a str. 301
gcugaugauuaacagcaaacagu

SEQ ID NO: 3948918 - RNA, 20 nt, Shigella flexneri 2a str. 301
gcugaugcaggcgaucgacg

SEQ ID NO: 3948919 - RNA, 14 nt, Shigella flexneri 2a str. 301
gcugaugccaggcu

SEQ ID NO: 3948920 - RNA, 18 nt, Shigella flexneri 2a str. 301
gcugaugccgcguuggug

SEQ ID NO: 3948921 - RNA, 19 nt, Shigella flexneri 2a str. 301
gcugauggcgccaguuauu

SEQ ID NO: 3948922 - RNA, 22 nt, Shigella flexneri 2a str. 301
gcugauggucagugccugcgcc

SEQ ID NO: 3948923 - RNA, 19 nt, Shigella flexneri 2a str. 301
gcugauuaugucaucaucg

SEQ ID NO: 3948924 - RNA, 14 nt, Shigella flexneri 2a str. 301
gcugauuccugcaa

SEQ ID NO: 3948925 - RNA, 20 nt, Shigella flexneri 2a str. 301
gcugauucucccucaucauu

SEQ ID NO: 3948926 - RNA, 21 nt, Shigella flexneri 2a str. 301
gcugauuucaccccacaccac

SEQ ID NO: 3948927 - RNA, 20 nt, Shigella flexneri 2a str. 301
gcugauuuuggucaugcuaa

SEQ ID NO: 3948928 - RNA, 12 nt, Shigella flexneri 2a str. 301
gcugauuuuucu

SEQ ID NO: 3948929 - RNA, 21 nt, Shigella flexneri 2a str. 301
gcugauuuuucugcucguugc

SEQ ID NO: 3948930 - RNA, 20 nt, Shigella flexneri 2a str. 301
gcugauuuuuuuucaaccua

SEQ ID NO: 3948931 - RNA, 22 nt, Shigella flexneri 2a str. 301
gcugauuuuuuuucaaccuaaa

SEQ ID NO: 3948932 - RNA, 16 nt, Shigella flexneri 2a str. 301
gcugcaaaaaauugcg

SEQ ID NO: 3948933 - RNA, 18 nt, Shigella flexneri 2a str. 301
gcugcaaagcauuuuuuc

SEQ ID NO: 3948934 - RNA, 12 nt, Shigella flexneri 2a str. 301
gcugcaaagucu

SEQ ID NO: 3948935 - RNA, 17 nt, Shigella flexneri 2a str. 301
gcugcaaagucugggcu

SEQ ID NO: 3948936 - RNA, 13 nt, Shigella flexneri 2a str. 301
gcugcaauaaaau

SEQ ID NO: 3948937 - RNA, 22 nt, Shigella flexneri 2a str. 301
gcugcaauaaaauaucuuccac

SEQ ID NO: 3948938 - RNA, 19 nt, Shigella flexneri 2a str. 301
gcugcacaauugccagccc

SEQ ID NO: 3948939 - RNA, 20 nt, Shigella flexneri 2a str. 301
gcugcacauacugcaucagc

SEQ ID NO: 3948940 - RNA, 15 nt, Shigella flexneri 2a str. 301
gcugcacauccggua

SEQ ID NO: 3948941 - RNA, 17 nt, Shigella flexneri 2a str. 301
gcugcaccucgagauca

SEQ ID NO: 3948942 - RNA, 19 nt, Shigella flexneri 2a str. 301
gcugcaccucgagaucauc

SEQ ID NO: 3948943 - RNA, 19 nt, Shigella flexneri 2a str. 301
gcugcacgccaucuggcug

SEQ ID NO: 3948944 - RNA, 20 nt, Shigella flexneri 2a str. 301
gcugcacgccaucuggcuga

SEQ ID NO: 3948945 - RNA, 22 nt, Shigella flexneri 2a str. 301
gcugcacgucauacugcucaga

SEQ ID NO: 3948946 - RNA, 19 nt, Shigella flexneri 2a str. 301
gcugcacugguuuccgcca

SEQ ID NO: 3948947 - RNA, 16 nt, Shigella flexneri 2a str. 301
gcugcagccaggguca

SEQ ID NO: 3948948 - RNA, 22 nt, Shigella flexneri 2a str. 301
gcugcagcucaucuaaugcagg

SEQ ID NO: 3948949 - RNA, 23 nt, Shigella flexneri 2a str. 301
gcugcaggaauaaucagcaacga

SEQ ID NO: 3948950 - RNA, 18 nt, Shigella flexneri 2a str. 301
gcugcauccgcgcuuucu

SEQ ID NO: 3948951 - RNA, 14 nt, Shigella flexneri 2a str. 301
gcugcaucugaaac

SEQ ID NO: 3948952 - RNA, 12 nt, Shigella flexneri 2a str. 301
gcugcauugccc

SEQ ID NO: 3948953 - RNA, 15 nt, Shigella flexneri 2a str. 301
gcugccagaaccgcu

SEQ ID NO: 3948954 - RNA, 13 nt, Shigella flexneri 2a str. 301
gcugccagcacuu

SEQ ID NO: 3948955 - RNA, 13 nt, Shigella flexneri 2a str. 301
gcugccaucgcaa

SEQ ID NO: 3948956 - RNA, 14 nt, Shigella flexneri 2a str. 301
gcugcccaucaucg

SEQ ID NO: 3948957 - RNA, 20 nt, Shigella flexneri 2a str. 301
gcugccgaaccacugaugga

SEQ ID NO: 3948958 - RNA, 13 nt, Shigella flexneri 2a str. 301
gcugccgacgcca

SEQ ID NO: 3948959 - RNA, 15 nt, Shigella flexneri 2a str. 301
gcugccgacgccagu

SEQ ID NO: 3948960 - RNA, 20 nt, Shigella flexneri 2a str. 301
gcugccgccaguucuuccag

SEQ ID NO: 3948961 - RNA, 16 nt, Shigella flexneri 2a str. 301
gcugccgccaguuuac

SEQ ID NO: 3948962 - RNA, 14 nt, Shigella flexneri 2a str. 301
gcugccgcgccaga

SEQ ID NO: 3948963 - RNA, 18 nt, Shigella flexneri 2a str. 301
gcugccggaccaucuucc

SEQ ID NO: 3948964 - RNA, 22 nt, Shigella flexneri 2a str. 301
gcugccggagcggacugcugcg

SEQ ID NO: 3948965 - RNA, 16 nt, Shigella flexneri 2a str. 301
gcuguacauauccagu

SEQ ID NO: 3948966 - RNA, 14 nt, Shigella flexneri 2a str. 301
gcuguacgccuuca

SEQ ID NO: 3948967 - RNA, 18 nt, Shigella flexneri 2a str. 301
gcuguagaagcugacgac

SEQ ID NO: 3948968 - RNA, 20 nt, Shigella flexneri 2a str. 301
gcuguagcaguuccagcauc

SEQ ID NO: 3948969 - RNA, 18 nt, Shigella flexneri 2a str. 301
gcuguagcuguucuggcg

SEQ ID NO: 3948970 - RNA, 20 nt, Shigella flexneri 2a str. 301
gcuguaguccuaacagagca

SEQ ID NO: 3948971 - RNA, 16 nt, Shigella flexneri 2a str. 301
gcuguauguuccccuc

SEQ ID NO: 3948972 - RNA, 20 nt, Shigella flexneri 2a str. 301
gcuguauucaagccaugaau

SEQ ID NO: 3948973 - RNA, 19 nt, Shigella flexneri 2a str. 301
gcugucaacugcgccacuc

SEQ ID NO: 3948974 - RNA, 16 nt, Shigella flexneri 2a str. 301
gcugucauccagcagc

SEQ ID NO: 3948975 - RNA, 17 nt, Shigella flexneri 2a str. 301
gcuguccgcuucaccac

SEQ ID NO: 3948976 - RNA, 19 nt, Shigella flexneri 2a str. 301
gcuguccgcuucaccaccg

SEQ ID NO: 3948977 - RNA, 19 nt, Shigella flexneri 2a str. 301
gcuguccggcaccaucgga

SEQ ID NO: 3948978 - RNA, 19 nt, Shigella flexneri 2a str. 301
gcuguccggcgcacuggug

SEQ ID NO: 3948979 - RNA, 21 nt, Shigella flexneri 2a str. 301
gcuguccggugauuuaucuuc

SEQ ID NO: 3948980 - RNA, 23 nt, Shigella flexneri 2a str. 301
gcugucgccaucccugucgucca

SEQ ID NO: 3948981 - RNA, 13 nt, Shigella flexneri 2a str. 301
gcugucggcggcg

SEQ ID NO: 3948982 - RNA, 20 nt, Shigella flexneri 2a str. 301
gcugucggcugccagccaua

SEQ ID NO: 3948983 - RNA, 14 nt, Shigella flexneri 2a str. 301
gcugucgguuucga

SEQ ID NO: 3948984 - RNA, 20 nt, Shigella flexneri 2a str. 301
gcugugacagauuuugccag

SEQ ID NO: 3948985 - RNA, 14 nt, Shigella flexneri 2a str. 301
gcugugccaggacu

SEQ ID NO: 3948986 - RNA, 20 nt, Shigella flexneri 2a str. 301
gcugugccagugccacacgc

SEQ ID NO: 3948987 - RNA, 14 nt, Shigella flexneri 2a str. 301
gcugugcggucuga

SEQ ID NO: 3948988 - RNA, 12 nt, Shigella flexneri 2a str. 301
gcugugcucugg

SEQ ID NO: 3948989 - RNA, 18 nt, Shigella flexneri 2a str. 301
gcugugggguauuuccag

SEQ ID NO: 3948990 - RNA, 16 nt, Shigella flexneri 2a str. 301
gcuguuaucccagcag

SEQ ID NO: 3948991 - RNA, 20 nt, Shigella flexneri 2a str. 301
gcuguuaucccagcaguuuc

SEQ ID NO: 3948992 - RNA, 15 nt, Shigella flexneri 2a str. 301
gcuguuccaucuuua

SEQ ID NO: 3948993 - RNA, 17 nt, Shigella flexneri 2a str. 301
gcuguuccggcuuuguu

SEQ ID NO: 3948994 - RNA, 20 nt, Shigella flexneri 2a str. 301
gcuguucgguuuugcccaca

SEQ ID NO: 3948995 - RNA, 12 nt, Shigella flexneri 2a str. 301
gcuguucuuccc

SEQ ID NO: 3948996 - RNA, 18 nt, Shigella flexneri 2a str. 301
gcuguuggugaacagcau

SEQ ID NO: 3948997 - RNA, 16 nt, Shigella flexneri 2a str. 301
gcuguuggugccagau

SEQ ID NO: 3948998 - RNA, 17 nt, Shigella flexneri 2a str. 301
gcuguugucugaaugau

SEQ ID NO: 3948999 - RNA, 14 nt, Shigella flexneri 2a str. 301
gcuguuguucaaca

SEQ ID NO: 3949000 - RNA, 15 nt, Shigella flexneri 2a str. 301
gcuguuguucaacac

SEQ ID NO: 3949001 - RNA, 20 nt, Shigella flexneri 2a str. 301
gcuguuguuuuuucaaccua

SEQ ID NO: 3949002 - RNA, 17 nt, Shigella flexneri 2a str. 301
gcuguuuguucaagcgc

SEQ ID NO: 3949003 - RNA, 14 nt, Shigella flexneri 2a str. 301
gcuguuuucagcac

SEQ ID NO: 3949004 - RNA, 16 nt, Shigella flexneri 2a str. 301
gcuguuuuccagcacc

SEQ ID NO: 3949005 - RNA, 19 nt, Shigella flexneri 2a str. 301
gcuguuuuccagcaccacu

SEQ ID NO: 3949006 - RNA, 15 nt, Shigella flexneri 2a str. 301
gcuguuuuucguuug

SEQ ID NO: 3949007 - RNA, 18 nt, Shigella flexneri 2a str. 301
gcuuaacaacgggcaccg

SEQ ID NO: 3949008 - RNA, 15 nt, Shigella flexneri 2a str. 301
gcuuaacagaacggc

SEQ ID NO: 3949009 - RNA, 14 nt, Shigella flexneri 2a str. 301
gcuuaacugauauu

SEQ ID NO: 3949010 - RNA, 16 nt, Shigella flexneri 2a str. 301
gcuuaagccaucauca

SEQ ID NO: 3949011 - RNA, 18 nt, Shigella flexneri 2a str. 301
gcuuaaggcagaaacaaa

SEQ ID NO: 3949012 - RNA, 18 nt, Shigella flexneri 2a str. 301
gcuuaaugcauggcagau

SEQ ID NO: 3949013 - RNA, 17 nt, Shigella flexneri 2a str. 301
gcuuaauguuaaccauc

SEQ ID NO: 3949014 - RNA, 20 nt, Shigella flexneri 2a str. 301
gcuuaauguugagcggcagu

SEQ ID NO: 3949015 - RNA, 16 nt, Shigella flexneri 2a str. 301
gcuuaauuacugccuu

SEQ ID NO: 3949016 - RNA, 22 nt, Shigella flexneri 2a str. 301
gcuuaauugcccgaagccaauu

SEQ ID NO: 3949017 - RNA, 15 nt, Shigella flexneri 2a str. 301
gcuuaccaugccaac

SEQ ID NO: 3949018 - RNA, 21 nt, Shigella flexneri 2a str. 301
gcuuaccguccucuucccaga

SEQ ID NO: 3949019 - RNA, 22 nt, Shigella flexneri 2a str. 301
gcuuaccguccucuucccagac

SEQ ID NO: 3949020 - RNA, 14 nt, Shigella flexneri 2a str. 301
gcuuacgccugcca

SEQ ID NO: 3949021 - RNA, 21 nt, Shigella flexneri 2a str. 301
gcuuacguuacccagcacgga

SEQ ID NO: 3949022 - RNA, 14 nt, Shigella flexneri 2a str. 301
gcuuacucauccac

SEQ ID NO: 3949023 - RNA, 21 nt, Shigella flexneri 2a str. 301
gcuuacucaugaugucauaaa

SEQ ID NO: 3949024 - RNA, 18 nt, Shigella flexneri 2a str. 301
gcuuacucuucguucuuc

SEQ ID NO: 3949025 - RNA, 22 nt, Shigella flexneri 2a str. 301
gcuuacuugcugcucugaaggu

SEQ ID NO: 3949026 - RNA, 21 nt, Shigella flexneri 2a str. 301
gcuuauauauuaaucaucauu

SEQ ID NO: 3949027 - RNA, 19 nt, Shigella flexneri 2a str. 301
gcuuaucaggccuacaaaa

SEQ ID NO: 3949028 - RNA, 18 nt, Shigella flexneri 2a str. 301
gcuuaucaggccuacgcg

SEQ ID NO: 3949029 - RNA, 19 nt, Shigella flexneri 2a str. 301
gcuuaucaggccugcaaac

SEQ ID NO: 3949030 - RNA, 18 nt, Shigella flexneri 2a str. 301
gcuuaucccagccacgau

SEQ ID NO: 3949031 - RNA, 16 nt, Shigella flexneri 2a str. 301
gcuuaucgccagcgcc

SEQ ID NO: 3949032 - RNA, 17 nt, Shigella flexneri 2a str. 301
gcuuaucgccagcgcca

SEQ ID NO: 3949033 - RNA, 21 nt, Shigella flexneri 2a str. 301
gcuuaucgccagcgccacgca

SEQ ID NO: 3949034 - RNA, 19 nt, Shigella flexneri 2a str. 301
gcuuaucgcccugcuccag

SEQ ID NO: 3949035 - RNA, 14 nt, Shigella flexneri 2a str. 301
gcuuaucuuccugu

SEQ ID NO: 3949036 - RNA, 22 nt, Shigella flexneri 2a str. 301
gcuuaugcgccguuuuuuuucu

SEQ ID NO: 3949037 - RNA, 16 nt, Shigella flexneri 2a str. 301
gcuuauuagggaucau

SEQ ID NO: 3949038 - RNA, 23 nt, Shigella flexneri 2a str. 301
gcuuauuagggaucaucuuaacu

SEQ ID NO: 3949039 - RNA, 17 nt, Shigella flexneri 2a str. 301
gcuuauucaucaauucg

SEQ ID NO: 3949040 - RNA, 14 nt, Shigella flexneri 2a str. 301
gcuuauucauuacu

SEQ ID NO: 3949041 - RNA, 13 nt, Shigella flexneri 2a str. 301
gcuucaaagugau

SEQ ID NO: 3949042 - RNA, 15 nt, Shigella flexneri 2a str. 301
gcuucaaauuagccg

SEQ ID NO: 3949043 - RNA, 17 nt, Shigella flexneri 2a str. 301
gcuucaaauuagccgca

SEQ ID NO: 3949044 - RNA, 15 nt, Shigella flexneri 2a str. 301
gcuucaacacaggcc

SEQ ID NO: 3949045 - RNA, 18 nt, Shigella flexneri 2a str. 301
gcuucaacacaggccggc

SEQ ID NO: 3949046 - RNA, 15 nt, Shigella flexneri 2a str. 301
gcuucaaccaacgca

SEQ ID NO: 3949047 - RNA, 18 nt, Shigella flexneri 2a str. 301
gcuucaaccguugcugga

SEQ ID NO: 3949048 - RNA, 16 nt, Shigella flexneri 2a str. 301
gcuucaaggugcgcga

SEQ ID NO: 3949049 - RNA, 21 nt, Shigella flexneri 2a str. 301
gcuucaaucaauaacagcgca

SEQ ID NO: 3949050 - RNA, 13 nt, Shigella flexneri 2a str. 301
gcuucaaucugau

SEQ ID NO: 3949051 - RNA, 23 nt, Shigella flexneri 2a str. 301
gcuucaaucugauauuuagccag

SEQ ID NO: 3949052 - RNA, 14 nt, Shigella flexneri 2a str. 301
gcuucaauuuuuuc

SEQ ID NO: 3949053 - RNA, 20 nt, Shigella flexneri 2a str. 301
gcuucaauuuuuucuggcga

SEQ ID NO: 3949054 - RNA, 13 nt, Shigella flexneri 2a str. 301
gcuucacaugcca

SEQ ID NO: 3949055 - RNA, 21 nt, Shigella flexneri 2a str. 301
gcuucaccaaucagaaaggcg

SEQ ID NO: 3949056 - RNA, 13 nt, Shigella flexneri 2a str. 301
gcuucaccagcag

SEQ ID NO: 3949057 - RNA, 15 nt, Shigella flexneri 2a str. 301
gcuucaccagcagcg

SEQ ID NO: 3949058 - RNA, 17 nt, Shigella flexneri 2a str. 301
gcuucacccgcagcacg

SEQ ID NO: 3949059 - RNA, 19 nt, Shigella flexneri 2a str. 301
gcuucacccuugaugcaga

SEQ ID NO: 3949060 - RNA, 19 nt, Shigella flexneri 2a str. 301
gcuucaccgacaucuuucu

SEQ ID NO: 3949061 - RNA, 19 nt, Shigella flexneri 2a str. 301
gcuucaccgauauccgcca

SEQ ID NO: 3949062 - RNA, 16 nt, Shigella flexneri 2a str. 301
gcuucacgcgccagcu

SEQ ID NO: 3949063 - RNA, 15 nt, Shigella flexneri 2a str. 301
gcuucagauuauguc

SEQ ID NO: 3949064 - RNA, 12 nt, Shigella flexneri 2a str. 301
gcuucagccgga

SEQ ID NO: 3949065 - RNA, 12 nt, Shigella flexneri 2a str. 301
gcuuuccacgca

SEQ ID NO: 3949066 - RNA, 18 nt, Shigella flexneri 2a str. 301
gcuuuccagcacaaagcg

SEQ ID NO: 3949067 - RNA, 22 nt, Shigella flexneri 2a str. 301
gcuuucccguuucagccccuug

SEQ ID NO: 3949068 - RNA, 17 nt, Shigella flexneri 2a str. 301
gcuuuccgggagcaauu

SEQ ID NO: 3949069 - RNA, 14 nt, Shigella flexneri 2a str. 301
gcuuuccugauaau

SEQ ID NO: 3949070 - RNA, 16 nt, Shigella flexneri 2a str. 301
gcuuucgagcacgacu

SEQ ID NO: 3949071 - RNA, 21 nt, Shigella flexneri 2a str. 301
gcuuucgagcacgacuuucuc

SEQ ID NO: 3949072 - RNA, 21 nt, Shigella flexneri 2a str. 301
gcuuucgcaauaaucaucucu

SEQ ID NO: 3949073 - RNA, 22 nt, Shigella flexneri 2a str. 301
gcuuucgcaauaaucaucucuc

SEQ ID NO: 3949074 - RNA, 20 nt, Shigella flexneri 2a str. 301
gcuuucgccaggucgcugac

SEQ ID NO: 3949075 - RNA, 22 nt, Shigella flexneri 2a str. 301
gcuuucguuuucuacuuuguaa

SEQ ID NO: 3949076 - RNA, 20 nt, Shigella flexneri 2a str. 301
gcuuucucugcaagaacuuu

SEQ ID NO: 3949077 - RNA, 13 nt, Shigella flexneri 2a str. 301
gcuuucugggaug

SEQ ID NO: 3949078 - RNA, 21 nt, Shigella flexneri 2a str. 301
gcuuucugggaugaucaccug

SEQ ID NO: 3949079 - RNA, 21 nt, Shigella flexneri 2a str. 301
gcuuucuucaaccaggcggau

SEQ ID NO: 3949080 - RNA, 23 nt, Shigella flexneri 2a str. 301
gcuuucuucucagauauaaacgg

SEQ ID NO: 3949081 - RNA, 14 nt, Shigella flexneri 2a str. 301
gcuuugaauaucuc

SEQ ID NO: 3949082 - RNA, 19 nt, Shigella flexneri 2a str. 301
gcuuugaauaucuccucug

SEQ ID NO: 3949083 - RNA, 20 nt, Shigella flexneri 2a str. 301
gcuuugaauaucuccucugc

SEQ ID NO: 3949084 - RNA, 15 nt, Shigella flexneri 2a str. 301
gcuuugcaucccaga

SEQ ID NO: 3949085 - RNA, 17 nt, Shigella flexneri 2a str. 301
gcuuugccacugccggu

SEQ ID NO: 3949086 - RNA, 17 nt, Shigella flexneri 2a str. 301
gcuuugcuaccuuccuc

SEQ ID NO: 3949087 - RNA, 16 nt, Shigella flexneri 2a str. 301
gcuuugcugauucucc

SEQ ID NO: 3949088 - RNA, 21 nt, Shigella flexneri 2a str. 301
gcuuuggauuugcaaauuuug

SEQ ID NO: 3949089 - RNA, 18 nt, Shigella flexneri 2a str. 301
gcuuuggcaaacuacaaa

SEQ ID NO: 3949090 - RNA, 19 nt, Shigella flexneri 2a str. 301
gcuuuggcaaacuacaaau

SEQ ID NO: 3949091 - RNA, 12 nt, Shigella flexneri 2a str. 301
gcuuuggcaaau

SEQ ID NO: 3949092 - RNA, 19 nt, Shigella flexneri 2a str. 301
gcuuuggcgugagaucgcg

SEQ ID NO: 3949093 - RNA, 23 nt, Shigella flexneri 2a str. 301
gcuuuggcugccgccaguuuacu

SEQ ID NO: 3949094 - RNA, 15 nt, Shigella flexneri 2a str. 301
gcuuuggugccagau

SEQ ID NO: 3949095 - RNA, 18 nt, Shigella flexneri 2a str. 301
gcuuuggugccagauuua

SEQ ID NO: 3949096 - RNA, 18 nt, Shigella flexneri 2a str. 301
gcuuugguggucaccaug

SEQ ID NO: 3949097 - RNA, 16 nt, Shigella flexneri 2a str. 301
gcuuugugcuggaaag

SEQ ID NO: 3949098 - RNA, 15 nt, Shigella flexneri 2a str. 301
gcuuuuaccagcaua

SEQ ID NO: 3949099 - RNA, 20 nt, Shigella flexneri 2a str. 301
gcuuuuaccgcgucaucggc

SEQ ID NO: 3949100 - RNA, 17 nt, Shigella flexneri 2a str. 301
gcuuuuacugcauucac

SEQ ID NO: 3949101 - RNA, 23 nt, Shigella flexneri 2a str. 301
gcuuuuagcgacaaauccuucac

SEQ ID NO: 3949102 - RNA, 13 nt, Shigella flexneri 2a str. 301
gcuuuucauguac

SEQ ID NO: 3949103 - RNA, 14 nt, Shigella flexneri 2a str. 301
gcuuuucccuccac

SEQ ID NO: 3949104 - RNA, 22 nt, Shigella flexneri 2a str. 301
gcuuuucuaccaccaaaaccac

SEQ ID NO: 3949105 - RNA, 15 nt, Shigella flexneri 2a str. 301
gcuuuucucaccuau

SEQ ID NO: 3949106 - RNA, 17 nt, Shigella flexneri 2a str. 301
gcuuuuguaggccggau

SEQ ID NO: 3949107 - RNA, 18 nt, Shigella flexneri 2a str. 301
gcuuuuuaguaucuauuc

SEQ ID NO: 3949108 - RNA, 19 nt, Shigella flexneri 2a str. 301
gcuuuuuccaggcuggcag

SEQ ID NO: 3949109 - RNA, 15 nt, Shigella flexneri 2a str. 301
gcuuuuucugcuucu

SEQ ID NO: 3949110 - RNA, 17 nt, Shigella flexneri 2a str. 301
gcuuuuucugcuucugc

SEQ ID NO: 3949111 - RNA, 13 nt, Shigella flexneri 2a str. 301
gcuuuuuuaaccg

SEQ ID NO: 3949112 - RNA, 18 nt, Shigella flexneri 2a str. 301
gcuuuuuuacaucaucag

SEQ ID NO: 3949113 - RNA, 17 nt, Shigella flexneri 2a str. 301
gcuuuuuuuacgucugc

SEQ ID NO: 3949114 - RNA, 15 nt, Shigella flexneri 2a str. 301
ggaaaaaagaaagaa

SEQ ID NO: 3949115 - RNA, 21 nt, Shigella flexneri 2a str. 301
ggaaaacagcgcaccagaaac

SEQ ID NO: 3949116 - RNA, 23 nt, Shigella flexneri 2a str. 301
ggaaaacguuucaaacaggcugc

SEQ ID NO: 3949117 - RNA, 16 nt, Shigella flexneri 2a str. 301
ggaaaauaucgcccau

SEQ ID NO: 3949118 - RNA, 18 nt, Shigella flexneri 2a str. 301
ggaaaaucaucaggggca

SEQ ID NO: 3949119 - RNA, 21 nt, Shigella flexneri 2a str. 301
ggaaaaucaucaggggcagca

SEQ ID NO: 3949120 - RNA, 21 nt, Shigella flexneri 2a str. 301
ggaaacacgcucaggcgauga

SEQ ID NO: 3949121 - RNA, 22 nt, Shigella flexneri 2a str. 301
ggaaacagcaccauccgcccac

SEQ ID NO: 3949122 - RNA, 13 nt, Shigella flexneri 2a str. 301
ggaaacagugcug

SEQ ID NO: 3949123 - RNA, 14 nt, Shigella flexneri 2a str. 301
ggaaaccaacucca

SEQ ID NO: 3949124 - RNA, 19 nt, Shigella flexneri 2a str. 301
ggaaacccaacgcaaagag

SEQ ID NO: 3949125 - RNA, 15 nt, Shigella flexneri 2a str. 301
ggaaacggagcaaaa

SEQ ID NO: 3949126 - RNA, 17 nt, Shigella flexneri 2a str. 301
ggaaacggagcaaaaaa

SEQ ID NO: 3949127 - RNA, 21 nt, Shigella flexneri 2a str. 301
ggaaacucugcuggcggaaca

SEQ ID NO: 3949128 - RNA, 23 nt, Shigella flexneri 2a str. 301
ggaaacugucaauaaacgccugc

SEQ ID NO: 3949129 - RNA, 14 nt, Shigella flexneri 2a str. 301
ggaaagcacaaaau

SEQ ID NO: 3949130 - RNA, 16 nt, Shigella flexneri 2a str. 301
ggaaagcacaaaauca

SEQ ID NO: 3949131 - RNA, 15 nt, Shigella flexneri 2a str. 301
ggaaagcaccugcgc

SEQ ID NO: 3949132 - RNA, 18 nt, Shigella flexneri 2a str. 301
ggaaagcagauaacccag

SEQ ID NO: 3949133 - RNA, 16 nt, Shigella flexneri 2a str. 301
ggaaaguguguauacg

SEQ ID NO: 3949134 - RNA, 22 nt, Shigella flexneri 2a str. 301
ggaaauacgcuggcugaacauu

SEQ ID NO: 3949135 - RNA, 23 nt, Shigella flexneri 2a str. 301
ggaaauauauuccccggucagca

SEQ ID NO: 3949136 - RNA, 14 nt, Shigella flexneri 2a str. 301
ggaaauccaacaga

SEQ ID NO: 3949137 - RNA, 17 nt, Shigella flexneri 2a str. 301
ggaaauccaggucagca

SEQ ID NO: 3949138 - RNA, 21 nt, Shigella flexneri 2a str. 301
ggaaaucccgugacgguaacg

SEQ ID NO: 3949139 - RNA, 21 nt, Shigella flexneri 2a str. 301
ggaaaugggugacaucgcccu

SEQ ID NO: 3949140 - RNA, 19 nt, Shigella flexneri 2a str. 301
ggaaauuauggaucaccau

SEQ ID NO: 3949141 - RNA, 14 nt, Shigella flexneri 2a str. 301
ggaaauucagcagu

SEQ ID NO: 3949142 - RNA, 21 nt, Shigella flexneri 2a str. 301
ggaaauucagcaguuuuugca

SEQ ID NO: 3949143 - RNA, 20 nt, Shigella flexneri 2a str. 301
ggaacaaaauuuucagcgug

SEQ ID NO: 3949144 - RNA, 16 nt, Shigella flexneri 2a str. 301
ggaacaacguaucuug

SEQ ID NO: 3949145 - RNA, 14 nt, Shigella flexneri 2a str. 301
ggaacaccucuggc

SEQ ID NO: 3949146 - RNA, 20 nt, Shigella flexneri 2a str. 301
ggaacacucuuccagucgcc

SEQ ID NO: 3949147 - RNA, 19 nt, Shigella flexneri 2a str. 301
ggaacauaucaaaaagcug

SEQ ID NO: 3949148 - RNA, 16 nt, Shigella flexneri 2a str. 301
ggaacaucaccccgcc

SEQ ID NO: 3949149 - RNA, 15 nt, Shigella flexneri 2a str. 301
ggaacauccuuuccu

SEQ ID NO: 3949150 - RNA, 15 nt, Shigella flexneri 2a str. 301
ggaaccuaacgcugu

SEQ ID NO: 3949151 - RNA, 16 nt, Shigella flexneri 2a str. 301
ggaaccugugacagca

SEQ ID NO: 3949152 - RNA, 19 nt, Shigella flexneri 2a str. 301
ggaacgauguaggccugau

SEQ ID NO: 3949153 - RNA, 23 nt, Shigella flexneri 2a str. 301
ggaacgcaaaauucccaccagac

SEQ ID NO: 3949154 - RNA, 17 nt, Shigella flexneri 2a str. 301
ggaacggggguuuuacu

SEQ ID NO: 3949155 - RNA, 23 nt, Shigella flexneri 2a str. 301
ggaacgguccuuaccaugcugca

SEQ ID NO: 3949156 - RNA, 23 nt, Shigella flexneri 2a str. 301
ggaacgugcugcauuugccccug

SEQ ID NO: 3949157 - RNA, 20 nt, Shigella flexneri 2a str. 301
ggaacugaaaggcgcucauu

SEQ ID NO: 3949158 - RNA, 20 nt, Shigella flexneri 2a str. 301
ggaacuggcaacaauggcau

SEQ ID NO: 3949159 - RNA, 18 nt, Shigella flexneri 2a str. 301
ggaacugugcugccgggg

SEQ ID NO: 3949160 - RNA, 20 nt, Shigella flexneri 2a str. 301
ggaagaauuugcuaccccug

SEQ ID NO: 3949161 - RNA, 14 nt, Shigella flexneri 2a str. 301
ggaagaccugacug

SEQ ID NO: 3949162 - RNA, 17 nt, Shigella flexneri 2a str. 301
ggaagacguugauucac

SEQ ID NO: 3949163 - RNA, 17 nt, Shigella flexneri 2a str. 301
ggaagagacuauuucuu

SEQ ID NO: 3949164 - RNA, 21 nt, Shigella flexneri 2a str. 301
ggaucuuugccagaucgccug

SEQ ID NO: 3949165 - RNA, 17 nt, Shigella flexneri 2a str. 301
ggaucuuuucuuucgcc

SEQ ID NO: 3949166 - RNA, 15 nt, Shigella flexneri 2a str. 301
ggaucuuuugucaug

SEQ ID NO: 3949167 - RNA, 15 nt, Shigella flexneri 2a str. 301
ggaucuuuuucgaac

SEQ ID NO: 3949168 - RNA, 15 nt, Shigella flexneri 2a str. 301
ggaugaaaaaauccc

SEQ ID NO: 3949169 - RNA, 22 nt, Shigella flexneri 2a str. 301
ggaugaaaucaccgcuauuugc

SEQ ID NO: 3949170 - RNA, 13 nt, Shigella flexneri 2a str. 301
ggaugaagugaag

SEQ ID NO: 3949171 - RNA, 22 nt, Shigella flexneri 2a str. 301
ggaugacacaucaccuccagcg

SEQ ID NO: 3949172 - RNA, 11 nt, Shigella flexneri 2a str. 301
ggaugauucac

SEQ ID NO: 3949173 - RNA, 23 nt, Shigella flexneri 2a str. 301
ggaugccugaugcgacgcugaua

SEQ ID NO: 3949174 - RNA, 16 nt, Shigella flexneri 2a str. 301
ggaugcgccgucagag

SEQ ID NO: 3949175 - RNA, 16 nt, Shigella flexneri 2a str. 301
ggaugcggcguaaaug

SEQ ID NO: 3949176 - RNA, 16 nt, Shigella flexneri 2a str. 301
ggaugcggcgugaacg

SEQ ID NO: 3949177 - RNA, 19 nt, Shigella flexneri 2a str. 301
ggaugcguucgcaccaccg

SEQ ID NO: 3949178 - RNA, 17 nt, Shigella flexneri 2a str. 301
ggauggcaaacugauua

SEQ ID NO: 3949179 - RNA, 13 nt, Shigella flexneri 2a str. 301
ggauggccgggca

SEQ ID NO: 3949180 - RNA, 12 nt, Shigella flexneri 2a str. 301
ggauggcggcuu

SEQ ID NO: 3949181 - RNA, 16 nt, Shigella flexneri 2a str. 301
ggauggcguagcagca

SEQ ID NO: 3949182 - RNA, 19 nt, Shigella flexneri 2a str. 301
ggauggcuggccgugcaga

SEQ ID NO: 3949183 - RNA, 17 nt, Shigella flexneri 2a str. 301
ggaugggcguagcuggg

SEQ ID NO: 3949184 - RNA, 22 nt, Shigella flexneri 2a str. 301
ggauggucgcuuuguggcggca

SEQ ID NO: 3949185 - RNA, 21 nt, Shigella flexneri 2a str. 301
ggaugucgcugcuagggcgcg

SEQ ID NO: 3949186 - RNA, 13 nt, Shigella flexneri 2a str. 301
ggaugugaugcau

SEQ ID NO: 3949187 - RNA, 14 nt, Shigella flexneri 2a str. 301
ggauuaaaaaguaa

SEQ ID NO: 3949188 - RNA, 15 nt, Shigella flexneri 2a str. 301
ggauuacaaauaaau

SEQ ID NO: 3949189 - RNA, 17 nt, Shigella flexneri 2a str. 301
ggauuacuccccgcaca

SEQ ID NO: 3949190 - RNA, 14 nt, Shigella flexneri 2a str. 301
ggauuagcgaccga

SEQ ID NO: 3949191 - RNA, 19 nt, Shigella flexneri 2a str. 301
ggauugcuauuuaacaguu

SEQ ID NO: 3949192 - RNA, 18 nt, Shigella flexneri 2a str. 301
ggauugcuccugcucauc

SEQ ID NO: 3949193 - RNA, 16 nt, Shigella flexneri 2a str. 301
ggauugcugaaauaca

SEQ ID NO: 3949194 - RNA, 16 nt, Shigella flexneri 2a str. 301
ggauugcuucugcuuc

SEQ ID NO: 3949195 - RNA, 17 nt, Shigella flexneri 2a str. 301
ggauuuaccuugcucau

SEQ ID NO: 3949196 - RNA, 14 nt, Shigella flexneri 2a str. 301
ggauuucauauccg

SEQ ID NO: 3949197 - RNA, 12 nt, Shigella flexneri 2a str. 301
ggauuucgcccg

SEQ ID NO: 3949198 - RNA, 16 nt, Shigella flexneri 2a str. 301
ggauuucuccccccuc

SEQ ID NO: 3949199 - RNA, 14 nt, Shigella flexneri 2a str. 301
ggauuucugauuau

SEQ ID NO: 3949200 - RNA, 13 nt, Shigella flexneri 2a str. 301
ggauuugugucag

SEQ ID NO: 3949201 - RNA, 14 nt, Shigella flexneri 2a str. 301
ggauuuuuuuauuu

SEQ ID NO: 3949202 - RNA, 12 nt, Shigella flexneri 2a str. 301
ggcaaaaaaguc

SEQ ID NO: 3949203 - RNA, 13 nt, Shigella flexneri 2a str. 301
ggcaaaaauaagg

SEQ ID NO: 3949204 - RNA, 15 nt, Shigella flexneri 2a str. 301
ggcaaaaaucggcaa

SEQ ID NO: 3949205 - RNA, 17 nt, Shigella flexneri 2a str. 301
ggcaaaagacaccaucg

SEQ ID NO: 3949206 - RNA, 12 nt, Shigella flexneri 2a str. 301
ggcaaaauaugu

SEQ ID NO: 3949207 - RNA, 18 nt, Shigella flexneri 2a str. 301
ggcaaaaugcaucggcau

SEQ ID NO: 3949208 - RNA, 19 nt, Shigella flexneri 2a str. 301
ggcaaaauuaucacaacuu

SEQ ID NO: 3949209 - RNA, 17 nt, Shigella flexneri 2a str. 301
ggcaaacaggcgcuggg

SEQ ID NO: 3949210 - RNA, 20 nt, Shigella flexneri 2a str. 301
ggcaaacaguuucugcagcu

SEQ ID NO: 3949211 - RNA, 15 nt, Shigella flexneri 2a str. 301
ggcaaaccuuaaagc

SEQ ID NO: 3949212 - RNA, 24 nt, Shigella flexneri 2a str. 301
ggcaaaggcuucguucaucucaaa

SEQ ID NO: 3949213 - RNA, 15 nt, Shigella flexneri 2a str. 301
ggcaaagguucaagc

SEQ ID NO: 3949214 - RNA, 17 nt, Shigella flexneri 2a str. 301
ggcaaagugaauacaga

SEQ ID NO: 3949215 - RNA, 19 nt, Shigella flexneri 2a str. 301
ggcaaagugaauacagaac

SEQ ID NO: 3949216 - RNA, 22 nt, Shigella flexneri 2a str. 301
ggcaaagugcaucucaccguug

SEQ ID NO: 3949217 - RNA, 16 nt, Shigella flexneri 2a str. 301
ggcaaauaccggacac

SEQ ID NO: 3949218 - RNA, 20 nt, Shigella flexneri 2a str. 301
ggcaaaugcaucagugacaa

SEQ ID NO: 3949219 - RNA, 18 nt, Shigella flexneri 2a str. 301
ggcaaauucuucacggaa

SEQ ID NO: 3949220 - RNA, 15 nt, Shigella flexneri 2a str. 301
ggcaacaucaaauua

SEQ ID NO: 3949221 - RNA, 19 nt, Shigella flexneri 2a str. 301
ggcaacaugaaacagaaaa

SEQ ID NO: 3949222 - RNA, 14 nt, Shigella flexneri 2a str. 301
ggcaaccagcccau

SEQ ID NO: 3949223 - RNA, 14 nt, Shigella flexneri 2a str. 301
ggcaaccgcugagc

SEQ ID NO: 3949224 - RNA, 15 nt, Shigella flexneri 2a str. 301
ggcaacgacugcgag

SEQ ID NO: 3949225 - RNA, 12 nt, Shigella flexneri 2a str. 301
ggcaagaaaauu

SEQ ID NO: 3949226 - RNA, 15 nt, Shigella flexneri 2a str. 301
ggcaagaauuacuuc

SEQ ID NO: 3949227 - RNA, 15 nt, Shigella flexneri 2a str. 301
ggcaagcaggacgcc

SEQ ID NO: 3949228 - RNA, 22 nt, Shigella flexneri 2a str. 301
ggcaagcaggucggcucagccg

SEQ ID NO: 3949229 - RNA, 16 nt, Shigella flexneri 2a str. 301
ggcaagcauaugacga

SEQ ID NO: 3949230 - RNA, 13 nt, Shigella flexneri 2a str. 301
ggcaagccagcau

SEQ ID NO: 3949231 - RNA, 14 nt, Shigella flexneri 2a str. 301
ggcaagccagcaua

SEQ ID NO: 3949232 - RNA, 22 nt, Shigella flexneri 2a str. 301
ggcaauacgauccugagcagcc

SEQ ID NO: 3949233 - RNA, 13 nt, Shigella flexneri 2a str. 301
ggcaauacuggca

SEQ ID NO: 3949234 - RNA, 20 nt, Shigella flexneri 2a str. 301
ggcaauagcggacacuacca

SEQ ID NO: 3949235 - RNA, 22 nt, Shigella flexneri 2a str. 301
ggcaauauagauaucaugcucu

SEQ ID NO: 3949236 - RNA, 23 nt, Shigella flexneri 2a str. 301
ggcaaucaucaccggucggccuu

SEQ ID NO: 3949237 - RNA, 12 nt, Shigella flexneri 2a str. 301
ggcaauccguaa

SEQ ID NO: 3949238 - RNA, 15 nt, Shigella flexneri 2a str. 301
ggcaaucggugcaaa

SEQ ID NO: 3949239 - RNA, 23 nt, Shigella flexneri 2a str. 301
ggcaaugacccguaugaugugcg

SEQ ID NO: 3949240 - RNA, 13 nt, Shigella flexneri 2a str. 301
ggcaaugcccggu

SEQ ID NO: 3949241 - RNA, 15 nt, Shigella flexneri 2a str. 301
ggcaaugcccggugu

SEQ ID NO: 3949242 - RNA, 20 nt, Shigella flexneri 2a str. 301
ggcaaugcgggugcaaucaa

SEQ ID NO: 3949243 - RNA, 22 nt, Shigella flexneri 2a str. 301
ggcaaugcguagcugagcaaca

SEQ ID NO: 3949244 - RNA, 14 nt, Shigella flexneri 2a str. 301
ggcaauuucacguu

SEQ ID NO: 3949245 - RNA, 13 nt, Shigella flexneri 2a str. 301
ggcaauuucgcug

SEQ ID NO: 3949246 - RNA, 17 nt, Shigella flexneri 2a str. 301
ggcaauuuuuaccgguc

SEQ ID NO: 3949247 - RNA, 12 nt, Shigella flexneri 2a str. 301
ggcacaaagcug

SEQ ID NO: 3949248 - RNA, 16 nt, Shigella flexneri 2a str. 301
ggcacaacucggcggc

SEQ ID NO: 3949249 - RNA, 22 nt, Shigella flexneri 2a str. 301
ggcacaagcauuaaggcaagaa

SEQ ID NO: 3949250 - RNA, 22 nt, Shigella flexneri 2a str. 301
ggcacacguaggccaaccguca

SEQ ID NO: 3949251 - RNA, 14 nt, Shigella flexneri 2a str. 301
ggcacauagccacc

SEQ ID NO: 3949252 - RNA, 22 nt, Shigella flexneri 2a str. 301
ggcacaucgacggugacacuuu

SEQ ID NO: 3949253 - RNA, 20 nt, Shigella flexneri 2a str. 301
ggcacauuuuguaggccuga

SEQ ID NO: 3949254 - RNA, 16 nt, Shigella flexneri 2a str. 301
ggcaccaaucaccgcc

SEQ ID NO: 3949255 - RNA, 22 nt, Shigella flexneri 2a str. 301
ggcaccaaucaccgccagcaag

SEQ ID NO: 3949256 - RNA, 15 nt, Shigella flexneri 2a str. 301
ggcaccagccccugg

SEQ ID NO: 3949257 - RNA, 12 nt, Shigella flexneri 2a str. 301
ggcaccagcgca

SEQ ID NO: 3949258 - RNA, 21 nt, Shigella flexneri 2a str. 301
ggcaccagcgcacaguuauaa

SEQ ID NO: 3949259 - RNA, 11 nt, Shigella flexneri 2a str. 301
ggcaccauuua

SEQ ID NO: 3949260 - RNA, 20 nt, Shigella flexneri 2a str. 301
ggcaccauuuaaaucaauaa

SEQ ID NO: 3949261 - RNA, 20 nt, Shigella flexneri 2a str. 301
ggcaccgccaaagauaaaau

SEQ ID NO: 3949262 - RNA, 15 nt, Shigella flexneri 2a str. 301
ggcaccuucgccucc

SEQ ID NO: 3949263 - RNA, 13 nt, Shigella flexneri 2a str. 301
ggcaccuuuucau

SEQ ID NO: 3949264 - RNA, 19 nt, Shigella flexneri 2a str. 301
ggcacgaaagguuccaaua

SEQ ID NO: 3949265 - RNA, 23 nt, Shigella flexneri 2a str. 301
ggcacgcaggaucugacuggcga

SEQ ID NO: 3949266 - RNA, 13 nt, Shigella flexneri 2a str. 301
ggcacgcccgcgc

SEQ ID NO: 3949267 - RNA, 16 nt, Shigella flexneri 2a str. 301
ggcacggcaaucauga

SEQ ID NO: 3949268 - RNA, 17 nt, Shigella flexneri 2a str. 301
ggcacguugcugcggcg

SEQ ID NO: 3949269 - RNA, 19 nt, Shigella flexneri 2a str. 301
ggcacuggauuauuacugg

SEQ ID NO: 3949270 - RNA, 16 nt, Shigella flexneri 2a str. 301
ggcacugguacucaac

SEQ ID NO: 3949271 - RNA, 14 nt, Shigella flexneri 2a str. 301
ggcacuuuuauccu

SEQ ID NO: 3949272 - RNA, 19 nt, Shigella flexneri 2a str. 301
ggcagaaacggaccuggga

SEQ ID NO: 3949273 - RNA, 13 nt, Shigella flexneri 2a str. 301
ggcagaacagaac

SEQ ID NO: 3949274 - RNA, 12 nt, Shigella flexneri 2a str. 301
ggcagaacgcuu

SEQ ID NO: 3949275 - RNA, 12 nt, Shigella flexneri 2a str. 301
ggcagaacggug

SEQ ID NO: 3949276 - RNA, 17 nt, Shigella flexneri 2a str. 301
ggcagaaugcccugcgg

SEQ ID NO: 3949277 - RNA, 15 nt, Shigella flexneri 2a str. 301
ggcagacaaaacaua

SEQ ID NO: 3949278 - RNA, 22 nt, Shigella flexneri 2a str. 301
ggcagacgcucgccauuuuuca

SEQ ID NO: 3949279 - RNA, 14 nt, Shigella flexneri 2a str. 301
ggcagagaucgccg

SEQ ID NO: 3949280 - RNA, 15 nt, Shigella flexneri 2a str. 301
ggcagagcaacauac

SEQ ID NO: 3949281 - RNA, 21 nt, Shigella flexneri 2a str. 301
ggcagauacaaccaaucgcgg

SEQ ID NO: 3949282 - RNA, 22 nt, Shigella flexneri 2a str. 301
ggcagauacaaccaaucgcggc

SEQ ID NO: 3949283 - RNA, 13 nt, Shigella flexneri 2a str. 301
ggcagaugcgucu

SEQ ID NO: 3949284 - RNA, 21 nt, Shigella flexneri 2a str. 301
ggcagaugcuuuaaucaucca

SEQ ID NO: 3949285 - RNA, 23 nt, Shigella flexneri 2a str. 301
ggcagcaaggcuauucagcaguu

SEQ ID NO: 3949286 - RNA, 16 nt, Shigella flexneri 2a str. 301
ggcagcaaucacugcc

SEQ ID NO: 3949287 - RNA, 12 nt, Shigella flexneri 2a str. 301
ggcagcaggugc

SEQ ID NO: 3949288 - RNA, 20 nt, Shigella flexneri 2a str. 301
ggcagcauccggcagucggc

SEQ ID NO: 3949289 - RNA, 22 nt, Shigella flexneri 2a str. 301
ggcagccaguucgagaaaaaua

SEQ ID NO: 3949290 - RNA, 13 nt, Shigella flexneri 2a str. 301
ggcagcgaagggu

SEQ ID NO: 3949291 - RNA, 18 nt, Shigella flexneri 2a str. 301
ggcagcuccagcaaaaag

SEQ ID NO: 3949292 - RNA, 17 nt, Shigella flexneri 2a str. 301
ggcaggaaaaaagcgcu

SEQ ID NO: 3949293 - RNA, 14 nt, Shigella flexneri 2a str. 301
ggcaggcagcgcca

SEQ ID NO: 3949294 - RNA, 19 nt, Shigella flexneri 2a str. 301
ggcaggcucugguguucuu

SEQ ID NO: 3949295 - RNA, 20 nt, Shigella flexneri 2a str. 301
ggcaggcuucaacacaggcc

SEQ ID NO: 3949296 - RNA, 22 nt, Shigella flexneri 2a str. 301
ggcaggcuucaacacaggccgg

SEQ ID NO: 3949297 - RNA, 19 nt, Shigella flexneri 2a str. 301
ggcagguaaugaauggacu

SEQ ID NO: 3949298 - RNA, 19 nt, Shigella flexneri 2a str. 301
ggcaggugacugggcggcg

SEQ ID NO: 3949299 - RNA, 16 nt, Shigella flexneri 2a str. 301
ggcaguacgcggcggu

SEQ ID NO: 3949300 - RNA, 22 nt, Shigella flexneri 2a str. 301
ggcagugcuuucauuucagcgu

SEQ ID NO: 3949301 - RNA, 20 nt, Shigella flexneri 2a str. 301
ggcaguucgucuuuggguuc

SEQ ID NO: 3949302 - RNA, 20 nt, Shigella flexneri 2a str. 301
ggcauaaauaauaagagcgu

SEQ ID NO: 3949303 - RNA, 20 nt, Shigella flexneri 2a str. 301
ggcauaacuccccgagaaau

SEQ ID NO: 3949304 - RNA, 16 nt, Shigella flexneri 2a str. 301
ggcauaagccgucccu

SEQ ID NO: 3949305 - RNA, 16 nt, Shigella flexneri 2a str. 301
ggcauaaucauuacaa

SEQ ID NO: 3949306 - RNA, 19 nt, Shigella flexneri 2a str. 301
ggcauacaacgccaugaag

SEQ ID NO: 3949307 - RNA, 21 nt, Shigella flexneri 2a str. 301
ggcauagccaccuggcugcgu

SEQ ID NO: 3949308 - RNA, 20 nt, Shigella flexneri 2a str. 301
ggcauauaggucugauuccg

SEQ ID NO: 3949309 - RNA, 21 nt, Shigella flexneri 2a str. 301
ggcauauaguggguaacaauu

SEQ ID NO: 3949310 - RNA, 13 nt, Shigella flexneri 2a str. 301
ggcauauucgcgc

SEQ ID NO: 3949311 - RNA, 10 nt, Shigella flexneri 2a str. 301
ggcaucaaac

SEQ ID NO: 3949312 - RNA, 22 nt, Shigella flexneri 2a str. 301
ggcaucaaugaaaggcuuccca

SEQ ID NO: 3949313 - RNA, 16 nt, Shigella flexneri 2a str. 301
ggcaucacaucgcugg

SEQ ID NO: 3949314 - RNA, 18 nt, Shigella flexneri 2a str. 301
ggcaucaccaucgggccu

SEQ ID NO: 3949315 - RNA, 14 nt, Shigella flexneri 2a str. 301
ggcaucaccgcgaa

SEQ ID NO: 3949316 - RNA, 23 nt, Shigella flexneri 2a str. 301
ggcaucagacaaaugucacugcu

SEQ ID NO: 3949317 - RNA, 14 nt, Shigella flexneri 2a str. 301
ggcaucagcagaau

SEQ ID NO: 3949318 - RNA, 16 nt, Shigella flexneri 2a str. 301
ggcauccagagaucgc

SEQ ID NO: 3949319 - RNA, 19 nt, Shigella flexneri 2a str. 301
ggcauccugaucguccugc

SEQ ID NO: 3949320 - RNA, 12 nt, Shigella flexneri 2a str. 301
ggcaucgugcac

SEQ ID NO: 3949321 - RNA, 15 nt, Shigella flexneri 2a str. 301
ggcaucguguugaug

SEQ ID NO: 3949322 - RNA, 19 nt, Shigella flexneri 2a str. 301
ggcaucguguugaugcucc

SEQ ID NO: 3949323 - RNA, 16 nt, Shigella flexneri 2a str. 301
ggcaucugcccccgca

SEQ ID NO: 3949324 - RNA, 12 nt, Shigella flexneri 2a str. 301
ggcaugaaagcg

SEQ ID NO: 3949325 - RNA, 14 nt, Shigella flexneri 2a str. 301
ggcaugaaugguca

SEQ ID NO: 3949326 - RNA, 12 nt, Shigella flexneri 2a str. 301
ggcaugauucau

SEQ ID NO: 3949327 - RNA, 12 nt, Shigella flexneri 2a str. 301
ggcaugcagcgu

SEQ ID NO: 3949328 - RNA, 20 nt, Shigella flexneri 2a str. 301
ggcaugcagcguaccugggu

SEQ ID NO: 3949329 - RNA, 15 nt, Shigella flexneri 2a str. 301
ggcauggggucaggu

SEQ ID NO: 3949330 - RNA, 17 nt, Shigella flexneri 2a str. 301
ggcauggggucaggugg

SEQ ID NO: 3949331 - RNA, 22 nt, Shigella flexneri 2a str. 301
ggcauggggucaggugggacca

SEQ ID NO: 3949332 - RNA, 20 nt, Shigella flexneri 2a str. 301
ggcaugggucacucaggcca

SEQ ID NO: 3949333 - RNA, 12 nt, Shigella flexneri 2a str. 301
ggcaugucacaa

SEQ ID NO: 3949334 - RNA, 17 nt, Shigella flexneri 2a str. 301
ggcaugucacaaauaga

SEQ ID NO: 3949335 - RNA, 23 nt, Shigella flexneri 2a str. 301
ggcaugucgguuguacaaaaaau

SEQ ID NO: 3949336 - RNA, 15 nt, Shigella flexneri 2a str. 301
ggcauguggcggcgc

SEQ ID NO: 3949337 - RNA, 23 nt, Shigella flexneri 2a str. 301
ggcauguggcggcgcgaggcgaa

SEQ ID NO: 3949338 - RNA, 22 nt, Shigella flexneri 2a str. 301
ggcauguuuaauucugcggcaa

SEQ ID NO: 3949339 - RNA, 12 nt, Shigella flexneri 2a str. 301
ggcauuaaacau

SEQ ID NO: 3949340 - RNA, 13 nt, Shigella flexneri 2a str. 301
ggcauuagauauu

SEQ ID NO: 3949341 - RNA, 18 nt, Shigella flexneri 2a str. 301
ggcauucagauaauaggu

SEQ ID NO: 3949342 - RNA, 15 nt, Shigella flexneri 2a str. 301
ggcauucagugcaaa

SEQ ID NO: 3949343 - RNA, 23 nt, Shigella flexneri 2a str. 301
ggcauucugcuggccuggcuggu

SEQ ID NO: 3949344 - RNA, 20 nt, Shigella flexneri 2a str. 301
ggcauuggcauagugcugag

SEQ ID NO: 3949345 - RNA, 21 nt, Shigella flexneri 2a str. 301
ggcauuuacgccgcauccggc

SEQ ID NO: 3949346 - RNA, 18 nt, Shigella flexneri 2a str. 301
ggccaaaaaacagccccu

SEQ ID NO: 3949347 - RNA, 22 nt, Shigella flexneri 2a str. 301
ggccaaaaaacagccccugagc

SEQ ID NO: 3949348 - RNA, 22 nt, Shigella flexneri 2a str. 301
ggccaaaaccacagugacccgc

SEQ ID NO: 3949349 - RNA, 14 nt, Shigella flexneri 2a str. 301
ggccaaacucacca

SEQ ID NO: 3949350 - RNA, 15 nt, Shigella flexneri 2a str. 301
ggccaaagaccagga

SEQ ID NO: 3949351 - RNA, 17 nt, Shigella flexneri 2a str. 301
ggccaaagccgccgagc

SEQ ID NO: 3949352 - RNA, 17 nt, Shigella flexneri 2a str. 301
ggccaaagguuuccuca

SEQ ID NO: 3949353 - RNA, 21 nt, Shigella flexneri 2a str. 301
ggccaaagguuuccucaugca

SEQ ID NO: 3949354 - RNA, 18 nt, Shigella flexneri 2a str. 301
ggccaaccauccgucauc

SEQ ID NO: 3949355 - RNA, 17 nt, Shigella flexneri 2a str. 301
ggccaauccagcccugc

SEQ ID NO: 3949356 - RNA, 16 nt, Shigella flexneri 2a str. 301
ggccaauuuggcugcc

SEQ ID NO: 3949357 - RNA, 14 nt, Shigella flexneri 2a str. 301
ggccacagccagcc

SEQ ID NO: 3949358 - RNA, 17 nt, Shigella flexneri 2a str. 301
ggccacagcgccagaca

SEQ ID NO: 3949359 - RNA, 14 nt, Shigella flexneri 2a str. 301
ggccaccaggccac

SEQ ID NO: 3949360 - RNA, 19 nt, Shigella flexneri 2a str. 301
ggccaccgaagagacauug

SEQ ID NO: 3949361 - RNA, 17 nt, Shigella flexneri 2a str. 301
ggccacgucauccggaa

SEQ ID NO: 3949362 - RNA, 15 nt, Shigella flexneri 2a str. 301
ggccagacauuauaa

SEQ ID NO: 3949363 - RNA, 19 nt, Shigella flexneri 2a str. 301
ggccagauaagacgcgcca

SEQ ID NO: 3949364 - RNA, 14 nt, Shigella flexneri 2a str. 301
ggccagccagcaga

SEQ ID NO: 3949365 - RNA, 21 nt, Shigella flexneri 2a str. 301
ggcgaggggacuguccgggca

SEQ ID NO: 3949366 - RNA, 20 nt, Shigella flexneri 2a str. 301
ggcgagguacgcccagcgcu

SEQ ID NO: 3949367 - RNA, 18 nt, Shigella flexneri 2a str. 301
ggcgagguaggcagucau

SEQ ID NO: 3949368 - RNA, 23 nt, Shigella flexneri 2a str. 301
ggcgaguauucuugcugauacuc

SEQ ID NO: 3949369 - RNA, 17 nt, Shigella flexneri 2a str. 301
ggcgaguucagaucagg

SEQ ID NO: 3949370 - RNA, 20 nt, Shigella flexneri 2a str. 301
ggcgauaaaguguugagcuu

SEQ ID NO: 3949371 - RNA, 18 nt, Shigella flexneri 2a str. 301
ggcgauaaucagcgccag

SEQ ID NO: 3949372 - RNA, 22 nt, Shigella flexneri 2a str. 301
ggcgauaaucagcgccagcgcg

SEQ ID NO: 3949373 - RNA, 17 nt, Shigella flexneri 2a str. 301
ggcgauauccagcgcgg

SEQ ID NO: 3949374 - RNA, 20 nt, Shigella flexneri 2a str. 301
ggcgauauuauccccugcga

SEQ ID NO: 3949375 - RNA, 21 nt, Shigella flexneri 2a str. 301
ggcgauauuauccccugcgau

SEQ ID NO: 3949376 - RNA, 15 nt, Shigella flexneri 2a str. 301
ggcgaucccagagcg

SEQ ID NO: 3949377 - RNA, 17 nt, Shigella flexneri 2a str. 301
ggcgauccggacgcuaa

SEQ ID NO: 3949378 - RNA, 21 nt, Shigella flexneri 2a str. 301
ggcgaucgacgugggcguggg

SEQ ID NO: 3949379 - RNA, 19 nt, Shigella flexneri 2a str. 301
ggcgaugcacaugcuucag

SEQ ID NO: 3949380 - RNA, 14 nt, Shigella flexneri 2a str. 301
ggcgaugcggggug

SEQ ID NO: 3949381 - RNA, 20 nt, Shigella flexneri 2a str. 301
ggcgaugcuguauucuucag

SEQ ID NO: 3949382 - RNA, 15 nt, Shigella flexneri 2a str. 301
ggcgauguucugguc

SEQ ID NO: 3949383 - RNA, 18 nt, Shigella flexneri 2a str. 301
ggcgauucauaugcgcca

SEQ ID NO: 3949384 - RNA, 14 nt, Shigella flexneri 2a str. 301
ggcgauucuuugcu

SEQ ID NO: 3949385 - RNA, 21 nt, Shigella flexneri 2a str. 301
ggcgauuuuccuccauuugcc

SEQ ID NO: 3949386 - RNA, 17 nt, Shigella flexneri 2a str. 301
ggcgauuuuugauaauu

SEQ ID NO: 3949387 - RNA, 15 nt, Shigella flexneri 2a str. 301
ggcgcaagcggcgac

SEQ ID NO: 3949388 - RNA, 21 nt, Shigella flexneri 2a str. 301
ggcgcaaugauaucgcuggca

SEQ ID NO: 3949389 - RNA, 13 nt, Shigella flexneri 2a str. 301
ggcgcaauucccg

SEQ ID NO: 3949390 - RNA, 18 nt, Shigella flexneri 2a str. 301
ggcgcaccugaaucguca

SEQ ID NO: 3949391 - RNA, 14 nt, Shigella flexneri 2a str. 301
ggcgcacgccgaca

SEQ ID NO: 3949392 - RNA, 23 nt, Shigella flexneri 2a str. 301
ggcgcacguucugucgcucugcu

SEQ ID NO: 3949393 - RNA, 13 nt, Shigella flexneri 2a str. 301
ggcgcagggugua

SEQ ID NO: 3949394 - RNA, 15 nt, Shigella flexneri 2a str. 301
ggcgcaucggucaga

SEQ ID NO: 3949395 - RNA, 20 nt, Shigella flexneri 2a str. 301
ggcgcauguuggcgcgguga

SEQ ID NO: 3949396 - RNA, 14 nt, Shigella flexneri 2a str. 301
ggcgcgaaacauca

SEQ ID NO: 3949397 - RNA, 12 nt, Shigella flexneri 2a str. 301
ggcgcgaccauu

SEQ ID NO: 3949398 - RNA, 16 nt, Shigella flexneri 2a str. 301
ggcgcgauucggcucc

SEQ ID NO: 3949399 - RNA, 19 nt, Shigella flexneri 2a str. 301
ggcgcggaaagcaccugcg

SEQ ID NO: 3949400 - RNA, 16 nt, Shigella flexneri 2a str. 301
ggcgcggacgcacaua

SEQ ID NO: 3949401 - RNA, 23 nt, Shigella flexneri 2a str. 301
ggcgcguguuccagagaacgacc

SEQ ID NO: 3949402 - RNA, 19 nt, Shigella flexneri 2a str. 301
ggcgcuaucaauacuuucc

SEQ ID NO: 3949403 - RNA, 19 nt, Shigella flexneri 2a str. 301
ggcgcuccugcgggagcgc

SEQ ID NO: 3949404 - RNA, 14 nt, Shigella flexneri 2a str. 301
ggcgcucgcccagc

SEQ ID NO: 3949405 - RNA, 22 nt, Shigella flexneri 2a str. 301
ggcgcucgcgccgcauccgaca

SEQ ID NO: 3949406 - RNA, 17 nt, Shigella flexneri 2a str. 301
ggcgcugaaggcacaga

SEQ ID NO: 3949407 - RNA, 19 nt, Shigella flexneri 2a str. 301
ggcgcugaaggcacagaaa

SEQ ID NO: 3949408 - RNA, 16 nt, Shigella flexneri 2a str. 301
ggcgcugauaaauccc

SEQ ID NO: 3949409 - RNA, 13 nt, Shigella flexneri 2a str. 301
ggcgcugcuguac

SEQ ID NO: 3949410 - RNA, 19 nt, Shigella flexneri 2a str. 301
ggcgcugcuuuccugcugc

SEQ ID NO: 3949411 - RNA, 15 nt, Shigella flexneri 2a str. 301
ggcgcuggcuccuga

SEQ ID NO: 3949412 - RNA, 18 nt, Shigella flexneri 2a str. 301
ggcgcuggguaaagagcg

SEQ ID NO: 3949413 - RNA, 20 nt, Shigella flexneri 2a str. 301
ggcgcuugucgucccaggca

SEQ ID NO: 3949414 - RNA, 19 nt, Shigella flexneri 2a str. 301
ggcggaaaucuuucauuuc

SEQ ID NO: 3949415 - RNA, 15 nt, Shigella flexneri 2a str. 301
ggcggaauaccgaca

SEQ ID NO: 3949416 - RNA, 21 nt, Shigella flexneri 2a str. 301
ggcggaauugguagacgcgcu

SEQ ID NO: 3949417 - RNA, 19 nt, Shigella flexneri 2a str. 301
ggcggauaauaauauccuu

SEQ ID NO: 3949418 - RNA, 14 nt, Shigella flexneri 2a str. 301
ggcggauggcgaau

SEQ ID NO: 3949419 - RNA, 16 nt, Shigella flexneri 2a str. 301
ggcggcaaucgcugcu

SEQ ID NO: 3949420 - RNA, 21 nt, Shigella flexneri 2a str. 301
ggcggcaaugaaagcgagcga

SEQ ID NO: 3949421 - RNA, 15 nt, Shigella flexneri 2a str. 301
ggcggcacagccagc

SEQ ID NO: 3949422 - RNA, 20 nt, Shigella flexneri 2a str. 301
ggcggcacagccagcgcugg

SEQ ID NO: 3949423 - RNA, 15 nt, Shigella flexneri 2a str. 301
ggcggcgcgccaggc

SEQ ID NO: 3949424 - RNA, 18 nt, Shigella flexneri 2a str. 301
ggcggcguucagucgccg

SEQ ID NO: 3949425 - RNA, 14 nt, Shigella flexneri 2a str. 301
ggcggcucaccugc

SEQ ID NO: 3949426 - RNA, 15 nt, Shigella flexneri 2a str. 301
ggcggcucaccugca

SEQ ID NO: 3949427 - RNA, 15 nt, Shigella flexneri 2a str. 301
ggcggcuggguuggg

SEQ ID NO: 3949428 - RNA, 20 nt, Shigella flexneri 2a str. 301
ggcgggacagcauggggcug

SEQ ID NO: 3949429 - RNA, 22 nt, Shigella flexneri 2a str. 301
ggcgggaucaccugcacaugca

SEQ ID NO: 3949430 - RNA, 16 nt, Shigella flexneri 2a str. 301
ggcgggcaacguucca

SEQ ID NO: 3949431 - RNA, 19 nt, Shigella flexneri 2a str. 301
ggcgguaauggcgcucuca

SEQ ID NO: 3949432 - RNA, 12 nt, Shigella flexneri 2a str. 301
ggcgguggauaa

SEQ ID NO: 3949433 - RNA, 17 nt, Shigella flexneri 2a str. 301
ggcgguuaauaaugauu

SEQ ID NO: 3949434 - RNA, 19 nt, Shigella flexneri 2a str. 301
ggcgguuaccuuggcacug

SEQ ID NO: 3949435 - RNA, 15 nt, Shigella flexneri 2a str. 301
ggcguaaugccuggg

SEQ ID NO: 3949436 - RNA, 20 nt, Shigella flexneri 2a str. 301
ggcguacugaccgucgccuu

SEQ ID NO: 3949437 - RNA, 13 nt, Shigella flexneri 2a str. 301
ggcguauauugca

SEQ ID NO: 3949438 - RNA, 21 nt, Shigella flexneri 2a str. 301
ggcgucacgccgaccagaccg

SEQ ID NO: 3949439 - RNA, 24 nt, Shigella flexneri 2a str. 301
ggcgucagcguuccacgugcggcc

SEQ ID NO: 3949440 - RNA, 13 nt, Shigella flexneri 2a str. 301
ggcguccagugcc

SEQ ID NO: 3949441 - RNA, 19 nt, Shigella flexneri 2a str. 301
ggcgucgcauccggcacua

SEQ ID NO: 3949442 - RNA, 13 nt, Shigella flexneri 2a str. 301
ggcgucuccaccu

SEQ ID NO: 3949443 - RNA, 17 nt, Shigella flexneri 2a str. 301
ggcgugacgaucaccac

SEQ ID NO: 3949444 - RNA, 18 nt, Shigella flexneri 2a str. 301
ggcgugagaucgcgcggg

SEQ ID NO: 3949445 - RNA, 22 nt, Shigella flexneri 2a str. 301
ggcgugagaucgcgcgggagca

SEQ ID NO: 3949446 - RNA, 21 nt, Shigella flexneri 2a str. 301
ggcgugaucuccuuggagaaa

SEQ ID NO: 3949447 - RNA, 21 nt, Shigella flexneri 2a str. 301
ggcgugauucauacagcggcc

SEQ ID NO: 3949448 - RNA, 15 nt, Shigella flexneri 2a str. 301
ggcgugauuccagac

SEQ ID NO: 3949449 - RNA, 15 nt, Shigella flexneri 2a str. 301
ggcgugguccagcug

SEQ ID NO: 3949450 - RNA, 14 nt, Shigella flexneri 2a str. 301
ggcguuacgcagca

SEQ ID NO: 3949451 - RNA, 16 nt, Shigella flexneri 2a str. 301
ggcguuauggcaaucu

SEQ ID NO: 3949452 - RNA, 15 nt, Shigella flexneri 2a str. 301
ggcguucugccuggc

SEQ ID NO: 3949453 - RNA, 15 nt, Shigella flexneri 2a str. 301
ggcguuuacgccgca

SEQ ID NO: 3949454 - RNA, 19 nt, Shigella flexneri 2a str. 301
ggcguuuacgccgcaucag

SEQ ID NO: 3949455 - RNA, 17 nt, Shigella flexneri 2a str. 301
ggcguuucacuucugag

SEQ ID NO: 3949456 - RNA, 14 nt, Shigella flexneri 2a str. 301
ggcguuuccagcuc

SEQ ID NO: 3949457 - RNA, 12 nt, Shigella flexneri 2a str. 301
ggcuaaaaaaag

SEQ ID NO: 3949458 - RNA, 15 nt, Shigella flexneri 2a str. 301
ggcuaaaauauucag

SEQ ID NO: 3949459 - RNA, 18 nt, Shigella flexneri 2a str. 301
ggcuaaacguguaguauu

SEQ ID NO: 3949460 - RNA, 21 nt, Shigella flexneri 2a str. 301
ggcuaacacccgucguugcaa

SEQ ID NO: 3949461 - RNA, 17 nt, Shigella flexneri 2a str. 301
ggcuaaccgcuuuucca

SEQ ID NO: 3949462 - RNA, 21 nt, Shigella flexneri 2a str. 301
ggcuaaccuuaugguguucag

SEQ ID NO: 3949463 - RNA, 18 nt, Shigella flexneri 2a str. 301
ggcuaaucgucaucgaca

SEQ ID NO: 3949464 - RNA, 21 nt, Shigella flexneri 2a str. 301
ggcuaaucuugaaaccagaca

SEQ ID NO: 3949465 - RNA, 15 nt, Shigella flexneri 2a str. 301
gggaggauuucuccc

SEQ ID NO: 3949466 - RNA, 13 nt, Shigella flexneri 2a str. 301
gggaguccacaac

SEQ ID NO: 3949467 - RNA, 13 nt, Shigella flexneri 2a str. 301
gggauagcucaau

SEQ ID NO: 3949468 - RNA, 22 nt, Shigella flexneri 2a str. 301
gggauauaacccucgcgcgaca

SEQ ID NO: 3949469 - RNA, 18 nt, Shigella flexneri 2a str. 301
gggauauccacugucaaa

SEQ ID NO: 3949470 - RNA, 20 nt, Shigella flexneri 2a str. 301
gggaucauccacccgcagca

SEQ ID NO: 3949471 - RNA, 17 nt, Shigella flexneri 2a str. 301
gggauccaguccccccc

SEQ ID NO: 3949472 - RNA, 19 nt, Shigella flexneri 2a str. 301
gggaucucuuccagugccu

SEQ ID NO: 3949473 - RNA, 17 nt, Shigella flexneri 2a str. 301
gggaucuucuuccgcgc

SEQ ID NO: 3949474 - RNA, 11 nt, Shigella flexneri 2a str. 301
gggaugcugau

SEQ ID NO: 3949475 - RNA, 14 nt, Shigella flexneri 2a str. 301
gggaugcuggggcc

SEQ ID NO: 3949476 - RNA, 21 nt, Shigella flexneri 2a str. 301
gggauggcguagcagcagcga

SEQ ID NO: 3949477 - RNA, 13 nt, Shigella flexneri 2a str. 301
gggauguguaagu

SEQ ID NO: 3949478 - RNA, 20 nt, Shigella flexneri 2a str. 301
gggauguguaaguaaugaca

SEQ ID NO: 3949479 - RNA, 19 nt, Shigella flexneri 2a str. 301
gggauuaaagcgcuccaga

SEQ ID NO: 3949480 - RNA, 17 nt, Shigella flexneri 2a str. 301
gggauuauugccgcagc

SEQ ID NO: 3949481 - RNA, 13 nt, Shigella flexneri 2a str. 301
gggauucgaaccu

SEQ ID NO: 3949482 - RNA, 15 nt, Shigella flexneri 2a str. 301
gggauuuauucccgg

SEQ ID NO: 3949483 - RNA, 23 nt, Shigella flexneri 2a str. 301
gggcaaacaccgcuucaacagcg

SEQ ID NO: 3949484 - RNA, 17 nt, Shigella flexneri 2a str. 301
gggcaaccugcuuuaaa

SEQ ID NO: 3949485 - RNA, 21 nt, Shigella flexneri 2a str. 301
gggcaagcgccuaaauccacc

SEQ ID NO: 3949486 - RNA, 22 nt, Shigella flexneri 2a str. 301
gggcaauuucacguucacccau

SEQ ID NO: 3949487 - RNA, 22 nt, Shigella flexneri 2a str. 301
gggcaccacgccggaugaaauc

SEQ ID NO: 3949488 - RNA, 22 nt, Shigella flexneri 2a str. 301
gggcacguucggcggaugcagg

SEQ ID NO: 3949489 - RNA, 18 nt, Shigella flexneri 2a str. 301
gggcagcaucgccaggau

SEQ ID NO: 3949490 - RNA, 18 nt, Shigella flexneri 2a str. 301
gggcaggggcuucuuccg

SEQ ID NO: 3949491 - RNA, 14 nt, Shigella flexneri 2a str. 301
gggcaucagcagca

SEQ ID NO: 3949492 - RNA, 18 nt, Shigella flexneri 2a str. 301
gggcauggugucaccacc

SEQ ID NO: 3949493 - RNA, 19 nt, Shigella flexneri 2a str. 301
gggcauguguuagcccugu

SEQ ID NO: 3949494 - RNA, 22 nt, Shigella flexneri 2a str. 301
gggcauucaugaacacacccgg

SEQ ID NO: 3949495 - RNA, 21 nt, Shigella flexneri 2a str. 301
gggcauuuccauuuuugacua

SEQ ID NO: 3949496 - RNA, 12 nt, Shigella flexneri 2a str. 301
gggccagcggcu

SEQ ID NO: 3949497 - RNA, 20 nt, Shigella flexneri 2a str. 301
gggccgaacaucagauaauc

SEQ ID NO: 3949498 - RNA, 19 nt, Shigella flexneri 2a str. 301
gggccgauuaaagacagcg

SEQ ID NO: 3949499 - RNA, 22 nt, Shigella flexneri 2a str. 301
gggccgauuaaagacagcgagg

SEQ ID NO: 3949500 - RNA, 17 nt, Shigella flexneri 2a str. 301
gggccgcugaacuggcg

SEQ ID NO: 3949501 - RNA, 19 nt, Shigella flexneri 2a str. 301
gggccgucaggugacacuu

SEQ ID NO: 3949502 - RNA, 11 nt, Shigella flexneri 2a str. 301
gggccgucccc

SEQ ID NO: 3949503 - RNA, 23 nt, Shigella flexneri 2a str. 301
gggccguuuucguuacuccgcca

SEQ ID NO: 3949504 - RNA, 14 nt, Shigella flexneri 2a str. 301
gggccuagugcggu

SEQ ID NO: 3949505 - RNA, 15 nt, Shigella flexneri 2a str. 301
gggccuccugcagcg

SEQ ID NO: 3949506 - RNA, 12 nt, Shigella flexneri 2a str. 301
gggccugaacaa

SEQ ID NO: 3949507 - RNA, 13 nt, Shigella flexneri 2a str. 301
gggcgauccggca

SEQ ID NO: 3949508 - RNA, 14 nt, Shigella flexneri 2a str. 301
gggcgauuuugcuu

SEQ ID NO: 3949509 - RNA, 11 nt, Shigella flexneri 2a str. 301
gggcgcgggcg

SEQ ID NO: 3949510 - RNA, 22 nt, Shigella flexneri 2a str. 301
gggcgcuggcuccugagcgcca

SEQ ID NO: 3949511 - RNA, 23 nt, Shigella flexneri 2a str. 301
gggcggagaugcggaaauaucgg

SEQ ID NO: 3949512 - RNA, 14 nt, Shigella flexneri 2a str. 301
gggcuaaugccagu

SEQ ID NO: 3949513 - RNA, 20 nt, Shigella flexneri 2a str. 301
gggcuauauacccuucucag

SEQ ID NO: 3949514 - RNA, 21 nt, Shigella flexneri 2a str. 301
gggcugacguuaagaaaacgg

SEQ ID NO: 3949515 - RNA, 21 nt, Shigella flexneri 2a str. 301
gggcugauaaacaagcguaca

SEQ ID NO: 3949516 - RNA, 21 nt, Shigella flexneri 2a str. 301
gggcuggaaacgcgaucgcca

SEQ ID NO: 3949517 - RNA, 19 nt, Shigella flexneri 2a str. 301
gggcuggccaauuggcugg

SEQ ID NO: 3949518 - RNA, 19 nt, Shigella flexneri 2a str. 301
gggcuguagcuuuucaugu

SEQ ID NO: 3949519 - RNA, 18 nt, Shigella flexneri 2a str. 301
gggcuuuauucaccagua

SEQ ID NO: 3949520 - RNA, 21 nt, Shigella flexneri 2a str. 301
gggcuuucaucacuugaucca

SEQ ID NO: 3949521 - RNA, 22 nt, Shigella flexneri 2a str. 301
gggcuuuucagaaauuuggcuc

SEQ ID NO: 3949522 - RNA, 17 nt, Shigella flexneri 2a str. 301
gggcuuuuuuauuucau

SEQ ID NO: 3949523 - RNA, 21 nt, Shigella flexneri 2a str. 301
gggcuuuuuuuauuauuccgu

SEQ ID NO: 3949524 - RNA, 14 nt, Shigella flexneri 2a str. 301
ggggaaguugcguc

SEQ ID NO: 3949525 - RNA, 12 nt, Shigella flexneri 2a str. 301
ggggaucauucc

SEQ ID NO: 3949526 - RNA, 21 nt, Shigella flexneri 2a str. 301
ggggauccagucccccccacu

SEQ ID NO: 3949527 - RNA, 14 nt, Shigella flexneri 2a str. 301
ggggaugcugaaaa

SEQ ID NO: 3949528 - RNA, 19 nt, Shigella flexneri 2a str. 301
ggggcacugaaagccgcag

SEQ ID NO: 3949529 - RNA, 15 nt, Shigella flexneri 2a str. 301
ggggcggcaaucgcu

SEQ ID NO: 3949530 - RNA, 18 nt, Shigella flexneri 2a str. 301
ggggguucaagucccccc

SEQ ID NO: 3949531 - RNA, 19 nt, Shigella flexneri 2a str. 301
gggguaucuuugacuacga

SEQ ID NO: 3949532 - RNA, 18 nt, Shigella flexneri 2a str. 301
gggguauuuccagggccu

SEQ ID NO: 3949533 - RNA, 20 nt, Shigella flexneri 2a str. 301
ggggucagggcuucaaaguu

SEQ ID NO: 3949534 - RNA, 13 nt, Shigella flexneri 2a str. 301
gggguuacgaccu

SEQ ID NO: 3949535 - RNA, 16 nt, Shigella flexneri 2a str. 301
gggguugcagaaacaa

SEQ ID NO: 3949536 - RNA, 12 nt, Shigella flexneri 2a str. 301
ggguaaaaggau

SEQ ID NO: 3949537 - RNA, 13 nt, Shigella flexneri 2a str. 301
ggguaaagagcgu

SEQ ID NO: 3949538 - RNA, 13 nt, Shigella flexneri 2a str. 301
ggguaagcgccac

SEQ ID NO: 3949539 - RNA, 13 nt, Shigella flexneri 2a str. 301
ggguaagggagga

SEQ ID NO: 3949540 - RNA, 16 nt, Shigella flexneri 2a str. 301
ggguauucauccggua

SEQ ID NO: 3949541 - RNA, 14 nt, Shigella flexneri 2a str. 301
gggucaggccagga

SEQ ID NO: 3949542 - RNA, 13 nt, Shigella flexneri 2a str. 301
gggucaguaugga

SEQ ID NO: 3949543 - RNA, 21 nt, Shigella flexneri 2a str. 301
gggucauccaggaacuccaga

SEQ ID NO: 3949544 - RNA, 19 nt, Shigella flexneri 2a str. 301
gggucuuccagcaaaucca

SEQ ID NO: 3949545 - RNA, 17 nt, Shigella flexneri 2a str. 301
gggucuuuuaaauccug

SEQ ID NO: 3949546 - RNA, 19 nt, Shigella flexneri 2a str. 301
gggugagggcguagagaga

SEQ ID NO: 3949547 - RNA, 15 nt, Shigella flexneri 2a str. 301
gggugcaaucaacac

SEQ ID NO: 3949548 - RNA, 16 nt, Shigella flexneri 2a str. 301
gggugccgggaacugg

SEQ ID NO: 3949549 - RNA, 21 nt, Shigella flexneri 2a str. 301
gggugcgaauaagcugcguga

SEQ ID NO: 3949550 - RNA, 15 nt, Shigella flexneri 2a str. 301
ggguguuaagcgcag

SEQ ID NO: 3949551 - RNA, 15 nt, Shigella flexneri 2a str. 301
ggguuagucugcauu

SEQ ID NO: 3949552 - RNA, 19 nt, Shigella flexneri 2a str. 301
ggguuagucugcauuuucu

SEQ ID NO: 3949553 - RNA, 17 nt, Shigella flexneri 2a str. 301
ggguucaaaaacuaauu

SEQ ID NO: 3949554 - RNA, 17 nt, Shigella flexneri 2a str. 301
ggguucaaguccccccc

SEQ ID NO: 3949555 - RNA, 17 nt, Shigella flexneri 2a str. 301
ggguugccaccgguaca

SEQ ID NO: 3949556 - RNA, 20 nt, Shigella flexneri 2a str. 301
ggguuugcguuugcagcauu

SEQ ID NO: 3949557 - RNA, 16 nt, Shigella flexneri 2a str. 301
ggguuuuauuauucca

SEQ ID NO: 3949558 - RNA, 12 nt, Shigella flexneri 2a str. 301
ggguuuuccagu

SEQ ID NO: 3949559 - RNA, 18 nt, Shigella flexneri 2a str. 301
ggguuuuucgcgcgggca

SEQ ID NO: 3949560 - RNA, 18 nt, Shigella flexneri 2a str. 301
gguaaaaccgacuuaaaa

SEQ ID NO: 3949561 - RNA, 16 nt, Shigella flexneri 2a str. 301
gguaaaauaucacucg

SEQ ID NO: 3949562 - RNA, 12 nt, Shigella flexneri 2a str. 301
gguaaagaagag

SEQ ID NO: 3949563 - RNA, 15 nt, Shigella flexneri 2a str. 301
gguaaagccgugcug

SEQ ID NO: 3949564 - RNA, 23 nt, Shigella flexneri 2a str. 301
gguaaagccgugcugcugccaaa

SEQ ID NO: 3949565 - RNA, 21 nt, Shigella flexneri 2a str. 301
gguugccccgcacgcuucauc

SEQ ID NO: 3949566 - RNA, 16 nt, Shigella flexneri 2a str. 301
gguugcucauaaaaug

SEQ ID NO: 3949567 - RNA, 18 nt, Shigella flexneri 2a str. 301
gguugcuggaaagagaaa

SEQ ID NO: 3949568 - RNA, 14 nt, Shigella flexneri 2a str. 301
gguugcuuaucccg

SEQ ID NO: 3949569 - RNA, 13 nt, Shigella flexneri 2a str. 301
gguuggagcgcgu

SEQ ID NO: 3949570 - RNA, 14 nt, Shigella flexneri 2a str. 301
gguuggcucaucaa

SEQ ID NO: 3949571 - RNA, 16 nt, Shigella flexneri 2a str. 301
gguugguacuguggca

SEQ ID NO: 3949572 - RNA, 17 nt, Shigella flexneri 2a str. 301
gguugugagcauaacgu

SEQ ID NO: 3949573 - RNA, 21 nt, Shigella flexneri 2a str. 301
gguuuaaacagagauuacuuu

SEQ ID NO: 3949574 - RNA, 23 nt, Shigella flexneri 2a str. 301
gguuuaagacaauuuaauaagaa

SEQ ID NO: 3949575 - RNA, 13 nt, Shigella flexneri 2a str. 301
gguuucaacugcg

SEQ ID NO: 3949576 - RNA, 19 nt, Shigella flexneri 2a str. 301
gguuucaagauuagccccc

SEQ ID NO: 3949577 - RNA, 20 nt, Shigella flexneri 2a str. 301
gguuucaagauuagcccccg

SEQ ID NO: 3949578 - RNA, 14 nt, Shigella flexneri 2a str. 301
gguuucaauuuccc

SEQ ID NO: 3949579 - RNA, 17 nt, Shigella flexneri 2a str. 301
gguuucacggcaccagc

SEQ ID NO: 3949580 - RNA, 19 nt, Shigella flexneri 2a str. 301
gguuucagauuauugacaa

SEQ ID NO: 3949581 - RNA, 17 nt, Shigella flexneri 2a str. 301
gguuuccggaucgccaa

SEQ ID NO: 3949582 - RNA, 16 nt, Shigella flexneri 2a str. 301
gguuuccucaugcaua

SEQ ID NO: 3949583 - RNA, 18 nt, Shigella flexneri 2a str. 301
gguuucgccacggcgcag

SEQ ID NO: 3949584 - RNA, 22 nt, Shigella flexneri 2a str. 301
gguuucgggucgaaaauaucgg

SEQ ID NO: 3949585 - RNA, 19 nt, Shigella flexneri 2a str. 301
gguuucgugaaacucagca

SEQ ID NO: 3949586 - RNA, 12 nt, Shigella flexneri 2a str. 301
gguuucgugcau

SEQ ID NO: 3949587 - RNA, 16 nt, Shigella flexneri 2a str. 301
gguuugaaaaaaccug

SEQ ID NO: 3949588 - RNA, 18 nt, Shigella flexneri 2a str. 301
gguuuguaggccggauaa

SEQ ID NO: 3949589 - RNA, 14 nt, Shigella flexneri 2a str. 301
gguuuguuauccac

SEQ ID NO: 3949590 - RNA, 21 nt, Shigella flexneri 2a str. 301
gguuuucaacgugucuuuuac

SEQ ID NO: 3949591 - RNA, 12 nt, Shigella flexneri 2a str. 301
gguuuucaaucg

SEQ ID NO: 3949592 - RNA, 22 nt, Shigella flexneri 2a str. 301
gguuuucaaucgacuuuucaua

SEQ ID NO: 3949593 - RNA, 21 nt, Shigella flexneri 2a str. 301
gguuuugaaacucgcugccag

SEQ ID NO: 3949594 - RNA, 14 nt, Shigella flexneri 2a str. 301
gguuuuugcugacg

SEQ ID NO: 3949595 - RNA, 22 nt, Shigella flexneri 2a str. 301
gguuuuuuauuaauucuaaaac

SEQ ID NO: 3949596 - RNA, 16 nt, Shigella flexneri 2a str. 301
guaaaaacgcauuuau

SEQ ID NO: 3949597 - RNA, 18 nt, Shigella flexneri 2a str. 301
guaaaaacgcauuuaucu

SEQ ID NO: 3949598 - RNA, 19 nt, Shigella flexneri 2a str. 301
guaaaaacgcauuuaucuu

SEQ ID NO: 3949599 - RNA, 15 nt, Shigella flexneri 2a str. 301
guaaaaagaaaguuu

SEQ ID NO: 3949600 - RNA, 15 nt, Shigella flexneri 2a str. 301
guaaaaccaugccau

SEQ ID NO: 3949601 - RNA, 21 nt, Shigella flexneri 2a str. 301
guaaaaccgacuuaaaaggaa

SEQ ID NO: 3949602 - RNA, 16 nt, Shigella flexneri 2a str. 301
guaaaaccgauauguu

SEQ ID NO: 3949603 - RNA, 21 nt, Shigella flexneri 2a str. 301
guaaaaccgcgaugaccaaaa

SEQ ID NO: 3949604 - RNA, 18 nt, Shigella flexneri 2a str. 301
guaaaaccugacaacaaa

SEQ ID NO: 3949605 - RNA, 12 nt, Shigella flexneri 2a str. 301
guaaaacgccca

SEQ ID NO: 3949606 - RNA, 21 nt, Shigella flexneri 2a str. 301
guaaaacggauaugauuuaaa

SEQ ID NO: 3949607 - RNA, 22 nt, Shigella flexneri 2a str. 301
guaaaacggauaugauuuaaaa

SEQ ID NO: 3949608 - RNA, 16 nt, Shigella flexneri 2a str. 301
guaaaacgugccauua

SEQ ID NO: 3949609 - RNA, 18 nt, Shigella flexneri 2a str. 301
guaaaaggucugaaagau

SEQ ID NO: 3949610 - RNA, 15 nt, Shigella flexneri 2a str. 301
guaaaauaacagcgg

SEQ ID NO: 3949611 - RNA, 17 nt, Shigella flexneri 2a str. 301
guaaaauaacagcggca

SEQ ID NO: 3949612 - RNA, 20 nt, Shigella flexneri 2a str. 301
guaaaaucgauaacgccuag

SEQ ID NO: 3949613 - RNA, 22 nt, Shigella flexneri 2a str. 301
guaaaaucuucacuaaaaucau

SEQ ID NO: 3949614 - RNA, 20 nt, Shigella flexneri 2a str. 301
guaaaauggucagccagcgg

SEQ ID NO: 3949615 - RNA, 22 nt, Shigella flexneri 2a str. 301
guaaaauucuacagaaaugaaa

SEQ ID NO: 3949616 - RNA, 23 nt, Shigella flexneri 2a str. 301
guaaaauuuggguguaucuucag

SEQ ID NO: 3949617 - RNA, 15 nt, Shigella flexneri 2a str. 301
guaaacaacuggcgc

SEQ ID NO: 3949618 - RNA, 20 nt, Shigella flexneri 2a str. 301
guaaaccaccaguccuucua

SEQ ID NO: 3949619 - RNA, 18 nt, Shigella flexneri 2a str. 301
guaaaccagagagaagcu

SEQ ID NO: 3949620 - RNA, 16 nt, Shigella flexneri 2a str. 301
guaaacccagccgcgu

SEQ ID NO: 3949621 - RNA, 22 nt, Shigella flexneri 2a str. 301
guaaaccggucguuaccaguaa

SEQ ID NO: 3949622 - RNA, 17 nt, Shigella flexneri 2a str. 301
guaaaccgucagcacca

SEQ ID NO: 3949623 - RNA, 14 nt, Shigella flexneri 2a str. 301
guaaaccucuuucg

SEQ ID NO: 3949624 - RNA, 15 nt, Shigella flexneri 2a str. 301
guaaacgaugaugcg

SEQ ID NO: 3949625 - RNA, 17 nt, Shigella flexneri 2a str. 301
guaaacgaugaugcggc

SEQ ID NO: 3949626 - RNA, 16 nt, Shigella flexneri 2a str. 301
guaaacgcagcaucau

SEQ ID NO: 3949627 - RNA, 20 nt, Shigella flexneri 2a str. 301
guaaacgcccaauccggccu

SEQ ID NO: 3949628 - RNA, 17 nt, Shigella flexneri 2a str. 301
guaaacgccgagcugga

SEQ ID NO: 3949629 - RNA, 14 nt, Shigella flexneri 2a str. 301
guaaacgccuuauc

SEQ ID NO: 3949630 - RNA, 20 nt, Shigella flexneri 2a str. 301
guaaacgccuuauccggccu

SEQ ID NO: 3949631 - RNA, 17 nt, Shigella flexneri 2a str. 301
guaaacgugcggcugug

SEQ ID NO: 3949632 - RNA, 13 nt, Shigella flexneri 2a str. 301
guaaagaagguaa

SEQ ID NO: 3949633 - RNA, 21 nt, Shigella flexneri 2a str. 301
guaaagagugugaauauucau

SEQ ID NO: 3949634 - RNA, 18 nt, Shigella flexneri 2a str. 301
guaaagccugcuggcagu

SEQ ID NO: 3949635 - RNA, 20 nt, Shigella flexneri 2a str. 301
guaaagcggcgaguauucuu

SEQ ID NO: 3949636 - RNA, 15 nt, Shigella flexneri 2a str. 301
guaaagcugcgcagg

SEQ ID NO: 3949637 - RNA, 19 nt, Shigella flexneri 2a str. 301
guaaaggcggcagaacaga

SEQ ID NO: 3949638 - RNA, 18 nt, Shigella flexneri 2a str. 301
guaaauacgccccacaga

SEQ ID NO: 3949639 - RNA, 12 nt, Shigella flexneri 2a str. 301
guaaaucaccag

SEQ ID NO: 3949640 - RNA, 20 nt, Shigella flexneri 2a str. 301
guaaaucccagugccugcau

SEQ ID NO: 3949641 - RNA, 17 nt, Shigella flexneri 2a str. 301
guaaaucggcgaagaga

SEQ ID NO: 3949642 - RNA, 20 nt, Shigella flexneri 2a str. 301
guaaaucugucagguaacaa

SEQ ID NO: 3949643 - RNA, 13 nt, Shigella flexneri 2a str. 301
guaaaugaacuca

SEQ ID NO: 3949644 - RNA, 22 nt, Shigella flexneri 2a str. 301
guaaaugccgacuuuguuuuua

SEQ ID NO: 3949645 - RNA, 15 nt, Shigella flexneri 2a str. 301
guaaauggcugacca

SEQ ID NO: 3949646 - RNA, 19 nt, Shigella flexneri 2a str. 301
guaaaugggccaacaccag

SEQ ID NO: 3949647 - RNA, 15 nt, Shigella flexneri 2a str. 301
guaaauucaauaaau

SEQ ID NO: 3949648 - RNA, 17 nt, Shigella flexneri 2a str. 301
guaaauugcaaaccuca

SEQ ID NO: 3949649 - RNA, 22 nt, Shigella flexneri 2a str. 301
guaaauugcaaaccucaggaau

SEQ ID NO: 3949650 - RNA, 15 nt, Shigella flexneri 2a str. 301
guaaauugcagcaca

SEQ ID NO: 3949651 - RNA, 13 nt, Shigella flexneri 2a str. 301
guaacaaaacuca

SEQ ID NO: 3949652 - RNA, 17 nt, Shigella flexneri 2a str. 301
guaacaaagccugcacc

SEQ ID NO: 3949653 - RNA, 17 nt, Shigella flexneri 2a str. 301
guaacaaaugugccauu

SEQ ID NO: 3949654 - RNA, 19 nt, Shigella flexneri 2a str. 301
guaacaauauuugcagagg

SEQ ID NO: 3949655 - RNA, 18 nt, Shigella flexneri 2a str. 301
guaacacauaacgccaau

SEQ ID NO: 3949656 - RNA, 13 nt, Shigella flexneri 2a str. 301
guaacagagcauc

SEQ ID NO: 3949657 - RNA, 20 nt, Shigella flexneri 2a str. 301
guaacagcaauuuugucauu

SEQ ID NO: 3949658 - RNA, 22 nt, Shigella flexneri 2a str. 301
guaacagugcaccggacacugc

SEQ ID NO: 3949659 - RNA, 16 nt, Shigella flexneri 2a str. 301
guaacaguuaccuuua

SEQ ID NO: 3949660 - RNA, 16 nt, Shigella flexneri 2a str. 301
guaacauacuccaccc

SEQ ID NO: 3949661 - RNA, 22 nt, Shigella flexneri 2a str. 301
guaaccaaaagcugggauggca

SEQ ID NO: 3949662 - RNA, 22 nt, Shigella flexneri 2a str. 301
guaaccaaacguggucgccagc

SEQ ID NO: 3949663 - RNA, 13 nt, Shigella flexneri 2a str. 301
guaaccacgcagc

SEQ ID NO: 3949664 - RNA, 14 nt, Shigella flexneri 2a str. 301
guaaccacgcagcg

SEQ ID NO: 3949665 - RNA, 12 nt, Shigella flexneri 2a str. 301
guaccuccuuca

SEQ ID NO: 3949666 - RNA, 18 nt, Shigella flexneri 2a str. 301
guaccuccuucacagugg

SEQ ID NO: 3949667 - RNA, 17 nt, Shigella flexneri 2a str. 301
guaccugggcgauaacg

SEQ ID NO: 3949668 - RNA, 19 nt, Shigella flexneri 2a str. 301
guaccugugaagugaaaaa

SEQ ID NO: 3949669 - RNA, 13 nt, Shigella flexneri 2a str. 301
guacgaaauaacu

SEQ ID NO: 3949670 - RNA, 15 nt, Shigella flexneri 2a str. 301
guacgacaaaagaau

SEQ ID NO: 3949671 - RNA, 14 nt, Shigella flexneri 2a str. 301
guacgacuuccugg

SEQ ID NO: 3949672 - RNA, 17 nt, Shigella flexneri 2a str. 301
guacgaggauucgaacc

SEQ ID NO: 3949673 - RNA, 16 nt, Shigella flexneri 2a str. 301
guacgauacagaagca

SEQ ID NO: 3949674 - RNA, 20 nt, Shigella flexneri 2a str. 301
guacgauacagaagcaccgu

SEQ ID NO: 3949675 - RNA, 20 nt, Shigella flexneri 2a str. 301
guacgauuuaaagcggccag

SEQ ID NO: 3949676 - RNA, 15 nt, Shigella flexneri 2a str. 301
guacgcaggcggcug

SEQ ID NO: 3949677 - RNA, 14 nt, Shigella flexneri 2a str. 301
guacgccaaucugc

SEQ ID NO: 3949678 - RNA, 21 nt, Shigella flexneri 2a str. 301
guacgcggcaauccccgccag

SEQ ID NO: 3949679 - RNA, 18 nt, Shigella flexneri 2a str. 301
guacgcguucaaucaaau

SEQ ID NO: 3949680 - RNA, 15 nt, Shigella flexneri 2a str. 301
guacgcuccagcagg

SEQ ID NO: 3949681 - RNA, 16 nt, Shigella flexneri 2a str. 301
guacgggacagcaggu

SEQ ID NO: 3949682 - RNA, 13 nt, Shigella flexneri 2a str. 301
guacgucgagaau

SEQ ID NO: 3949683 - RNA, 14 nt, Shigella flexneri 2a str. 301
guacguucauggcg

SEQ ID NO: 3949684 - RNA, 15 nt, Shigella flexneri 2a str. 301
guacucaccgcucac

SEQ ID NO: 3949685 - RNA, 11 nt, Shigella flexneri 2a str. 301
guacuccagca

SEQ ID NO: 3949686 - RNA, 14 nt, Shigella flexneri 2a str. 301
guacuccagcagac

SEQ ID NO: 3949687 - RNA, 24 nt, Shigella flexneri 2a str. 301
guacugaccgucgccuucaacgua

SEQ ID NO: 3949688 - RNA, 12 nt, Shigella flexneri 2a str. 301
guacugagagau

SEQ ID NO: 3949689 - RNA, 19 nt, Shigella flexneri 2a str. 301
guacugccgaacagaaugc

SEQ ID NO: 3949690 - RNA, 22 nt, Shigella flexneri 2a str. 301
guacuggcaaucgccagcggca

SEQ ID NO: 3949691 - RNA, 19 nt, Shigella flexneri 2a str. 301
guacuggcgugggcaucga

SEQ ID NO: 3949692 - RNA, 13 nt, Shigella flexneri 2a str. 301
guacuguuucacu

SEQ ID NO: 3949693 - RNA, 21 nt, Shigella flexneri 2a str. 301
guacuucaugaguuccacugg

SEQ ID NO: 3949694 - RNA, 22 nt, Shigella flexneri 2a str. 301
guacuuccggacguucagccau

SEQ ID NO: 3949695 - RNA, 12 nt, Shigella flexneri 2a str. 301
guacuuucaaca

SEQ ID NO: 3949696 - RNA, 16 nt, Shigella flexneri 2a str. 301
guacuuuugaaugagu

SEQ ID NO: 3949697 - RNA, 16 nt, Shigella flexneri 2a str. 301
guagaaauuauuucuu

SEQ ID NO: 3949698 - RNA, 23 nt, Shigella flexneri 2a str. 301
guagacauaaggaaacuccagcc

SEQ ID NO: 3949699 - RNA, 19 nt, Shigella flexneri 2a str. 301
guagaccugauacauagca

SEQ ID NO: 3949700 - RNA, 13 nt, Shigella flexneri 2a str. 301
guagacugcagcg

SEQ ID NO: 3949701 - RNA, 21 nt, Shigella flexneri 2a str. 301
guagacugcagcggucacaug

SEQ ID NO: 3949702 - RNA, 22 nt, Shigella flexneri 2a str. 301
guagacuuuagcgcaaucgcau

SEQ ID NO: 3949703 - RNA, 14 nt, Shigella flexneri 2a str. 301
guagagaauccagu

SEQ ID NO: 3949704 - RNA, 13 nt, Shigella flexneri 2a str. 301
guagagcagcacg

SEQ ID NO: 3949705 - RNA, 18 nt, Shigella flexneri 2a str. 301
guagaguuugaacucaca

SEQ ID NO: 3949706 - RNA, 19 nt, Shigella flexneri 2a str. 301
guagauaagcaaggcaauc

SEQ ID NO: 3949707 - RNA, 22 nt, Shigella flexneri 2a str. 301
guagaucuccauacuuccacua

SEQ ID NO: 3949708 - RNA, 15 nt, Shigella flexneri 2a str. 301
guagaucuugauuua

SEQ ID NO: 3949709 - RNA, 13 nt, Shigella flexneri 2a str. 301
guagaugauuuuu

SEQ ID NO: 3949710 - RNA, 18 nt, Shigella flexneri 2a str. 301
guagauggggccaugauu

SEQ ID NO: 3949711 - RNA, 19 nt, Shigella flexneri 2a str. 301
guagauugcacuugcuuaa

SEQ ID NO: 3949712 - RNA, 20 nt, Shigella flexneri 2a str. 301
guagcaccgacgucgauaua

SEQ ID NO: 3949713 - RNA, 15 nt, Shigella flexneri 2a str. 301
guagcagcuuucagc

SEQ ID NO: 3949714 - RNA, 19 nt, Shigella flexneri 2a str. 301
guagcagcuuucagcagcg

SEQ ID NO: 3949715 - RNA, 13 nt, Shigella flexneri 2a str. 301
guagcaggcaggc

SEQ ID NO: 3949716 - RNA, 16 nt, Shigella flexneri 2a str. 301
guagcauccccggcaa

SEQ ID NO: 3949717 - RNA, 20 nt, Shigella flexneri 2a str. 301
guagccaauaaaugccacca

SEQ ID NO: 3949718 - RNA, 23 nt, Shigella flexneri 2a str. 301
guagccaauaaaugccaccacac

SEQ ID NO: 3949719 - RNA, 14 nt, Shigella flexneri 2a str. 301
guagccagacaaug

SEQ ID NO: 3949720 - RNA, 22 nt, Shigella flexneri 2a str. 301
guagccaugcauaaugcagcca

SEQ ID NO: 3949721 - RNA, 18 nt, Shigella flexneri 2a str. 301
guagccccagucuuccug

SEQ ID NO: 3949722 - RNA, 15 nt, Shigella flexneri 2a str. 301
guagccucgccgagc

SEQ ID NO: 3949723 - RNA, 17 nt, Shigella flexneri 2a str. 301
guagcgacgcaaugcca

SEQ ID NO: 3949724 - RNA, 18 nt, Shigella flexneri 2a str. 301
guagcgccauacugacua

SEQ ID NO: 3949725 - RNA, 16 nt, Shigella flexneri 2a str. 301
guagcggcucggaaua

SEQ ID NO: 3949726 - RNA, 14 nt, Shigella flexneri 2a str. 301
guagcgggcaguaa

SEQ ID NO: 3949727 - RNA, 20 nt, Shigella flexneri 2a str. 301
guagcguuuuauaccaacaa

SEQ ID NO: 3949728 - RNA, 14 nt, Shigella flexneri 2a str. 301
guagcucagcugga

SEQ ID NO: 3949729 - RNA, 15 nt, Shigella flexneri 2a str. 301
guagcucaucuucau

SEQ ID NO: 3949730 - RNA, 17 nt, Shigella flexneri 2a str. 301
guagcucaucuucauaa

SEQ ID NO: 3949731 - RNA, 20 nt, Shigella flexneri 2a str. 301
guagcugcaggaauaaucag

SEQ ID NO: 3949732 - RNA, 22 nt, Shigella flexneri 2a str. 301
guagcugguaccuugaaacgau

SEQ ID NO: 3949733 - RNA, 17 nt, Shigella flexneri 2a str. 301
guaggcagcauccggca

SEQ ID NO: 3949734 - RNA, 10 nt, Shigella flexneri 2a str. 301
guaggccgga

SEQ ID NO: 3949735 - RNA, 20 nt, Shigella flexneri 2a str. 301
guaggccggucaagcgcagc

SEQ ID NO: 3949736 - RNA, 18 nt, Shigella flexneri 2a str. 301
guaggccguauccggcau

SEQ ID NO: 3949737 - RNA, 19 nt, Shigella flexneri 2a str. 301
guaggccugauaagacgcg

SEQ ID NO: 3949738 - RNA, 18 nt, Shigella flexneri 2a str. 301
guaggccugauaagcgua

SEQ ID NO: 3949739 - RNA, 20 nt, Shigella flexneri 2a str. 301
guaggccugauaagcguagc

SEQ ID NO: 3949740 - RNA, 22 nt, Shigella flexneri 2a str. 301
guaggcgcguuucugcgcuucu

SEQ ID NO: 3949741 - RNA, 18 nt, Shigella flexneri 2a str. 301
guaggcuggauaaggcgu

SEQ ID NO: 3949742 - RNA, 14 nt, Shigella flexneri 2a str. 301
guaggucacucccg

SEQ ID NO: 3949743 - RNA, 16 nt, Shigella flexneri 2a str. 301
guaguauagaaagaua

SEQ ID NO: 3949744 - RNA, 15 nt, Shigella flexneri 2a str. 301
guaguauccacacca

SEQ ID NO: 3949745 - RNA, 22 nt, Shigella flexneri 2a str. 301
guaguauccgugccgagguggu

SEQ ID NO: 3949746 - RNA, 12 nt, Shigella flexneri 2a str. 301
guaguccgcuga

SEQ ID NO: 3949747 - RNA, 13 nt, Shigella flexneri 2a str. 301
guagucggugcca

SEQ ID NO: 3949748 - RNA, 18 nt, Shigella flexneri 2a str. 301
guagugauuuuaauaaau

SEQ ID NO: 3949749 - RNA, 16 nt, Shigella flexneri 2a str. 301
guaguggaucagcaaa

SEQ ID NO: 3949750 - RNA, 19 nt, Shigella flexneri 2a str. 301
guaguuaugaaaauaggaa

SEQ ID NO: 3949751 - RNA, 14 nt, Shigella flexneri 2a str. 301
guaguuccagcaug

SEQ ID NO: 3949752 - RNA, 14 nt, Shigella flexneri 2a str. 301
guaguugaucgccc

SEQ ID NO: 3949753 - RNA, 12 nt, Shigella flexneri 2a str. 301
guaguuucuccc

SEQ ID NO: 3949754 - RNA, 21 nt, Shigella flexneri 2a str. 301
guaguuuggugagaacaccaa

SEQ ID NO: 3949755 - RNA, 15 nt, Shigella flexneri 2a str. 301
guauaacgcaaaaau

SEQ ID NO: 3949756 - RNA, 19 nt, Shigella flexneri 2a str. 301
guauaagagguuuccagcc

SEQ ID NO: 3949757 - RNA, 14 nt, Shigella flexneri 2a str. 301
guauaccauuucug

SEQ ID NO: 3949758 - RNA, 15 nt, Shigella flexneri 2a str. 301
guauacgccacauca

SEQ ID NO: 3949759 - RNA, 17 nt, Shigella flexneri 2a str. 301
guauacgggcuuuuuaa

SEQ ID NO: 3949760 - RNA, 23 nt, Shigella flexneri 2a str. 301
guauacgucccggugaagcgccc

SEQ ID NO: 3949761 - RNA, 14 nt, Shigella flexneri 2a str. 301
guauauaaaaaaca

SEQ ID NO: 3949762 - RNA, 21 nt, Shigella flexneri 2a str. 301
guauauaaauguuaagacugg

SEQ ID NO: 3949763 - RNA, 21 nt, Shigella flexneri 2a str. 301
guauaucccugacgaccaaug

SEQ ID NO: 3949764 - RNA, 13 nt, Shigella flexneri 2a str. 301
guaucaaacacag

SEQ ID NO: 3949765 - RNA, 12 nt, Shigella flexneri 2a str. 301
gucagaugcggc

SEQ ID NO: 3949766 - RNA, 19 nt, Shigella flexneri 2a str. 301
gucagcagguguccagcca

SEQ ID NO: 3949767 - RNA, 12 nt, Shigella flexneri 2a str. 301
gucagcaucaua

SEQ ID NO: 3949768 - RNA, 19 nt, Shigella flexneri 2a str. 301
gucagcaucauaccuccgc

SEQ ID NO: 3949769 - RNA, 21 nt, Shigella flexneri 2a str. 301
gucagcaucauaccuccgcaa

SEQ ID NO: 3949770 - RNA, 20 nt, Shigella flexneri 2a str. 301
gucagcccgugauuuuccug

SEQ ID NO: 3949771 - RNA, 18 nt, Shigella flexneri 2a str. 301
gucagccucgcuggucag

SEQ ID NO: 3949772 - RNA, 20 nt, Shigella flexneri 2a str. 301
gucagccucgcuggucagcg

SEQ ID NO: 3949773 - RNA, 19 nt, Shigella flexneri 2a str. 301
gucagccugcucaguugca

SEQ ID NO: 3949774 - RNA, 23 nt, Shigella flexneri 2a str. 301
gucagcgccaggcuuuccgucag

SEQ ID NO: 3949775 - RNA, 22 nt, Shigella flexneri 2a str. 301
gucagcgucgcaucuggcauaa

SEQ ID NO: 3949776 - RNA, 17 nt, Shigella flexneri 2a str. 301
gucagcguuccacgugc

SEQ ID NO: 3949777 - RNA, 15 nt, Shigella flexneri 2a str. 301
gucagcucauccagc

SEQ ID NO: 3949778 - RNA, 13 nt, Shigella flexneri 2a str. 301
gucagcugcuguu

SEQ ID NO: 3949779 - RNA, 23 nt, Shigella flexneri 2a str. 301
gucagcuuucagagaagcaccgc

SEQ ID NO: 3949780 - RNA, 12 nt, Shigella flexneri 2a str. 301
gucaggaagccc

SEQ ID NO: 3949781 - RNA, 15 nt, Shigella flexneri 2a str. 301
gucaggaagccccag

SEQ ID NO: 3949782 - RNA, 20 nt, Shigella flexneri 2a str. 301
gucaggcaaccgcugagcga

SEQ ID NO: 3949783 - RNA, 17 nt, Shigella flexneri 2a str. 301
gucaggccgauaauaaa

SEQ ID NO: 3949784 - RNA, 17 nt, Shigella flexneri 2a str. 301
gucaggggcauuuucaa

SEQ ID NO: 3949785 - RNA, 18 nt, Shigella flexneri 2a str. 301
gucaggggcauuuucaag

SEQ ID NO: 3949786 - RNA, 18 nt, Shigella flexneri 2a str. 301
gucaggucacccaacaug

SEQ ID NO: 3949787 - RNA, 16 nt, Shigella flexneri 2a str. 301
gucagguuuuaccucu

SEQ ID NO: 3949788 - RNA, 18 nt, Shigella flexneri 2a str. 301
gucaguaaccgcuuuuuc

SEQ ID NO: 3949789 - RNA, 20 nt, Shigella flexneri 2a str. 301
gucaguaaccgcuuuuucaa

SEQ ID NO: 3949790 - RNA, 21 nt, Shigella flexneri 2a str. 301
gucaguagcgcaaucaccacc

SEQ ID NO: 3949791 - RNA, 14 nt, Shigella flexneri 2a str. 301
gucagucaucacuu

SEQ ID NO: 3949792 - RNA, 21 nt, Shigella flexneri 2a str. 301
gucaguggacgauaagcaccg

SEQ ID NO: 3949793 - RNA, 13 nt, Shigella flexneri 2a str. 301
gucaguggcagca

SEQ ID NO: 3949794 - RNA, 14 nt, Shigella flexneri 2a str. 301
gucaguggcagcaa

SEQ ID NO: 3949795 - RNA, 19 nt, Shigella flexneri 2a str. 301
gucagugucuuaucuggca

SEQ ID NO: 3949796 - RNA, 13 nt, Shigella flexneri 2a str. 301
gucaguucagaau

SEQ ID NO: 3949797 - RNA, 13 nt, Shigella flexneri 2a str. 301
gucaguucauggu

SEQ ID NO: 3949798 - RNA, 16 nt, Shigella flexneri 2a str. 301
gucaguucccagggcu

SEQ ID NO: 3949799 - RNA, 18 nt, Shigella flexneri 2a str. 301
gucaguuccgcuucgcca

SEQ ID NO: 3949800 - RNA, 15 nt, Shigella flexneri 2a str. 301
gucaguuucagccag

SEQ ID NO: 3949801 - RNA, 22 nt, Shigella flexneri 2a str. 301
gucaguuuccagcauucgcgca

SEQ ID NO: 3949802 - RNA, 19 nt, Shigella flexneri 2a str. 301
gucauaacuggucaucaaa

SEQ ID NO: 3949803 - RNA, 23 nt, Shigella flexneri 2a str. 301
gucauacaacgcgcggugaugau

SEQ ID NO: 3949804 - RNA, 21 nt, Shigella flexneri 2a str. 301
gucauacgcguaaaacagcca

SEQ ID NO: 3949805 - RNA, 21 nt, Shigella flexneri 2a str. 301
gucauacuccagucgcugcug

SEQ ID NO: 3949806 - RNA, 17 nt, Shigella flexneri 2a str. 301
gucauaggugucaacca

SEQ ID NO: 3949807 - RNA, 12 nt, Shigella flexneri 2a str. 301
gucauauagccg

SEQ ID NO: 3949808 - RNA, 21 nt, Shigella flexneri 2a str. 301
gucauauagccgcgcaguuuc

SEQ ID NO: 3949809 - RNA, 19 nt, Shigella flexneri 2a str. 301
gucauauuucuguuugcgu

SEQ ID NO: 3949810 - RNA, 13 nt, Shigella flexneri 2a str. 301
gucaucaaaauca

SEQ ID NO: 3949811 - RNA, 22 nt, Shigella flexneri 2a str. 301
gucaucaaacggcauaugccau

SEQ ID NO: 3949812 - RNA, 21 nt, Shigella flexneri 2a str. 301
gucaucaccggcuucucgccu

SEQ ID NO: 3949813 - RNA, 20 nt, Shigella flexneri 2a str. 301
gucaucagcgccaacccgcu

SEQ ID NO: 3949814 - RNA, 19 nt, Shigella flexneri 2a str. 301
gucaucagucugagccugc

SEQ ID NO: 3949815 - RNA, 14 nt, Shigella flexneri 2a str. 301
gucaucaguuucaa

SEQ ID NO: 3949816 - RNA, 18 nt, Shigella flexneri 2a str. 301
gucaucauagacuucccu

SEQ ID NO: 3949817 - RNA, 23 nt, Shigella flexneri 2a str. 301
gucauccaaaucgcccagcaaau

SEQ ID NO: 3949818 - RNA, 14 nt, Shigella flexneri 2a str. 301
gucauccagcagcg

SEQ ID NO: 3949819 - RNA, 18 nt, Shigella flexneri 2a str. 301
gucauccaggaacuccag

SEQ ID NO: 3949820 - RNA, 12 nt, Shigella flexneri 2a str. 301
gucauccauacc

SEQ ID NO: 3949821 - RNA, 19 nt, Shigella flexneri 2a str. 301
gucaucccccaguggcagc

SEQ ID NO: 3949822 - RNA, 22 nt, Shigella flexneri 2a str. 301
gucaucccccaguggcagcaau

SEQ ID NO: 3949823 - RNA, 20 nt, Shigella flexneri 2a str. 301
gucauccggcacgcuaccau

SEQ ID NO: 3949824 - RNA, 22 nt, Shigella flexneri 2a str. 301
gucauccggcgucauauuacug

SEQ ID NO: 3949825 - RNA, 14 nt, Shigella flexneri 2a str. 301
gucaucgacaucaa

SEQ ID NO: 3949826 - RNA, 17 nt, Shigella flexneri 2a str. 301
gucaucgaugagaugac

SEQ ID NO: 3949827 - RNA, 21 nt, Shigella flexneri 2a str. 301
gucaucggaucauuagucaca

SEQ ID NO: 3949828 - RNA, 14 nt, Shigella flexneri 2a str. 301
gucaucugcacggu

SEQ ID NO: 3949829 - RNA, 14 nt, Shigella flexneri 2a str. 301
gucaugaaauauag

SEQ ID NO: 3949830 - RNA, 21 nt, Shigella flexneri 2a str. 301
gucaugaaauauagaccgcca

SEQ ID NO: 3949831 - RNA, 14 nt, Shigella flexneri 2a str. 301
gucaugaaccugcc

SEQ ID NO: 3949832 - RNA, 19 nt, Shigella flexneri 2a str. 301
gucaugacgacaaggcagg

SEQ ID NO: 3949833 - RNA, 15 nt, Shigella flexneri 2a str. 301
gucaugacuacacua

SEQ ID NO: 3949834 - RNA, 12 nt, Shigella flexneri 2a str. 301
gucaugcagcuc

SEQ ID NO: 3949835 - RNA, 14 nt, Shigella flexneri 2a str. 301
gucaugcagcucca

SEQ ID NO: 3949836 - RNA, 22 nt, Shigella flexneri 2a str. 301
gucauggcauuaauaugcucaa

SEQ ID NO: 3949837 - RNA, 15 nt, Shigella flexneri 2a str. 301
gucaugguaaugauc

SEQ ID NO: 3949838 - RNA, 21 nt, Shigella flexneri 2a str. 301
gucauguauauuauccaucaa

SEQ ID NO: 3949839 - RNA, 21 nt, Shigella flexneri 2a str. 301
gucauuaaagccgccaaacgg

SEQ ID NO: 3949840 - RNA, 13 nt, Shigella flexneri 2a str. 301
gucauuaccagcg

SEQ ID NO: 3949841 - RNA, 22 nt, Shigella flexneri 2a str. 301
gucauuaccugaaaaaacaaau

SEQ ID NO: 3949842 - RNA, 13 nt, Shigella flexneri 2a str. 301
gucauuaugucug

SEQ ID NO: 3949843 - RNA, 13 nt, Shigella flexneri 2a str. 301
gucauuccuucaa

SEQ ID NO: 3949844 - RNA, 20 nt, Shigella flexneri 2a str. 301
gucauucugcaaggcaaaau

SEQ ID NO: 3949845 - RNA, 15 nt, Shigella flexneri 2a str. 301
gucauugaccagauc

SEQ ID NO: 3949846 - RNA, 13 nt, Shigella flexneri 2a str. 301
gucauugacgcug

SEQ ID NO: 3949847 - RNA, 14 nt, Shigella flexneri 2a str. 301
gucauugacgcugg

SEQ ID NO: 3949848 - RNA, 14 nt, Shigella flexneri 2a str. 301
gucauuggcagcca

SEQ ID NO: 3949849 - RNA, 21 nt, Shigella flexneri 2a str. 301
gucauuggcagccagcaucug

SEQ ID NO: 3949850 - RNA, 18 nt, Shigella flexneri 2a str. 301
gucauuguccaguugccc

SEQ ID NO: 3949851 - RNA, 21 nt, Shigella flexneri 2a str. 301
gucauuucccaucucaauauu

SEQ ID NO: 3949852 - RNA, 15 nt, Shigella flexneri 2a str. 301
gucauuuuuucgaca

SEQ ID NO: 3949853 - RNA, 18 nt, Shigella flexneri 2a str. 301
guccaaaagguccuucag

SEQ ID NO: 3949854 - RNA, 20 nt, Shigella flexneri 2a str. 301
guccaaaagguccuucaggc

SEQ ID NO: 3949855 - RNA, 22 nt, Shigella flexneri 2a str. 301
guccaaaagguccuucaggccc

SEQ ID NO: 3949856 - RNA, 18 nt, Shigella flexneri 2a str. 301
guccaccaauagcccaug

SEQ ID NO: 3949857 - RNA, 15 nt, Shigella flexneri 2a str. 301
guccaccccagcaga

SEQ ID NO: 3949858 - RNA, 16 nt, Shigella flexneri 2a str. 301
guccaccgcgaugcug

SEQ ID NO: 3949859 - RNA, 18 nt, Shigella flexneri 2a str. 301
guccaccgcgaugcugcc

SEQ ID NO: 3949860 - RNA, 13 nt, Shigella flexneri 2a str. 301
guccacggugcga

SEQ ID NO: 3949861 - RNA, 13 nt, Shigella flexneri 2a str. 301
guccacgucauca

SEQ ID NO: 3949862 - RNA, 19 nt, Shigella flexneri 2a str. 301
guccagacgcgcagcuuca

SEQ ID NO: 3949863 - RNA, 14 nt, Shigella flexneri 2a str. 301
guccagacggagcu

SEQ ID NO: 3949864 - RNA, 18 nt, Shigella flexneri 2a str. 301
guccagacggagcugcca

SEQ ID NO: 3949865 - RNA, 11 nt, Shigella flexneri 2a str. 301
gucgcuuugac

SEQ ID NO: 3949866 - RNA, 18 nt, Shigella flexneri 2a str. 301
gucggaaacaugaaacgc

SEQ ID NO: 3949867 - RNA, 18 nt, Shigella flexneri 2a str. 301
gucggaaccacaacucaa

SEQ ID NO: 3949868 - RNA, 22 nt, Shigella flexneri 2a str. 301
gucggaucgcugaacgcaccuu

SEQ ID NO: 3949869 - RNA, 13 nt, Shigella flexneri 2a str. 301
gucggaugcgccg

SEQ ID NO: 3949870 - RNA, 16 nt, Shigella flexneri 2a str. 301
gucggaugcgcuucgc

SEQ ID NO: 3949871 - RNA, 15 nt, Shigella flexneri 2a str. 301
gucggcaaagcgggc

SEQ ID NO: 3949872 - RNA, 19 nt, Shigella flexneri 2a str. 301
gucggcacacacaucacgg

SEQ ID NO: 3949873 - RNA, 13 nt, Shigella flexneri 2a str. 301
gucggcaguucgu

SEQ ID NO: 3949874 - RNA, 18 nt, Shigella flexneri 2a str. 301
gucgggccgucuggcugc

SEQ ID NO: 3949875 - RNA, 15 nt, Shigella flexneri 2a str. 301
gucggggccagcgca

SEQ ID NO: 3949876 - RNA, 15 nt, Shigella flexneri 2a str. 301
gucgguaauuucaca

SEQ ID NO: 3949877 - RNA, 20 nt, Shigella flexneri 2a str. 301
gucgguaauuucacaaguug

SEQ ID NO: 3949878 - RNA, 14 nt, Shigella flexneri 2a str. 301
gucgguacagagca

SEQ ID NO: 3949879 - RNA, 17 nt, Shigella flexneri 2a str. 301
gucgguguccacuuccg

SEQ ID NO: 3949880 - RNA, 14 nt, Shigella flexneri 2a str. 301
gucgguuucgcgca

SEQ ID NO: 3949881 - RNA, 14 nt, Shigella flexneri 2a str. 301
gucguaaacaacug

SEQ ID NO: 3949882 - RNA, 14 nt, Shigella flexneri 2a str. 301
gucguagaaguuca

SEQ ID NO: 3949883 - RNA, 22 nt, Shigella flexneri 2a str. 301
gucguauuuauuuuccaaaaua

SEQ ID NO: 3949884 - RNA, 20 nt, Shigella flexneri 2a str. 301
gucguccggcagcagaaagc

SEQ ID NO: 3949885 - RNA, 22 nt, Shigella flexneri 2a str. 301
gucguccgguacgacaaucuca

SEQ ID NO: 3949886 - RNA, 21 nt, Shigella flexneri 2a str. 301
gucgucugucgggaacacuuu

SEQ ID NO: 3949887 - RNA, 14 nt, Shigella flexneri 2a str. 301
gucgugaaacgcgu

SEQ ID NO: 3949888 - RNA, 12 nt, Shigella flexneri 2a str. 301
gucgugaaugcc

SEQ ID NO: 3949889 - RNA, 21 nt, Shigella flexneri 2a str. 301
gucgugaaugccguaggccca

SEQ ID NO: 3949890 - RNA, 23 nt, Shigella flexneri 2a str. 301
gucgugauugucggugccggaac

SEQ ID NO: 3949891 - RNA, 21 nt, Shigella flexneri 2a str. 301
gucguggcaaucguagcccag

SEQ ID NO: 3949892 - RNA, 13 nt, Shigella flexneri 2a str. 301
gucguuauauaaa

SEQ ID NO: 3949893 - RNA, 16 nt, Shigella flexneri 2a str. 301
gucguuuucaguugcu

SEQ ID NO: 3949894 - RNA, 14 nt, Shigella flexneri 2a str. 301
gucuaaaucuuccg

SEQ ID NO: 3949895 - RNA, 19 nt, Shigella flexneri 2a str. 301
gucuaauggugaacugaca

SEQ ID NO: 3949896 - RNA, 17 nt, Shigella flexneri 2a str. 301
gucuaccagcaccugcu

SEQ ID NO: 3949897 - RNA, 22 nt, Shigella flexneri 2a str. 301
gucucaagggaggagucauccu

SEQ ID NO: 3949898 - RNA, 19 nt, Shigella flexneri 2a str. 301
gucucaauuaguaaugaua

SEQ ID NO: 3949899 - RNA, 15 nt, Shigella flexneri 2a str. 301
gucucagauucagau

SEQ ID NO: 3949900 - RNA, 16 nt, Shigella flexneri 2a str. 301
gucucaggugucuggc

SEQ ID NO: 3949901 - RNA, 17 nt, Shigella flexneri 2a str. 301
gucucaggugucuggca

SEQ ID NO: 3949902 - RNA, 23 nt, Shigella flexneri 2a str. 301
gucuccgcugagacgcgcuugca

SEQ ID NO: 3949903 - RNA, 15 nt, Shigella flexneri 2a str. 301
gucuccgguccaguc

SEQ ID NO: 3949904 - RNA, 20 nt, Shigella flexneri 2a str. 301
gucucggaagguuucuucaa

SEQ ID NO: 3949905 - RNA, 23 nt, Shigella flexneri 2a str. 301
gucucucagcacaccauaaaaca

SEQ ID NO: 3949906 - RNA, 18 nt, Shigella flexneri 2a str. 301
gucucuggcuucccggca

SEQ ID NO: 3949907 - RNA, 15 nt, Shigella flexneri 2a str. 301
gucucuucaugccuc

SEQ ID NO: 3949908 - RNA, 19 nt, Shigella flexneri 2a str. 301
gucucuugccgguuuugca

SEQ ID NO: 3949909 - RNA, 17 nt, Shigella flexneri 2a str. 301
gucucuuuucguuuugg

SEQ ID NO: 3949910 - RNA, 13 nt, Shigella flexneri 2a str. 301
gucugaauccauc

SEQ ID NO: 3949911 - RNA, 14 nt, Shigella flexneri 2a str. 301
gucugaauccaucu

SEQ ID NO: 3949912 - RNA, 20 nt, Shigella flexneri 2a str. 301
gucugaauccaucuguaucc

SEQ ID NO: 3949913 - RNA, 16 nt, Shigella flexneri 2a str. 301
gucugauaaaaaaccc

SEQ ID NO: 3949914 - RNA, 22 nt, Shigella flexneri 2a str. 301
gucugauuccgauauucaauug

SEQ ID NO: 3949915 - RNA, 16 nt, Shigella flexneri 2a str. 301
gucugcagauauucau

SEQ ID NO: 3949916 - RNA, 14 nt, Shigella flexneri 2a str. 301
gucugccccgccgc

SEQ ID NO: 3949917 - RNA, 18 nt, Shigella flexneri 2a str. 301
gucugccgggaagcucuc

SEQ ID NO: 3949918 - RNA, 17 nt, Shigella flexneri 2a str. 301
gucugccgguacuucac

SEQ ID NO: 3949919 - RNA, 17 nt, Shigella flexneri 2a str. 301
gucugccguugccacgu

SEQ ID NO: 3949920 - RNA, 16 nt, Shigella flexneri 2a str. 301
gucugcugaccaccug

SEQ ID NO: 3949921 - RNA, 22 nt, Shigella flexneri 2a str. 301
gucuggauuuggcugccgagca

SEQ ID NO: 3949922 - RNA, 21 nt, Shigella flexneri 2a str. 301
gucuggcagauccugaaauuc

SEQ ID NO: 3949923 - RNA, 16 nt, Shigella flexneri 2a str. 301
gucugguaucgcgcca

SEQ ID NO: 3949924 - RNA, 17 nt, Shigella flexneri 2a str. 301
gucugguguaucugcug

SEQ ID NO: 3949925 - RNA, 19 nt, Shigella flexneri 2a str. 301
gucugguguaucugcuguu

SEQ ID NO: 3949926 - RNA, 13 nt, Shigella flexneri 2a str. 301
gucuguaugacaa

SEQ ID NO: 3949927 - RNA, 19 nt, Shigella flexneri 2a str. 301
gucuguucgccccaaaaaa

SEQ ID NO: 3949928 - RNA, 20 nt, Shigella flexneri 2a str. 301
gucuuaaaccggacaauaaa

SEQ ID NO: 3949929 - RNA, 21 nt, Shigella flexneri 2a str. 301
gucuuaaaggggugaaaaaaa

SEQ ID NO: 3949930 - RNA, 16 nt, Shigella flexneri 2a str. 301
gucuuaucaugccuac

SEQ ID NO: 3949931 - RNA, 20 nt, Shigella flexneri 2a str. 301
gucuuauccggccuuccugu

SEQ ID NO: 3949932 - RNA, 15 nt, Shigella flexneri 2a str. 301
gucuuaucuggccua

SEQ ID NO: 3949933 - RNA, 20 nt, Shigella flexneri 2a str. 301
gucuucaucauccucuucag

SEQ ID NO: 3949934 - RNA, 14 nt, Shigella flexneri 2a str. 301
gucuucccagcccc

SEQ ID NO: 3949935 - RNA, 14 nt, Shigella flexneri 2a str. 301
gucuucccgcagcc

SEQ ID NO: 3949936 - RNA, 10 nt, Shigella flexneri 2a str. 301
gucuucccug

SEQ ID NO: 3949937 - RNA, 11 nt, Shigella flexneri 2a str. 301
gucuucccugc

SEQ ID NO: 3949938 - RNA, 10 nt, Shigella flexneri 2a str. 301
gucuuccugc

SEQ ID NO: 3949939 - RNA, 18 nt, Shigella flexneri 2a str. 301
gucuucucaccgccgccu

SEQ ID NO: 3949940 - RNA, 20 nt, Shigella flexneri 2a str. 301
gucuucugcagucaccugcg

SEQ ID NO: 3949941 - RNA, 21 nt, Shigella flexneri 2a str. 301
gucuucugguugcgaaaaaau

SEQ ID NO: 3949942 - RNA, 17 nt, Shigella flexneri 2a str. 301
gucuucugguuuuucug

SEQ ID NO: 3949943 - RNA, 19 nt, Shigella flexneri 2a str. 301
gucuucugugauuccgcca

SEQ ID NO: 3949944 - RNA, 21 nt, Shigella flexneri 2a str. 301
gucuugaauaaauuggcuggg

SEQ ID NO: 3949945 - RNA, 16 nt, Shigella flexneri 2a str. 301
gucuuuacuaaacggu

SEQ ID NO: 3949946 - RNA, 22 nt, Shigella flexneri 2a str. 301
gucuuuauugaguaccagcgca

SEQ ID NO: 3949947 - RNA, 22 nt, Shigella flexneri 2a str. 301
gucuuucuuaccccugauuuug

SEQ ID NO: 3949948 - RNA, 22 nt, Shigella flexneri 2a str. 301
gucuuuuucucccuuaaaaaau

SEQ ID NO: 3949949 - RNA, 16 nt, Shigella flexneri 2a str. 301
gucuuuuuucaacuuu

SEQ ID NO: 3949950 - RNA, 14 nt, Shigella flexneri 2a str. 301
gucuuuuuucacug

SEQ ID NO: 3949951 - RNA, 24 nt, Shigella flexneri 2a str. 301
gucuuuuuucacuggcaaugacgg

SEQ ID NO: 3949952 - RNA, 13 nt, Shigella flexneri 2a str. 301
gugaaaaauaaaa

SEQ ID NO: 3949953 - RNA, 18 nt, Shigella flexneri 2a str. 301
gugaaaaauggcgcccau

SEQ ID NO: 3949954 - RNA, 14 nt, Shigella flexneri 2a str. 301
gugaaaauguggua

SEQ ID NO: 3949955 - RNA, 18 nt, Shigella flexneri 2a str. 301
gugaaaauucuccggcgu

SEQ ID NO: 3949956 - RNA, 21 nt, Shigella flexneri 2a str. 301
gugaaagagccgucauucugc

SEQ ID NO: 3949957 - RNA, 17 nt, Shigella flexneri 2a str. 301
gugaaaucugaaaucau

SEQ ID NO: 3949958 - RNA, 22 nt, Shigella flexneri 2a str. 301
gugaacccugaaggacgccaga

SEQ ID NO: 3949959 - RNA, 20 nt, Shigella flexneri 2a str. 301
gugaacgagaaaaugacgau

SEQ ID NO: 3949960 - RNA, 22 nt, Shigella flexneri 2a str. 301
gugaacgagaaaaugacgauga

SEQ ID NO: 3949961 - RNA, 14 nt, Shigella flexneri 2a str. 301
gugaacgccuuauc

SEQ ID NO: 3949962 - RNA, 20 nt, Shigella flexneri 2a str. 301
gugaacgccuuauccgaccu

SEQ ID NO: 3949963 - RNA, 20 nt, Shigella flexneri 2a str. 301
gugaacgccuuauccgcccu

SEQ ID NO: 3949964 - RNA, 20 nt, Shigella flexneri 2a str. 301
gugaacgccuuauccggucu

SEQ ID NO: 3949965 - RNA, 11 nt, Shigella flexneri 2a str. 301
gugcagcaucg

SEQ ID NO: 3949966 - RNA, 16 nt, Shigella flexneri 2a str. 301
gugcagcaugcacccu

SEQ ID NO: 3949967 - RNA, 17 nt, Shigella flexneri 2a str. 301
gugcagcaugcacccuc

SEQ ID NO: 3949968 - RNA, 14 nt, Shigella flexneri 2a str. 301
gugcagccaaaaau

SEQ ID NO: 3949969 - RNA, 23 nt, Shigella flexneri 2a str. 301
gugcagccggagcuucacccgca

SEQ ID NO: 3949970 - RNA, 21 nt, Shigella flexneri 2a str. 301
gugcaggcaccagccccugga

SEQ ID NO: 3949971 - RNA, 14 nt, Shigella flexneri 2a str. 301
gugcaguacaucgu

SEQ ID NO: 3949972 - RNA, 18 nt, Shigella flexneri 2a str. 301
gugcaguggcuccagcgc

SEQ ID NO: 3949973 - RNA, 16 nt, Shigella flexneri 2a str. 301
gugcaguuccugcaac

SEQ ID NO: 3949974 - RNA, 15 nt, Shigella flexneri 2a str. 301
gugcaucaacauaua

SEQ ID NO: 3949975 - RNA, 14 nt, Shigella flexneri 2a str. 301
gugcauccagcagc

SEQ ID NO: 3949976 - RNA, 22 nt, Shigella flexneri 2a str. 301
gugcaucggugcgcugugugug

SEQ ID NO: 3949977 - RNA, 19 nt, Shigella flexneri 2a str. 301
gugcaucuccugacacaac

SEQ ID NO: 3949978 - RNA, 14 nt, Shigella flexneri 2a str. 301
gugcauugaguccc

SEQ ID NO: 3949979 - RNA, 21 nt, Shigella flexneri 2a str. 301
gugcauuucucacuuuucacc

SEQ ID NO: 3949980 - RNA, 18 nt, Shigella flexneri 2a str. 301
gugcauuuucgucaacca

SEQ ID NO: 3949981 - RNA, 19 nt, Shigella flexneri 2a str. 301
gugccacaggcggucgaac

SEQ ID NO: 3949982 - RNA, 19 nt, Shigella flexneri 2a str. 301
gugccaccagugcaggcac

SEQ ID NO: 3949983 - RNA, 23 nt, Shigella flexneri 2a str. 301
gugccagcgauuuugccagccgc

SEQ ID NO: 3949984 - RNA, 12 nt, Shigella flexneri 2a str. 301
gugccaggacca

SEQ ID NO: 3949985 - RNA, 17 nt, Shigella flexneri 2a str. 301
gugccaucauacagccg

SEQ ID NO: 3949986 - RNA, 16 nt, Shigella flexneri 2a str. 301
gugccaucgauaauca

SEQ ID NO: 3949987 - RNA, 19 nt, Shigella flexneri 2a str. 301
gugccaugccaaucagcag

SEQ ID NO: 3949988 - RNA, 23 nt, Shigella flexneri 2a str. 301
gugccauuaaugucggaugcggc

SEQ ID NO: 3949989 - RNA, 12 nt, Shigella flexneri 2a str. 301
gugccauugacc

SEQ ID NO: 3949990 - RNA, 18 nt, Shigella flexneri 2a str. 301
gugccauugaccagcugc

SEQ ID NO: 3949991 - RNA, 22 nt, Shigella flexneri 2a str. 301
gugcccaacugccugaugcgau

SEQ ID NO: 3949992 - RNA, 21 nt, Shigella flexneri 2a str. 301
gugcccguaaaaaauggcugg

SEQ ID NO: 3949993 - RNA, 16 nt, Shigella flexneri 2a str. 301
gugcccguuggcagac

SEQ ID NO: 3949994 - RNA, 20 nt, Shigella flexneri 2a str. 301
gugccgacaucgccacggca

SEQ ID NO: 3949995 - RNA, 19 nt, Shigella flexneri 2a str. 301
gugccgagaguaacacauu

SEQ ID NO: 3949996 - RNA, 13 nt, Shigella flexneri 2a str. 301
gugccgcagcuuc

SEQ ID NO: 3949997 - RNA, 15 nt, Shigella flexneri 2a str. 301
gugccgcauugacgc

SEQ ID NO: 3949998 - RNA, 14 nt, Shigella flexneri 2a str. 301
gugccgcgacagau

SEQ ID NO: 3949999 - RNA, 18 nt, Shigella flexneri 2a str. 301
gugccggaaggaagacgc

SEQ ID NO: 3950000 - RNA, 15 nt, Shigella flexneri 2a str. 301
gugccggaaggggcg

SEQ ID NO: 3950001 - RNA, 13 nt, Shigella flexneri 2a str. 301
gugccgucagcag

SEQ ID NO: 3950002 - RNA, 19 nt, Shigella flexneri 2a str. 301
gugccgucugccccgccgc

SEQ ID NO: 3950003 - RNA, 14 nt, Shigella flexneri 2a str. 301
gugccguuauucag

SEQ ID NO: 3950004 - RNA, 13 nt, Shigella flexneri 2a str. 301
gugccucaagaau

SEQ ID NO: 3950005 - RNA, 22 nt, Shigella flexneri 2a str. 301
gugccugagccggaguugcaga

SEQ ID NO: 3950006 - RNA, 14 nt, Shigella flexneri 2a str. 301
gugccugucgggac

SEQ ID NO: 3950007 - RNA, 22 nt, Shigella flexneri 2a str. 301
gugccuuagccacaaagcaggg

SEQ ID NO: 3950008 - RNA, 22 nt, Shigella flexneri 2a str. 301
gugccuuuaauaccaucggcag

SEQ ID NO: 3950009 - RNA, 19 nt, Shigella flexneri 2a str. 301
gugccuuuuuuauuuaugc

SEQ ID NO: 3950010 - RNA, 20 nt, Shigella flexneri 2a str. 301
gugcgaaugcgauggcaaaa

SEQ ID NO: 3950011 - RNA, 16 nt, Shigella flexneri 2a str. 301
gugcgaauugccacca

SEQ ID NO: 3950012 - RNA, 13 nt, Shigella flexneri 2a str. 301
gugcgauccacgc

SEQ ID NO: 3950013 - RNA, 14 nt, Shigella flexneri 2a str. 301
gugcgccacagaca

SEQ ID NO: 3950014 - RNA, 16 nt, Shigella flexneri 2a str. 301
gugcgcgagcuggugc

SEQ ID NO: 3950015 - RNA, 21 nt, Shigella flexneri 2a str. 301
gugcgcgauagauagcguucu

SEQ ID NO: 3950016 - RNA, 23 nt, Shigella flexneri 2a str. 301
gugcgcgauagauagcguucuuu

SEQ ID NO: 3950017 - RNA, 13 nt, Shigella flexneri 2a str. 301
gugcgcgccagga

SEQ ID NO: 3950018 - RNA, 14 nt, Shigella flexneri 2a str. 301
gugcgcggcagcca

SEQ ID NO: 3950019 - RNA, 23 nt, Shigella flexneri 2a str. 301
gugcggcgguaucgucgggcugg

SEQ ID NO: 3950020 - RNA, 14 nt, Shigella flexneri 2a str. 301
gugcgguaagcugc

SEQ ID NO: 3950021 - RNA, 17 nt, Shigella flexneri 2a str. 301
gugcgguaagcugcggu

SEQ ID NO: 3950022 - RNA, 15 nt, Shigella flexneri 2a str. 301
gugcggucaggcauc

SEQ ID NO: 3950023 - RNA, 19 nt, Shigella flexneri 2a str. 301
gugcgguuucagcucacgg

SEQ ID NO: 3950024 - RNA, 17 nt, Shigella flexneri 2a str. 301
gugcuacgguugacuga

SEQ ID NO: 3950025 - RNA, 16 nt, Shigella flexneri 2a str. 301
gugcucaaugagcacc

SEQ ID NO: 3950026 - RNA, 17 nt, Shigella flexneri 2a str. 301
gugcucaaugagcaccu

SEQ ID NO: 3950027 - RNA, 22 nt, Shigella flexneri 2a str. 301
gugcucaaugagcaccuuuuuu

SEQ ID NO: 3950028 - RNA, 20 nt, Shigella flexneri 2a str. 301
gugcucaccacgcagcagcc

SEQ ID NO: 3950029 - RNA, 13 nt, Shigella flexneri 2a str. 301
gugcucacuacgg

SEQ ID NO: 3950030 - RNA, 18 nt, Shigella flexneri 2a str. 301
gugcucaucagcccggca

SEQ ID NO: 3950031 - RNA, 13 nt, Shigella flexneri 2a str. 301
gugcuccaggagc

SEQ ID NO: 3950032 - RNA, 13 nt, Shigella flexneri 2a str. 301
gugcuccauuguu

SEQ ID NO: 3950033 - RNA, 21 nt, Shigella flexneri 2a str. 301
gugcugaaccguaggccguau

SEQ ID NO: 3950034 - RNA, 20 nt, Shigella flexneri 2a str. 301
gugcugcgucaguugggauu

SEQ ID NO: 3950035 - RNA, 21 nt, Shigella flexneri 2a str. 301
gugcugggaaaccuggauauu

SEQ ID NO: 3950036 - RNA, 11 nt, Shigella flexneri 2a str. 301
gugcuggucac

SEQ ID NO: 3950037 - RNA, 14 nt, Shigella flexneri 2a str. 301
gugcugugacagau

SEQ ID NO: 3950038 - RNA, 21 nt, Shigella flexneri 2a str. 301
gugcuuaucgcgaugauuuuc

SEQ ID NO: 3950039 - RNA, 13 nt, Shigella flexneri 2a str. 301
gugcuucacucaa

SEQ ID NO: 3950040 - RNA, 21 nt, Shigella flexneri 2a str. 301
gugcuucugccacuucuucga

SEQ ID NO: 3950041 - RNA, 18 nt, Shigella flexneri 2a str. 301
gugcuuucauuucagcgu

SEQ ID NO: 3950042 - RNA, 16 nt, Shigella flexneri 2a str. 301
guggaaaagaaaacag

SEQ ID NO: 3950043 - RNA, 15 nt, Shigella flexneri 2a str. 301
guggaaacagugauu

SEQ ID NO: 3950044 - RNA, 19 nt, Shigella flexneri 2a str. 301
guggaacaaauagacacaa

SEQ ID NO: 3950045 - RNA, 20 nt, Shigella flexneri 2a str. 301
guggaagcaccuuuacgcca

SEQ ID NO: 3950046 - RNA, 17 nt, Shigella flexneri 2a str. 301
guggaauaugcgccaca

SEQ ID NO: 3950047 - RNA, 24 nt, Shigella flexneri 2a str. 301
guggacauagcucugccacugguu

SEQ ID NO: 3950048 - RNA, 16 nt, Shigella flexneri 2a str. 301
guggacugauuuagcu

SEQ ID NO: 3950049 - RNA, 19 nt, Shigella flexneri 2a str. 301
guggagcaacacgccagcg

SEQ ID NO: 3950050 - RNA, 20 nt, Shigella flexneri 2a str. 301
guggagcaacacgccagcgu

SEQ ID NO: 3950051 - RNA, 16 nt, Shigella flexneri 2a str. 301
guggauagacgcaggu

SEQ ID NO: 3950052 - RNA, 16 nt, Shigella flexneri 2a str. 301
guggaucgauuucaau

SEQ ID NO: 3950053 - RNA, 23 nt, Shigella flexneri 2a str. 301
guggcaaagguggccauccgcgu

SEQ ID NO: 3950054 - RNA, 16 nt, Shigella flexneri 2a str. 301
guggcaaucguagccc

SEQ ID NO: 3950055 - RNA, 19 nt, Shigella flexneri 2a str. 301
guggcaaucguagcccagc

SEQ ID NO: 3950056 - RNA, 21 nt, Shigella flexneri 2a str. 301
guggcaauggcgacuucugcu

SEQ ID NO: 3950057 - RNA, 14 nt, Shigella flexneri 2a str. 301
guggcagccagcca

SEQ ID NO: 3950058 - RNA, 21 nt, Shigella flexneri 2a str. 301
guggcagcguuaugucccgcu

SEQ ID NO: 3950059 - RNA, 15 nt, Shigella flexneri 2a str. 301
guggcagggcagcga

SEQ ID NO: 3950060 - RNA, 16 nt, Shigella flexneri 2a str. 301
guggcagggcagcgau

SEQ ID NO: 3950061 - RNA, 15 nt, Shigella flexneri 2a str. 301
guggcagucuggccu

SEQ ID NO: 3950062 - RNA, 16 nt, Shigella flexneri 2a str. 301
guggcccagccuuucc

SEQ ID NO: 3950063 - RNA, 21 nt, Shigella flexneri 2a str. 301
guggcgacauugaccagccaa

SEQ ID NO: 3950064 - RNA, 19 nt, Shigella flexneri 2a str. 301
guggcgauaaucagcgcca

SEQ ID NO: 3950065 - RNA, 13 nt, Shigella flexneri 2a str. 301
guuaagcaauacc

SEQ ID NO: 3950066 - RNA, 14 nt, Shigella flexneri 2a str. 301
guuaaguuuauccc

SEQ ID NO: 3950067 - RNA, 16 nt, Shigella flexneri 2a str. 301
guuaauaaugauuuug

SEQ ID NO: 3950068 - RNA, 19 nt, Shigella flexneri 2a str. 301
guuaauccacagcaaugca

SEQ ID NO: 3950069 - RNA, 19 nt, Shigella flexneri 2a str. 301
guuaauccgcaaauaacgu

SEQ ID NO: 3950070 - RNA, 15 nt, Shigella flexneri 2a str. 301
guuaaucgccguaua

SEQ ID NO: 3950071 - RNA, 20 nt, Shigella flexneri 2a str. 301
guuaaucuuuucugagucaa

SEQ ID NO: 3950072 - RNA, 14 nt, Shigella flexneri 2a str. 301
guuaaugcgccaag

SEQ ID NO: 3950073 - RNA, 20 nt, Shigella flexneri 2a str. 301
guuaauggcuuuacgcgcca

SEQ ID NO: 3950074 - RNA, 20 nt, Shigella flexneri 2a str. 301
guuaauuuuucaaacucuuc

SEQ ID NO: 3950075 - RNA, 21 nt, Shigella flexneri 2a str. 301
guuacaacauccuauauuccu

SEQ ID NO: 3950076 - RNA, 15 nt, Shigella flexneri 2a str. 301
guuacacaucauuag

SEQ ID NO: 3950077 - RNA, 12 nt, Shigella flexneri 2a str. 301
guuaccagcggc

SEQ ID NO: 3950078 - RNA, 17 nt, Shigella flexneri 2a str. 301
guuaccagcggccggau

SEQ ID NO: 3950079 - RNA, 20 nt, Shigella flexneri 2a str. 301
guuaccccucuauccagcuc

SEQ ID NO: 3950080 - RNA, 21 nt, Shigella flexneri 2a str. 301
guuaccgacugcggccugagu

SEQ ID NO: 3950081 - RNA, 15 nt, Shigella flexneri 2a str. 301
guuaccgaucgccag

SEQ ID NO: 3950082 - RNA, 16 nt, Shigella flexneri 2a str. 301
guuaccgaucgccagc

SEQ ID NO: 3950083 - RNA, 14 nt, Shigella flexneri 2a str. 301
guuaccgauuucac

SEQ ID NO: 3950084 - RNA, 15 nt, Shigella flexneri 2a str. 301
guuaccgcuauuugc

SEQ ID NO: 3950085 - RNA, 21 nt, Shigella flexneri 2a str. 301
guuacgcaaaaccucuuccag

SEQ ID NO: 3950086 - RNA, 20 nt, Shigella flexneri 2a str. 301
guuacgcagauauucguuca

SEQ ID NO: 3950087 - RNA, 22 nt, Shigella flexneri 2a str. 301
guuacgccggugauuaaaccaa

SEQ ID NO: 3950088 - RNA, 17 nt, Shigella flexneri 2a str. 301
guuacgcgcauaaugca

SEQ ID NO: 3950089 - RNA, 15 nt, Shigella flexneri 2a str. 301
guuacggaucucccg

SEQ ID NO: 3950090 - RNA, 15 nt, Shigella flexneri 2a str. 301
guuacguucuccuga

SEQ ID NO: 3950091 - RNA, 19 nt, Shigella flexneri 2a str. 301
guuacguuucucugcuaau

SEQ ID NO: 3950092 - RNA, 21 nt, Shigella flexneri 2a str. 301
guuacuuaucgauaaacggca

SEQ ID NO: 3950093 - RNA, 14 nt, Shigella flexneri 2a str. 301
guuagaaaacgccu

SEQ ID NO: 3950094 - RNA, 21 nt, Shigella flexneri 2a str. 301
guuagaauaccugccugucac

SEQ ID NO: 3950095 - RNA, 23 nt, Shigella flexneri 2a str. 301
guuagagccagggaucgggucac

SEQ ID NO: 3950096 - RNA, 19 nt, Shigella flexneri 2a str. 301
guuagcugcguacauugcc

SEQ ID NO: 3950097 - RNA, 14 nt, Shigella flexneri 2a str. 301
guuaggcacaucaa

SEQ ID NO: 3950098 - RNA, 15 nt, Shigella flexneri 2a str. 301
guuagucaucaucag

SEQ ID NO: 3950099 - RNA, 23 nt, Shigella flexneri 2a str. 301
guuagucaucaucaggaacaucc

SEQ ID NO: 3950100 - RNA, 15 nt, Shigella flexneri 2a str. 301
guuagucaugaaaua

SEQ ID NO: 3950101 - RNA, 14 nt, Shigella flexneri 2a str. 301
guuaguccacacgc

SEQ ID NO: 3950102 - RNA, 17 nt, Shigella flexneri 2a str. 301
guuagugucuuaucugg

SEQ ID NO: 3950103 - RNA, 19 nt, Shigella flexneri 2a str. 301
guuagugucuuaucuggca

SEQ ID NO: 3950104 - RNA, 16 nt, Shigella flexneri 2a str. 301
guuauaucaauuauua

SEQ ID NO: 3950105 - RNA, 20 nt, Shigella flexneri 2a str. 301
guuauaucccauuuuugaau

SEQ ID NO: 3950106 - RNA, 13 nt, Shigella flexneri 2a str. 301
guuaucaaauuca

SEQ ID NO: 3950107 - RNA, 18 nt, Shigella flexneri 2a str. 301
guuauccgccagcgccau

SEQ ID NO: 3950108 - RNA, 23 nt, Shigella flexneri 2a str. 301
guuauccugaccaccauauaagc

SEQ ID NO: 3950109 - RNA, 19 nt, Shigella flexneri 2a str. 301
guuauccugauaaaaacca

SEQ ID NO: 3950110 - RNA, 23 nt, Shigella flexneri 2a str. 301
guuauccugaucaagcacaugcu

SEQ ID NO: 3950111 - RNA, 23 nt, Shigella flexneri 2a str. 301
guuaucgcucgucgcgacgacca

SEQ ID NO: 3950112 - RNA, 14 nt, Shigella flexneri 2a str. 301
guuaucucauucaa

SEQ ID NO: 3950113 - RNA, 22 nt, Shigella flexneri 2a str. 301
guuaugcaccgacaauccggua

SEQ ID NO: 3950114 - RNA, 16 nt, Shigella flexneri 2a str. 301
guuauggcgugagcug

SEQ ID NO: 3950115 - RNA, 20 nt, Shigella flexneri 2a str. 301
guuauuaaauaaccagcgca

SEQ ID NO: 3950116 - RNA, 19 nt, Shigella flexneri 2a str. 301
guuauuacgcccgccagaa

SEQ ID NO: 3950117 - RNA, 14 nt, Shigella flexneri 2a str. 301
guuauucccaacgc

SEQ ID NO: 3950118 - RNA, 15 nt, Shigella flexneri 2a str. 301
guuauucgcuuccuc

SEQ ID NO: 3950119 - RNA, 22 nt, Shigella flexneri 2a str. 301
guuauugguauggucgugauca

SEQ ID NO: 3950120 - RNA, 22 nt, Shigella flexneri 2a str. 301
guuauugucgggcguuucgcca

SEQ ID NO: 3950121 - RNA, 12 nt, Shigella flexneri 2a str. 301
guucaaaaaaau

SEQ ID NO: 3950122 - RNA, 16 nt, Shigella flexneri 2a str. 301
guucaaaguuaccgga

SEQ ID NO: 3950123 - RNA, 15 nt, Shigella flexneri 2a str. 301
guucaaccaccggca

SEQ ID NO: 3950124 - RNA, 13 nt, Shigella flexneri 2a str. 301
guucaagaugucu

SEQ ID NO: 3950125 - RNA, 16 nt, Shigella flexneri 2a str. 301
guucaauaucuuccug

SEQ ID NO: 3950126 - RNA, 16 nt, Shigella flexneri 2a str. 301
guucaaugauaguuca

SEQ ID NO: 3950127 - RNA, 13 nt, Shigella flexneri 2a str. 301
guucaauuuccag

SEQ ID NO: 3950128 - RNA, 16 nt, Shigella flexneri 2a str. 301
guucaccacgacuucu

SEQ ID NO: 3950129 - RNA, 14 nt, Shigella flexneri 2a str. 301
guucacgcagcuuc

SEQ ID NO: 3950130 - RNA, 18 nt, Shigella flexneri 2a str. 301
guucacgcagcuucucgu

SEQ ID NO: 3950131 - RNA, 18 nt, Shigella flexneri 2a str. 301
guucacgccaucaucggc

SEQ ID NO: 3950132 - RNA, 22 nt, Shigella flexneri 2a str. 301
guucacggcgauaccaguaaua

SEQ ID NO: 3950133 - RNA, 18 nt, Shigella flexneri 2a str. 301
guucacucaucaacguuu

SEQ ID NO: 3950134 - RNA, 13 nt, Shigella flexneri 2a str. 301
guucacugccgua

SEQ ID NO: 3950135 - RNA, 22 nt, Shigella flexneri 2a str. 301
guucacugccguacaggcagcu

SEQ ID NO: 3950136 - RNA, 14 nt, Shigella flexneri 2a str. 301
guucacugugcugg

SEQ ID NO: 3950137 - RNA, 15 nt, Shigella flexneri 2a str. 301
guucacugugcuggu

SEQ ID NO: 3950138 - RNA, 14 nt, Shigella flexneri 2a str. 301
guucagaaagcgcc

SEQ ID NO: 3950139 - RNA, 19 nt, Shigella flexneri 2a str. 301
guucagauggccaauaacc

SEQ ID NO: 3950140 - RNA, 15 nt, Shigella flexneri 2a str. 301
guucagcaguucugc

SEQ ID NO: 3950141 - RNA, 21 nt, Shigella flexneri 2a str. 301
guucagccugacagcacgccc

SEQ ID NO: 3950142 - RNA, 18 nt, Shigella flexneri 2a str. 301
guucagcgggcagggcau

SEQ ID NO: 3950143 - RNA, 23 nt, Shigella flexneri 2a str. 301
guucagcguacguucauggcgcg

SEQ ID NO: 3950144 - RNA, 20 nt, Shigella flexneri 2a str. 301
guucagcgucggcgucaucg

SEQ ID NO: 3950145 - RNA, 16 nt, Shigella flexneri 2a str. 301
guucaggcgaaucuua

SEQ ID NO: 3950146 - RNA, 14 nt, Shigella flexneri 2a str. 301
guucaggcgcugca

SEQ ID NO: 3950147 - RNA, 14 nt, Shigella flexneri 2a str. 301
guucagugaucgcc

SEQ ID NO: 3950148 - RNA, 15 nt, Shigella flexneri 2a str. 301
guucaguucagaaag

SEQ ID NO: 3950149 - RNA, 11 nt, Shigella flexneri 2a str. 301
guucaguuccg

SEQ ID NO: 3950150 - RNA, 18 nt, Shigella flexneri 2a str. 301
guucauauggagcaaaag

SEQ ID NO: 3950151 - RNA, 17 nt, Shigella flexneri 2a str. 301
guucaucacaccagucc

SEQ ID NO: 3950152 - RNA, 22 nt, Shigella flexneri 2a str. 301
guucaucacaccaguccagcgc

SEQ ID NO: 3950153 - RNA, 23 nt, Shigella flexneri 2a str. 301
guucaucacaccaguccagcgcc

SEQ ID NO: 3950154 - RNA, 18 nt, Shigella flexneri 2a str. 301
guucauccccucuuccau

SEQ ID NO: 3950155 - RNA, 14 nt, Shigella flexneri 2a str. 301
guucaucucaaaca

SEQ ID NO: 3950156 - RNA, 17 nt, Shigella flexneri 2a str. 301
guucauuggguucaucu

SEQ ID NO: 3950157 - RNA, 19 nt, Shigella flexneri 2a str. 301
guuccaccacguuuuucaa

SEQ ID NO: 3950158 - RNA, 12 nt, Shigella flexneri 2a str. 301
guuccacccagc

SEQ ID NO: 3950159 - RNA, 22 nt, Shigella flexneri 2a str. 301
guuccaccgcguuuuccaguuc

SEQ ID NO: 3950160 - RNA, 15 nt, Shigella flexneri 2a str. 301
guuccacucuuucag

SEQ ID NO: 3950161 - RNA, 18 nt, Shigella flexneri 2a str. 301
guuccagaccauauuuuc

SEQ ID NO: 3950162 - RNA, 14 nt, Shigella flexneri 2a str. 301
guuccagcaucucc

SEQ ID NO: 3950163 - RNA, 16 nt, Shigella flexneri 2a str. 301
guuccagccaguguua

SEQ ID NO: 3950164 - RNA, 21 nt, Shigella flexneri 2a str. 301
guuccagccaguguuaaccag

SEQ ID NO: 3950165 - RNA, 19 nt, Shigella flexneri 2a str. 301
guugcaccgaguucuucac

SEQ ID NO: 3950166 - RNA, 19 nt, Shigella flexneri 2a str. 301
guugcacgcagacacugcu

SEQ ID NO: 3950167 - RNA, 16 nt, Shigella flexneri 2a str. 301
guugcacgccaggcac

SEQ ID NO: 3950168 - RNA, 15 nt, Shigella flexneri 2a str. 301
guugcagacccgcca

SEQ ID NO: 3950169 - RNA, 21 nt, Shigella flexneri 2a str. 301
guugcagauuugccaguaccg

SEQ ID NO: 3950170 - RNA, 16 nt, Shigella flexneri 2a str. 301
guugcaguucugccau

SEQ ID NO: 3950171 - RNA, 22 nt, Shigella flexneri 2a str. 301
guugcauaauuucagcaagaca

SEQ ID NO: 3950172 - RNA, 18 nt, Shigella flexneri 2a str. 301
guugcauaauuucuucgu

SEQ ID NO: 3950173 - RNA, 17 nt, Shigella flexneri 2a str. 301
guugcauccggcauggc

SEQ ID NO: 3950174 - RNA, 21 nt, Shigella flexneri 2a str. 301
guugcaugauuucgucauccg

SEQ ID NO: 3950175 - RNA, 13 nt, Shigella flexneri 2a str. 301
guugcauuccagu

SEQ ID NO: 3950176 - RNA, 15 nt, Shigella flexneri 2a str. 301
guugccauacagaca

SEQ ID NO: 3950177 - RNA, 17 nt, Shigella flexneri 2a str. 301
guugccauacagacacc

SEQ ID NO: 3950178 - RNA, 21 nt, Shigella flexneri 2a str. 301
guugccauuucugcugccacu

SEQ ID NO: 3950179 - RNA, 17 nt, Shigella flexneri 2a str. 301
guugccccucuaacucu

SEQ ID NO: 3950180 - RNA, 11 nt, Shigella flexneri 2a str. 301
guugccgcagc

SEQ ID NO: 3950181 - RNA, 18 nt, Shigella flexneri 2a str. 301
guugccgcucuuuuguuc

SEQ ID NO: 3950182 - RNA, 21 nt, Shigella flexneri 2a str. 301
guugccugaugcgacgcuggc

SEQ ID NO: 3950183 - RNA, 14 nt, Shigella flexneri 2a str. 301
guugccugcacuca

SEQ ID NO: 3950184 - RNA, 12 nt, Shigella flexneri 2a str. 301
guugccugcugu

SEQ ID NO: 3950185 - RNA, 21 nt, Shigella flexneri 2a str. 301
guugccuuuuuuguacuccag

SEQ ID NO: 3950186 - RNA, 23 nt, Shigella flexneri 2a str. 301
guugcgaaaaaaucauccauccg

SEQ ID NO: 3950187 - RNA, 16 nt, Shigella flexneri 2a str. 301
guugcgaucgaccugc

SEQ ID NO: 3950188 - RNA, 21 nt, Shigella flexneri 2a str. 301
guugcgcagaguuuccaggcu

SEQ ID NO: 3950189 - RNA, 15 nt, Shigella flexneri 2a str. 301
guugcgccugauaau

SEQ ID NO: 3950190 - RNA, 22 nt, Shigella flexneri 2a str. 301
guugcgccugauaaucugcuga

SEQ ID NO: 3950191 - RNA, 20 nt, Shigella flexneri 2a str. 301
guugcgcuucccgaaucaug

SEQ ID NO: 3950192 - RNA, 16 nt, Shigella flexneri 2a str. 301
guugcgucgccgccug

SEQ ID NO: 3950193 - RNA, 21 nt, Shigella flexneri 2a str. 301
guugcgucucgacaaacuccg

SEQ ID NO: 3950194 - RNA, 16 nt, Shigella flexneri 2a str. 301
guugcguugaaacguu

SEQ ID NO: 3950195 - RNA, 15 nt, Shigella flexneri 2a str. 301
guugcugaaauucca

SEQ ID NO: 3950196 - RNA, 15 nt, Shigella flexneri 2a str. 301
guugcugaagugcgu

SEQ ID NO: 3950197 - RNA, 13 nt, Shigella flexneri 2a str. 301
guugcugacugua

SEQ ID NO: 3950198 - RNA, 14 nt, Shigella flexneri 2a str. 301
guugcuucaucuca

SEQ ID NO: 3950199 - RNA, 22 nt, Shigella flexneri 2a str. 301
guugcuugaggaucaacugaaa

SEQ ID NO: 3950200 - RNA, 23 nt, Shigella flexneri 2a str. 301
guuggauaaggcgguuacgccgc

SEQ ID NO: 3950201 - RNA, 22 nt, Shigella flexneri 2a str. 301
guuggcaagauaggcaucccgc

SEQ ID NO: 3950202 - RNA, 13 nt, Shigella flexneri 2a str. 301
guuggcaggccaa

SEQ ID NO: 3950203 - RNA, 20 nt, Shigella flexneri 2a str. 301
guuggcgcguguuccagaga

SEQ ID NO: 3950204 - RNA, 19 nt, Shigella flexneri 2a str. 301
guuggcggugccaucgaua

SEQ ID NO: 3950205 - RNA, 15 nt, Shigella flexneri 2a str. 301
guuggcucaucaagc

SEQ ID NO: 3950206 - RNA, 14 nt, Shigella flexneri 2a str. 301
guuggguuagccaa

SEQ ID NO: 3950207 - RNA, 14 nt, Shigella flexneri 2a str. 301
guuggugcgaucug

SEQ ID NO: 3950208 - RNA, 12 nt, Shigella flexneri 2a str. 301
guugguuaaucu

SEQ ID NO: 3950209 - RNA, 13 nt, Shigella flexneri 2a str. 301
guugguuauucaa

SEQ ID NO: 3950210 - RNA, 15 nt, Shigella flexneri 2a str. 301
guuguaaucaccacu

SEQ ID NO: 3950211 - RNA, 14 nt, Shigella flexneri 2a str. 301
guuguaaugacaac

SEQ ID NO: 3950212 - RNA, 22 nt, Shigella flexneri 2a str. 301
guuguaaugauuuaauggaugu

SEQ ID NO: 3950213 - RNA, 21 nt, Shigella flexneri 2a str. 301
guuguacagcgaaacauacag

SEQ ID NO: 3950214 - RNA, 22 nt, Shigella flexneri 2a str. 301
guuguagaccggaaaagguguu

SEQ ID NO: 3950215 - RNA, 20 nt, Shigella flexneri 2a str. 301
guugucaauacuuucacaaa

SEQ ID NO: 3950216 - RNA, 15 nt, Shigella flexneri 2a str. 301
guugucagcaacugu

SEQ ID NO: 3950217 - RNA, 23 nt, Shigella flexneri 2a str. 301
guugucaggaagccccagcuuuu

SEQ ID NO: 3950218 - RNA, 18 nt, Shigella flexneri 2a str. 301
guugucaguucuuuuauu

SEQ ID NO: 3950219 - RNA, 16 nt, Shigella flexneri 2a str. 301
guuguccucgccguuu

SEQ ID NO: 3950220 - RNA, 23 nt, Shigella flexneri 2a str. 301
guuguccuuaccacagacaaaau

SEQ ID NO: 3950221 - RNA, 12 nt, Shigella flexneri 2a str. 301
guugucgauaaa

SEQ ID NO: 3950222 - RNA, 21 nt, Shigella flexneri 2a str. 301
guugucgauaaacaguuucgc

SEQ ID NO: 3950223 - RNA, 21 nt, Shigella flexneri 2a str. 301
guugucgcacauuucaaucau

SEQ ID NO: 3950224 - RNA, 22 nt, Shigella flexneri 2a str. 301
guugucgguaauugcgccguug

SEQ ID NO: 3950225 - RNA, 22 nt, Shigella flexneri 2a str. 301
guugugccagaccaaacagcau

SEQ ID NO: 3950226 - RNA, 18 nt, Shigella flexneri 2a str. 301
guugugccuuccaucccu

SEQ ID NO: 3950227 - RNA, 19 nt, Shigella flexneri 2a str. 301
guugugcuaacucaucacc

SEQ ID NO: 3950228 - RNA, 17 nt, Shigella flexneri 2a str. 301
guuguuaaccaccagua

SEQ ID NO: 3950229 - RNA, 16 nt, Shigella flexneri 2a str. 301
guuguuacaacaucaa

SEQ ID NO: 3950230 - RNA, 14 nt, Shigella flexneri 2a str. 301
guuguuccuuccag

SEQ ID NO: 3950231 - RNA, 21 nt, Shigella flexneri 2a str. 301
guuguucugcgacgcgcggug

SEQ ID NO: 3950232 - RNA, 17 nt, Shigella flexneri 2a str. 301
guuguugauaagcccca

SEQ ID NO: 3950233 - RNA, 13 nt, Shigella flexneri 2a str. 301
guuguugcugaau

SEQ ID NO: 3950234 - RNA, 12 nt, Shigella flexneri 2a str. 301
guuguugcugcc

SEQ ID NO: 3950235 - RNA, 13 nt, Shigella flexneri 2a str. 301
guuguuuuuucaa

SEQ ID NO: 3950236 - RNA, 13 nt, Shigella flexneri 2a str. 301
guuuaaaccugau

SEQ ID NO: 3950237 - RNA, 21 nt, Shigella flexneri 2a str. 301
guuuaacacgcucuggcaggc

SEQ ID NO: 3950238 - RNA, 14 nt, Shigella flexneri 2a str. 301
guuuaaccaacaca

SEQ ID NO: 3950239 - RNA, 14 nt, Shigella flexneri 2a str. 301
guuuaaccaucagg

SEQ ID NO: 3950240 - RNA, 20 nt, Shigella flexneri 2a str. 301
guuuaaccgggagauuuucu

SEQ ID NO: 3950241 - RNA, 12 nt, Shigella flexneri 2a str. 301
guuuaccagcag

SEQ ID NO: 3950242 - RNA, 14 nt, Shigella flexneri 2a str. 301
guuuaccagcagcc

SEQ ID NO: 3950243 - RNA, 18 nt, Shigella flexneri 2a str. 301
guuuaccccgucaccacu

SEQ ID NO: 3950244 - RNA, 18 nt, Shigella flexneri 2a str. 301
guuuaccugaauaucgcc

SEQ ID NO: 3950245 - RNA, 15 nt, Shigella flexneri 2a str. 301
guuuacgcagcucac

SEQ ID NO: 3950246 - RNA, 14 nt, Shigella flexneri 2a str. 301
guuuacgccaggca

SEQ ID NO: 3950247 - RNA, 22 nt, Shigella flexneri 2a str. 301
guuuacgcguuuuucagaacuu

SEQ ID NO: 3950248 - RNA, 17 nt, Shigella flexneri 2a str. 301
guuuacgcuuuccagca

SEQ ID NO: 3950249 - RNA, 21 nt, Shigella flexneri 2a str. 301
guuuacugucugcuucugccu

SEQ ID NO: 3950250 - RNA, 23 nt, Shigella flexneri 2a str. 301
guuuacuucgcuuuacccugguu

SEQ ID NO: 3950251 - RNA, 19 nt, Shigella flexneri 2a str. 301
guuuagccgcuucugcagc

SEQ ID NO: 3950252 - RNA, 16 nt, Shigella flexneri 2a str. 301
guuuauaacggugcug

SEQ ID NO: 3950253 - RNA, 20 nt, Shigella flexneri 2a str. 301
guuuauaacggugcugcaca

SEQ ID NO: 3950254 - RNA, 21 nt, Shigella flexneri 2a str. 301
guuuaucaauuaacugugcca

SEQ ID NO: 3950255 - RNA, 14 nt, Shigella flexneri 2a str. 301
guuuaucaggccac

SEQ ID NO: 3950256 - RNA, 18 nt, Shigella flexneri 2a str. 301
guuuaucuacagcauuuc

SEQ ID NO: 3950257 - RNA, 21 nt, Shigella flexneri 2a str. 301
guuuaugacgcuugagcagga

SEQ ID NO: 3950258 - RNA, 15 nt, Shigella flexneri 2a str. 301
guuuauuaugccaca

SEQ ID NO: 3950259 - RNA, 15 nt, Shigella flexneri 2a str. 301
guuuauuucccagau

SEQ ID NO: 3950260 - RNA, 16 nt, Shigella flexneri 2a str. 301
guuuauuugacagccc

SEQ ID NO: 3950261 - RNA, 16 nt, Shigella flexneri 2a str. 301
guuucaaaaacaaaga

SEQ ID NO: 3950262 - RNA, 14 nt, Shigella flexneri 2a str. 301
guuucaaacaggcu

SEQ ID NO: 3950263 - RNA, 15 nt, Shigella flexneri 2a str. 301
guuucaacacaggau

SEQ ID NO: 3950264 - RNA, 21 nt, Shigella flexneri 2a str. 301
guuucaacgacccagccagac

SEQ ID NO: 3950265 - RNA, 19 nt, Shigella flexneri 2a str. 301
guuucaaugauaagccuuc

SEQ ID NO: 3950266 - RNA, 15 nt, Shigella flexneri 2a str. 301
guuucaccaaacuuc

SEQ ID NO: 3950267 - RNA, 13 nt, Shigella flexneri 2a str. 301
guuucaccgcgua

SEQ ID NO: 3950268 - RNA, 16 nt, Shigella flexneri 2a str. 301
guuucacuuucugcaa

SEQ ID NO: 3950269 - RNA, 18 nt, Shigella flexneri 2a str. 301
guuucagaccaauaaucc

SEQ ID NO: 3950270 - RNA, 19 nt, Shigella flexneri 2a str. 301
guuucagauuguugacaaa

SEQ ID NO: 3950271 - RNA, 15 nt, Shigella flexneri 2a str. 301
guuucagcagcggca

SEQ ID NO: 3950272 - RNA, 17 nt, Shigella flexneri 2a str. 301
guuucagccucugccgc

SEQ ID NO: 3950273 - RNA, 19 nt, Shigella flexneri 2a str. 301
guuucaguaauccuuucuc

SEQ ID NO: 3950274 - RNA, 17 nt, Shigella flexneri 2a str. 301
guuucauagcgucccag

SEQ ID NO: 3950275 - RNA, 22 nt, Shigella flexneri 2a str. 301
guuucauagugcaaauccacuc

SEQ ID NO: 3950276 - RNA, 16 nt, Shigella flexneri 2a str. 301
guuucauaucugccag

SEQ ID NO: 3950277 - RNA, 13 nt, Shigella flexneri 2a str. 301
guuucaucuucag

SEQ ID NO: 3950278 - RNA, 18 nt, Shigella flexneri 2a str. 301
guuuccagauuuugcuua

SEQ ID NO: 3950279 - RNA, 13 nt, Shigella flexneri 2a str. 301
guuuccauucgcu

SEQ ID NO: 3950280 - RNA, 13 nt, Shigella flexneri 2a str. 301
guuucccuguuca

SEQ ID NO: 3950281 - RNA, 14 nt, Shigella flexneri 2a str. 301
guuuccucaugcau

SEQ ID NO: 3950282 - RNA, 13 nt, Shigella flexneri 2a str. 301
guuuccugaugga

SEQ ID NO: 3950283 - RNA, 22 nt, Shigella flexneri 2a str. 301
guuucgaacaggccgacuggca

SEQ ID NO: 3950284 - RNA, 17 nt, Shigella flexneri 2a str. 301
guuucgaauuacacagc

SEQ ID NO: 3950285 - RNA, 20 nt, Shigella flexneri 2a str. 301
guuucgaauuacacagccac

SEQ ID NO: 3950286 - RNA, 23 nt, Shigella flexneri 2a str. 301
guuucgaauuacacagccacagg

SEQ ID NO: 3950287 - RNA, 16 nt, Shigella flexneri 2a str. 301
guuucgacaauaauca

SEQ ID NO: 3950288 - RNA, 19 nt, Shigella flexneri 2a str. 301
guuucgcagucgccagcaa

SEQ ID NO: 3950289 - RNA, 12 nt, Shigella flexneri 2a str. 301
guuucgccagcc

SEQ ID NO: 3950290 - RNA, 14 nt, Shigella flexneri 2a str. 301
guuucgccugccag

SEQ ID NO: 3950291 - RNA, 20 nt, Shigella flexneri 2a str. 301
guuucgcgguugguggcggu

SEQ ID NO: 3950292 - RNA, 19 nt, Shigella flexneri 2a str. 301
guuucgcuauagacaccuu

SEQ ID NO: 3950293 - RNA, 16 nt, Shigella flexneri 2a str. 301
guuucgcuucuucagc

SEQ ID NO: 3950294 - RNA, 18 nt, Shigella flexneri 2a str. 301
guuucggcaucagcagaa

SEQ ID NO: 3950295 - RNA, 13 nt, Shigella flexneri 2a str. 301
guuucggcguuca

SEQ ID NO: 3950296 - RNA, 15 nt, Shigella flexneri 2a str. 301
guuucgugcaucaug

SEQ ID NO: 3950297 - RNA, 23 nt, Shigella flexneri 2a str. 301
guuucucaaaugaccgcgcuggc

SEQ ID NO: 3950298 - RNA, 13 nt, Shigella flexneri 2a str. 301
guuucuccacgau

SEQ ID NO: 3950299 - RNA, 16 nt, Shigella flexneri 2a str. 301
guuucucgccacuaaa

SEQ ID NO: 3950300 - RNA, 18 nt, Shigella flexneri 2a str. 301
guuucucugacgcucucu

SEQ ID NO: 3950301 - RNA, 20 nt, Shigella flexneri 2a str. 301
guuucucuuaaaugcacaau

SEQ ID NO: 3950302 - RNA, 20 nt, Shigella flexneri 2a str. 301
guuucugacauuuuuacucc

SEQ ID NO: 3950303 - RNA, 19 nt, Shigella flexneri 2a str. 301
guuucugauacugcuccgg

SEQ ID NO: 3950304 - RNA, 13 nt, Shigella flexneri 2a str. 301
guuucugcagcuc

SEQ ID NO: 3950305 - RNA, 16 nt, Shigella flexneri 2a str. 301
guuucugcagcuccag

SEQ ID NO: 3950306 - RNA, 18 nt, Shigella flexneri 2a str. 301
guuucugcauuauccagc

SEQ ID NO: 3950307 - RNA, 16 nt, Shigella flexneri 2a str. 301
guuucugcgcuucugc

SEQ ID NO: 3950308 - RNA, 17 nt, Shigella flexneri 2a str. 301
guuucugcuucugccag

SEQ ID NO: 3950309 - RNA, 19 nt, Shigella flexneri 2a str. 301
guuucuggaugauccuggc

SEQ ID NO: 3950310 - RNA, 18 nt, Shigella flexneri 2a str. 301
guuucuggcuuaaacgca

SEQ ID NO: 3950311 - RNA, 20 nt, Shigella flexneri 2a str. 301
guuucuggugugcagcguga

SEQ ID NO: 3950312 - RNA, 16 nt, Shigella flexneri 2a str. 301
guuucuuccagcgcca

SEQ ID NO: 3950313 - RNA, 22 nt, Shigella flexneri 2a str. 301
guuucuuugccgaggaagacaa

SEQ ID NO: 3950314 - RNA, 16 nt, Shigella flexneri 2a str. 301
guuugaaaaaaccugc

SEQ ID NO: 3950315 - RNA, 14 nt, Shigella flexneri 2a str. 301
guuugaaauaccag

SEQ ID NO: 3950316 - RNA, 21 nt, Shigella flexneri 2a str. 301
guuugacuuauaagucucaga

SEQ ID NO: 3950317 - RNA, 16 nt, Shigella flexneri 2a str. 301
guuugaucacuuccag

SEQ ID NO: 3950318 - RNA, 18 nt, Shigella flexneri 2a str. 301
guuugaucacuuccagca

SEQ ID NO: 3950319 - RNA, 21 nt, Shigella flexneri 2a str. 301
guuugaugcgugagguaacaa

SEQ ID NO: 3950320 - RNA, 14 nt, Shigella flexneri 2a str. 301
guuugauugaaaaa

SEQ ID NO: 3950321 - RNA, 23 nt, Shigella flexneri 2a str. 301
guuugcaggguuaauugaugguu

SEQ ID NO: 3950322 - RNA, 14 nt, Shigella flexneri 2a str. 301
guuugcauccagcu

SEQ ID NO: 3950323 - RNA, 15 nt, Shigella flexneri 2a str. 301
guuugcauccagcuc

SEQ ID NO: 3950324 - RNA, 16 nt, Shigella flexneri 2a str. 301
guuugccaccugugca

SEQ ID NO: 3950325 - RNA, 22 nt, Shigella flexneri 2a str. 301
guuugccagugccguuccagcc

SEQ ID NO: 3950326 - RNA, 23 nt, Shigella flexneri 2a str. 301
guuugccaugacuuucuggcacg

SEQ ID NO: 3950327 - RNA, 22 nt, Shigella flexneri 2a str. 301
guuugccaugcauauccaggcu

SEQ ID NO: 3950328 - RNA, 12 nt, Shigella flexneri 2a str. 301
guuugccauuuu

SEQ ID NO: 3950329 - RNA, 19 nt, Shigella flexneri 2a str. 301
guuugccguugaucucucc

SEQ ID NO: 3950330 - RNA, 21 nt, Shigella flexneri 2a str. 301
guuugccuucacaggccgcca

SEQ ID NO: 3950331 - RNA, 22 nt, Shigella flexneri 2a str. 301
guuugccuuucggcgcagucac

SEQ ID NO: 3950332 - RNA, 21 nt, Shigella flexneri 2a str. 301
guuugcgcagccaguuaaccu

SEQ ID NO: 3950333 - RNA, 15 nt, Shigella flexneri 2a str. 301
guuugcgcccaguua

SEQ ID NO: 3950334 - RNA, 18 nt, Shigella flexneri 2a str. 301
guuugcgguguguggcug

SEQ ID NO: 3950335 - RNA, 19 nt, Shigella flexneri 2a str. 301
guuugcgucagcuucagau

SEQ ID NO: 3950336 - RNA, 13 nt, Shigella flexneri 2a str. 301
guuugcugccuuc

SEQ ID NO: 3950337 - RNA, 19 nt, Shigella flexneri 2a str. 301
guuugcugccuucacggcu

SEQ ID NO: 3950338 - RNA, 11 nt, Shigella flexneri 2a str. 301
guuuggcaaau

SEQ ID NO: 3950339 - RNA, 24 nt, Shigella flexneri 2a str. 301
guuuggccaauaguuccacuauuu

SEQ ID NO: 3950340 - RNA, 22 nt, Shigella flexneri 2a str. 301
guuuggccgcgccaaugccuga

SEQ ID NO: 3950341 - RNA, 15 nt, Shigella flexneri 2a str. 301
guuuguaggccugau

SEQ ID NO: 3950342 - RNA, 21 nt, Shigella flexneri 2a str. 301
guuugucauaaaucucagccc

SEQ ID NO: 3950343 - RNA, 17 nt, Shigella flexneri 2a str. 301
guuugugggaauaacca

SEQ ID NO: 3950344 - RNA, 13 nt, Shigella flexneri 2a str. 301
guuuguuauccac

SEQ ID NO: 3950345 - RNA, 12 nt, Shigella flexneri 2a str. 301
guuuguucagcu

SEQ ID NO: 3950346 - RNA, 19 nt, Shigella flexneri 2a str. 301
guuuuaaucacuucuucuu

SEQ ID NO: 3950347 - RNA, 15 nt, Shigella flexneri 2a str. 301
guuuuaauuccuauc

SEQ ID NO: 3950348 - RNA, 15 nt, Shigella flexneri 2a str. 301
guuuuacaacgcugu

SEQ ID NO: 3950349 - RNA, 15 nt, Shigella flexneri 2a str. 301
guuuuacaacguauu

SEQ ID NO: 3950350 - RNA, 15 nt, Shigella flexneri 2a str. 301
guuuuacguaaugcu

SEQ ID NO: 3950351 - RNA, 14 nt, Shigella flexneri 2a str. 301
guuuuacuccaacu

SEQ ID NO: 3950352 - RNA, 22 nt, Shigella flexneri 2a str. 301
guuuuacucuuucucggaguaa

SEQ ID NO: 3950353 - RNA, 21 nt, Shigella flexneri 2a str. 301
guuuuacuggaguuauucauu

SEQ ID NO: 3950354 - RNA, 21 nt, Shigella flexneri 2a str. 301
guuuuacuuuuuaacuuuaau

SEQ ID NO: 3950355 - RNA, 13 nt, Shigella flexneri 2a str. 301
guuuuaguaacaa

SEQ ID NO: 3950356 - RNA, 17 nt, Shigella flexneri 2a str. 301
guuuuauaacggcuggc

SEQ ID NO: 3950357 - RNA, 14 nt, Shigella flexneri 2a str. 301
guuuuauaaucgca

SEQ ID NO: 3950358 - RNA, 20 nt, Shigella flexneri 2a str. 301
guuuuauagcgggaaauacu

SEQ ID NO: 3950359 - RNA, 16 nt, Shigella flexneri 2a str. 301
guuuuauuauuccauc

SEQ ID NO: 3950360 - RNA, 22 nt, Shigella flexneri 2a str. 301
guuuuauuauuccauccugcuc

SEQ ID NO: 3950361 - RNA, 11 nt, Shigella flexneri 2a str. 301
guuuucaacgg

SEQ ID NO: 3950362 - RNA, 15 nt, Shigella flexneri 2a str. 301
guuuucaacggcggc

SEQ ID NO: 3950363 - RNA, 20 nt, Shigella flexneri 2a str. 301
guuuucaaugauaaagguca

SEQ ID NO: 3950364 - RNA, 12 nt, Shigella flexneri 2a str. 301
guuuucaccagu

SEQ ID NO: 3950365 - RNA, 21 nt, Shigella flexneri 2a str. 301
uaaaaugacucgccgcugugg

SEQ ID NO: 3950366 - RNA, 15 nt, Shigella flexneri 2a str. 301
uaaaaugauacgcuc

SEQ ID NO: 3950367 - RNA, 13 nt, Shigella flexneri 2a str. 301
uaaaauggccgua

SEQ ID NO: 3950368 - RNA, 13 nt, Shigella flexneri 2a str. 301
uaaaauguacaug

SEQ ID NO: 3950369 - RNA, 19 nt, Shigella flexneri 2a str. 301
uaaaauucaucaaauggca

SEQ ID NO: 3950370 - RNA, 17 nt, Shigella flexneri 2a str. 301
uaaaauucauucaauua

SEQ ID NO: 3950371 - RNA, 13 nt, Shigella flexneri 2a str. 301
uaaaauuuaacau

SEQ ID NO: 3950372 - RNA, 12 nt, Shigella flexneri 2a str. 301
uaaacaaagcgc

SEQ ID NO: 3950373 - RNA, 15 nt, Shigella flexneri 2a str. 301
uaaacaccaccgaaa

SEQ ID NO: 3950374 - RNA, 12 nt, Shigella flexneri 2a str. 301
uaaacaccagca

SEQ ID NO: 3950375 - RNA, 15 nt, Shigella flexneri 2a str. 301
uaaacagacaguaau

SEQ ID NO: 3950376 - RNA, 19 nt, Shigella flexneri 2a str. 301
uaaacaggaucugguauua

SEQ ID NO: 3950377 - RNA, 23 nt, Shigella flexneri 2a str. 301
uaaacagguaaagaccauaaaua

SEQ ID NO: 3950378 - RNA, 16 nt, Shigella flexneri 2a str. 301
uaaacaguuucgccag

SEQ ID NO: 3950379 - RNA, 21 nt, Shigella flexneri 2a str. 301
uaaacaucgggacaugauaug

SEQ ID NO: 3950380 - RNA, 16 nt, Shigella flexneri 2a str. 301
uaaacauuaaaauucu

SEQ ID NO: 3950381 - RNA, 17 nt, Shigella flexneri 2a str. 301
uaaaccaacaaaacuca

SEQ ID NO: 3950382 - RNA, 14 nt, Shigella flexneri 2a str. 301
uaaaccacagaccg

SEQ ID NO: 3950383 - RNA, 15 nt, Shigella flexneri 2a str. 301
uaaaccacccaccag

SEQ ID NO: 3950384 - RNA, 23 nt, Shigella flexneri 2a str. 301
uaaaccaccugggucugcagaua

SEQ ID NO: 3950385 - RNA, 18 nt, Shigella flexneri 2a str. 301
uaaaccacugacacaggc

SEQ ID NO: 3950386 - RNA, 23 nt, Shigella flexneri 2a str. 301
uaaaccacugacacaggcagcaa

SEQ ID NO: 3950387 - RNA, 13 nt, Shigella flexneri 2a str. 301
uaaaccagcuguc

SEQ ID NO: 3950388 - RNA, 12 nt, Shigella flexneri 2a str. 301
uaaaccaucggc

SEQ ID NO: 3950389 - RNA, 20 nt, Shigella flexneri 2a str. 301
uaaaccccuuaucuggccua

SEQ ID NO: 3950390 - RNA, 19 nt, Shigella flexneri 2a str. 301
uaaacccgaccacuuccac

SEQ ID NO: 3950391 - RNA, 15 nt, Shigella flexneri 2a str. 301
uaaacccuaacauca

SEQ ID NO: 3950392 - RNA, 18 nt, Shigella flexneri 2a str. 301
uaaacccuaacaucaucc

SEQ ID NO: 3950393 - RNA, 17 nt, Shigella flexneri 2a str. 301
uaaaccgcucgucacau

SEQ ID NO: 3950394 - RNA, 16 nt, Shigella flexneri 2a str. 301
uaaaccgucagcacca

SEQ ID NO: 3950395 - RNA, 21 nt, Shigella flexneri 2a str. 301
uaaaccgucagcaccagggaa

SEQ ID NO: 3950396 - RNA, 23 nt, Shigella flexneri 2a str. 301
uaaaccucucugcuagcuggcuc

SEQ ID NO: 3950397 - RNA, 13 nt, Shigella flexneri 2a str. 301
uaaacgcauacau

SEQ ID NO: 3950398 - RNA, 12 nt, Shigella flexneri 2a str. 301
uaaacgccaggu

SEQ ID NO: 3950399 - RNA, 14 nt, Shigella flexneri 2a str. 301
uaaacgccgccagu

SEQ ID NO: 3950400 - RNA, 14 nt, Shigella flexneri 2a str. 301
uaaacgccuuaucc

SEQ ID NO: 3950401 - RNA, 20 nt, Shigella flexneri 2a str. 301
uaaacgccuuauccagccua

SEQ ID NO: 3950402 - RNA, 20 nt, Shigella flexneri 2a str. 301
uaaacgccuuauccgcccua

SEQ ID NO: 3950403 - RNA, 20 nt, Shigella flexneri 2a str. 301
uaaacgccuuauccggccua

SEQ ID NO: 3950404 - RNA, 20 nt, Shigella flexneri 2a str. 301
uaaacgcuuuguccggccca

SEQ ID NO: 3950405 - RNA, 20 nt, Shigella flexneri 2a str. 301
uaaacgcuuuuuugagcagc

SEQ ID NO: 3950406 - RNA, 19 nt, Shigella flexneri 2a str. 301
uaaacggcugggaaaucac

SEQ ID NO: 3950407 - RNA, 15 nt, Shigella flexneri 2a str. 301
uaaacgucucacuaa

SEQ ID NO: 3950408 - RNA, 21 nt, Shigella flexneri 2a str. 301
uaaacgugugugccagguucg

SEQ ID NO: 3950409 - RNA, 15 nt, Shigella flexneri 2a str. 301
uaaacucaaucaggc

SEQ ID NO: 3950410 - RNA, 12 nt, Shigella flexneri 2a str. 301
uaaacuccuuuc

SEQ ID NO: 3950411 - RNA, 15 nt, Shigella flexneri 2a str. 301
uaaacucugccgcaa

SEQ ID NO: 3950412 - RNA, 20 nt, Shigella flexneri 2a str. 301
uaaacuuacugacaucaaac

SEQ ID NO: 3950413 - RNA, 13 nt, Shigella flexneri 2a str. 301
uaaacuucaccag

SEQ ID NO: 3950414 - RNA, 19 nt, Shigella flexneri 2a str. 301
uaaacuucacuuccccgag

SEQ ID NO: 3950415 - RNA, 14 nt, Shigella flexneri 2a str. 301
uaaacuuuuucgcg

SEQ ID NO: 3950416 - RNA, 13 nt, Shigella flexneri 2a str. 301
uaaagaaaguaau

SEQ ID NO: 3950417 - RNA, 23 nt, Shigella flexneri 2a str. 301
uaaagaaaguaaucuauauuucu

SEQ ID NO: 3950418 - RNA, 10 nt, Shigella flexneri 2a str. 301
uaaagaagag

SEQ ID NO: 3950419 - RNA, 20 nt, Shigella flexneri 2a str. 301
uaaagaaggcauaacucccc

SEQ ID NO: 3950420 - RNA, 15 nt, Shigella flexneri 2a str. 301
uaaagaccauaaaua

SEQ ID NO: 3950421 - RNA, 22 nt, Shigella flexneri 2a str. 301
uaaagaccauugaugcucuccg

SEQ ID NO: 3950422 - RNA, 20 nt, Shigella flexneri 2a str. 301
uaaagagaacucuuuuuucc

SEQ ID NO: 3950423 - RNA, 21 nt, Shigella flexneri 2a str. 301
uaaagagaacucuuuuuuccg

SEQ ID NO: 3950424 - RNA, 22 nt, Shigella flexneri 2a str. 301
uaaagagcauuacacgcggcug

SEQ ID NO: 3950425 - RNA, 23 nt, Shigella flexneri 2a str. 301
uaaagagcgccucccuuuuucaa

SEQ ID NO: 3950426 - RNA, 14 nt, Shigella flexneri 2a str. 301
uaaagauaauguaa

SEQ ID NO: 3950427 - RNA, 13 nt, Shigella flexneri 2a str. 301
uaaagaugccauu

SEQ ID NO: 3950428 - RNA, 11 nt, Shigella flexneri 2a str. 301
uaaagcaauga

SEQ ID NO: 3950429 - RNA, 19 nt, Shigella flexneri 2a str. 301
uaaagcacugucuaacaac

SEQ ID NO: 3950430 - RNA, 19 nt, Shigella flexneri 2a str. 301
uaaagcauuuucauccauu

SEQ ID NO: 3950431 - RNA, 19 nt, Shigella flexneri 2a str. 301
uaaagcccauaccacagca

SEQ ID NO: 3950432 - RNA, 17 nt, Shigella flexneri 2a str. 301
uaaagcccucaccgaag

SEQ ID NO: 3950433 - RNA, 21 nt, Shigella flexneri 2a str. 301
uaaagccugcuucaaacgcug

SEQ ID NO: 3950434 - RNA, 14 nt, Shigella flexneri 2a str. 301
uaaagccuuuuacc

SEQ ID NO: 3950435 - RNA, 23 nt, Shigella flexneri 2a str. 301
uaaagcgcgcaguuugucuucaa

SEQ ID NO: 3950436 - RNA, 17 nt, Shigella flexneri 2a str. 301
uaaagcgguuacacaug

SEQ ID NO: 3950437 - RNA, 15 nt, Shigella flexneri 2a str. 301
uaaagcugaucacau

SEQ ID NO: 3950438 - RNA, 18 nt, Shigella flexneri 2a str. 301
uaaagcugccgucaauuu

SEQ ID NO: 3950439 - RNA, 21 nt, Shigella flexneri 2a str. 301
uaaaggagaaggguuaugaug

SEQ ID NO: 3950440 - RNA, 17 nt, Shigella flexneri 2a str. 301
uaaaggcggcagaacag

SEQ ID NO: 3950441 - RNA, 22 nt, Shigella flexneri 2a str. 301
uaaaggcggcagaacagaacau

SEQ ID NO: 3950442 - RNA, 20 nt, Shigella flexneri 2a str. 301
uaaagggaucaauaaugaug

SEQ ID NO: 3950443 - RNA, 17 nt, Shigella flexneri 2a str. 301
uaaaggggugaaaaaaa

SEQ ID NO: 3950444 - RNA, 14 nt, Shigella flexneri 2a str. 301
uaaaggucaucaca

SEQ ID NO: 3950445 - RNA, 23 nt, Shigella flexneri 2a str. 301
uaaaguacguguggucuuuucaa

SEQ ID NO: 3950446 - RNA, 15 nt, Shigella flexneri 2a str. 301
uaaaguagaaauuau

SEQ ID NO: 3950447 - RNA, 23 nt, Shigella flexneri 2a str. 301
uaaaguccgguaauggagauugu

SEQ ID NO: 3950448 - RNA, 19 nt, Shigella flexneri 2a str. 301
uaaagucuaaaaaugugcc

SEQ ID NO: 3950449 - RNA, 24 nt, Shigella flexneri 2a str. 301
uaaaguguuaccccucuauccagc

SEQ ID NO: 3950450 - RNA, 19 nt, Shigella flexneri 2a str. 301
uaaaguuaccuguggcgua

SEQ ID NO: 3950451 - RNA, 20 nt, Shigella flexneri 2a str. 301
uaaaguuaccuucgaagaac

SEQ ID NO: 3950452 - RNA, 14 nt, Shigella flexneri 2a str. 301
uaaaguuagucgcg

SEQ ID NO: 3950453 - RNA, 18 nt, Shigella flexneri 2a str. 301
uaaaguugcucucaaaga

SEQ ID NO: 3950454 - RNA, 14 nt, Shigella flexneri 2a str. 301
uaaaguuuuauccc

SEQ ID NO: 3950455 - RNA, 13 nt, Shigella flexneri 2a str. 301
uaaauaacuuuua

SEQ ID NO: 3950456 - RNA, 17 nt, Shigella flexneri 2a str. 301
uaaauaacuuuuaucug

SEQ ID NO: 3950457 - RNA, 20 nt, Shigella flexneri 2a str. 301
uaaauaaggugguagcugcc

SEQ ID NO: 3950458 - RNA, 10 nt, Shigella flexneri 2a str. 301
uaaauaauaa

SEQ ID NO: 3950459 - RNA, 20 nt, Shigella flexneri 2a str. 301
uaaauaaucgcauucaggac

SEQ ID NO: 3950460 - RNA, 22 nt, Shigella flexneri 2a str. 301
uaaauacagcuuaaucaccagc

SEQ ID NO: 3950461 - RNA, 17 nt, Shigella flexneri 2a str. 301
uaaauaccuuacacuca

SEQ ID NO: 3950462 - RNA, 23 nt, Shigella flexneri 2a str. 301
uaaauaccuuacacucaaauauc

SEQ ID NO: 3950463 - RNA, 16 nt, Shigella flexneri 2a str. 301
uaaauagaggaaucug

SEQ ID NO: 3950464 - RNA, 19 nt, Shigella flexneri 2a str. 301
uaaauagaggaaucugauu

SEQ ID NO: 3950465 - RNA, 15 nt, Shigella flexneri 2a str. 301
uaaccagcgcagaca

SEQ ID NO: 3950466 - RNA, 16 nt, Shigella flexneri 2a str. 301
uaaccaguccauuacc

SEQ ID NO: 3950467 - RNA, 16 nt, Shigella flexneri 2a str. 301
uaaccaucaaaacgcu

SEQ ID NO: 3950468 - RNA, 12 nt, Shigella flexneri 2a str. 301
uaaccaucagcu

SEQ ID NO: 3950469 - RNA, 15 nt, Shigella flexneri 2a str. 301
uaaccaucagcugug

SEQ ID NO: 3950470 - RNA, 21 nt, Shigella flexneri 2a str. 301
uaaccauccauauuuggcaug

SEQ ID NO: 3950471 - RNA, 15 nt, Shigella flexneri 2a str. 301
uaaccaucgcacagc

SEQ ID NO: 3950472 - RNA, 19 nt, Shigella flexneri 2a str. 301
uaacccacugacuucucug

SEQ ID NO: 3950473 - RNA, 13 nt, Shigella flexneri 2a str. 301
uaacccagcgaug

SEQ ID NO: 3950474 - RNA, 21 nt, Shigella flexneri 2a str. 301
uaacccauccagcagagauac

SEQ ID NO: 3950475 - RNA, 18 nt, Shigella flexneri 2a str. 301
uaacccauuuuguuuuau

SEQ ID NO: 3950476 - RNA, 16 nt, Shigella flexneri 2a str. 301
uaaccccaccagcaug

SEQ ID NO: 3950477 - RNA, 19 nt, Shigella flexneri 2a str. 301
uaacccccaaauaaccccu

SEQ ID NO: 3950478 - RNA, 17 nt, Shigella flexneri 2a str. 301
uaaccccgggcuggauu

SEQ ID NO: 3950479 - RNA, 21 nt, Shigella flexneri 2a str. 301
uaacccgcagcuuaaugaacu

SEQ ID NO: 3950480 - RNA, 21 nt, Shigella flexneri 2a str. 301
uaacccggcaccaacaaagcc

SEQ ID NO: 3950481 - RNA, 20 nt, Shigella flexneri 2a str. 301
uaaccgaccuucacgcugcg

SEQ ID NO: 3950482 - RNA, 20 nt, Shigella flexneri 2a str. 301
uaaccgcaguguaguucugg

SEQ ID NO: 3950483 - RNA, 19 nt, Shigella flexneri 2a str. 301
uaaccgcccagugccagca

SEQ ID NO: 3950484 - RNA, 16 nt, Shigella flexneri 2a str. 301
uaaccgcugcaaaaaa

SEQ ID NO: 3950485 - RNA, 15 nt, Shigella flexneri 2a str. 301
uaaccgcuuuuccag

SEQ ID NO: 3950486 - RNA, 16 nt, Shigella flexneri 2a str. 301
uaaccgcuuuuucaau

SEQ ID NO: 3950487 - RNA, 22 nt, Shigella flexneri 2a str. 301
uaaccggaggauaugcaucaug

SEQ ID NO: 3950488 - RNA, 15 nt, Shigella flexneri 2a str. 301
uaaccgggagauuuu

SEQ ID NO: 3950489 - RNA, 22 nt, Shigella flexneri 2a str. 301
uaaccgggagauuuucuccugc

SEQ ID NO: 3950490 - RNA, 19 nt, Shigella flexneri 2a str. 301
uaaccgggguuucacccac

SEQ ID NO: 3950491 - RNA, 14 nt, Shigella flexneri 2a str. 301
uaaccgucacguuc

SEQ ID NO: 3950492 - RNA, 18 nt, Shigella flexneri 2a str. 301
uaaccgugggaaacagua

SEQ ID NO: 3950493 - RNA, 15 nt, Shigella flexneri 2a str. 301
uaaccguuuccuuga

SEQ ID NO: 3950494 - RNA, 20 nt, Shigella flexneri 2a str. 301
uaaccuauuguuuuaaugac

SEQ ID NO: 3950495 - RNA, 22 nt, Shigella flexneri 2a str. 301
uaaccugaaaccggaaagcuuc

SEQ ID NO: 3950496 - RNA, 22 nt, Shigella flexneri 2a str. 301
uaaccugccugacggaaaucau

SEQ ID NO: 3950497 - RNA, 14 nt, Shigella flexneri 2a str. 301
uaaccuucaccgug

SEQ ID NO: 3950498 - RNA, 17 nt, Shigella flexneri 2a str. 301
uaaccuucuucauuaug

SEQ ID NO: 3950499 - RNA, 14 nt, Shigella flexneri 2a str. 301
uaaccuuuaaucag

SEQ ID NO: 3950500 - RNA, 22 nt, Shigella flexneri 2a str. 301
uaaccuuuaucgcgcagcagau

SEQ ID NO: 3950501 - RNA, 14 nt, Shigella flexneri 2a str. 301
uaacgaacgcagug

SEQ ID NO: 3950502 - RNA, 15 nt, Shigella flexneri 2a str. 301
uaacgacauuuucug

SEQ ID NO: 3950503 - RNA, 23 nt, Shigella flexneri 2a str. 301
uaacgcagaaucuucuucucagc

SEQ ID NO: 3950504 - RNA, 21 nt, Shigella flexneri 2a str. 301
uaacgccaauucauuccuuga

SEQ ID NO: 3950505 - RNA, 23 nt, Shigella flexneri 2a str. 301
uaacgccaauucauuccuugaaa

SEQ ID NO: 3950506 - RNA, 14 nt, Shigella flexneri 2a str. 301
uaacgccagccugu

SEQ ID NO: 3950507 - RNA, 15 nt, Shigella flexneri 2a str. 301
uaacgccccaaucca

SEQ ID NO: 3950508 - RNA, 12 nt, Shigella flexneri 2a str. 301
uaacgccccaca

SEQ ID NO: 3950509 - RNA, 23 nt, Shigella flexneri 2a str. 301
uaacgccccacaaacccgccaga

SEQ ID NO: 3950510 - RNA, 16 nt, Shigella flexneri 2a str. 301
uaacgccugcuccagu

SEQ ID NO: 3950511 - RNA, 16 nt, Shigella flexneri 2a str. 301
uaacgccuucccuuuc

SEQ ID NO: 3950512 - RNA, 19 nt, Shigella flexneri 2a str. 301
uaacgccuucccuuucagc

SEQ ID NO: 3950513 - RNA, 15 nt, Shigella flexneri 2a str. 301
uaacgccuuuuccag

SEQ ID NO: 3950514 - RNA, 19 nt, Shigella flexneri 2a str. 301
uaacgcgggcuucuucuuu

SEQ ID NO: 3950515 - RNA, 20 nt, Shigella flexneri 2a str. 301
uaacgcgucuuaucuggccu

SEQ ID NO: 3950516 - RNA, 17 nt, Shigella flexneri 2a str. 301
uaacgcuucucccagcc

SEQ ID NO: 3950517 - RNA, 16 nt, Shigella flexneri 2a str. 301
uaacgcuucuggcgua

SEQ ID NO: 3950518 - RNA, 14 nt, Shigella flexneri 2a str. 301
uaacggcaacggug

SEQ ID NO: 3950519 - RNA, 22 nt, Shigella flexneri 2a str. 301
uaacggcagaagcugcaggacc

SEQ ID NO: 3950520 - RNA, 14 nt, Shigella flexneri 2a str. 301
uaacggcaggauca

SEQ ID NO: 3950521 - RNA, 22 nt, Shigella flexneri 2a str. 301
uaacggcucacgcccaucagca

SEQ ID NO: 3950522 - RNA, 16 nt, Shigella flexneri 2a str. 301
uaacggcugauaacaa

SEQ ID NO: 3950523 - RNA, 21 nt, Shigella flexneri 2a str. 301
uaacgguaaagcccucaccga

SEQ ID NO: 3950524 - RNA, 19 nt, Shigella flexneri 2a str. 301
uaacguaaaaacccgcuuc

SEQ ID NO: 3950525 - RNA, 14 nt, Shigella flexneri 2a str. 301
uaacgucccccaga

SEQ ID NO: 3950526 - RNA, 19 nt, Shigella flexneri 2a str. 301
uaacgucgguuucaucaca

SEQ ID NO: 3950527 - RNA, 21 nt, Shigella flexneri 2a str. 301
uaacgucuaguaaagcagacg

SEQ ID NO: 3950528 - RNA, 19 nt, Shigella flexneri 2a str. 301
uaacgugcagcuuucccuu

SEQ ID NO: 3950529 - RNA, 17 nt, Shigella flexneri 2a str. 301
uaacguuauaucccauu

SEQ ID NO: 3950530 - RNA, 15 nt, Shigella flexneri 2a str. 301
uaacuacaaucacga

SEQ ID NO: 3950531 - RNA, 17 nt, Shigella flexneri 2a str. 301
uaacuaggcgaacauuc

SEQ ID NO: 3950532 - RNA, 23 nt, Shigella flexneri 2a str. 301
uaacuauuguuuugaugaaucag

SEQ ID NO: 3950533 - RNA, 21 nt, Shigella flexneri 2a str. 301
uaacucaaaaauaaucaucuc

SEQ ID NO: 3950534 - RNA, 12 nt, Shigella flexneri 2a str. 301
uaacucaccauc

SEQ ID NO: 3950535 - RNA, 14 nt, Shigella flexneri 2a str. 301
uaacucaccaucaa

SEQ ID NO: 3950536 - RNA, 15 nt, Shigella flexneri 2a str. 301
uaacucauauaacgc

SEQ ID NO: 3950537 - RNA, 17 nt, Shigella flexneri 2a str. 301
uaacucccccuuucuga

SEQ ID NO: 3950538 - RNA, 22 nt, Shigella flexneri 2a str. 301
uaacuccuucuaaagcaacucc

SEQ ID NO: 3950539 - RNA, 22 nt, Shigella flexneri 2a str. 301
uaacugacuuucguuugaaaac

SEQ ID NO: 3950540 - RNA, 19 nt, Shigella flexneri 2a str. 301
uaacugccgucaaugcgca

SEQ ID NO: 3950541 - RNA, 19 nt, Shigella flexneri 2a str. 301
uaacugcgcgauuaucauu

SEQ ID NO: 3950542 - RNA, 19 nt, Shigella flexneri 2a str. 301
uaacugcguuucuggcuua

SEQ ID NO: 3950543 - RNA, 15 nt, Shigella flexneri 2a str. 301
uaacuggucaucaaa

SEQ ID NO: 3950544 - RNA, 15 nt, Shigella flexneri 2a str. 301
uaacuuaauaaacau

SEQ ID NO: 3950545 - RNA, 16 nt, Shigella flexneri 2a str. 301
uaacuuaauaaacauc

SEQ ID NO: 3950546 - RNA, 13 nt, Shigella flexneri 2a str. 301
uaacuuaauguca

SEQ ID NO: 3950547 - RNA, 15 nt, Shigella flexneri 2a str. 301
uaacuuaucuguaau

SEQ ID NO: 3950548 - RNA, 15 nt, Shigella flexneri 2a str. 301
uaacuucaucagcaa

SEQ ID NO: 3950549 - RNA, 19 nt, Shigella flexneri 2a str. 301
uaacuucccgcauccagaa

SEQ ID NO: 3950550 - RNA, 19 nt, Shigella flexneri 2a str. 301
uaacuuccugcuggcugua

SEQ ID NO: 3950551 - RNA, 23 nt, Shigella flexneri 2a str. 301
uaacuucugaucuacagccuuau

SEQ ID NO: 3950552 - RNA, 23 nt, Shigella flexneri 2a str. 301
uaacuucuuuacuggcuuucauu

SEQ ID NO: 3950553 - RNA, 15 nt, Shigella flexneri 2a str. 301
uaacuuuaauuuugu

SEQ ID NO: 3950554 - RNA, 22 nt, Shigella flexneri 2a str. 301
uaacuuucguguguuuucuguu

SEQ ID NO: 3950555 - RNA, 17 nt, Shigella flexneri 2a str. 301
uaacuuugaagcccagu

SEQ ID NO: 3950556 - RNA, 16 nt, Shigella flexneri 2a str. 301
uaacuuugaucgcguu

SEQ ID NO: 3950557 - RNA, 13 nt, Shigella flexneri 2a str. 301
uaacuuuuaucug

SEQ ID NO: 3950558 - RNA, 15 nt, Shigella flexneri 2a str. 301
uaacuuuuaucuguu

SEQ ID NO: 3950559 - RNA, 17 nt, Shigella flexneri 2a str. 301
uaacuuuucauccugcg

SEQ ID NO: 3950560 - RNA, 18 nt, Shigella flexneri 2a str. 301
uaagaaaacggaagcuca

SEQ ID NO: 3950561 - RNA, 12 nt, Shigella flexneri 2a str. 301
uaagaacaagca

SEQ ID NO: 3950562 - RNA, 23 nt, Shigella flexneri 2a str. 301
uaagaacugacuuccacuuccug

SEQ ID NO: 3950563 - RNA, 18 nt, Shigella flexneri 2a str. 301
uaagaauccggaaacgcu

SEQ ID NO: 3950564 - RNA, 20 nt, Shigella flexneri 2a str. 301
uaagaaugcgaaaacgaugu

SEQ ID NO: 3950565 - RNA, 20 nt, Shigella flexneri 2a str. 301
uaauaccagccuucuucauc

SEQ ID NO: 3950566 - RNA, 22 nt, Shigella flexneri 2a str. 301
uaauaccgacuccguagaaccu

SEQ ID NO: 3950567 - RNA, 23 nt, Shigella flexneri 2a str. 301
uaauaccgacuucggccagugcu

SEQ ID NO: 3950568 - RNA, 11 nt, Shigella flexneri 2a str. 301
uaauaccggau

SEQ ID NO: 3950569 - RNA, 15 nt, Shigella flexneri 2a str. 301
uaauaccugccuggu

SEQ ID NO: 3950570 - RNA, 20 nt, Shigella flexneri 2a str. 301
uaauacgccggucacgcccg

SEQ ID NO: 3950571 - RNA, 23 nt, Shigella flexneri 2a str. 301
uaauacguagcaccgacgucgau

SEQ ID NO: 3950572 - RNA, 15 nt, Shigella flexneri 2a str. 301
uaauagaacuauaau

SEQ ID NO: 3950573 - RNA, 20 nt, Shigella flexneri 2a str. 301
uaauagaacuauaauugcuu

SEQ ID NO: 3950574 - RNA, 22 nt, Shigella flexneri 2a str. 301
uaauagagauagccugaucaug

SEQ ID NO: 3950575 - RNA, 19 nt, Shigella flexneri 2a str. 301
uaauaggcaggcaucauca

SEQ ID NO: 3950576 - RNA, 12 nt, Shigella flexneri 2a str. 301
uaauauaacagc

SEQ ID NO: 3950577 - RNA, 16 nt, Shigella flexneri 2a str. 301
uaauauauaaagauuc

SEQ ID NO: 3950578 - RNA, 22 nt, Shigella flexneri 2a str. 301
uaauauauccccccaugaaaua

SEQ ID NO: 3950579 - RNA, 22 nt, Shigella flexneri 2a str. 301
uaauauccccagccuaagccau

SEQ ID NO: 3950580 - RNA, 23 nt, Shigella flexneri 2a str. 301
uaauauccccagccuaagccauu

SEQ ID NO: 3950581 - RNA, 19 nt, Shigella flexneri 2a str. 301
uaauauccggugcauucau

SEQ ID NO: 3950582 - RNA, 23 nt, Shigella flexneri 2a str. 301
uaauauccugccguuuuuuauuu

SEQ ID NO: 3950583 - RNA, 14 nt, Shigella flexneri 2a str. 301
uaauauccuuuccc

SEQ ID NO: 3950584 - RNA, 19 nt, Shigella flexneri 2a str. 301
uaauaucgcgcagaaauuc

SEQ ID NO: 3950585 - RNA, 15 nt, Shigella flexneri 2a str. 301
uaauaucuccagcua

SEQ ID NO: 3950586 - RNA, 15 nt, Shigella flexneri 2a str. 301
uaauaugcaauucac

SEQ ID NO: 3950587 - RNA, 21 nt, Shigella flexneri 2a str. 301
uaauaugcucaacaauaaacu

SEQ ID NO: 3950588 - RNA, 22 nt, Shigella flexneri 2a str. 301
uaauaugcugguuccugacucc

SEQ ID NO: 3950589 - RNA, 20 nt, Shigella flexneri 2a str. 301
uaauauuagucaauuaaaaa

SEQ ID NO: 3950590 - RNA, 22 nt, Shigella flexneri 2a str. 301
uaauauuccgcugacuuuauac

SEQ ID NO: 3950591 - RNA, 16 nt, Shigella flexneri 2a str. 301
uaauauugauauccgc

SEQ ID NO: 3950592 - RNA, 15 nt, Shigella flexneri 2a str. 301
uaaucaaaucaacaa

SEQ ID NO: 3950593 - RNA, 19 nt, Shigella flexneri 2a str. 301
uaaucaaaucaacaaccug

SEQ ID NO: 3950594 - RNA, 15 nt, Shigella flexneri 2a str. 301
uaaucaacaaaccaa

SEQ ID NO: 3950595 - RNA, 21 nt, Shigella flexneri 2a str. 301
uaaucaacgcaccgacaaauu

SEQ ID NO: 3950596 - RNA, 19 nt, Shigella flexneri 2a str. 301
uaaucacauaauccagaca

SEQ ID NO: 3950597 - RNA, 18 nt, Shigella flexneri 2a str. 301
uaaucaccaucagcagca

SEQ ID NO: 3950598 - RNA, 21 nt, Shigella flexneri 2a str. 301
uaaucacuucuucuuguucau

SEQ ID NO: 3950599 - RNA, 14 nt, Shigella flexneri 2a str. 301
uaaucagacuggcg

SEQ ID NO: 3950600 - RNA, 17 nt, Shigella flexneri 2a str. 301
uaaucagacuggcggca

SEQ ID NO: 3950601 - RNA, 16 nt, Shigella flexneri 2a str. 301
uaaucagcuuuuccau

SEQ ID NO: 3950602 - RNA, 17 nt, Shigella flexneri 2a str. 301
uaaucaggaacuggaag

SEQ ID NO: 3950603 - RNA, 17 nt, Shigella flexneri 2a str. 301
uaaucauauuaaauuuu

SEQ ID NO: 3950604 - RNA, 21 nt, Shigella flexneri 2a str. 301
uaaucaucacgccaauaccgc

SEQ ID NO: 3950605 - RNA, 23 nt, Shigella flexneri 2a str. 301
uaaucauccaccuuaaaacaaua

SEQ ID NO: 3950606 - RNA, 16 nt, Shigella flexneri 2a str. 301
uaaucauuacaaccgc

SEQ ID NO: 3950607 - RNA, 20 nt, Shigella flexneri 2a str. 301
uaauccacuuucuuaaagcc

SEQ ID NO: 3950608 - RNA, 15 nt, Shigella flexneri 2a str. 301
uaauccagccuacaa

SEQ ID NO: 3950609 - RNA, 19 nt, Shigella flexneri 2a str. 301
uaauccaggacauaucagg

SEQ ID NO: 3950610 - RNA, 21 nt, Shigella flexneri 2a str. 301
uaauccauaguguguuccucu

SEQ ID NO: 3950611 - RNA, 19 nt, Shigella flexneri 2a str. 301
uaaucccgcgcaacaaaua

SEQ ID NO: 3950612 - RNA, 14 nt, Shigella flexneri 2a str. 301
uaauccgagaaucg

SEQ ID NO: 3950613 - RNA, 21 nt, Shigella flexneri 2a str. 301
uaauccgguuuacccgcuuga

SEQ ID NO: 3950614 - RNA, 15 nt, Shigella flexneri 2a str. 301
uaaucgaaaacauca

SEQ ID NO: 3950615 - RNA, 13 nt, Shigella flexneri 2a str. 301
uaaucgaaccaaa

SEQ ID NO: 3950616 - RNA, 23 nt, Shigella flexneri 2a str. 301
uaaucgaaccaaacagcgccaga

SEQ ID NO: 3950617 - RNA, 22 nt, Shigella flexneri 2a str. 301
uaaucgccagcaaaaucaccau

SEQ ID NO: 3950618 - RNA, 18 nt, Shigella flexneri 2a str. 301
uaaucgccuuaauaaccc

SEQ ID NO: 3950619 - RNA, 16 nt, Shigella flexneri 2a str. 301
uaaucgcucagcgcau

SEQ ID NO: 3950620 - RNA, 19 nt, Shigella flexneri 2a str. 301
uaaucggggauaagaauau

SEQ ID NO: 3950621 - RNA, 18 nt, Shigella flexneri 2a str. 301
uaaucgucaguuuuucac

SEQ ID NO: 3950622 - RNA, 14 nt, Shigella flexneri 2a str. 301
uaaucgucaucagc

SEQ ID NO: 3950623 - RNA, 22 nt, Shigella flexneri 2a str. 301
uaaucguuggcagacguuuuuu

SEQ ID NO: 3950624 - RNA, 14 nt, Shigella flexneri 2a str. 301
uaaucuauauuucu

SEQ ID NO: 3950625 - RNA, 16 nt, Shigella flexneri 2a str. 301
uaaucucgccuuauca

SEQ ID NO: 3950626 - RNA, 18 nt, Shigella flexneri 2a str. 301
uaaucucugcuuucgcau

SEQ ID NO: 3950627 - RNA, 23 nt, Shigella flexneri 2a str. 301
uaaucugaauggcugcauuccuu

SEQ ID NO: 3950628 - RNA, 22 nt, Shigella flexneri 2a str. 301
uaaucuggauguucggcgucuu

SEQ ID NO: 3950629 - RNA, 14 nt, Shigella flexneri 2a str. 301
uaaucuguacugug

SEQ ID NO: 3950630 - RNA, 17 nt, Shigella flexneri 2a str. 301
uaaucuguuucaucucu

SEQ ID NO: 3950631 - RNA, 18 nt, Shigella flexneri 2a str. 301
uaaucuuccagaucaccg

SEQ ID NO: 3950632 - RNA, 13 nt, Shigella flexneri 2a str. 301
uaaucuuuaaaaa

SEQ ID NO: 3950633 - RNA, 20 nt, Shigella flexneri 2a str. 301
uaaucuuuaaaaaaagcauu

SEQ ID NO: 3950634 - RNA, 14 nt, Shigella flexneri 2a str. 301
uaaucuuuucauau

SEQ ID NO: 3950635 - RNA, 21 nt, Shigella flexneri 2a str. 301
uaaucuuuuugggguuuuaau

SEQ ID NO: 3950636 - RNA, 23 nt, Shigella flexneri 2a str. 301
uaaugaacuccggagaguauuau

SEQ ID NO: 3950637 - RNA, 11 nt, Shigella flexneri 2a str. 301
uaaugaaucau

SEQ ID NO: 3950638 - RNA, 14 nt, Shigella flexneri 2a str. 301
uaaugacccacccc

SEQ ID NO: 3950639 - RNA, 20 nt, Shigella flexneri 2a str. 301
uaaugagcaccgcaccuaaa

SEQ ID NO: 3950640 - RNA, 16 nt, Shigella flexneri 2a str. 301
uaaugauguaaaaaua

SEQ ID NO: 3950641 - RNA, 13 nt, Shigella flexneri 2a str. 301
uaaugcaucagcc

SEQ ID NO: 3950642 - RNA, 22 nt, Shigella flexneri 2a str. 301
uaaugccaaucuucacaucauc

SEQ ID NO: 3950643 - RNA, 13 nt, Shigella flexneri 2a str. 301
uaaugccacauua

SEQ ID NO: 3950644 - RNA, 13 nt, Shigella flexneri 2a str. 301
uaaugccaguccc

SEQ ID NO: 3950645 - RNA, 23 nt, Shigella flexneri 2a str. 301
uaaugcccgaugaccuugucaug

SEQ ID NO: 3950646 - RNA, 23 nt, Shigella flexneri 2a str. 301
uaaugccgacauaggccagccgc

SEQ ID NO: 3950647 - RNA, 16 nt, Shigella flexneri 2a str. 301
uaaugccucuccccag

SEQ ID NO: 3950648 - RNA, 22 nt, Shigella flexneri 2a str. 301
uaaugccugcacuuugugucag

SEQ ID NO: 3950649 - RNA, 22 nt, Shigella flexneri 2a str. 301
uaaugccugggcgauuuccuuc

SEQ ID NO: 3950650 - RNA, 14 nt, Shigella flexneri 2a str. 301
uaaugcgauuuuca

SEQ ID NO: 3950651 - RNA, 15 nt, Shigella flexneri 2a str. 301
uaaugcgcuuccugc

SEQ ID NO: 3950652 - RNA, 21 nt, Shigella flexneri 2a str. 301
uaaugcguaacguuucuuuca

SEQ ID NO: 3950653 - RNA, 15 nt, Shigella flexneri 2a str. 301
uaaugcugacaaaac

SEQ ID NO: 3950654 - RNA, 18 nt, Shigella flexneri 2a str. 301
uaaugcugugaagauggc

SEQ ID NO: 3950655 - RNA, 12 nt, Shigella flexneri 2a str. 301
uaaugcuucaca

SEQ ID NO: 3950656 - RNA, 22 nt, Shigella flexneri 2a str. 301
uaaugcuucuaccgucuguaac

SEQ ID NO: 3950657 - RNA, 12 nt, Shigella flexneri 2a str. 301
uaauggaaaacu

SEQ ID NO: 3950658 - RNA, 17 nt, Shigella flexneri 2a str. 301
uaauggcgauaaucgaa

SEQ ID NO: 3950659 - RNA, 13 nt, Shigella flexneri 2a str. 301
uaauggcgcgggu

SEQ ID NO: 3950660 - RNA, 22 nt, Shigella flexneri 2a str. 301
uaaugguccgugacccggaaua

SEQ ID NO: 3950661 - RNA, 17 nt, Shigella flexneri 2a str. 301
uaauggucgagcgacag

SEQ ID NO: 3950662 - RNA, 14 nt, Shigella flexneri 2a str. 301
uaauguguucaacu

SEQ ID NO: 3950663 - RNA, 22 nt, Shigella flexneri 2a str. 301
uaauguuguaagcuugacauau

SEQ ID NO: 3950664 - RNA, 13 nt, Shigella flexneri 2a str. 301
uacagaugcugcu

SEQ ID NO: 3950665 - RNA, 20 nt, Shigella flexneri 2a str. 301
uacagcaauggaaaaaguuu

SEQ ID NO: 3950666 - RNA, 16 nt, Shigella flexneri 2a str. 301
uacagcagguguuacc

SEQ ID NO: 3950667 - RNA, 21 nt, Shigella flexneri 2a str. 301
uacagcaguacgccgagaaua

SEQ ID NO: 3950668 - RNA, 14 nt, Shigella flexneri 2a str. 301
uacagcauuuccuu

SEQ ID NO: 3950669 - RNA, 18 nt, Shigella flexneri 2a str. 301
uacagccaaaucaucagu

SEQ ID NO: 3950670 - RNA, 17 nt, Shigella flexneri 2a str. 301
uacagccgacaaugcca

SEQ ID NO: 3950671 - RNA, 18 nt, Shigella flexneri 2a str. 301
uacagccgacaaugccac

SEQ ID NO: 3950672 - RNA, 22 nt, Shigella flexneri 2a str. 301
uacagccgacaaugccacaaac

SEQ ID NO: 3950673 - RNA, 17 nt, Shigella flexneri 2a str. 301
uacagccugccagcaug

SEQ ID NO: 3950674 - RNA, 19 nt, Shigella flexneri 2a str. 301
uacagccugccagcaugca

SEQ ID NO: 3950675 - RNA, 17 nt, Shigella flexneri 2a str. 301
uacagccuuaacaagau

SEQ ID NO: 3950676 - RNA, 15 nt, Shigella flexneri 2a str. 301
uacagcgaaacauac

SEQ ID NO: 3950677 - RNA, 23 nt, Shigella flexneri 2a str. 301
uacagcgcggaccccacgcucuc

SEQ ID NO: 3950678 - RNA, 14 nt, Shigella flexneri 2a str. 301
uacagcgcgggcug

SEQ ID NO: 3950679 - RNA, 15 nt, Shigella flexneri 2a str. 301
uacagcggccaacca

SEQ ID NO: 3950680 - RNA, 13 nt, Shigella flexneri 2a str. 301
uacagcucgguau

SEQ ID NO: 3950681 - RNA, 13 nt, Shigella flexneri 2a str. 301
uacagcuggagua

SEQ ID NO: 3950682 - RNA, 22 nt, Shigella flexneri 2a str. 301
uacagcuuagcgccuucuacag

SEQ ID NO: 3950683 - RNA, 22 nt, Shigella flexneri 2a str. 301
uacagcuucacgcgccagcuua

SEQ ID NO: 3950684 - RNA, 14 nt, Shigella flexneri 2a str. 301
uacaggauauauuu

SEQ ID NO: 3950685 - RNA, 17 nt, Shigella flexneri 2a str. 301
uacaggauauauuucau

SEQ ID NO: 3950686 - RNA, 12 nt, Shigella flexneri 2a str. 301
uacaggcacaug

SEQ ID NO: 3950687 - RNA, 16 nt, Shigella flexneri 2a str. 301
uacaggcagcuuagaa

SEQ ID NO: 3950688 - RNA, 16 nt, Shigella flexneri 2a str. 301
uacaggcaguaaccaa

SEQ ID NO: 3950689 - RNA, 17 nt, Shigella flexneri 2a str. 301
uacaggcugguuucucu

SEQ ID NO: 3950690 - RNA, 19 nt, Shigella flexneri 2a str. 301
uacaguaugagcaaacaau

SEQ ID NO: 3950691 - RNA, 18 nt, Shigella flexneri 2a str. 301
uacagucuggcgaacucu

SEQ ID NO: 3950692 - RNA, 11 nt, Shigella flexneri 2a str. 301
uacauacugag

SEQ ID NO: 3950693 - RNA, 14 nt, Shigella flexneri 2a str. 301
uacauauauuacaa

SEQ ID NO: 3950694 - RNA, 12 nt, Shigella flexneri 2a str. 301
uacaucaccgcc

SEQ ID NO: 3950695 - RNA, 20 nt, Shigella flexneri 2a str. 301
uacaucaucacugccaggag

SEQ ID NO: 3950696 - RNA, 17 nt, Shigella flexneri 2a str. 301
uacaucuacaaaaaacu

SEQ ID NO: 3950697 - RNA, 22 nt, Shigella flexneri 2a str. 301
uacaucuuaaucuuagguaaug

SEQ ID NO: 3950698 - RNA, 15 nt, Shigella flexneri 2a str. 301
uacaucuucaucauc

SEQ ID NO: 3950699 - RNA, 18 nt, Shigella flexneri 2a str. 301
uacaucuuccacuuugau

SEQ ID NO: 3950700 - RNA, 18 nt, Shigella flexneri 2a str. 301
uacaugaagcacugcauc

SEQ ID NO: 3950701 - RNA, 12 nt, Shigella flexneri 2a str. 301
uacaugcagggc

SEQ ID NO: 3950702 - RNA, 17 nt, Shigella flexneri 2a str. 301
uacaugcgcgacaaaaa

SEQ ID NO: 3950703 - RNA, 20 nt, Shigella flexneri 2a str. 301
uacaugcgcgacaaaaauua

SEQ ID NO: 3950704 - RNA, 19 nt, Shigella flexneri 2a str. 301
uacauguucaaaaaaauca

SEQ ID NO: 3950705 - RNA, 21 nt, Shigella flexneri 2a str. 301
uacauuaucgcgucuaaauuu

SEQ ID NO: 3950706 - RNA, 19 nt, Shigella flexneri 2a str. 301
uacauugagaauaucggca

SEQ ID NO: 3950707 - RNA, 13 nt, Shigella flexneri 2a str. 301
uacauugccgggc

SEQ ID NO: 3950708 - RNA, 21 nt, Shigella flexneri 2a str. 301
uacauugccgggcgcaucaga

SEQ ID NO: 3950709 - RNA, 16 nt, Shigella flexneri 2a str. 301
uacauuguuuuccaga

SEQ ID NO: 3950710 - RNA, 11 nt, Shigella flexneri 2a str. 301
uacauuuugac

SEQ ID NO: 3950711 - RNA, 21 nt, Shigella flexneri 2a str. 301
uaccaaaaucaucaauugcca

SEQ ID NO: 3950712 - RNA, 13 nt, Shigella flexneri 2a str. 301
uaccaaaaugacu

SEQ ID NO: 3950713 - RNA, 18 nt, Shigella flexneri 2a str. 301
uaccaaaaugacuuaaua

SEQ ID NO: 3950714 - RNA, 20 nt, Shigella flexneri 2a str. 301
uaccaaaaugacuuaauaac

SEQ ID NO: 3950715 - RNA, 18 nt, Shigella flexneri 2a str. 301
uaccaaauuccagaaaag

SEQ ID NO: 3950716 - RNA, 18 nt, Shigella flexneri 2a str. 301
uaccaaauuggcaaaauu

SEQ ID NO: 3950717 - RNA, 17 nt, Shigella flexneri 2a str. 301
uaccaauaaacuucaau

SEQ ID NO: 3950718 - RNA, 22 nt, Shigella flexneri 2a str. 301
uaccaauaaacuucaauauauu

SEQ ID NO: 3950719 - RNA, 18 nt, Shigella flexneri 2a str. 301
uaccacagacaaaauccu

SEQ ID NO: 3950720 - RNA, 21 nt, Shigella flexneri 2a str. 301
uaccacagacaaaauccugcc

SEQ ID NO: 3950721 - RNA, 14 nt, Shigella flexneri 2a str. 301
uaccaccgacgugg

SEQ ID NO: 3950722 - RNA, 20 nt, Shigella flexneri 2a str. 301
uaccaccugcucgucauccg

SEQ ID NO: 3950723 - RNA, 17 nt, Shigella flexneri 2a str. 301
uaccacgcaaagcacgc

SEQ ID NO: 3950724 - RNA, 20 nt, Shigella flexneri 2a str. 301
uaccacgguacgccagagug

SEQ ID NO: 3950725 - RNA, 13 nt, Shigella flexneri 2a str. 301
uaccacuacauca

SEQ ID NO: 3950726 - RNA, 13 nt, Shigella flexneri 2a str. 301
uaccacuucaucc

SEQ ID NO: 3950727 - RNA, 15 nt, Shigella flexneri 2a str. 301
uaccacuuccagcag

SEQ ID NO: 3950728 - RNA, 19 nt, Shigella flexneri 2a str. 301
uaccacuuccagcagacca

SEQ ID NO: 3950729 - RNA, 17 nt, Shigella flexneri 2a str. 301
uaccagaccauacagug

SEQ ID NO: 3950730 - RNA, 18 nt, Shigella flexneri 2a str. 301
uaccagaccgcacaccga

SEQ ID NO: 3950731 - RNA, 19 nt, Shigella flexneri 2a str. 301
uaccagauaaucaccugcc

SEQ ID NO: 3950732 - RNA, 15 nt, Shigella flexneri 2a str. 301
uaccagaucucacca

SEQ ID NO: 3950733 - RNA, 18 nt, Shigella flexneri 2a str. 301
uaccagauuaauuauuga

SEQ ID NO: 3950734 - RNA, 23 nt, Shigella flexneri 2a str. 301
uaccagauuaauuauugauucca

SEQ ID NO: 3950735 - RNA, 20 nt, Shigella flexneri 2a str. 301
uaccagcaacgcuucaacca

SEQ ID NO: 3950736 - RNA, 20 nt, Shigella flexneri 2a str. 301
uaccagcaacugauggccca

SEQ ID NO: 3950737 - RNA, 11 nt, Shigella flexneri 2a str. 301
uaccagcagcg

SEQ ID NO: 3950738 - RNA, 19 nt, Shigella flexneri 2a str. 301
uaccagccagacacuguua

SEQ ID NO: 3950739 - RNA, 19 nt, Shigella flexneri 2a str. 301
uaccagcgacaucaccgcc

SEQ ID NO: 3950740 - RNA, 18 nt, Shigella flexneri 2a str. 301
uaccagcgaggucaaaau

SEQ ID NO: 3950741 - RNA, 20 nt, Shigella flexneri 2a str. 301
uaccaggcgaccguuuucac

SEQ ID NO: 3950742 - RNA, 19 nt, Shigella flexneri 2a str. 301
uaccaggcgguaugguaaa

SEQ ID NO: 3950743 - RNA, 16 nt, Shigella flexneri 2a str. 301
uaccaguacgcccacg

SEQ ID NO: 3950744 - RNA, 12 nt, Shigella flexneri 2a str. 301
uaccaguccuac

SEQ ID NO: 3950745 - RNA, 19 nt, Shigella flexneri 2a str. 301
uaccaguucgcuuuccguu

SEQ ID NO: 3950746 - RNA, 12 nt, Shigella flexneri 2a str. 301
uaccaucaccaa

SEQ ID NO: 3950747 - RNA, 15 nt, Shigella flexneri 2a str. 301
uaccaugcaccaacc

SEQ ID NO: 3950748 - RNA, 18 nt, Shigella flexneri 2a str. 301
uaccauggcucaccagca

SEQ ID NO: 3950749 - RNA, 22 nt, Shigella flexneri 2a str. 301
uaccauuaaucgauaaaccagc

SEQ ID NO: 3950750 - RNA, 17 nt, Shigella flexneri 2a str. 301
uaccauuuacaagcguu

SEQ ID NO: 3950751 - RNA, 21 nt, Shigella flexneri 2a str. 301
uacccaaacuuaacacugaga

SEQ ID NO: 3950752 - RNA, 18 nt, Shigella flexneri 2a str. 301
uacccaaaucgcccgguu

SEQ ID NO: 3950753 - RNA, 15 nt, Shigella flexneri 2a str. 301
uacccacugcgcagu

SEQ ID NO: 3950754 - RNA, 15 nt, Shigella flexneri 2a str. 301
uacccagcagcagcg

SEQ ID NO: 3950755 - RNA, 22 nt, Shigella flexneri 2a str. 301
uacccagcgaauccagcaugcu

SEQ ID NO: 3950756 - RNA, 13 nt, Shigella flexneri 2a str. 301
uaccccagucagg

SEQ ID NO: 3950757 - RNA, 17 nt, Shigella flexneri 2a str. 301
uaccccgccagcagaau

SEQ ID NO: 3950758 - RNA, 19 nt, Shigella flexneri 2a str. 301
uaccccgucaccacuucac

SEQ ID NO: 3950759 - RNA, 20 nt, Shigella flexneri 2a str. 301
uaccccucuauccagcucau

SEQ ID NO: 3950760 - RNA, 15 nt, Shigella flexneri 2a str. 301
uacccgaugcaaaaa

SEQ ID NO: 3950761 - RNA, 22 nt, Shigella flexneri 2a str. 301
uacccggccuguuuauccauca

SEQ ID NO: 3950762 - RNA, 17 nt, Shigella flexneri 2a str. 301
uacccugacccagaccg

SEQ ID NO: 3950763 - RNA, 17 nt, Shigella flexneri 2a str. 301
uacccugaucaaucacu

SEQ ID NO: 3950764 - RNA, 17 nt, Shigella flexneri 2a str. 301
uacgccagauuguguga

SEQ ID NO: 3950765 - RNA, 13 nt, Shigella flexneri 2a str. 301
uacgccagucacg

SEQ ID NO: 3950766 - RNA, 16 nt, Shigella flexneri 2a str. 301
uacgccauccggcgug

SEQ ID NO: 3950767 - RNA, 14 nt, Shigella flexneri 2a str. 301
uacgccaucgccag

SEQ ID NO: 3950768 - RNA, 14 nt, Shigella flexneri 2a str. 301
uacgcccacgccag

SEQ ID NO: 3950769 - RNA, 16 nt, Shigella flexneri 2a str. 301
uacgcccucgaucggc

SEQ ID NO: 3950770 - RNA, 16 nt, Shigella flexneri 2a str. 301
uacgccgagcgccagc

SEQ ID NO: 3950771 - RNA, 14 nt, Shigella flexneri 2a str. 301
uacgccgcagagcg

SEQ ID NO: 3950772 - RNA, 16 nt, Shigella flexneri 2a str. 301
uacgccgcauccaaca

SEQ ID NO: 3950773 - RNA, 18 nt, Shigella flexneri 2a str. 301
uacgccgcauccggcaua

SEQ ID NO: 3950774 - RNA, 14 nt, Shigella flexneri 2a str. 301
uacgcgaucguccg

SEQ ID NO: 3950775 - RNA, 21 nt, Shigella flexneri 2a str. 301
uacgcgccaaucggcaauuca

SEQ ID NO: 3950776 - RNA, 15 nt, Shigella flexneri 2a str. 301
uacgcgccccuucca

SEQ ID NO: 3950777 - RNA, 17 nt, Shigella flexneri 2a str. 301
uacgcgcccgcgcagcu

SEQ ID NO: 3950778 - RNA, 15 nt, Shigella flexneri 2a str. 301
uacgcgcucaccgcu

SEQ ID NO: 3950779 - RNA, 20 nt, Shigella flexneri 2a str. 301
uacgcguaaaacagccagcg

SEQ ID NO: 3950780 - RNA, 22 nt, Shigella flexneri 2a str. 301
uacgcguaaaacagccagcgcu

SEQ ID NO: 3950781 - RNA, 19 nt, Shigella flexneri 2a str. 301
uacgcucacgcgcugccuc

SEQ ID NO: 3950782 - RNA, 14 nt, Shigella flexneri 2a str. 301
uacgcucacugcaa

SEQ ID NO: 3950783 - RNA, 15 nt, Shigella flexneri 2a str. 301
uacgcucacugcaaa

SEQ ID NO: 3950784 - RNA, 16 nt, Shigella flexneri 2a str. 301
uacgcucaucggcaua

SEQ ID NO: 3950785 - RNA, 13 nt, Shigella flexneri 2a str. 301
uacgcuccagcag

SEQ ID NO: 3950786 - RNA, 13 nt, Shigella flexneri 2a str. 301
uacgcuuaucagg

SEQ ID NO: 3950787 - RNA, 23 nt, Shigella flexneri 2a str. 301
uacgcuuaucaggccuacaaaau

SEQ ID NO: 3950788 - RNA, 16 nt, Shigella flexneri 2a str. 301
uacgcuugccggacau

SEQ ID NO: 3950789 - RNA, 21 nt, Shigella flexneri 2a str. 301
uacggauagcagaaaacucac

SEQ ID NO: 3950790 - RNA, 19 nt, Shigella flexneri 2a str. 301
uacggauauguuuacuucu

SEQ ID NO: 3950791 - RNA, 14 nt, Shigella flexneri 2a str. 301
uacggaucuuuucu

SEQ ID NO: 3950792 - RNA, 23 nt, Shigella flexneri 2a str. 301
uacggcaaaagaauaucagagcc

SEQ ID NO: 3950793 - RNA, 12 nt, Shigella flexneri 2a str. 301
uacggcagugaa

SEQ ID NO: 3950794 - RNA, 13 nt, Shigella flexneri 2a str. 301
uacggcauucugc

SEQ ID NO: 3950795 - RNA, 14 nt, Shigella flexneri 2a str. 301
uacggcccagaccc

SEQ ID NO: 3950796 - RNA, 20 nt, Shigella flexneri 2a str. 301
uacggcuccgcaagcgaaug

SEQ ID NO: 3950797 - RNA, 15 nt, Shigella flexneri 2a str. 301
uacggcugcggaugu

SEQ ID NO: 3950798 - RNA, 17 nt, Shigella flexneri 2a str. 301
uacgggaggucaucagc

SEQ ID NO: 3950799 - RNA, 21 nt, Shigella flexneri 2a str. 301
uacgggcaauuucacguucac

SEQ ID NO: 3950800 - RNA, 19 nt, Shigella flexneri 2a str. 301
uacggguucaagucccguc

SEQ ID NO: 3950801 - RNA, 13 nt, Shigella flexneri 2a str. 301
uacgguggaacau

SEQ ID NO: 3950802 - RNA, 19 nt, Shigella flexneri 2a str. 301
uacgguguucacucaucaa

SEQ ID NO: 3950803 - RNA, 11 nt, Shigella flexneri 2a str. 301
uacguaaccca

SEQ ID NO: 3950804 - RNA, 14 nt, Shigella flexneri 2a str. 301
uacguaaugcucau

SEQ ID NO: 3950805 - RNA, 13 nt, Shigella flexneri 2a str. 301
uacguaauucacc

SEQ ID NO: 3950806 - RNA, 15 nt, Shigella flexneri 2a str. 301
uacguaauuuauaau

SEQ ID NO: 3950807 - RNA, 17 nt, Shigella flexneri 2a str. 301
uacgucagcgucauaca

SEQ ID NO: 3950808 - RNA, 13 nt, Shigella flexneri 2a str. 301
uacgucaucccaa

SEQ ID NO: 3950809 - RNA, 15 nt, Shigella flexneri 2a str. 301
uacguccaccccagc

SEQ ID NO: 3950810 - RNA, 12 nt, Shigella flexneri 2a str. 301
uacgucgagaau

SEQ ID NO: 3950811 - RNA, 23 nt, Shigella flexneri 2a str. 301
uacgucggcaucgggcagcaucg

SEQ ID NO: 3950812 - RNA, 15 nt, Shigella flexneri 2a str. 301
uacgugaggcaucag

SEQ ID NO: 3950813 - RNA, 15 nt, Shigella flexneri 2a str. 301
uacgugcacaggcaa

SEQ ID NO: 3950814 - RNA, 23 nt, Shigella flexneri 2a str. 301
uacguggguaggaucaguauggg

SEQ ID NO: 3950815 - RNA, 22 nt, Shigella flexneri 2a str. 301
uacguucauggcgcgacauggc

SEQ ID NO: 3950816 - RNA, 18 nt, Shigella flexneri 2a str. 301
uacguuccuuuacgguga

SEQ ID NO: 3950817 - RNA, 13 nt, Shigella flexneri 2a str. 301
uacguuuuuauug

SEQ ID NO: 3950818 - RNA, 12 nt, Shigella flexneri 2a str. 301
uacuaaaaagcg

SEQ ID NO: 3950819 - RNA, 17 nt, Shigella flexneri 2a str. 301
uacuaaaugugcaauca

SEQ ID NO: 3950820 - RNA, 23 nt, Shigella flexneri 2a str. 301
uacuaauaaaucgugaaacaauc

SEQ ID NO: 3950821 - RNA, 15 nt, Shigella flexneri 2a str. 301
uacuaaucucaccca

SEQ ID NO: 3950822 - RNA, 18 nt, Shigella flexneri 2a str. 301
uacuagccugcucccuua

SEQ ID NO: 3950823 - RNA, 11 nt, Shigella flexneri 2a str. 301
uacuaucugcu

SEQ ID NO: 3950824 - RNA, 21 nt, Shigella flexneri 2a str. 301
uacuaugauuuuccugaggag

SEQ ID NO: 3950825 - RNA, 14 nt, Shigella flexneri 2a str. 301
uacucaagcagcca

SEQ ID NO: 3950826 - RNA, 20 nt, Shigella flexneri 2a str. 301
uacucagcaacuuccugcuu

SEQ ID NO: 3950827 - RNA, 18 nt, Shigella flexneri 2a str. 301
uacucagcgccugcugca

SEQ ID NO: 3950828 - RNA, 16 nt, Shigella flexneri 2a str. 301
uacuccaacccggcag

SEQ ID NO: 3950829 - RNA, 14 nt, Shigella flexneri 2a str. 301
uacuccggcagcca

SEQ ID NO: 3950830 - RNA, 15 nt, Shigella flexneri 2a str. 301
uacuccggcagccag

SEQ ID NO: 3950831 - RNA, 13 nt, Shigella flexneri 2a str. 301
uacuccuuagcaa

SEQ ID NO: 3950832 - RNA, 22 nt, Shigella flexneri 2a str. 301
uacucgaggcauuggcaaauuu

SEQ ID NO: 3950833 - RNA, 16 nt, Shigella flexneri 2a str. 301
uacucuccuccagguu

SEQ ID NO: 3950834 - RNA, 16 nt, Shigella flexneri 2a str. 301
uacucuccugcggcga

SEQ ID NO: 3950835 - RNA, 16 nt, Shigella flexneri 2a str. 301
uacucucgcuccaguu

SEQ ID NO: 3950836 - RNA, 23 nt, Shigella flexneri 2a str. 301
uacucuuaucaaacgacagcgug

SEQ ID NO: 3950837 - RNA, 19 nt, Shigella flexneri 2a str. 301
uacucuuugaacagccaga

SEQ ID NO: 3950838 - RNA, 14 nt, Shigella flexneri 2a str. 301
uacugaaccacgga

SEQ ID NO: 3950839 - RNA, 15 nt, Shigella flexneri 2a str. 301
uacugaaggcgcauu

SEQ ID NO: 3950840 - RNA, 16 nt, Shigella flexneri 2a str. 301
uacugacaaacugcgc

SEQ ID NO: 3950841 - RNA, 21 nt, Shigella flexneri 2a str. 301
uacugacaauuugcccaugua

SEQ ID NO: 3950842 - RNA, 11 nt, Shigella flexneri 2a str. 301
uacugacauca

SEQ ID NO: 3950843 - RNA, 16 nt, Shigella flexneri 2a str. 301
uacugacaucaaaccc

SEQ ID NO: 3950844 - RNA, 21 nt, Shigella flexneri 2a str. 301
uacugacggaucccgccaaca

SEQ ID NO: 3950845 - RNA, 23 nt, Shigella flexneri 2a str. 301
uacugacuagaugugcaguuccu

SEQ ID NO: 3950846 - RNA, 20 nt, Shigella flexneri 2a str. 301
uacugagaacgcaauggucg

SEQ ID NO: 3950847 - RNA, 14 nt, Shigella flexneri 2a str. 301
uacugagcaaggca

SEQ ID NO: 3950848 - RNA, 23 nt, Shigella flexneri 2a str. 301
uacugaggccggaugucgcugcu

SEQ ID NO: 3950849 - RNA, 18 nt, Shigella flexneri 2a str. 301
uacugauaauuuuuucac

SEQ ID NO: 3950850 - RNA, 22 nt, Shigella flexneri 2a str. 301
uacugauaguguuuuauguuca

SEQ ID NO: 3950851 - RNA, 14 nt, Shigella flexneri 2a str. 301
uacugaucaucauu

SEQ ID NO: 3950852 - RNA, 16 nt, Shigella flexneri 2a str. 301
uacugauguuugucac

SEQ ID NO: 3950853 - RNA, 16 nt, Shigella flexneri 2a str. 301
uacugcauucaccagu

SEQ ID NO: 3950854 - RNA, 22 nt, Shigella flexneri 2a str. 301
uacugccgaacagaaugcacgu

SEQ ID NO: 3950855 - RNA, 15 nt, Shigella flexneri 2a str. 301
uacugccuugaugaa

SEQ ID NO: 3950856 - RNA, 21 nt, Shigella flexneri 2a str. 301
uacugcucagacggugaccag

SEQ ID NO: 3950857 - RNA, 15 nt, Shigella flexneri 2a str. 301
uacuggaauuucauu

SEQ ID NO: 3950858 - RNA, 17 nt, Shigella flexneri 2a str. 301
uacuggaguuauucauu

SEQ ID NO: 3950859 - RNA, 23 nt, Shigella flexneri 2a str. 301
uacuggcaccgaagcccaucagu

SEQ ID NO: 3950860 - RNA, 17 nt, Shigella flexneri 2a str. 301
uacuggcagggaucuga

SEQ ID NO: 3950861 - RNA, 17 nt, Shigella flexneri 2a str. 301
uacuggcgauugucauu

SEQ ID NO: 3950862 - RNA, 16 nt, Shigella flexneri 2a str. 301
uacuggcgguuuucuu

SEQ ID NO: 3950863 - RNA, 15 nt, Shigella flexneri 2a str. 301
uacuggcuuucauuu

SEQ ID NO: 3950864 - RNA, 16 nt, Shigella flexneri 2a str. 301
uacuggugcaaaaccu

SEQ ID NO: 3950865 - RNA, 17 nt, Shigella flexneri 2a str. 301
uagccgaugccgcugca

SEQ ID NO: 3950866 - RNA, 23 nt, Shigella flexneri 2a str. 301
uagccgccagcucuuuaaacacg

SEQ ID NO: 3950867 - RNA, 17 nt, Shigella flexneri 2a str. 301
uagccgcggaucacgcg

SEQ ID NO: 3950868 - RNA, 18 nt, Shigella flexneri 2a str. 301
uagccgcuuggcaagccc

SEQ ID NO: 3950869 - RNA, 22 nt, Shigella flexneri 2a str. 301
uagccgcuuuuucugcgcacac

SEQ ID NO: 3950870 - RNA, 23 nt, Shigella flexneri 2a str. 301
uagccgcuuuuucugcgcacaca

SEQ ID NO: 3950871 - RNA, 15 nt, Shigella flexneri 2a str. 301
uagccgguuuuucaa

SEQ ID NO: 3950872 - RNA, 22 nt, Shigella flexneri 2a str. 301
uagccguggcaaccuucuucuu

SEQ ID NO: 3950873 - RNA, 11 nt, Shigella flexneri 2a str. 301
uagccugccag

SEQ ID NO: 3950874 - RNA, 18 nt, Shigella flexneri 2a str. 301
uagccugccagaggagcc

SEQ ID NO: 3950875 - RNA, 14 nt, Shigella flexneri 2a str. 301
uagccugcucccuu

SEQ ID NO: 3950876 - RNA, 17 nt, Shigella flexneri 2a str. 301
uagccuguccacaccca

SEQ ID NO: 3950877 - RNA, 19 nt, Shigella flexneri 2a str. 301
uagcgaauaaaguagaaau

SEQ ID NO: 3950878 - RNA, 21 nt, Shigella flexneri 2a str. 301
uagcgaauuuuucgagggugc

SEQ ID NO: 3950879 - RNA, 16 nt, Shigella flexneri 2a str. 301
uagcgcaucacuucca

SEQ ID NO: 3950880 - RNA, 14 nt, Shigella flexneri 2a str. 301
uagcgcaucaggca

SEQ ID NO: 3950881 - RNA, 19 nt, Shigella flexneri 2a str. 301
uagcgcaugaccagugagg

SEQ ID NO: 3950882 - RNA, 22 nt, Shigella flexneri 2a str. 301
uagcgcccuuucagcgccuuca

SEQ ID NO: 3950883 - RNA, 15 nt, Shigella flexneri 2a str. 301
uagcgccguuuuuau

SEQ ID NO: 3950884 - RNA, 16 nt, Shigella flexneri 2a str. 301
uagcgcggugcugaaa

SEQ ID NO: 3950885 - RNA, 14 nt, Shigella flexneri 2a str. 301
uagcgcugcugcac

SEQ ID NO: 3950886 - RNA, 18 nt, Shigella flexneri 2a str. 301
uagcgcuuguaggaauca

SEQ ID NO: 3950887 - RNA, 21 nt, Shigella flexneri 2a str. 301
uagcggaaaucuccagauaau

SEQ ID NO: 3950888 - RNA, 21 nt, Shigella flexneri 2a str. 301
uagcggacucaccgagcagca

SEQ ID NO: 3950889 - RNA, 13 nt, Shigella flexneri 2a str. 301
uagcggagcaauu

SEQ ID NO: 3950890 - RNA, 16 nt, Shigella flexneri 2a str. 301
uagcggcaagagaauu

SEQ ID NO: 3950891 - RNA, 19 nt, Shigella flexneri 2a str. 301
uagcggcaggaaaaaagcg

SEQ ID NO: 3950892 - RNA, 16 nt, Shigella flexneri 2a str. 301
uagcggcggcagauug

SEQ ID NO: 3950893 - RNA, 15 nt, Shigella flexneri 2a str. 301
uagcggcucuggcuc

SEQ ID NO: 3950894 - RNA, 15 nt, Shigella flexneri 2a str. 301
uagcguaaggauuau

SEQ ID NO: 3950895 - RNA, 15 nt, Shigella flexneri 2a str. 301
uagcgucguggcaaa

SEQ ID NO: 3950896 - RNA, 16 nt, Shigella flexneri 2a str. 301
uagcgugaaacgcguu

SEQ ID NO: 3950897 - RNA, 16 nt, Shigella flexneri 2a str. 301
uagcgugacaccagca

SEQ ID NO: 3950898 - RNA, 18 nt, Shigella flexneri 2a str. 301
uagcguguugauuauaau

SEQ ID NO: 3950899 - RNA, 18 nt, Shigella flexneri 2a str. 301
uagcguuaaucaucaacu

SEQ ID NO: 3950900 - RNA, 17 nt, Shigella flexneri 2a str. 301
uagcguuaauggcagau

SEQ ID NO: 3950901 - RNA, 17 nt, Shigella flexneri 2a str. 301
uagcuaacgaaagaaca

SEQ ID NO: 3950902 - RNA, 19 nt, Shigella flexneri 2a str. 301
uagcuaauuuuuguuguuu

SEQ ID NO: 3950903 - RNA, 19 nt, Shigella flexneri 2a str. 301
uagcucaaaguaaucaagc

SEQ ID NO: 3950904 - RNA, 15 nt, Shigella flexneri 2a str. 301
uagcuggugacaaag

SEQ ID NO: 3950905 - RNA, 21 nt, Shigella flexneri 2a str. 301
uagcuguuguaaugauuuaau

SEQ ID NO: 3950906 - RNA, 20 nt, Shigella flexneri 2a str. 301
uagcuucagccgggaagaau

SEQ ID NO: 3950907 - RNA, 18 nt, Shigella flexneri 2a str. 301
uagcuucgaaguuuucac

SEQ ID NO: 3950908 - RNA, 13 nt, Shigella flexneri 2a str. 301
uagcuuggcagag

SEQ ID NO: 3950909 - RNA, 14 nt, Shigella flexneri 2a str. 301
uagcuuuaauccau

SEQ ID NO: 3950910 - RNA, 21 nt, Shigella flexneri 2a str. 301
uaggacagcguugccagcucg

SEQ ID NO: 3950911 - RNA, 15 nt, Shigella flexneri 2a str. 301
uaggacgaaaaauca

SEQ ID NO: 3950912 - RNA, 16 nt, Shigella flexneri 2a str. 301
uaggacgaaaaaucaa

SEQ ID NO: 3950913 - RNA, 17 nt, Shigella flexneri 2a str. 301
uaggacgaaaaaucaau

SEQ ID NO: 3950914 - RNA, 17 nt, Shigella flexneri 2a str. 301
uaggagguuuccggguc

SEQ ID NO: 3950915 - RNA, 22 nt, Shigella flexneri 2a str. 301
uaggagucacucgacagcaccg

SEQ ID NO: 3950916 - RNA, 15 nt, Shigella flexneri 2a str. 301
uaggauacuuaucug

SEQ ID NO: 3950917 - RNA, 15 nt, Shigella flexneri 2a str. 301
uaggcaauuggcgca

SEQ ID NO: 3950918 - RNA, 23 nt, Shigella flexneri 2a str. 301
uaggcaauuggcgcaucaugccu

SEQ ID NO: 3950919 - RNA, 17 nt, Shigella flexneri 2a str. 301
uaggcaggauaaggcgu

SEQ ID NO: 3950920 - RNA, 14 nt, Shigella flexneri 2a str. 301
uaggcaucagcaau

SEQ ID NO: 3950921 - RNA, 18 nt, Shigella flexneri 2a str. 301
uaggccagauaagacgcg

SEQ ID NO: 3950922 - RNA, 18 nt, Shigella flexneri 2a str. 301
uaggccgcugaugccagg

SEQ ID NO: 3950923 - RNA, 12 nt, Shigella flexneri 2a str. 301
uaggccggauaa

SEQ ID NO: 3950924 - RNA, 13 nt, Shigella flexneri 2a str. 301
uaggcgucacauc

SEQ ID NO: 3950925 - RNA, 21 nt, Shigella flexneri 2a str. 301
uaggcuucuauaccaaugauu

SEQ ID NO: 3950926 - RNA, 14 nt, Shigella flexneri 2a str. 301
uagggaguuuaauc

SEQ ID NO: 3950927 - RNA, 14 nt, Shigella flexneri 2a str. 301
uagggaucaucuua

SEQ ID NO: 3950928 - RNA, 14 nt, Shigella flexneri 2a str. 301
uagguacaaagcca

SEQ ID NO: 3950929 - RNA, 15 nt, Shigella flexneri 2a str. 301
uaggucacaucaccg

SEQ ID NO: 3950930 - RNA, 20 nt, Shigella flexneri 2a str. 301
uagguccugaccaaagcccc

SEQ ID NO: 3950931 - RNA, 20 nt, Shigella flexneri 2a str. 301
uagguggcaaagaaauccac

SEQ ID NO: 3950932 - RNA, 22 nt, Shigella flexneri 2a str. 301
uaggugucaaccagccagcgcu

SEQ ID NO: 3950933 - RNA, 20 nt, Shigella flexneri 2a str. 301
uagguucucucagucuuucc

SEQ ID NO: 3950934 - RNA, 19 nt, Shigella flexneri 2a str. 301
uaguaaacgcguagaucuc

SEQ ID NO: 3950935 - RNA, 22 nt, Shigella flexneri 2a str. 301
uaguaaaugggccaacaccaga

SEQ ID NO: 3950936 - RNA, 18 nt, Shigella flexneri 2a str. 301
uaguaaauucacugccug

SEQ ID NO: 3950937 - RNA, 17 nt, Shigella flexneri 2a str. 301
uaguacccgaucacaac

SEQ ID NO: 3950938 - RNA, 18 nt, Shigella flexneri 2a str. 301
uaguagguccugaccaaa

SEQ ID NO: 3950939 - RNA, 12 nt, Shigella flexneri 2a str. 301
uaguaucuauuc

SEQ ID NO: 3950940 - RNA, 20 nt, Shigella flexneri 2a str. 301
uaguauggagcaggaauaua

SEQ ID NO: 3950941 - RNA, 13 nt, Shigella flexneri 2a str. 301
uaguauuaagcca

SEQ ID NO: 3950942 - RNA, 11 nt, Shigella flexneri 2a str. 301
uaguauuuauc

SEQ ID NO: 3950943 - RNA, 11 nt, Shigella flexneri 2a str. 301
uagucaccgcc

SEQ ID NO: 3950944 - RNA, 12 nt, Shigella flexneri 2a str. 301
uagucaucauca

SEQ ID NO: 3950945 - RNA, 13 nt, Shigella flexneri 2a str. 301
uagucaucaucag

SEQ ID NO: 3950946 - RNA, 18 nt, Shigella flexneri 2a str. 301
uagucaucaucaggaaca

SEQ ID NO: 3950947 - RNA, 15 nt, Shigella flexneri 2a str. 301
uagucaugaugacgc

SEQ ID NO: 3950948 - RNA, 20 nt, Shigella flexneri 2a str. 301
uaguccacacgccaggccac

SEQ ID NO: 3950949 - RNA, 15 nt, Shigella flexneri 2a str. 301
uagucccaaacagca

SEQ ID NO: 3950950 - RNA, 20 nt, Shigella flexneri 2a str. 301
uagucccuucgguagcagcu

SEQ ID NO: 3950951 - RNA, 14 nt, Shigella flexneri 2a str. 301
uagucgcuuucauu

SEQ ID NO: 3950952 - RNA, 20 nt, Shigella flexneri 2a str. 301
uagugaaaaagcucccuaaa

SEQ ID NO: 3950953 - RNA, 14 nt, Shigella flexneri 2a str. 301
uagugaaaucgcca

SEQ ID NO: 3950954 - RNA, 21 nt, Shigella flexneri 2a str. 301
uagugaugccauacuucauaa

SEQ ID NO: 3950955 - RNA, 22 nt, Shigella flexneri 2a str. 301
uagugaugccauacuucauaac

SEQ ID NO: 3950956 - RNA, 13 nt, Shigella flexneri 2a str. 301
uagugcaguacau

SEQ ID NO: 3950957 - RNA, 17 nt, Shigella flexneri 2a str. 301
uagugccgcacuugcca

SEQ ID NO: 3950958 - RNA, 16 nt, Shigella flexneri 2a str. 301
uagugccgucagcagg

SEQ ID NO: 3950959 - RNA, 12 nt, Shigella flexneri 2a str. 301
uagugucuuauc

SEQ ID NO: 3950960 - RNA, 13 nt, Shigella flexneri 2a str. 301
uagugugaucagc

SEQ ID NO: 3950961 - RNA, 15 nt, Shigella flexneri 2a str. 301
uagugugcaaucacu

SEQ ID NO: 3950962 - RNA, 13 nt, Shigella flexneri 2a str. 301
uaguguuccugcg

SEQ ID NO: 3950963 - RNA, 23 nt, Shigella flexneri 2a str. 301
uaguguuggaucugauccaacaa

SEQ ID NO: 3950964 - RNA, 17 nt, Shigella flexneri 2a str. 301
uaguguuuguauuagau

SEQ ID NO: 3950965 - RNA, 15 nt, Shigella flexneri 2a str. 301
uaucaguauacgcca

SEQ ID NO: 3950966 - RNA, 22 nt, Shigella flexneri 2a str. 301
uaucaguauacgccacaucauu

SEQ ID NO: 3950967 - RNA, 20 nt, Shigella flexneri 2a str. 301
uaucagugauauauuuuuaa

SEQ ID NO: 3950968 - RNA, 14 nt, Shigella flexneri 2a str. 301
uaucaguucagaag

SEQ ID NO: 3950969 - RNA, 22 nt, Shigella flexneri 2a str. 301
uaucaguucagaagcugaagca

SEQ ID NO: 3950970 - RNA, 13 nt, Shigella flexneri 2a str. 301
uaucaucauuauu

SEQ ID NO: 3950971 - RNA, 21 nt, Shigella flexneri 2a str. 301
uaucaucauuugcauacccag

SEQ ID NO: 3950972 - RNA, 17 nt, Shigella flexneri 2a str. 301
uaucaucggucagcguu

SEQ ID NO: 3950973 - RNA, 19 nt, Shigella flexneri 2a str. 301
uaucaugcuggauggcgca

SEQ ID NO: 3950974 - RNA, 22 nt, Shigella flexneri 2a str. 301
uaucauugcgugguuuuugcug

SEQ ID NO: 3950975 - RNA, 16 nt, Shigella flexneri 2a str. 301
uaucauuuugcugcca

SEQ ID NO: 3950976 - RNA, 15 nt, Shigella flexneri 2a str. 301
uauccaaaucgcagu

SEQ ID NO: 3950977 - RNA, 14 nt, Shigella flexneri 2a str. 301
uauccaccacccag

SEQ ID NO: 3950978 - RNA, 21 nt, Shigella flexneri 2a str. 301
uauccaccuccagcuccgcca

SEQ ID NO: 3950979 - RNA, 21 nt, Shigella flexneri 2a str. 301
uauccacgcgauacuuuuuca

SEQ ID NO: 3950980 - RNA, 21 nt, Shigella flexneri 2a str. 301
uauccacgucgacaacucccg

SEQ ID NO: 3950981 - RNA, 14 nt, Shigella flexneri 2a str. 301
uauccacugucaaa

SEQ ID NO: 3950982 - RNA, 17 nt, Shigella flexneri 2a str. 301
uauccagcaaagcguca

SEQ ID NO: 3950983 - RNA, 19 nt, Shigella flexneri 2a str. 301
uauccagcacgucgagcag

SEQ ID NO: 3950984 - RNA, 22 nt, Shigella flexneri 2a str. 301
uauccagcgcggcgaaggugcc

SEQ ID NO: 3950985 - RNA, 14 nt, Shigella flexneri 2a str. 301
uauccagcuucacu

SEQ ID NO: 3950986 - RNA, 20 nt, Shigella flexneri 2a str. 301
uauccaggcuaauccagucu

SEQ ID NO: 3950987 - RNA, 21 nt, Shigella flexneri 2a str. 301
uauccaguccgcgcuugccgc

SEQ ID NO: 3950988 - RNA, 13 nt, Shigella flexneri 2a str. 301
uauccaguuucug

SEQ ID NO: 3950989 - RNA, 13 nt, Shigella flexneri 2a str. 301
uauccauauggcu

SEQ ID NO: 3950990 - RNA, 19 nt, Shigella flexneri 2a str. 301
uauccauauggcugcauuc

SEQ ID NO: 3950991 - RNA, 20 nt, Shigella flexneri 2a str. 301
uauccaucaaagguuuuuca

SEQ ID NO: 3950992 - RNA, 20 nt, Shigella flexneri 2a str. 301
uauccauuugugacauuaac

SEQ ID NO: 3950993 - RNA, 17 nt, Shigella flexneri 2a str. 301
uauccccccaugaaaua

SEQ ID NO: 3950994 - RNA, 18 nt, Shigella flexneri 2a str. 301
uauccccccaugaaauaa

SEQ ID NO: 3950995 - RNA, 15 nt, Shigella flexneri 2a str. 301
uauccccugcgaugg

SEQ ID NO: 3950996 - RNA, 19 nt, Shigella flexneri 2a str. 301
uaucccgcgcguuuuucuu

SEQ ID NO: 3950997 - RNA, 16 nt, Shigella flexneri 2a str. 301
uaucccugcuguccug

SEQ ID NO: 3950998 - RNA, 15 nt, Shigella flexneri 2a str. 301
uauccgaaaaaggau

SEQ ID NO: 3950999 - RNA, 14 nt, Shigella flexneri 2a str. 301
uauccgacaucccg

SEQ ID NO: 3951000 - RNA, 15 nt, Shigella flexneri 2a str. 301
uauccggcuaacaaa

SEQ ID NO: 3951001 - RNA, 23 nt, Shigella flexneri 2a str. 301
uauccggugcaacugcuucaaaa

SEQ ID NO: 3951002 - RNA, 16 nt, Shigella flexneri 2a str. 301
uauccguaccuaaccu

SEQ ID NO: 3951003 - RNA, 16 nt, Shigella flexneri 2a str. 301
uauccucaguugucug

SEQ ID NO: 3951004 - RNA, 14 nt, Shigella flexneri 2a str. 301
uauccugauaaaaa

SEQ ID NO: 3951005 - RNA, 20 nt, Shigella flexneri 2a str. 301
uauccugcccacuccagcua

SEQ ID NO: 3951006 - RNA, 20 nt, Shigella flexneri 2a str. 301
uauccugucaguucguuuua

SEQ ID NO: 3951007 - RNA, 18 nt, Shigella flexneri 2a str. 301
uauccuucugcguuuuug

SEQ ID NO: 3951008 - RNA, 12 nt, Shigella flexneri 2a str. 301
uaucgaacaugc

SEQ ID NO: 3951009 - RNA, 14 nt, Shigella flexneri 2a str. 301
uaucgaaccagcgg

SEQ ID NO: 3951010 - RNA, 17 nt, Shigella flexneri 2a str. 301
uaucgauaaauggcgca

SEQ ID NO: 3951011 - RNA, 16 nt, Shigella flexneri 2a str. 301
uaucgaucacauccag

SEQ ID NO: 3951012 - RNA, 23 nt, Shigella flexneri 2a str. 301
uaucgauuucuacacccagcccc

SEQ ID NO: 3951013 - RNA, 20 nt, Shigella flexneri 2a str. 301
uaucgcaagucauuguccag

SEQ ID NO: 3951014 - RNA, 15 nt, Shigella flexneri 2a str. 301
uaucgccagcgccac

SEQ ID NO: 3951015 - RNA, 19 nt, Shigella flexneri 2a str. 301
uaucgccaggccagccugg

SEQ ID NO: 3951016 - RNA, 19 nt, Shigella flexneri 2a str. 301
uaucgcccugcuccagcaa

SEQ ID NO: 3951017 - RNA, 19 nt, Shigella flexneri 2a str. 301
uaucgcgaaaaaaaagaug

SEQ ID NO: 3951018 - RNA, 16 nt, Shigella flexneri 2a str. 301
uaucgcgauacaccag

SEQ ID NO: 3951019 - RNA, 16 nt, Shigella flexneri 2a str. 301
uaucgcgaugauuuuc

SEQ ID NO: 3951020 - RNA, 14 nt, Shigella flexneri 2a str. 301
uaucgcgcagaaau

SEQ ID NO: 3951021 - RNA, 17 nt, Shigella flexneri 2a str. 301
uaucgcgccagccagua

SEQ ID NO: 3951022 - RNA, 23 nt, Shigella flexneri 2a str. 301
uaucgcgguacuucucaccggua

SEQ ID NO: 3951023 - RNA, 16 nt, Shigella flexneri 2a str. 301
uaucgcguugaugauu

SEQ ID NO: 3951024 - RNA, 19 nt, Shigella flexneri 2a str. 301
uaucgcguugaugauuugu

SEQ ID NO: 3951025 - RNA, 18 nt, Shigella flexneri 2a str. 301
uaucgcugauauacccuu

SEQ ID NO: 3951026 - RNA, 21 nt, Shigella flexneri 2a str. 301
uaucgcugauauacccuucau

SEQ ID NO: 3951027 - RNA, 23 nt, Shigella flexneri 2a str. 301
uaucgcugauauacccuucauca

SEQ ID NO: 3951028 - RNA, 13 nt, Shigella flexneri 2a str. 301
uaucggagaacag

SEQ ID NO: 3951029 - RNA, 14 nt, Shigella flexneri 2a str. 301
uaucggccauaugu

SEQ ID NO: 3951030 - RNA, 13 nt, Shigella flexneri 2a str. 301
uaucggguuuguu

SEQ ID NO: 3951031 - RNA, 24 nt, Shigella flexneri 2a str. 301
uaucgugccuacacauuaucucaa

SEQ ID NO: 3951032 - RNA, 12 nt, Shigella flexneri 2a str. 301
uaucguucugcc

SEQ ID NO: 3951033 - RNA, 15 nt, Shigella flexneri 2a str. 301
uaucguucugccaga

SEQ ID NO: 3951034 - RNA, 19 nt, Shigella flexneri 2a str. 301
uaucuacagcauuuccuua

SEQ ID NO: 3951035 - RNA, 15 nt, Shigella flexneri 2a str. 301
uaucuauauacaauc

SEQ ID NO: 3951036 - RNA, 12 nt, Shigella flexneri 2a str. 301
uaucuauucauc

SEQ ID NO: 3951037 - RNA, 13 nt, Shigella flexneri 2a str. 301
uaucucaaaaauu

SEQ ID NO: 3951038 - RNA, 18 nt, Shigella flexneri 2a str. 301
uaucucagauaaaugcaa

SEQ ID NO: 3951039 - RNA, 18 nt, Shigella flexneri 2a str. 301
uaucuccagcuauaacgu

SEQ ID NO: 3951040 - RNA, 14 nt, Shigella flexneri 2a str. 301
uaucugaaucaaaa

SEQ ID NO: 3951041 - RNA, 15 nt, Shigella flexneri 2a str. 301
uaucugaaucaaaau

SEQ ID NO: 3951042 - RNA, 18 nt, Shigella flexneri 2a str. 301
uaucugcagauguuuuaa

SEQ ID NO: 3951043 - RNA, 18 nt, Shigella flexneri 2a str. 301
uaucugcagauuaugccu

SEQ ID NO: 3951044 - RNA, 20 nt, Shigella flexneri 2a str. 301
uaucugcuccguaaaacuca

SEQ ID NO: 3951045 - RNA, 19 nt, Shigella flexneri 2a str. 301
uaucugcugugguuugccc

SEQ ID NO: 3951046 - RNA, 17 nt, Shigella flexneri 2a str. 301
uaucuggcaagcaggac

SEQ ID NO: 3951047 - RNA, 17 nt, Shigella flexneri 2a str. 301
uaucuuacccuuccuua

SEQ ID NO: 3951048 - RNA, 12 nt, Shigella flexneri 2a str. 301
uaucuuauagac

SEQ ID NO: 3951049 - RNA, 14 nt, Shigella flexneri 2a str. 301
uaucuucaaucaga

SEQ ID NO: 3951050 - RNA, 10 nt, Shigella flexneri 2a str. 301
uaucuucaca

SEQ ID NO: 3951051 - RNA, 18 nt, Shigella flexneri 2a str. 301
uaucuucaccguucguga

SEQ ID NO: 3951052 - RNA, 13 nt, Shigella flexneri 2a str. 301
uaucuuccacuuc

SEQ ID NO: 3951053 - RNA, 19 nt, Shigella flexneri 2a str. 301
uaucuucccagccaaugca

SEQ ID NO: 3951054 - RNA, 13 nt, Shigella flexneri 2a str. 301
uaucuucccagcg

SEQ ID NO: 3951055 - RNA, 14 nt, Shigella flexneri 2a str. 301
uaucuucgauaaac

SEQ ID NO: 3951056 - RNA, 18 nt, Shigella flexneri 2a str. 301
uaucuuuacugauaauuu

SEQ ID NO: 3951057 - RNA, 16 nt, Shigella flexneri 2a str. 301
uaucuuucauauucaa

SEQ ID NO: 3951058 - RNA, 14 nt, Shigella flexneri 2a str. 301
uaugaaaauaggaa

SEQ ID NO: 3951059 - RNA, 18 nt, Shigella flexneri 2a str. 301
uaugaacacgaucucacg

SEQ ID NO: 3951060 - RNA, 18 nt, Shigella flexneri 2a str. 301
uaugaauagcggaaaucu

SEQ ID NO: 3951061 - RNA, 19 nt, Shigella flexneri 2a str. 301
uaugaaucuuuucaucgca

SEQ ID NO: 3951062 - RNA, 15 nt, Shigella flexneri 2a str. 301
uaugaaugauaaaau

SEQ ID NO: 3951063 - RNA, 19 nt, Shigella flexneri 2a str. 301
uaugaaugauaaaauucau

SEQ ID NO: 3951064 - RNA, 21 nt, Shigella flexneri 2a str. 301
uaugaauuacuucucuuuccc

SEQ ID NO: 3951065 - RNA, 20 nt, Shigella flexneri 2a str. 301
uauugaucgugggccggaga

SEQ ID NO: 3951066 - RNA, 14 nt, Shigella flexneri 2a str. 301
uauugaugcucacu

SEQ ID NO: 3951067 - RNA, 16 nt, Shigella flexneri 2a str. 301
uauugaugggaagccu

SEQ ID NO: 3951068 - RNA, 21 nt, Shigella flexneri 2a str. 301
uauugauucaucucuucuucc

SEQ ID NO: 3951069 - RNA, 17 nt, Shigella flexneri 2a str. 301
uauugauuuaacagcaa

SEQ ID NO: 3951070 - RNA, 22 nt, Shigella flexneri 2a str. 301
uauugcauuggguguaaacguu

SEQ ID NO: 3951071 - RNA, 18 nt, Shigella flexneri 2a str. 301
uauugcgaaguauggaaa

SEQ ID NO: 3951072 - RNA, 14 nt, Shigella flexneri 2a str. 301
uauugcgcaggcgc

SEQ ID NO: 3951073 - RNA, 17 nt, Shigella flexneri 2a str. 301
uauugcgcaugacacac

SEQ ID NO: 3951074 - RNA, 22 nt, Shigella flexneri 2a str. 301
uauugcguggcgauuugaguaa

SEQ ID NO: 3951075 - RNA, 17 nt, Shigella flexneri 2a str. 301
uauugcugaaauaacgu

SEQ ID NO: 3951076 - RNA, 12 nt, Shigella flexneri 2a str. 301
uauugcuguacu

SEQ ID NO: 3951077 - RNA, 15 nt, Shigella flexneri 2a str. 301
uauugcuucucaggu

SEQ ID NO: 3951078 - RNA, 15 nt, Shigella flexneri 2a str. 301
uauugguguugugaa

SEQ ID NO: 3951079 - RNA, 13 nt, Shigella flexneri 2a str. 301
uauuguagacaac

SEQ ID NO: 3951080 - RNA, 14 nt, Shigella flexneri 2a str. 301
uauuguguagccag

SEQ ID NO: 3951081 - RNA, 13 nt, Shigella flexneri 2a str. 301
uauuguuaaauau

SEQ ID NO: 3951082 - RNA, 16 nt, Shigella flexneri 2a str. 301
uauuguugaauuccga

SEQ ID NO: 3951083 - RNA, 20 nt, Shigella flexneri 2a str. 301
uauuuaccgcaugcucacag

SEQ ID NO: 3951084 - RNA, 17 nt, Shigella flexneri 2a str. 301
uauuuacgugaagaugc

SEQ ID NO: 3951085 - RNA, 18 nt, Shigella flexneri 2a str. 301
uauuuacgugaagaugcc

SEQ ID NO: 3951086 - RNA, 14 nt, Shigella flexneri 2a str. 301
uauuuauacaguga

SEQ ID NO: 3951087 - RNA, 16 nt, Shigella flexneri 2a str. 301
uauuuauccauaauuu

SEQ ID NO: 3951088 - RNA, 13 nt, Shigella flexneri 2a str. 301
uauuuauuauuaa

SEQ ID NO: 3951089 - RNA, 13 nt, Shigella flexneri 2a str. 301
uauuuauuuccuu

SEQ ID NO: 3951090 - RNA, 16 nt, Shigella flexneri 2a str. 301
uauuucacauaacugc

SEQ ID NO: 3951091 - RNA, 12 nt, Shigella flexneri 2a str. 301
uauuucaccagc

SEQ ID NO: 3951092 - RNA, 13 nt, Shigella flexneri 2a str. 301
uauuucagcccca

SEQ ID NO: 3951093 - RNA, 22 nt, Shigella flexneri 2a str. 301
uauuucauagauuaauuuccca

SEQ ID NO: 3951094 - RNA, 17 nt, Shigella flexneri 2a str. 301
uauuuccaccucccccu

SEQ ID NO: 3951095 - RNA, 15 nt, Shigella flexneri 2a str. 301
uauuuccagcucaac

SEQ ID NO: 3951096 - RNA, 20 nt, Shigella flexneri 2a str. 301
uauuuccagcucaaccagau

SEQ ID NO: 3951097 - RNA, 24 nt, Shigella flexneri 2a str. 301
uauuucccggccaacgauaauuca

SEQ ID NO: 3951098 - RNA, 18 nt, Shigella flexneri 2a str. 301
uauuuccggucgcaggca

SEQ ID NO: 3951099 - RNA, 16 nt, Shigella flexneri 2a str. 301
uauuucgaauuuucca

SEQ ID NO: 3951100 - RNA, 14 nt, Shigella flexneri 2a str. 301
uauuucgucagcau

SEQ ID NO: 3951101 - RNA, 16 nt, Shigella flexneri 2a str. 301
uauuucuauauccuca

SEQ ID NO: 3951102 - RNA, 16 nt, Shigella flexneri 2a str. 301
uauuucucacuuuucc

SEQ ID NO: 3951103 - RNA, 21 nt, Shigella flexneri 2a str. 301
uauuucucggcaaauucauua

SEQ ID NO: 3951104 - RNA, 14 nt, Shigella flexneri 2a str. 301
uauuucuugugcau

SEQ ID NO: 3951105 - RNA, 22 nt, Shigella flexneri 2a str. 301
uauuugacccgcaguaaaucag

SEQ ID NO: 3951106 - RNA, 21 nt, Shigella flexneri 2a str. 301
uauuugaggaguuuaauaaau

SEQ ID NO: 3951107 - RNA, 23 nt, Shigella flexneri 2a str. 301
uauuugaggaguuuaauaaauuu

SEQ ID NO: 3951108 - RNA, 18 nt, Shigella flexneri 2a str. 301
uauuugcaaaguuccuau

SEQ ID NO: 3951109 - RNA, 21 nt, Shigella flexneri 2a str. 301
uauuugcaccuaaagcgcgca

SEQ ID NO: 3951110 - RNA, 19 nt, Shigella flexneri 2a str. 301
uauuugcgucagcucacaa

SEQ ID NO: 3951111 - RNA, 14 nt, Shigella flexneri 2a str. 301
uauuuguucagcaa

SEQ ID NO: 3951112 - RNA, 17 nt, Shigella flexneri 2a str. 301
uauuuuacauccggcaa

SEQ ID NO: 3951113 - RNA, 13 nt, Shigella flexneri 2a str. 301
uauuuucaaucug

SEQ ID NO: 3951114 - RNA, 20 nt, Shigella flexneri 2a str. 301
uauuuuccgagguuaauauu

SEQ ID NO: 3951115 - RNA, 15 nt, Shigella flexneri 2a str. 301
uauuuugaauuugca

SEQ ID NO: 3951116 - RNA, 20 nt, Shigella flexneri 2a str. 301
uauuuugcccugcuaugcaa

SEQ ID NO: 3951117 - RNA, 18 nt, Shigella flexneri 2a str. 301
uauuuugcuuccggcaag

SEQ ID NO: 3951118 - RNA, 17 nt, Shigella flexneri 2a str. 301
uauuuugguaaugacuc

SEQ ID NO: 3951119 - RNA, 12 nt, Shigella flexneri 2a str. 301
uauuuuuaaaua

SEQ ID NO: 3951120 - RNA, 17 nt, Shigella flexneri 2a str. 301
uauuuuuaaccguauuu

SEQ ID NO: 3951121 - RNA, 13 nt, Shigella flexneri 2a str. 301
uauuuuucccuga

SEQ ID NO: 3951122 - RNA, 17 nt, Shigella flexneri 2a str. 301
uauuuuuuuaauuguga

SEQ ID NO: 3951123 - RNA, 22 nt, Shigella flexneri 2a str. 301
uauuuuuuugauaaucuucuuc

SEQ ID NO: 3951124 - RNA, 16 nt, Shigella flexneri 2a str. 301
ucaaaaaaacggcgcu

SEQ ID NO: 3951125 - RNA, 17 nt, Shigella flexneri 2a str. 301
ucaaaaaacuggaaaaa

SEQ ID NO: 3951126 - RNA, 14 nt, Shigella flexneri 2a str. 301
ucaaaaacaaagaa

SEQ ID NO: 3951127 - RNA, 16 nt, Shigella flexneri 2a str. 301
ucaaaaacuaauucac

SEQ ID NO: 3951128 - RNA, 13 nt, Shigella flexneri 2a str. 301
ucaaaaagcugua

SEQ ID NO: 3951129 - RNA, 15 nt, Shigella flexneri 2a str. 301
ucaaaacaaaaaccg

SEQ ID NO: 3951130 - RNA, 12 nt, Shigella flexneri 2a str. 301
ucaaaacaacac

SEQ ID NO: 3951131 - RNA, 16 nt, Shigella flexneri 2a str. 301
ucaaaacguccggcaa

SEQ ID NO: 3951132 - RNA, 17 nt, Shigella flexneri 2a str. 301
ucaaaauaauacacaca

SEQ ID NO: 3951133 - RNA, 20 nt, Shigella flexneri 2a str. 301
ucaaaauaucgacauucaau

SEQ ID NO: 3951134 - RNA, 20 nt, Shigella flexneri 2a str. 301
ucaaaaucaucaucuuuaua

SEQ ID NO: 3951135 - RNA, 22 nt, Shigella flexneri 2a str. 301
ucaaaaucaucaucuuuauaua

SEQ ID NO: 3951136 - RNA, 18 nt, Shigella flexneri 2a str. 301
ucaaacaacggcacuuca

SEQ ID NO: 3951137 - RNA, 22 nt, Shigella flexneri 2a str. 301
ucaaacagggcaauuaaaaauu

SEQ ID NO: 3951138 - RNA, 12 nt, Shigella flexneri 2a str. 301
ucaaacaguggu

SEQ ID NO: 3951139 - RNA, 16 nt, Shigella flexneri 2a str. 301
ucaaacaguucuggaa

SEQ ID NO: 3951140 - RNA, 22 nt, Shigella flexneri 2a str. 301
ucaaacauuagcgcaugaccag

SEQ ID NO: 3951141 - RNA, 13 nt, Shigella flexneri 2a str. 301
ucaaaccaauggc

SEQ ID NO: 3951142 - RNA, 20 nt, Shigella flexneri 2a str. 301
ucaaaccaauggcauuggca

SEQ ID NO: 3951143 - RNA, 18 nt, Shigella flexneri 2a str. 301
ucaaaccacuuaauuauu

SEQ ID NO: 3951144 - RNA, 22 nt, Shigella flexneri 2a str. 301
ucaaaccauucccugcuuugca

SEQ ID NO: 3951145 - RNA, 20 nt, Shigella flexneri 2a str. 301
ucaaaccguaguccauaccc

SEQ ID NO: 3951146 - RNA, 19 nt, Shigella flexneri 2a str. 301
ucaaacggcauaugccaug

SEQ ID NO: 3951147 - RNA, 18 nt, Shigella flexneri 2a str. 301
ucaaacggcguuuucuca

SEQ ID NO: 3951148 - RNA, 17 nt, Shigella flexneri 2a str. 301
ucaaacgguugauaaau

SEQ ID NO: 3951149 - RNA, 17 nt, Shigella flexneri 2a str. 301
ucaaacucggcuucgcu

SEQ ID NO: 3951150 - RNA, 14 nt, Shigella flexneri 2a str. 301
ucaaacucuucaca

SEQ ID NO: 3951151 - RNA, 16 nt, Shigella flexneri 2a str. 301
ucaaacucuucacacc

SEQ ID NO: 3951152 - RNA, 15 nt, Shigella flexneri 2a str. 301
ucaaacuucgucaca

SEQ ID NO: 3951153 - RNA, 18 nt, Shigella flexneri 2a str. 301
ucaaacuuuaauuuuuca

SEQ ID NO: 3951154 - RNA, 15 nt, Shigella flexneri 2a str. 301
ucaaacuuuuaaauu

SEQ ID NO: 3951155 - RNA, 16 nt, Shigella flexneri 2a str. 301
ucaaagacguuaaaaa

SEQ ID NO: 3951156 - RNA, 17 nt, Shigella flexneri 2a str. 301
ucaaagaugaugucaca

SEQ ID NO: 3951157 - RNA, 20 nt, Shigella flexneri 2a str. 301
ucaaagaugaugucacagcc

SEQ ID NO: 3951158 - RNA, 17 nt, Shigella flexneri 2a str. 301
ucaaagcgaucauguac

SEQ ID NO: 3951159 - RNA, 15 nt, Shigella flexneri 2a str. 301
ucaaagcgugccccc

SEQ ID NO: 3951160 - RNA, 15 nt, Shigella flexneri 2a str. 301
ucaaagcugcuuuuc

SEQ ID NO: 3951161 - RNA, 20 nt, Shigella flexneri 2a str. 301
ucaaaggcauuaaacgcaua

SEQ ID NO: 3951162 - RNA, 23 nt, Shigella flexneri 2a str. 301
ucaaaggcauuaaacgcauacau

SEQ ID NO: 3951163 - RNA, 16 nt, Shigella flexneri 2a str. 301
ucaaaggccgacagca

SEQ ID NO: 3951164 - RNA, 15 nt, Shigella flexneri 2a str. 301
ucaaaggcuucaacg

SEQ ID NO: 3951165 - RNA, 15 nt, Shigella flexneri 2a str. 301
ucacagaaggccagg

SEQ ID NO: 3951166 - RNA, 16 nt, Shigella flexneri 2a str. 301
ucacagaaggccagga

SEQ ID NO: 3951167 - RNA, 17 nt, Shigella flexneri 2a str. 301
ucacagaaggccaggau

SEQ ID NO: 3951168 - RNA, 16 nt, Shigella flexneri 2a str. 301
ucacagaagugaagca

SEQ ID NO: 3951169 - RNA, 21 nt, Shigella flexneri 2a str. 301
ucacagcuaaucaucaucagu

SEQ ID NO: 3951170 - RNA, 22 nt, Shigella flexneri 2a str. 301
ucacagcuaaucaucaucagug

SEQ ID NO: 3951171 - RNA, 17 nt, Shigella flexneri 2a str. 301
ucacaggcacaccgccg

SEQ ID NO: 3951172 - RNA, 21 nt, Shigella flexneri 2a str. 301
ucacagggcucuuaagcaccg

SEQ ID NO: 3951173 - RNA, 20 nt, Shigella flexneri 2a str. 301
ucacaggguggcccaaaugg

SEQ ID NO: 3951174 - RNA, 17 nt, Shigella flexneri 2a str. 301
ucacauaacggcccggc

SEQ ID NO: 3951175 - RNA, 18 nt, Shigella flexneri 2a str. 301
ucacauaaucgaaaacau

SEQ ID NO: 3951176 - RNA, 19 nt, Shigella flexneri 2a str. 301
ucacauaaucgaaaacauc

SEQ ID NO: 3951177 - RNA, 19 nt, Shigella flexneri 2a str. 301
ucacaucaccauaaaucag

SEQ ID NO: 3951178 - RNA, 20 nt, Shigella flexneri 2a str. 301
ucacaucaccauagccuaau

SEQ ID NO: 3951179 - RNA, 14 nt, Shigella flexneri 2a str. 301
ucacaucagcgcau

SEQ ID NO: 3951180 - RNA, 23 nt, Shigella flexneri 2a str. 301
ucacaucagcgcauuuaccaggc

SEQ ID NO: 3951181 - RNA, 18 nt, Shigella flexneri 2a str. 301
ucacauccaguacgccuu

SEQ ID NO: 3951182 - RNA, 13 nt, Shigella flexneri 2a str. 301
ucacaucccagca

SEQ ID NO: 3951183 - RNA, 21 nt, Shigella flexneri 2a str. 301
ucacauccggcaauauucauu

SEQ ID NO: 3951184 - RNA, 15 nt, Shigella flexneri 2a str. 301
ucacauccggccagu

SEQ ID NO: 3951185 - RNA, 21 nt, Shigella flexneri 2a str. 301
ucacaugcuggaaccacagcg

SEQ ID NO: 3951186 - RNA, 14 nt, Shigella flexneri 2a str. 301
ucacauuuaaacaa

SEQ ID NO: 3951187 - RNA, 16 nt, Shigella flexneri 2a str. 301
ucacauuuaaacaauu

SEQ ID NO: 3951188 - RNA, 18 nt, Shigella flexneri 2a str. 301
ucaccaaacuucagcccu

SEQ ID NO: 3951189 - RNA, 12 nt, Shigella flexneri 2a str. 301
ucaccaaaggca

SEQ ID NO: 3951190 - RNA, 19 nt, Shigella flexneri 2a str. 301
ucaccaaucggcagaacgg

SEQ ID NO: 3951191 - RNA, 22 nt, Shigella flexneri 2a str. 301
ucaccaaugaaagccccaccag

SEQ ID NO: 3951192 - RNA, 23 nt, Shigella flexneri 2a str. 301
ucaccaaugaaagccccaccagc

SEQ ID NO: 3951193 - RNA, 21 nt, Shigella flexneri 2a str. 301
ucaccaaugauaaguuucacu

SEQ ID NO: 3951194 - RNA, 17 nt, Shigella flexneri 2a str. 301
ucaccacagacaaacag

SEQ ID NO: 3951195 - RNA, 12 nt, Shigella flexneri 2a str. 301
ucaccacaucca

SEQ ID NO: 3951196 - RNA, 15 nt, Shigella flexneri 2a str. 301
ucaccaccagcaccg

SEQ ID NO: 3951197 - RNA, 22 nt, Shigella flexneri 2a str. 301
ucaccaccagcggaauaucaga

SEQ ID NO: 3951198 - RNA, 20 nt, Shigella flexneri 2a str. 301
ucaccacccagcgguaaaau

SEQ ID NO: 3951199 - RNA, 22 nt, Shigella flexneri 2a str. 301
ucaccacccguaaucaccacau

SEQ ID NO: 3951200 - RNA, 16 nt, Shigella flexneri 2a str. 301
ucaccacccugcccgu

SEQ ID NO: 3951201 - RNA, 15 nt, Shigella flexneri 2a str. 301
ucaccacgaaaacag

SEQ ID NO: 3951202 - RNA, 23 nt, Shigella flexneri 2a str. 301
ucaccacgaaaacagcggccacu

SEQ ID NO: 3951203 - RNA, 13 nt, Shigella flexneri 2a str. 301
ucaccacgcagca

SEQ ID NO: 3951204 - RNA, 17 nt, Shigella flexneri 2a str. 301
ucaccacgcagcagcca

SEQ ID NO: 3951205 - RNA, 19 nt, Shigella flexneri 2a str. 301
ucaccacgcagcagccaag

SEQ ID NO: 3951206 - RNA, 19 nt, Shigella flexneri 2a str. 301
ucaccacgcugagagaagc

SEQ ID NO: 3951207 - RNA, 17 nt, Shigella flexneri 2a str. 301
ucaccacugccagcggu

SEQ ID NO: 3951208 - RNA, 20 nt, Shigella flexneri 2a str. 301
ucaccagacaucccagugca

SEQ ID NO: 3951209 - RNA, 16 nt, Shigella flexneri 2a str. 301
ucaccagcaaauccag

SEQ ID NO: 3951210 - RNA, 12 nt, Shigella flexneri 2a str. 301
ucaccagcagcg

SEQ ID NO: 3951211 - RNA, 17 nt, Shigella flexneri 2a str. 301
ucaccagcaucagcgau

SEQ ID NO: 3951212 - RNA, 19 nt, Shigella flexneri 2a str. 301
ucaccagcgcgaggaucac

SEQ ID NO: 3951213 - RNA, 22 nt, Shigella flexneri 2a str. 301
ucaccagcgcgaggaucacgca

SEQ ID NO: 3951214 - RNA, 18 nt, Shigella flexneri 2a str. 301
ucaccagcugacguagca

SEQ ID NO: 3951215 - RNA, 16 nt, Shigella flexneri 2a str. 301
ucaccaggucaccaga

SEQ ID NO: 3951216 - RNA, 20 nt, Shigella flexneri 2a str. 301
ucaccaguaaggcaucuucu

SEQ ID NO: 3951217 - RNA, 17 nt, Shigella flexneri 2a str. 301
ucaccauauucagcagc

SEQ ID NO: 3951218 - RNA, 18 nt, Shigella flexneri 2a str. 301
ucaccauauucagcagca

SEQ ID NO: 3951219 - RNA, 19 nt, Shigella flexneri 2a str. 301
ucaccauauucagcagcag

SEQ ID NO: 3951220 - RNA, 15 nt, Shigella flexneri 2a str. 301
ucaccaucagcagca

SEQ ID NO: 3951221 - RNA, 14 nt, Shigella flexneri 2a str. 301
ucaccauccacgga

SEQ ID NO: 3951222 - RNA, 14 nt, Shigella flexneri 2a str. 301
ucaccaucuucacu

SEQ ID NO: 3951223 - RNA, 13 nt, Shigella flexneri 2a str. 301
ucaccauuagaca

SEQ ID NO: 3951224 - RNA, 15 nt, Shigella flexneri 2a str. 301
ucaccauuagacagu

SEQ ID NO: 3951225 - RNA, 17 nt, Shigella flexneri 2a str. 301
ucaccauuagacaguuu

SEQ ID NO: 3951226 - RNA, 14 nt, Shigella flexneri 2a str. 301
ucaccauuggcauu

SEQ ID NO: 3951227 - RNA, 14 nt, Shigella flexneri 2a str. 301
ucacccaacaugcc

SEQ ID NO: 3951228 - RNA, 13 nt, Shigella flexneri 2a str. 301
ucacccacaucag

SEQ ID NO: 3951229 - RNA, 18 nt, Shigella flexneri 2a str. 301
ucacccaccgauuuucag

SEQ ID NO: 3951230 - RNA, 15 nt, Shigella flexneri 2a str. 301
ucacccagacaaaau

SEQ ID NO: 3951231 - RNA, 18 nt, Shigella flexneri 2a str. 301
ucacccgcaaucaucgau

SEQ ID NO: 3951232 - RNA, 20 nt, Shigella flexneri 2a str. 301
ucacccggaggaaagcaccu

SEQ ID NO: 3951233 - RNA, 20 nt, Shigella flexneri 2a str. 301
ucaccgagcagcacaaugcc

SEQ ID NO: 3951234 - RNA, 15 nt, Shigella flexneri 2a str. 301
ucaccgccaccagcg

SEQ ID NO: 3951235 - RNA, 19 nt, Shigella flexneri 2a str. 301
ucaccgccacuaccaucag

SEQ ID NO: 3951236 - RNA, 14 nt, Shigella flexneri 2a str. 301
ucaccgccagcaag

SEQ ID NO: 3951237 - RNA, 16 nt, Shigella flexneri 2a str. 301
ucaccgccagcaucgg

SEQ ID NO: 3951238 - RNA, 20 nt, Shigella flexneri 2a str. 301
ucaccgccgagacauccacu

SEQ ID NO: 3951239 - RNA, 12 nt, Shigella flexneri 2a str. 301
ucaccgccgccu

SEQ ID NO: 3951240 - RNA, 21 nt, Shigella flexneri 2a str. 301
ucaccgccgccuuuuacgcau

SEQ ID NO: 3951241 - RNA, 20 nt, Shigella flexneri 2a str. 301
ucaccgcgaaauaaucaaau

SEQ ID NO: 3951242 - RNA, 21 nt, Shigella flexneri 2a str. 301
ucaccgcgguguauaccagcu

SEQ ID NO: 3951243 - RNA, 16 nt, Shigella flexneri 2a str. 301
ucaccgcgucuucgcu

SEQ ID NO: 3951244 - RNA, 15 nt, Shigella flexneri 2a str. 301
ucaccggcaaagcca

SEQ ID NO: 3951245 - RNA, 18 nt, Shigella flexneri 2a str. 301
ucaccggcguucccgucc

SEQ ID NO: 3951246 - RNA, 19 nt, Shigella flexneri 2a str. 301
ucaccggcuucucgccuac

SEQ ID NO: 3951247 - RNA, 20 nt, Shigella flexneri 2a str. 301
ucaccggguaggccugagaa

SEQ ID NO: 3951248 - RNA, 16 nt, Shigella flexneri 2a str. 301
ucaccggugagcugca

SEQ ID NO: 3951249 - RNA, 16 nt, Shigella flexneri 2a str. 301
ucaccgugauccccac

SEQ ID NO: 3951250 - RNA, 19 nt, Shigella flexneri 2a str. 301
ucaccguucaaagcgugcc

SEQ ID NO: 3951251 - RNA, 18 nt, Shigella flexneri 2a str. 301
ucaccguucagcuugcgu

SEQ ID NO: 3951252 - RNA, 17 nt, Shigella flexneri 2a str. 301
ucaccguucgcuggaag

SEQ ID NO: 3951253 - RNA, 19 nt, Shigella flexneri 2a str. 301
ucaccguugccaaccugaa

SEQ ID NO: 3951254 - RNA, 21 nt, Shigella flexneri 2a str. 301
ucaccuccagcgaaggaucac

SEQ ID NO: 3951255 - RNA, 22 nt, Shigella flexneri 2a str. 301
ucaccucuucagcguccaucca

SEQ ID NO: 3951256 - RNA, 14 nt, Shigella flexneri 2a str. 301
ucaccucuuuggcg

SEQ ID NO: 3951257 - RNA, 17 nt, Shigella flexneri 2a str. 301
ucaccucuuuuuccacu

SEQ ID NO: 3951258 - RNA, 21 nt, Shigella flexneri 2a str. 301
ucaccugaugcccguacgcug

SEQ ID NO: 3951259 - RNA, 18 nt, Shigella flexneri 2a str. 301
ucaccugcauacaaauaa

SEQ ID NO: 3951260 - RNA, 12 nt, Shigella flexneri 2a str. 301
ucaccugccagg

SEQ ID NO: 3951261 - RNA, 18 nt, Shigella flexneri 2a str. 301
ucaccugcgccugcgguu

SEQ ID NO: 3951262 - RNA, 23 nt, Shigella flexneri 2a str. 301
ucaccugcgucuuucgcggcaac

SEQ ID NO: 3951263 - RNA, 17 nt, Shigella flexneri 2a str. 301
ucaccuggagccaguug

SEQ ID NO: 3951264 - RNA, 22 nt, Shigella flexneri 2a str. 301
ucaccugugacgacuuuuucca

SEQ ID NO: 3951265 - RNA, 14 nt, Shigella flexneri 2a str. 301
ucacuugcuguaau

SEQ ID NO: 3951266 - RNA, 18 nt, Shigella flexneri 2a str. 301
ucacuuucggugacagaa

SEQ ID NO: 3951267 - RNA, 18 nt, Shigella flexneri 2a str. 301
ucacuuuuggugcuuuug

SEQ ID NO: 3951268 - RNA, 20 nt, Shigella flexneri 2a str. 301
ucacuuuuggugcuuuugcu

SEQ ID NO: 3951269 - RNA, 19 nt, Shigella flexneri 2a str. 301
ucagaaaaauacaauucuc

SEQ ID NO: 3951270 - RNA, 19 nt, Shigella flexneri 2a str. 301
ucagaaaaaucaauauuuu

SEQ ID NO: 3951271 - RNA, 14 nt, Shigella flexneri 2a str. 301
ucagaaacacacuu

SEQ ID NO: 3951272 - RNA, 19 nt, Shigella flexneri 2a str. 301
ucagaaacuguaauugaga

SEQ ID NO: 3951273 - RNA, 21 nt, Shigella flexneri 2a str. 301
ucagaaagcccgaaucaguaa

SEQ ID NO: 3951274 - RNA, 18 nt, Shigella flexneri 2a str. 301
ucagaaagcgccagcaag

SEQ ID NO: 3951275 - RNA, 19 nt, Shigella flexneri 2a str. 301
ucagaaaggcguuguccuu

SEQ ID NO: 3951276 - RNA, 17 nt, Shigella flexneri 2a str. 301
ucagaaaguaauaugug

SEQ ID NO: 3951277 - RNA, 20 nt, Shigella flexneri 2a str. 301
ucagaaaguaauuacacccu

SEQ ID NO: 3951278 - RNA, 21 nt, Shigella flexneri 2a str. 301
ucagaaaguaauuacacccuu

SEQ ID NO: 3951279 - RNA, 21 nt, Shigella flexneri 2a str. 301
ucagaaaguauauaaaaaaca

SEQ ID NO: 3951280 - RNA, 20 nt, Shigella flexneri 2a str. 301
ucagaaauuuggcuccucug

SEQ ID NO: 3951281 - RNA, 22 nt, Shigella flexneri 2a str. 301
ucagaaauuuggcuccucugac

SEQ ID NO: 3951282 - RNA, 16 nt, Shigella flexneri 2a str. 301
ucagaagacgcuccag

SEQ ID NO: 3951283 - RNA, 15 nt, Shigella flexneri 2a str. 301
ucagaaguugcaccc

SEQ ID NO: 3951284 - RNA, 22 nt, Shigella flexneri 2a str. 301
ucagaauagaaaguugccagau

SEQ ID NO: 3951285 - RNA, 21 nt, Shigella flexneri 2a str. 301
ucagaauagacaaaaauuucu

SEQ ID NO: 3951286 - RNA, 21 nt, Shigella flexneri 2a str. 301
ucagaaucacgccaacaaaca

SEQ ID NO: 3951287 - RNA, 18 nt, Shigella flexneri 2a str. 301
ucagaauccggugccuua

SEQ ID NO: 3951288 - RNA, 13 nt, Shigella flexneri 2a str. 301
ucagacaccaguc

SEQ ID NO: 3951289 - RNA, 20 nt, Shigella flexneri 2a str. 301
ucagaccaauccagccggca

SEQ ID NO: 3951290 - RNA, 19 nt, Shigella flexneri 2a str. 301
ucagacccugcucuuucag

SEQ ID NO: 3951291 - RNA, 22 nt, Shigella flexneri 2a str. 301
ucagaccguuaugcacggcaug

SEQ ID NO: 3951292 - RNA, 16 nt, Shigella flexneri 2a str. 301
ucagaccuuuuaauuu

SEQ ID NO: 3951293 - RNA, 19 nt, Shigella flexneri 2a str. 301
ucagacguucuuccugugg

SEQ ID NO: 3951294 - RNA, 20 nt, Shigella flexneri 2a str. 301
ucagacguugcauuucgucu

SEQ ID NO: 3951295 - RNA, 20 nt, Shigella flexneri 2a str. 301
ucagacucauauaaaaaccg

SEQ ID NO: 3951296 - RNA, 17 nt, Shigella flexneri 2a str. 301
ucagacuuaagccuguu

SEQ ID NO: 3951297 - RNA, 14 nt, Shigella flexneri 2a str. 301
ucagagaagcaccg

SEQ ID NO: 3951298 - RNA, 13 nt, Shigella flexneri 2a str. 301
ucagagagccagc

SEQ ID NO: 3951299 - RNA, 14 nt, Shigella flexneri 2a str. 301
ucagagagccagcc

SEQ ID NO: 3951300 - RNA, 15 nt, Shigella flexneri 2a str. 301
ucagaggcuguuccg

SEQ ID NO: 3951301 - RNA, 23 nt, Shigella flexneri 2a str. 301
ucagaguuaaccugaaaccggaa

SEQ ID NO: 3951302 - RNA, 12 nt, Shigella flexneri 2a str. 301
ucagauaaaaua

SEQ ID NO: 3951303 - RNA, 15 nt, Shigella flexneri 2a str. 301
ucagauaaaauacac

SEQ ID NO: 3951304 - RNA, 20 nt, Shigella flexneri 2a str. 301
ucagauaaaucacgcuucac

SEQ ID NO: 3951305 - RNA, 19 nt, Shigella flexneri 2a str. 301
ucagauaaaugcaaacgca

SEQ ID NO: 3951306 - RNA, 20 nt, Shigella flexneri 2a str. 301
ucagauaaaugcaaacgcau

SEQ ID NO: 3951307 - RNA, 21 nt, Shigella flexneri 2a str. 301
ucagauaauccccaaugaccu

SEQ ID NO: 3951308 - RNA, 22 nt, Shigella flexneri 2a str. 301
ucagauaauccccaaugaccuu

SEQ ID NO: 3951309 - RNA, 16 nt, Shigella flexneri 2a str. 301
ucagauaaugcccgau

SEQ ID NO: 3951310 - RNA, 21 nt, Shigella flexneri 2a str. 301
ucagauaaugcccgaugaccu

SEQ ID NO: 3951311 - RNA, 17 nt, Shigella flexneri 2a str. 301
ucagaucagccacuucc

SEQ ID NO: 3951312 - RNA, 20 nt, Shigella flexneri 2a str. 301
ucagaucagccacuuccugc

SEQ ID NO: 3951313 - RNA, 15 nt, Shigella flexneri 2a str. 301
ucagaucauccugcg

SEQ ID NO: 3951314 - RNA, 17 nt, Shigella flexneri 2a str. 301
ucagauccgcacccgca

SEQ ID NO: 3951315 - RNA, 21 nt, Shigella flexneri 2a str. 301
ucagaucgccccggucaucaa

SEQ ID NO: 3951316 - RNA, 19 nt, Shigella flexneri 2a str. 301
ucagaucgguuuuuuucga

SEQ ID NO: 3951317 - RNA, 23 nt, Shigella flexneri 2a str. 301
ucagaucgguuuuuuucgaaccg

SEQ ID NO: 3951318 - RNA, 17 nt, Shigella flexneri 2a str. 301
ucagaucguucgcacca

SEQ ID NO: 3951319 - RNA, 22 nt, Shigella flexneri 2a str. 301
ucagaucguucgcaccaaaucc

SEQ ID NO: 3951320 - RNA, 16 nt, Shigella flexneri 2a str. 301
ucagaucguugaccug

SEQ ID NO: 3951321 - RNA, 22 nt, Shigella flexneri 2a str. 301
ucagaugaacgagucaacgcuu

SEQ ID NO: 3951322 - RNA, 14 nt, Shigella flexneri 2a str. 301
ucagaugccugaug

SEQ ID NO: 3951323 - RNA, 21 nt, Shigella flexneri 2a str. 301
ucagauguuccgccauuuuaa

SEQ ID NO: 3951324 - RNA, 15 nt, Shigella flexneri 2a str. 301
ucagauucaaauuau

SEQ ID NO: 3951325 - RNA, 13 nt, Shigella flexneri 2a str. 301
ucagauugagcau

SEQ ID NO: 3951326 - RNA, 20 nt, Shigella flexneri 2a str. 301
ucagauuggcuucauugauu

SEQ ID NO: 3951327 - RNA, 16 nt, Shigella flexneri 2a str. 301
ucagauuguugauuaa

SEQ ID NO: 3951328 - RNA, 15 nt, Shigella flexneri 2a str. 301
ucagcaaacgcaguu

SEQ ID NO: 3951329 - RNA, 18 nt, Shigella flexneri 2a str. 301
ucagcaaaggcgugaacu

SEQ ID NO: 3951330 - RNA, 18 nt, Shigella flexneri 2a str. 301
ucagcaaauagauaaaau

SEQ ID NO: 3951331 - RNA, 20 nt, Shigella flexneri 2a str. 301
ucagcaagacaauguuugca

SEQ ID NO: 3951332 - RNA, 16 nt, Shigella flexneri 2a str. 301
ucagcaaggaaagcca

SEQ ID NO: 3951333 - RNA, 24 nt, Shigella flexneri 2a str. 301
ucagcaauaaucagauggcggcug

SEQ ID NO: 3951334 - RNA, 18 nt, Shigella flexneri 2a str. 301
ucagcaaucgcgccagcc

SEQ ID NO: 3951335 - RNA, 13 nt, Shigella flexneri 2a str. 301
ucagcaaucucuu

SEQ ID NO: 3951336 - RNA, 16 nt, Shigella flexneri 2a str. 301
ucagcaaucucuucaa

SEQ ID NO: 3951337 - RNA, 19 nt, Shigella flexneri 2a str. 301
ucagcaauucucucuucag

SEQ ID NO: 3951338 - RNA, 15 nt, Shigella flexneri 2a str. 301
ucagcaauuucuccg

SEQ ID NO: 3951339 - RNA, 18 nt, Shigella flexneri 2a str. 301
ucagcacaaaucggcaac

SEQ ID NO: 3951340 - RNA, 12 nt, Shigella flexneri 2a str. 301
ucagcaccagau

SEQ ID NO: 3951341 - RNA, 19 nt, Shigella flexneri 2a str. 301
ucagcacgacauaagcgca

SEQ ID NO: 3951342 - RNA, 19 nt, Shigella flexneri 2a str. 301
ucagcacgucuuccauugc

SEQ ID NO: 3951343 - RNA, 21 nt, Shigella flexneri 2a str. 301
ucagcagacggccaaaaucuc

SEQ ID NO: 3951344 - RNA, 22 nt, Shigella flexneri 2a str. 301
ucagcagacggccaaaaucucu

SEQ ID NO: 3951345 - RNA, 15 nt, Shigella flexneri 2a str. 301
ucagcagcucaucaa

SEQ ID NO: 3951346 - RNA, 16 nt, Shigella flexneri 2a str. 301
ucagcaguucacgcag

SEQ ID NO: 3951347 - RNA, 14 nt, Shigella flexneri 2a str. 301
ucagcaguucagca

SEQ ID NO: 3951348 - RNA, 16 nt, Shigella flexneri 2a str. 301
ucagcaguucugccag

SEQ ID NO: 3951349 - RNA, 23 nt, Shigella flexneri 2a str. 301
ucagcaguuuuuccccugccaga

SEQ ID NO: 3951350 - RNA, 18 nt, Shigella flexneri 2a str. 301
ucagcauauaggaggccu

SEQ ID NO: 3951351 - RNA, 19 nt, Shigella flexneri 2a str. 301
ucagcauauaggaggccuc

SEQ ID NO: 3951352 - RNA, 23 nt, Shigella flexneri 2a str. 301
ucagcauccguuaacuuucugcg

SEQ ID NO: 3951353 - RNA, 17 nt, Shigella flexneri 2a str. 301
ucagcaugacaaaaaag

SEQ ID NO: 3951354 - RNA, 19 nt, Shigella flexneri 2a str. 301
ucagcauuacccagauaau

SEQ ID NO: 3951355 - RNA, 22 nt, Shigella flexneri 2a str. 301
ucagcauuguugaaaacgcgca

SEQ ID NO: 3951356 - RNA, 20 nt, Shigella flexneri 2a str. 301
ucagcauuucgcgauauugc

SEQ ID NO: 3951357 - RNA, 20 nt, Shigella flexneri 2a str. 301
ucagcauuuucuauuucuga

SEQ ID NO: 3951358 - RNA, 16 nt, Shigella flexneri 2a str. 301
ucagccaaauccagcg

SEQ ID NO: 3951359 - RNA, 13 nt, Shigella flexneri 2a str. 301
ucagccacuccac

SEQ ID NO: 3951360 - RNA, 13 nt, Shigella flexneri 2a str. 301
ucagccacuucuu

SEQ ID NO: 3951361 - RNA, 17 nt, Shigella flexneri 2a str. 301
ucagccagaaagaaccg

SEQ ID NO: 3951362 - RNA, 19 nt, Shigella flexneri 2a str. 301
ucagcccaaagcagaguug

SEQ ID NO: 3951363 - RNA, 15 nt, Shigella flexneri 2a str. 301
ucagcccaacaaagc

SEQ ID NO: 3951364 - RNA, 15 nt, Shigella flexneri 2a str. 301
ucaggugucuggcag

SEQ ID NO: 3951365 - RNA, 18 nt, Shigella flexneri 2a str. 301
ucagguuuuucagcugcc

SEQ ID NO: 3951366 - RNA, 14 nt, Shigella flexneri 2a str. 301
ucaguaaacgcuuu

SEQ ID NO: 3951367 - RNA, 18 nt, Shigella flexneri 2a str. 301
ucaguaaaguuaccuucg

SEQ ID NO: 3951368 - RNA, 23 nt, Shigella flexneri 2a str. 301
ucaguaaaguuaccuucgaagaa

SEQ ID NO: 3951369 - RNA, 13 nt, Shigella flexneri 2a str. 301
ucaguaagccagc

SEQ ID NO: 3951370 - RNA, 13 nt, Shigella flexneri 2a str. 301
ucaguacaccacc

SEQ ID NO: 3951371 - RNA, 15 nt, Shigella flexneri 2a str. 301
ucaguacaccaccua

SEQ ID NO: 3951372 - RNA, 15 nt, Shigella flexneri 2a str. 301
ucaguagaauaaucu

SEQ ID NO: 3951373 - RNA, 19 nt, Shigella flexneri 2a str. 301
ucaguagcgcaaucaccac

SEQ ID NO: 3951374 - RNA, 15 nt, Shigella flexneri 2a str. 301
ucaguauaacuacug

SEQ ID NO: 3951375 - RNA, 18 nt, Shigella flexneri 2a str. 301
ucaguaugacuuuaugcu

SEQ ID NO: 3951376 - RNA, 19 nt, Shigella flexneri 2a str. 301
ucaguauggaucaaaucuc

SEQ ID NO: 3951377 - RNA, 13 nt, Shigella flexneri 2a str. 301
ucaguauggucga

SEQ ID NO: 3951378 - RNA, 21 nt, Shigella flexneri 2a str. 301
ucagucacgacaaagacauca

SEQ ID NO: 3951379 - RNA, 12 nt, Shigella flexneri 2a str. 301
ucagucagcagu

SEQ ID NO: 3951380 - RNA, 16 nt, Shigella flexneri 2a str. 301
ucagucaguggcagca

SEQ ID NO: 3951381 - RNA, 21 nt, Shigella flexneri 2a str. 301
ucagucucaagggaggaguca

SEQ ID NO: 3951382 - RNA, 15 nt, Shigella flexneri 2a str. 301
ucagugaucgccugc

SEQ ID NO: 3951383 - RNA, 17 nt, Shigella flexneri 2a str. 301
ucagugcaaaugccaga

SEQ ID NO: 3951384 - RNA, 21 nt, Shigella flexneri 2a str. 301
ucagugcaccgcguagcaucu

SEQ ID NO: 3951385 - RNA, 17 nt, Shigella flexneri 2a str. 301
ucagugcuucaccgaua

SEQ ID NO: 3951386 - RNA, 22 nt, Shigella flexneri 2a str. 301
ucaguggaagacguugauucac

SEQ ID NO: 3951387 - RNA, 18 nt, Shigella flexneri 2a str. 301
ucaguggcuuaucuuccu

SEQ ID NO: 3951388 - RNA, 17 nt, Shigella flexneri 2a str. 301
ucagugguguagggcag

SEQ ID NO: 3951389 - RNA, 14 nt, Shigella flexneri 2a str. 301
ucagugucgcagua

SEQ ID NO: 3951390 - RNA, 13 nt, Shigella flexneri 2a str. 301
ucagugucuuauc

SEQ ID NO: 3951391 - RNA, 19 nt, Shigella flexneri 2a str. 301
ucaguguuggauggcggcu

SEQ ID NO: 3951392 - RNA, 14 nt, Shigella flexneri 2a str. 301
ucaguuaacggcag

SEQ ID NO: 3951393 - RNA, 22 nt, Shigella flexneri 2a str. 301
ucaguuaacggcaggaucaggc

SEQ ID NO: 3951394 - RNA, 13 nt, Shigella flexneri 2a str. 301
ucaguucaaauuc

SEQ ID NO: 3951395 - RNA, 15 nt, Shigella flexneri 2a str. 301
ucaguucaaauucau

SEQ ID NO: 3951396 - RNA, 15 nt, Shigella flexneri 2a str. 301
ucaguucaccauuag

SEQ ID NO: 3951397 - RNA, 16 nt, Shigella flexneri 2a str. 301
ucaguucagaauggcg

SEQ ID NO: 3951398 - RNA, 22 nt, Shigella flexneri 2a str. 301
ucaguucagcgauauccagcga

SEQ ID NO: 3951399 - RNA, 21 nt, Shigella flexneri 2a str. 301
ucaguucauggugcaagaaau

SEQ ID NO: 3951400 - RNA, 14 nt, Shigella flexneri 2a str. 301
ucaguuccaguuca

SEQ ID NO: 3951401 - RNA, 23 nt, Shigella flexneri 2a str. 301
ucaguucguuuuacgcacuucuu

SEQ ID NO: 3951402 - RNA, 15 nt, Shigella flexneri 2a str. 301
ucaguucuaccauca

SEQ ID NO: 3951403 - RNA, 16 nt, Shigella flexneri 2a str. 301
ucaguucuagaacuaa

SEQ ID NO: 3951404 - RNA, 21 nt, Shigella flexneri 2a str. 301
ucaguugcaccugauccagcu

SEQ ID NO: 3951405 - RNA, 21 nt, Shigella flexneri 2a str. 301
ucaguuguucagaaugcccac

SEQ ID NO: 3951406 - RNA, 13 nt, Shigella flexneri 2a str. 301
ucaguuucagaaa

SEQ ID NO: 3951407 - RNA, 15 nt, Shigella flexneri 2a str. 301
ucaguuugcaaaccc

SEQ ID NO: 3951408 - RNA, 16 nt, Shigella flexneri 2a str. 301
ucaguuuuacucuuuc

SEQ ID NO: 3951409 - RNA, 20 nt, Shigella flexneri 2a str. 301
ucaguuuuucacccgcaauc

SEQ ID NO: 3951410 - RNA, 22 nt, Shigella flexneri 2a str. 301
ucaguuuuuguugauaaacaaa

SEQ ID NO: 3951411 - RNA, 14 nt, Shigella flexneri 2a str. 301
ucauaaaaauuaaa

SEQ ID NO: 3951412 - RNA, 18 nt, Shigella flexneri 2a str. 301
ucauaaauacagagcacg

SEQ ID NO: 3951413 - RNA, 23 nt, Shigella flexneri 2a str. 301
ucauaaauacagagcacgcaagg

SEQ ID NO: 3951414 - RNA, 12 nt, Shigella flexneri 2a str. 301
ucauaacggcaa

SEQ ID NO: 3951415 - RNA, 21 nt, Shigella flexneri 2a str. 301
ucauaagaagcuuuucucaau

SEQ ID NO: 3951416 - RNA, 21 nt, Shigella flexneri 2a str. 301
ucauaagcaucccuuuaauua

SEQ ID NO: 3951417 - RNA, 12 nt, Shigella flexneri 2a str. 301
ucauaauggcug

SEQ ID NO: 3951418 - RNA, 14 nt, Shigella flexneri 2a str. 301
ucauaauggcugcc

SEQ ID NO: 3951419 - RNA, 16 nt, Shigella flexneri 2a str. 301
ucauacaccagcggca

SEQ ID NO: 3951420 - RNA, 14 nt, Shigella flexneri 2a str. 301
ucauacacuucaca

SEQ ID NO: 3951421 - RNA, 21 nt, Shigella flexneri 2a str. 301
ucauacagaugcugcucuuca

SEQ ID NO: 3951422 - RNA, 18 nt, Shigella flexneri 2a str. 301
ucauacagcggacagcca

SEQ ID NO: 3951423 - RNA, 20 nt, Shigella flexneri 2a str. 301
ucauacccaacguaacaaaa

SEQ ID NO: 3951424 - RNA, 16 nt, Shigella flexneri 2a str. 301
ucauaccgaucaccga

SEQ ID NO: 3951425 - RNA, 21 nt, Shigella flexneri 2a str. 301
ucauacgcggcagaaugguuu

SEQ ID NO: 3951426 - RNA, 20 nt, Shigella flexneri 2a str. 301
ucauacgcguaaaacagcca

SEQ ID NO: 3951427 - RNA, 14 nt, Shigella flexneri 2a str. 301
ucauacucaccguu

SEQ ID NO: 3951428 - RNA, 16 nt, Shigella flexneri 2a str. 301
ucauacucaccguuca

SEQ ID NO: 3951429 - RNA, 13 nt, Shigella flexneri 2a str. 301
ucauacugaacuu

SEQ ID NO: 3951430 - RNA, 24 nt, Shigella flexneri 2a str. 301
ucauacugccgaccaucuguucug

SEQ ID NO: 3951431 - RNA, 13 nt, Shigella flexneri 2a str. 301
ucauagaccauug

SEQ ID NO: 3951432 - RNA, 18 nt, Shigella flexneri 2a str. 301
ucauaggccgcugaugcc

SEQ ID NO: 3951433 - RNA, 16 nt, Shigella flexneri 2a str. 301
ucauagguaaacauca

SEQ ID NO: 3951434 - RNA, 15 nt, Shigella flexneri 2a str. 301
ucauauaccgcauca

SEQ ID NO: 3951435 - RNA, 17 nt, Shigella flexneri 2a str. 301
ucauauagccgccuugu

SEQ ID NO: 3951436 - RNA, 19 nt, Shigella flexneri 2a str. 301
ucauaucgacaacgaagcc

SEQ ID NO: 3951437 - RNA, 16 nt, Shigella flexneri 2a str. 301
ucauaugauaggcuuc

SEQ ID NO: 3951438 - RNA, 15 nt, Shigella flexneri 2a str. 301
ucauaugauucauau

SEQ ID NO: 3951439 - RNA, 16 nt, Shigella flexneri 2a str. 301
ucauauuaaauuuuuu

SEQ ID NO: 3951440 - RNA, 12 nt, Shigella flexneri 2a str. 301
ucauauucacca

SEQ ID NO: 3951441 - RNA, 18 nt, Shigella flexneri 2a str. 301
ucaucaaaaucaucauug

SEQ ID NO: 3951442 - RNA, 13 nt, Shigella flexneri 2a str. 301
ucaucaaagccaa

SEQ ID NO: 3951443 - RNA, 20 nt, Shigella flexneri 2a str. 301
ucaucaaauuacgauaauca

SEQ ID NO: 3951444 - RNA, 15 nt, Shigella flexneri 2a str. 301
ucaucaacuggcaac

SEQ ID NO: 3951445 - RNA, 21 nt, Shigella flexneri 2a str. 301
ucaucaacuggcaaccagaag

SEQ ID NO: 3951446 - RNA, 14 nt, Shigella flexneri 2a str. 301
ucaucaagcuguuc

SEQ ID NO: 3951447 - RNA, 16 nt, Shigella flexneri 2a str. 301
ucaucaagcuguucuu

SEQ ID NO: 3951448 - RNA, 13 nt, Shigella flexneri 2a str. 301
ucaucaauaccug

SEQ ID NO: 3951449 - RNA, 21 nt, Shigella flexneri 2a str. 301
ucaucaauaccugguccuuca

SEQ ID NO: 3951450 - RNA, 18 nt, Shigella flexneri 2a str. 301
ucaucacauagcgguaag

SEQ ID NO: 3951451 - RNA, 18 nt, Shigella flexneri 2a str. 301
ucaucacaucccagcaga

SEQ ID NO: 3951452 - RNA, 23 nt, Shigella flexneri 2a str. 301
ucaucaccauugcaucgaggaaa

SEQ ID NO: 3951453 - RNA, 18 nt, Shigella flexneri 2a str. 301
ucaucaccuccagccuga

SEQ ID NO: 3951454 - RNA, 21 nt, Shigella flexneri 2a str. 301
ucaucaccugagcuggcagac

SEQ ID NO: 3951455 - RNA, 14 nt, Shigella flexneri 2a str. 301
ucaucacgaaaauc

SEQ ID NO: 3951456 - RNA, 15 nt, Shigella flexneri 2a str. 301
ucaucacgaaaauca

SEQ ID NO: 3951457 - RNA, 17 nt, Shigella flexneri 2a str. 301
ucaucacgcaggcugua

SEQ ID NO: 3951458 - RNA, 15 nt, Shigella flexneri 2a str. 301
ucaucacgcgguuac

SEQ ID NO: 3951459 - RNA, 21 nt, Shigella flexneri 2a str. 301
ucaucacgcgguuacgcaccg

SEQ ID NO: 3951460 - RNA, 17 nt, Shigella flexneri 2a str. 301
ucaucacguuggucugg

SEQ ID NO: 3951461 - RNA, 22 nt, Shigella flexneri 2a str. 301
ucaucagcaaaggcgugaacuu

SEQ ID NO: 3951462 - RNA, 19 nt, Shigella flexneri 2a str. 301
ucaucagcauaaucaccag

SEQ ID NO: 3951463 - RNA, 21 nt, Shigella flexneri 2a str. 301
ucaucagcauaaucaccagua

SEQ ID NO: 3951464 - RNA, 15 nt, Shigella flexneri 2a str. 301
ucauguuaaauuccg

SEQ ID NO: 3951465 - RNA, 19 nt, Shigella flexneri 2a str. 301
ucauguuaaauuccggcuc

SEQ ID NO: 3951466 - RNA, 13 nt, Shigella flexneri 2a str. 301
ucauuaaagccgc

SEQ ID NO: 3951467 - RNA, 20 nt, Shigella flexneri 2a str. 301
ucauuaaccguuuacgucau

SEQ ID NO: 3951468 - RNA, 11 nt, Shigella flexneri 2a str. 301
ucauuaauauc

SEQ ID NO: 3951469 - RNA, 18 nt, Shigella flexneri 2a str. 301
ucauuaauaucuuucaua

SEQ ID NO: 3951470 - RNA, 13 nt, Shigella flexneri 2a str. 301
ucauuaccaagaa

SEQ ID NO: 3951471 - RNA, 14 nt, Shigella flexneri 2a str. 301
ucauuacccaaaac

SEQ ID NO: 3951472 - RNA, 16 nt, Shigella flexneri 2a str. 301
ucauuaccgaacaaca

SEQ ID NO: 3951473 - RNA, 15 nt, Shigella flexneri 2a str. 301
ucauuaccgcgaaga

SEQ ID NO: 3951474 - RNA, 20 nt, Shigella flexneri 2a str. 301
ucauuaccuuauaacgcuua

SEQ ID NO: 3951475 - RNA, 19 nt, Shigella flexneri 2a str. 301
ucauuacgaaguuuaauuc

SEQ ID NO: 3951476 - RNA, 15 nt, Shigella flexneri 2a str. 301
ucauuacgccaguca

SEQ ID NO: 3951477 - RNA, 17 nt, Shigella flexneri 2a str. 301
ucauuacgccagucacg

SEQ ID NO: 3951478 - RNA, 14 nt, Shigella flexneri 2a str. 301
ucauuacuuacaca

SEQ ID NO: 3951479 - RNA, 21 nt, Shigella flexneri 2a str. 301
ucauuagcccaauaaucaccg

SEQ ID NO: 3951480 - RNA, 23 nt, Shigella flexneri 2a str. 301
ucauuagcccgguagcaugaacc

SEQ ID NO: 3951481 - RNA, 16 nt, Shigella flexneri 2a str. 301
ucauuaggccauuuga

SEQ ID NO: 3951482 - RNA, 18 nt, Shigella flexneri 2a str. 301
ucauuagucacaaaucuc

SEQ ID NO: 3951483 - RNA, 16 nt, Shigella flexneri 2a str. 301
ucauuaugaucaaaau

SEQ ID NO: 3951484 - RNA, 13 nt, Shigella flexneri 2a str. 301
ucauuaugcugga

SEQ ID NO: 3951485 - RNA, 13 nt, Shigella flexneri 2a str. 301
ucauuauuaauau

SEQ ID NO: 3951486 - RNA, 15 nt, Shigella flexneri 2a str. 301
ucauuauugucggug

SEQ ID NO: 3951487 - RNA, 12 nt, Shigella flexneri 2a str. 301
ucauucaccagu

SEQ ID NO: 3951488 - RNA, 13 nt, Shigella flexneri 2a str. 301
ucauucaccaguu

SEQ ID NO: 3951489 - RNA, 16 nt, Shigella flexneri 2a str. 301
ucauucagcucgcuaa

SEQ ID NO: 3951490 - RNA, 23 nt, Shigella flexneri 2a str. 301
ucauucagugacagguugcucau

SEQ ID NO: 3951491 - RNA, 14 nt, Shigella flexneri 2a str. 301
ucauucauccgccg

SEQ ID NO: 3951492 - RNA, 18 nt, Shigella flexneri 2a str. 301
ucauuccaccgaaacuuu

SEQ ID NO: 3951493 - RNA, 15 nt, Shigella flexneri 2a str. 301
ucauucgaaaccacc

SEQ ID NO: 3951494 - RNA, 21 nt, Shigella flexneri 2a str. 301
ucauucgacgcgcgcacacaa

SEQ ID NO: 3951495 - RNA, 22 nt, Shigella flexneri 2a str. 301
ucauucgcaguugcaguaccag

SEQ ID NO: 3951496 - RNA, 19 nt, Shigella flexneri 2a str. 301
ucauucgccgguuccagcu

SEQ ID NO: 3951497 - RNA, 20 nt, Shigella flexneri 2a str. 301
ucauucgccgguuccagcuu

SEQ ID NO: 3951498 - RNA, 19 nt, Shigella flexneri 2a str. 301
ucauucgucuccuggccgu

SEQ ID NO: 3951499 - RNA, 20 nt, Shigella flexneri 2a str. 301
ucauucugcaaggcaaaaua

SEQ ID NO: 3951500 - RNA, 17 nt, Shigella flexneri 2a str. 301
ucauugaaggcggcgca

SEQ ID NO: 3951501 - RNA, 14 nt, Shigella flexneri 2a str. 301
ucauugacgccaag

SEQ ID NO: 3951502 - RNA, 20 nt, Shigella flexneri 2a str. 301
ucauugagcugcaaccauuu

SEQ ID NO: 3951503 - RNA, 18 nt, Shigella flexneri 2a str. 301
ucauugccauucgccagu

SEQ ID NO: 3951504 - RNA, 19 nt, Shigella flexneri 2a str. 301
ucauugcggcaacaaugcu

SEQ ID NO: 3951505 - RNA, 17 nt, Shigella flexneri 2a str. 301
ucauugcuaucuccugu

SEQ ID NO: 3951506 - RNA, 17 nt, Shigella flexneri 2a str. 301
ucauugguccaucuuuu

SEQ ID NO: 3951507 - RNA, 17 nt, Shigella flexneri 2a str. 301
ucauuguccgucugaaa

SEQ ID NO: 3951508 - RNA, 23 nt, Shigella flexneri 2a str. 301
ucauugucgggccgcacgcugua

SEQ ID NO: 3951509 - RNA, 23 nt, Shigella flexneri 2a str. 301
ucauugugguucucaauuacagu

SEQ ID NO: 3951510 - RNA, 22 nt, Shigella flexneri 2a str. 301
ucauuguguacauccuaaaggc

SEQ ID NO: 3951511 - RNA, 12 nt, Shigella flexneri 2a str. 301
ucauuguuaacg

SEQ ID NO: 3951512 - RNA, 14 nt, Shigella flexneri 2a str. 301
ucauuuauuaccuu

SEQ ID NO: 3951513 - RNA, 21 nt, Shigella flexneri 2a str. 301
ucauuucccaucucaauauua

SEQ ID NO: 3951514 - RNA, 13 nt, Shigella flexneri 2a str. 301
ucauuucgccuga

SEQ ID NO: 3951515 - RNA, 17 nt, Shigella flexneri 2a str. 301
ucauuugaauaguuaau

SEQ ID NO: 3951516 - RNA, 22 nt, Shigella flexneri 2a str. 301
ucauuuuacguugcauuuccau

SEQ ID NO: 3951517 - RNA, 24 nt, Shigella flexneri 2a str. 301
ucauuuuauugcguaaucuuuuca

SEQ ID NO: 3951518 - RNA, 21 nt, Shigella flexneri 2a str. 301
ucauuuucuucagcaguucag

SEQ ID NO: 3951519 - RNA, 21 nt, Shigella flexneri 2a str. 301
ucauuuuuucgguuuagugua

SEQ ID NO: 3951520 - RNA, 15 nt, Shigella flexneri 2a str. 301
uccaaaaaacaaacc

SEQ ID NO: 3951521 - RNA, 16 nt, Shigella flexneri 2a str. 301
uccaagauuaaaggca

SEQ ID NO: 3951522 - RNA, 13 nt, Shigella flexneri 2a str. 301
uccaagccugaua

SEQ ID NO: 3951523 - RNA, 21 nt, Shigella flexneri 2a str. 301
uccaagcgcggcaggcaucgg

SEQ ID NO: 3951524 - RNA, 18 nt, Shigella flexneri 2a str. 301
uccaagucaacgucauua

SEQ ID NO: 3951525 - RNA, 21 nt, Shigella flexneri 2a str. 301
uccacaacgugggccuggcgu

SEQ ID NO: 3951526 - RNA, 21 nt, Shigella flexneri 2a str. 301
uccacaagaaugccugccagc

SEQ ID NO: 3951527 - RNA, 15 nt, Shigella flexneri 2a str. 301
uccacaccacuuccg

SEQ ID NO: 3951528 - RNA, 11 nt, Shigella flexneri 2a str. 301
uccacacccag

SEQ ID NO: 3951529 - RNA, 19 nt, Shigella flexneri 2a str. 301
uccacaggguguauucaug

SEQ ID NO: 3951530 - RNA, 13 nt, Shigella flexneri 2a str. 301
uccacagucaggc

SEQ ID NO: 3951531 - RNA, 21 nt, Shigella flexneri 2a str. 301
uccacaguugcucaaucaucu

SEQ ID NO: 3951532 - RNA, 16 nt, Shigella flexneri 2a str. 301
uccacaucggcaucag

SEQ ID NO: 3951533 - RNA, 19 nt, Shigella flexneri 2a str. 301
uccacauuuuccaucacga

SEQ ID NO: 3951534 - RNA, 20 nt, Shigella flexneri 2a str. 301
uccaccacccagcgccccca

SEQ ID NO: 3951535 - RNA, 13 nt, Shigella flexneri 2a str. 301
uccaccagcacca

SEQ ID NO: 3951536 - RNA, 18 nt, Shigella flexneri 2a str. 301
uccaccagcaccagcaau

SEQ ID NO: 3951537 - RNA, 13 nt, Shigella flexneri 2a str. 301
uccaccagcgcgu

SEQ ID NO: 3951538 - RNA, 10 nt, Shigella flexneri 2a str. 301
uccaccagug

SEQ ID NO: 3951539 - RNA, 13 nt, Shigella flexneri 2a str. 301
uccaccaucacgc

SEQ ID NO: 3951540 - RNA, 17 nt, Shigella flexneri 2a str. 301
uccacccgcagcaagcg

SEQ ID NO: 3951541 - RNA, 14 nt, Shigella flexneri 2a str. 301
uccacccgcagcca

SEQ ID NO: 3951542 - RNA, 15 nt, Shigella flexneri 2a str. 301
uccaccgauuuugag

SEQ ID NO: 3951543 - RNA, 17 nt, Shigella flexneri 2a str. 301
uccaccgauuuugagaa

SEQ ID NO: 3951544 - RNA, 17 nt, Shigella flexneri 2a str. 301
uccaccgcguucagcag

SEQ ID NO: 3951545 - RNA, 18 nt, Shigella flexneri 2a str. 301
uccaccgcguucagcagc

SEQ ID NO: 3951546 - RNA, 18 nt, Shigella flexneri 2a str. 301
uccaccgggcgcaaggug

SEQ ID NO: 3951547 - RNA, 19 nt, Shigella flexneri 2a str. 301
uccaccguuucuuuuucga

SEQ ID NO: 3951548 - RNA, 19 nt, Shigella flexneri 2a str. 301
uccaccuccagcuccgcca

SEQ ID NO: 3951549 - RNA, 21 nt, Shigella flexneri 2a str. 301
uccaccugcgucgcgccguag

SEQ ID NO: 3951550 - RNA, 22 nt, Shigella flexneri 2a str. 301
uccaccuggccugggaucauca

SEQ ID NO: 3951551 - RNA, 21 nt, Shigella flexneri 2a str. 301
uccaccuuaucgacaugcggu

SEQ ID NO: 3951552 - RNA, 16 nt, Shigella flexneri 2a str. 301
uccaccuugcggaaac

SEQ ID NO: 3951553 - RNA, 18 nt, Shigella flexneri 2a str. 301
uccacgacguguuccuga

SEQ ID NO: 3951554 - RNA, 15 nt, Shigella flexneri 2a str. 301
uccacgauacgcugc

SEQ ID NO: 3951555 - RNA, 22 nt, Shigella flexneri 2a str. 301
uccacgccaagcucauaacggc

SEQ ID NO: 3951556 - RNA, 17 nt, Shigella flexneri 2a str. 301
uccacgcccagcgcagg

SEQ ID NO: 3951557 - RNA, 20 nt, Shigella flexneri 2a str. 301
uccacgccgcugucuaccag

SEQ ID NO: 3951558 - RNA, 21 nt, Shigella flexneri 2a str. 301
uccacgccgcugucuaccagc

SEQ ID NO: 3951559 - RNA, 17 nt, Shigella flexneri 2a str. 301
uccacgccuuuuuucac

SEQ ID NO: 3951560 - RNA, 20 nt, Shigella flexneri 2a str. 301
uccacgcgauacuuuuucaa

SEQ ID NO: 3951561 - RNA, 13 nt, Shigella flexneri 2a str. 301
uccacgcgcggac

SEQ ID NO: 3951562 - RNA, 23 nt, Shigella flexneri 2a str. 301
uccacgcggguuuacuacggcuu

SEQ ID NO: 3951563 - RNA, 20 nt, Shigella flexneri 2a str. 301
uccacgcuauacagcagcca

SEQ ID NO: 3951564 - RNA, 20 nt, Shigella flexneri 2a str. 301
uccaguagauucaacauaau

SEQ ID NO: 3951565 - RNA, 21 nt, Shigella flexneri 2a str. 301
uccaguaucgauuuuccgauu

SEQ ID NO: 3951566 - RNA, 13 nt, Shigella flexneri 2a str. 301
uccaguccccccc

SEQ ID NO: 3951567 - RNA, 21 nt, Shigella flexneri 2a str. 301
uccagugaaacgcuuuacguu

SEQ ID NO: 3951568 - RNA, 13 nt, Shigella flexneri 2a str. 301
uccagugauucca

SEQ ID NO: 3951569 - RNA, 19 nt, Shigella flexneri 2a str. 301
uccagugcauccagcacga

SEQ ID NO: 3951570 - RNA, 20 nt, Shigella flexneri 2a str. 301
uccagugccggaugauucac

SEQ ID NO: 3951571 - RNA, 21 nt, Shigella flexneri 2a str. 301
uccagugccggaugauucaca

SEQ ID NO: 3951572 - RNA, 22 nt, Shigella flexneri 2a str. 301
uccagugccugugacaacacuu

SEQ ID NO: 3951573 - RNA, 21 nt, Shigella flexneri 2a str. 301
uccagugcgcuuuauucagau

SEQ ID NO: 3951574 - RNA, 22 nt, Shigella flexneri 2a str. 301
uccagugcgguaacguaaucuu

SEQ ID NO: 3951575 - RNA, 21 nt, Shigella flexneri 2a str. 301
uccagugcguccgguuuacuu

SEQ ID NO: 3951576 - RNA, 17 nt, Shigella flexneri 2a str. 301
uccaguguggccagagu

SEQ ID NO: 3951577 - RNA, 20 nt, Shigella flexneri 2a str. 301
uccaguuaucaagccauagc

SEQ ID NO: 3951578 - RNA, 20 nt, Shigella flexneri 2a str. 301
uccaguucaagugcuaccca

SEQ ID NO: 3951579 - RNA, 19 nt, Shigella flexneri 2a str. 301
uccaguucgaucucuucgc

SEQ ID NO: 3951580 - RNA, 14 nt, Shigella flexneri 2a str. 301
uccaguugauacag

SEQ ID NO: 3951581 - RNA, 11 nt, Shigella flexneri 2a str. 301
uccaguuucac

SEQ ID NO: 3951582 - RNA, 23 nt, Shigella flexneri 2a str. 301
uccaguuugcucaaauccaucag

SEQ ID NO: 3951583 - RNA, 13 nt, Shigella flexneri 2a str. 301
uccauaagguccu

SEQ ID NO: 3951584 - RNA, 18 nt, Shigella flexneri 2a str. 301
uccauacccagcaucagu

SEQ ID NO: 3951585 - RNA, 13 nt, Shigella flexneri 2a str. 301
uccauaccggacu

SEQ ID NO: 3951586 - RNA, 16 nt, Shigella flexneri 2a str. 301
uccauacgggcaugug

SEQ ID NO: 3951587 - RNA, 11 nt, Shigella flexneri 2a str. 301
uccauacuguc

SEQ ID NO: 3951588 - RNA, 15 nt, Shigella flexneri 2a str. 301
uccauacugucucca

SEQ ID NO: 3951589 - RNA, 21 nt, Shigella flexneri 2a str. 301
uccauacuuccacuaguauuu

SEQ ID NO: 3951590 - RNA, 16 nt, Shigella flexneri 2a str. 301
uccauagcgauguauu

SEQ ID NO: 3951591 - RNA, 20 nt, Shigella flexneri 2a str. 301
uccauagucacuaccuguuu

SEQ ID NO: 3951592 - RNA, 17 nt, Shigella flexneri 2a str. 301
uccauauggcugcauuc

SEQ ID NO: 3951593 - RNA, 21 nt, Shigella flexneri 2a str. 301
uccaucaaagguuuuucagua

SEQ ID NO: 3951594 - RNA, 21 nt, Shigella flexneri 2a str. 301
uccaucaacauugguguguua

SEQ ID NO: 3951595 - RNA, 16 nt, Shigella flexneri 2a str. 301
uccaucaagauuagcg

SEQ ID NO: 3951596 - RNA, 12 nt, Shigella flexneri 2a str. 301
uccaucaccaga

SEQ ID NO: 3951597 - RNA, 13 nt, Shigella flexneri 2a str. 301
uccaucacuucau

SEQ ID NO: 3951598 - RNA, 14 nt, Shigella flexneri 2a str. 301
uccaucacuucauc

SEQ ID NO: 3951599 - RNA, 13 nt, Shigella flexneri 2a str. 301
uccaucacuucgc

SEQ ID NO: 3951600 - RNA, 16 nt, Shigella flexneri 2a str. 301
uccaucagauucagca

SEQ ID NO: 3951601 - RNA, 19 nt, Shigella flexneri 2a str. 301
uccaucagauucagcagcg

SEQ ID NO: 3951602 - RNA, 20 nt, Shigella flexneri 2a str. 301
uccauccagcaacaacagcg

SEQ ID NO: 3951603 - RNA, 17 nt, Shigella flexneri 2a str. 301
uccauccggcaacauca

SEQ ID NO: 3951604 - RNA, 18 nt, Shigella flexneri 2a str. 301
uccaucgaccaaccuugc

SEQ ID NO: 3951605 - RNA, 17 nt, Shigella flexneri 2a str. 301
uccaucguccgugaaga

SEQ ID NO: 3951606 - RNA, 19 nt, Shigella flexneri 2a str. 301
uccaucgucuccagagcag

SEQ ID NO: 3951607 - RNA, 12 nt, Shigella flexneri 2a str. 301
uccaucuguauc

SEQ ID NO: 3951608 - RNA, 18 nt, Shigella flexneri 2a str. 301
uccaucuuuaugaaauau

SEQ ID NO: 3951609 - RNA, 14 nt, Shigella flexneri 2a str. 301
uccaugaaaauaga

SEQ ID NO: 3951610 - RNA, 19 nt, Shigella flexneri 2a str. 301
uccaugcacugcaacgccu

SEQ ID NO: 3951611 - RNA, 22 nt, Shigella flexneri 2a str. 301
uccauggacgaugagacccgcc

SEQ ID NO: 3951612 - RNA, 14 nt, Shigella flexneri 2a str. 301
uccauguccagcuu

SEQ ID NO: 3951613 - RNA, 20 nt, Shigella flexneri 2a str. 301
uccaugucgguacagagcaa

SEQ ID NO: 3951614 - RNA, 15 nt, Shigella flexneri 2a str. 301
uccauuacaucacga

SEQ ID NO: 3951615 - RNA, 22 nt, Shigella flexneri 2a str. 301
uccauuaccaguccugugacuc

SEQ ID NO: 3951616 - RNA, 20 nt, Shigella flexneri 2a str. 301
uccauucaccauuuuuuaau

SEQ ID NO: 3951617 - RNA, 20 nt, Shigella flexneri 2a str. 301
uccauugggcuguuauccca

SEQ ID NO: 3951618 - RNA, 15 nt, Shigella flexneri 2a str. 301
uccauuucauugagu

SEQ ID NO: 3951619 - RNA, 21 nt, Shigella flexneri 2a str. 301
uccauuuugagggaaacggag

SEQ ID NO: 3951620 - RNA, 12 nt, Shigella flexneri 2a str. 301
uccauuuuucac

SEQ ID NO: 3951621 - RNA, 17 nt, Shigella flexneri 2a str. 301
uccauuuuucacuuaau

SEQ ID NO: 3951622 - RNA, 23 nt, Shigella flexneri 2a str. 301
ucccaaaaacgcgguugccagau

SEQ ID NO: 3951623 - RNA, 13 nt, Shigella flexneri 2a str. 301
ucccaaaagcucg

SEQ ID NO: 3951624 - RNA, 17 nt, Shigella flexneri 2a str. 301
ucccaaagaucuccuca

SEQ ID NO: 3951625 - RNA, 18 nt, Shigella flexneri 2a str. 301
ucccaacaacagcgcgcu

SEQ ID NO: 3951626 - RNA, 19 nt, Shigella flexneri 2a str. 301
ucccaaccuuguuucugag

SEQ ID NO: 3951627 - RNA, 17 nt, Shigella flexneri 2a str. 301
ucccaauugcacauauu

SEQ ID NO: 3951628 - RNA, 22 nt, Shigella flexneri 2a str. 301
ucccacagccgucgagggcaac

SEQ ID NO: 3951629 - RNA, 16 nt, Shigella flexneri 2a str. 301
ucccaccaccagcaau

SEQ ID NO: 3951630 - RNA, 22 nt, Shigella flexneri 2a str. 301
ucccaccagacgugauaaacau

SEQ ID NO: 3951631 - RNA, 16 nt, Shigella flexneri 2a str. 301
ucccaccgggcaacug

SEQ ID NO: 3951632 - RNA, 16 nt, Shigella flexneri 2a str. 301
ucccaccugaaauggu

SEQ ID NO: 3951633 - RNA, 19 nt, Shigella flexneri 2a str. 301
ucccacgaccgcagcauug

SEQ ID NO: 3951634 - RNA, 13 nt, Shigella flexneri 2a str. 301
ucccacgccgaau

SEQ ID NO: 3951635 - RNA, 19 nt, Shigella flexneri 2a str. 301
ucccacgcggcaacggcuu

SEQ ID NO: 3951636 - RNA, 18 nt, Shigella flexneri 2a str. 301
ucccacggugcagcugcg

SEQ ID NO: 3951637 - RNA, 17 nt, Shigella flexneri 2a str. 301
ucccacuuuuauuucac

SEQ ID NO: 3951638 - RNA, 15 nt, Shigella flexneri 2a str. 301
ucccagaauguuaac

SEQ ID NO: 3951639 - RNA, 14 nt, Shigella flexneri 2a str. 301
ucccagaccuucau

SEQ ID NO: 3951640 - RNA, 23 nt, Shigella flexneri 2a str. 301
ucccagacguuucgccagccgau

SEQ ID NO: 3951641 - RNA, 19 nt, Shigella flexneri 2a str. 301
ucccagcagagaucuuuca

SEQ ID NO: 3951642 - RNA, 20 nt, Shigella flexneri 2a str. 301
ucccagcagagaucuuucac

SEQ ID NO: 3951643 - RNA, 16 nt, Shigella flexneri 2a str. 301
ucccagcccagcgcuu

SEQ ID NO: 3951644 - RNA, 17 nt, Shigella flexneri 2a str. 301
ucccagccuugccagau

SEQ ID NO: 3951645 - RNA, 15 nt, Shigella flexneri 2a str. 301
ucccagcgcaggcag

SEQ ID NO: 3951646 - RNA, 19 nt, Shigella flexneri 2a str. 301
ucccagcgcggugauaacc

SEQ ID NO: 3951647 - RNA, 22 nt, Shigella flexneri 2a str. 301
ucccagcgcggugauaaccguu

SEQ ID NO: 3951648 - RNA, 13 nt, Shigella flexneri 2a str. 301
ucccagcgcguuc

SEQ ID NO: 3951649 - RNA, 19 nt, Shigella flexneri 2a str. 301
ucccagcguggagagcagc

SEQ ID NO: 3951650 - RNA, 16 nt, Shigella flexneri 2a str. 301
ucccaggcaaauccca

SEQ ID NO: 3951651 - RNA, 11 nt, Shigella flexneri 2a str. 301
ucccaggcacc

SEQ ID NO: 3951652 - RNA, 15 nt, Shigella flexneri 2a str. 301
ucccaggccaaaucc

SEQ ID NO: 3951653 - RNA, 22 nt, Shigella flexneri 2a str. 301
ucccaggccgccugcaacgcuu

SEQ ID NO: 3951654 - RNA, 14 nt, Shigella flexneri 2a str. 301
ucccaggcuucagg

SEQ ID NO: 3951655 - RNA, 14 nt, Shigella flexneri 2a str. 301
ucccaguagugcuu

SEQ ID NO: 3951656 - RNA, 14 nt, Shigella flexneri 2a str. 301
ucccagucuuucca

SEQ ID NO: 3951657 - RNA, 15 nt, Shigella flexneri 2a str. 301
ucccagugccugcau

SEQ ID NO: 3951658 - RNA, 16 nt, Shigella flexneri 2a str. 301
ucccauaagugcguca

SEQ ID NO: 3951659 - RNA, 15 nt, Shigella flexneri 2a str. 301
ucccaucuuuuuaag

SEQ ID NO: 3951660 - RNA, 14 nt, Shigella flexneri 2a str. 301
ucccauuaccauuc

SEQ ID NO: 3951661 - RNA, 16 nt, Shigella flexneri 2a str. 301
ucccauuuauuuuucc

SEQ ID NO: 3951662 - RNA, 14 nt, Shigella flexneri 2a str. 301
ucccauuuuugaau

SEQ ID NO: 3951663 - RNA, 22 nt, Shigella flexneri 2a str. 301
ucccauuuuugaauggaucucc

SEQ ID NO: 3951664 - RNA, 17 nt, Shigella flexneri 2a str. 301
uccgaagucccacggug

SEQ ID NO: 3951665 - RNA, 21 nt, Shigella flexneri 2a str. 301
uccgaauacggucuuuuuaua

SEQ ID NO: 3951666 - RNA, 22 nt, Shigella flexneri 2a str. 301
uccgacaaauguguucagcgau

SEQ ID NO: 3951667 - RNA, 12 nt, Shigella flexneri 2a str. 301
uccgacagaaua

SEQ ID NO: 3951668 - RNA, 18 nt, Shigella flexneri 2a str. 301
uccgacaucccgccagcc

SEQ ID NO: 3951669 - RNA, 18 nt, Shigella flexneri 2a str. 301
uccgacauuucugcugcc

SEQ ID NO: 3951670 - RNA, 20 nt, Shigella flexneri 2a str. 301
uccgacauuucugcugccua

SEQ ID NO: 3951671 - RNA, 19 nt, Shigella flexneri 2a str. 301
uccgaccuacaaaaccugc

SEQ ID NO: 3951672 - RNA, 19 nt, Shigella flexneri 2a str. 301
uccgagaauggacaccagc

SEQ ID NO: 3951673 - RNA, 15 nt, Shigella flexneri 2a str. 301
uccgagguuaauauu

SEQ ID NO: 3951674 - RNA, 18 nt, Shigella flexneri 2a str. 301
uccgaguggcugaaggag

SEQ ID NO: 3951675 - RNA, 13 nt, Shigella flexneri 2a str. 301
uccgaucccugcg

SEQ ID NO: 3951676 - RNA, 13 nt, Shigella flexneri 2a str. 301
uccgauccucacu

SEQ ID NO: 3951677 - RNA, 18 nt, Shigella flexneri 2a str. 301
uccgaucgcgcaucagca

SEQ ID NO: 3951678 - RNA, 13 nt, Shigella flexneri 2a str. 301
uccgauuaccggc

SEQ ID NO: 3951679 - RNA, 13 nt, Shigella flexneri 2a str. 301
uccgauuuguucu

SEQ ID NO: 3951680 - RNA, 22 nt, Shigella flexneri 2a str. 301
uccgcaagcgaaugaggcagca

SEQ ID NO: 3951681 - RNA, 20 nt, Shigella flexneri 2a str. 301
uccgcaauacaucaaagcgu

SEQ ID NO: 3951682 - RNA, 12 nt, Shigella flexneri 2a str. 301
uccgcaaucaaa

SEQ ID NO: 3951683 - RNA, 23 nt, Shigella flexneri 2a str. 301
uccgcaaucaaaugacugguuuu

SEQ ID NO: 3951684 - RNA, 18 nt, Shigella flexneri 2a str. 301
uccgcaccaacuccacuu

SEQ ID NO: 3951685 - RNA, 15 nt, Shigella flexneri 2a str. 301
uccgcaccugccagc

SEQ ID NO: 3951686 - RNA, 18 nt, Shigella flexneri 2a str. 301
uccgcacguuagaaacaa

SEQ ID NO: 3951687 - RNA, 16 nt, Shigella flexneri 2a str. 301
uccgcagacacuuucc

SEQ ID NO: 3951688 - RNA, 17 nt, Shigella flexneri 2a str. 301
uccgcauccggcauaaa

SEQ ID NO: 3951689 - RNA, 21 nt, Shigella flexneri 2a str. 301
uccgcauuuguaggcaggaua

SEQ ID NO: 3951690 - RNA, 14 nt, Shigella flexneri 2a str. 301
uccgccaauuucau

SEQ ID NO: 3951691 - RNA, 13 nt, Shigella flexneri 2a str. 301
uccgccaccugcg

SEQ ID NO: 3951692 - RNA, 17 nt, Shigella flexneri 2a str. 301
uccgccagccuacagaa

SEQ ID NO: 3951693 - RNA, 13 nt, Shigella flexneri 2a str. 301
uccgccagcgcca

SEQ ID NO: 3951694 - RNA, 11 nt, Shigella flexneri 2a str. 301
uccgccagcgg

SEQ ID NO: 3951695 - RNA, 19 nt, Shigella flexneri 2a str. 301
uccgccagugccaaagcca

SEQ ID NO: 3951696 - RNA, 14 nt, Shigella flexneri 2a str. 301
uccgccaucagucg

SEQ ID NO: 3951697 - RNA, 15 nt, Shigella flexneri 2a str. 301
uccgccauuuuaauc

SEQ ID NO: 3951698 - RNA, 16 nt, Shigella flexneri 2a str. 301
uccgccccauuuuuaa

SEQ ID NO: 3951699 - RNA, 15 nt, Shigella flexneri 2a str. 301
uccgccgccagcaga

SEQ ID NO: 3951700 - RNA, 16 nt, Shigella flexneri 2a str. 301
uccgccgccagcagac

SEQ ID NO: 3951701 - RNA, 21 nt, Shigella flexneri 2a str. 301
uccgccgccauugacguuccu

SEQ ID NO: 3951702 - RNA, 12 nt, Shigella flexneri 2a str. 301
uccgccgucacc

SEQ ID NO: 3951703 - RNA, 15 nt, Shigella flexneri 2a str. 301
uccgccgucaccauu

SEQ ID NO: 3951704 - RNA, 18 nt, Shigella flexneri 2a str. 301
uccgccgucgggucagcu

SEQ ID NO: 3951705 - RNA, 18 nt, Shigella flexneri 2a str. 301
uccgccucuaacagauca

SEQ ID NO: 3951706 - RNA, 23 nt, Shigella flexneri 2a str. 301
uccgccucuaacagaucauccau

SEQ ID NO: 3951707 - RNA, 16 nt, Shigella flexneri 2a str. 301
uccgccucuuucacuc

SEQ ID NO: 3951708 - RNA, 17 nt, Shigella flexneri 2a str. 301
uccgcgaacagcagcgg

SEQ ID NO: 3951709 - RNA, 18 nt, Shigella flexneri 2a str. 301
uccgcggcuuugucauaa

SEQ ID NO: 3951710 - RNA, 19 nt, Shigella flexneri 2a str. 301
uccgcgucauugacgcugg

SEQ ID NO: 3951711 - RNA, 15 nt, Shigella flexneri 2a str. 301
uccgcgugacgcugg

SEQ ID NO: 3951712 - RNA, 23 nt, Shigella flexneri 2a str. 301
uccgcgugacgcuggcagaaagu

SEQ ID NO: 3951713 - RNA, 20 nt, Shigella flexneri 2a str. 301
uccgcuaguguacccuucgu

SEQ ID NO: 3951714 - RNA, 16 nt, Shigella flexneri 2a str. 301
uccgcuaucaguucag

SEQ ID NO: 3951715 - RNA, 17 nt, Shigella flexneri 2a str. 301
uccgcuaucaguucaga

SEQ ID NO: 3951716 - RNA, 13 nt, Shigella flexneri 2a str. 301
uccgcuauuucuu

SEQ ID NO: 3951717 - RNA, 20 nt, Shigella flexneri 2a str. 301
uccgcucggucacugacacc

SEQ ID NO: 3951718 - RNA, 21 nt, Shigella flexneri 2a str. 301
uccgcugauucaaaaccgguu

SEQ ID NO: 3951719 - RNA, 12 nt, Shigella flexneri 2a str. 301
uccgcuggagca

SEQ ID NO: 3951720 - RNA, 17 nt, Shigella flexneri 2a str. 301
uccgcuggcccaucaga

SEQ ID NO: 3951721 - RNA, 16 nt, Shigella flexneri 2a str. 301
uccgcuggcgucuggg

SEQ ID NO: 3951722 - RNA, 18 nt, Shigella flexneri 2a str. 301
uccgcuguugcgcuaagc

SEQ ID NO: 3951723 - RNA, 18 nt, Shigella flexneri 2a str. 301
uccgcuucaccaccgcaa

SEQ ID NO: 3951724 - RNA, 19 nt, Shigella flexneri 2a str. 301
uccgcuuucgguuuuucua

SEQ ID NO: 3951725 - RNA, 23 nt, Shigella flexneri 2a str. 301
uccgcuuuguguaaguuuaaccu

SEQ ID NO: 3951726 - RNA, 17 nt, Shigella flexneri 2a str. 301
uccggaauacuauucac

SEQ ID NO: 3951727 - RNA, 23 nt, Shigella flexneri 2a str. 301
uccggacaugcugcacgccaucu

SEQ ID NO: 3951728 - RNA, 15 nt, Shigella flexneri 2a str. 301
uccggacguucagcc

SEQ ID NO: 3951729 - RNA, 19 nt, Shigella flexneri 2a str. 301
uccggacuccgcaccgccg

SEQ ID NO: 3951730 - RNA, 13 nt, Shigella flexneri 2a str. 301
uccggaucgccaa

SEQ ID NO: 3951731 - RNA, 22 nt, Shigella flexneri 2a str. 301
uccggaucgccaaagcggcagu

SEQ ID NO: 3951732 - RNA, 16 nt, Shigella flexneri 2a str. 301
uccggauggcaaacug

SEQ ID NO: 3951733 - RNA, 17 nt, Shigella flexneri 2a str. 301
uccggauucaaaccuaa

SEQ ID NO: 3951734 - RNA, 19 nt, Shigella flexneri 2a str. 301
uccggauuuuuuuaugcac

SEQ ID NO: 3951735 - RNA, 14 nt, Shigella flexneri 2a str. 301
uccggcaaaaacaa

SEQ ID NO: 3951736 - RNA, 23 nt, Shigella flexneri 2a str. 301
uccggcaaauaacgccccggcaa

SEQ ID NO: 3951737 - RNA, 21 nt, Shigella flexneri 2a str. 301
uccggcaauaagcaacgcgca

SEQ ID NO: 3951738 - RNA, 23 nt, Shigella flexneri 2a str. 301
uccggcaaucggugcaaaugcca

SEQ ID NO: 3951739 - RNA, 22 nt, Shigella flexneri 2a str. 301
uccggcaauugugauggucaga

SEQ ID NO: 3951740 - RNA, 22 nt, Shigella flexneri 2a str. 301
uccggcaccaauguaggccuga

SEQ ID NO: 3951741 - RNA, 20 nt, Shigella flexneri 2a str. 301
uccggcaccuuuucaucagg

SEQ ID NO: 3951742 - RNA, 14 nt, Shigella flexneri 2a str. 301
uccggcagaagcaa

SEQ ID NO: 3951743 - RNA, 22 nt, Shigella flexneri 2a str. 301
uccggcagaagcaaucauccca

SEQ ID NO: 3951744 - RNA, 13 nt, Shigella flexneri 2a str. 301
uccggcagagaaa

SEQ ID NO: 3951745 - RNA, 15 nt, Shigella flexneri 2a str. 301
uccggcagcagaaag

SEQ ID NO: 3951746 - RNA, 16 nt, Shigella flexneri 2a str. 301
uccggcagcagaaagc

SEQ ID NO: 3951747 - RNA, 20 nt, Shigella flexneri 2a str. 301
uccggcaggcgggaaagcca

SEQ ID NO: 3951748 - RNA, 13 nt, Shigella flexneri 2a str. 301
uccggcagucagu

SEQ ID NO: 3951749 - RNA, 14 nt, Shigella flexneri 2a str. 301
uccggcaguuucau

SEQ ID NO: 3951750 - RNA, 20 nt, Shigella flexneri 2a str. 301
uccggcauaaacaaagcgca

SEQ ID NO: 3951751 - RNA, 20 nt, Shigella flexneri 2a str. 301
uccggcauaaacaaagugca

SEQ ID NO: 3951752 - RNA, 23 nt, Shigella flexneri 2a str. 301
uccggcaucaacaaagugcacgu

SEQ ID NO: 3951753 - RNA, 20 nt, Shigella flexneri 2a str. 301
uccggcaucacaucgcuggu

SEQ ID NO: 3951754 - RNA, 14 nt, Shigella flexneri 2a str. 301
uccggcauccagcc

SEQ ID NO: 3951755 - RNA, 20 nt, Shigella flexneri 2a str. 301
uccggcaucguuugcugccu

SEQ ID NO: 3951756 - RNA, 15 nt, Shigella flexneri 2a str. 301
uccggcaugaacaaa

SEQ ID NO: 3951757 - RNA, 23 nt, Shigella flexneri 2a str. 301
uccggcaugauauguaacauacc

SEQ ID NO: 3951758 - RNA, 19 nt, Shigella flexneri 2a str. 301
uccggcauuaucacaucag

SEQ ID NO: 3951759 - RNA, 16 nt, Shigella flexneri 2a str. 301
uccggccgccacacag

SEQ ID NO: 3951760 - RNA, 15 nt, Shigella flexneri 2a str. 301
uccggccugcacugc

SEQ ID NO: 3951761 - RNA, 23 nt, Shigella flexneri 2a str. 301
uccggcgaauuaccagccagaca

SEQ ID NO: 3951762 - RNA, 15 nt, Shigella flexneri 2a str. 301
uccggcgacacaucu

SEQ ID NO: 3951763 - RNA, 13 nt, Shigella flexneri 2a str. 301
uccggcgucgcuu

SEQ ID NO: 3951764 - RNA, 18 nt, Shigella flexneri 2a str. 301
uccugccgaucaacugcg

SEQ ID NO: 3951765 - RNA, 16 nt, Shigella flexneri 2a str. 301
uccugccgcaguuucu

SEQ ID NO: 3951766 - RNA, 21 nt, Shigella flexneri 2a str. 301
uccugccggacguguuuucac

SEQ ID NO: 3951767 - RNA, 16 nt, Shigella flexneri 2a str. 301
uccugcgcacaagccc

SEQ ID NO: 3951768 - RNA, 18 nt, Shigella flexneri 2a str. 301
uccugcgcaggaagcggu

SEQ ID NO: 3951769 - RNA, 20 nt, Shigella flexneri 2a str. 301
uccugcgcaggaagcgguug

SEQ ID NO: 3951770 - RNA, 16 nt, Shigella flexneri 2a str. 301
uccugcgcuuccagcu

SEQ ID NO: 3951771 - RNA, 14 nt, Shigella flexneri 2a str. 301
uccugcggacaguc

SEQ ID NO: 3951772 - RNA, 19 nt, Shigella flexneri 2a str. 301
uccugcgugacuaaaaccc

SEQ ID NO: 3951773 - RNA, 18 nt, Shigella flexneri 2a str. 301
uccugcucaaguaauaaa

SEQ ID NO: 3951774 - RNA, 22 nt, Shigella flexneri 2a str. 301
uccugcucaaugucugucauau

SEQ ID NO: 3951775 - RNA, 13 nt, Shigella flexneri 2a str. 301
uccugcuccuguc

SEQ ID NO: 3951776 - RNA, 19 nt, Shigella flexneri 2a str. 301
uccugcugcacgcccugau

SEQ ID NO: 3951777 - RNA, 19 nt, Shigella flexneri 2a str. 301
uccuggaucacaauccgcu

SEQ ID NO: 3951778 - RNA, 22 nt, Shigella flexneri 2a str. 301
uccuggcaacggacgaccgauu

SEQ ID NO: 3951779 - RNA, 16 nt, Shigella flexneri 2a str. 301
uccuggcgaaaacgcc

SEQ ID NO: 3951780 - RNA, 13 nt, Shigella flexneri 2a str. 301
uccuggcgcuggc

SEQ ID NO: 3951781 - RNA, 19 nt, Shigella flexneri 2a str. 301
uccuggcgguuaauaauga

SEQ ID NO: 3951782 - RNA, 21 nt, Shigella flexneri 2a str. 301
uccuggcgguuaauaaugauu

SEQ ID NO: 3951783 - RNA, 21 nt, Shigella flexneri 2a str. 301
uccuggcugauugauauccag

SEQ ID NO: 3951784 - RNA, 18 nt, Shigella flexneri 2a str. 301
uccuggcuugccagccau

SEQ ID NO: 3951785 - RNA, 14 nt, Shigella flexneri 2a str. 301
uccuggcuuggcug

SEQ ID NO: 3951786 - RNA, 23 nt, Shigella flexneri 2a str. 301
uccuggcuuggcuggcgugagcc

SEQ ID NO: 3951787 - RNA, 22 nt, Shigella flexneri 2a str. 301
uccuggggguucaucaccacug

SEQ ID NO: 3951788 - RNA, 18 nt, Shigella flexneri 2a str. 301
uccuggggucaucagcau

SEQ ID NO: 3951789 - RNA, 18 nt, Shigella flexneri 2a str. 301
uccugguaguccaggaug

SEQ ID NO: 3951790 - RNA, 18 nt, Shigella flexneri 2a str. 301
uccuggucggcaaacugc

SEQ ID NO: 3951791 - RNA, 20 nt, Shigella flexneri 2a str. 301
uccuggucugaugaaugguu

SEQ ID NO: 3951792 - RNA, 17 nt, Shigella flexneri 2a str. 301
uccugguuucuggucau

SEQ ID NO: 3951793 - RNA, 18 nt, Shigella flexneri 2a str. 301
uccugguuucuggucauu

SEQ ID NO: 3951794 - RNA, 18 nt, Shigella flexneri 2a str. 301
uccuguaaugagaauaau

SEQ ID NO: 3951795 - RNA, 16 nt, Shigella flexneri 2a str. 301
uccuguacuguuucac

SEQ ID NO: 3951796 - RNA, 13 nt, Shigella flexneri 2a str. 301
uccuguagcguua

SEQ ID NO: 3951797 - RNA, 18 nt, Shigella flexneri 2a str. 301
uccuguagcuggaaaauc

SEQ ID NO: 3951798 - RNA, 15 nt, Shigella flexneri 2a str. 301
uccuguaugacccgg

SEQ ID NO: 3951799 - RNA, 14 nt, Shigella flexneri 2a str. 301
uccugucuucccug

SEQ ID NO: 3951800 - RNA, 15 nt, Shigella flexneri 2a str. 301
uccugucuucccugc

SEQ ID NO: 3951801 - RNA, 20 nt, Shigella flexneri 2a str. 301
uccuguggacgcagcucaua

SEQ ID NO: 3951802 - RNA, 17 nt, Shigella flexneri 2a str. 301
uccuguuccauggugua

SEQ ID NO: 3951803 - RNA, 20 nt, Shigella flexneri 2a str. 301
uccuguugucuuuccagacu

SEQ ID NO: 3951804 - RNA, 15 nt, Shigella flexneri 2a str. 301
uccuguuucggacuu

SEQ ID NO: 3951805 - RNA, 18 nt, Shigella flexneri 2a str. 301
uccuguuuuuaagugaug

SEQ ID NO: 3951806 - RNA, 14 nt, Shigella flexneri 2a str. 301
uccuuaaacaccug

SEQ ID NO: 3951807 - RNA, 13 nt, Shigella flexneri 2a str. 301
uccuuaauaaaau

SEQ ID NO: 3951808 - RNA, 14 nt, Shigella flexneri 2a str. 301
uccuuaauaaaaua

SEQ ID NO: 3951809 - RNA, 16 nt, Shigella flexneri 2a str. 301
uccuuaauaaaauacu

SEQ ID NO: 3951810 - RNA, 15 nt, Shigella flexneri 2a str. 301
uccuuacugcccccg

SEQ ID NO: 3951811 - RNA, 23 nt, Shigella flexneri 2a str. 301
uccuuagcaacaggccaguucga

SEQ ID NO: 3951812 - RNA, 23 nt, Shigella flexneri 2a str. 301
uccuucacuuuugccagacgaau

SEQ ID NO: 3951813 - RNA, 12 nt, Shigella flexneri 2a str. 301
uccuucagcaac

SEQ ID NO: 3951814 - RNA, 18 nt, Shigella flexneri 2a str. 301
uccuucaggaucaaccgc

SEQ ID NO: 3951815 - RNA, 20 nt, Shigella flexneri 2a str. 301
uccuucaucuucaacugcca

SEQ ID NO: 3951816 - RNA, 12 nt, Shigella flexneri 2a str. 301
uccuuccagcug

SEQ ID NO: 3951817 - RNA, 13 nt, Shigella flexneri 2a str. 301
uccuuccagguca

SEQ ID NO: 3951818 - RNA, 15 nt, Shigella flexneri 2a str. 301
uccuucgauaaaagc

SEQ ID NO: 3951819 - RNA, 16 nt, Shigella flexneri 2a str. 301
uccuucgauaaaagcc

SEQ ID NO: 3951820 - RNA, 17 nt, Shigella flexneri 2a str. 301
uccuucggauuuccguu

SEQ ID NO: 3951821 - RNA, 16 nt, Shigella flexneri 2a str. 301
uccuucgggaagccuu

SEQ ID NO: 3951822 - RNA, 23 nt, Shigella flexneri 2a str. 301
uccuucuauaaggccccuuccuc

SEQ ID NO: 3951823 - RNA, 23 nt, Shigella flexneri 2a str. 301
uccuucuuguucgaagaguucca

SEQ ID NO: 3951824 - RNA, 14 nt, Shigella flexneri 2a str. 301
uccuugaaaaagag

SEQ ID NO: 3951825 - RNA, 17 nt, Shigella flexneri 2a str. 301
uccuugaguuucgucuu

SEQ ID NO: 3951826 - RNA, 21 nt, Shigella flexneri 2a str. 301
uccuugcgcuuucuuaaauua

SEQ ID NO: 3951827 - RNA, 18 nt, Shigella flexneri 2a str. 301
uccuugcguacaccaaca

SEQ ID NO: 3951828 - RNA, 17 nt, Shigella flexneri 2a str. 301
uccuuggauauuuuaau

SEQ ID NO: 3951829 - RNA, 18 nt, Shigella flexneri 2a str. 301
uccuuggauauuuuaauc

SEQ ID NO: 3951830 - RNA, 19 nt, Shigella flexneri 2a str. 301
uccuuggauauuuuaauca

SEQ ID NO: 3951831 - RNA, 19 nt, Shigella flexneri 2a str. 301
uccuuggucugauacuaau

SEQ ID NO: 3951832 - RNA, 17 nt, Shigella flexneri 2a str. 301
uccuuuccuuaagccag

SEQ ID NO: 3951833 - RNA, 21 nt, Shigella flexneri 2a str. 301
uccuuuguacaggauauauuu

SEQ ID NO: 3951834 - RNA, 12 nt, Shigella flexneri 2a str. 301
uccuuuguacca

SEQ ID NO: 3951835 - RNA, 16 nt, Shigella flexneri 2a str. 301
uccuuuuauuuaaccg

SEQ ID NO: 3951836 - RNA, 13 nt, Shigella flexneri 2a str. 301
ucgaaaaugcgca

SEQ ID NO: 3951837 - RNA, 19 nt, Shigella flexneri 2a str. 301
ucgaaaauggccucggcua

SEQ ID NO: 3951838 - RNA, 22 nt, Shigella flexneri 2a str. 301
ucgaaauagagaaaguaaacca

SEQ ID NO: 3951839 - RNA, 16 nt, Shigella flexneri 2a str. 301
ucgaaauaucacugau

SEQ ID NO: 3951840 - RNA, 17 nt, Shigella flexneri 2a str. 301
ucgaaaucaacauguuc

SEQ ID NO: 3951841 - RNA, 24 nt, Shigella flexneri 2a str. 301
ucgaaauccauguugcuggaagau

SEQ ID NO: 3951842 - RNA, 13 nt, Shigella flexneri 2a str. 301
ucgaaaugauggu

SEQ ID NO: 3951843 - RNA, 19 nt, Shigella flexneri 2a str. 301
ucgaaaugauggucuggug

SEQ ID NO: 3951844 - RNA, 14 nt, Shigella flexneri 2a str. 301
ucgaacagcagcag

SEQ ID NO: 3951845 - RNA, 21 nt, Shigella flexneri 2a str. 301
ucgaacauccccacagaaaca

SEQ ID NO: 3951846 - RNA, 15 nt, Shigella flexneri 2a str. 301
ucgaacgccaguuca

SEQ ID NO: 3951847 - RNA, 17 nt, Shigella flexneri 2a str. 301
ucgaacucauacaccag

SEQ ID NO: 3951848 - RNA, 18 nt, Shigella flexneri 2a str. 301
ucgaacucauacaccagc

SEQ ID NO: 3951849 - RNA, 19 nt, Shigella flexneri 2a str. 301
ucgaacucauacaccagcg

SEQ ID NO: 3951850 - RNA, 17 nt, Shigella flexneri 2a str. 301
ucgaagaucagcauaau

SEQ ID NO: 3951851 - RNA, 13 nt, Shigella flexneri 2a str. 301
ucgaaguuuuccu

SEQ ID NO: 3951852 - RNA, 17 nt, Shigella flexneri 2a str. 301
ucgaaguuuuccucagu

SEQ ID NO: 3951853 - RNA, 15 nt, Shigella flexneri 2a str. 301
ucgaaugccgcagca

SEQ ID NO: 3951854 - RNA, 19 nt, Shigella flexneri 2a str. 301
ucgaauuacacagccacag

SEQ ID NO: 3951855 - RNA, 15 nt, Shigella flexneri 2a str. 301
ucgacaaaaacccug

SEQ ID NO: 3951856 - RNA, 17 nt, Shigella flexneri 2a str. 301
ucgacaaaaucggaaac

SEQ ID NO: 3951857 - RNA, 18 nt, Shigella flexneri 2a str. 301
ucgacaauaaucaacgcg

SEQ ID NO: 3951858 - RNA, 15 nt, Shigella flexneri 2a str. 301
ucgacaccaaacaga

SEQ ID NO: 3951859 - RNA, 12 nt, Shigella flexneri 2a str. 301
ucgacaccaucu

SEQ ID NO: 3951860 - RNA, 15 nt, Shigella flexneri 2a str. 301
ucgacagacgccagc

SEQ ID NO: 3951861 - RNA, 21 nt, Shigella flexneri 2a str. 301
ucgacagacgccagcgcuuuu

SEQ ID NO: 3951862 - RNA, 13 nt, Shigella flexneri 2a str. 301
ucgacagcagccc

SEQ ID NO: 3951863 - RNA, 21 nt, Shigella flexneri 2a str. 301
ucgacagccaguuugacaucg

SEQ ID NO: 3951864 - RNA, 20 nt, Shigella flexneri 2a str. 301
ucgccacggcaugaaagcga

SEQ ID NO: 3951865 - RNA, 16 nt, Shigella flexneri 2a str. 301
ucgccacuaaagccug

SEQ ID NO: 3951866 - RNA, 14 nt, Shigella flexneri 2a str. 301
ucgccagaaaucag

SEQ ID NO: 3951867 - RNA, 16 nt, Shigella flexneri 2a str. 301
ucgccagcaacacaaa

SEQ ID NO: 3951868 - RNA, 14 nt, Shigella flexneri 2a str. 301
ucgccagcagccau

SEQ ID NO: 3951869 - RNA, 14 nt, Shigella flexneri 2a str. 301
ucgccagcaucggc

SEQ ID NO: 3951870 - RNA, 15 nt, Shigella flexneri 2a str. 301
ucgccagccaccaug

SEQ ID NO: 3951871 - RNA, 20 nt, Shigella flexneri 2a str. 301
ucgccagccucccagccauu

SEQ ID NO: 3951872 - RNA, 20 nt, Shigella flexneri 2a str. 301
ucgccagcgccagcgcuucc

SEQ ID NO: 3951873 - RNA, 19 nt, Shigella flexneri 2a str. 301
ucgccagcggaauaacgcg

SEQ ID NO: 3951874 - RNA, 13 nt, Shigella flexneri 2a str. 301
ucgccagcggcag

SEQ ID NO: 3951875 - RNA, 13 nt, Shigella flexneri 2a str. 301
ucgccagcucaag

SEQ ID NO: 3951876 - RNA, 20 nt, Shigella flexneri 2a str. 301
ucgccaggcguuugaaaaag

SEQ ID NO: 3951877 - RNA, 23 nt, Shigella flexneri 2a str. 301
ucgccaggcguuugaaaaagcca

SEQ ID NO: 3951878 - RNA, 17 nt, Shigella flexneri 2a str. 301
ucgccagguuaaacauc

SEQ ID NO: 3951879 - RNA, 15 nt, Shigella flexneri 2a str. 301
ucgccagucccuuuc

SEQ ID NO: 3951880 - RNA, 16 nt, Shigella flexneri 2a str. 301
ucgccagucccuuuca

SEQ ID NO: 3951881 - RNA, 14 nt, Shigella flexneri 2a str. 301
ucgccaguccuuca

SEQ ID NO: 3951882 - RNA, 15 nt, Shigella flexneri 2a str. 301
ucgccaucaaaggcu

SEQ ID NO: 3951883 - RNA, 20 nt, Shigella flexneri 2a str. 301
ucgccaucccugucguccag

SEQ ID NO: 3951884 - RNA, 23 nt, Shigella flexneri 2a str. 301
ucgccauccgaauucacuuaauc

SEQ ID NO: 3951885 - RNA, 17 nt, Shigella flexneri 2a str. 301
ucgccaugaacgcgaag

SEQ ID NO: 3951886 - RNA, 19 nt, Shigella flexneri 2a str. 301
ucgccauuuucugccgcau

SEQ ID NO: 3951887 - RNA, 15 nt, Shigella flexneri 2a str. 301
ucgcccacaccagau

SEQ ID NO: 3951888 - RNA, 13 nt, Shigella flexneri 2a str. 301
ucgcccacaucau

SEQ ID NO: 3951889 - RNA, 17 nt, Shigella flexneri 2a str. 301
ucgcccacgccagagau

SEQ ID NO: 3951890 - RNA, 23 nt, Shigella flexneri 2a str. 301
ucgcccacuucuuucgcccagcg

SEQ ID NO: 3951891 - RNA, 16 nt, Shigella flexneri 2a str. 301
ucgcccaggcgaccag

SEQ ID NO: 3951892 - RNA, 16 nt, Shigella flexneri 2a str. 301
ucgcccauuuuucaug

SEQ ID NO: 3951893 - RNA, 12 nt, Shigella flexneri 2a str. 301
ucgcccccucuu

SEQ ID NO: 3951894 - RNA, 16 nt, Shigella flexneri 2a str. 301
ucgccccgagaaaaau

SEQ ID NO: 3951895 - RNA, 22 nt, Shigella flexneri 2a str. 301
ucgcccgaccaucgccagcuca

SEQ ID NO: 3951896 - RNA, 15 nt, Shigella flexneri 2a str. 301
ucgcccguucauccg

SEQ ID NO: 3951897 - RNA, 16 nt, Shigella flexneri 2a str. 301
ucgcccguuuugagaa

SEQ ID NO: 3951898 - RNA, 21 nt, Shigella flexneri 2a str. 301
ucgcccugcuccagcaacuca

SEQ ID NO: 3951899 - RNA, 22 nt, Shigella flexneri 2a str. 301
ucgcccuggacaacauuccugc

SEQ ID NO: 3951900 - RNA, 16 nt, Shigella flexneri 2a str. 301
ucgcccuucaucuuug

SEQ ID NO: 3951901 - RNA, 21 nt, Shigella flexneri 2a str. 301
ucgccgaacacacauuuaucc

SEQ ID NO: 3951902 - RNA, 20 nt, Shigella flexneri 2a str. 301
ucgccgccagcgucugagca

SEQ ID NO: 3951903 - RNA, 13 nt, Shigella flexneri 2a str. 301
ucgccgccgcugg

SEQ ID NO: 3951904 - RNA, 19 nt, Shigella flexneri 2a str. 301
ucgccgcgacacaacgcuu

SEQ ID NO: 3951905 - RNA, 20 nt, Shigella flexneri 2a str. 301
ucgccgcugacggcucgccc

SEQ ID NO: 3951906 - RNA, 18 nt, Shigella flexneri 2a str. 301
ucgccgcugugauuucag

SEQ ID NO: 3951907 - RNA, 19 nt, Shigella flexneri 2a str. 301
ucgccgcugugauuucagc

SEQ ID NO: 3951908 - RNA, 16 nt, Shigella flexneri 2a str. 301
ucgccggaauuucuuu

SEQ ID NO: 3951909 - RNA, 22 nt, Shigella flexneri 2a str. 301
ucgccggaauuucuuucagcag

SEQ ID NO: 3951910 - RNA, 23 nt, Shigella flexneri 2a str. 301
ucgccggaauuucuuucagcagu

SEQ ID NO: 3951911 - RNA, 15 nt, Shigella flexneri 2a str. 301
ucgccgguuccagcu

SEQ ID NO: 3951912 - RNA, 21 nt, Shigella flexneri 2a str. 301
ucgccgguuuugucuucgaua

SEQ ID NO: 3951913 - RNA, 15 nt, Shigella flexneri 2a str. 301
ucgccgucaggcaag

SEQ ID NO: 3951914 - RNA, 15 nt, Shigella flexneri 2a str. 301
ucgccguuaccguac

SEQ ID NO: 3951915 - RNA, 13 nt, Shigella flexneri 2a str. 301
ucgccuccuguuc

SEQ ID NO: 3951916 - RNA, 17 nt, Shigella flexneri 2a str. 301
ucgccuccuguucugug

SEQ ID NO: 3951917 - RNA, 14 nt, Shigella flexneri 2a str. 301
ucgccucgccgaaa

SEQ ID NO: 3951918 - RNA, 20 nt, Shigella flexneri 2a str. 301
ucgccugaauuacugggaug

SEQ ID NO: 3951919 - RNA, 17 nt, Shigella flexneri 2a str. 301
ucgccugcaucaccauc

SEQ ID NO: 3951920 - RNA, 16 nt, Shigella flexneri 2a str. 301
ucgccugccagaugca

SEQ ID NO: 3951921 - RNA, 22 nt, Shigella flexneri 2a str. 301
ucgccugccagaugcagcggua

SEQ ID NO: 3951922 - RNA, 14 nt, Shigella flexneri 2a str. 301
ucgccugccgccag

SEQ ID NO: 3951923 - RNA, 13 nt, Shigella flexneri 2a str. 301
ucgccugcggcgc

SEQ ID NO: 3951924 - RNA, 18 nt, Shigella flexneri 2a str. 301
ucgccuggaccagcgggu

SEQ ID NO: 3951925 - RNA, 22 nt, Shigella flexneri 2a str. 301
ucgccuuccacuucugcgucga

SEQ ID NO: 3951926 - RNA, 20 nt, Shigella flexneri 2a str. 301
ucgccuuccggcaguuucau

SEQ ID NO: 3951927 - RNA, 16 nt, Shigella flexneri 2a str. 301
ucgccuuucggcugca

SEQ ID NO: 3951928 - RNA, 19 nt, Shigella flexneri 2a str. 301
ucgccuuucggcugcagca

SEQ ID NO: 3951929 - RNA, 15 nt, Shigella flexneri 2a str. 301
ucgccuuuuaaugcg

SEQ ID NO: 3951930 - RNA, 12 nt, Shigella flexneri 2a str. 301
ucgcgaaaugca

SEQ ID NO: 3951931 - RNA, 22 nt, Shigella flexneri 2a str. 301
ucgcgaaccgccuggcgcugcu

SEQ ID NO: 3951932 - RNA, 16 nt, Shigella flexneri 2a str. 301
ucgcgaaucgccacaa

SEQ ID NO: 3951933 - RNA, 18 nt, Shigella flexneri 2a str. 301
ucgcgaauggccugcgca

SEQ ID NO: 3951934 - RNA, 16 nt, Shigella flexneri 2a str. 301
ucgcgaccaaucacac

SEQ ID NO: 3951935 - RNA, 23 nt, Shigella flexneri 2a str. 301
ucgcgaccgccucgcgccagcgu

SEQ ID NO: 3951936 - RNA, 15 nt, Shigella flexneri 2a str. 301
ucgcgaccucaagcu

SEQ ID NO: 3951937 - RNA, 12 nt, Shigella flexneri 2a str. 301
ucgcgacgcuga

SEQ ID NO: 3951938 - RNA, 15 nt, Shigella flexneri 2a str. 301
ucgcgagauacaucg

SEQ ID NO: 3951939 - RNA, 15 nt, Shigella flexneri 2a str. 301
ucgcgauaacggauc

SEQ ID NO: 3951940 - RNA, 15 nt, Shigella flexneri 2a str. 301
ucgcgaugaugcgac

SEQ ID NO: 3951941 - RNA, 22 nt, Shigella flexneri 2a str. 301
ucgcgcacaggcugcccaguug

SEQ ID NO: 3951942 - RNA, 14 nt, Shigella flexneri 2a str. 301
ucgcgcacggugca

SEQ ID NO: 3951943 - RNA, 19 nt, Shigella flexneri 2a str. 301
ucgcgcacuaugugccagc

SEQ ID NO: 3951944 - RNA, 13 nt, Shigella flexneri 2a str. 301
ucgcgcacuggau

SEQ ID NO: 3951945 - RNA, 19 nt, Shigella flexneri 2a str. 301
ucgcgcagauagagcgccu

SEQ ID NO: 3951946 - RNA, 15 nt, Shigella flexneri 2a str. 301
ucgcgccaaucagcg

SEQ ID NO: 3951947 - RNA, 17 nt, Shigella flexneri 2a str. 301
ucgcgccuuacgcugcg

SEQ ID NO: 3951948 - RNA, 19 nt, Shigella flexneri 2a str. 301
ucgcgcgggaaaucaaguu

SEQ ID NO: 3951949 - RNA, 17 nt, Shigella flexneri 2a str. 301
ucgcgcguuaucccuua

SEQ ID NO: 3951950 - RNA, 20 nt, Shigella flexneri 2a str. 301
ucgcgcuuaucgccagcgcc

SEQ ID NO: 3951951 - RNA, 21 nt, Shigella flexneri 2a str. 301
ucgcgcuugcggaagcaaccg

SEQ ID NO: 3951952 - RNA, 20 nt, Shigella flexneri 2a str. 301
ucgcggcaauuuuuaccggu

SEQ ID NO: 3951953 - RNA, 22 nt, Shigella flexneri 2a str. 301
ucgcggcgauauccagcgcggc

SEQ ID NO: 3951954 - RNA, 18 nt, Shigella flexneri 2a str. 301
ucgcgguaaacugcgucg

SEQ ID NO: 3951955 - RNA, 17 nt, Shigella flexneri 2a str. 301
ucgcgguaaugacucca

SEQ ID NO: 3951956 - RNA, 15 nt, Shigella flexneri 2a str. 301
ucgcggucaaccauc

SEQ ID NO: 3951957 - RNA, 16 nt, Shigella flexneri 2a str. 301
ucgcgguuagcggcuu

SEQ ID NO: 3951958 - RNA, 16 nt, Shigella flexneri 2a str. 301
ucgcguaaauccagcg

SEQ ID NO: 3951959 - RNA, 16 nt, Shigella flexneri 2a str. 301
ucgcguaacugcugcu

SEQ ID NO: 3951960 - RNA, 16 nt, Shigella flexneri 2a str. 301
ucgcguacucaccgcu

SEQ ID NO: 3951961 - RNA, 17 nt, Shigella flexneri 2a str. 301
ucgcguaguaaagccuu

SEQ ID NO: 3951962 - RNA, 18 nt, Shigella flexneri 2a str. 301
ucgcgucuaaauuuugca

SEQ ID NO: 3951963 - RNA, 14 nt, Shigella flexneri 2a str. 301
ucgcguucggaaau

SEQ ID NO: 3951964 - RNA, 23 nt, Shigella flexneri 2a str. 301
ucggggcgaucgcgccaaucagc

SEQ ID NO: 3951965 - RNA, 17 nt, Shigella flexneri 2a str. 301
ucggggcuguuuuccag

SEQ ID NO: 3951966 - RNA, 18 nt, Shigella flexneri 2a str. 301
ucgggugcgacaggagcc

SEQ ID NO: 3951967 - RNA, 23 nt, Shigella flexneri 2a str. 301
ucggguuuacgugcacaggcaac

SEQ ID NO: 3951968 - RNA, 19 nt, Shigella flexneri 2a str. 301
ucgguauuaaucugccagc

SEQ ID NO: 3951969 - RNA, 17 nt, Shigella flexneri 2a str. 301
ucgguauuuccauuuuu

SEQ ID NO: 3951970 - RNA, 19 nt, Shigella flexneri 2a str. 301
ucggucacugacaccagca

SEQ ID NO: 3951971 - RNA, 14 nt, Shigella flexneri 2a str. 301
ucggucagcacgcg

SEQ ID NO: 3951972 - RNA, 22 nt, Shigella flexneri 2a str. 301
ucgguccaccacguaccacggc

SEQ ID NO: 3951973 - RNA, 19 nt, Shigella flexneri 2a str. 301
ucggucuuagcaaaggcuu

SEQ ID NO: 3951974 - RNA, 14 nt, Shigella flexneri 2a str. 301
ucggugaauucagc

SEQ ID NO: 3951975 - RNA, 15 nt, Shigella flexneri 2a str. 301
ucggugacagaaacu

SEQ ID NO: 3951976 - RNA, 15 nt, Shigella flexneri 2a str. 301
ucggugcaaaugcca

SEQ ID NO: 3951977 - RNA, 17 nt, Shigella flexneri 2a str. 301
ucggugcaaaugccaga

SEQ ID NO: 3951978 - RNA, 21 nt, Shigella flexneri 2a str. 301
ucggugcacaauugccggaug

SEQ ID NO: 3951979 - RNA, 20 nt, Shigella flexneri 2a str. 301
ucggugcacgaugccugaug

SEQ ID NO: 3951980 - RNA, 18 nt, Shigella flexneri 2a str. 301
ucggugcucaucagcccg

SEQ ID NO: 3951981 - RNA, 16 nt, Shigella flexneri 2a str. 301
ucgguggaaaauagca

SEQ ID NO: 3951982 - RNA, 19 nt, Shigella flexneri 2a str. 301
ucggugucguuacgccgca

SEQ ID NO: 3951983 - RNA, 18 nt, Shigella flexneri 2a str. 301
ucgguuaccacaccggca

SEQ ID NO: 3951984 - RNA, 16 nt, Shigella flexneri 2a str. 301
ucgguucgccugcacc

SEQ ID NO: 3951985 - RNA, 16 nt, Shigella flexneri 2a str. 301
ucgguugccauaaccu

SEQ ID NO: 3951986 - RNA, 19 nt, Shigella flexneri 2a str. 301
ucgguuuaaccggccuuuu

SEQ ID NO: 3951987 - RNA, 16 nt, Shigella flexneri 2a str. 301
ucgguuucaucacaua

SEQ ID NO: 3951988 - RNA, 14 nt, Shigella flexneri 2a str. 301
ucgguuuucaaucg

SEQ ID NO: 3951989 - RNA, 13 nt, Shigella flexneri 2a str. 301
ucguaagcaggag

SEQ ID NO: 3951990 - RNA, 18 nt, Shigella flexneri 2a str. 301
ucguaagccgugaaaaca

SEQ ID NO: 3951991 - RNA, 18 nt, Shigella flexneri 2a str. 301
ucguaagcgccaggaauu

SEQ ID NO: 3951992 - RNA, 12 nt, Shigella flexneri 2a str. 301
ucguaaguaagc

SEQ ID NO: 3951993 - RNA, 21 nt, Shigella flexneri 2a str. 301
ucguaauaacucacccaugaa

SEQ ID NO: 3951994 - RNA, 15 nt, Shigella flexneri 2a str. 301
ucguaaugaauguuu

SEQ ID NO: 3951995 - RNA, 17 nt, Shigella flexneri 2a str. 301
ucguaaugcuccggcuc

SEQ ID NO: 3951996 - RNA, 14 nt, Shigella flexneri 2a str. 301
ucguaauuuuucgg

SEQ ID NO: 3951997 - RNA, 19 nt, Shigella flexneri 2a str. 301
ucguaccaucauuggagag

SEQ ID NO: 3951998 - RNA, 14 nt, Shigella flexneri 2a str. 301
ucguacgaaagugc

SEQ ID NO: 3951999 - RNA, 15 nt, Shigella flexneri 2a str. 301
ucguagacugcagcg

SEQ ID NO: 3952000 - RNA, 14 nt, Shigella flexneri 2a str. 301
ucguagccaccauc

SEQ ID NO: 3952001 - RNA, 18 nt, Shigella flexneri 2a str. 301
ucguagccaccaucuuuu

SEQ ID NO: 3952002 - RNA, 20 nt, Shigella flexneri 2a str. 301
ucguaggccagauaagacgc

SEQ ID NO: 3952003 - RNA, 20 nt, Shigella flexneri 2a str. 301
ucguaggccagauaaggcgu

SEQ ID NO: 3952004 - RNA, 20 nt, Shigella flexneri 2a str. 301
ucguaggccggauaaggcgu

SEQ ID NO: 3952005 - RNA, 14 nt, Shigella flexneri 2a str. 301
ucguaggccugaua

SEQ ID NO: 3952006 - RNA, 15 nt, Shigella flexneri 2a str. 301
ucguaguaguucauc

SEQ ID NO: 3952007 - RNA, 14 nt, Shigella flexneri 2a str. 301
ucguauagaucacu

SEQ ID NO: 3952008 - RNA, 20 nt, Shigella flexneri 2a str. 301
ucguaucuggcaagcaggac

SEQ ID NO: 3952009 - RNA, 18 nt, Shigella flexneri 2a str. 301
ucguauugguacauaaca

SEQ ID NO: 3952010 - RNA, 13 nt, Shigella flexneri 2a str. 301
ucguauuuaaaac

SEQ ID NO: 3952011 - RNA, 22 nt, Shigella flexneri 2a str. 301
ucguauuuauuuuccaaaauaa

SEQ ID NO: 3952012 - RNA, 20 nt, Shigella flexneri 2a str. 301
ucgucacggugcgucggcuu

SEQ ID NO: 3952013 - RNA, 14 nt, Shigella flexneri 2a str. 301
ucgucagaaauggu

SEQ ID NO: 3952014 - RNA, 13 nt, Shigella flexneri 2a str. 301
ucgucagauuuua

SEQ ID NO: 3952015 - RNA, 22 nt, Shigella flexneri 2a str. 301
ucgucagccgggaugaaaggca

SEQ ID NO: 3952016 - RNA, 23 nt, Shigella flexneri 2a str. 301
ucgucaggaucagccauuuugca

SEQ ID NO: 3952017 - RNA, 22 nt, Shigella flexneri 2a str. 301
ucgucaguuccauaauguacau

SEQ ID NO: 3952018 - RNA, 13 nt, Shigella flexneri 2a str. 301
ucgucaucccagu

SEQ ID NO: 3952019 - RNA, 16 nt, Shigella flexneri 2a str. 301
ucgucaucccagucuu

SEQ ID NO: 3952020 - RNA, 16 nt, Shigella flexneri 2a str. 301
ucguccacgucaucaa

SEQ ID NO: 3952021 - RNA, 17 nt, Shigella flexneri 2a str. 301
ucguccacgucaucaaa

SEQ ID NO: 3952022 - RNA, 16 nt, Shigella flexneri 2a str. 301
ucgucccaaaagcucg

SEQ ID NO: 3952023 - RNA, 15 nt, Shigella flexneri 2a str. 301
ucgucgcgcacgccc

SEQ ID NO: 3952024 - RNA, 18 nt, Shigella flexneri 2a str. 301
ucgucgguguccacuucc

SEQ ID NO: 3952025 - RNA, 21 nt, Shigella flexneri 2a str. 301
ucgucgugaagcagagcagac

SEQ ID NO: 3952026 - RNA, 22 nt, Shigella flexneri 2a str. 301
ucgucguuaagccuuucgcaaa

SEQ ID NO: 3952027 - RNA, 17 nt, Shigella flexneri 2a str. 301
ucgucuggcgauuuuga

SEQ ID NO: 3952028 - RNA, 14 nt, Shigella flexneri 2a str. 301
ucgucuguuuuauc

SEQ ID NO: 3952029 - RNA, 17 nt, Shigella flexneri 2a str. 301
ucgucuucgucccaguc

SEQ ID NO: 3952030 - RNA, 16 nt, Shigella flexneri 2a str. 301
ucgucuuuauccugac

SEQ ID NO: 3952031 - RNA, 22 nt, Shigella flexneri 2a str. 301
ucgucuuuuucucccuuaaaaa

SEQ ID NO: 3952032 - RNA, 15 nt, Shigella flexneri 2a str. 301
ucgugaaaggaaaaa

SEQ ID NO: 3952033 - RNA, 21 nt, Shigella flexneri 2a str. 301
ucgugaagcuggcagaaguug

SEQ ID NO: 3952034 - RNA, 20 nt, Shigella flexneri 2a str. 301
ucgugaauaugucgcgccag

SEQ ID NO: 3952035 - RNA, 22 nt, Shigella flexneri 2a str. 301
ucgugaauuuuaggaugcugca

SEQ ID NO: 3952036 - RNA, 21 nt, Shigella flexneri 2a str. 301
ucgugacaauaauacccagca

SEQ ID NO: 3952037 - RNA, 21 nt, Shigella flexneri 2a str. 301
ucgugcaccaauugccggaug

SEQ ID NO: 3952038 - RNA, 10 nt, Shigella flexneri 2a str. 301
ucgugcagaa

SEQ ID NO: 3952039 - RNA, 13 nt, Shigella flexneri 2a str. 301
ucgugcaggcauu

SEQ ID NO: 3952040 - RNA, 20 nt, Shigella flexneri 2a str. 301
ucgugcggguaaccagccaa

SEQ ID NO: 3952041 - RNA, 19 nt, Shigella flexneri 2a str. 301
ucgugcgucgcauccggca

SEQ ID NO: 3952042 - RNA, 20 nt, Shigella flexneri 2a str. 301
ucgugcgucgcauccggcaa

SEQ ID NO: 3952043 - RNA, 10 nt, Shigella flexneri 2a str. 301
ucgugcuaaa

SEQ ID NO: 3952044 - RNA, 17 nt, Shigella flexneri 2a str. 301
ucgugcuaacguuuagu

SEQ ID NO: 3952045 - RNA, 12 nt, Shigella flexneri 2a str. 301
ucgugcucgcuu

SEQ ID NO: 3952046 - RNA, 20 nt, Shigella flexneri 2a str. 301
ucgugcuggauuugugucag

SEQ ID NO: 3952047 - RNA, 21 nt, Shigella flexneri 2a str. 301
ucgugggcaggaaaaucagca

SEQ ID NO: 3952048 - RNA, 16 nt, Shigella flexneri 2a str. 301
ucgugguaagaaggcc

SEQ ID NO: 3952049 - RNA, 21 nt, Shigella flexneri 2a str. 301
ucguguaacguacugcuuugu

SEQ ID NO: 3952050 - RNA, 11 nt, Shigella flexneri 2a str. 301
ucguguuaaca

SEQ ID NO: 3952051 - RNA, 23 nt, Shigella flexneri 2a str. 301
ucguguugcaccgaguucuucac

SEQ ID NO: 3952052 - RNA, 21 nt, Shigella flexneri 2a str. 301
ucguuaaacucugccgcaauc

SEQ ID NO: 3952053 - RNA, 19 nt, Shigella flexneri 2a str. 301
ucguuaacaacaacuucua

SEQ ID NO: 3952054 - RNA, 22 nt, Shigella flexneri 2a str. 301
ucguuacgccccgguuucucuu

SEQ ID NO: 3952055 - RNA, 22 nt, Shigella flexneri 2a str. 301
ucguucaaacgauucggcaauc

SEQ ID NO: 3952056 - RNA, 17 nt, Shigella flexneri 2a str. 301
ucguucagcggcccguu

SEQ ID NO: 3952057 - RNA, 13 nt, Shigella flexneri 2a str. 301
ucguucauauauu

SEQ ID NO: 3952058 - RNA, 19 nt, Shigella flexneri 2a str. 301
ucguucucugcaaucacca

SEQ ID NO: 3952059 - RNA, 14 nt, Shigella flexneri 2a str. 301
ucguugaagucagg

SEQ ID NO: 3952060 - RNA, 22 nt, Shigella flexneri 2a str. 301
ucguugauaaacguacauccau

SEQ ID NO: 3952061 - RNA, 17 nt, Shigella flexneri 2a str. 301
ucguugccgaagcggcg

SEQ ID NO: 3952062 - RNA, 22 nt, Shigella flexneri 2a str. 301
ucguugcgccgggaugauggcu

SEQ ID NO: 3952063 - RNA, 21 nt, Shigella flexneri 2a str. 301
ucguugugggccgaaaugaga

SEQ ID NO: 3952064 - RNA, 18 nt, Shigella flexneri 2a str. 301
ucuccagcaguucuacug

SEQ ID NO: 3952065 - RNA, 16 nt, Shigella flexneri 2a str. 301
ucuccagcgaauccgu

SEQ ID NO: 3952066 - RNA, 15 nt, Shigella flexneri 2a str. 301
ucuccagcuccccac

SEQ ID NO: 3952067 - RNA, 19 nt, Shigella flexneri 2a str. 301
ucuccagcuucaaaucauu

SEQ ID NO: 3952068 - RNA, 23 nt, Shigella flexneri 2a str. 301
ucuccauacucguugacgaccag

SEQ ID NO: 3952069 - RNA, 19 nt, Shigella flexneri 2a str. 301
ucuccauggauacauucca

SEQ ID NO: 3952070 - RNA, 15 nt, Shigella flexneri 2a str. 301
ucuccauuucauuga

SEQ ID NO: 3952071 - RNA, 15 nt, Shigella flexneri 2a str. 301
ucucccagccgcccu

SEQ ID NO: 3952072 - RNA, 13 nt, Shigella flexneri 2a str. 301
ucucccaguaagc

SEQ ID NO: 3952073 - RNA, 12 nt, Shigella flexneri 2a str. 301
ucuccccaaggg

SEQ ID NO: 3952074 - RNA, 15 nt, Shigella flexneri 2a str. 301
ucuccccaagggggc

SEQ ID NO: 3952075 - RNA, 12 nt, Shigella flexneri 2a str. 301
ucuccccggagg

SEQ ID NO: 3952076 - RNA, 23 nt, Shigella flexneri 2a str. 301
ucucccgaaugaccgccccugcg

SEQ ID NO: 3952077 - RNA, 22 nt, Shigella flexneri 2a str. 301
ucucccgauaaccuucuucauu

SEQ ID NO: 3952078 - RNA, 12 nt, Shigella flexneri 2a str. 301
ucucccguuccu

SEQ ID NO: 3952079 - RNA, 20 nt, Shigella flexneri 2a str. 301
ucucccucaucauuugaaau

SEQ ID NO: 3952080 - RNA, 18 nt, Shigella flexneri 2a str. 301
ucucccuguaucccagau

SEQ ID NO: 3952081 - RNA, 22 nt, Shigella flexneri 2a str. 301
ucuccgcugagacgcgcuugca

SEQ ID NO: 3952082 - RNA, 17 nt, Shigella flexneri 2a str. 301
ucuccgcuggagcgggg

SEQ ID NO: 3952083 - RNA, 20 nt, Shigella flexneri 2a str. 301
ucuccggcgcauccaugaua

SEQ ID NO: 3952084 - RNA, 11 nt, Shigella flexneri 2a str. 301
ucuccggcguu

SEQ ID NO: 3952085 - RNA, 20 nt, Shigella flexneri 2a str. 301
ucuccgucaacguuaacuuu

SEQ ID NO: 3952086 - RNA, 17 nt, Shigella flexneri 2a str. 301
ucuccguuaucacagca

SEQ ID NO: 3952087 - RNA, 15 nt, Shigella flexneri 2a str. 301
ucuccguucaguuua

SEQ ID NO: 3952088 - RNA, 13 nt, Shigella flexneri 2a str. 301
ucuccucccuugu

SEQ ID NO: 3952089 - RNA, 14 nt, Shigella flexneri 2a str. 301
ucuccuccgaugac

SEQ ID NO: 3952090 - RNA, 22 nt, Shigella flexneri 2a str. 301
ucuccugcaacagguugcgcug

SEQ ID NO: 3952091 - RNA, 21 nt, Shigella flexneri 2a str. 301
ucuccugccaauacaaaauuu

SEQ ID NO: 3952092 - RNA, 14 nt, Shigella flexneri 2a str. 301
ucuccuuacugccc

SEQ ID NO: 3952093 - RNA, 17 nt, Shigella flexneri 2a str. 301
ucuccuuuaccacucuc

SEQ ID NO: 3952094 - RNA, 22 nt, Shigella flexneri 2a str. 301
ucuccuuuaccgugguugcgcc

SEQ ID NO: 3952095 - RNA, 24 nt, Shigella flexneri 2a str. 301
ucuccuuuauagugugcaaucacu

SEQ ID NO: 3952096 - RNA, 18 nt, Shigella flexneri 2a str. 301
ucucgauaaaccauccug

SEQ ID NO: 3952097 - RNA, 16 nt, Shigella flexneri 2a str. 301
ucucgcagcucaucaa

SEQ ID NO: 3952098 - RNA, 13 nt, Shigella flexneri 2a str. 301
ucucgccagcacu

SEQ ID NO: 3952099 - RNA, 18 nt, Shigella flexneri 2a str. 301
ucucgccuaccauccaua

SEQ ID NO: 3952100 - RNA, 23 nt, Shigella flexneri 2a str. 301
ucucgcgcagcgguuucacagga

SEQ ID NO: 3952101 - RNA, 23 nt, Shigella flexneri 2a str. 301
ucucgcucaaaaauccagauuua

SEQ ID NO: 3952102 - RNA, 13 nt, Shigella flexneri 2a str. 301
ucucgcuucugag

SEQ ID NO: 3952103 - RNA, 15 nt, Shigella flexneri 2a str. 301
ucucggcgcggcccu

SEQ ID NO: 3952104 - RNA, 14 nt, Shigella flexneri 2a str. 301
ucucgggaaggccc

SEQ ID NO: 3952105 - RNA, 22 nt, Shigella flexneri 2a str. 301
ucucgucgaacucauacaccag

SEQ ID NO: 3952106 - RNA, 21 nt, Shigella flexneri 2a str. 301
ucucgucgguaauuucacaag

SEQ ID NO: 3952107 - RNA, 17 nt, Shigella flexneri 2a str. 301
ucucgugccaccagugc

SEQ ID NO: 3952108 - RNA, 20 nt, Shigella flexneri 2a str. 301
ucucgugccaccagugcagg

SEQ ID NO: 3952109 - RNA, 17 nt, Shigella flexneri 2a str. 301
ucucuauuccaccauca

SEQ ID NO: 3952110 - RNA, 15 nt, Shigella flexneri 2a str. 301
ucucuauuucaccca

SEQ ID NO: 3952111 - RNA, 14 nt, Shigella flexneri 2a str. 301
ucucuccuuucggc

SEQ ID NO: 3952112 - RNA, 14 nt, Shigella flexneri 2a str. 301
ucucucuucagcuu

SEQ ID NO: 3952113 - RNA, 17 nt, Shigella flexneri 2a str. 301
ucucucuugcuaucacc

SEQ ID NO: 3952114 - RNA, 22 nt, Shigella flexneri 2a str. 301
ucucugaaguagccaguaccac

SEQ ID NO: 3952115 - RNA, 23 nt, Shigella flexneri 2a str. 301
ucucugcaaucaccacugccagc

SEQ ID NO: 3952116 - RNA, 15 nt, Shigella flexneri 2a str. 301
ucucugcuccugaug

SEQ ID NO: 3952117 - RNA, 16 nt, Shigella flexneri 2a str. 301
ucucugcuuucgcauu

SEQ ID NO: 3952118 - RNA, 12 nt, Shigella flexneri 2a str. 301
ucucuggaagag

SEQ ID NO: 3952119 - RNA, 23 nt, Shigella flexneri 2a str. 301
ucucuggcccgcuuuucauuauc

SEQ ID NO: 3952120 - RNA, 21 nt, Shigella flexneri 2a str. 301
ucucuggcuguuucgcuucuu

SEQ ID NO: 3952121 - RNA, 18 nt, Shigella flexneri 2a str. 301
ucucuguuuugcaugggg

SEQ ID NO: 3952122 - RNA, 13 nt, Shigella flexneri 2a str. 301
ucucuuaucaucc

SEQ ID NO: 3952123 - RNA, 24 nt, Shigella flexneri 2a str. 301
ucucuucaacacggcgcauugcca

SEQ ID NO: 3952124 - RNA, 13 nt, Shigella flexneri 2a str. 301
ucucuucaccaua

SEQ ID NO: 3952125 - RNA, 21 nt, Shigella flexneri 2a str. 301
ucucuucacgcuuugcaggcu

SEQ ID NO: 3952126 - RNA, 14 nt, Shigella flexneri 2a str. 301
ucucuuccagugcc

SEQ ID NO: 3952127 - RNA, 17 nt, Shigella flexneri 2a str. 301
ucucuucgccugccugc

SEQ ID NO: 3952128 - RNA, 19 nt, Shigella flexneri 2a str. 301
ucucuucggcuucugccuu

SEQ ID NO: 3952129 - RNA, 13 nt, Shigella flexneri 2a str. 301
ucucuucuccuug

SEQ ID NO: 3952130 - RNA, 18 nt, Shigella flexneri 2a str. 301
ucucuugccgguuuugca

SEQ ID NO: 3952131 - RNA, 18 nt, Shigella flexneri 2a str. 301
ucucuuggggcuucaucu

SEQ ID NO: 3952132 - RNA, 18 nt, Shigella flexneri 2a str. 301
ucucuuuaaaaaguaaaa

SEQ ID NO: 3952133 - RNA, 18 nt, Shigella flexneri 2a str. 301
ucucuuucaacauccugu

SEQ ID NO: 3952134 - RNA, 15 nt, Shigella flexneri 2a str. 301
ucucuuucaccagcg

SEQ ID NO: 3952135 - RNA, 18 nt, Shigella flexneri 2a str. 301
ucucuuucggcagugcca

SEQ ID NO: 3952136 - RNA, 20 nt, Shigella flexneri 2a str. 301
ucugaaaacuaaccuuacaa

SEQ ID NO: 3952137 - RNA, 21 nt, Shigella flexneri 2a str. 301
ucugaaaucaucaauaccagc

SEQ ID NO: 3952138 - RNA, 22 nt, Shigella flexneri 2a str. 301
ucugaaaucaucaauaccagcc

SEQ ID NO: 3952139 - RNA, 23 nt, Shigella flexneri 2a str. 301
ucugaauaucaucccccugcgau

SEQ ID NO: 3952140 - RNA, 20 nt, Shigella flexneri 2a str. 301
ucugaaugguggugugcuca

SEQ ID NO: 3952141 - RNA, 21 nt, Shigella flexneri 2a str. 301
ucugaauuucagcgccugaua

SEQ ID NO: 3952142 - RNA, 22 nt, Shigella flexneri 2a str. 301
ucugacaacguagcguuaaaac

SEQ ID NO: 3952143 - RNA, 22 nt, Shigella flexneri 2a str. 301
ucugacaccaucacccaacaau

SEQ ID NO: 3952144 - RNA, 23 nt, Shigella flexneri 2a str. 301
ucugacauaaccacucaccgccg

SEQ ID NO: 3952145 - RNA, 23 nt, Shigella flexneri 2a str. 301
ucugacauuuuuacuccuuagca

SEQ ID NO: 3952146 - RNA, 15 nt, Shigella flexneri 2a str. 301
ucugaccggccagca

SEQ ID NO: 3952147 - RNA, 19 nt, Shigella flexneri 2a str. 301
ucugacgcgcauacucucc

SEQ ID NO: 3952148 - RNA, 22 nt, Shigella flexneri 2a str. 301
ucugacgugcgcaaacuucuuc

SEQ ID NO: 3952149 - RNA, 21 nt, Shigella flexneri 2a str. 301
ucugacguuuucucguccagu

SEQ ID NO: 3952150 - RNA, 16 nt, Shigella flexneri 2a str. 301
ucugacuauauaaauu

SEQ ID NO: 3952151 - RNA, 21 nt, Shigella flexneri 2a str. 301
ucugacuauauaaauuacccu

SEQ ID NO: 3952152 - RNA, 13 nt, Shigella flexneri 2a str. 301
ucugacugucaga

SEQ ID NO: 3952153 - RNA, 15 nt, Shigella flexneri 2a str. 301
ucugacuguguuagc

SEQ ID NO: 3952154 - RNA, 14 nt, Shigella flexneri 2a str. 301
ucugagaaacucau

SEQ ID NO: 3952155 - RNA, 17 nt, Shigella flexneri 2a str. 301
ucugagauucaauuaua

SEQ ID NO: 3952156 - RNA, 20 nt, Shigella flexneri 2a str. 301
ucugagcaucacauaaucga

SEQ ID NO: 3952157 - RNA, 17 nt, Shigella flexneri 2a str. 301
ucugagcggccuuuucc

SEQ ID NO: 3952158 - RNA, 17 nt, Shigella flexneri 2a str. 301
ucugauacaugcuguug

SEQ ID NO: 3952159 - RNA, 19 nt, Shigella flexneri 2a str. 301
ucugauacugcuccggcgc

SEQ ID NO: 3952160 - RNA, 12 nt, Shigella flexneri 2a str. 301
ucugauccugca

SEQ ID NO: 3952161 - RNA, 20 nt, Shigella flexneri 2a str. 301
ucugaugaggcauaagcgac

SEQ ID NO: 3952162 - RNA, 17 nt, Shigella flexneri 2a str. 301
ucugaugauauuuuucc

SEQ ID NO: 3952163 - RNA, 22 nt, Shigella flexneri 2a str. 301
ucugguuucaguaauccuuucu

SEQ ID NO: 3952164 - RNA, 20 nt, Shigella flexneri 2a str. 301
ucugguuugccacguucuga

SEQ ID NO: 3952165 - RNA, 13 nt, Shigella flexneri 2a str. 301
ucuguaacaaggu

SEQ ID NO: 3952166 - RNA, 18 nt, Shigella flexneri 2a str. 301
ucuguaacgcacuggugg

SEQ ID NO: 3952167 - RNA, 21 nt, Shigella flexneri 2a str. 301
ucuguaauugaaggcuuauaa

SEQ ID NO: 3952168 - RNA, 15 nt, Shigella flexneri 2a str. 301
ucuguaccaccagaa

SEQ ID NO: 3952169 - RNA, 23 nt, Shigella flexneri 2a str. 301
ucuguaccaccagaaucgccagc

SEQ ID NO: 3952170 - RNA, 15 nt, Shigella flexneri 2a str. 301
ucuguauauaaaugu

SEQ ID NO: 3952171 - RNA, 18 nt, Shigella flexneri 2a str. 301
ucuguauauaaauguuaa

SEQ ID NO: 3952172 - RNA, 15 nt, Shigella flexneri 2a str. 301
ucugucagguaacaa

SEQ ID NO: 3952173 - RNA, 17 nt, Shigella flexneri 2a str. 301
ucugucgauaaacucau

SEQ ID NO: 3952174 - RNA, 14 nt, Shigella flexneri 2a str. 301
ucugucgcucugcu

SEQ ID NO: 3952175 - RNA, 18 nt, Shigella flexneri 2a str. 301
ucugucugauaaaaaacc

SEQ ID NO: 3952176 - RNA, 17 nt, Shigella flexneri 2a str. 301
ucugucuguacggcagu

SEQ ID NO: 3952177 - RNA, 14 nt, Shigella flexneri 2a str. 301
ucugucuuaacgca

SEQ ID NO: 3952178 - RNA, 23 nt, Shigella flexneri 2a str. 301
ucuguguaaaugccuuucucaga

SEQ ID NO: 3952179 - RNA, 12 nt, Shigella flexneri 2a str. 301
ucuguuaauguu

SEQ ID NO: 3952180 - RNA, 14 nt, Shigella flexneri 2a str. 301
ucuguuaauguuag

SEQ ID NO: 3952181 - RNA, 18 nt, Shigella flexneri 2a str. 301
ucuguuccauaaucgccu

SEQ ID NO: 3952182 - RNA, 18 nt, Shigella flexneri 2a str. 301
ucuguuguaauaguguau

SEQ ID NO: 3952183 - RNA, 14 nt, Shigella flexneri 2a str. 301
ucuguugugccaca

SEQ ID NO: 3952184 - RNA, 23 nt, Shigella flexneri 2a str. 301
ucuguugugccacauccaguggc

SEQ ID NO: 3952185 - RNA, 19 nt, Shigella flexneri 2a str. 301
ucuguuugcaggugaccag

SEQ ID NO: 3952186 - RNA, 22 nt, Shigella flexneri 2a str. 301
ucuguuugccucguucuucccu

SEQ ID NO: 3952187 - RNA, 21 nt, Shigella flexneri 2a str. 301
ucuguuuucguaauaauucac

SEQ ID NO: 3952188 - RNA, 20 nt, Shigella flexneri 2a str. 301
ucuuaaaauauaaaacugaa

SEQ ID NO: 3952189 - RNA, 20 nt, Shigella flexneri 2a str. 301
ucuuaagguucacuuaaucu

SEQ ID NO: 3952190 - RNA, 22 nt, Shigella flexneri 2a str. 301
ucuuacagaaaugguaaagaag

SEQ ID NO: 3952191 - RNA, 17 nt, Shigella flexneri 2a str. 301
ucuuacgcgaauaguuu

SEQ ID NO: 3952192 - RNA, 17 nt, Shigella flexneri 2a str. 301
ucuuacucuuucaauuu

SEQ ID NO: 3952193 - RNA, 13 nt, Shigella flexneri 2a str. 301
ucuuacuucaaca

SEQ ID NO: 3952194 - RNA, 20 nt, Shigella flexneri 2a str. 301
ucuuacuucaacacauaacc

SEQ ID NO: 3952195 - RNA, 13 nt, Shigella flexneri 2a str. 301
ucuuauaugauga

SEQ ID NO: 3952196 - RNA, 23 nt, Shigella flexneri 2a str. 301
ucuuaucacgaugcuaaaaacau

SEQ ID NO: 3952197 - RNA, 15 nt, Shigella flexneri 2a str. 301
ucuuaucaggccaau

SEQ ID NO: 3952198 - RNA, 13 nt, Shigella flexneri 2a str. 301
ucuuaucaggccu

SEQ ID NO: 3952199 - RNA, 21 nt, Shigella flexneri 2a str. 301
ucuuaucaggccuacaacucc

SEQ ID NO: 3952200 - RNA, 16 nt, Shigella flexneri 2a str. 301
ucuuaucaggccugug

SEQ ID NO: 3952201 - RNA, 19 nt, Shigella flexneri 2a str. 301
ucuuaucaguauacgccac

SEQ ID NO: 3952202 - RNA, 21 nt, Shigella flexneri 2a str. 301
ucuuaucaugccuacauauuu

SEQ ID NO: 3952203 - RNA, 17 nt, Shigella flexneri 2a str. 301
ucuuauccagcaaccag

SEQ ID NO: 3952204 - RNA, 22 nt, Shigella flexneri 2a str. 301
ucuuauccggccuacguguguu

SEQ ID NO: 3952205 - RNA, 20 nt, Shigella flexneri 2a str. 301
ucuuauuaaauugucuuaaa

SEQ ID NO: 3952206 - RNA, 13 nt, Shigella flexneri 2a str. 301
ucuuauuucacua

SEQ ID NO: 3952207 - RNA, 17 nt, Shigella flexneri 2a str. 301
ucuucaaaaaagucaga

SEQ ID NO: 3952208 - RNA, 15 nt, Shigella flexneri 2a str. 301
ucuucaaacggcaua

SEQ ID NO: 3952209 - RNA, 18 nt, Shigella flexneri 2a str. 301
ucuucaacaauugaagaa

SEQ ID NO: 3952210 - RNA, 22 nt, Shigella flexneri 2a str. 301
ucuucaacacacugaauaaaaa

SEQ ID NO: 3952211 - RNA, 16 nt, Shigella flexneri 2a str. 301
ucuucaacgaagaaaa

SEQ ID NO: 3952212 - RNA, 14 nt, Shigella flexneri 2a str. 301
ucuucaacugccau

SEQ ID NO: 3952213 - RNA, 19 nt, Shigella flexneri 2a str. 301
ucuucaacugccaugaccg

SEQ ID NO: 3952214 - RNA, 16 nt, Shigella flexneri 2a str. 301
ucuucaagaauacugu

SEQ ID NO: 3952215 - RNA, 14 nt, Shigella flexneri 2a str. 301
ucuucacaucauca

SEQ ID NO: 3952216 - RNA, 15 nt, Shigella flexneri 2a str. 301
ucuucacaucaucau

SEQ ID NO: 3952217 - RNA, 15 nt, Shigella flexneri 2a str. 301
ucuucacgcccgccc

SEQ ID NO: 3952218 - RNA, 13 nt, Shigella flexneri 2a str. 301
ucuucacggaaaa

SEQ ID NO: 3952219 - RNA, 16 nt, Shigella flexneri 2a str. 301
ucuucacggaaaauau

SEQ ID NO: 3952220 - RNA, 19 nt, Shigella flexneri 2a str. 301
ucuucacguuuuucgaaaa

SEQ ID NO: 3952221 - RNA, 13 nt, Shigella flexneri 2a str. 301
ucuucagcaucaa

SEQ ID NO: 3952222 - RNA, 14 nt, Shigella flexneri 2a str. 301
ucuucagcaucaau

SEQ ID NO: 3952223 - RNA, 22 nt, Shigella flexneri 2a str. 301
ucuucauaacuuugaucgcguu

SEQ ID NO: 3952224 - RNA, 21 nt, Shigella flexneri 2a str. 301
ucuucauacgcggcagaaugg

SEQ ID NO: 3952225 - RNA, 13 nt, Shigella flexneri 2a str. 301
ucuucaucaccga

SEQ ID NO: 3952226 - RNA, 19 nt, Shigella flexneri 2a str. 301
ucuucauuaaaccagugcc

SEQ ID NO: 3952227 - RNA, 13 nt, Shigella flexneri 2a str. 301
ucuucauuaccuu

SEQ ID NO: 3952228 - RNA, 15 nt, Shigella flexneri 2a str. 301
ucuucauuaccuuca

SEQ ID NO: 3952229 - RNA, 16 nt, Shigella flexneri 2a str. 301
ucuuccacgccugcau

SEQ ID NO: 3952230 - RNA, 20 nt, Shigella flexneri 2a str. 301
ucuuccagaauaaacaacug

SEQ ID NO: 3952231 - RNA, 14 nt, Shigella flexneri 2a str. 301
ucuuccagcaucag

SEQ ID NO: 3952232 - RNA, 23 nt, Shigella flexneri 2a str. 301
ucuuccagcgcaaggaaauaacg

SEQ ID NO: 3952233 - RNA, 19 nt, Shigella flexneri 2a str. 301
ucuuccagcgugucaaaug

SEQ ID NO: 3952234 - RNA, 22 nt, Shigella flexneri 2a str. 301
ucuuccagcguuucaaguguac

SEQ ID NO: 3952235 - RNA, 14 nt, Shigella flexneri 2a str. 301
ucuuccagucgccu

SEQ ID NO: 3952236 - RNA, 20 nt, Shigella flexneri 2a str. 301
ucuuccagugccucaagaau

SEQ ID NO: 3952237 - RNA, 13 nt, Shigella flexneri 2a str. 301
ucuuccaguuccg

SEQ ID NO: 3952238 - RNA, 19 nt, Shigella flexneri 2a str. 301
ucuuccauaaucgacuccc

SEQ ID NO: 3952239 - RNA, 15 nt, Shigella flexneri 2a str. 301
ucuuccaucacaaag

SEQ ID NO: 3952240 - RNA, 22 nt, Shigella flexneri 2a str. 301
ucuuccauugcuuugguaaaug

SEQ ID NO: 3952241 - RNA, 14 nt, Shigella flexneri 2a str. 301
ucuucccagccccc

SEQ ID NO: 3952242 - RNA, 17 nt, Shigella flexneri 2a str. 301
ucuucccagcccccgca

SEQ ID NO: 3952243 - RNA, 21 nt, Shigella flexneri 2a str. 301
ucuucccagguuucaaugccg

SEQ ID NO: 3952244 - RNA, 22 nt, Shigella flexneri 2a str. 301
ucuucccgagacauuccuuuac

SEQ ID NO: 3952245 - RNA, 23 nt, Shigella flexneri 2a str. 301
ucuucccgagacauuccuuuacu

SEQ ID NO: 3952246 - RNA, 24 nt, Shigella flexneri 2a str. 301
ucuucccgagacauuccuuuacuu

SEQ ID NO: 3952247 - RNA, 13 nt, Shigella flexneri 2a str. 301
ucuucccgcagcc

SEQ ID NO: 3952248 - RNA, 15 nt, Shigella flexneri 2a str. 301
ucuucccgccuguca

SEQ ID NO: 3952249 - RNA, 21 nt, Shigella flexneri 2a str. 301
ucuucccugcugaauccccuu

SEQ ID NO: 3952250 - RNA, 13 nt, Shigella flexneri 2a str. 301
ucuucccuuguua

SEQ ID NO: 3952251 - RNA, 13 nt, Shigella flexneri 2a str. 301
ucuucccuuucug

SEQ ID NO: 3952252 - RNA, 17 nt, Shigella flexneri 2a str. 301
ucuuccgccggaucgaa

SEQ ID NO: 3952253 - RNA, 11 nt, Shigella flexneri 2a str. 301
ucuuccggcag

SEQ ID NO: 3952254 - RNA, 21 nt, Shigella flexneri 2a str. 301
ucuuccggcgauucuuugcug

SEQ ID NO: 3952255 - RNA, 22 nt, Shigella flexneri 2a str. 301
ucuuccguagcggcucggaaua

SEQ ID NO: 3952256 - RNA, 18 nt, Shigella flexneri 2a str. 301
ucuuccugauacaugaau

SEQ ID NO: 3952257 - RNA, 18 nt, Shigella flexneri 2a str. 301
ucuuccuggcuuggcugg

SEQ ID NO: 3952258 - RNA, 16 nt, Shigella flexneri 2a str. 301
ucuuccuucagcuccc

SEQ ID NO: 3952259 - RNA, 19 nt, Shigella flexneri 2a str. 301
ucuucgaagaucucgguaa

SEQ ID NO: 3952260 - RNA, 20 nt, Shigella flexneri 2a str. 301
ucuucgacaaucgcaaauau

SEQ ID NO: 3952261 - RNA, 17 nt, Shigella flexneri 2a str. 301
ucuucgauauugacgau

SEQ ID NO: 3952262 - RNA, 19 nt, Shigella flexneri 2a str. 301
ucuucgcacuuaccuucac

SEQ ID NO: 3952263 - RNA, 13 nt, Shigella flexneri 2a str. 301
ugaaaaucaccau

SEQ ID NO: 3952264 - RNA, 13 nt, Shigella flexneri 2a str. 301
ugaaaaugcuggu

SEQ ID NO: 3952265 - RNA, 14 nt, Shigella flexneri 2a str. 301
ugaaacaaaucacu

SEQ ID NO: 3952266 - RNA, 20 nt, Shigella flexneri 2a str. 301
ugaaacaacguggaacaaau

SEQ ID NO: 3952267 - RNA, 23 nt, Shigella flexneri 2a str. 301
ugaaacaagaaguuauccuggua

SEQ ID NO: 3952268 - RNA, 14 nt, Shigella flexneri 2a str. 301
ugaaacgaaaucuu

SEQ ID NO: 3952269 - RNA, 12 nt, Shigella flexneri 2a str. 301
ugaaacgcuggu

SEQ ID NO: 3952270 - RNA, 22 nt, Shigella flexneri 2a str. 301
ugaaacgcuuuacguuccuggc

SEQ ID NO: 3952271 - RNA, 19 nt, Shigella flexneri 2a str. 301
ugaaacggaugccaaucac

SEQ ID NO: 3952272 - RNA, 22 nt, Shigella flexneri 2a str. 301
ugaaacgucaaauaauuccugc

SEQ ID NO: 3952273 - RNA, 17 nt, Shigella flexneri 2a str. 301
ugaaacgucacccagga

SEQ ID NO: 3952274 - RNA, 13 nt, Shigella flexneri 2a str. 301
ugaaacucagcca

SEQ ID NO: 3952275 - RNA, 18 nt, Shigella flexneri 2a str. 301
ugaaacucgauacgacac

SEQ ID NO: 3952276 - RNA, 17 nt, Shigella flexneri 2a str. 301
ugaaacucgcugccagc

SEQ ID NO: 3952277 - RNA, 22 nt, Shigella flexneri 2a str. 301
ugaaagaaaaucaauccagugu

SEQ ID NO: 3952278 - RNA, 21 nt, Shigella flexneri 2a str. 301
ugaaagaagcggugaaaaaau

SEQ ID NO: 3952279 - RNA, 20 nt, Shigella flexneri 2a str. 301
ugaaagagccgucauucugc

SEQ ID NO: 3952280 - RNA, 17 nt, Shigella flexneri 2a str. 301
ugaaagccccaccagca

SEQ ID NO: 3952281 - RNA, 22 nt, Shigella flexneri 2a str. 301
ugaaagccccaccagcaaauau

SEQ ID NO: 3952282 - RNA, 19 nt, Shigella flexneri 2a str. 301
ugaaagcguuguguuuuuu

SEQ ID NO: 3952283 - RNA, 12 nt, Shigella flexneri 2a str. 301
ugaaaggaaaaa

SEQ ID NO: 3952284 - RNA, 15 nt, Shigella flexneri 2a str. 301
ugaaaggcuucccaa

SEQ ID NO: 3952285 - RNA, 15 nt, Shigella flexneri 2a str. 301
ugaaaguaaaaaaga

SEQ ID NO: 3952286 - RNA, 21 nt, Shigella flexneri 2a str. 301
ugaaagugguuucaugauugc

SEQ ID NO: 3952287 - RNA, 15 nt, Shigella flexneri 2a str. 301
ugaaauaaaaauaag

SEQ ID NO: 3952288 - RNA, 16 nt, Shigella flexneri 2a str. 301
ugaaauaaaaauaaga

SEQ ID NO: 3952289 - RNA, 20 nt, Shigella flexneri 2a str. 301
ugaaauacccgcucauucgu

SEQ ID NO: 3952290 - RNA, 14 nt, Shigella flexneri 2a str. 301
ugaaaucacgcauc

SEQ ID NO: 3952291 - RNA, 12 nt, Shigella flexneri 2a str. 301
ugaaaucacuaa

SEQ ID NO: 3952292 - RNA, 23 nt, Shigella flexneri 2a str. 301
ugaaaucagcacauaagucagcc

SEQ ID NO: 3952293 - RNA, 16 nt, Shigella flexneri 2a str. 301
ugaaaucgaacagguu

SEQ ID NO: 3952294 - RNA, 19 nt, Shigella flexneri 2a str. 301
ugaaaucugaaaucaucaa

SEQ ID NO: 3952295 - RNA, 14 nt, Shigella flexneri 2a str. 301
ugaaaugaaaauca

SEQ ID NO: 3952296 - RNA, 18 nt, Shigella flexneri 2a str. 301
ugaaaugaaaaucaccau

SEQ ID NO: 3952297 - RNA, 22 nt, Shigella flexneri 2a str. 301
ugaaaugccaaauauuucuuua

SEQ ID NO: 3952298 - RNA, 13 nt, Shigella flexneri 2a str. 301
ugaaaugcggcga

SEQ ID NO: 3952299 - RNA, 14 nt, Shigella flexneri 2a str. 301
ugaaauuccaucac

SEQ ID NO: 3952300 - RNA, 14 nt, Shigella flexneri 2a str. 301
ugaaauugcugguu

SEQ ID NO: 3952301 - RNA, 19 nt, Shigella flexneri 2a str. 301
ugaaauugugauaaaaauc

SEQ ID NO: 3952302 - RNA, 22 nt, Shigella flexneri 2a str. 301
ugaaauuuugggcgucuuuccg

SEQ ID NO: 3952303 - RNA, 14 nt, Shigella flexneri 2a str. 301
ugaacaaaaaagag

SEQ ID NO: 3952304 - RNA, 17 nt, Shigella flexneri 2a str. 301
ugaacaaaaaagaguaa

SEQ ID NO: 3952305 - RNA, 12 nt, Shigella flexneri 2a str. 301
ugaacaaagcgc

SEQ ID NO: 3952306 - RNA, 12 nt, Shigella flexneri 2a str. 301
ugaacaaccaga

SEQ ID NO: 3952307 - RNA, 13 nt, Shigella flexneri 2a str. 301
ugaacaaccagaa

SEQ ID NO: 3952308 - RNA, 23 nt, Shigella flexneri 2a str. 301
ugaacaaguauaucaaacagugg

SEQ ID NO: 3952309 - RNA, 19 nt, Shigella flexneri 2a str. 301
ugaacaauuaacguaucaa

SEQ ID NO: 3952310 - RNA, 23 nt, Shigella flexneri 2a str. 301
ugaacaauuaacguaucaauuag

SEQ ID NO: 3952311 - RNA, 20 nt, Shigella flexneri 2a str. 301
ugaacaccaaacccugagug

SEQ ID NO: 3952312 - RNA, 15 nt, Shigella flexneri 2a str. 301
ugaacaccuucucag

SEQ ID NO: 3952313 - RNA, 20 nt, Shigella flexneri 2a str. 301
ugaacacgaucucacgcuga

SEQ ID NO: 3952314 - RNA, 14 nt, Shigella flexneri 2a str. 301
ugaacacguaauuc

SEQ ID NO: 3952315 - RNA, 19 nt, Shigella flexneri 2a str. 301
ugaacagaccacauuccag

SEQ ID NO: 3952316 - RNA, 22 nt, Shigella flexneri 2a str. 301
ugaacagcagaacaucagcugg

SEQ ID NO: 3952317 - RNA, 12 nt, Shigella flexneri 2a str. 301
ugaacagccaga

SEQ ID NO: 3952318 - RNA, 19 nt, Shigella flexneri 2a str. 301
ugaacauagucauccucuc

SEQ ID NO: 3952319 - RNA, 16 nt, Shigella flexneri 2a str. 301
ugaacauuacuuuccg

SEQ ID NO: 3952320 - RNA, 21 nt, Shigella flexneri 2a str. 301
ugaacauuauuuuugcgacag

SEQ ID NO: 3952321 - RNA, 14 nt, Shigella flexneri 2a str. 301
ugaacauugcugcu

SEQ ID NO: 3952322 - RNA, 16 nt, Shigella flexneri 2a str. 301
ugaacauugcugcuga

SEQ ID NO: 3952323 - RNA, 17 nt, Shigella flexneri 2a str. 301
ugaaccagacugcacau

SEQ ID NO: 3952324 - RNA, 19 nt, Shigella flexneri 2a str. 301
ugaaccagccaacuugccc

SEQ ID NO: 3952325 - RNA, 13 nt, Shigella flexneri 2a str. 301
ugaacccugaagg

SEQ ID NO: 3952326 - RNA, 15 nt, Shigella flexneri 2a str. 301
ugaaccgcacagguu

SEQ ID NO: 3952327 - RNA, 21 nt, Shigella flexneri 2a str. 301
ugaaccgguaugaauuugcag

SEQ ID NO: 3952328 - RNA, 21 nt, Shigella flexneri 2a str. 301
ugaaccgugucgccaucaaag

SEQ ID NO: 3952329 - RNA, 22 nt, Shigella flexneri 2a str. 301
ugaaccugccgccuuaaaccuc

SEQ ID NO: 3952330 - RNA, 18 nt, Shigella flexneri 2a str. 301
ugaacgaaauuauggugu

SEQ ID NO: 3952331 - RNA, 22 nt, Shigella flexneri 2a str. 301
ugaacgaccuccacucucgaaa

SEQ ID NO: 3952332 - RNA, 18 nt, Shigella flexneri 2a str. 301
ugaacgccaaauucuuua

SEQ ID NO: 3952333 - RNA, 20 nt, Shigella flexneri 2a str. 301
ugaacgccaaauucuuuauc

SEQ ID NO: 3952334 - RNA, 22 nt, Shigella flexneri 2a str. 301
ugaacgccaccccacaccagug

SEQ ID NO: 3952335 - RNA, 15 nt, Shigella flexneri 2a str. 301
ugaacgcccccucac

SEQ ID NO: 3952336 - RNA, 19 nt, Shigella flexneri 2a str. 301
ugaacgccuaauccagccu

SEQ ID NO: 3952337 - RNA, 20 nt, Shigella flexneri 2a str. 301
ugaacgccuaauccagccua

SEQ ID NO: 3952338 - RNA, 20 nt, Shigella flexneri 2a str. 301
ugaacgccuuauccgaccua

SEQ ID NO: 3952339 - RNA, 20 nt, Shigella flexneri 2a str. 301
ugaacgccuuauccggccug

SEQ ID NO: 3952340 - RNA, 20 nt, Shigella flexneri 2a str. 301
ugaacgccuuaucuggccua

SEQ ID NO: 3952341 - RNA, 19 nt, Shigella flexneri 2a str. 301
ugaacgcguuauccggcua

SEQ ID NO: 3952342 - RNA, 16 nt, Shigella flexneri 2a str. 301
ugaacggcuucgccuc

SEQ ID NO: 3952343 - RNA, 16 nt, Shigella flexneri 2a str. 301
ugaacgguaagaacaa

SEQ ID NO: 3952344 - RNA, 15 nt, Shigella flexneri 2a str. 301
ugaacggugaugcuc

SEQ ID NO: 3952345 - RNA, 20 nt, Shigella flexneri 2a str. 301
ugaacgugcaaaaucaaaca

SEQ ID NO: 3952346 - RNA, 14 nt, Shigella flexneri 2a str. 301
ugaacguggccaug

SEQ ID NO: 3952347 - RNA, 22 nt, Shigella flexneri 2a str. 301
ugaacgugggucugucccauuu

SEQ ID NO: 3952348 - RNA, 20 nt, Shigella flexneri 2a str. 301
ugaacucaacgccuucuucg

SEQ ID NO: 3952349 - RNA, 23 nt, Shigella flexneri 2a str. 301
ugaacucgacgcccuggaagaaa

SEQ ID NO: 3952350 - RNA, 19 nt, Shigella flexneri 2a str. 301
ugaacucgccgcacaggcg

SEQ ID NO: 3952351 - RNA, 20 nt, Shigella flexneri 2a str. 301
ugaacucuuaagguucacuu

SEQ ID NO: 3952352 - RNA, 13 nt, Shigella flexneri 2a str. 301
ugaacucuucuuc

SEQ ID NO: 3952353 - RNA, 15 nt, Shigella flexneri 2a str. 301
ugaacugaacaaaaa

SEQ ID NO: 3952354 - RNA, 17 nt, Shigella flexneri 2a str. 301
ugaacugaacaaaaaag

SEQ ID NO: 3952355 - RNA, 14 nt, Shigella flexneri 2a str. 301
ugaacugaauacga

SEQ ID NO: 3952356 - RNA, 19 nt, Shigella flexneri 2a str. 301
ugaacugacagccaaaggg

SEQ ID NO: 3952357 - RNA, 12 nt, Shigella flexneri 2a str. 301
ugaacugauugc

SEQ ID NO: 3952358 - RNA, 16 nt, Shigella flexneri 2a str. 301
ugaacugauugccacc

SEQ ID NO: 3952359 - RNA, 20 nt, Shigella flexneri 2a str. 301
ugaacuggcuuuuuucaauu

SEQ ID NO: 3952360 - RNA, 22 nt, Shigella flexneri 2a str. 301
ugaacuggcuuuuuucaauuaa

SEQ ID NO: 3952361 - RNA, 17 nt, Shigella flexneri 2a str. 301
ugaacuguacaaagccg

SEQ ID NO: 3952362 - RNA, 17 nt, Shigella flexneri 2a str. 301
ugaacuuaucaucaggc

SEQ ID NO: 3952363 - RNA, 17 nt, Shigella flexneri 2a str. 301
ugacagcauaccuucac

SEQ ID NO: 3952364 - RNA, 17 nt, Shigella flexneri 2a str. 301
ugacagcgccgacuguu

SEQ ID NO: 3952365 - RNA, 18 nt, Shigella flexneri 2a str. 301
ugacagcgcgcgccgcca

SEQ ID NO: 3952366 - RNA, 20 nt, Shigella flexneri 2a str. 301
ugacagcgcgcgccgccaau

SEQ ID NO: 3952367 - RNA, 20 nt, Shigella flexneri 2a str. 301
ugacagcuuauguugcuuac

SEQ ID NO: 3952368 - RNA, 17 nt, Shigella flexneri 2a str. 301
ugacaggcgggaagaac

SEQ ID NO: 3952369 - RNA, 23 nt, Shigella flexneri 2a str. 301
ugacaggcgggaagaacggcaac

SEQ ID NO: 3952370 - RNA, 14 nt, Shigella flexneri 2a str. 301
ugacaguugucagc

SEQ ID NO: 3952371 - RNA, 16 nt, Shigella flexneri 2a str. 301
ugacaguuuauuuucu

SEQ ID NO: 3952372 - RNA, 14 nt, Shigella flexneri 2a str. 301
ugacauaaugcaaa

SEQ ID NO: 3952373 - RNA, 13 nt, Shigella flexneri 2a str. 301
ugacauaauuggc

SEQ ID NO: 3952374 - RNA, 20 nt, Shigella flexneri 2a str. 301
ugacauacucuuuccauugc

SEQ ID NO: 3952375 - RNA, 20 nt, Shigella flexneri 2a str. 301
ugacauaguagccagccaga

SEQ ID NO: 3952376 - RNA, 15 nt, Shigella flexneri 2a str. 301
ugacaucgcccugau

SEQ ID NO: 3952377 - RNA, 19 nt, Shigella flexneri 2a str. 301
ugacaucgugcugguagaa

SEQ ID NO: 3952378 - RNA, 14 nt, Shigella flexneri 2a str. 301
ugacaucuccagcg

SEQ ID NO: 3952379 - RNA, 20 nt, Shigella flexneri 2a str. 301
ugacauuaaguguccgccaa

SEQ ID NO: 3952380 - RNA, 18 nt, Shigella flexneri 2a str. 301
ugacauuaucagacaccg

SEQ ID NO: 3952381 - RNA, 13 nt, Shigella flexneri 2a str. 301
ugacauuaucugg

SEQ ID NO: 3952382 - RNA, 13 nt, Shigella flexneri 2a str. 301
ugaccaaaaacau

SEQ ID NO: 3952383 - RNA, 21 nt, Shigella flexneri 2a str. 301
ugaccaccaccaccugcaucu

SEQ ID NO: 3952384 - RNA, 12 nt, Shigella flexneri 2a str. 301
ugaccaccagca

SEQ ID NO: 3952385 - RNA, 14 nt, Shigella flexneri 2a str. 301
ugaccaccagcacg

SEQ ID NO: 3952386 - RNA, 19 nt, Shigella flexneri 2a str. 301
ugaccaccggggacaggcg

SEQ ID NO: 3952387 - RNA, 17 nt, Shigella flexneri 2a str. 301
ugaccacggccacagcc

SEQ ID NO: 3952388 - RNA, 20 nt, Shigella flexneri 2a str. 301
ugaccacggccacagccagc

SEQ ID NO: 3952389 - RNA, 18 nt, Shigella flexneri 2a str. 301
ugaccacuuugcgcuccu

SEQ ID NO: 3952390 - RNA, 14 nt, Shigella flexneri 2a str. 301
ugaccagaacugau

SEQ ID NO: 3952391 - RNA, 23 nt, Shigella flexneri 2a str. 301
ugaccagaucuucaucaccgaug

SEQ ID NO: 3952392 - RNA, 20 nt, Shigella flexneri 2a str. 301
ugaccauaacccgcuuccag

SEQ ID NO: 3952393 - RNA, 17 nt, Shigella flexneri 2a str. 301
ugaccaucuuccagcau

SEQ ID NO: 3952394 - RNA, 22 nt, Shigella flexneri 2a str. 301
ugaccaugcucaacaaaccguu

SEQ ID NO: 3952395 - RNA, 22 nt, Shigella flexneri 2a str. 301
ugacccaccccagcagcagccg

SEQ ID NO: 3952396 - RNA, 12 nt, Shigella flexneri 2a str. 301
ugacccagcaag

SEQ ID NO: 3952397 - RNA, 13 nt, Shigella flexneri 2a str. 301
ugacccagcacca

SEQ ID NO: 3952398 - RNA, 12 nt, Shigella flexneri 2a str. 301
ugacccaguaga

SEQ ID NO: 3952399 - RNA, 18 nt, Shigella flexneri 2a str. 301
ugacccaguagacgagcc

SEQ ID NO: 3952400 - RNA, 18 nt, Shigella flexneri 2a str. 301
ugacccgcagccagcacu

SEQ ID NO: 3952401 - RNA, 19 nt, Shigella flexneri 2a str. 301
ugacccgcagccagcacug

SEQ ID NO: 3952402 - RNA, 18 nt, Shigella flexneri 2a str. 301
ugacccucucggcauaua

SEQ ID NO: 3952403 - RNA, 19 nt, Shigella flexneri 2a str. 301
ugaccgaaugcagucgcgu

SEQ ID NO: 3952404 - RNA, 22 nt, Shigella flexneri 2a str. 301
ugaccgauaugaauaauuucgg

SEQ ID NO: 3952405 - RNA, 16 nt, Shigella flexneri 2a str. 301
ugaccgcgccauccau

SEQ ID NO: 3952406 - RNA, 19 nt, Shigella flexneri 2a str. 301
ugaccgcguugcagcauau

SEQ ID NO: 3952407 - RNA, 14 nt, Shigella flexneri 2a str. 301
ugaccgcuccgcca

SEQ ID NO: 3952408 - RNA, 16 nt, Shigella flexneri 2a str. 301
ugaccgcuccgccauc

SEQ ID NO: 3952409 - RNA, 20 nt, Shigella flexneri 2a str. 301
ugaccgggcgcggcuguugc

SEQ ID NO: 3952410 - RNA, 14 nt, Shigella flexneri 2a str. 301
ugaccgucuuucau

SEQ ID NO: 3952411 - RNA, 23 nt, Shigella flexneri 2a str. 301
ugaccgugcgggcgaaagcagaa

SEQ ID NO: 3952412 - RNA, 15 nt, Shigella flexneri 2a str. 301
ugaccguuacugaua

SEQ ID NO: 3952413 - RNA, 22 nt, Shigella flexneri 2a str. 301
ugaccuagcaaacuaucugugu

SEQ ID NO: 3952414 - RNA, 14 nt, Shigella flexneri 2a str. 301
ugaccugccgcaga

SEQ ID NO: 3952415 - RNA, 16 nt, Shigella flexneri 2a str. 301
ugaccugcggcaccag

SEQ ID NO: 3952416 - RNA, 17 nt, Shigella flexneri 2a str. 301
ugaccugcggcaccagc

SEQ ID NO: 3952417 - RNA, 20 nt, Shigella flexneri 2a str. 301
ugaccugcggcaccagcggu

SEQ ID NO: 3952418 - RNA, 16 nt, Shigella flexneri 2a str. 301
ugaccuuaccaccuua

SEQ ID NO: 3952419 - RNA, 16 nt, Shigella flexneri 2a str. 301
ugaccuuccagcgccg

SEQ ID NO: 3952420 - RNA, 13 nt, Shigella flexneri 2a str. 301
ugaccuucuucag

SEQ ID NO: 3952421 - RNA, 18 nt, Shigella flexneri 2a str. 301
ugaccuugucaugcagcu

SEQ ID NO: 3952422 - RNA, 15 nt, Shigella flexneri 2a str. 301
ugacgaccacccagc

SEQ ID NO: 3952423 - RNA, 17 nt, Shigella flexneri 2a str. 301
ugacgaccacccagcau

SEQ ID NO: 3952424 - RNA, 21 nt, Shigella flexneri 2a str. 301
ugacgaucaacccaguugauc

SEQ ID NO: 3952425 - RNA, 21 nt, Shigella flexneri 2a str. 301
ugacgaugcuccacuccugcc

SEQ ID NO: 3952426 - RNA, 15 nt, Shigella flexneri 2a str. 301
ugacgauuguagaaa

SEQ ID NO: 3952427 - RNA, 20 nt, Shigella flexneri 2a str. 301
ugacgcagauccugauuuaa

SEQ ID NO: 3952428 - RNA, 16 nt, Shigella flexneri 2a str. 301
ugacgccaccagcggu

SEQ ID NO: 3952429 - RNA, 23 nt, Shigella flexneri 2a str. 301
ugacgccaucucccggcauacca

SEQ ID NO: 3952430 - RNA, 20 nt, Shigella flexneri 2a str. 301
ugacgcccguuaaccgcucu

SEQ ID NO: 3952431 - RNA, 21 nt, Shigella flexneri 2a str. 301
ugacgcgcauacucuccucca

SEQ ID NO: 3952432 - RNA, 15 nt, Shigella flexneri 2a str. 301
ugacgcgcuaagcga

SEQ ID NO: 3952433 - RNA, 16 nt, Shigella flexneri 2a str. 301
ugacgcgggcagcaga

SEQ ID NO: 3952434 - RNA, 17 nt, Shigella flexneri 2a str. 301
ugacgcgggcagcagaa

SEQ ID NO: 3952435 - RNA, 20 nt, Shigella flexneri 2a str. 301
ugacgcgucuuaucaggccu

SEQ ID NO: 3952436 - RNA, 21 nt, Shigella flexneri 2a str. 301
ugacgcgucuuaucaggccua

SEQ ID NO: 3952437 - RNA, 23 nt, Shigella flexneri 2a str. 301
ugacgcgucuuaucaggccuaca

SEQ ID NO: 3952438 - RNA, 20 nt, Shigella flexneri 2a str. 301
ugacgcgucuuaucuggccu

SEQ ID NO: 3952439 - RNA, 21 nt, Shigella flexneri 2a str. 301
ugacgcgucuuaucuggccua

SEQ ID NO: 3952440 - RNA, 21 nt, Shigella flexneri 2a str. 301
ugacgcucucuacgcccugua

SEQ ID NO: 3952441 - RNA, 23 nt, Shigella flexneri 2a str. 301
ugacgcugauuuuuuuucaaccu

SEQ ID NO: 3952442 - RNA, 17 nt, Shigella flexneri 2a str. 301
ugacggacgcccgccga

SEQ ID NO: 3952443 - RNA, 19 nt, Shigella flexneri 2a str. 301
ugacggaucccgccaacag

SEQ ID NO: 3952444 - RNA, 21 nt, Shigella flexneri 2a str. 301
ugacgggcaagaauaucugcu

SEQ ID NO: 3952445 - RNA, 15 nt, Shigella flexneri 2a str. 301
ugacgggcaaggcug

SEQ ID NO: 3952446 - RNA, 19 nt, Shigella flexneri 2a str. 301
ugacguagcagcuccgcca

SEQ ID NO: 3952447 - RNA, 14 nt, Shigella flexneri 2a str. 301
ugacguaucaccga

SEQ ID NO: 3952448 - RNA, 18 nt, Shigella flexneri 2a str. 301
ugacguaucaccgagaca

SEQ ID NO: 3952449 - RNA, 20 nt, Shigella flexneri 2a str. 301
ugacguccagcccuucucgc

SEQ ID NO: 3952450 - RNA, 17 nt, Shigella flexneri 2a str. 301
ugacguccuguacuguu

SEQ ID NO: 3952451 - RNA, 18 nt, Shigella flexneri 2a str. 301
ugacgucgcuaagcacga

SEQ ID NO: 3952452 - RNA, 20 nt, Shigella flexneri 2a str. 301
ugacgugucuuaucaggccu

SEQ ID NO: 3952453 - RNA, 21 nt, Shigella flexneri 2a str. 301
ugacgugucuuaucaggccua

SEQ ID NO: 3952454 - RNA, 23 nt, Shigella flexneri 2a str. 301
ugacgugucuuaucaggccuaca

SEQ ID NO: 3952455 - RNA, 14 nt, Shigella flexneri 2a str. 301
ugacguucaguuca

SEQ ID NO: 3952456 - RNA, 14 nt, Shigella flexneri 2a str. 301
ugacguuccuuucu

SEQ ID NO: 3952457 - RNA, 18 nt, Shigella flexneri 2a str. 301
ugacguuuacuucgcuuu

SEQ ID NO: 3952458 - RNA, 18 nt, Shigella flexneri 2a str. 301
ugacuacacuaaacgucu

SEQ ID NO: 3952459 - RNA, 17 nt, Shigella flexneri 2a str. 301
ugacuauccuggacuuu

SEQ ID NO: 3952460 - RNA, 16 nt, Shigella flexneri 2a str. 301
ugacucagcaucugca

SEQ ID NO: 3952461 - RNA, 20 nt, Shigella flexneri 2a str. 301
ugacucagcggcugccagca

SEQ ID NO: 3952462 - RNA, 15 nt, Shigella flexneri 2a str. 301
ugaguucacugccgu

SEQ ID NO: 3952463 - RNA, 14 nt, Shigella flexneri 2a str. 301
ugaguuccacuggu

SEQ ID NO: 3952464 - RNA, 18 nt, Shigella flexneri 2a str. 301
ugaguuccgccguauguu

SEQ ID NO: 3952465 - RNA, 17 nt, Shigella flexneri 2a str. 301
ugaguuccgcugcuggg

SEQ ID NO: 3952466 - RNA, 20 nt, Shigella flexneri 2a str. 301
ugaguuucuauguauugugc

SEQ ID NO: 3952467 - RNA, 11 nt, Shigella flexneri 2a str. 301
ugaguuuucag

SEQ ID NO: 3952468 - RNA, 21 nt, Shigella flexneri 2a str. 301
ugaguuuuuuguccguuacca

SEQ ID NO: 3952469 - RNA, 12 nt, Shigella flexneri 2a str. 301
ugauaaaaaacc

SEQ ID NO: 3952470 - RNA, 13 nt, Shigella flexneri 2a str. 301
ugauaaacaagcg

SEQ ID NO: 3952471 - RNA, 16 nt, Shigella flexneri 2a str. 301
ugauaaaccuccagca

SEQ ID NO: 3952472 - RNA, 14 nt, Shigella flexneri 2a str. 301
ugauaaaucaccug

SEQ ID NO: 3952473 - RNA, 18 nt, Shigella flexneri 2a str. 301
ugauaacuucuaccagau

SEQ ID NO: 3952474 - RNA, 12 nt, Shigella flexneri 2a str. 301
ugauaaggaaau

SEQ ID NO: 3952475 - RNA, 17 nt, Shigella flexneri 2a str. 301
ugauaaggaaauucagc

SEQ ID NO: 3952476 - RNA, 14 nt, Shigella flexneri 2a str. 301
ugauaaucauccca

SEQ ID NO: 3952477 - RNA, 13 nt, Shigella flexneri 2a str. 301
ugauaauccauca

SEQ ID NO: 3952478 - RNA, 18 nt, Shigella flexneri 2a str. 301
ugauaauccaucacuuca

SEQ ID NO: 3952479 - RNA, 23 nt, Shigella flexneri 2a str. 301
ugauaauguuauuuaauuacuga

SEQ ID NO: 3952480 - RNA, 14 nt, Shigella flexneri 2a str. 301
ugauaauuaugaag

SEQ ID NO: 3952481 - RNA, 15 nt, Shigella flexneri 2a str. 301
ugauaauuaugaagu

SEQ ID NO: 3952482 - RNA, 22 nt, Shigella flexneri 2a str. 301
ugauaauuguuaucguuugcau

SEQ ID NO: 3952483 - RNA, 23 nt, Shigella flexneri 2a str. 301
ugauaauuguuaucguuugcauu

SEQ ID NO: 3952484 - RNA, 21 nt, Shigella flexneri 2a str. 301
ugauaauuuucgguaaugacu

SEQ ID NO: 3952485 - RNA, 12 nt, Shigella flexneri 2a str. 301
ugauacaacgac

SEQ ID NO: 3952486 - RNA, 16 nt, Shigella flexneri 2a str. 301
ugauacaggaacagcc

SEQ ID NO: 3952487 - RNA, 20 nt, Shigella flexneri 2a str. 301
ugauaccgauuacucagcaa

SEQ ID NO: 3952488 - RNA, 21 nt, Shigella flexneri 2a str. 301
ugauaccgggcguccugcuug

SEQ ID NO: 3952489 - RNA, 19 nt, Shigella flexneri 2a str. 301
ugauaccgggcuguucacu

SEQ ID NO: 3952490 - RNA, 20 nt, Shigella flexneri 2a str. 301
ugauacgcgccaaucggcaa

SEQ ID NO: 3952491 - RNA, 19 nt, Shigella flexneri 2a str. 301
ugauacgggaggucaucag

SEQ ID NO: 3952492 - RNA, 15 nt, Shigella flexneri 2a str. 301
ugauacguaaaccac

SEQ ID NO: 3952493 - RNA, 22 nt, Shigella flexneri 2a str. 301
ugauagauuuauuuauuauuaa

SEQ ID NO: 3952494 - RNA, 15 nt, Shigella flexneri 2a str. 301
ugauagcccggauuu

SEQ ID NO: 3952495 - RNA, 18 nt, Shigella flexneri 2a str. 301
ugauagcccggauuucca

SEQ ID NO: 3952496 - RNA, 12 nt, Shigella flexneri 2a str. 301
ugauaggcguug

SEQ ID NO: 3952497 - RNA, 16 nt, Shigella flexneri 2a str. 301
ugauaguucaacagau

SEQ ID NO: 3952498 - RNA, 19 nt, Shigella flexneri 2a str. 301
ugauauauuuuuaaauaua

SEQ ID NO: 3952499 - RNA, 16 nt, Shigella flexneri 2a str. 301
ugauaucauuaaaguu

SEQ ID NO: 3952500 - RNA, 22 nt, Shigella flexneri 2a str. 301
ugauauccaccgcguucagcag

SEQ ID NO: 3952501 - RNA, 22 nt, Shigella flexneri 2a str. 301
ugauaucccgcgcguuuuucuu

SEQ ID NO: 3952502 - RNA, 17 nt, Shigella flexneri 2a str. 301
ugauaucggccaucugu

SEQ ID NO: 3952503 - RNA, 14 nt, Shigella flexneri 2a str. 301
ugauaucucaccag

SEQ ID NO: 3952504 - RNA, 16 nt, Shigella flexneri 2a str. 301
ugauaugccugcuggc

SEQ ID NO: 3952505 - RNA, 12 nt, Shigella flexneri 2a str. 301
ugauauggucaa

SEQ ID NO: 3952506 - RNA, 19 nt, Shigella flexneri 2a str. 301
ugauauugcccgugacucc

SEQ ID NO: 3952507 - RNA, 22 nt, Shigella flexneri 2a str. 301
ugauauugcucgcacugggcga

SEQ ID NO: 3952508 - RNA, 18 nt, Shigella flexneri 2a str. 301
ugauauuggcaucgccag

SEQ ID NO: 3952509 - RNA, 14 nt, Shigella flexneri 2a str. 301
ugauauuuucugcc

SEQ ID NO: 3952510 - RNA, 15 nt, Shigella flexneri 2a str. 301
ugauauuuuucccug

SEQ ID NO: 3952511 - RNA, 22 nt, Shigella flexneri 2a str. 301
ugaucaaaaucauauaauuguu

SEQ ID NO: 3952512 - RNA, 13 nt, Shigella flexneri 2a str. 301
ugaucaacagcau

SEQ ID NO: 3952513 - RNA, 12 nt, Shigella flexneri 2a str. 301
ugaucaccagug

SEQ ID NO: 3952514 - RNA, 13 nt, Shigella flexneri 2a str. 301
ugaucacccacau

SEQ ID NO: 3952515 - RNA, 23 nt, Shigella flexneri 2a str. 301
ugaucagacacguuaauggcuuu

SEQ ID NO: 3952516 - RNA, 22 nt, Shigella flexneri 2a str. 301
ugaucagccccggcaaaugacg

SEQ ID NO: 3952517 - RNA, 15 nt, Shigella flexneri 2a str. 301
ugaucaggucagauu

SEQ ID NO: 3952518 - RNA, 11 nt, Shigella flexneri 2a str. 301
ugaucaucauu

SEQ ID NO: 3952519 - RNA, 13 nt, Shigella flexneri 2a str. 301
ugaucauccgccu

SEQ ID NO: 3952520 - RNA, 22 nt, Shigella flexneri 2a str. 301
ugaucaugugcaggauuaauaa

SEQ ID NO: 3952521 - RNA, 14 nt, Shigella flexneri 2a str. 301
ugaucauucaccag

SEQ ID NO: 3952522 - RNA, 16 nt, Shigella flexneri 2a str. 301
ugaucauucaccagcc

SEQ ID NO: 3952523 - RNA, 18 nt, Shigella flexneri 2a str. 301
ugauccacgguucuccac

SEQ ID NO: 3952524 - RNA, 20 nt, Shigella flexneri 2a str. 301
ugauccagaugugcaccuuu

SEQ ID NO: 3952525 - RNA, 19 nt, Shigella flexneri 2a str. 301
ugauccagccauugccaua

SEQ ID NO: 3952526 - RNA, 17 nt, Shigella flexneri 2a str. 301
ugauccaggagcuccag

SEQ ID NO: 3952527 - RNA, 22 nt, Shigella flexneri 2a str. 301
ugauccaggagcuccagguccu

SEQ ID NO: 3952528 - RNA, 15 nt, Shigella flexneri 2a str. 301
ugauccccgcuuccu

SEQ ID NO: 3952529 - RNA, 23 nt, Shigella flexneri 2a str. 301
ugaucccgauggucagcuucacc

SEQ ID NO: 3952530 - RNA, 17 nt, Shigella flexneri 2a str. 301
ugauccgccgcgcggug

SEQ ID NO: 3952531 - RNA, 20 nt, Shigella flexneri 2a str. 301
ugauccgccgcgcggugggc

SEQ ID NO: 3952532 - RNA, 12 nt, Shigella flexneri 2a str. 301
ugauccggauuc

SEQ ID NO: 3952533 - RNA, 17 nt, Shigella flexneri 2a str. 301
ugauccugcaacagcac

SEQ ID NO: 3952534 - RNA, 21 nt, Shigella flexneri 2a str. 301
ugauccugcaacagcaccagc

SEQ ID NO: 3952535 - RNA, 18 nt, Shigella flexneri 2a str. 301
ugauccuggauuuccucg

SEQ ID NO: 3952536 - RNA, 14 nt, Shigella flexneri 2a str. 301
ugaucgaaaaugcg

SEQ ID NO: 3952537 - RNA, 17 nt, Shigella flexneri 2a str. 301
ugaucgaaaaugcgcau

SEQ ID NO: 3952538 - RNA, 17 nt, Shigella flexneri 2a str. 301
ugaucgccagcggaaua

SEQ ID NO: 3952539 - RNA, 13 nt, Shigella flexneri 2a str. 301
ugaucgccauauu

SEQ ID NO: 3952540 - RNA, 16 nt, Shigella flexneri 2a str. 301
ugaucgccgcacuuuc

SEQ ID NO: 3952541 - RNA, 19 nt, Shigella flexneri 2a str. 301
ugaucgcgccgccgcccau

SEQ ID NO: 3952542 - RNA, 16 nt, Shigella flexneri 2a str. 301
ugaucgcguuuuuugu

SEQ ID NO: 3952543 - RNA, 15 nt, Shigella flexneri 2a str. 301
ugaucggcgcgaaag

SEQ ID NO: 3952544 - RNA, 21 nt, Shigella flexneri 2a str. 301
ugaucggcuggcgaaccagga

SEQ ID NO: 3952545 - RNA, 13 nt, Shigella flexneri 2a str. 301
ugaucgucacgau

SEQ ID NO: 3952546 - RNA, 23 nt, Shigella flexneri 2a str. 301
ugaucuaaaaucgcuucagccgg

SEQ ID NO: 3952547 - RNA, 18 nt, Shigella flexneri 2a str. 301
ugaucuauaccaccgcuc

SEQ ID NO: 3952548 - RNA, 13 nt, Shigella flexneri 2a str. 301
ugaucucuuucca

SEQ ID NO: 3952549 - RNA, 19 nt, Shigella flexneri 2a str. 301
ugaucugaccgaaugcagu

SEQ ID NO: 3952550 - RNA, 18 nt, Shigella flexneri 2a str. 301
ugaucuuaugauguaaau

SEQ ID NO: 3952551 - RNA, 11 nt, Shigella flexneri 2a str. 301
ugaucuuuuuu

SEQ ID NO: 3952552 - RNA, 17 nt, Shigella flexneri 2a str. 301
ugaugaaaaaaccagaa

SEQ ID NO: 3952553 - RNA, 13 nt, Shigella flexneri 2a str. 301
ugaugaaaacgaa

SEQ ID NO: 3952554 - RNA, 14 nt, Shigella flexneri 2a str. 301
ugaugaagacagac

SEQ ID NO: 3952555 - RNA, 19 nt, Shigella flexneri 2a str. 301
ugaugaccagaucaggcuu

SEQ ID NO: 3952556 - RNA, 16 nt, Shigella flexneri 2a str. 301
ugaugacugaugcuuu

SEQ ID NO: 3952557 - RNA, 16 nt, Shigella flexneri 2a str. 301
ugaugaguugaaaacc

SEQ ID NO: 3952558 - RNA, 16 nt, Shigella flexneri 2a str. 301
ugaugauaucacuggu

SEQ ID NO: 3952559 - RNA, 19 nt, Shigella flexneri 2a str. 301
ugaugauuuccggcagcau

SEQ ID NO: 3952560 - RNA, 15 nt, Shigella flexneri 2a str. 301
ugaugcacaccaucg

SEQ ID NO: 3952561 - RNA, 14 nt, Shigella flexneri 2a str. 301
ugaugcaccaccug

SEQ ID NO: 3952562 - RNA, 17 nt, Shigella flexneri 2a str. 301
ugaugcagccagugauu

SEQ ID NO: 3952563 - RNA, 12 nt, Shigella flexneri 2a str. 301
ugcaaccacaca

SEQ ID NO: 3952564 - RNA, 22 nt, Shigella flexneri 2a str. 301
ugcaacccgccagguuucauag

SEQ ID NO: 3952565 - RNA, 17 nt, Shigella flexneri 2a str. 301
ugcaaccuuuuccauug

SEQ ID NO: 3952566 - RNA, 14 nt, Shigella flexneri 2a str. 301
ugcaacgaacgcau

SEQ ID NO: 3952567 - RNA, 18 nt, Shigella flexneri 2a str. 301
ugcaacuucucuuucggc

SEQ ID NO: 3952568 - RNA, 15 nt, Shigella flexneri 2a str. 301
ugcaagaucgcgcau

SEQ ID NO: 3952569 - RNA, 20 nt, Shigella flexneri 2a str. 301
ugcaagaucgcgcaucagcu

SEQ ID NO: 3952570 - RNA, 23 nt, Shigella flexneri 2a str. 301
ugcaagaucgcgcaucagcuccg

SEQ ID NO: 3952571 - RNA, 15 nt, Shigella flexneri 2a str. 301
ugcaagaucgcucau

SEQ ID NO: 3952572 - RNA, 19 nt, Shigella flexneri 2a str. 301
ugcaagaucgcucaucagc

SEQ ID NO: 3952573 - RNA, 20 nt, Shigella flexneri 2a str. 301
ugcaagaucgcucaucagcu

SEQ ID NO: 3952574 - RNA, 16 nt, Shigella flexneri 2a str. 301
ugcaagccuguaguac

SEQ ID NO: 3952575 - RNA, 17 nt, Shigella flexneri 2a str. 301
ugcaagccuguaguaca

SEQ ID NO: 3952576 - RNA, 21 nt, Shigella flexneri 2a str. 301
ugcaagcgggguaaaugccau

SEQ ID NO: 3952577 - RNA, 14 nt, Shigella flexneri 2a str. 301
ugcaaggcuugaac

SEQ ID NO: 3952578 - RNA, 22 nt, Shigella flexneri 2a str. 301
ugcaagguggucagacggaaca

SEQ ID NO: 3952579 - RNA, 18 nt, Shigella flexneri 2a str. 301
ugcaagugagucggcuuu

SEQ ID NO: 3952580 - RNA, 13 nt, Shigella flexneri 2a str. 301
ugcaauaaauaug

SEQ ID NO: 3952581 - RNA, 17 nt, Shigella flexneri 2a str. 301
ugcaauaacaauacuua

SEQ ID NO: 3952582 - RNA, 19 nt, Shigella flexneri 2a str. 301
ugcaauaacaauacuuaua

SEQ ID NO: 3952583 - RNA, 22 nt, Shigella flexneri 2a str. 301
ugcaauaauggaaccuaacgcu

SEQ ID NO: 3952584 - RNA, 18 nt, Shigella flexneri 2a str. 301
ugcaauacuuccgcuucc

SEQ ID NO: 3952585 - RNA, 20 nt, Shigella flexneri 2a str. 301
ugcaauagcgccugcugcug

SEQ ID NO: 3952586 - RNA, 16 nt, Shigella flexneri 2a str. 301
ugcaauauauugaauu

SEQ ID NO: 3952587 - RNA, 15 nt, Shigella flexneri 2a str. 301
ugcaauaugcuggca

SEQ ID NO: 3952588 - RNA, 21 nt, Shigella flexneri 2a str. 301
ugcaaucaacaccacugccag

SEQ ID NO: 3952589 - RNA, 15 nt, Shigella flexneri 2a str. 301
ugcaaucacaaauag

SEQ ID NO: 3952590 - RNA, 16 nt, Shigella flexneri 2a str. 301
ugcaaucacuuccuca

SEQ ID NO: 3952591 - RNA, 16 nt, Shigella flexneri 2a str. 301
ugcaaucagauaaaau

SEQ ID NO: 3952592 - RNA, 13 nt, Shigella flexneri 2a str. 301
ugcaaucaguuca

SEQ ID NO: 3952593 - RNA, 15 nt, Shigella flexneri 2a str. 301
ugcaaucuacaaaag

SEQ ID NO: 3952594 - RNA, 15 nt, Shigella flexneri 2a str. 301
ugcaaugauucaggc

SEQ ID NO: 3952595 - RNA, 15 nt, Shigella flexneri 2a str. 301
ugcaaugucaucagc

SEQ ID NO: 3952596 - RNA, 22 nt, Shigella flexneri 2a str. 301
ugcaaugucaucagcauucuca

SEQ ID NO: 3952597 - RNA, 16 nt, Shigella flexneri 2a str. 301
ugcaauuccaucauau

SEQ ID NO: 3952598 - RNA, 14 nt, Shigella flexneri 2a str. 301
ugcaauuuauugau

SEQ ID NO: 3952599 - RNA, 16 nt, Shigella flexneri 2a str. 301
ugcacaacaaucugca

SEQ ID NO: 3952600 - RNA, 16 nt, Shigella flexneri 2a str. 301
ugcacaauugccagcc

SEQ ID NO: 3952601 - RNA, 16 nt, Shigella flexneri 2a str. 301
ugcacaauugccggau

SEQ ID NO: 3952602 - RNA, 23 nt, Shigella flexneri 2a str. 301
ugcacaauugccggaugcggcgu

SEQ ID NO: 3952603 - RNA, 22 nt, Shigella flexneri 2a str. 301
ugcacaauuuaccggcagguga

SEQ ID NO: 3952604 - RNA, 22 nt, Shigella flexneri 2a str. 301
ugcacaccccgcgcagcugaga

SEQ ID NO: 3952605 - RNA, 20 nt, Shigella flexneri 2a str. 301
ugcacaccgcggaacgcacu

SEQ ID NO: 3952606 - RNA, 17 nt, Shigella flexneri 2a str. 301
ugcacagacuuaauauu

SEQ ID NO: 3952607 - RNA, 20 nt, Shigella flexneri 2a str. 301
ugcacagacuuaauauugcc

SEQ ID NO: 3952608 - RNA, 12 nt, Shigella flexneri 2a str. 301
ugcacaggcaac

SEQ ID NO: 3952609 - RNA, 12 nt, Shigella flexneri 2a str. 301
ugcacaggcaau

SEQ ID NO: 3952610 - RNA, 19 nt, Shigella flexneri 2a str. 301
ugcacaucuaaccauuauu

SEQ ID NO: 3952611 - RNA, 22 nt, Shigella flexneri 2a str. 301
ugcacaugaugauggcuaucaa

SEQ ID NO: 3952612 - RNA, 14 nt, Shigella flexneri 2a str. 301
ugcacaugcaacgu

SEQ ID NO: 3952613 - RNA, 14 nt, Shigella flexneri 2a str. 301
ugcacauuccagau

SEQ ID NO: 3952614 - RNA, 22 nt, Shigella flexneri 2a str. 301
ugcaccaacccuaacccaacau

SEQ ID NO: 3952615 - RNA, 16 nt, Shigella flexneri 2a str. 301
ugcaccagcaacaagc

SEQ ID NO: 3952616 - RNA, 19 nt, Shigella flexneri 2a str. 301
ugcaccagcaacaagccag

SEQ ID NO: 3952617 - RNA, 15 nt, Shigella flexneri 2a str. 301
ugcaccauugcugcc

SEQ ID NO: 3952618 - RNA, 19 nt, Shigella flexneri 2a str. 301
ugcaccauugcugccgcca

SEQ ID NO: 3952619 - RNA, 22 nt, Shigella flexneri 2a str. 301
ugcaccccaauuaauugccagc

SEQ ID NO: 3952620 - RNA, 17 nt, Shigella flexneri 2a str. 301
ugcacccgcuucaguga

SEQ ID NO: 3952621 - RNA, 14 nt, Shigella flexneri 2a str. 301
ugcaccgaguucuu

SEQ ID NO: 3952622 - RNA, 15 nt, Shigella flexneri 2a str. 301
ugcaccgauuucgag

SEQ ID NO: 3952623 - RNA, 16 nt, Shigella flexneri 2a str. 301
ugcaccggucgacgau

SEQ ID NO: 3952624 - RNA, 15 nt, Shigella flexneri 2a str. 301
ugcaccucugcugcu

SEQ ID NO: 3952625 - RNA, 14 nt, Shigella flexneri 2a str. 301
ugcacgaaaccacu

SEQ ID NO: 3952626 - RNA, 16 nt, Shigella flexneri 2a str. 301
ugcacgaaccagagac

SEQ ID NO: 3952627 - RNA, 23 nt, Shigella flexneri 2a str. 301
ugcacgaccggguuuucaaugau

SEQ ID NO: 3952628 - RNA, 22 nt, Shigella flexneri 2a str. 301
ugcacgaugccucaucacaaaa

SEQ ID NO: 3952629 - RNA, 23 nt, Shigella flexneri 2a str. 301
ugcacgccaucuggcugacggug

SEQ ID NO: 3952630 - RNA, 12 nt, Shigella flexneri 2a str. 301
ugcacgcccuga

SEQ ID NO: 3952631 - RNA, 23 nt, Shigella flexneri 2a str. 301
ugcacgcccugauaaaucaccug

SEQ ID NO: 3952632 - RNA, 17 nt, Shigella flexneri 2a str. 301
ugcacggagauauccag

SEQ ID NO: 3952633 - RNA, 19 nt, Shigella flexneri 2a str. 301
ugcacggagauauccagcg

SEQ ID NO: 3952634 - RNA, 21 nt, Shigella flexneri 2a str. 301
ugcacggagauauccagcgcc

SEQ ID NO: 3952635 - RNA, 22 nt, Shigella flexneri 2a str. 301
ugcacggcaugagccgccgcca

SEQ ID NO: 3952636 - RNA, 19 nt, Shigella flexneri 2a str. 301
ugcacgguuuuuccagcuc

SEQ ID NO: 3952637 - RNA, 22 nt, Shigella flexneri 2a str. 301
ugcacguccgguggcauccgca

SEQ ID NO: 3952638 - RNA, 21 nt, Shigella flexneri 2a str. 301
ugcacguggugugggcgguga

SEQ ID NO: 3952639 - RNA, 17 nt, Shigella flexneri 2a str. 301
ugcacguuaucagacac

SEQ ID NO: 3952640 - RNA, 22 nt, Shigella flexneri 2a str. 301
ugcacguuaucagacaccagcc

SEQ ID NO: 3952641 - RNA, 17 nt, Shigella flexneri 2a str. 301
ugcacguuguuauccag

SEQ ID NO: 3952642 - RNA, 13 nt, Shigella flexneri 2a str. 301
ugcacguuuucaa

SEQ ID NO: 3952643 - RNA, 22 nt, Shigella flexneri 2a str. 301
ugcacuacccaguauguaacug

SEQ ID NO: 3952644 - RNA, 19 nt, Shigella flexneri 2a str. 301
ugcacuagacgaugaaaaa

SEQ ID NO: 3952645 - RNA, 20 nt, Shigella flexneri 2a str. 301
ugcacucagguaacagggaa

SEQ ID NO: 3952646 - RNA, 12 nt, Shigella flexneri 2a str. 301
ugcacuggcuuc

SEQ ID NO: 3952647 - RNA, 13 nt, Shigella flexneri 2a str. 301
ugcacugggagaa

SEQ ID NO: 3952648 - RNA, 17 nt, Shigella flexneri 2a str. 301
ugcacuuaacaggaucu

SEQ ID NO: 3952649 - RNA, 19 nt, Shigella flexneri 2a str. 301
ugcacuugcuuaaaauccc

SEQ ID NO: 3952650 - RNA, 15 nt, Shigella flexneri 2a str. 301
ugcagaaacaaccug

SEQ ID NO: 3952651 - RNA, 15 nt, Shigella flexneri 2a str. 301
ugcagaaaccaaagc

SEQ ID NO: 3952652 - RNA, 22 nt, Shigella flexneri 2a str. 301
ugcagaccgcugacggcagcga

SEQ ID NO: 3952653 - RNA, 16 nt, Shigella flexneri 2a str. 301
ugcagacggcucauca

SEQ ID NO: 3952654 - RNA, 17 nt, Shigella flexneri 2a str. 301
ugcagacggcucaucac

SEQ ID NO: 3952655 - RNA, 15 nt, Shigella flexneri 2a str. 301
ugcagacugaauacg

SEQ ID NO: 3952656 - RNA, 17 nt, Shigella flexneri 2a str. 301
ugcagauaccacaucaa

SEQ ID NO: 3952657 - RNA, 15 nt, Shigella flexneri 2a str. 301
ugcagauauugcacc

SEQ ID NO: 3952658 - RNA, 22 nt, Shigella flexneri 2a str. 301
ugcagaucgcgauagugcuuaa

SEQ ID NO: 3952659 - RNA, 16 nt, Shigella flexneri 2a str. 301
ugcagcaacucuuuuu

SEQ ID NO: 3952660 - RNA, 22 nt, Shigella flexneri 2a str. 301
ugcagcacacauuauaggccug

SEQ ID NO: 3952661 - RNA, 23 nt, Shigella flexneri 2a str. 301
ugcagcacacauuauaggccuga

SEQ ID NO: 3952662 - RNA, 22 nt, Shigella flexneri 2a str. 301
ugccaccaccagcguaccgaua

SEQ ID NO: 3952663 - RNA, 14 nt, Shigella flexneri 2a str. 301
ugccaccacugcaa

SEQ ID NO: 3952664 - RNA, 18 nt, Shigella flexneri 2a str. 301
ugccaccacugcaaugac

SEQ ID NO: 3952665 - RNA, 15 nt, Shigella flexneri 2a str. 301
ugccaccagcagcgu

SEQ ID NO: 3952666 - RNA, 15 nt, Shigella flexneri 2a str. 301
ugccaccagcgcaau

SEQ ID NO: 3952667 - RNA, 12 nt, Shigella flexneri 2a str. 301
ugccacccugcg

SEQ ID NO: 3952668 - RNA, 20 nt, Shigella flexneri 2a str. 301
ugccacccugcggcugcuga

SEQ ID NO: 3952669 - RNA, 23 nt, Shigella flexneri 2a str. 301
ugccaccugccggagcgccacca

SEQ ID NO: 3952670 - RNA, 16 nt, Shigella flexneri 2a str. 301
ugccacgccacgcugc

SEQ ID NO: 3952671 - RNA, 16 nt, Shigella flexneri 2a str. 301
ugccacguucugaucu

SEQ ID NO: 3952672 - RNA, 18 nt, Shigella flexneri 2a str. 301
ugccacugccggugucga

SEQ ID NO: 3952673 - RNA, 16 nt, Shigella flexneri 2a str. 301
ugccacuggccccacc

SEQ ID NO: 3952674 - RNA, 22 nt, Shigella flexneri 2a str. 301
ugccacugguuuuccugagcaa

SEQ ID NO: 3952675 - RNA, 22 nt, Shigella flexneri 2a str. 301
ugccagaaauccaggcccgcau

SEQ ID NO: 3952676 - RNA, 17 nt, Shigella flexneri 2a str. 301
ugccagaacaaccagag

SEQ ID NO: 3952677 - RNA, 14 nt, Shigella flexneri 2a str. 301
ugccagaaccgcuu

SEQ ID NO: 3952678 - RNA, 13 nt, Shigella flexneri 2a str. 301
ugccagaacugau

SEQ ID NO: 3952679 - RNA, 19 nt, Shigella flexneri 2a str. 301
ugccagaauccccacugca

SEQ ID NO: 3952680 - RNA, 18 nt, Shigella flexneri 2a str. 301
ugccagacaacaugagaa

SEQ ID NO: 3952681 - RNA, 16 nt, Shigella flexneri 2a str. 301
ugccagaccaaacagc

SEQ ID NO: 3952682 - RNA, 14 nt, Shigella flexneri 2a str. 301
ugccagaccuccgu

SEQ ID NO: 3952683 - RNA, 22 nt, Shigella flexneri 2a str. 301
ugccagacuucaucggcgguga

SEQ ID NO: 3952684 - RNA, 15 nt, Shigella flexneri 2a str. 301
ugccagagcccauca

SEQ ID NO: 3952685 - RNA, 19 nt, Shigella flexneri 2a str. 301
ugccagaggagccaucacc

SEQ ID NO: 3952686 - RNA, 21 nt, Shigella flexneri 2a str. 301
ugccagaggagccaucaccau

SEQ ID NO: 3952687 - RNA, 22 nt, Shigella flexneri 2a str. 301
ugccagaggagccaucaccauc

SEQ ID NO: 3952688 - RNA, 16 nt, Shigella flexneri 2a str. 301
ugccagauaauggcug

SEQ ID NO: 3952689 - RNA, 14 nt, Shigella flexneri 2a str. 301
ugccagauacaaaa

SEQ ID NO: 3952690 - RNA, 14 nt, Shigella flexneri 2a str. 301
ugccagauagccag

SEQ ID NO: 3952691 - RNA, 15 nt, Shigella flexneri 2a str. 301
ugccagaucggccau

SEQ ID NO: 3952692 - RNA, 16 nt, Shigella flexneri 2a str. 301
ugccagaugcagcggu

SEQ ID NO: 3952693 - RNA, 19 nt, Shigella flexneri 2a str. 301
ugccagauggcauccagag

SEQ ID NO: 3952694 - RNA, 17 nt, Shigella flexneri 2a str. 301
ugccagauucuccaaca

SEQ ID NO: 3952695 - RNA, 20 nt, Shigella flexneri 2a str. 301
ugccagauuuaacggcagca

SEQ ID NO: 3952696 - RNA, 13 nt, Shigella flexneri 2a str. 301
ugccagcaaauag

SEQ ID NO: 3952697 - RNA, 15 nt, Shigella flexneri 2a str. 301
ugccagcaaauagau

SEQ ID NO: 3952698 - RNA, 13 nt, Shigella flexneri 2a str. 301
ugccagcaccauc

SEQ ID NO: 3952699 - RNA, 18 nt, Shigella flexneri 2a str. 301
ugccagcauaaucaccau

SEQ ID NO: 3952700 - RNA, 20 nt, Shigella flexneri 2a str. 301
ugccagcauaccgccgagga

SEQ ID NO: 3952701 - RNA, 22 nt, Shigella flexneri 2a str. 301
ugccagccaggauaugcgccuu

SEQ ID NO: 3952702 - RNA, 15 nt, Shigella flexneri 2a str. 301
ugccagccgccgcua

SEQ ID NO: 3952703 - RNA, 19 nt, Shigella flexneri 2a str. 301
ugccagcgauuuaucggca

SEQ ID NO: 3952704 - RNA, 19 nt, Shigella flexneri 2a str. 301
ugccagcguaaauccugac

SEQ ID NO: 3952705 - RNA, 20 nt, Shigella flexneri 2a str. 301
ugccagcguaaauccugacg

SEQ ID NO: 3952706 - RNA, 15 nt, Shigella flexneri 2a str. 301
ugccagcguugagga

SEQ ID NO: 3952707 - RNA, 22 nt, Shigella flexneri 2a str. 301
ugccagcucuuucgacagcgau

SEQ ID NO: 3952708 - RNA, 16 nt, Shigella flexneri 2a str. 301
ugccagcugcugugga

SEQ ID NO: 3952709 - RNA, 17 nt, Shigella flexneri 2a str. 301
ugccagcuucccgcugg

SEQ ID NO: 3952710 - RNA, 18 nt, Shigella flexneri 2a str. 301
ugccagcuugcuuuccag

SEQ ID NO: 3952711 - RNA, 19 nt, Shigella flexneri 2a str. 301
ugccagcuugcuuuccagc

SEQ ID NO: 3952712 - RNA, 16 nt, Shigella flexneri 2a str. 301
ugccagcuuuaaauua

SEQ ID NO: 3952713 - RNA, 15 nt, Shigella flexneri 2a str. 301
ugccagcuuucaccu

SEQ ID NO: 3952714 - RNA, 14 nt, Shigella flexneri 2a str. 301
ugccaggaccauuc

SEQ ID NO: 3952715 - RNA, 20 nt, Shigella flexneri 2a str. 301
ugccaggacuucaucacgau

SEQ ID NO: 3952716 - RNA, 15 nt, Shigella flexneri 2a str. 301
ugccaguaaucacga

SEQ ID NO: 3952717 - RNA, 24 nt, Shigella flexneri 2a str. 301
ugccaguaaucacgaucucgccag

SEQ ID NO: 3952718 - RNA, 22 nt, Shigella flexneri 2a str. 301
ugccaguacccaugugauuuaa

SEQ ID NO: 3952719 - RNA, 15 nt, Shigella flexneri 2a str. 301
ugccaguaguucauc

SEQ ID NO: 3952720 - RNA, 18 nt, Shigella flexneri 2a str. 301
ugccagucaaucauccau

SEQ ID NO: 3952721 - RNA, 15 nt, Shigella flexneri 2a str. 301
ugccaguccuaaaaa

SEQ ID NO: 3952722 - RNA, 19 nt, Shigella flexneri 2a str. 301
ugccagucgcgccuuacgc

SEQ ID NO: 3952723 - RNA, 16 nt, Shigella flexneri 2a str. 301
ugccagugaaaguuuu

SEQ ID NO: 3952724 - RNA, 17 nt, Shigella flexneri 2a str. 301
ugccagugagugaaauu

SEQ ID NO: 3952725 - RNA, 19 nt, Shigella flexneri 2a str. 301
ugccagugccguuccagcc

SEQ ID NO: 3952726 - RNA, 21 nt, Shigella flexneri 2a str. 301
ugccagugcgguuuccacgcc

SEQ ID NO: 3952727 - RNA, 18 nt, Shigella flexneri 2a str. 301
ugccaguuaucgcaggua

SEQ ID NO: 3952728 - RNA, 15 nt, Shigella flexneri 2a str. 301
ugccaguuugcgcgu

SEQ ID NO: 3952729 - RNA, 13 nt, Shigella flexneri 2a str. 301
ugccaguuuuucc

SEQ ID NO: 3952730 - RNA, 21 nt, Shigella flexneri 2a str. 301
ugccauaaccugugcaccaga

SEQ ID NO: 3952731 - RNA, 20 nt, Shigella flexneri 2a str. 301
ugccauaacgggcggcguug

SEQ ID NO: 3952732 - RNA, 23 nt, Shigella flexneri 2a str. 301
ugccauacgugguugccgaagau

SEQ ID NO: 3952733 - RNA, 23 nt, Shigella flexneri 2a str. 301
ugccauauucgcuuucagcgagu

SEQ ID NO: 3952734 - RNA, 17 nt, Shigella flexneri 2a str. 301
ugccaucagcgccugau

SEQ ID NO: 3952735 - RNA, 17 nt, Shigella flexneri 2a str. 301
ugccaucagggcggccg

SEQ ID NO: 3952736 - RNA, 13 nt, Shigella flexneri 2a str. 301
ugccauccagcuu

SEQ ID NO: 3952737 - RNA, 14 nt, Shigella flexneri 2a str. 301
ugccauccagcuuu

SEQ ID NO: 3952738 - RNA, 17 nt, Shigella flexneri 2a str. 301
ugccauccguaauuuuu

SEQ ID NO: 3952739 - RNA, 22 nt, Shigella flexneri 2a str. 301
ugccauccguaauuuuuacucc

SEQ ID NO: 3952740 - RNA, 19 nt, Shigella flexneri 2a str. 301
ugccaucgacgaaauggug

SEQ ID NO: 3952741 - RNA, 16 nt, Shigella flexneri 2a str. 301
ugccaucgggcaaaau

SEQ ID NO: 3952742 - RNA, 14 nt, Shigella flexneri 2a str. 301
ugccaucucugcaa

SEQ ID NO: 3952743 - RNA, 18 nt, Shigella flexneri 2a str. 301
ugccaugcacgcaagaac

SEQ ID NO: 3952744 - RNA, 13 nt, Shigella flexneri 2a str. 301
ugccaugcauauc

SEQ ID NO: 3952745 - RNA, 15 nt, Shigella flexneri 2a str. 301
ugccaugccaaucag

SEQ ID NO: 3952746 - RNA, 15 nt, Shigella flexneri 2a str. 301
ugccauuaaaccaac

SEQ ID NO: 3952747 - RNA, 21 nt, Shigella flexneri 2a str. 301
ugccauuaacaggccaaaugc

SEQ ID NO: 3952748 - RNA, 13 nt, Shigella flexneri 2a str. 301
ugccauuaauguc

SEQ ID NO: 3952749 - RNA, 17 nt, Shigella flexneri 2a str. 301
ugccauuaaugucagau

SEQ ID NO: 3952750 - RNA, 17 nt, Shigella flexneri 2a str. 301
ugccauuaaugucggau

SEQ ID NO: 3952751 - RNA, 18 nt, Shigella flexneri 2a str. 301
ugccauucgccaguccuu

SEQ ID NO: 3952752 - RNA, 17 nt, Shigella flexneri 2a str. 301
ugccauuucugcugcca

SEQ ID NO: 3952753 - RNA, 16 nt, Shigella flexneri 2a str. 301
ugccauuugccagacu

SEQ ID NO: 3952754 - RNA, 15 nt, Shigella flexneri 2a str. 301
ugccauuuuuuauug

SEQ ID NO: 3952755 - RNA, 14 nt, Shigella flexneri 2a str. 301
ugcccaacauacug

SEQ ID NO: 3952756 - RNA, 13 nt, Shigella flexneri 2a str. 301
ugcccaacugccu

SEQ ID NO: 3952757 - RNA, 21 nt, Shigella flexneri 2a str. 301
ugcccaccgacgcagucaugc

SEQ ID NO: 3952758 - RNA, 15 nt, Shigella flexneri 2a str. 301
ugcccagcaaaaagc

SEQ ID NO: 3952759 - RNA, 17 nt, Shigella flexneri 2a str. 301
ugcccagcgcgccgcca

SEQ ID NO: 3952760 - RNA, 15 nt, Shigella flexneri 2a str. 301
ugcccagugaccaaa

SEQ ID NO: 3952761 - RNA, 22 nt, Shigella flexneri 2a str. 301
ugcccaugauaguguccauuaa

SEQ ID NO: 3952762 - RNA, 14 nt, Shigella flexneri 2a str. 301
ugccguacagacag

SEQ ID NO: 3952763 - RNA, 14 nt, Shigella flexneri 2a str. 301
ugccguagcgauag

SEQ ID NO: 3952764 - RNA, 18 nt, Shigella flexneri 2a str. 301
ugccguaggcccagccgu

SEQ ID NO: 3952765 - RNA, 18 nt, Shigella flexneri 2a str. 301
ugccguauacacacuuuc

SEQ ID NO: 3952766 - RNA, 21 nt, Shigella flexneri 2a str. 301
ugccgucaauuuuaagcagau

SEQ ID NO: 3952767 - RNA, 14 nt, Shigella flexneri 2a str. 301
ugccgucaccagca

SEQ ID NO: 3952768 - RNA, 13 nt, Shigella flexneri 2a str. 301
ugccgucagcagg

SEQ ID NO: 3952769 - RNA, 19 nt, Shigella flexneri 2a str. 301
ugccgucagccacuucuuc

SEQ ID NO: 3952770 - RNA, 15 nt, Shigella flexneri 2a str. 301
ugccgucgaccagca

SEQ ID NO: 3952771 - RNA, 15 nt, Shigella flexneri 2a str. 301
ugccgucugggcaaa

SEQ ID NO: 3952772 - RNA, 17 nt, Shigella flexneri 2a str. 301
ugccgucugggcaaaau

SEQ ID NO: 3952773 - RNA, 16 nt, Shigella flexneri 2a str. 301
ugccgugcagcacgga

SEQ ID NO: 3952774 - RNA, 19 nt, Shigella flexneri 2a str. 301
ugccguggcgauacacuga

SEQ ID NO: 3952775 - RNA, 13 nt, Shigella flexneri 2a str. 301
ugccguuaaaacu

SEQ ID NO: 3952776 - RNA, 13 nt, Shigella flexneri 2a str. 301
ugccguugccacg

SEQ ID NO: 3952777 - RNA, 22 nt, Shigella flexneri 2a str. 301
ugccguugcuugaugcacuggg

SEQ ID NO: 3952778 - RNA, 14 nt, Shigella flexneri 2a str. 301
ugccguuggcggcg

SEQ ID NO: 3952779 - RNA, 18 nt, Shigella flexneri 2a str. 301
ugccguuugcugcaugau

SEQ ID NO: 3952780 - RNA, 21 nt, Shigella flexneri 2a str. 301
ugccuaacaauucgccagggc

SEQ ID NO: 3952781 - RNA, 19 nt, Shigella flexneri 2a str. 301
ugccuaauaaaucuaaaac

SEQ ID NO: 3952782 - RNA, 22 nt, Shigella flexneri 2a str. 301
ugccuacacaaugccugaugcg

SEQ ID NO: 3952783 - RNA, 16 nt, Shigella flexneri 2a str. 301
ugccuaccaaaccugc

SEQ ID NO: 3952784 - RNA, 20 nt, Shigella flexneri 2a str. 301
ugccucaacccuuuuuuaaa

SEQ ID NO: 3952785 - RNA, 19 nt, Shigella flexneri 2a str. 301
ugccucacgaucacagcag

SEQ ID NO: 3952786 - RNA, 20 nt, Shigella flexneri 2a str. 301
ugccucacgaucacagcagu

SEQ ID NO: 3952787 - RNA, 16 nt, Shigella flexneri 2a str. 301
ugccuccccaacauau

SEQ ID NO: 3952788 - RNA, 22 nt, Shigella flexneri 2a str. 301
ugccucggggaacgcaaaauuc

SEQ ID NO: 3952789 - RNA, 14 nt, Shigella flexneri 2a str. 301
ugccucguucuucc

SEQ ID NO: 3952790 - RNA, 17 nt, Shigella flexneri 2a str. 301
ugccucguuggucagcu

SEQ ID NO: 3952791 - RNA, 23 nt, Shigella flexneri 2a str. 301
ugccucguuggucagcucaaagc

SEQ ID NO: 3952792 - RNA, 16 nt, Shigella flexneri 2a str. 301
ugccucuccccagcgg

SEQ ID NO: 3952793 - RNA, 21 nt, Shigella flexneri 2a str. 301
ugccucuccccagcggaaaau

SEQ ID NO: 3952794 - RNA, 21 nt, Shigella flexneri 2a str. 301
ugccucuccuguucucacuaa

SEQ ID NO: 3952795 - RNA, 17 nt, Shigella flexneri 2a str. 301
ugccucugcgcccagca

SEQ ID NO: 3952796 - RNA, 17 nt, Shigella flexneri 2a str. 301
ugccugacggaaaucau

SEQ ID NO: 3952797 - RNA, 16 nt, Shigella flexneri 2a str. 301
ugccugauccugggcu

SEQ ID NO: 3952798 - RNA, 15 nt, Shigella flexneri 2a str. 301
ugccugaugcggcgu

SEQ ID NO: 3952799 - RNA, 22 nt, Shigella flexneri 2a str. 301
ugccugaugcggcguaaacgcc

SEQ ID NO: 3952800 - RNA, 12 nt, Shigella flexneri 2a str. 301
ugccugauuacg

SEQ ID NO: 3952801 - RNA, 18 nt, Shigella flexneri 2a str. 301
ugccugcacuuuguguca

SEQ ID NO: 3952802 - RNA, 21 nt, Shigella flexneri 2a str. 301
ugccugcagcugcucauuaca

SEQ ID NO: 3952803 - RNA, 18 nt, Shigella flexneri 2a str. 301
ugccugccagucaaucau

SEQ ID NO: 3952804 - RNA, 17 nt, Shigella flexneri 2a str. 301
ugccugcgaagcucuuu

SEQ ID NO: 3952805 - RNA, 23 nt, Shigella flexneri 2a str. 301
ugccugcuggcuagccucccugc

SEQ ID NO: 3952806 - RNA, 19 nt, Shigella flexneri 2a str. 301
ugccugcugugccagugcc

SEQ ID NO: 3952807 - RNA, 18 nt, Shigella flexneri 2a str. 301
ugccugggcgauuuccuu

SEQ ID NO: 3952808 - RNA, 21 nt, Shigella flexneri 2a str. 301
ugccugggcgauuuccuucag

SEQ ID NO: 3952809 - RNA, 13 nt, Shigella flexneri 2a str. 301
ugccuguacggca

SEQ ID NO: 3952810 - RNA, 19 nt, Shigella flexneri 2a str. 301
ugccuguacggcagugaac

SEQ ID NO: 3952811 - RNA, 21 nt, Shigella flexneri 2a str. 301
ugccuguauuccuggccguga

SEQ ID NO: 3952812 - RNA, 21 nt, Shigella flexneri 2a str. 301
ugccuguccucuucagcauca

SEQ ID NO: 3952813 - RNA, 21 nt, Shigella flexneri 2a str. 301
ugccugugacaacacuucaua

SEQ ID NO: 3952814 - RNA, 18 nt, Shigella flexneri 2a str. 301
ugccuguucgcuacuguu

SEQ ID NO: 3952815 - RNA, 12 nt, Shigella flexneri 2a str. 301
ugccuuaaucaa

SEQ ID NO: 3952816 - RNA, 18 nt, Shigella flexneri 2a str. 301
ugccuuagccacaaagca

SEQ ID NO: 3952817 - RNA, 16 nt, Shigella flexneri 2a str. 301
ugccuuaugcccggca

SEQ ID NO: 3952818 - RNA, 18 nt, Shigella flexneri 2a str. 301
ugccuucacaggccgcca

SEQ ID NO: 3952819 - RNA, 20 nt, Shigella flexneri 2a str. 301
ugccuucacaggccgccagg

SEQ ID NO: 3952820 - RNA, 21 nt, Shigella flexneri 2a str. 301
ugccuuccaccagauggcuuu

SEQ ID NO: 3952821 - RNA, 11 nt, Shigella flexneri 2a str. 301
ugccuuccagc

SEQ ID NO: 3952822 - RNA, 14 nt, Shigella flexneri 2a str. 301
ugccuuccagcgau

SEQ ID NO: 3952823 - RNA, 14 nt, Shigella flexneri 2a str. 301
ugccuuccaucccu

SEQ ID NO: 3952824 - RNA, 20 nt, Shigella flexneri 2a str. 301
ugccuucggcgucuccaccu

SEQ ID NO: 3952825 - RNA, 18 nt, Shigella flexneri 2a str. 301
ugccuugugggccugaaa

SEQ ID NO: 3952826 - RNA, 20 nt, Shigella flexneri 2a str. 301
ugccuuuaauaccaucggca

SEQ ID NO: 3952827 - RNA, 17 nt, Shigella flexneri 2a str. 301
ugccuuuccuccugucu

SEQ ID NO: 3952828 - RNA, 22 nt, Shigella flexneri 2a str. 301
ugccuuugaaaucgaacagguu

SEQ ID NO: 3952829 - RNA, 16 nt, Shigella flexneri 2a str. 301
ugccuuuuuuguacuc

SEQ ID NO: 3952830 - RNA, 11 nt, Shigella flexneri 2a str. 301
ugcgaaacgau

SEQ ID NO: 3952831 - RNA, 18 nt, Shigella flexneri 2a str. 301
ugcgaaaguaccauuaau

SEQ ID NO: 3952832 - RNA, 22 nt, Shigella flexneri 2a str. 301
ugcgaacugugcacccgcuuca

SEQ ID NO: 3952833 - RNA, 22 nt, Shigella flexneri 2a str. 301
ugcgaauaagcugcgugacgaa

SEQ ID NO: 3952834 - RNA, 15 nt, Shigella flexneri 2a str. 301
ugcgaauacacccug

SEQ ID NO: 3952835 - RNA, 18 nt, Shigella flexneri 2a str. 301
ugcgaauggcaugcuccc

SEQ ID NO: 3952836 - RNA, 18 nt, Shigella flexneri 2a str. 301
ugcgacagagauauucag

SEQ ID NO: 3952837 - RNA, 22 nt, Shigella flexneri 2a str. 301
ugcgacagagauauucagcccg

SEQ ID NO: 3952838 - RNA, 16 nt, Shigella flexneri 2a str. 301
ugcgacagauucgcgg

SEQ ID NO: 3952839 - RNA, 21 nt, Shigella flexneri 2a str. 301
ugcgacagggaucucuuccag

SEQ ID NO: 3952840 - RNA, 14 nt, Shigella flexneri 2a str. 301
ugcgaccaaacugc

SEQ ID NO: 3952841 - RNA, 16 nt, Shigella flexneri 2a str. 301
ugcgaccagaccaggc

SEQ ID NO: 3952842 - RNA, 12 nt, Shigella flexneri 2a str. 301
ugcgaccgcucu

SEQ ID NO: 3952843 - RNA, 21 nt, Shigella flexneri 2a str. 301
ugcgaccggcguaacggccac

SEQ ID NO: 3952844 - RNA, 16 nt, Shigella flexneri 2a str. 301
ugcgaccguacaacca

SEQ ID NO: 3952845 - RNA, 22 nt, Shigella flexneri 2a str. 301
ugcgaccguacaaccaaaucug

SEQ ID NO: 3952846 - RNA, 14 nt, Shigella flexneri 2a str. 301
ugcgacgagaaaau

SEQ ID NO: 3952847 - RNA, 19 nt, Shigella flexneri 2a str. 301
ugcgacgcaacgcgcguga

SEQ ID NO: 3952848 - RNA, 18 nt, Shigella flexneri 2a str. 301
ugcgagaaguucugcagc

SEQ ID NO: 3952849 - RNA, 21 nt, Shigella flexneri 2a str. 301
ugcgagacggcggaaagggcc

SEQ ID NO: 3952850 - RNA, 13 nt, Shigella flexneri 2a str. 301
ugcgagcaaaauc

SEQ ID NO: 3952851 - RNA, 15 nt, Shigella flexneri 2a str. 301
ugcgagcaaagcgca

SEQ ID NO: 3952852 - RNA, 19 nt, Shigella flexneri 2a str. 301
ugcgagcaaagcgcagccg

SEQ ID NO: 3952853 - RNA, 22 nt, Shigella flexneri 2a str. 301
ugcgagguuauccgccagcgcc

SEQ ID NO: 3952854 - RNA, 19 nt, Shigella flexneri 2a str. 301
ugcgaguguuaccuucauc

SEQ ID NO: 3952855 - RNA, 19 nt, Shigella flexneri 2a str. 301
ugcgauaaagcauaccgug

SEQ ID NO: 3952856 - RNA, 22 nt, Shigella flexneri 2a str. 301
ugcgauacaggaaugcagucgc

SEQ ID NO: 3952857 - RNA, 18 nt, Shigella flexneri 2a str. 301
ugcgauagccuucagugc

SEQ ID NO: 3952858 - RNA, 15 nt, Shigella flexneri 2a str. 301
ugcgauauucuucag

SEQ ID NO: 3952859 - RNA, 14 nt, Shigella flexneri 2a str. 301
ugcgaucaggcauu

SEQ ID NO: 3952860 - RNA, 14 nt, Shigella flexneri 2a str. 301
ugcgaucagugcau

SEQ ID NO: 3952861 - RNA, 14 nt, Shigella flexneri 2a str. 301
ugcgauccugcaga

SEQ ID NO: 3952862 - RNA, 16 nt, Shigella flexneri 2a str. 301
ugcgaucgcaaaucca

SEQ ID NO: 3952863 - RNA, 21 nt, Shigella flexneri 2a str. 301
ugcgaucucgcguccgccgau

SEQ ID NO: 3952864 - RNA, 14 nt, Shigella flexneri 2a str. 301
ugcgaugccuggca

SEQ ID NO: 3952865 - RNA, 18 nt, Shigella flexneri 2a str. 301
ugcgaugcuugacguguc

SEQ ID NO: 3952866 - RNA, 22 nt, Shigella flexneri 2a str. 301
ugcgauggcaaaagacaccauc

SEQ ID NO: 3952867 - RNA, 21 nt, Shigella flexneri 2a str. 301
ugcgauggugguugcgccgua

SEQ ID NO: 3952868 - RNA, 15 nt, Shigella flexneri 2a str. 301
ugcgauguucuucac

SEQ ID NO: 3952869 - RNA, 20 nt, Shigella flexneri 2a str. 301
ugcgcaaccguaaacgauca

SEQ ID NO: 3952870 - RNA, 17 nt, Shigella flexneri 2a str. 301
ugcgcaacgcaaucccc

SEQ ID NO: 3952871 - RNA, 14 nt, Shigella flexneri 2a str. 301
ugcgcaacugaggc

SEQ ID NO: 3952872 - RNA, 20 nt, Shigella flexneri 2a str. 301
ugcgcaauacguugcaaaau

SEQ ID NO: 3952873 - RNA, 12 nt, Shigella flexneri 2a str. 301
ugcgcacaucaa

SEQ ID NO: 3952874 - RNA, 20 nt, Shigella flexneri 2a str. 301
ugcgcaccggguaaugacuc

SEQ ID NO: 3952875 - RNA, 18 nt, Shigella flexneri 2a str. 301
ugcgcagaguuuccaggc

SEQ ID NO: 3952876 - RNA, 14 nt, Shigella flexneri 2a str. 301
ugcgcagccagcgu

SEQ ID NO: 3952877 - RNA, 19 nt, Shigella flexneri 2a str. 301
ugcgcagcggugagccagg

SEQ ID NO: 3952878 - RNA, 20 nt, Shigella flexneri 2a str. 301
ugcgcagcggugagccagga

SEQ ID NO: 3952879 - RNA, 17 nt, Shigella flexneri 2a str. 301
ugcgcaguacugugaac

SEQ ID NO: 3952880 - RNA, 18 nt, Shigella flexneri 2a str. 301
ugcgcauaacugccggau

SEQ ID NO: 3952881 - RNA, 14 nt, Shigella flexneri 2a str. 301
ugcgcaucaaagcc

SEQ ID NO: 3952882 - RNA, 15 nt, Shigella flexneri 2a str. 301
ugcgcaucaaagcca

SEQ ID NO: 3952883 - RNA, 18 nt, Shigella flexneri 2a str. 301
ugcgcaucaucgauacca

SEQ ID NO: 3952884 - RNA, 14 nt, Shigella flexneri 2a str. 301
ugcgcauccagcgu

SEQ ID NO: 3952885 - RNA, 16 nt, Shigella flexneri 2a str. 301
ugcgcaucggcgucgu

SEQ ID NO: 3952886 - RNA, 17 nt, Shigella flexneri 2a str. 301
ugcgcauucuacuuugc

SEQ ID NO: 3952887 - RNA, 23 nt, Shigella flexneri 2a str. 301
ugcgccaaaugucagcugccagu

SEQ ID NO: 3952888 - RNA, 18 nt, Shigella flexneri 2a str. 301
ugcgccacaaccguccuc

SEQ ID NO: 3952889 - RNA, 17 nt, Shigella flexneri 2a str. 301
ugcgccacaggucagca

SEQ ID NO: 3952890 - RNA, 18 nt, Shigella flexneri 2a str. 301
ugcgccacaggucagcag

SEQ ID NO: 3952891 - RNA, 18 nt, Shigella flexneri 2a str. 301
ugcgccacauccggcaua

SEQ ID NO: 3952892 - RNA, 17 nt, Shigella flexneri 2a str. 301
ugcgccacuaacgcauu

SEQ ID NO: 3952893 - RNA, 17 nt, Shigella flexneri 2a str. 301
ugcgccacuucccagcc

SEQ ID NO: 3952894 - RNA, 17 nt, Shigella flexneri 2a str. 301
ugcgccagcaucgcauc

SEQ ID NO: 3952895 - RNA, 17 nt, Shigella flexneri 2a str. 301
ugcgccagcgcgcguug

SEQ ID NO: 3952896 - RNA, 17 nt, Shigella flexneri 2a str. 301
ugcgccaguagggcguc

SEQ ID NO: 3952897 - RNA, 22 nt, Shigella flexneri 2a str. 301
ugcgccauaccaugcaccaacc

SEQ ID NO: 3952898 - RNA, 15 nt, Shigella flexneri 2a str. 301
ugcgccaucaaugcc

SEQ ID NO: 3952899 - RNA, 18 nt, Shigella flexneri 2a str. 301
ugcgccaucggcagcauc

SEQ ID NO: 3952900 - RNA, 12 nt, Shigella flexneri 2a str. 301
ugcgcccagcgu

SEQ ID NO: 3952901 - RNA, 20 nt, Shigella flexneri 2a str. 301
ugcgcccccgauccagcggu

SEQ ID NO: 3952902 - RNA, 23 nt, Shigella flexneri 2a str. 301
ugcgcccgaaugcgaaaauccuc

SEQ ID NO: 3952903 - RNA, 15 nt, Shigella flexneri 2a str. 301
ugcgcccugggcuuc

SEQ ID NO: 3952904 - RNA, 17 nt, Shigella flexneri 2a str. 301
ugcgccgaaaucgcauc

SEQ ID NO: 3952905 - RNA, 19 nt, Shigella flexneri 2a str. 301
ugcgccgccucugcgcuuu

SEQ ID NO: 3952906 - RNA, 20 nt, Shigella flexneri 2a str. 301
ugcgccuacggcauucugca

SEQ ID NO: 3952907 - RNA, 22 nt, Shigella flexneri 2a str. 301
ugcgccucaagaaucacuucau

SEQ ID NO: 3952908 - RNA, 22 nt, Shigella flexneri 2a str. 301
ugcgccugauaaucugcugaac

SEQ ID NO: 3952909 - RNA, 21 nt, Shigella flexneri 2a str. 301
ugcgccugcgaccagaccagg

SEQ ID NO: 3952910 - RNA, 14 nt, Shigella flexneri 2a str. 301
ugcgccugcuaaac

SEQ ID NO: 3952911 - RNA, 19 nt, Shigella flexneri 2a str. 301
ugcgccuguucccuucuca

SEQ ID NO: 3952912 - RNA, 24 nt, Shigella flexneri 2a str. 301
ugcgcgacguugcuucucuugcug

SEQ ID NO: 3952913 - RNA, 17 nt, Shigella flexneri 2a str. 301
ugcgcgacucccugacu

SEQ ID NO: 3952914 - RNA, 17 nt, Shigella flexneri 2a str. 301
ugcgcgacuucauucag

SEQ ID NO: 3952915 - RNA, 18 nt, Shigella flexneri 2a str. 301
ugcgcgagcuggugccgg

SEQ ID NO: 3952916 - RNA, 16 nt, Shigella flexneri 2a str. 301
ugcgcgagguuaaaaa

SEQ ID NO: 3952917 - RNA, 13 nt, Shigella flexneri 2a str. 301
ugcgcgcaaucag

SEQ ID NO: 3952918 - RNA, 21 nt, Shigella flexneri 2a str. 301
ugcgcgccgccgcugaacuga

SEQ ID NO: 3952919 - RNA, 16 nt, Shigella flexneri 2a str. 301
ugcgcgccgugaacgu

SEQ ID NO: 3952920 - RNA, 19 nt, Shigella flexneri 2a str. 301
ugcgcggauccacaccuga

SEQ ID NO: 3952921 - RNA, 18 nt, Shigella flexneri 2a str. 301
ugcgcgguaaagcgcggc

SEQ ID NO: 3952922 - RNA, 14 nt, Shigella flexneri 2a str. 301
ugcgcgugcagugg

SEQ ID NO: 3952923 - RNA, 17 nt, Shigella flexneri 2a str. 301
ugcgcuaaacaggaucu

SEQ ID NO: 3952924 - RNA, 16 nt, Shigella flexneri 2a str. 301
ugcgcuaaauguuuag

SEQ ID NO: 3952925 - RNA, 14 nt, Shigella flexneri 2a str. 301
ugcgcuaccaggaa

SEQ ID NO: 3952926 - RNA, 14 nt, Shigella flexneri 2a str. 301
ugcgcuacgcucau

SEQ ID NO: 3952927 - RNA, 20 nt, Shigella flexneri 2a str. 301
ugcgcuacgcucaucaggcc

SEQ ID NO: 3952928 - RNA, 21 nt, Shigella flexneri 2a str. 301
ugcgcuacgcucaucaggccu

SEQ ID NO: 3952929 - RNA, 21 nt, Shigella flexneri 2a str. 301
ugcgcuacgcuuaucaggccu

SEQ ID NO: 3952930 - RNA, 12 nt, Shigella flexneri 2a str. 301
ugcgcuaucagg

SEQ ID NO: 3952931 - RNA, 14 nt, Shigella flexneri 2a str. 301
ugcgcuauccagcg

SEQ ID NO: 3952932 - RNA, 16 nt, Shigella flexneri 2a str. 301
ugcgcucauacuucca

SEQ ID NO: 3952933 - RNA, 22 nt, Shigella flexneri 2a str. 301
ugcgcuccgcuuaucaggccua

SEQ ID NO: 3952934 - RNA, 20 nt, Shigella flexneri 2a str. 301
ugcgcuccggcggcacagcc

SEQ ID NO: 3952935 - RNA, 17 nt, Shigella flexneri 2a str. 301
ugcgcucuucgaggccg

SEQ ID NO: 3952936 - RNA, 20 nt, Shigella flexneri 2a str. 301
ugcgcugaauacggaagcga

SEQ ID NO: 3952937 - RNA, 16 nt, Shigella flexneri 2a str. 301
ugcgcugacucuacug

SEQ ID NO: 3952938 - RNA, 22 nt, Shigella flexneri 2a str. 301
ugcgcugcuuguuccacuucau

SEQ ID NO: 3952939 - RNA, 15 nt, Shigella flexneri 2a str. 301
ugcgcugggcaacaa

SEQ ID NO: 3952940 - RNA, 21 nt, Shigella flexneri 2a str. 301
ugcgcuguaauauccaacgau

SEQ ID NO: 3952941 - RNA, 15 nt, Shigella flexneri 2a str. 301
ugcgcugugugugcu

SEQ ID NO: 3952942 - RNA, 22 nt, Shigella flexneri 2a str. 301
ugcgcuuauccggcccacauca

SEQ ID NO: 3952943 - RNA, 13 nt, Shigella flexneri 2a str. 301
ugcgcuucaccag

SEQ ID NO: 3952944 - RNA, 12 nt, Shigella flexneri 2a str. 301
ugcgcuuccagc

SEQ ID NO: 3952945 - RNA, 13 nt, Shigella flexneri 2a str. 301
ugcgcuuccagcu

SEQ ID NO: 3952946 - RNA, 21 nt, Shigella flexneri 2a str. 301
ugcgcuuccagcuccauccac

SEQ ID NO: 3952947 - RNA, 13 nt, Shigella flexneri 2a str. 301
ugcgcuuccugca

SEQ ID NO: 3952948 - RNA, 18 nt, Shigella flexneri 2a str. 301
ugcgcuuccugcagcuuc

SEQ ID NO: 3952949 - RNA, 16 nt, Shigella flexneri 2a str. 301
ugcgcuucuuccagca

SEQ ID NO: 3952950 - RNA, 13 nt, Shigella flexneri 2a str. 301
ugcggaaaaaaga

SEQ ID NO: 3952951 - RNA, 14 nt, Shigella flexneri 2a str. 301
ugcggaaaaaagaa

SEQ ID NO: 3952952 - RNA, 19 nt, Shigella flexneri 2a str. 301
ugcggaaagcuugcgucgc

SEQ ID NO: 3952953 - RNA, 14 nt, Shigella flexneri 2a str. 301
ugcggaaauuccag

SEQ ID NO: 3952954 - RNA, 17 nt, Shigella flexneri 2a str. 301
ugcggaaauuccagcgg

SEQ ID NO: 3952955 - RNA, 17 nt, Shigella flexneri 2a str. 301
ugcggaacccagcgcga

SEQ ID NO: 3952956 - RNA, 19 nt, Shigella flexneri 2a str. 301
ugcggagacucaaaccccg

SEQ ID NO: 3952957 - RNA, 18 nt, Shigella flexneri 2a str. 301
ugcggagguuucuuuuua

SEQ ID NO: 3952958 - RNA, 20 nt, Shigella flexneri 2a str. 301
ugcggauaaaucauauaucg

SEQ ID NO: 3952959 - RNA, 22 nt, Shigella flexneri 2a str. 301
ugcggaucaacuuuguucugaa

SEQ ID NO: 3952960 - RNA, 13 nt, Shigella flexneri 2a str. 301
ugcggaucugcuc

SEQ ID NO: 3952961 - RNA, 18 nt, Shigella flexneri 2a str. 301
ugcggauugucauagcga

SEQ ID NO: 3952962 - RNA, 14 nt, Shigella flexneri 2a str. 301
ugcucaucagcccg

SEQ ID NO: 3952963 - RNA, 23 nt, Shigella flexneri 2a str. 301
ugcucaucuggcguaccaaucag

SEQ ID NO: 3952964 - RNA, 19 nt, Shigella flexneri 2a str. 301
ugcucauuacaguagcuau

SEQ ID NO: 3952965 - RNA, 18 nt, Shigella flexneri 2a str. 301
ugcucauucuuccuccag

SEQ ID NO: 3952966 - RNA, 14 nt, Shigella flexneri 2a str. 301
ugcuccacuccugc

SEQ ID NO: 3952967 - RNA, 13 nt, Shigella flexneri 2a str. 301
ugcuccacugcuc

SEQ ID NO: 3952968 - RNA, 17 nt, Shigella flexneri 2a str. 301
ugcuccagcagauggca

SEQ ID NO: 3952969 - RNA, 13 nt, Shigella flexneri 2a str. 301
ugcuccagucguu

SEQ ID NO: 3952970 - RNA, 21 nt, Shigella flexneri 2a str. 301
ugcuccauccauugcauaaac

SEQ ID NO: 3952971 - RNA, 22 nt, Shigella flexneri 2a str. 301
ugcuccauuagcccgagaucuu

SEQ ID NO: 3952972 - RNA, 14 nt, Shigella flexneri 2a str. 301
ugcucccagcgcau

SEQ ID NO: 3952973 - RNA, 19 nt, Shigella flexneri 2a str. 301
ugcuccccagggaacauuu

SEQ ID NO: 3952974 - RNA, 16 nt, Shigella flexneri 2a str. 301
ugcucccgcagugaaa

SEQ ID NO: 3952975 - RNA, 23 nt, Shigella flexneri 2a str. 301
ugcuccgccgcagccgcauuuuu

SEQ ID NO: 3952976 - RNA, 22 nt, Shigella flexneri 2a str. 301
ugcuccggguagagguuauaaa

SEQ ID NO: 3952977 - RNA, 14 nt, Shigella flexneri 2a str. 301
ugcuccuccuucuc

SEQ ID NO: 3952978 - RNA, 16 nt, Shigella flexneri 2a str. 301
ugcuccuccuucucac

SEQ ID NO: 3952979 - RNA, 22 nt, Shigella flexneri 2a str. 301
ugcucgaacauccccacagaaa

SEQ ID NO: 3952980 - RNA, 16 nt, Shigella flexneri 2a str. 301
ugcucgcaucagggaa

SEQ ID NO: 3952981 - RNA, 16 nt, Shigella flexneri 2a str. 301
ugcucgcuggcaggcc

SEQ ID NO: 3952982 - RNA, 22 nt, Shigella flexneri 2a str. 301
ugcucguuauucagccugacag

SEQ ID NO: 3952983 - RNA, 14 nt, Shigella flexneri 2a str. 301
ugcucguucagcgg

SEQ ID NO: 3952984 - RNA, 22 nt, Shigella flexneri 2a str. 301
ugcucugaagguuguuaaccac

SEQ ID NO: 3952985 - RNA, 18 nt, Shigella flexneri 2a str. 301
ugcucugcagcagccugc

SEQ ID NO: 3952986 - RNA, 21 nt, Shigella flexneri 2a str. 301
ugcucuggucugccauaauau

SEQ ID NO: 3952987 - RNA, 13 nt, Shigella flexneri 2a str. 301
ugcucuggugcgg

SEQ ID NO: 3952988 - RNA, 12 nt, Shigella flexneri 2a str. 301
ugcucuucuuuc

SEQ ID NO: 3952989 - RNA, 13 nt, Shigella flexneri 2a str. 301
ugcucuucuuuca

SEQ ID NO: 3952990 - RNA, 14 nt, Shigella flexneri 2a str. 301
ugcucuucuuucau

SEQ ID NO: 3952991 - RNA, 16 nt, Shigella flexneri 2a str. 301
ugcucuuuauaauuau

SEQ ID NO: 3952992 - RNA, 11 nt, Shigella flexneri 2a str. 301
ugcucuuucag

SEQ ID NO: 3952993 - RNA, 16 nt, Shigella flexneri 2a str. 301
ugcucuuuuugcauaa

SEQ ID NO: 3952994 - RNA, 23 nt, Shigella flexneri 2a str. 301
ugcugaaacuuaacucacugugg

SEQ ID NO: 3952995 - RNA, 18 nt, Shigella flexneri 2a str. 301
ugcugaaagggcaaauaa

SEQ ID NO: 3952996 - RNA, 13 nt, Shigella flexneri 2a str. 301
ugcugaaaucaca

SEQ ID NO: 3952997 - RNA, 19 nt, Shigella flexneri 2a str. 301
ugcugaacagcuuuuuccu

SEQ ID NO: 3952998 - RNA, 13 nt, Shigella flexneri 2a str. 301
ugcugaaccguag

SEQ ID NO: 3952999 - RNA, 14 nt, Shigella flexneri 2a str. 301
ugcugaacuuaugc

SEQ ID NO: 3953000 - RNA, 14 nt, Shigella flexneri 2a str. 301
ugcugacgcaaaac

SEQ ID NO: 3953001 - RNA, 15 nt, Shigella flexneri 2a str. 301
ugcugacggcacuac

SEQ ID NO: 3953002 - RNA, 21 nt, Shigella flexneri 2a str. 301
ugcugacuuugauccagccau

SEQ ID NO: 3953003 - RNA, 11 nt, Shigella flexneri 2a str. 301
ugcugaggcug

SEQ ID NO: 3953004 - RNA, 15 nt, Shigella flexneri 2a str. 301
ugcugauaacgugca

SEQ ID NO: 3953005 - RNA, 23 nt, Shigella flexneri 2a str. 301
ugcugauacuccaugaguaacag

SEQ ID NO: 3953006 - RNA, 14 nt, Shigella flexneri 2a str. 301
ugcugaugcacgau

SEQ ID NO: 3953007 - RNA, 19 nt, Shigella flexneri 2a str. 301
ugcugcaauaaaauaucuu

SEQ ID NO: 3953008 - RNA, 16 nt, Shigella flexneri 2a str. 301
ugcugcaauugcggca

SEQ ID NO: 3953009 - RNA, 17 nt, Shigella flexneri 2a str. 301
ugcugcacauacugcau

SEQ ID NO: 3953010 - RNA, 21 nt, Shigella flexneri 2a str. 301
ugcugcaguaaccggaaauaa

SEQ ID NO: 3953011 - RNA, 20 nt, Shigella flexneri 2a str. 301
ugcugcauugagguaaacag

SEQ ID NO: 3953012 - RNA, 15 nt, Shigella flexneri 2a str. 301
ugcugccaucuucuu

SEQ ID NO: 3953013 - RNA, 16 nt, Shigella flexneri 2a str. 301
ugcugccgauggcaca

SEQ ID NO: 3953014 - RNA, 22 nt, Shigella flexneri 2a str. 301
ugcugccgauggcgcaaacuua

SEQ ID NO: 3953015 - RNA, 13 nt, Shigella flexneri 2a str. 301
ugcugccgccagu

SEQ ID NO: 3953016 - RNA, 16 nt, Shigella flexneri 2a str. 301
ugcugccgccaguucu

SEQ ID NO: 3953017 - RNA, 16 nt, Shigella flexneri 2a str. 301
ugcugccuucacggcu

SEQ ID NO: 3953018 - RNA, 12 nt, Shigella flexneri 2a str. 301
ugcugcucugaa

SEQ ID NO: 3953019 - RNA, 15 nt, Shigella flexneri 2a str. 301
ugcugcugauccagc

SEQ ID NO: 3953020 - RNA, 23 nt, Shigella flexneri 2a str. 301
ugcugcugauccagcuuccaggc

SEQ ID NO: 3953021 - RNA, 20 nt, Shigella flexneri 2a str. 301
ugcugcuggaagguaaggau

SEQ ID NO: 3953022 - RNA, 18 nt, Shigella flexneri 2a str. 301
ugcugcuuuaucagauca

SEQ ID NO: 3953023 - RNA, 13 nt, Shigella flexneri 2a str. 301
ugcuggaaaaccu

SEQ ID NO: 3953024 - RNA, 18 nt, Shigella flexneri 2a str. 301
ugcuggaaccacagcgcc

SEQ ID NO: 3953025 - RNA, 13 nt, Shigella flexneri 2a str. 301
ugcuggacgcauu

SEQ ID NO: 3953026 - RNA, 21 nt, Shigella flexneri 2a str. 301
ugcuggaucugcggguuaguc

SEQ ID NO: 3953027 - RNA, 13 nt, Shigella flexneri 2a str. 301
ugcuggauuuccc

SEQ ID NO: 3953028 - RNA, 12 nt, Shigella flexneri 2a str. 301
ugcuggcauuac

SEQ ID NO: 3953029 - RNA, 22 nt, Shigella flexneri 2a str. 301
ugcuggcgcaucuuauccggcc

SEQ ID NO: 3953030 - RNA, 22 nt, Shigella flexneri 2a str. 301
ugcuggcgcucaccauuuccgg

SEQ ID NO: 3953031 - RNA, 16 nt, Shigella flexneri 2a str. 301
ugcuggcuuacgcuga

SEQ ID NO: 3953032 - RNA, 16 nt, Shigella flexneri 2a str. 301
ugcugggauaauugcg

SEQ ID NO: 3953033 - RNA, 19 nt, Shigella flexneri 2a str. 301
ugcugguaauccgagaauc

SEQ ID NO: 3953034 - RNA, 16 nt, Shigella flexneri 2a str. 301
ugcugguagaagcugg

SEQ ID NO: 3953035 - RNA, 13 nt, Shigella flexneri 2a str. 301
ugcuggugguggu

SEQ ID NO: 3953036 - RNA, 18 nt, Shigella flexneri 2a str. 301
ugcugguuuugugcgcca

SEQ ID NO: 3953037 - RNA, 15 nt, Shigella flexneri 2a str. 301
ugcuguaaaaugagu

SEQ ID NO: 3953038 - RNA, 12 nt, Shigella flexneri 2a str. 301
ugcuguaaacaa

SEQ ID NO: 3953039 - RNA, 14 nt, Shigella flexneri 2a str. 301
ugcuguaauuucac

SEQ ID NO: 3953040 - RNA, 17 nt, Shigella flexneri 2a str. 301
ugcuguacauauccagu

SEQ ID NO: 3953041 - RNA, 15 nt, Shigella flexneri 2a str. 301
ugcugucggcgguaa

SEQ ID NO: 3953042 - RNA, 20 nt, Shigella flexneri 2a str. 301
ugcugucuuuuuacucccgc

SEQ ID NO: 3953043 - RNA, 17 nt, Shigella flexneri 2a str. 301
ugcugugccggaagggg

SEQ ID NO: 3953044 - RNA, 21 nt, Shigella flexneri 2a str. 301
ugcugugcgccacagacauaa

SEQ ID NO: 3953045 - RNA, 16 nt, Shigella flexneri 2a str. 301
ugcuguguucaauauc

SEQ ID NO: 3953046 - RNA, 15 nt, Shigella flexneri 2a str. 301
ugcuguugaugcgua

SEQ ID NO: 3953047 - RNA, 19 nt, Shigella flexneri 2a str. 301
ugcuguuuuuucaggcccu

SEQ ID NO: 3953048 - RNA, 23 nt, Shigella flexneri 2a str. 301
ugcuuaaauuucuuaccacugcc

SEQ ID NO: 3953049 - RNA, 22 nt, Shigella flexneri 2a str. 301
ugcuuaacauuggucagagcau

SEQ ID NO: 3953050 - RNA, 15 nt, Shigella flexneri 2a str. 301
ugcuuaaggcagaaa

SEQ ID NO: 3953051 - RNA, 23 nt, Shigella flexneri 2a str. 301
ugcuuaaggcagaaacaaacgca

SEQ ID NO: 3953052 - RNA, 17 nt, Shigella flexneri 2a str. 301
ugcuuacgcaacugcca

SEQ ID NO: 3953053 - RNA, 12 nt, Shigella flexneri 2a str. 301
ugcuuacguugu

SEQ ID NO: 3953054 - RNA, 18 nt, Shigella flexneri 2a str. 301
ugcuuacuuacgaaaaaa

SEQ ID NO: 3953055 - RNA, 21 nt, Shigella flexneri 2a str. 301
ugcuuaguaaaaauagugcgu

SEQ ID NO: 3953056 - RNA, 14 nt, Shigella flexneri 2a str. 301
ugcuuauccagcac

SEQ ID NO: 3953057 - RNA, 14 nt, Shigella flexneri 2a str. 301
ugcuuauccucugu

SEQ ID NO: 3953058 - RNA, 15 nt, Shigella flexneri 2a str. 301
ugcuucaagaugcca

SEQ ID NO: 3953059 - RNA, 20 nt, Shigella flexneri 2a str. 301
ugcuucaccgauauccgcca

SEQ ID NO: 3953060 - RNA, 18 nt, Shigella flexneri 2a str. 301
ugcuucacgcccagaucc

SEQ ID NO: 3953061 - RNA, 19 nt, Shigella flexneri 2a str. 301
ugcuucacgcccagaucca

SEQ ID NO: 3953062 - RNA, 20 nt, Shigella flexneri 2a str. 301
uggaugcaaucacaaauaga

SEQ ID NO: 3953063 - RNA, 22 nt, Shigella flexneri 2a str. 301
uggaugcccggauuuggcaaau

SEQ ID NO: 3953064 - RNA, 21 nt, Shigella flexneri 2a str. 301
uggaugcgccauaccaugcac

SEQ ID NO: 3953065 - RNA, 21 nt, Shigella flexneri 2a str. 301
uggaugcggcaugaacaccuu

SEQ ID NO: 3953066 - RNA, 19 nt, Shigella flexneri 2a str. 301
uggauugcugaaauacaga

SEQ ID NO: 3953067 - RNA, 21 nt, Shigella flexneri 2a str. 301
uggauuuaccguuaagcugga

SEQ ID NO: 3953068 - RNA, 17 nt, Shigella flexneri 2a str. 301
uggcaaacugaguggag

SEQ ID NO: 3953069 - RNA, 21 nt, Shigella flexneri 2a str. 301
uggcaaagcugucaccaauca

SEQ ID NO: 3953070 - RNA, 19 nt, Shigella flexneri 2a str. 301
uggcaaaugcaucagugac

SEQ ID NO: 3953071 - RNA, 14 nt, Shigella flexneri 2a str. 301
uggcaacaauggca

SEQ ID NO: 3953072 - RNA, 13 nt, Shigella flexneri 2a str. 301
uggcaacacagau

SEQ ID NO: 3953073 - RNA, 20 nt, Shigella flexneri 2a str. 301
uggcaaccuucuucuuucag

SEQ ID NO: 3953074 - RNA, 18 nt, Shigella flexneri 2a str. 301
uggcaacgacgguaaacc

SEQ ID NO: 3953075 - RNA, 16 nt, Shigella flexneri 2a str. 301
uggcaauaaagacauc

SEQ ID NO: 3953076 - RNA, 21 nt, Shigella flexneri 2a str. 301
uggcaauagcuucuuccacau

SEQ ID NO: 3953077 - RNA, 21 nt, Shigella flexneri 2a str. 301
uggcaauccagcucuuuucca

SEQ ID NO: 3953078 - RNA, 13 nt, Shigella flexneri 2a str. 301
uggcaaucgcggu

SEQ ID NO: 3953079 - RNA, 18 nt, Shigella flexneri 2a str. 301
uggcaaucuuccucgcca

SEQ ID NO: 3953080 - RNA, 21 nt, Shigella flexneri 2a str. 301
uggcaaugacuagcgccauaa

SEQ ID NO: 3953081 - RNA, 20 nt, Shigella flexneri 2a str. 301
uggcaaugagcaguuugguu

SEQ ID NO: 3953082 - RNA, 16 nt, Shigella flexneri 2a str. 301
uggcaaugcgcuguuu

SEQ ID NO: 3953083 - RNA, 12 nt, Shigella flexneri 2a str. 301
uggcaauggcuu

SEQ ID NO: 3953084 - RNA, 20 nt, Shigella flexneri 2a str. 301
uggcacaaauggcaaugacu

SEQ ID NO: 3953085 - RNA, 12 nt, Shigella flexneri 2a str. 301
uggcacaacucg

SEQ ID NO: 3953086 - RNA, 15 nt, Shigella flexneri 2a str. 301
uggcacagaagucac

SEQ ID NO: 3953087 - RNA, 19 nt, Shigella flexneri 2a str. 301
uggcacaugcauaaagcgg

SEQ ID NO: 3953088 - RNA, 14 nt, Shigella flexneri 2a str. 301
uggcacccagcgcu

SEQ ID NO: 3953089 - RNA, 13 nt, Shigella flexneri 2a str. 301
uggcaccgcagau

SEQ ID NO: 3953090 - RNA, 19 nt, Shigella flexneri 2a str. 301
uggcacguugcugcggcgu

SEQ ID NO: 3953091 - RNA, 15 nt, Shigella flexneri 2a str. 301
uggcacucaacaacc

SEQ ID NO: 3953092 - RNA, 18 nt, Shigella flexneri 2a str. 301
uggcacugggaucagcuu

SEQ ID NO: 3953093 - RNA, 19 nt, Shigella flexneri 2a str. 301
uggcagaaacagccauaac

SEQ ID NO: 3953094 - RNA, 15 nt, Shigella flexneri 2a str. 301
uggcagauaaacaac

SEQ ID NO: 3953095 - RNA, 17 nt, Shigella flexneri 2a str. 301
uggcagauacauugcca

SEQ ID NO: 3953096 - RNA, 21 nt, Shigella flexneri 2a str. 301
uggcagaugcuuuaaucaucc

SEQ ID NO: 3953097 - RNA, 21 nt, Shigella flexneri 2a str. 301
uggcagcaccgauccuggcgg

SEQ ID NO: 3953098 - RNA, 20 nt, Shigella flexneri 2a str. 301
uggcagcagucgcaacggcu

SEQ ID NO: 3953099 - RNA, 14 nt, Shigella flexneri 2a str. 301
uggcagccagccau

SEQ ID NO: 3953100 - RNA, 23 nt, Shigella flexneri 2a str. 301
uggcagccauaaucacucuuccc

SEQ ID NO: 3953101 - RNA, 15 nt, Shigella flexneri 2a str. 301
uggcaggccagcaau

SEQ ID NO: 3953102 - RNA, 13 nt, Shigella flexneri 2a str. 301
uggcaggcucaga

SEQ ID NO: 3953103 - RNA, 23 nt, Shigella flexneri 2a str. 301
uggcagguaaucggcauuggcau

SEQ ID NO: 3953104 - RNA, 15 nt, Shigella flexneri 2a str. 301
uggcaguacgcuggg

SEQ ID NO: 3953105 - RNA, 20 nt, Shigella flexneri 2a str. 301
uggcaguagcgccucuucca

SEQ ID NO: 3953106 - RNA, 14 nt, Shigella flexneri 2a str. 301
uggcaguaucggca

SEQ ID NO: 3953107 - RNA, 14 nt, Shigella flexneri 2a str. 301
uggcagucuggccu

SEQ ID NO: 3953108 - RNA, 22 nt, Shigella flexneri 2a str. 301
uggcauaaacaaagcgcacuau

SEQ ID NO: 3953109 - RNA, 14 nt, Shigella flexneri 2a str. 301
uggcauauuccgcc

SEQ ID NO: 3953110 - RNA, 21 nt, Shigella flexneri 2a str. 301
uggcaucagaggaaugauuuc

SEQ ID NO: 3953111 - RNA, 17 nt, Shigella flexneri 2a str. 301
uggcauccgugguggca

SEQ ID NO: 3953112 - RNA, 15 nt, Shigella flexneri 2a str. 301
uggcauccuguuuuc

SEQ ID NO: 3953113 - RNA, 22 nt, Shigella flexneri 2a str. 301
uggcauccuugcuaaccaacaa

SEQ ID NO: 3953114 - RNA, 17 nt, Shigella flexneri 2a str. 301
uggcaucgauaucaacc

SEQ ID NO: 3953115 - RNA, 19 nt, Shigella flexneri 2a str. 301
uggcaucgauaucaaccag

SEQ ID NO: 3953116 - RNA, 16 nt, Shigella flexneri 2a str. 301
uggcaucgggcacagc

SEQ ID NO: 3953117 - RNA, 18 nt, Shigella flexneri 2a str. 301
uggcauguccuucuucug

SEQ ID NO: 3953118 - RNA, 17 nt, Shigella flexneri 2a str. 301
uggcauucucacuccag

SEQ ID NO: 3953119 - RNA, 18 nt, Shigella flexneri 2a str. 301
uggcauucucacuccagc

SEQ ID NO: 3953120 - RNA, 20 nt, Shigella flexneri 2a str. 301
uggcauucucacuccagcca

SEQ ID NO: 3953121 - RNA, 18 nt, Shigella flexneri 2a str. 301
uggcauuggccguugcca

SEQ ID NO: 3953122 - RNA, 22 nt, Shigella flexneri 2a str. 301
uggcauuuuuaucucaaaaauu

SEQ ID NO: 3953123 - RNA, 15 nt, Shigella flexneri 2a str. 301
uggccaauuggcugg

SEQ ID NO: 3953124 - RNA, 19 nt, Shigella flexneri 2a str. 301
uggccaauuggcuggcccu

SEQ ID NO: 3953125 - RNA, 19 nt, Shigella flexneri 2a str. 301
uggccacuucuguuacucc

SEQ ID NO: 3953126 - RNA, 14 nt, Shigella flexneri 2a str. 301
uggccagagugcgu

SEQ ID NO: 3953127 - RNA, 21 nt, Shigella flexneri 2a str. 301
uggccagagugcguucaccga

SEQ ID NO: 3953128 - RNA, 17 nt, Shigella flexneri 2a str. 301
uggccaguaaucggcug

SEQ ID NO: 3953129 - RNA, 17 nt, Shigella flexneri 2a str. 301
uggccauugagagcaac

SEQ ID NO: 3953130 - RNA, 16 nt, Shigella flexneri 2a str. 301
uggccauuucugccag

SEQ ID NO: 3953131 - RNA, 14 nt, Shigella flexneri 2a str. 301
uggcccaaaaggca

SEQ ID NO: 3953132 - RNA, 16 nt, Shigella flexneri 2a str. 301
uggcccagccuuuccu

SEQ ID NO: 3953133 - RNA, 21 nt, Shigella flexneri 2a str. 301
uggcccaguugauucgcgcgu

SEQ ID NO: 3953134 - RNA, 12 nt, Shigella flexneri 2a str. 301
uggcccaucaga

SEQ ID NO: 3953135 - RNA, 11 nt, Shigella flexneri 2a str. 301
uggcccgccgc

SEQ ID NO: 3953136 - RNA, 18 nt, Shigella flexneri 2a str. 301
uggcccggaauggugcug

SEQ ID NO: 3953137 - RNA, 22 nt, Shigella flexneri 2a str. 301
uggccgauccggacaugcugca

SEQ ID NO: 3953138 - RNA, 14 nt, Shigella flexneri 2a str. 301
uggccgccacgcgu

SEQ ID NO: 3953139 - RNA, 14 nt, Shigella flexneri 2a str. 301
uggccgucgagcag

SEQ ID NO: 3953140 - RNA, 14 nt, Shigella flexneri 2a str. 301
uggccgugcagacc

SEQ ID NO: 3953141 - RNA, 15 nt, Shigella flexneri 2a str. 301
uggccguuauccuga

SEQ ID NO: 3953142 - RNA, 20 nt, Shigella flexneri 2a str. 301
uggccguuguugaacggcaa

SEQ ID NO: 3953143 - RNA, 20 nt, Shigella flexneri 2a str. 301
uggccucugccagcugcuca

SEQ ID NO: 3953144 - RNA, 21 nt, Shigella flexneri 2a str. 301
uggccugagacugaugacaaa

SEQ ID NO: 3953145 - RNA, 18 nt, Shigella flexneri 2a str. 301
uggccugcucaacugcca

SEQ ID NO: 3953146 - RNA, 14 nt, Shigella flexneri 2a str. 301
uggccuggcuggug

SEQ ID NO: 3953147 - RNA, 20 nt, Shigella flexneri 2a str. 301
uggcgaaccuugcgcggugu

SEQ ID NO: 3953148 - RNA, 12 nt, Shigella flexneri 2a str. 301
uggcgaauagaa

SEQ ID NO: 3953149 - RNA, 12 nt, Shigella flexneri 2a str. 301
uggcgagagccg

SEQ ID NO: 3953150 - RNA, 15 nt, Shigella flexneri 2a str. 301
uggcgauaaucagcg

SEQ ID NO: 3953151 - RNA, 22 nt, Shigella flexneri 2a str. 301
uggcgauaaucgaaccaaacag

SEQ ID NO: 3953152 - RNA, 12 nt, Shigella flexneri 2a str. 301
uggcgauagccc

SEQ ID NO: 3953153 - RNA, 18 nt, Shigella flexneri 2a str. 301
uggcgauguaauucagcc

SEQ ID NO: 3953154 - RNA, 19 nt, Shigella flexneri 2a str. 301
uggcgauguaauucagcca

SEQ ID NO: 3953155 - RNA, 21 nt, Shigella flexneri 2a str. 301
uggcgcaaguuacuccuggua

SEQ ID NO: 3953156 - RNA, 19 nt, Shigella flexneri 2a str. 301
uggcgcaaugccauccagc

SEQ ID NO: 3953157 - RNA, 20 nt, Shigella flexneri 2a str. 301
uggcgcaccuuuuuuuaugc

SEQ ID NO: 3953158 - RNA, 21 nt, Shigella flexneri 2a str. 301
uggcgcauaacucaccaucaa

SEQ ID NO: 3953159 - RNA, 19 nt, Shigella flexneri 2a str. 301
uggcgcaucggucagaccc

SEQ ID NO: 3953160 - RNA, 19 nt, Shigella flexneri 2a str. 301
uggcgcgaccaaugucagg

SEQ ID NO: 3953161 - RNA, 20 nt, Shigella flexneri 2a str. 301
uggcgcugauaaaucccgcc

SEQ ID NO: 3953162 - RNA, 17 nt, Shigella flexneri 2a str. 301
ugguuuugcuuuauuaa

SEQ ID NO: 3953163 - RNA, 15 nt, Shigella flexneri 2a str. 301
ugguuuuguaggcug

SEQ ID NO: 3953164 - RNA, 11 nt, Shigella flexneri 2a str. 301
uguaaaagaag

SEQ ID NO: 3953165 - RNA, 12 nt, Shigella flexneri 2a str. 301
uguaaacaacau

SEQ ID NO: 3953166 - RNA, 22 nt, Shigella flexneri 2a str. 301
uguaaagauugauuauugagcg

SEQ ID NO: 3953167 - RNA, 22 nt, Shigella flexneri 2a str. 301
uguaaauacucuugugccaguu

SEQ ID NO: 3953168 - RNA, 16 nt, Shigella flexneri 2a str. 301
uguaacccaccaugcc

SEQ ID NO: 3953169 - RNA, 17 nt, Shigella flexneri 2a str. 301
uguaaccuaauuuauua

SEQ ID NO: 3953170 - RNA, 17 nt, Shigella flexneri 2a str. 301
uguaaccuucacccuca

SEQ ID NO: 3953171 - RNA, 17 nt, Shigella flexneri 2a str. 301
uguaacgccuuuuccag

SEQ ID NO: 3953172 - RNA, 23 nt, Shigella flexneri 2a str. 301
uguaacugcgccagacccagacg

SEQ ID NO: 3953173 - RNA, 21 nt, Shigella flexneri 2a str. 301
uguaacugcguuucuggcuua

SEQ ID NO: 3953174 - RNA, 19 nt, Shigella flexneri 2a str. 301
uguaagaucgaaggcuguu

SEQ ID NO: 3953175 - RNA, 22 nt, Shigella flexneri 2a str. 301
uguaagccaagcgccgccucag

SEQ ID NO: 3953176 - RNA, 18 nt, Shigella flexneri 2a str. 301
uguaagggcuaaucugaa

SEQ ID NO: 3953177 - RNA, 16 nt, Shigella flexneri 2a str. 301
uguaagguggcgucaa

SEQ ID NO: 3953178 - RNA, 23 nt, Shigella flexneri 2a str. 301
uguaaguaaugacaaaauugcug

SEQ ID NO: 3953179 - RNA, 17 nt, Shigella flexneri 2a str. 301
uguaaguggaugcccgg

SEQ ID NO: 3953180 - RNA, 17 nt, Shigella flexneri 2a str. 301
uguaauaguguauuaau

SEQ ID NO: 3953181 - RNA, 11 nt, Shigella flexneri 2a str. 301
uguaaucaacu

SEQ ID NO: 3953182 - RNA, 15 nt, Shigella flexneri 2a str. 301
uguaaucauauuaaa

SEQ ID NO: 3953183 - RNA, 19 nt, Shigella flexneri 2a str. 301
uguaaugagaauaaucacc

SEQ ID NO: 3953184 - RNA, 13 nt, Shigella flexneri 2a str. 301
uguaaugauuuaa

SEQ ID NO: 3953185 - RNA, 18 nt, Shigella flexneri 2a str. 301
uguaauuuuuuuauugau

SEQ ID NO: 3953186 - RNA, 15 nt, Shigella flexneri 2a str. 301
uguacaaaaaaugug

SEQ ID NO: 3953187 - RNA, 15 nt, Shigella flexneri 2a str. 301
uguacaacuuucucg

SEQ ID NO: 3953188 - RNA, 22 nt, Shigella flexneri 2a str. 301
uguacagauccgccauuucucc

SEQ ID NO: 3953189 - RNA, 16 nt, Shigella flexneri 2a str. 301
uguacagcgaaacaua

SEQ ID NO: 3953190 - RNA, 16 nt, Shigella flexneri 2a str. 301
uguacaggauauauuu

SEQ ID NO: 3953191 - RNA, 20 nt, Shigella flexneri 2a str. 301
uguacaggauauauuucauc

SEQ ID NO: 3953192 - RNA, 21 nt, Shigella flexneri 2a str. 301
uguacaggauauauuucauca

SEQ ID NO: 3953193 - RNA, 17 nt, Shigella flexneri 2a str. 301
uguacauggugcacauu

SEQ ID NO: 3953194 - RNA, 13 nt, Shigella flexneri 2a str. 301
uguacauuuugac

SEQ ID NO: 3953195 - RNA, 14 nt, Shigella flexneri 2a str. 301
uguaccacaaccug

SEQ ID NO: 3953196 - RNA, 20 nt, Shigella flexneri 2a str. 301
uguaccaccagaaucgccag

SEQ ID NO: 3953197 - RNA, 20 nt, Shigella flexneri 2a str. 301
uguacccgcugcagcucuuu

SEQ ID NO: 3953198 - RNA, 16 nt, Shigella flexneri 2a str. 301
uguaccuucagcggca

SEQ ID NO: 3953199 - RNA, 13 nt, Shigella flexneri 2a str. 301
uguacggcaguga

SEQ ID NO: 3953200 - RNA, 15 nt, Shigella flexneri 2a str. 301
uguacggcagugaac

SEQ ID NO: 3953201 - RNA, 18 nt, Shigella flexneri 2a str. 301
uguacgucauccguggcg

SEQ ID NO: 3953202 - RNA, 19 nt, Shigella flexneri 2a str. 301
uguacuccagcagaccagc

SEQ ID NO: 3953203 - RNA, 15 nt, Shigella flexneri 2a str. 301
uguacuguuucacug

SEQ ID NO: 3953204 - RNA, 13 nt, Shigella flexneri 2a str. 301
uguagaaaaucuc

SEQ ID NO: 3953205 - RNA, 19 nt, Shigella flexneri 2a str. 301
uguagaaaaucucaaugua

SEQ ID NO: 3953206 - RNA, 20 nt, Shigella flexneri 2a str. 301
uguagaccggaaaagguguu

SEQ ID NO: 3953207 - RNA, 16 nt, Shigella flexneri 2a str. 301
uguagauauacugcac

SEQ ID NO: 3953208 - RNA, 23 nt, Shigella flexneri 2a str. 301
uguagaucuccauacuuccacua

SEQ ID NO: 3953209 - RNA, 17 nt, Shigella flexneri 2a str. 301
uguagcacuugcagcuc

SEQ ID NO: 3953210 - RNA, 19 nt, Shigella flexneri 2a str. 301
uguagcacuugcagcuccu

SEQ ID NO: 3953211 - RNA, 18 nt, Shigella flexneri 2a str. 301
uguagccaauaaaugcca

SEQ ID NO: 3953212 - RNA, 19 nt, Shigella flexneri 2a str. 301
uguagccaauaaaugccac

SEQ ID NO: 3953213 - RNA, 20 nt, Shigella flexneri 2a str. 301
uguagcgcaucacuuccagu

SEQ ID NO: 3953214 - RNA, 19 nt, Shigella flexneri 2a str. 301
uguaggcaggauaaggcgu

SEQ ID NO: 3953215 - RNA, 14 nt, Shigella flexneri 2a str. 301
uguaggccagauaa

SEQ ID NO: 3953216 - RNA, 20 nt, Shigella flexneri 2a str. 301
uguaggccagauaagacguu

SEQ ID NO: 3953217 - RNA, 19 nt, Shigella flexneri 2a str. 301
uguaggccggauaagcgua

SEQ ID NO: 3953218 - RNA, 19 nt, Shigella flexneri 2a str. 301
uguaggccggauaaggcau

SEQ ID NO: 3953219 - RNA, 20 nt, Shigella flexneri 2a str. 301
uguaggccggauaaggcgcu

SEQ ID NO: 3953220 - RNA, 19 nt, Shigella flexneri 2a str. 301
uguaggccggauaaggcgu

SEQ ID NO: 3953221 - RNA, 19 nt, Shigella flexneri 2a str. 301
uguaggccugauaagcgua

SEQ ID NO: 3953222 - RNA, 14 nt, Shigella flexneri 2a str. 301
uguaggguggggaa

SEQ ID NO: 3953223 - RNA, 20 nt, Shigella flexneri 2a str. 301
uguaggguggggaaaaacac

SEQ ID NO: 3953224 - RNA, 20 nt, Shigella flexneri 2a str. 301
uguaggucggauaaggcguu

SEQ ID NO: 3953225 - RNA, 17 nt, Shigella flexneri 2a str. 301
uguagguuuuggcgcaa

SEQ ID NO: 3953226 - RNA, 18 nt, Shigella flexneri 2a str. 301
uguaguccuaacagagca

SEQ ID NO: 3953227 - RNA, 14 nt, Shigella flexneri 2a str. 301
uguaguuauccgca

SEQ ID NO: 3953228 - RNA, 15 nt, Shigella flexneri 2a str. 301
uguaguucuggccuu

SEQ ID NO: 3953229 - RNA, 13 nt, Shigella flexneri 2a str. 301
uguauacgcuggc

SEQ ID NO: 3953230 - RNA, 13 nt, Shigella flexneri 2a str. 301
uguauacggcaac

SEQ ID NO: 3953231 - RNA, 19 nt, Shigella flexneri 2a str. 301
uguauacgggcuuuuuaau

SEQ ID NO: 3953232 - RNA, 18 nt, Shigella flexneri 2a str. 301
uguauauuauccaucaaa

SEQ ID NO: 3953233 - RNA, 18 nt, Shigella flexneri 2a str. 301
uguaucccagaucgcuuu

SEQ ID NO: 3953234 - RNA, 16 nt, Shigella flexneri 2a str. 301
uguaucgucacugguu

SEQ ID NO: 3953235 - RNA, 12 nt, Shigella flexneri 2a str. 301
uguaucugcugu

SEQ ID NO: 3953236 - RNA, 12 nt, Shigella flexneri 2a str. 301
uguaucuucauc

SEQ ID NO: 3953237 - RNA, 16 nt, Shigella flexneri 2a str. 301
uguaugccucuuucag

SEQ ID NO: 3953238 - RNA, 18 nt, Shigella flexneri 2a str. 301
uguauggcgauagcccag

SEQ ID NO: 3953239 - RNA, 22 nt, Shigella flexneri 2a str. 301
uguauuacagagguuuuaugau

SEQ ID NO: 3953240 - RNA, 22 nt, Shigella flexneri 2a str. 301
uguauuccuggccgugaagaag

SEQ ID NO: 3953241 - RNA, 14 nt, Shigella flexneri 2a str. 301
uguauugauuuagc

SEQ ID NO: 3953242 - RNA, 15 nt, Shigella flexneri 2a str. 301
uguauugugcggcgg

SEQ ID NO: 3953243 - RNA, 18 nt, Shigella flexneri 2a str. 301
uguauuuauuuucaggau

SEQ ID NO: 3953244 - RNA, 22 nt, Shigella flexneri 2a str. 301
uguauuucuucauacuaccugg

SEQ ID NO: 3953245 - RNA, 13 nt, Shigella flexneri 2a str. 301
ugucaaacccgau

SEQ ID NO: 3953246 - RNA, 18 nt, Shigella flexneri 2a str. 301
ugucaaacgggcuucuaa

SEQ ID NO: 3953247 - RNA, 17 nt, Shigella flexneri 2a str. 301
ugucaaccagccagcgc

SEQ ID NO: 3953248 - RNA, 20 nt, Shigella flexneri 2a str. 301
ugucaacugcgccacucgau

SEQ ID NO: 3953249 - RNA, 20 nt, Shigella flexneri 2a str. 301
ugucaagauugauacgggga

SEQ ID NO: 3953250 - RNA, 14 nt, Shigella flexneri 2a str. 301
ugucaauaaucuga

SEQ ID NO: 3953251 - RNA, 21 nt, Shigella flexneri 2a str. 301
ugucaauacuuucacaaaaau

SEQ ID NO: 3953252 - RNA, 21 nt, Shigella flexneri 2a str. 301
ugucaauucccgagcugcucg

SEQ ID NO: 3953253 - RNA, 14 nt, Shigella flexneri 2a str. 301
ugucaccagccgau

SEQ ID NO: 3953254 - RNA, 21 nt, Shigella flexneri 2a str. 301
ugucacggugcgcguugcuua

SEQ ID NO: 3953255 - RNA, 16 nt, Shigella flexneri 2a str. 301
ugucacgucucaucag

SEQ ID NO: 3953256 - RNA, 17 nt, Shigella flexneri 2a str. 301
ugucacgucucaucagg

SEQ ID NO: 3953257 - RNA, 11 nt, Shigella flexneri 2a str. 301
ugucacuuuga

SEQ ID NO: 3953258 - RNA, 14 nt, Shigella flexneri 2a str. 301
ugucagaaguugca

SEQ ID NO: 3953259 - RNA, 19 nt, Shigella flexneri 2a str. 301
ugucagcaaucugauugac

SEQ ID NO: 3953260 - RNA, 15 nt, Shigella flexneri 2a str. 301
ugucagcccuuuuuc

SEQ ID NO: 3953261 - RNA, 15 nt, Shigella flexneri 2a str. 301
ugucagcucauccag

SEQ ID NO: 3953262 - RNA, 23 nt, Shigella flexneri 2a str. 301
ugugcagcgugaguaugauacgu

SEQ ID NO: 3953263 - RNA, 22 nt, Shigella flexneri 2a str. 301
ugugcagguggaauauccguca

SEQ ID NO: 3953264 - RNA, 15 nt, Shigella flexneri 2a str. 301
ugugcaguuccugca

SEQ ID NO: 3953265 - RNA, 19 nt, Shigella flexneri 2a str. 301
ugugcauuuaagagaaacg

SEQ ID NO: 3953266 - RNA, 14 nt, Shigella flexneri 2a str. 301
ugugccacauccag

SEQ ID NO: 3953267 - RNA, 18 nt, Shigella flexneri 2a str. 301
ugugccagcucgugcaga

SEQ ID NO: 3953268 - RNA, 15 nt, Shigella flexneri 2a str. 301
ugugccauuaauguc

SEQ ID NO: 3953269 - RNA, 16 nt, Shigella flexneri 2a str. 301
ugugcccguaaaaaau

SEQ ID NO: 3953270 - RNA, 20 nt, Shigella flexneri 2a str. 301
ugugcccguaaaaaauggcu

SEQ ID NO: 3953271 - RNA, 13 nt, Shigella flexneri 2a str. 301
ugugccgccgcca

SEQ ID NO: 3953272 - RNA, 20 nt, Shigella flexneri 2a str. 301
ugugccgcgaugauugggcu

SEQ ID NO: 3953273 - RNA, 14 nt, Shigella flexneri 2a str. 301
ugugccguaaccaa

SEQ ID NO: 3953274 - RNA, 19 nt, Shigella flexneri 2a str. 301
ugugccugaauauacgcca

SEQ ID NO: 3953275 - RNA, 23 nt, Shigella flexneri 2a str. 301
ugugcgagcaaagcgcagccguc

SEQ ID NO: 3953276 - RNA, 14 nt, Shigella flexneri 2a str. 301
ugugcgcacauugc

SEQ ID NO: 3953277 - RNA, 21 nt, Shigella flexneri 2a str. 301
ugugcuaacucaucaccauca

SEQ ID NO: 3953278 - RNA, 15 nt, Shigella flexneri 2a str. 301
ugugcucuaaccaac

SEQ ID NO: 3953279 - RNA, 12 nt, Shigella flexneri 2a str. 301
ugugcuggcaaa

SEQ ID NO: 3953280 - RNA, 14 nt, Shigella flexneri 2a str. 301
ugugcugguacugg

SEQ ID NO: 3953281 - RNA, 18 nt, Shigella flexneri 2a str. 301
ugugcugguacuggugca

SEQ ID NO: 3953282 - RNA, 16 nt, Shigella flexneri 2a str. 301
ugugcugugacagauu

SEQ ID NO: 3953283 - RNA, 18 nt, Shigella flexneri 2a str. 301
ugugcuuuacaccaugcc

SEQ ID NO: 3953284 - RNA, 20 nt, Shigella flexneri 2a str. 301
ugugcuuuacaccaugccac

SEQ ID NO: 3953285 - RNA, 23 nt, Shigella flexneri 2a str. 301
ugugcuuucaguucuagaacuaa

SEQ ID NO: 3953286 - RNA, 19 nt, Shigella flexneri 2a str. 301
uguggauuaaauugcgcca

SEQ ID NO: 3953287 - RNA, 13 nt, Shigella flexneri 2a str. 301
uguggccgccagu

SEQ ID NO: 3953288 - RNA, 20 nt, Shigella flexneri 2a str. 301
uguggcugcgcgagguuaaa

SEQ ID NO: 3953289 - RNA, 12 nt, Shigella flexneri 2a str. 301
uguggcuggggu

SEQ ID NO: 3953290 - RNA, 21 nt, Shigella flexneri 2a str. 301
uguggcugggguacgaggauu

SEQ ID NO: 3953291 - RNA, 17 nt, Shigella flexneri 2a str. 301
ugugggauugcuucagu

SEQ ID NO: 3953292 - RNA, 15 nt, Shigella flexneri 2a str. 301
ugugggguauuucca

SEQ ID NO: 3953293 - RNA, 17 nt, Shigella flexneri 2a str. 301
uguggugagauugcugc

SEQ ID NO: 3953294 - RNA, 15 nt, Shigella flexneri 2a str. 301
uguguaaacccagcc

SEQ ID NO: 3953295 - RNA, 21 nt, Shigella flexneri 2a str. 301
uguguacauccuaaaggcaaa

SEQ ID NO: 3953296 - RNA, 16 nt, Shigella flexneri 2a str. 301
uguguaggccagcgau

SEQ ID NO: 3953297 - RNA, 13 nt, Shigella flexneri 2a str. 301
ugugucacuuuga

SEQ ID NO: 3953298 - RNA, 13 nt, Shigella flexneri 2a str. 301
ugugucagcgcca

SEQ ID NO: 3953299 - RNA, 23 nt, Shigella flexneri 2a str. 301
uguguugaggaucacaaaacgaa

SEQ ID NO: 3953300 - RNA, 21 nt, Shigella flexneri 2a str. 301
uguguugcauccggcauggca

SEQ ID NO: 3953301 - RNA, 20 nt, Shigella flexneri 2a str. 301
uguguuuacgcguuuuucag

SEQ ID NO: 3953302 - RNA, 11 nt, Shigella flexneri 2a str. 301
uguguuuauaa

SEQ ID NO: 3953303 - RNA, 15 nt, Shigella flexneri 2a str. 301
uguguuugaucacuu

SEQ ID NO: 3953304 - RNA, 21 nt, Shigella flexneri 2a str. 301
uguuaaaugauaccgggcugu

SEQ ID NO: 3953305 - RNA, 17 nt, Shigella flexneri 2a str. 301
uguuaacagcaacauag

SEQ ID NO: 3953306 - RNA, 12 nt, Shigella flexneri 2a str. 301
uguuaaccaacg

SEQ ID NO: 3953307 - RNA, 21 nt, Shigella flexneri 2a str. 301
uguuaaccaccaguaaauugu

SEQ ID NO: 3953308 - RNA, 15 nt, Shigella flexneri 2a str. 301
uguuaaggaaauccu

SEQ ID NO: 3953309 - RNA, 22 nt, Shigella flexneri 2a str. 301
uguuaaguuuaucccaauuauc

SEQ ID NO: 3953310 - RNA, 18 nt, Shigella flexneri 2a str. 301
uguuacaacaucaacaaa

SEQ ID NO: 3953311 - RNA, 18 nt, Shigella flexneri 2a str. 301
uguuacguuucucugcua

SEQ ID NO: 3953312 - RNA, 22 nt, Shigella flexneri 2a str. 301
uguuagaugugggcaaucucac

SEQ ID NO: 3953313 - RNA, 16 nt, Shigella flexneri 2a str. 301
uguuaucccgaugaug

SEQ ID NO: 3953314 - RNA, 15 nt, Shigella flexneri 2a str. 301
uguuaucgaguucau

SEQ ID NO: 3953315 - RNA, 19 nt, Shigella flexneri 2a str. 301
uguuaucguuugcauuauc

SEQ ID NO: 3953316 - RNA, 19 nt, Shigella flexneri 2a str. 301
uguuauuaguguguauaua

SEQ ID NO: 3953317 - RNA, 13 nt, Shigella flexneri 2a str. 301
uguuauucagaau

SEQ ID NO: 3953318 - RNA, 16 nt, Shigella flexneri 2a str. 301
uguuauuguguagcca

SEQ ID NO: 3953319 - RNA, 19 nt, Shigella flexneri 2a str. 301
uguuauuuaauuacugaga

SEQ ID NO: 3953320 - RNA, 21 nt, Shigella flexneri 2a str. 301
uguucaaaaaaaucacauagu

SEQ ID NO: 3953321 - RNA, 12 nt, Shigella flexneri 2a str. 301
uguucaacaauu

SEQ ID NO: 3953322 - RNA, 16 nt, Shigella flexneri 2a str. 301
uguucacccaacucuc

SEQ ID NO: 3953323 - RNA, 12 nt, Shigella flexneri 2a str. 301
uguucacugccg

SEQ ID NO: 3953324 - RNA, 13 nt, Shigella flexneri 2a str. 301
uguucacugccgu

SEQ ID NO: 3953325 - RNA, 17 nt, Shigella flexneri 2a str. 301
uguucagaaugcccacg

SEQ ID NO: 3953326 - RNA, 14 nt, Shigella flexneri 2a str. 301
uguucagauggcca

SEQ ID NO: 3953327 - RNA, 13 nt, Shigella flexneri 2a str. 301
uguucagcaaaug

SEQ ID NO: 3953328 - RNA, 18 nt, Shigella flexneri 2a str. 301
uguucagccugaccgcac

SEQ ID NO: 3953329 - RNA, 18 nt, Shigella flexneri 2a str. 301
uguucagcgggcagggca

SEQ ID NO: 3953330 - RNA, 15 nt, Shigella flexneri 2a str. 301
uguucagcugcgugc

SEQ ID NO: 3953331 - RNA, 12 nt, Shigella flexneri 2a str. 301
uguucaggagaa

SEQ ID NO: 3953332 - RNA, 22 nt, Shigella flexneri 2a str. 301
uguucaucugcauuccggugua

SEQ ID NO: 3953333 - RNA, 21 nt, Shigella flexneri 2a str. 301
uguuccacucuuucagcacca

SEQ ID NO: 3953334 - RNA, 21 nt, Shigella flexneri 2a str. 301
uguuccagaccauauuuucau

SEQ ID NO: 3953335 - RNA, 12 nt, Shigella flexneri 2a str. 301
uguuccagugcg

SEQ ID NO: 3953336 - RNA, 18 nt, Shigella flexneri 2a str. 301
uguucccgcgccucaggc

SEQ ID NO: 3953337 - RNA, 19 nt, Shigella flexneri 2a str. 301
uguucccugcgccagcgcg

SEQ ID NO: 3953338 - RNA, 15 nt, Shigella flexneri 2a str. 301
uguucccuucucagc

SEQ ID NO: 3953339 - RNA, 12 nt, Shigella flexneri 2a str. 301
uguuccgccagc

SEQ ID NO: 3953340 - RNA, 20 nt, Shigella flexneri 2a str. 301
uguuccgccagcgacugcgc

SEQ ID NO: 3953341 - RNA, 15 nt, Shigella flexneri 2a str. 301
uguuccggcggcagg

SEQ ID NO: 3953342 - RNA, 22 nt, Shigella flexneri 2a str. 301
uguuccggcuuucugggaugau

SEQ ID NO: 3953343 - RNA, 13 nt, Shigella flexneri 2a str. 301
uguuccgucagcc

SEQ ID NO: 3953344 - RNA, 15 nt, Shigella flexneri 2a str. 301
uguucgagcaucaca

SEQ ID NO: 3953345 - RNA, 22 nt, Shigella flexneri 2a str. 301
uguucgcaaccuaaaccaaaca

SEQ ID NO: 3953346 - RNA, 21 nt, Shigella flexneri 2a str. 301
uguucgcucuauucauugacu

SEQ ID NO: 3953347 - RNA, 13 nt, Shigella flexneri 2a str. 301
uguucggcauucu

SEQ ID NO: 3953348 - RNA, 16 nt, Shigella flexneri 2a str. 301
uguucggcauucugcu

SEQ ID NO: 3953349 - RNA, 18 nt, Shigella flexneri 2a str. 301
uguucggcauucugcugg

SEQ ID NO: 3953350 - RNA, 20 nt, Shigella flexneri 2a str. 301
uguucgucccgauucagcac

SEQ ID NO: 3953351 - RNA, 14 nt, Shigella flexneri 2a str. 301
uguucguuauuggg

SEQ ID NO: 3953352 - RNA, 16 nt, Shigella flexneri 2a str. 301
uguucuacgugcgcua

SEQ ID NO: 3953353 - RNA, 15 nt, Shigella flexneri 2a str. 301
uguucucuucauuac

SEQ ID NO: 3953354 - RNA, 21 nt, Shigella flexneri 2a str. 301
uguucugauaguuaaaauuca

SEQ ID NO: 3953355 - RNA, 19 nt, Shigella flexneri 2a str. 301
uguucugcgccaaacagau

SEQ ID NO: 3953356 - RNA, 19 nt, Shigella flexneri 2a str. 301
uguucugcgcuugguuuug

SEQ ID NO: 3953357 - RNA, 16 nt, Shigella flexneri 2a str. 301
uguucuggucacucuc

SEQ ID NO: 3953358 - RNA, 19 nt, Shigella flexneri 2a str. 301
uguucuggucacucucgac

SEQ ID NO: 3953359 - RNA, 11 nt, Shigella flexneri 2a str. 301
uguugaagaaa

SEQ ID NO: 3953360 - RNA, 15 nt, Shigella flexneri 2a str. 301
uguugaaugccgguu

SEQ ID NO: 3953361 - RNA, 15 nt, Shigella flexneri 2a str. 301
uguugaggaagcgca

SEQ ID NO: 3953362 - RNA, 19 nt, Shigella flexneri 2a str. 301
uuaaccagcacguugaacu

SEQ ID NO: 3953363 - RNA, 20 nt, Shigella flexneri 2a str. 301
uuaaccagcacguugaacug

SEQ ID NO: 3953364 - RNA, 18 nt, Shigella flexneri 2a str. 301
uuaaccagucggaaacau

SEQ ID NO: 3953365 - RNA, 12 nt, Shigella flexneri 2a str. 301
uuaacccauuuu

SEQ ID NO: 3953366 - RNA, 15 nt, Shigella flexneri 2a str. 301
uuaaccccgggcugg

SEQ ID NO: 3953367 - RNA, 19 nt, Shigella flexneri 2a str. 301
uuaaccgugggaaacagua

SEQ ID NO: 3953368 - RNA, 21 nt, Shigella flexneri 2a str. 301
uuaacgacacucucuucaaca

SEQ ID NO: 3953369 - RNA, 13 nt, Shigella flexneri 2a str. 301
uuaacgacgcaua

SEQ ID NO: 3953370 - RNA, 21 nt, Shigella flexneri 2a str. 301
uuaacgccuucccuuucagca

SEQ ID NO: 3953371 - RNA, 19 nt, Shigella flexneri 2a str. 301
uuaacgcgaucgacgcguc

SEQ ID NO: 3953372 - RNA, 23 nt, Shigella flexneri 2a str. 301
uuaacgcgccggaaauugccacu

SEQ ID NO: 3953373 - RNA, 18 nt, Shigella flexneri 2a str. 301
uuaacgcgggcuucuucu

SEQ ID NO: 3953374 - RNA, 18 nt, Shigella flexneri 2a str. 301
uuaacgcuucucccagcc

SEQ ID NO: 3953375 - RNA, 19 nt, Shigella flexneri 2a str. 301
uuaacggaggagagugcaa

SEQ ID NO: 3953376 - RNA, 14 nt, Shigella flexneri 2a str. 301
uuaacgguaagcgc

SEQ ID NO: 3953377 - RNA, 14 nt, Shigella flexneri 2a str. 301
uuaacgguaucuuu

SEQ ID NO: 3953378 - RNA, 19 nt, Shigella flexneri 2a str. 301
uuaacguaaguuagaggca

SEQ ID NO: 3953379 - RNA, 20 nt, Shigella flexneri 2a str. 301
uuaacguaaguuagaggcac

SEQ ID NO: 3953380 - RNA, 17 nt, Shigella flexneri 2a str. 301
uuaacguuacuaauaaa

SEQ ID NO: 3953381 - RNA, 13 nt, Shigella flexneri 2a str. 301
uuaacguuaucug

SEQ ID NO: 3953382 - RNA, 17 nt, Shigella flexneri 2a str. 301
uuaacucgagcagcuga

SEQ ID NO: 3953383 - RNA, 18 nt, Shigella flexneri 2a str. 301
uuaacucuuccugauaca

SEQ ID NO: 3953384 - RNA, 22 nt, Shigella flexneri 2a str. 301
uuaacugacuuucguuugaaaa

SEQ ID NO: 3953385 - RNA, 16 nt, Shigella flexneri 2a str. 301
uuaacugauauuuaaa

SEQ ID NO: 3953386 - RNA, 18 nt, Shigella flexneri 2a str. 301
uuaacugcgcgauuauca

SEQ ID NO: 3953387 - RNA, 18 nt, Shigella flexneri 2a str. 301
uuaacuuaauaaacauca

SEQ ID NO: 3953388 - RNA, 15 nt, Shigella flexneri 2a str. 301
uuaacuuuucauccu

SEQ ID NO: 3953389 - RNA, 11 nt, Shigella flexneri 2a str. 301
uuaagaaaacg

SEQ ID NO: 3953390 - RNA, 20 nt, Shigella flexneri 2a str. 301
uuaagaaaacggaagcucag

SEQ ID NO: 3953391 - RNA, 14 nt, Shigella flexneri 2a str. 301
uuaagacacacuau

SEQ ID NO: 3953392 - RNA, 23 nt, Shigella flexneri 2a str. 301
uuaagacuggcaaagcaggccag

SEQ ID NO: 3953393 - RNA, 22 nt, Shigella flexneri 2a str. 301
uuaagcacuggcggcagcaggu

SEQ ID NO: 3953394 - RNA, 20 nt, Shigella flexneri 2a str. 301
uuaagccaguucucaccaaa

SEQ ID NO: 3953395 - RNA, 15 nt, Shigella flexneri 2a str. 301
uuaagccaucaucaa

SEQ ID NO: 3953396 - RNA, 18 nt, Shigella flexneri 2a str. 301
uuaagccaucaucaauau

SEQ ID NO: 3953397 - RNA, 15 nt, Shigella flexneri 2a str. 301
uuaagcgcaaaggcc

SEQ ID NO: 3953398 - RNA, 22 nt, Shigella flexneri 2a str. 301
uuaagcgcaucgacgccaucau

SEQ ID NO: 3953399 - RNA, 13 nt, Shigella flexneri 2a str. 301
uuaagcucagaaa

SEQ ID NO: 3953400 - RNA, 19 nt, Shigella flexneri 2a str. 301
uuaagcuuuccggcaucac

SEQ ID NO: 3953401 - RNA, 15 nt, Shigella flexneri 2a str. 301
uuaaggcaagaaaau

SEQ ID NO: 3953402 - RNA, 18 nt, Shigella flexneri 2a str. 301
uuaaggcagaaacaaacg

SEQ ID NO: 3953403 - RNA, 17 nt, Shigella flexneri 2a str. 301
uuaaguaugcaauaaca

SEQ ID NO: 3953404 - RNA, 16 nt, Shigella flexneri 2a str. 301
uuaagucggucaagua

SEQ ID NO: 3953405 - RNA, 15 nt, Shigella flexneri 2a str. 301
uuaauaaaauacuuu

SEQ ID NO: 3953406 - RNA, 16 nt, Shigella flexneri 2a str. 301
uuaauaaaauuaucca

SEQ ID NO: 3953407 - RNA, 20 nt, Shigella flexneri 2a str. 301
uuaauaaaauuauccagcuu

SEQ ID NO: 3953408 - RNA, 15 nt, Shigella flexneri 2a str. 301
uuaauaaauuuuaua

SEQ ID NO: 3953409 - RNA, 17 nt, Shigella flexneri 2a str. 301
uuaauaacacauauauu

SEQ ID NO: 3953410 - RNA, 14 nt, Shigella flexneri 2a str. 301
uuaauaacgacaua

SEQ ID NO: 3953411 - RNA, 14 nt, Shigella flexneri 2a str. 301
uuaauaauaaguau

SEQ ID NO: 3953412 - RNA, 14 nt, Shigella flexneri 2a str. 301
uuaauaaucacaua

SEQ ID NO: 3953413 - RNA, 14 nt, Shigella flexneri 2a str. 301
uuaauaaucucgcc

SEQ ID NO: 3953414 - RNA, 22 nt, Shigella flexneri 2a str. 301
uuaauaccaucggcagcgccaa

SEQ ID NO: 3953415 - RNA, 18 nt, Shigella flexneri 2a str. 301
uuaauaccgagcguucaa

SEQ ID NO: 3953416 - RNA, 15 nt, Shigella flexneri 2a str. 301
uuaauaccugccugg

SEQ ID NO: 3953417 - RNA, 16 nt, Shigella flexneri 2a str. 301
uuaauauuaacuuaau

SEQ ID NO: 3953418 - RNA, 23 nt, Shigella flexneri 2a str. 301
uuaaucaagaaaccgaaguugua

SEQ ID NO: 3953419 - RNA, 13 nt, Shigella flexneri 2a str. 301
uuaaucaccagcg

SEQ ID NO: 3953420 - RNA, 16 nt, Shigella flexneri 2a str. 301
uuaaucagugcaauca

SEQ ID NO: 3953421 - RNA, 11 nt, Shigella flexneri 2a str. 301
uuaaucaucaa

SEQ ID NO: 3953422 - RNA, 16 nt, Shigella flexneri 2a str. 301
uuaaucaucaacuggc

SEQ ID NO: 3953423 - RNA, 19 nt, Shigella flexneri 2a str. 301
uuaaucaucaaugccagca

SEQ ID NO: 3953424 - RNA, 18 nt, Shigella flexneri 2a str. 301
uuaauccacagcaaugca

SEQ ID NO: 3953425 - RNA, 15 nt, Shigella flexneri 2a str. 301
uuaaucgagauaccu

SEQ ID NO: 3953426 - RNA, 15 nt, Shigella flexneri 2a str. 301
uuaaucgcggcuggc

SEQ ID NO: 3953427 - RNA, 19 nt, Shigella flexneri 2a str. 301
uuaaucguugucuuacuuu

SEQ ID NO: 3953428 - RNA, 13 nt, Shigella flexneri 2a str. 301
uuaaucugguauc

SEQ ID NO: 3953429 - RNA, 17 nt, Shigella flexneri 2a str. 301
uuaaucuuccagaucac

SEQ ID NO: 3953430 - RNA, 19 nt, Shigella flexneri 2a str. 301
uuaaugaacucgauaacac

SEQ ID NO: 3953431 - RNA, 18 nt, Shigella flexneri 2a str. 301
uuaaugcaccaacaaaua

SEQ ID NO: 3953432 - RNA, 23 nt, Shigella flexneri 2a str. 301
uuaaugcauggcagauaaacaac

SEQ ID NO: 3953433 - RNA, 22 nt, Shigella flexneri 2a str. 301
uuaaugccacauuagauaaaaa

SEQ ID NO: 3953434 - RNA, 15 nt, Shigella flexneri 2a str. 301
uuaaugcgcccagcg

SEQ ID NO: 3953435 - RNA, 17 nt, Shigella flexneri 2a str. 301
uuaaugcgcuuccugca

SEQ ID NO: 3953436 - RNA, 16 nt, Shigella flexneri 2a str. 301
uuaauggcaaaaacuu

SEQ ID NO: 3953437 - RNA, 22 nt, Shigella flexneri 2a str. 301
uuaauguuguaagcuugacaua

SEQ ID NO: 3953438 - RNA, 14 nt, Shigella flexneri 2a str. 301
uuaauuaacgcguu

SEQ ID NO: 3953439 - RNA, 14 nt, Shigella flexneri 2a str. 301
uuaauuauccccuc

SEQ ID NO: 3953440 - RNA, 12 nt, Shigella flexneri 2a str. 301
uuaauucuaaaa

SEQ ID NO: 3953441 - RNA, 19 nt, Shigella flexneri 2a str. 301
uuaauugaaccuaagcuuu

SEQ ID NO: 3953442 - RNA, 21 nt, Shigella flexneri 2a str. 301
uuaauugcccgaagccaauuu

SEQ ID NO: 3953443 - RNA, 19 nt, Shigella flexneri 2a str. 301
uuaauugccguuaaaacua

SEQ ID NO: 3953444 - RNA, 16 nt, Shigella flexneri 2a str. 301
uuaauuuucgcccguu

SEQ ID NO: 3953445 - RNA, 19 nt, Shigella flexneri 2a str. 301
uuacaaaaagugcuuucug

SEQ ID NO: 3953446 - RNA, 16 nt, Shigella flexneri 2a str. 301
uuacaacacauuauua

SEQ ID NO: 3953447 - RNA, 22 nt, Shigella flexneri 2a str. 301
uuacacagcgacguaaaaaaca

SEQ ID NO: 3953448 - RNA, 12 nt, Shigella flexneri 2a str. 301
uuacagaaucug

SEQ ID NO: 3953449 - RNA, 21 nt, Shigella flexneri 2a str. 301
uuacagcaacgggcugaagaa

SEQ ID NO: 3953450 - RNA, 13 nt, Shigella flexneri 2a str. 301
uuacagcaccuua

SEQ ID NO: 3953451 - RNA, 21 nt, Shigella flexneri 2a str. 301
uuacagccagccgcuaacuuc

SEQ ID NO: 3953452 - RNA, 13 nt, Shigella flexneri 2a str. 301
uuacagccugcca

SEQ ID NO: 3953453 - RNA, 14 nt, Shigella flexneri 2a str. 301
uuacagcucucacu

SEQ ID NO: 3953454 - RNA, 20 nt, Shigella flexneri 2a str. 301
uuacagcuggaguacggccu

SEQ ID NO: 3953455 - RNA, 19 nt, Shigella flexneri 2a str. 301
uuacaggcaguaaccaaaa

SEQ ID NO: 3953456 - RNA, 21 nt, Shigella flexneri 2a str. 301
uuacaguaugagcaaacaaua

SEQ ID NO: 3953457 - RNA, 15 nt, Shigella flexneri 2a str. 301
uuacagucugcuccc

SEQ ID NO: 3953458 - RNA, 12 nt, Shigella flexneri 2a str. 301
uuacaucaucag

SEQ ID NO: 3953459 - RNA, 20 nt, Shigella flexneri 2a str. 301
uuacaucccuauagauuauu

SEQ ID NO: 3953460 - RNA, 16 nt, Shigella flexneri 2a str. 301
uuacaucuacaaaaaa

SEQ ID NO: 3953461 - RNA, 20 nt, Shigella flexneri 2a str. 301
uuacaugcgcgacaaaaauu

SEQ ID NO: 3953462 - RNA, 18 nt, Shigella flexneri 2a str. 301
uuagcgcaugaccaguga

SEQ ID NO: 3953463 - RNA, 15 nt, Shigella flexneri 2a str. 301
uuagcgccagccaga

SEQ ID NO: 3953464 - RNA, 22 nt, Shigella flexneri 2a str. 301
uuagcgucaaggggucaaugcc

SEQ ID NO: 3953465 - RNA, 17 nt, Shigella flexneri 2a str. 301
uuaggaccgguuucaaa

SEQ ID NO: 3953466 - RNA, 17 nt, Shigella flexneri 2a str. 301
uuaggauacuuaucugg

SEQ ID NO: 3953467 - RNA, 18 nt, Shigella flexneri 2a str. 301
uuaggaugcugcaauaaa

SEQ ID NO: 3953468 - RNA, 18 nt, Shigella flexneri 2a str. 301
uuaggcacaguagcccac

SEQ ID NO: 3953469 - RNA, 20 nt, Shigella flexneri 2a str. 301
uuagggugaggggaacagac

SEQ ID NO: 3953470 - RNA, 20 nt, Shigella flexneri 2a str. 301
uuagggugaggggaacccgu

SEQ ID NO: 3953471 - RNA, 17 nt, Shigella flexneri 2a str. 301
uuagguacaaagccaac

SEQ ID NO: 3953472 - RNA, 22 nt, Shigella flexneri 2a str. 301
uuagguacaaagccaacagcag

SEQ ID NO: 3953473 - RNA, 19 nt, Shigella flexneri 2a str. 301
uuaguaaacgcguagaucu

SEQ ID NO: 3953474 - RNA, 19 nt, Shigella flexneri 2a str. 301
uuaguauuguuaaauauua

SEQ ID NO: 3953475 - RNA, 18 nt, Shigella flexneri 2a str. 301
uuagucccaaacagcaga

SEQ ID NO: 3953476 - RNA, 20 nt, Shigella flexneri 2a str. 301
uuagucgcccauuuugccac

SEQ ID NO: 3953477 - RNA, 21 nt, Shigella flexneri 2a str. 301
uuagucgcccauuuugccacc

SEQ ID NO: 3953478 - RNA, 12 nt, Shigella flexneri 2a str. 301
uuagucugcauu

SEQ ID NO: 3953479 - RNA, 21 nt, Shigella flexneri 2a str. 301
uuagugcugcuggaagguaag

SEQ ID NO: 3953480 - RNA, 14 nt, Shigella flexneri 2a str. 301
uuaguguucauaaa

SEQ ID NO: 3953481 - RNA, 13 nt, Shigella flexneri 2a str. 301
uuauaaaagaaaa

SEQ ID NO: 3953482 - RNA, 21 nt, Shigella flexneri 2a str. 301
uuauaaaccacgcaauaaaca

SEQ ID NO: 3953483 - RNA, 13 nt, Shigella flexneri 2a str. 301
uuauaaacguucc

SEQ ID NO: 3953484 - RNA, 14 nt, Shigella flexneri 2a str. 301
uuauaaauaaaaau

SEQ ID NO: 3953485 - RNA, 13 nt, Shigella flexneri 2a str. 301
uuauaaaugugua

SEQ ID NO: 3953486 - RNA, 16 nt, Shigella flexneri 2a str. 301
uuauaacggugcugca

SEQ ID NO: 3953487 - RNA, 18 nt, Shigella flexneri 2a str. 301
uuauaagccaguaagaca

SEQ ID NO: 3953488 - RNA, 16 nt, Shigella flexneri 2a str. 301
uuauaaucuuuaaaaa

SEQ ID NO: 3953489 - RNA, 18 nt, Shigella flexneri 2a str. 301
uuauaaucuuuaaaaaaa

SEQ ID NO: 3953490 - RNA, 15 nt, Shigella flexneri 2a str. 301
uuauacucagucagg

SEQ ID NO: 3953491 - RNA, 17 nt, Shigella flexneri 2a str. 301
uuauacuuuguuauuca

SEQ ID NO: 3953492 - RNA, 18 nt, Shigella flexneri 2a str. 301
uuauagacuaaauuucac

SEQ ID NO: 3953493 - RNA, 14 nt, Shigella flexneri 2a str. 301
uuauagcaguaauu

SEQ ID NO: 3953494 - RNA, 23 nt, Shigella flexneri 2a str. 301
uuauagcauagcguugauuagac

SEQ ID NO: 3953495 - RNA, 13 nt, Shigella flexneri 2a str. 301
uuauauauuaauc

SEQ ID NO: 3953496 - RNA, 19 nt, Shigella flexneri 2a str. 301
uuauauauugggaucaaaa

SEQ ID NO: 3953497 - RNA, 16 nt, Shigella flexneri 2a str. 301
uuauaucagugauaua

SEQ ID NO: 3953498 - RNA, 19 nt, Shigella flexneri 2a str. 301
uuauaucagugauauauuu

SEQ ID NO: 3953499 - RNA, 14 nt, Shigella flexneri 2a str. 301
uuauaucccauuuu

SEQ ID NO: 3953500 - RNA, 18 nt, Shigella flexneri 2a str. 301
uuauauggaaaaauauuc

SEQ ID NO: 3953501 - RNA, 21 nt, Shigella flexneri 2a str. 301
uuauauugauuaccaauauca

SEQ ID NO: 3953502 - RNA, 11 nt, Shigella flexneri 2a str. 301
uuauauuuccc

SEQ ID NO: 3953503 - RNA, 21 nt, Shigella flexneri 2a str. 301
uuaucaauuaacugugccagc

SEQ ID NO: 3953504 - RNA, 12 nt, Shigella flexneri 2a str. 301
uuaucaauuccu

SEQ ID NO: 3953505 - RNA, 12 nt, Shigella flexneri 2a str. 301
uuaucacagcag

SEQ ID NO: 3953506 - RNA, 19 nt, Shigella flexneri 2a str. 301
uuaucaccuguugcccuuu

SEQ ID NO: 3953507 - RNA, 20 nt, Shigella flexneri 2a str. 301
uuaucacgaugcuaaaaaca

SEQ ID NO: 3953508 - RNA, 23 nt, Shigella flexneri 2a str. 301
uuaucacgaugcuaaaaacauca

SEQ ID NO: 3953509 - RNA, 14 nt, Shigella flexneri 2a str. 301
uuaucacugugaug

SEQ ID NO: 3953510 - RNA, 15 nt, Shigella flexneri 2a str. 301
uuaucacuuaaccca

SEQ ID NO: 3953511 - RNA, 17 nt, Shigella flexneri 2a str. 301
uuaucagaaccgcccag

SEQ ID NO: 3953512 - RNA, 22 nt, Shigella flexneri 2a str. 301
uuaucagacaccgauugccccu

SEQ ID NO: 3953513 - RNA, 11 nt, Shigella flexneri 2a str. 301
uuaucaggccu

SEQ ID NO: 3953514 - RNA, 14 nt, Shigella flexneri 2a str. 301
uuaucaggccuaca

SEQ ID NO: 3953515 - RNA, 17 nt, Shigella flexneri 2a str. 301
uuaucaggccuacaaaa

SEQ ID NO: 3953516 - RNA, 18 nt, Shigella flexneri 2a str. 301
uuaucaggccuacaaguc

SEQ ID NO: 3953517 - RNA, 21 nt, Shigella flexneri 2a str. 301
uuaucaggccuacauuuucuc

SEQ ID NO: 3953518 - RNA, 20 nt, Shigella flexneri 2a str. 301
uuaucaggccuacgacuuuc

SEQ ID NO: 3953519 - RNA, 17 nt, Shigella flexneri 2a str. 301
uuaucagguauugaucu

SEQ ID NO: 3953520 - RNA, 11 nt, Shigella flexneri 2a str. 301
uuaucaucacc

SEQ ID NO: 3953521 - RNA, 18 nt, Shigella flexneri 2a str. 301
uuauccacgaaacggcgu

SEQ ID NO: 3953522 - RNA, 22 nt, Shigella flexneri 2a str. 301
uuauccagccuacaaaaacuca

SEQ ID NO: 3953523 - RNA, 15 nt, Shigella flexneri 2a str. 301
uuauccaguuaucaa

SEQ ID NO: 3953524 - RNA, 23 nt, Shigella flexneri 2a str. 301
uuauccaucaaagguuuuucagu

SEQ ID NO: 3953525 - RNA, 22 nt, Shigella flexneri 2a str. 301
uuaucccaucccacucaucgca

SEQ ID NO: 3953526 - RNA, 21 nt, Shigella flexneri 2a str. 301
uuaucccgauuaaucagugca

SEQ ID NO: 3953527 - RNA, 21 nt, Shigella flexneri 2a str. 301
uuaucccugcggaaaaaagaa

SEQ ID NO: 3953528 - RNA, 23 nt, Shigella flexneri 2a str. 301
uuaucccugucuaaccagucgcc

SEQ ID NO: 3953529 - RNA, 15 nt, Shigella flexneri 2a str. 301
uuauccgccagcgcc

SEQ ID NO: 3953530 - RNA, 15 nt, Shigella flexneri 2a str. 301
uuauccgccaguuug

SEQ ID NO: 3953531 - RNA, 17 nt, Shigella flexneri 2a str. 301
uuauccggcaugaaaac

SEQ ID NO: 3953532 - RNA, 17 nt, Shigella flexneri 2a str. 301
uuauccggccuacaaaa

SEQ ID NO: 3953533 - RNA, 13 nt, Shigella flexneri 2a str. 301
uuauccggcuaua

SEQ ID NO: 3953534 - RNA, 22 nt, Shigella flexneri 2a str. 301
uuauccuucgauaaaagccauc

SEQ ID NO: 3953535 - RNA, 19 nt, Shigella flexneri 2a str. 301
uuaucgacugccagaguca

SEQ ID NO: 3953536 - RNA, 19 nt, Shigella flexneri 2a str. 301
uuaucgauuuucaaaauau

SEQ ID NO: 3953537 - RNA, 20 nt, Shigella flexneri 2a str. 301
uuaucgcauuaucaaagaug

SEQ ID NO: 3953538 - RNA, 22 nt, Shigella flexneri 2a str. 301
uuaucgcccugcuccagcaacu

SEQ ID NO: 3953539 - RNA, 13 nt, Shigella flexneri 2a str. 301
uuaucgccuacca

SEQ ID NO: 3953540 - RNA, 15 nt, Shigella flexneri 2a str. 301
uuaucgcgccaucaa

SEQ ID NO: 3953541 - RNA, 18 nt, Shigella flexneri 2a str. 301
uuaucgcgucaacagggc

SEQ ID NO: 3953542 - RNA, 17 nt, Shigella flexneri 2a str. 301
uuaucguaaugcucgac

SEQ ID NO: 3953543 - RNA, 15 nt, Shigella flexneri 2a str. 301
uuaucucaacacacg

SEQ ID NO: 3953544 - RNA, 19 nt, Shigella flexneri 2a str. 301
uuaucuccauccgggauca

SEQ ID NO: 3953545 - RNA, 20 nt, Shigella flexneri 2a str. 301
uuaucucccuguaucccagu

SEQ ID NO: 3953546 - RNA, 13 nt, Shigella flexneri 2a str. 301
uuaucuccuugcu

SEQ ID NO: 3953547 - RNA, 17 nt, Shigella flexneri 2a str. 301
uuaucugaucaauauag

SEQ ID NO: 3953548 - RNA, 23 nt, Shigella flexneri 2a str. 301
uuaucugaucaauauagauauca

SEQ ID NO: 3953549 - RNA, 22 nt, Shigella flexneri 2a str. 301
uuaucuggaauuccuuucccua

SEQ ID NO: 3953550 - RNA, 17 nt, Shigella flexneri 2a str. 301
uuaucuggauccacgau

SEQ ID NO: 3953551 - RNA, 20 nt, Shigella flexneri 2a str. 301
uuaucuggauuuaacgauaa

SEQ ID NO: 3953552 - RNA, 17 nt, Shigella flexneri 2a str. 301
uuaucuggcauuugcac

SEQ ID NO: 3953553 - RNA, 21 nt, Shigella flexneri 2a str. 301
uuaucuggcauuugcacugaa

SEQ ID NO: 3953554 - RNA, 20 nt, Shigella flexneri 2a str. 301
uuaucuggccuacaaagggc

SEQ ID NO: 3953555 - RNA, 19 nt, Shigella flexneri 2a str. 301
uuaucuggccuacagauga

SEQ ID NO: 3953556 - RNA, 16 nt, Shigella flexneri 2a str. 301
uuaucuuacccuuccu

SEQ ID NO: 3953557 - RNA, 15 nt, Shigella flexneri 2a str. 301
uuaucuucccagccc

SEQ ID NO: 3953558 - RNA, 17 nt, Shigella flexneri 2a str. 301
uuaucuucgcacuuacc

SEQ ID NO: 3953559 - RNA, 13 nt, Shigella flexneri 2a str. 301
uuaugaggaugca

SEQ ID NO: 3953560 - RNA, 19 nt, Shigella flexneri 2a str. 301
uuaugaguauuuaacggau

SEQ ID NO: 3953561 - RNA, 13 nt, Shigella flexneri 2a str. 301
uuaugaucaucaa

SEQ ID NO: 3953562 - RNA, 17 nt, Shigella flexneri 2a str. 301
uucacgcaggcgagaau

SEQ ID NO: 3953563 - RNA, 18 nt, Shigella flexneri 2a str. 301
uucacgcaggcgagaauc

SEQ ID NO: 3953564 - RNA, 15 nt, Shigella flexneri 2a str. 301
uucacgcagugcugc

SEQ ID NO: 3953565 - RNA, 21 nt, Shigella flexneri 2a str. 301
uucacgcccgccccaguaaau

SEQ ID NO: 3953566 - RNA, 23 nt, Shigella flexneri 2a str. 301
uucacgccgcauccggcaaguug

SEQ ID NO: 3953567 - RNA, 23 nt, Shigella flexneri 2a str. 301
uucacgccgcauccggcaguaau

SEQ ID NO: 3953568 - RNA, 18 nt, Shigella flexneri 2a str. 301
uucacgcgcuccaggagu

SEQ ID NO: 3953569 - RNA, 19 nt, Shigella flexneri 2a str. 301
uucacgcgcuccaggaguu

SEQ ID NO: 3953570 - RNA, 18 nt, Shigella flexneri 2a str. 301
uucacgcuaaaagcgauu

SEQ ID NO: 3953571 - RNA, 13 nt, Shigella flexneri 2a str. 301
uucacggcaccag

SEQ ID NO: 3953572 - RNA, 21 nt, Shigella flexneri 2a str. 301
uucacggcgauaccaguaaua

SEQ ID NO: 3953573 - RNA, 16 nt, Shigella flexneri 2a str. 301
uucacgguauuauuca

SEQ ID NO: 3953574 - RNA, 13 nt, Shigella flexneri 2a str. 301
uucacguucaccc

SEQ ID NO: 3953575 - RNA, 15 nt, Shigella flexneri 2a str. 301
uucacguucacccau

SEQ ID NO: 3953576 - RNA, 12 nt, Shigella flexneri 2a str. 301
uucacucacgcc

SEQ ID NO: 3953577 - RNA, 13 nt, Shigella flexneri 2a str. 301
uucacucacgccg

SEQ ID NO: 3953578 - RNA, 17 nt, Shigella flexneri 2a str. 301
uucacuccacuggcugc

SEQ ID NO: 3953579 - RNA, 19 nt, Shigella flexneri 2a str. 301
uucacugccguacaggcag

SEQ ID NO: 3953580 - RNA, 12 nt, Shigella flexneri 2a str. 301
uucacugccugc

SEQ ID NO: 3953581 - RNA, 20 nt, Shigella flexneri 2a str. 301
uucacugggcgauuaauaaa

SEQ ID NO: 3953582 - RNA, 15 nt, Shigella flexneri 2a str. 301
uucacuguccgucag

SEQ ID NO: 3953583 - RNA, 17 nt, Shigella flexneri 2a str. 301
uucacuucaaccacauu

SEQ ID NO: 3953584 - RNA, 13 nt, Shigella flexneri 2a str. 301
uucacuuucugaa

SEQ ID NO: 3953585 - RNA, 20 nt, Shigella flexneri 2a str. 301
uucacuuuugccagacgaau

SEQ ID NO: 3953586 - RNA, 23 nt, Shigella flexneri 2a str. 301
uucagaaagcccgaaucaguaau

SEQ ID NO: 3953587 - RNA, 15 nt, Shigella flexneri 2a str. 301
uucagaagcugaagc

SEQ ID NO: 3953588 - RNA, 16 nt, Shigella flexneri 2a str. 301
uucagaauagacaaaa

SEQ ID NO: 3953589 - RNA, 17 nt, Shigella flexneri 2a str. 301
uucagaauauucgaaau

SEQ ID NO: 3953590 - RNA, 13 nt, Shigella flexneri 2a str. 301
uucagaccaauaa

SEQ ID NO: 3953591 - RNA, 14 nt, Shigella flexneri 2a str. 301
uucagaccaauaau

SEQ ID NO: 3953592 - RNA, 17 nt, Shigella flexneri 2a str. 301
uucagaccagacugcuc

SEQ ID NO: 3953593 - RNA, 21 nt, Shigella flexneri 2a str. 301
uucagauaaaucacgcuucac

SEQ ID NO: 3953594 - RNA, 23 nt, Shigella flexneri 2a str. 301
uucagauaauagguaaacauccg

SEQ ID NO: 3953595 - RNA, 23 nt, Shigella flexneri 2a str. 301
uucagauaaugcccgaugaccuu

SEQ ID NO: 3953596 - RNA, 20 nt, Shigella flexneri 2a str. 301
uucagaucuuuaaugaucuu

SEQ ID NO: 3953597 - RNA, 18 nt, Shigella flexneri 2a str. 301
uucagauguuccgccauu

SEQ ID NO: 3953598 - RNA, 15 nt, Shigella flexneri 2a str. 301
uucagauugcagaca

SEQ ID NO: 3953599 - RNA, 21 nt, Shigella flexneri 2a str. 301
uucagcaaaccacugauaagc

SEQ ID NO: 3953600 - RNA, 12 nt, Shigella flexneri 2a str. 301
uucagcaaaugg

SEQ ID NO: 3953601 - RNA, 21 nt, Shigella flexneri 2a str. 301
uucagcaacaaaauggcaaag

SEQ ID NO: 3953602 - RNA, 22 nt, Shigella flexneri 2a str. 301
uucagcaacgugcuucgcgcug

SEQ ID NO: 3953603 - RNA, 20 nt, Shigella flexneri 2a str. 301
uucagcaauucucucuucag

SEQ ID NO: 3953604 - RNA, 11 nt, Shigella flexneri 2a str. 301
uucagcaccag

SEQ ID NO: 3953605 - RNA, 12 nt, Shigella flexneri 2a str. 301
uucagcaccaga

SEQ ID NO: 3953606 - RNA, 13 nt, Shigella flexneri 2a str. 301
uucagcagcccau

SEQ ID NO: 3953607 - RNA, 18 nt, Shigella flexneri 2a str. 301
uucagcagcggcacacaa

SEQ ID NO: 3953608 - RNA, 20 nt, Shigella flexneri 2a str. 301
uucagcagcggcucggucag

SEQ ID NO: 3953609 - RNA, 13 nt, Shigella flexneri 2a str. 301
uucagcaguuuuu

SEQ ID NO: 3953610 - RNA, 18 nt, Shigella flexneri 2a str. 301
uucagcauccguuaacuu

SEQ ID NO: 3953611 - RNA, 15 nt, Shigella flexneri 2a str. 301
uucagccaacgcauu

SEQ ID NO: 3953612 - RNA, 14 nt, Shigella flexneri 2a str. 301
uucagccacgcguu

SEQ ID NO: 3953613 - RNA, 14 nt, Shigella flexneri 2a str. 301
uucagccccagcac

SEQ ID NO: 3953614 - RNA, 21 nt, Shigella flexneri 2a str. 301
uucagccccagcacuucgcug

SEQ ID NO: 3953615 - RNA, 23 nt, Shigella flexneri 2a str. 301
uucagccccagcacuucgcuggu

SEQ ID NO: 3953616 - RNA, 23 nt, Shigella flexneri 2a str. 301
uucagccgcaaaccuggcaacaa

SEQ ID NO: 3953617 - RNA, 16 nt, Shigella flexneri 2a str. 301
uucagccggaauaauc

SEQ ID NO: 3953618 - RNA, 17 nt, Shigella flexneri 2a str. 301
uucagccggaauaauca

SEQ ID NO: 3953619 - RNA, 15 nt, Shigella flexneri 2a str. 301
uucagccgucaucca

SEQ ID NO: 3953620 - RNA, 14 nt, Shigella flexneri 2a str. 301
uucagccucugccg

SEQ ID NO: 3953621 - RNA, 20 nt, Shigella flexneri 2a str. 301
uucagccugacagcacgccc

SEQ ID NO: 3953622 - RNA, 16 nt, Shigella flexneri 2a str. 301
uucagccugaccgcac

SEQ ID NO: 3953623 - RNA, 20 nt, Shigella flexneri 2a str. 301
uucagccugaccgcacaccc

SEQ ID NO: 3953624 - RNA, 17 nt, Shigella flexneri 2a str. 301
uucagcgauauccagcg

SEQ ID NO: 3953625 - RNA, 21 nt, Shigella flexneri 2a str. 301
uucagcgaucgcuuucgcuuu

SEQ ID NO: 3953626 - RNA, 16 nt, Shigella flexneri 2a str. 301
uucagcgaucguuuuu

SEQ ID NO: 3953627 - RNA, 11 nt, Shigella flexneri 2a str. 301
uucagcggcag

SEQ ID NO: 3953628 - RNA, 21 nt, Shigella flexneri 2a str. 301
uucagcggcgcaacccccaca

SEQ ID NO: 3953629 - RNA, 15 nt, Shigella flexneri 2a str. 301
uucagcguaucccag

SEQ ID NO: 3953630 - RNA, 14 nt, Shigella flexneri 2a str. 301
uucagcucaagaau

SEQ ID NO: 3953631 - RNA, 14 nt, Shigella flexneri 2a str. 301
uucaggaaauaaau

SEQ ID NO: 3953632 - RNA, 20 nt, Shigella flexneri 2a str. 301
uucaggagaagcaucagccc

SEQ ID NO: 3953633 - RNA, 13 nt, Shigella flexneri 2a str. 301
uucaggagcaggc

SEQ ID NO: 3953634 - RNA, 23 nt, Shigella flexneri 2a str. 301
uucaggauauagucgaacgccuu

SEQ ID NO: 3953635 - RNA, 21 nt, Shigella flexneri 2a str. 301
uucaggauauuuauauuuugc

SEQ ID NO: 3953636 - RNA, 13 nt, Shigella flexneri 2a str. 301
uucaggaugguau

SEQ ID NO: 3953637 - RNA, 17 nt, Shigella flexneri 2a str. 301
uucaggaugguauugga

SEQ ID NO: 3953638 - RNA, 17 nt, Shigella flexneri 2a str. 301
uucaggccgcgcaguuc

SEQ ID NO: 3953639 - RNA, 21 nt, Shigella flexneri 2a str. 301
uucaggcgaaccggaacauca

SEQ ID NO: 3953640 - RNA, 13 nt, Shigella flexneri 2a str. 301
uucaggcgcugaa

SEQ ID NO: 3953641 - RNA, 16 nt, Shigella flexneri 2a str. 301
uucaggcgugauucau

SEQ ID NO: 3953642 - RNA, 22 nt, Shigella flexneri 2a str. 301
uucaggcgugauucauacagcg

SEQ ID NO: 3953643 - RNA, 21 nt, Shigella flexneri 2a str. 301
uucaggcuuuuuuccagcugu

SEQ ID NO: 3953644 - RNA, 19 nt, Shigella flexneri 2a str. 301
uucagguguuaguguccuu

SEQ ID NO: 3953645 - RNA, 21 nt, Shigella flexneri 2a str. 301
uucaguacguucacgcagcuc

SEQ ID NO: 3953646 - RNA, 22 nt, Shigella flexneri 2a str. 301
uucaguauagcggggaacauca

SEQ ID NO: 3953647 - RNA, 17 nt, Shigella flexneri 2a str. 301
uucaguauugagcaaug

SEQ ID NO: 3953648 - RNA, 18 nt, Shigella flexneri 2a str. 301
uucaguauugagcaaugu

SEQ ID NO: 3953649 - RNA, 18 nt, Shigella flexneri 2a str. 301
uucagugacuucugccag

SEQ ID NO: 3953650 - RNA, 15 nt, Shigella flexneri 2a str. 301
uucagugcaaaugcc

SEQ ID NO: 3953651 - RNA, 16 nt, Shigella flexneri 2a str. 301
uucagugcaaaugcca

SEQ ID NO: 3953652 - RNA, 13 nt, Shigella flexneri 2a str. 301
uucagugccaggu

SEQ ID NO: 3953653 - RNA, 17 nt, Shigella flexneri 2a str. 301
uucagugccucguucac

SEQ ID NO: 3953654 - RNA, 18 nt, Shigella flexneri 2a str. 301
uucaguggguuaugaaac

SEQ ID NO: 3953655 - RNA, 17 nt, Shigella flexneri 2a str. 301
uucaguuaccugaaugc

SEQ ID NO: 3953656 - RNA, 15 nt, Shigella flexneri 2a str. 301
uucaguucagaaagc

SEQ ID NO: 3953657 - RNA, 10 nt, Shigella flexneri 2a str. 301
uucaguuccg

SEQ ID NO: 3953658 - RNA, 14 nt, Shigella flexneri 2a str. 301
uucaguugcucugc

SEQ ID NO: 3953659 - RNA, 14 nt, Shigella flexneri 2a str. 301
uucaguuuuacucu

SEQ ID NO: 3953660 - RNA, 16 nt, Shigella flexneri 2a str. 301
uucauaaucacgcuuu

SEQ ID NO: 3953661 - RNA, 13 nt, Shigella flexneri 2a str. 301
uucauacagcgga

SEQ ID NO: 3953662 - RNA, 13 nt, Shigella flexneri 2a str. 301
uuccaggcaucag

SEQ ID NO: 3953663 - RNA, 15 nt, Shigella flexneri 2a str. 301
uuccaggcaucagca

SEQ ID NO: 3953664 - RNA, 22 nt, Shigella flexneri 2a str. 301
uuccaggcucauaccuuccacu

SEQ ID NO: 3953665 - RNA, 22 nt, Shigella flexneri 2a str. 301
uuccaggcuggcaggccucaug

SEQ ID NO: 3953666 - RNA, 24 nt, Shigella flexneri 2a str. 301
uuccagggggaagcgcaccaauuc

SEQ ID NO: 3953667 - RNA, 22 nt, Shigella flexneri 2a str. 301
uuccagguuauuuuauuucugu

SEQ ID NO: 3953668 - RNA, 21 nt, Shigella flexneri 2a str. 301
uuccagucggcguaauccuga

SEQ ID NO: 3953669 - RNA, 18 nt, Shigella flexneri 2a str. 301
uuccagucuucuugcucc

SEQ ID NO: 3953670 - RNA, 20 nt, Shigella flexneri 2a str. 301
uuccagucuucuugcuccac

SEQ ID NO: 3953671 - RNA, 14 nt, Shigella flexneri 2a str. 301
uuccagugcgguaa

SEQ ID NO: 3953672 - RNA, 18 nt, Shigella flexneri 2a str. 301
uuccagugcgguaacgua

SEQ ID NO: 3953673 - RNA, 22 nt, Shigella flexneri 2a str. 301
uuccaguuccggcaucgacagu

SEQ ID NO: 3953674 - RNA, 23 nt, Shigella flexneri 2a str. 301
uuccauaaucgacucccgcgccg

SEQ ID NO: 3953675 - RNA, 18 nt, Shigella flexneri 2a str. 301
uuccauaccgaccaugua

SEQ ID NO: 3953676 - RNA, 16 nt, Shigella flexneri 2a str. 301
uuccauaccuaaaaaa

SEQ ID NO: 3953677 - RNA, 15 nt, Shigella flexneri 2a str. 301
uuccauaugaauucc

SEQ ID NO: 3953678 - RNA, 17 nt, Shigella flexneri 2a str. 301
uuccauauugucuucaa

SEQ ID NO: 3953679 - RNA, 17 nt, Shigella flexneri 2a str. 301
uuccaucagauucagca

SEQ ID NO: 3953680 - RNA, 23 nt, Shigella flexneri 2a str. 301
uuccauccggcaacaucaaauua

SEQ ID NO: 3953681 - RNA, 22 nt, Shigella flexneri 2a str. 301
uuccaucgaccaaccuugcgcc

SEQ ID NO: 3953682 - RNA, 16 nt, Shigella flexneri 2a str. 301
uuccauugccgcuuuc

SEQ ID NO: 3953683 - RNA, 17 nt, Shigella flexneri 2a str. 301
uuccauuuuucacuuaa

SEQ ID NO: 3953684 - RNA, 17 nt, Shigella flexneri 2a str. 301
uucccaacaacagcgcg

SEQ ID NO: 3953685 - RNA, 17 nt, Shigella flexneri 2a str. 301
uucccaauauugcaccu

SEQ ID NO: 3953686 - RNA, 23 nt, Shigella flexneri 2a str. 301
uucccaccauacugcuuaaacca

SEQ ID NO: 3953687 - RNA, 20 nt, Shigella flexneri 2a str. 301
uucccacgucagaccaaaac

SEQ ID NO: 3953688 - RNA, 19 nt, Shigella flexneri 2a str. 301
uucccagauagcaacagca

SEQ ID NO: 3953689 - RNA, 12 nt, Shigella flexneri 2a str. 301
uucccaggcacc

SEQ ID NO: 3953690 - RNA, 16 nt, Shigella flexneri 2a str. 301
uucccaucucaauauu

SEQ ID NO: 3953691 - RNA, 20 nt, Shigella flexneri 2a str. 301
uuccccggaaccugaacucg

SEQ ID NO: 3953692 - RNA, 17 nt, Shigella flexneri 2a str. 301
uuccccucuaccgcuuu

SEQ ID NO: 3953693 - RNA, 17 nt, Shigella flexneri 2a str. 301
uucccgccguugccgca

SEQ ID NO: 3953694 - RNA, 14 nt, Shigella flexneri 2a str. 301
uucccggaauaauu

SEQ ID NO: 3953695 - RNA, 14 nt, Shigella flexneri 2a str. 301
uucccgggcuucuc

SEQ ID NO: 3953696 - RNA, 19 nt, Shigella flexneri 2a str. 301
uucccggguaguacuuaac

SEQ ID NO: 3953697 - RNA, 21 nt, Shigella flexneri 2a str. 301
uucccgggucgcgacugccag

SEQ ID NO: 3953698 - RNA, 22 nt, Shigella flexneri 2a str. 301
uucccggucaguagaauaaucu

SEQ ID NO: 3953699 - RNA, 20 nt, Shigella flexneri 2a str. 301
uucccguccacugcgagaaa

SEQ ID NO: 3953700 - RNA, 18 nt, Shigella flexneri 2a str. 301
uucccucccguuucccug

SEQ ID NO: 3953701 - RNA, 13 nt, Shigella flexneri 2a str. 301
uucccugacaaau

SEQ ID NO: 3953702 - RNA, 21 nt, Shigella flexneri 2a str. 301
uucccugcagucaccugcccu

SEQ ID NO: 3953703 - RNA, 19 nt, Shigella flexneri 2a str. 301
uucccugcgccagcgcgac

SEQ ID NO: 3953704 - RNA, 22 nt, Shigella flexneri 2a str. 301
uucccugcgccagcgcgaccag

SEQ ID NO: 3953705 - RNA, 15 nt, Shigella flexneri 2a str. 301
uucccugcgguaagu

SEQ ID NO: 3953706 - RNA, 22 nt, Shigella flexneri 2a str. 301
uucccuggcguucgguauuaau

SEQ ID NO: 3953707 - RNA, 17 nt, Shigella flexneri 2a str. 301
uucccuguucagccuga

SEQ ID NO: 3953708 - RNA, 23 nt, Shigella flexneri 2a str. 301
uuccgaccaggcguucugccugg

SEQ ID NO: 3953709 - RNA, 16 nt, Shigella flexneri 2a str. 301
uuccgacggcgagugu

SEQ ID NO: 3953710 - RNA, 13 nt, Shigella flexneri 2a str. 301
uuccgaugagcga

SEQ ID NO: 3953711 - RNA, 14 nt, Shigella flexneri 2a str. 301
uuccgcaauacagc

SEQ ID NO: 3953712 - RNA, 15 nt, Shigella flexneri 2a str. 301
uuccgcaccugccag

SEQ ID NO: 3953713 - RNA, 20 nt, Shigella flexneri 2a str. 301
uuccgcaccugccagcgccg

SEQ ID NO: 3953714 - RNA, 20 nt, Shigella flexneri 2a str. 301
uuccgccagcgacugcgccg

SEQ ID NO: 3953715 - RNA, 14 nt, Shigella flexneri 2a str. 301
uuccgcgaaacagg

SEQ ID NO: 3953716 - RNA, 22 nt, Shigella flexneri 2a str. 301
uuccgcgcaaucgcccagcgcg

SEQ ID NO: 3953717 - RNA, 19 nt, Shigella flexneri 2a str. 301
uuccgcgucaaucugcccg

SEQ ID NO: 3953718 - RNA, 17 nt, Shigella flexneri 2a str. 301
uuccgcuaucaguucag

SEQ ID NO: 3953719 - RNA, 14 nt, Shigella flexneri 2a str. 301
uuccggacguucag

SEQ ID NO: 3953720 - RNA, 16 nt, Shigella flexneri 2a str. 301
uuccggcaacaaugcc

SEQ ID NO: 3953721 - RNA, 15 nt, Shigella flexneri 2a str. 301
uuccggcaagcaaau

SEQ ID NO: 3953722 - RNA, 17 nt, Shigella flexneri 2a str. 301
uuccggcaagcaaauga

SEQ ID NO: 3953723 - RNA, 17 nt, Shigella flexneri 2a str. 301
uuccggcaccacaaacu

SEQ ID NO: 3953724 - RNA, 19 nt, Shigella flexneri 2a str. 301
uuccggcaucacaucgcug

SEQ ID NO: 3953725 - RNA, 14 nt, Shigella flexneri 2a str. 301
uuccggcgacguau

SEQ ID NO: 3953726 - RNA, 18 nt, Shigella flexneri 2a str. 301
uuccgggagcaauuugua

SEQ ID NO: 3953727 - RNA, 20 nt, Shigella flexneri 2a str. 301
uuccgggguaaauuucuucc

SEQ ID NO: 3953728 - RNA, 21 nt, Shigella flexneri 2a str. 301
uuccggguuugccacaucacu

SEQ ID NO: 3953729 - RNA, 16 nt, Shigella flexneri 2a str. 301
uuccggucgcaggcag

SEQ ID NO: 3953730 - RNA, 22 nt, Shigella flexneri 2a str. 301
uuccgguuugcguugcacgcag

SEQ ID NO: 3953731 - RNA, 21 nt, Shigella flexneri 2a str. 301
uuccguagcuuaucuguucag

SEQ ID NO: 3953732 - RNA, 14 nt, Shigella flexneri 2a str. 301
uuccgucccagccu

SEQ ID NO: 3953733 - RNA, 18 nt, Shigella flexneri 2a str. 301
uuccgugacuuccagcgu

SEQ ID NO: 3953734 - RNA, 19 nt, Shigella flexneri 2a str. 301
uuccuaaccgaauucaaau

SEQ ID NO: 3953735 - RNA, 14 nt, Shigella flexneri 2a str. 301
uuccuacugcuccu

SEQ ID NO: 3953736 - RNA, 24 nt, Shigella flexneri 2a str. 301
uuccuaucgaugaaccguucgcug

SEQ ID NO: 3953737 - RNA, 19 nt, Shigella flexneri 2a str. 301
uuccuaucgaugaacgguu

SEQ ID NO: 3953738 - RNA, 18 nt, Shigella flexneri 2a str. 301
uuccuaucuucauggaga

SEQ ID NO: 3953739 - RNA, 22 nt, Shigella flexneri 2a str. 301
uuccuaugcaacaacugaaaaa

SEQ ID NO: 3953740 - RNA, 22 nt, Shigella flexneri 2a str. 301
uuccucaaccacuuuaucgaga

SEQ ID NO: 3953741 - RNA, 13 nt, Shigella flexneri 2a str. 301
uuccuccauugaa

SEQ ID NO: 3953742 - RNA, 18 nt, Shigella flexneri 2a str. 301
uuccuccugucuucccug

SEQ ID NO: 3953743 - RNA, 20 nt, Shigella flexneri 2a str. 301
uuccuccugucuucccugcu

SEQ ID NO: 3953744 - RNA, 12 nt, Shigella flexneri 2a str. 301
uuccucugcccu

SEQ ID NO: 3953745 - RNA, 12 nt, Shigella flexneri 2a str. 301
uuccugacuccu

SEQ ID NO: 3953746 - RNA, 17 nt, Shigella flexneri 2a str. 301
uuccugagcaauaaucu

SEQ ID NO: 3953747 - RNA, 22 nt, Shigella flexneri 2a str. 301
uuccugaguaauaacuuccuga

SEQ ID NO: 3953748 - RNA, 19 nt, Shigella flexneri 2a str. 301
uuccugcaacuucucuuuc

SEQ ID NO: 3953749 - RNA, 23 nt, Shigella flexneri 2a str. 301
uuccugcaaucgucgauuguuau

SEQ ID NO: 3953750 - RNA, 14 nt, Shigella flexneri 2a str. 301
uuccugcaucgccu

SEQ ID NO: 3953751 - RNA, 17 nt, Shigella flexneri 2a str. 301
uuccugccacuguuccg

SEQ ID NO: 3953752 - RNA, 15 nt, Shigella flexneri 2a str. 301
uuccugcugcaucug

SEQ ID NO: 3953753 - RNA, 20 nt, Shigella flexneri 2a str. 301
uuccugcuuuauaaucccuc

SEQ ID NO: 3953754 - RNA, 15 nt, Shigella flexneri 2a str. 301
uuccuggagcaggag

SEQ ID NO: 3953755 - RNA, 17 nt, Shigella flexneri 2a str. 301
uuccuggccgugaagaa

SEQ ID NO: 3953756 - RNA, 23 nt, Shigella flexneri 2a str. 301
uuccuggccgugaagaagaguuu

SEQ ID NO: 3953757 - RNA, 15 nt, Shigella flexneri 2a str. 301
uuccuggcuuggcug

SEQ ID NO: 3953758 - RNA, 20 nt, Shigella flexneri 2a str. 301
uuccugggauaugagcgauu

SEQ ID NO: 3953759 - RNA, 16 nt, Shigella flexneri 2a str. 301
uuccuguucaucgaca

SEQ ID NO: 3953760 - RNA, 14 nt, Shigella flexneri 2a str. 301
uuccuuaaaaguga

SEQ ID NO: 3953761 - RNA, 10 nt, Shigella flexneri 2a str. 301
uucgucgcua

SEQ ID NO: 3953762 - RNA, 22 nt, Shigella flexneri 2a str. 301
uucgucguaguaguucaucccc

SEQ ID NO: 3953763 - RNA, 19 nt, Shigella flexneri 2a str. 301
uucgucuggcgauuuugaa

SEQ ID NO: 3953764 - RNA, 13 nt, Shigella flexneri 2a str. 301
uucgugagcguuu

SEQ ID NO: 3953765 - RNA, 15 nt, Shigella flexneri 2a str. 301
uucgugccacaguuu

SEQ ID NO: 3953766 - RNA, 14 nt, Shigella flexneri 2a str. 301
uucguggacguuac

SEQ ID NO: 3953767 - RNA, 20 nt, Shigella flexneri 2a str. 301
uucguguggaaaagcaguaa

SEQ ID NO: 3953768 - RNA, 22 nt, Shigella flexneri 2a str. 301
uucguuaacaacaacuucuaau

SEQ ID NO: 3953769 - RNA, 23 nt, Shigella flexneri 2a str. 301
uucguuagguucucucagucuuu

SEQ ID NO: 3953770 - RNA, 19 nt, Shigella flexneri 2a str. 301
uucguuuggggguaaccca

SEQ ID NO: 3953771 - RNA, 14 nt, Shigella flexneri 2a str. 301
uucguuuucagcuu

SEQ ID NO: 3953772 - RNA, 22 nt, Shigella flexneri 2a str. 301
uucguuuuggcagaaacagcca

SEQ ID NO: 3953773 - RNA, 17 nt, Shigella flexneri 2a str. 301
uucuaaauguucaauaa

SEQ ID NO: 3953774 - RNA, 23 nt, Shigella flexneri 2a str. 301
uucuaacgacauuuucugcccau

SEQ ID NO: 3953775 - RNA, 14 nt, Shigella flexneri 2a str. 301
uucuacaagcagag

SEQ ID NO: 3953776 - RNA, 15 nt, Shigella flexneri 2a str. 301
uucuacacccagccc

SEQ ID NO: 3953777 - RNA, 16 nt, Shigella flexneri 2a str. 301
uucuacacccagcccc

SEQ ID NO: 3953778 - RNA, 16 nt, Shigella flexneri 2a str. 301
uucuacagaaaugaaa

SEQ ID NO: 3953779 - RNA, 22 nt, Shigella flexneri 2a str. 301
uucuaccagguuucgcaauaac

SEQ ID NO: 3953780 - RNA, 21 nt, Shigella flexneri 2a str. 301
uucuaccgucuguaaccagau

SEQ ID NO: 3953781 - RNA, 17 nt, Shigella flexneri 2a str. 301
uucuacggguaaguguu

SEQ ID NO: 3953782 - RNA, 23 nt, Shigella flexneri 2a str. 301
uucuacgugcgcuauguguuaaa

SEQ ID NO: 3953783 - RNA, 18 nt, Shigella flexneri 2a str. 301
uucuaugaagaacuggaa

SEQ ID NO: 3953784 - RNA, 13 nt, Shigella flexneri 2a str. 301
uucucaaaugacc

SEQ ID NO: 3953785 - RNA, 22 nt, Shigella flexneri 2a str. 301
uucucaacacauuacugcuugc

SEQ ID NO: 3953786 - RNA, 21 nt, Shigella flexneri 2a str. 301
uucucaaugcgucaguucaga

SEQ ID NO: 3953787 - RNA, 14 nt, Shigella flexneri 2a str. 301
uucucaccagcuga

SEQ ID NO: 3953788 - RNA, 20 nt, Shigella flexneri 2a str. 301
uucucacuccagccagagcc

SEQ ID NO: 3953789 - RNA, 13 nt, Shigella flexneri 2a str. 301
uucuccagcgccg

SEQ ID NO: 3953790 - RNA, 11 nt, Shigella flexneri 2a str. 301
uucuccccccu

SEQ ID NO: 3953791 - RNA, 15 nt, Shigella flexneri 2a str. 301
uucuccccccucuga

SEQ ID NO: 3953792 - RNA, 16 nt, Shigella flexneri 2a str. 301
uucuccucccuugucu

SEQ ID NO: 3953793 - RNA, 18 nt, Shigella flexneri 2a str. 301
uucuccucccuugucuga

SEQ ID NO: 3953794 - RNA, 18 nt, Shigella flexneri 2a str. 301
uucuccucgcuccauacu

SEQ ID NO: 3953795 - RNA, 13 nt, Shigella flexneri 2a str. 301
uucuccuggcccg

SEQ ID NO: 3953796 - RNA, 16 nt, Shigella flexneri 2a str. 301
uucuccuucacucuau

SEQ ID NO: 3953797 - RNA, 17 nt, Shigella flexneri 2a str. 301
uucucgauaaaaccuuc

SEQ ID NO: 3953798 - RNA, 18 nt, Shigella flexneri 2a str. 301
uucucgccguggcuguug

SEQ ID NO: 3953799 - RNA, 18 nt, Shigella flexneri 2a str. 301
uucucgcgaaccgccugg

SEQ ID NO: 3953800 - RNA, 18 nt, Shigella flexneri 2a str. 301
uucucgcuucugagcugg

SEQ ID NO: 3953801 - RNA, 15 nt, Shigella flexneri 2a str. 301
uucucggcaaacagc

SEQ ID NO: 3953802 - RNA, 19 nt, Shigella flexneri 2a str. 301
uucucggcaucacgcuuga

SEQ ID NO: 3953803 - RNA, 14 nt, Shigella flexneri 2a str. 301
uucucuauuucacc

SEQ ID NO: 3953804 - RNA, 20 nt, Shigella flexneri 2a str. 301
uucucucaauccgccaaaac

SEQ ID NO: 3953805 - RNA, 18 nt, Shigella flexneri 2a str. 301
uucucucugauuacccuu

SEQ ID NO: 3953806 - RNA, 15 nt, Shigella flexneri 2a str. 301
uucucuuucggcagu

SEQ ID NO: 3953807 - RNA, 20 nt, Shigella flexneri 2a str. 301
uucucuuuguuaaacagugc

SEQ ID NO: 3953808 - RNA, 12 nt, Shigella flexneri 2a str. 301
uucugaacugaa

SEQ ID NO: 3953809 - RNA, 22 nt, Shigella flexneri 2a str. 301
uucugaaggauuagccggauau

SEQ ID NO: 3953810 - RNA, 22 nt, Shigella flexneri 2a str. 301
uucugacuauauaaauuacccu

SEQ ID NO: 3953811 - RNA, 12 nt, Shigella flexneri 2a str. 301
uucugacucagg

SEQ ID NO: 3953812 - RNA, 21 nt, Shigella flexneri 2a str. 301
uucugagagcaugaaaugaaa

SEQ ID NO: 3953813 - RNA, 13 nt, Shigella flexneri 2a str. 301
uucugauccugca

SEQ ID NO: 3953814 - RNA, 20 nt, Shigella flexneri 2a str. 301
uucugauuuaaucuguauca

SEQ ID NO: 3953815 - RNA, 16 nt, Shigella flexneri 2a str. 301
uucugcaaugcugcga

SEQ ID NO: 3953816 - RNA, 13 nt, Shigella flexneri 2a str. 301
uucugcagcucca

SEQ ID NO: 3953817 - RNA, 23 nt, Shigella flexneri 2a str. 301
uucugccaaacgcucccugccag

SEQ ID NO: 3953818 - RNA, 17 nt, Shigella flexneri 2a str. 301
uucugccaggcuggcag

SEQ ID NO: 3953819 - RNA, 22 nt, Shigella flexneri 2a str. 301
uucugcccauuuaacguuaucu

SEQ ID NO: 3953820 - RNA, 17 nt, Shigella flexneri 2a str. 301
uucugccgcuuccagca

SEQ ID NO: 3953821 - RNA, 22 nt, Shigella flexneri 2a str. 301
uucugcgacgcgcggugguacg

SEQ ID NO: 3953822 - RNA, 13 nt, Shigella flexneri 2a str. 301
uucugcgacguga

SEQ ID NO: 3953823 - RNA, 17 nt, Shigella flexneri 2a str. 301
uucugcgauagcagcag

SEQ ID NO: 3953824 - RNA, 20 nt, Shigella flexneri 2a str. 301
uucugcgcuugguuuugcca

SEQ ID NO: 3953825 - RNA, 20 nt, Shigella flexneri 2a str. 301
uucugcguucugauuuaauc

SEQ ID NO: 3953826 - RNA, 19 nt, Shigella flexneri 2a str. 301
uucugcucgcgguuaaguu

SEQ ID NO: 3953827 - RNA, 14 nt, Shigella flexneri 2a str. 301
uucugcugccuaca

SEQ ID NO: 3953828 - RNA, 18 nt, Shigella flexneri 2a str. 301
uucugcuuuggcugccgc

SEQ ID NO: 3953829 - RNA, 18 nt, Shigella flexneri 2a str. 301
uucugcuuuucccuccac

SEQ ID NO: 3953830 - RNA, 19 nt, Shigella flexneri 2a str. 301
uucuggaaguaaucacgaa

SEQ ID NO: 3953831 - RNA, 14 nt, Shigella flexneri 2a str. 301
uucuggaugccauc

SEQ ID NO: 3953832 - RNA, 13 nt, Shigella flexneri 2a str. 301
uucuggcaccagu

SEQ ID NO: 3953833 - RNA, 21 nt, Shigella flexneri 2a str. 301
uucuggcaccuguaccagccc

SEQ ID NO: 3953834 - RNA, 19 nt, Shigella flexneri 2a str. 301
uucuggcgcgaacagcaca

SEQ ID NO: 3953835 - RNA, 21 nt, Shigella flexneri 2a str. 301
uucuggcugacauaaacacca

SEQ ID NO: 3953836 - RNA, 21 nt, Shigella flexneri 2a str. 301
uucuggucaugaaccugccgc

SEQ ID NO: 3953837 - RNA, 20 nt, Shigella flexneri 2a str. 301
uucuggugcgagaucgccaa

SEQ ID NO: 3953838 - RNA, 17 nt, Shigella flexneri 2a str. 301
uucugguuauauuuccc

SEQ ID NO: 3953839 - RNA, 12 nt, Shigella flexneri 2a str. 301
uucugguuuuuc

SEQ ID NO: 3953840 - RNA, 15 nt, Shigella flexneri 2a str. 301
uucuguagauaaaac

SEQ ID NO: 3953841 - RNA, 11 nt, Shigella flexneri 2a str. 301
uucugucauga

SEQ ID NO: 3953842 - RNA, 15 nt, Shigella flexneri 2a str. 301
uucugucggcaaaac

SEQ ID NO: 3953843 - RNA, 20 nt, Shigella flexneri 2a str. 301
uucugucuuaacgcaccaug

SEQ ID NO: 3953844 - RNA, 22 nt, Shigella flexneri 2a str. 301
uucugugauuccgccaguugcg

SEQ ID NO: 3953845 - RNA, 12 nt, Shigella flexneri 2a str. 301
uucugugcgcca

SEQ ID NO: 3953846 - RNA, 16 nt, Shigella flexneri 2a str. 301
uucuguggcagggcag

SEQ ID NO: 3953847 - RNA, 21 nt, Shigella flexneri 2a str. 301
uucuguguaaaugccuuucuc

SEQ ID NO: 3953848 - RNA, 22 nt, Shigella flexneri 2a str. 301
uucuguguaaaugccuuucuca

SEQ ID NO: 3953849 - RNA, 19 nt, Shigella flexneri 2a str. 301
uucuguuuucguaauaauu

SEQ ID NO: 3953850 - RNA, 24 nt, Shigella flexneri 2a str. 301
uucuuacuucaacacauaaccgua

SEQ ID NO: 3953851 - RNA, 20 nt, Shigella flexneri 2a str. 301
uucuuagucccaaacagcag

SEQ ID NO: 3953852 - RNA, 14 nt, Shigella flexneri 2a str. 301
uucuuauaaagaaa

SEQ ID NO: 3953853 - RNA, 21 nt, Shigella flexneri 2a str. 301
uucuuauaaagaaaaucugaa

SEQ ID NO: 3953854 - RNA, 16 nt, Shigella flexneri 2a str. 301
uucuuauuaaauuguc

SEQ ID NO: 3953855 - RNA, 13 nt, Shigella flexneri 2a str. 301
uucuucaaaaaua

SEQ ID NO: 3953856 - RNA, 15 nt, Shigella flexneri 2a str. 301
uucuucaacaauuga

SEQ ID NO: 3953857 - RNA, 17 nt, Shigella flexneri 2a str. 301
uucuucaagccaggcuu

SEQ ID NO: 3953858 - RNA, 21 nt, Shigella flexneri 2a str. 301
uucuucaagccaggcuuuaaa

SEQ ID NO: 3953859 - RNA, 19 nt, Shigella flexneri 2a str. 301
uucuucaaguguggccgcc

SEQ ID NO: 3953860 - RNA, 23 nt, Shigella flexneri 2a str. 301
uucuucaaguguggccgccagug

SEQ ID NO: 3953861 - RNA, 14 nt, Shigella flexneri 2a str. 301
uugaugcacaccau

SEQ ID NO: 3953862 - RNA, 15 nt, Shigella flexneri 2a str. 301
uugaugcauuuuuua

SEQ ID NO: 3953863 - RNA, 22 nt, Shigella flexneri 2a str. 301
uugaugcgaguaaucaggcuau

SEQ ID NO: 3953864 - RNA, 22 nt, Shigella flexneri 2a str. 301
uugaugcguaccucacguucca

SEQ ID NO: 3953865 - RNA, 20 nt, Shigella flexneri 2a str. 301
uugauggaaaauuguuccgu

SEQ ID NO: 3953866 - RNA, 13 nt, Shigella flexneri 2a str. 301
uugaugguaaaau

SEQ ID NO: 3953867 - RNA, 16 nt, Shigella flexneri 2a str. 301
uugauguccaguuccc

SEQ ID NO: 3953868 - RNA, 17 nt, Shigella flexneri 2a str. 301
uugauguccaguuccca

SEQ ID NO: 3953869 - RNA, 13 nt, Shigella flexneri 2a str. 301
uugauuaaaggaa

SEQ ID NO: 3953870 - RNA, 16 nt, Shigella flexneri 2a str. 301
uugauuaauugcaacg

SEQ ID NO: 3953871 - RNA, 19 nt, Shigella flexneri 2a str. 301
uugauuacacaaauccagc

SEQ ID NO: 3953872 - RNA, 23 nt, Shigella flexneri 2a str. 301
uugauuauuggacgguaaaaaga

SEQ ID NO: 3953873 - RNA, 16 nt, Shigella flexneri 2a str. 301
uugauucuguucagua

SEQ ID NO: 3953874 - RNA, 13 nt, Shigella flexneri 2a str. 301
uugauuuaucagg

SEQ ID NO: 3953875 - RNA, 16 nt, Shigella flexneri 2a str. 301
uugauuuucgaaaaaa

SEQ ID NO: 3953876 - RNA, 21 nt, Shigella flexneri 2a str. 301
uugauuuucgaaaaaaaagaa

SEQ ID NO: 3953877 - RNA, 16 nt, Shigella flexneri 2a str. 301
uugauuuucgaauagc

SEQ ID NO: 3953878 - RNA, 19 nt, Shigella flexneri 2a str. 301
uugauuuuuuugauaaacc

SEQ ID NO: 3953879 - RNA, 12 nt, Shigella flexneri 2a str. 301
uugcaaaguucc

SEQ ID NO: 3953880 - RNA, 16 nt, Shigella flexneri 2a str. 301
uugcaacauguugaau

SEQ ID NO: 3953881 - RNA, 17 nt, Shigella flexneri 2a str. 301
uugcaaccacacaggca

SEQ ID NO: 3953882 - RNA, 23 nt, Shigella flexneri 2a str. 301
uugcaagaucgcgcaucagcucc

SEQ ID NO: 3953883 - RNA, 23 nt, Shigella flexneri 2a str. 301
uugcaagaucgcucaucagcucc

SEQ ID NO: 3953884 - RNA, 19 nt, Shigella flexneri 2a str. 301
uugcaagccuguaguacaa

SEQ ID NO: 3953885 - RNA, 22 nt, Shigella flexneri 2a str. 301
uugcaauacaccuccggcuggg

SEQ ID NO: 3953886 - RNA, 18 nt, Shigella flexneri 2a str. 301
uugcaaucagauaaaaua

SEQ ID NO: 3953887 - RNA, 20 nt, Shigella flexneri 2a str. 301
uugcaaucagauaaaauaca

SEQ ID NO: 3953888 - RNA, 16 nt, Shigella flexneri 2a str. 301
uugcacagacuuaaua

SEQ ID NO: 3953889 - RNA, 23 nt, Shigella flexneri 2a str. 301
uugcacagguggcaaacgccacc

SEQ ID NO: 3953890 - RNA, 20 nt, Shigella flexneri 2a str. 301
uugcaccauccauuuuucac

SEQ ID NO: 3953891 - RNA, 17 nt, Shigella flexneri 2a str. 301
uugcaccgaggccaaaa

SEQ ID NO: 3953892 - RNA, 18 nt, Shigella flexneri 2a str. 301
uugcaccgauugccggau

SEQ ID NO: 3953893 - RNA, 15 nt, Shigella flexneri 2a str. 301
uugcaccuaaagcgc

SEQ ID NO: 3953894 - RNA, 16 nt, Shigella flexneri 2a str. 301
uugcaccucugcugcu

SEQ ID NO: 3953895 - RNA, 19 nt, Shigella flexneri 2a str. 301
uugcaccuuuuagcggaac

SEQ ID NO: 3953896 - RNA, 20 nt, Shigella flexneri 2a str. 301
uugcacgcagacacugcuga

SEQ ID NO: 3953897 - RNA, 17 nt, Shigella flexneri 2a str. 301
uugcacucgcagaagca

SEQ ID NO: 3953898 - RNA, 18 nt, Shigella flexneri 2a str. 301
uugcacugaaugccggau

SEQ ID NO: 3953899 - RNA, 22 nt, Shigella flexneri 2a str. 301
uugcagacccguuaagcguuca

SEQ ID NO: 3953900 - RNA, 19 nt, Shigella flexneri 2a str. 301
uugcagaggugcugaaagg

SEQ ID NO: 3953901 - RNA, 16 nt, Shigella flexneri 2a str. 301
uugcagauaccacauc

SEQ ID NO: 3953902 - RNA, 16 nt, Shigella flexneri 2a str. 301
uugcagaucgccaaua

SEQ ID NO: 3953903 - RNA, 17 nt, Shigella flexneri 2a str. 301
uugcagcacacauuaua

SEQ ID NO: 3953904 - RNA, 19 nt, Shigella flexneri 2a str. 301
uugcaggaaaaacugcccg

SEQ ID NO: 3953905 - RNA, 12 nt, Shigella flexneri 2a str. 301
uugcaggaucag

SEQ ID NO: 3953906 - RNA, 20 nt, Shigella flexneri 2a str. 301
uugcaggccagauaaggcgu

SEQ ID NO: 3953907 - RNA, 12 nt, Shigella flexneri 2a str. 301
uugcaggcuauu

SEQ ID NO: 3953908 - RNA, 22 nt, Shigella flexneri 2a str. 301
uugcaggggagcgaauacuccc

SEQ ID NO: 3953909 - RNA, 22 nt, Shigella flexneri 2a str. 301
uugcauaaaugccgcaaugugc

SEQ ID NO: 3953910 - RNA, 18 nt, Shigella flexneri 2a str. 301
uugcauagcggcgacuug

SEQ ID NO: 3953911 - RNA, 16 nt, Shigella flexneri 2a str. 301
uugcaucccagaaaaa

SEQ ID NO: 3953912 - RNA, 17 nt, Shigella flexneri 2a str. 301
uugcauccggcauggca

SEQ ID NO: 3953913 - RNA, 22 nt, Shigella flexneri 2a str. 301
uugcaucgucuguuuuaucucc

SEQ ID NO: 3953914 - RNA, 23 nt, Shigella flexneri 2a str. 301
uugcauuacuacgguaauacaac

SEQ ID NO: 3953915 - RNA, 21 nt, Shigella flexneri 2a str. 301
uugcauuccaguccacaucaa

SEQ ID NO: 3953916 - RNA, 16 nt, Shigella flexneri 2a str. 301
uugccacccaacgcca

SEQ ID NO: 3953917 - RNA, 21 nt, Shigella flexneri 2a str. 301
uugccaccgguacaaacauca

SEQ ID NO: 3953918 - RNA, 23 nt, Shigella flexneri 2a str. 301
uugccaccgguacaaacaucauc

SEQ ID NO: 3953919 - RNA, 22 nt, Shigella flexneri 2a str. 301
uugccacugcccgagaacagca

SEQ ID NO: 3953920 - RNA, 18 nt, Shigella flexneri 2a str. 301
uugccagaaauccaggcc

SEQ ID NO: 3953921 - RNA, 20 nt, Shigella flexneri 2a str. 301
uugccagaucgccugccgcc

SEQ ID NO: 3953922 - RNA, 17 nt, Shigella flexneri 2a str. 301
uugccagcaugacuacc

SEQ ID NO: 3953923 - RNA, 12 nt, Shigella flexneri 2a str. 301
uugccagcgcca

SEQ ID NO: 3953924 - RNA, 10 nt, Shigella flexneri 2a str. 301
uugccaggac

SEQ ID NO: 3953925 - RNA, 19 nt, Shigella flexneri 2a str. 301
uugccaguaacagaacgca

SEQ ID NO: 3953926 - RNA, 19 nt, Shigella flexneri 2a str. 301
uugccaguccuaaaaacag

SEQ ID NO: 3953927 - RNA, 12 nt, Shigella flexneri 2a str. 301
uugccauaucuu

SEQ ID NO: 3953928 - RNA, 20 nt, Shigella flexneri 2a str. 301
uugccaucaaucacuuugcg

SEQ ID NO: 3953929 - RNA, 24 nt, Shigella flexneri 2a str. 301
uugccaugcaauauuguagcaacu

SEQ ID NO: 3953930 - RNA, 16 nt, Shigella flexneri 2a str. 301
uugcccgcaaagauga

SEQ ID NO: 3953931 - RNA, 19 nt, Shigella flexneri 2a str. 301
uugcccgggcgagcaaugu

SEQ ID NO: 3953932 - RNA, 15 nt, Shigella flexneri 2a str. 301
uugcccggucaggug

SEQ ID NO: 3953933 - RNA, 16 nt, Shigella flexneri 2a str. 301
uugcccucacccugua

SEQ ID NO: 3953934 - RNA, 20 nt, Shigella flexneri 2a str. 301
uugcccuuuucaccaugggc

SEQ ID NO: 3953935 - RNA, 11 nt, Shigella flexneri 2a str. 301
uugccgccagc

SEQ ID NO: 3953936 - RNA, 18 nt, Shigella flexneri 2a str. 301
uugccgcgcucuuuaaag

SEQ ID NO: 3953937 - RNA, 20 nt, Shigella flexneri 2a str. 301
uugccggauauuccugaaug

SEQ ID NO: 3953938 - RNA, 13 nt, Shigella flexneri 2a str. 301
uugccguaagcaa

SEQ ID NO: 3953939 - RNA, 15 nt, Shigella flexneri 2a str. 301
uugccguaccacgcc

SEQ ID NO: 3953940 - RNA, 16 nt, Shigella flexneri 2a str. 301
uugccguauacacacu

SEQ ID NO: 3953941 - RNA, 19 nt, Shigella flexneri 2a str. 301
uugccguccggcaucgcaa

SEQ ID NO: 3953942 - RNA, 20 nt, Shigella flexneri 2a str. 301
uugccgucgauaugcaaauc

SEQ ID NO: 3953943 - RNA, 18 nt, Shigella flexneri 2a str. 301
uugccgugccccauaugg

SEQ ID NO: 3953944 - RNA, 13 nt, Shigella flexneri 2a str. 301
uugccgugugccg

SEQ ID NO: 3953945 - RNA, 22 nt, Shigella flexneri 2a str. 301
uugccguuaaaacuaaaaacag

SEQ ID NO: 3953946 - RNA, 18 nt, Shigella flexneri 2a str. 301
uugccguuuaccgccauc

SEQ ID NO: 3953947 - RNA, 13 nt, Shigella flexneri 2a str. 301
uugccugaugcgc

SEQ ID NO: 3953948 - RNA, 16 nt, Shigella flexneri 2a str. 301
uugccugaugcgcuac

SEQ ID NO: 3953949 - RNA, 20 nt, Shigella flexneri 2a str. 301
uugccugaugcgcugggcaa

SEQ ID NO: 3953950 - RNA, 18 nt, Shigella flexneri 2a str. 301
uugccugcgaagcucuuu

SEQ ID NO: 3953951 - RNA, 14 nt, Shigella flexneri 2a str. 301
uugccugggugcaa

SEQ ID NO: 3953952 - RNA, 21 nt, Shigella flexneri 2a str. 301
uugccugugacuuucugagau

SEQ ID NO: 3953953 - RNA, 17 nt, Shigella flexneri 2a str. 301
uugccugugcaaccuuu

SEQ ID NO: 3953954 - RNA, 17 nt, Shigella flexneri 2a str. 301
uugccuuaaugcuugug

SEQ ID NO: 3953955 - RNA, 21 nt, Shigella flexneri 2a str. 301
uugcgaacgcguucacugccg

SEQ ID NO: 3953956 - RNA, 21 nt, Shigella flexneri 2a str. 301
uugcgagccuguaccacaacc

SEQ ID NO: 3953957 - RNA, 23 nt, Shigella flexneri 2a str. 301
uugcgauacaggaaugcagucgc

SEQ ID NO: 3953958 - RNA, 13 nt, Shigella flexneri 2a str. 301
uugcgauaucaac

SEQ ID NO: 3953959 - RNA, 18 nt, Shigella flexneri 2a str. 301
uugcgauauucuucagua

SEQ ID NO: 3953960 - RNA, 14 nt, Shigella flexneri 2a str. 301
uuggugcuuuugcu

SEQ ID NO: 3953961 - RNA, 21 nt, Shigella flexneri 2a str. 301
uugguggcgaccggaauguuc

SEQ ID NO: 3953962 - RNA, 12 nt, Shigella flexneri 2a str. 301
uugguucaucgu

SEQ ID NO: 3953963 - RNA, 21 nt, Shigella flexneri 2a str. 301
uugguugcgcuucuuccagca

SEQ ID NO: 3953964 - RNA, 16 nt, Shigella flexneri 2a str. 301
uugguuucgaggaucc

SEQ ID NO: 3953965 - RNA, 14 nt, Shigella flexneri 2a str. 301
uuguaaauuuccca

SEQ ID NO: 3953966 - RNA, 23 nt, Shigella flexneri 2a str. 301
uuguaacaauccgauaaucccuu

SEQ ID NO: 3953967 - RNA, 14 nt, Shigella flexneri 2a str. 301
uuguaagcugucga

SEQ ID NO: 3953968 - RNA, 16 nt, Shigella flexneri 2a str. 301
uuguaagucagaaagc

SEQ ID NO: 3953969 - RNA, 17 nt, Shigella flexneri 2a str. 301
uuguaaucauauuaaau

SEQ ID NO: 3953970 - RNA, 12 nt, Shigella flexneri 2a str. 301
uuguacaaaaaa

SEQ ID NO: 3953971 - RNA, 13 nt, Shigella flexneri 2a str. 301
uuguacaaaaaau

SEQ ID NO: 3953972 - RNA, 14 nt, Shigella flexneri 2a str. 301
uuguacaaaccaua

SEQ ID NO: 3953973 - RNA, 22 nt, Shigella flexneri 2a str. 301
uuguaccaguucgcuuuccguu

SEQ ID NO: 3953974 - RNA, 16 nt, Shigella flexneri 2a str. 301
uuguacuccagcagac

SEQ ID NO: 3953975 - RNA, 15 nt, Shigella flexneri 2a str. 301
uuguacuuuccagcc

SEQ ID NO: 3953976 - RNA, 16 nt, Shigella flexneri 2a str. 301
uuguacuuuccagcca

SEQ ID NO: 3953977 - RNA, 13 nt, Shigella flexneri 2a str. 301
uuguagaccugau

SEQ ID NO: 3953978 - RNA, 14 nt, Shigella flexneri 2a str. 301
uuguagauuuugca

SEQ ID NO: 3953979 - RNA, 20 nt, Shigella flexneri 2a str. 301
uuguaggcaggauaaggcgu

SEQ ID NO: 3953980 - RNA, 19 nt, Shigella flexneri 2a str. 301
uuguaggcggauaaggcgu

SEQ ID NO: 3953981 - RNA, 19 nt, Shigella flexneri 2a str. 301
uuguaggucugauagcgua

SEQ ID NO: 3953982 - RNA, 15 nt, Shigella flexneri 2a str. 301
uuguaguuugauaau

SEQ ID NO: 3953983 - RNA, 18 nt, Shigella flexneri 2a str. 301
uuguauuacaacgugcuc

SEQ ID NO: 3953984 - RNA, 18 nt, Shigella flexneri 2a str. 301
uugucaacgacguaccaa

SEQ ID NO: 3953985 - RNA, 15 nt, Shigella flexneri 2a str. 301
uugucaagauugaua

SEQ ID NO: 3953986 - RNA, 21 nt, Shigella flexneri 2a str. 301
uugucagcaaucugauugaca

SEQ ID NO: 3953987 - RNA, 22 nt, Shigella flexneri 2a str. 301
uugucagcaaucugauugacau

SEQ ID NO: 3953988 - RNA, 17 nt, Shigella flexneri 2a str. 301
uugucaucaguuucaaa

SEQ ID NO: 3953989 - RNA, 13 nt, Shigella flexneri 2a str. 301
uugucaugcagcu

SEQ ID NO: 3953990 - RNA, 20 nt, Shigella flexneri 2a str. 301
uugucaugcgcucucccaug

SEQ ID NO: 3953991 - RNA, 14 nt, Shigella flexneri 2a str. 301
uugucauuggcagc

SEQ ID NO: 3953992 - RNA, 16 nt, Shigella flexneri 2a str. 301
uuguccauaaaaugca

SEQ ID NO: 3953993 - RNA, 17 nt, Shigella flexneri 2a str. 301
uuguccgucugaaaacu

SEQ ID NO: 3953994 - RNA, 14 nt, Shigella flexneri 2a str. 301
uugucgauuuccau

SEQ ID NO: 3953995 - RNA, 14 nt, Shigella flexneri 2a str. 301
uugucgcaggcggu

SEQ ID NO: 3953996 - RNA, 18 nt, Shigella flexneri 2a str. 301
uugucggcgugaacgcgc

SEQ ID NO: 3953997 - RNA, 16 nt, Shigella flexneri 2a str. 301
uugucuccaccaauga

SEQ ID NO: 3953998 - RNA, 18 nt, Shigella flexneri 2a str. 301
uugucuccaccaaugacg

SEQ ID NO: 3953999 - RNA, 12 nt, Shigella flexneri 2a str. 301
uugucugaaucc

SEQ ID NO: 3954000 - RNA, 13 nt, Shigella flexneri 2a str. 301
uugucugaaucca

SEQ ID NO: 3954001 - RNA, 21 nt, Shigella flexneri 2a str. 301
uugucuucaagaucagcggca

SEQ ID NO: 3954002 - RNA, 16 nt, Shigella flexneri 2a str. 301
uugucuuuccagacuc

SEQ ID NO: 3954003 - RNA, 17 nt, Shigella flexneri 2a str. 301
uugucuuuuuaaugacu

SEQ ID NO: 3954004 - RNA, 18 nt, Shigella flexneri 2a str. 301
uugucuuuuuaaugacuu

SEQ ID NO: 3954005 - RNA, 20 nt, Shigella flexneri 2a str. 301
uugugaacgagaaaaugacg

SEQ ID NO: 3954006 - RNA, 14 nt, Shigella flexneri 2a str. 301
uugugaucuuuuuc

SEQ ID NO: 3954007 - RNA, 22 nt, Shigella flexneri 2a str. 301
uugugauuaaacuucaccagca

SEQ ID NO: 3954008 - RNA, 16 nt, Shigella flexneri 2a str. 301
uugugcaaauucaaua

SEQ ID NO: 3954009 - RNA, 20 nt, Shigella flexneri 2a str. 301
uugugcaaauucaauaaauu

SEQ ID NO: 3954010 - RNA, 15 nt, Shigella flexneri 2a str. 301
uugugcaccaccaaa

SEQ ID NO: 3954011 - RNA, 20 nt, Shigella flexneri 2a str. 301
uugugcacgauugccggaug

SEQ ID NO: 3954012 - RNA, 18 nt, Shigella flexneri 2a str. 301
uugugcacgugccagaug

SEQ ID NO: 3954013 - RNA, 18 nt, Shigella flexneri 2a str. 301
uugugccacgcuggcccg

SEQ ID NO: 3954014 - RNA, 14 nt, Shigella flexneri 2a str. 301
uugugccagaccaa

SEQ ID NO: 3954015 - RNA, 21 nt, Shigella flexneri 2a str. 301
uugugccagaccaaacagcau

SEQ ID NO: 3954016 - RNA, 19 nt, Shigella flexneri 2a str. 301
uugugcgccacauccggca

SEQ ID NO: 3954017 - RNA, 22 nt, Shigella flexneri 2a str. 301
uugugcuggcaaaucaguggcu

SEQ ID NO: 3954018 - RNA, 13 nt, Shigella flexneri 2a str. 301
uugugcuucaguu

SEQ ID NO: 3954019 - RNA, 15 nt, Shigella flexneri 2a str. 301
uuguggcggaaagac

SEQ ID NO: 3954020 - RNA, 15 nt, Shigella flexneri 2a str. 301
uuguguaaguuuaac

SEQ ID NO: 3954021 - RNA, 20 nt, Shigella flexneri 2a str. 301
uuguuaaauauuaaggguaa

SEQ ID NO: 3954022 - RNA, 22 nt, Shigella flexneri 2a str. 301
uuguuaacaacgugugcuuugu

SEQ ID NO: 3954023 - RNA, 15 nt, Shigella flexneri 2a str. 301
uuguuacgguguuca

SEQ ID NO: 3954024 - RNA, 14 nt, Shigella flexneri 2a str. 301
uuguucaggcucca

SEQ ID NO: 3954025 - RNA, 22 nt, Shigella flexneri 2a str. 301
uuguucucagcacauugauggc

SEQ ID NO: 3954026 - RNA, 12 nt, Shigella flexneri 2a str. 301
uuguucuuccgg

SEQ ID NO: 3954027 - RNA, 14 nt, Shigella flexneri 2a str. 301
uuguugauaaggaa

SEQ ID NO: 3954028 - RNA, 15 nt, Shigella flexneri 2a str. 301
uuguugcaggaacag

SEQ ID NO: 3954029 - RNA, 23 nt, Shigella flexneri 2a str. 301
uuguugcgcugaaacuuuaccaa

SEQ ID NO: 3954030 - RNA, 13 nt, Shigella flexneri 2a str. 301
uuguugucacacc

SEQ ID NO: 3954031 - RNA, 17 nt, Shigella flexneri 2a str. 301
uuguugucuauuuccac

SEQ ID NO: 3954032 - RNA, 12 nt, Shigella flexneri 2a str. 301
uuguuuaaauau

SEQ ID NO: 3954033 - RNA, 19 nt, Shigella flexneri 2a str. 301
uuguuuagauccauaucca

SEQ ID NO: 3954034 - RNA, 16 nt, Shigella flexneri 2a str. 301
uuguuuaugccggaug

SEQ ID NO: 3954035 - RNA, 23 nt, Shigella flexneri 2a str. 301
uuguuucuucgauggcuggggua

SEQ ID NO: 3954036 - RNA, 20 nt, Shigella flexneri 2a str. 301
uuguuugcaaaaucaaauac

SEQ ID NO: 3954037 - RNA, 15 nt, Shigella flexneri 2a str. 301
uuguuuuauaaagaa

SEQ ID NO: 3954038 - RNA, 19 nt, Shigella flexneri 2a str. 301
uuguuuuggguguuuaugc

SEQ ID NO: 3954039 - RNA, 16 nt, Shigella flexneri 2a str. 301
uuguuuuugccggaug

SEQ ID NO: 3954040 - RNA, 17 nt, Shigella flexneri 2a str. 301
uuguuuuuucaaccuaa

SEQ ID NO: 3954041 - RNA, 18 nt, Shigella flexneri 2a str. 301
uuuaaaaagaaaaaacua

SEQ ID NO: 3954042 - RNA, 16 nt, Shigella flexneri 2a str. 301
uuuaaaacauuguuga

SEQ ID NO: 3954043 - RNA, 18 nt, Shigella flexneri 2a str. 301
uuuaaacaauuucagaau

SEQ ID NO: 3954044 - RNA, 19 nt, Shigella flexneri 2a str. 301
uuuaaacagagauuacuuu

SEQ ID NO: 3954045 - RNA, 20 nt, Shigella flexneri 2a str. 301
uuuaaagagacagaaucagg

SEQ ID NO: 3954046 - RNA, 23 nt, Shigella flexneri 2a str. 301
uuuaaagagacagaaucaggcca

SEQ ID NO: 3954047 - RNA, 19 nt, Shigella flexneri 2a str. 301
uuuaaauaucaucaaaauu

SEQ ID NO: 3954048 - RNA, 11 nt, Shigella flexneri 2a str. 301
uuuaaccaaca

SEQ ID NO: 3954049 - RNA, 14 nt, Shigella flexneri 2a str. 301
uuuaaccguggugc

SEQ ID NO: 3954050 - RNA, 16 nt, Shigella flexneri 2a str. 301
uuuaacgcaugcacau

SEQ ID NO: 3954051 - RNA, 22 nt, Shigella flexneri 2a str. 301
uuuaacggacacuccuuccuga

SEQ ID NO: 3954052 - RNA, 23 nt, Shigella flexneri 2a str. 301
uuuaacucaccgaugaucgccau

SEQ ID NO: 3954053 - RNA, 17 nt, Shigella flexneri 2a str. 301
uuuaagaauugauggua

SEQ ID NO: 3954054 - RNA, 18 nt, Shigella flexneri 2a str. 301
uuuaagcuggguaaaugc

SEQ ID NO: 3954055 - RNA, 19 nt, Shigella flexneri 2a str. 301
uuuaagcuggguaaaugca

SEQ ID NO: 3954056 - RNA, 14 nt, Shigella flexneri 2a str. 301
uuuaauaaauuuag

SEQ ID NO: 3954057 - RNA, 15 nt, Shigella flexneri 2a str. 301
uuuaauauuaaacca

SEQ ID NO: 3954058 - RNA, 18 nt, Shigella flexneri 2a str. 301
uuuaaugccacauuagau

SEQ ID NO: 3954059 - RNA, 13 nt, Shigella flexneri 2a str. 301
uuuaauugccauu

SEQ ID NO: 3954060 - RNA, 13 nt, Shigella flexneri 2a str. 301
uuucaccugcuga

SEQ ID NO: 3954061 - RNA, 15 nt, Shigella flexneri 2a str. 301
uuucaccuuuuucca

SEQ ID NO: 3954062 - RNA, 15 nt, Shigella flexneri 2a str. 301
uuucacgaacacagu

SEQ ID NO: 3954063 - RNA, 22 nt, Shigella flexneri 2a str. 301
uuucacgaccaccgaugaagaa

SEQ ID NO: 3954064 - RNA, 16 nt, Shigella flexneri 2a str. 301
uuucacgcaauaccug

SEQ ID NO: 3954065 - RNA, 21 nt, Shigella flexneri 2a str. 301
uuucacgccgccguuagcuuc

SEQ ID NO: 3954066 - RNA, 22 nt, Shigella flexneri 2a str. 301
uuucacgccgggaaauuuuucc

SEQ ID NO: 3954067 - RNA, 16 nt, Shigella flexneri 2a str. 301
uuucacggcaccagcc

SEQ ID NO: 3954068 - RNA, 19 nt, Shigella flexneri 2a str. 301
uuucacggccacucugccu

SEQ ID NO: 3954069 - RNA, 18 nt, Shigella flexneri 2a str. 301
uuucacuauguaauccug

SEQ ID NO: 3954070 - RNA, 14 nt, Shigella flexneri 2a str. 301
uuucacuauuucuu

SEQ ID NO: 3954071 - RNA, 16 nt, Shigella flexneri 2a str. 301
uuucacuuaaugaauc

SEQ ID NO: 3954072 - RNA, 14 nt, Shigella flexneri 2a str. 301
uuucacuucugagu

SEQ ID NO: 3954073 - RNA, 16 nt, Shigella flexneri 2a str. 301
uuucacuuucugcaau

SEQ ID NO: 3954074 - RNA, 18 nt, Shigella flexneri 2a str. 301
uuucagaaaguauauaaa

SEQ ID NO: 3954075 - RNA, 17 nt, Shigella flexneri 2a str. 301
uuucagaaauuuggcuc

SEQ ID NO: 3954076 - RNA, 22 nt, Shigella flexneri 2a str. 301
uuucagauguuccgccauuuua

SEQ ID NO: 3954077 - RNA, 19 nt, Shigella flexneri 2a str. 301
uuucagauuggugacaaag

SEQ ID NO: 3954078 - RNA, 14 nt, Shigella flexneri 2a str. 301
uuucagcaccagau

SEQ ID NO: 3954079 - RNA, 14 nt, Shigella flexneri 2a str. 301
uuucagcacuuauc

SEQ ID NO: 3954080 - RNA, 11 nt, Shigella flexneri 2a str. 301
uuucagcagcg

SEQ ID NO: 3954081 - RNA, 15 nt, Shigella flexneri 2a str. 301
uuucagcagcggcac

SEQ ID NO: 3954082 - RNA, 12 nt, Shigella flexneri 2a str. 301
uuucagcugccc

SEQ ID NO: 3954083 - RNA, 12 nt, Shigella flexneri 2a str. 301
uuucaggaaacu

SEQ ID NO: 3954084 - RNA, 18 nt, Shigella flexneri 2a str. 301
uuucaggaaauaaauaau

SEQ ID NO: 3954085 - RNA, 23 nt, Shigella flexneri 2a str. 301
uuucagggaugaagugaagauga

SEQ ID NO: 3954086 - RNA, 15 nt, Shigella flexneri 2a str. 301
uuucaggucgguuuu

SEQ ID NO: 3954087 - RNA, 21 nt, Shigella flexneri 2a str. 301
uuucaguaauccuuucucaau

SEQ ID NO: 3954088 - RNA, 17 nt, Shigella flexneri 2a str. 301
uuucaguauuuccacaa

SEQ ID NO: 3954089 - RNA, 19 nt, Shigella flexneri 2a str. 301
uuucaguggggcaggggcu

SEQ ID NO: 3954090 - RNA, 18 nt, Shigella flexneri 2a str. 301
uuucaguggguuaugaaa

SEQ ID NO: 3954091 - RNA, 13 nt, Shigella flexneri 2a str. 301
uuucaguuggcug

SEQ ID NO: 3954092 - RNA, 15 nt, Shigella flexneri 2a str. 301
uuucaguuugccgcu

SEQ ID NO: 3954093 - RNA, 19 nt, Shigella flexneri 2a str. 301
uuucauagauuaauuuccc

SEQ ID NO: 3954094 - RNA, 19 nt, Shigella flexneri 2a str. 301
uuucauaucugccagauaa

SEQ ID NO: 3954095 - RNA, 21 nt, Shigella flexneri 2a str. 301
uuucauauucaauuugcaauu

SEQ ID NO: 3954096 - RNA, 15 nt, Shigella flexneri 2a str. 301
uuucaucccucucau

SEQ ID NO: 3954097 - RNA, 15 nt, Shigella flexneri 2a str. 301
uuucauccuucauua

SEQ ID NO: 3954098 - RNA, 23 nt, Shigella flexneri 2a str. 301
uuucaucgcuuacccuaaauccg

SEQ ID NO: 3954099 - RNA, 21 nt, Shigella flexneri 2a str. 301
uuucaucgcuuucuuuauaga

SEQ ID NO: 3954100 - RNA, 17 nt, Shigella flexneri 2a str. 301
uuucaucuucuucgaaa

SEQ ID NO: 3954101 - RNA, 21 nt, Shigella flexneri 2a str. 301
uuucauguuaaauuccggcuc

SEQ ID NO: 3954102 - RNA, 22 nt, Shigella flexneri 2a str. 301
uuucauucagaacacuucuucu

SEQ ID NO: 3954103 - RNA, 16 nt, Shigella flexneri 2a str. 301
uuucauuccaguaagg

SEQ ID NO: 3954104 - RNA, 17 nt, Shigella flexneri 2a str. 301
uuucauuguccgucuga

SEQ ID NO: 3954105 - RNA, 17 nt, Shigella flexneri 2a str. 301
uuucauuuauuaccucc

SEQ ID NO: 3954106 - RNA, 13 nt, Shigella flexneri 2a str. 301
uuuccaaaacugg

SEQ ID NO: 3954107 - RNA, 13 nt, Shigella flexneri 2a str. 301
uuuccaccgcaaa

SEQ ID NO: 3954108 - RNA, 15 nt, Shigella flexneri 2a str. 301
uuuccacgcaggcau

SEQ ID NO: 3954109 - RNA, 23 nt, Shigella flexneri 2a str. 301
uuuccagaucgaucauauuuccu

SEQ ID NO: 3954110 - RNA, 22 nt, Shigella flexneri 2a str. 301
uuuccagccgagccgacgguuu

SEQ ID NO: 3954111 - RNA, 21 nt, Shigella flexneri 2a str. 301
uuuccagcucaaccagauucg

SEQ ID NO: 3954112 - RNA, 17 nt, Shigella flexneri 2a str. 301
uuuccaggcaucagcaa

SEQ ID NO: 3954113 - RNA, 16 nt, Shigella flexneri 2a str. 301
uuuccagggccucucc

SEQ ID NO: 3954114 - RNA, 17 nt, Shigella flexneri 2a str. 301
uuuccagguuauuuuau

SEQ ID NO: 3954115 - RNA, 16 nt, Shigella flexneri 2a str. 301
uuuccaguuugcguuc

SEQ ID NO: 3954116 - RNA, 21 nt, Shigella flexneri 2a str. 301
uuuccaucauuagugugauca

SEQ ID NO: 3954117 - RNA, 20 nt, Shigella flexneri 2a str. 301
uuuccaucuccagcugcucg

SEQ ID NO: 3954118 - RNA, 16 nt, Shigella flexneri 2a str. 301
uuuccaugaccugcca

SEQ ID NO: 3954119 - RNA, 21 nt, Shigella flexneri 2a str. 301
uuucccagcaagaaccaugca

SEQ ID NO: 3954120 - RNA, 17 nt, Shigella flexneri 2a str. 301
uuucccauuaccauucc

SEQ ID NO: 3954121 - RNA, 14 nt, Shigella flexneri 2a str. 301
uuucccauucuugg

SEQ ID NO: 3954122 - RNA, 14 nt, Shigella flexneri 2a str. 301
uuuccccaacgaug

SEQ ID NO: 3954123 - RNA, 14 nt, Shigella flexneri 2a str. 301
uuucccccacagcu

SEQ ID NO: 3954124 - RNA, 23 nt, Shigella flexneri 2a str. 301
uuucccgcacguuggcggugcca

SEQ ID NO: 3954125 - RNA, 19 nt, Shigella flexneri 2a str. 301
uuucccgcuucguuuucag

SEQ ID NO: 3954126 - RNA, 22 nt, Shigella flexneri 2a str. 301
uuucccggcugauaaaguguuc

SEQ ID NO: 3954127 - RNA, 19 nt, Shigella flexneri 2a str. 301
uuucccuauuuuuucgugu

SEQ ID NO: 3954128 - RNA, 14 nt, Shigella flexneri 2a str. 301
uuucccuccacucc

SEQ ID NO: 3954129 - RNA, 22 nt, Shigella flexneri 2a str. 301
uuucccuucacucugcugccac

SEQ ID NO: 3954130 - RNA, 19 nt, Shigella flexneri 2a str. 301
uuuccgcgcaaucgcccag

SEQ ID NO: 3954131 - RNA, 23 nt, Shigella flexneri 2a str. 301
uuuccggaucgccaaagcggcag

SEQ ID NO: 3954132 - RNA, 14 nt, Shigella flexneri 2a str. 301
uuuccggcagaagc

SEQ ID NO: 3954133 - RNA, 15 nt, Shigella flexneri 2a str. 301
uuuccggcagaagca

SEQ ID NO: 3954134 - RNA, 20 nt, Shigella flexneri 2a str. 301
uuuccggcggcggaaaguau

SEQ ID NO: 3954135 - RNA, 20 nt, Shigella flexneri 2a str. 301
uuuccggguuguacauuuug

SEQ ID NO: 3954136 - RNA, 15 nt, Shigella flexneri 2a str. 301
uuuccgucagcggca

SEQ ID NO: 3954137 - RNA, 18 nt, Shigella flexneri 2a str. 301
uuuccuccugucuucccu

SEQ ID NO: 3954138 - RNA, 16 nt, Shigella flexneri 2a str. 301
uuuccugacucagcau

SEQ ID NO: 3954139 - RNA, 20 nt, Shigella flexneri 2a str. 301
uuuccugccagaccuuauca

SEQ ID NO: 3954140 - RNA, 18 nt, Shigella flexneri 2a str. 301
uuuccuggcgaacaucca

SEQ ID NO: 3954141 - RNA, 18 nt, Shigella flexneri 2a str. 301
uuuccuuaaacaccuggc

SEQ ID NO: 3954142 - RNA, 13 nt, Shigella flexneri 2a str. 301
uuuccuuaacucc

SEQ ID NO: 3954143 - RNA, 18 nt, Shigella flexneri 2a str. 301
uuuccuuaacuccucgcc

SEQ ID NO: 3954144 - RNA, 15 nt, Shigella flexneri 2a str. 301
uuuccuuccuuggau

SEQ ID NO: 3954145 - RNA, 19 nt, Shigella flexneri 2a str. 301
uuucgaaugcucaugaucg

SEQ ID NO: 3954146 - RNA, 15 nt, Shigella flexneri 2a str. 301
uuucgaauuuuccau

SEQ ID NO: 3954147 - RNA, 18 nt, Shigella flexneri 2a str. 301
uuucgacaauaaucaacg

SEQ ID NO: 3954148 - RNA, 20 nt, Shigella flexneri 2a str. 301
uuucgaccggguuucuuauu

SEQ ID NO: 3954149 - RNA, 22 nt, Shigella flexneri 2a str. 301
uuucgaggauccaugacaucuc

SEQ ID NO: 3954150 - RNA, 14 nt, Shigella flexneri 2a str. 301
uuucgauaaucaaa

SEQ ID NO: 3954151 - RNA, 15 nt, Shigella flexneri 2a str. 301
uuucgauaaucauca

SEQ ID NO: 3954152 - RNA, 17 nt, Shigella flexneri 2a str. 301
uuucgauaucaagccau

SEQ ID NO: 3954153 - RNA, 13 nt, Shigella flexneri 2a str. 301
uuucgauugcaca

SEQ ID NO: 3954154 - RNA, 12 nt, Shigella flexneri 2a str. 301
uuucgcaaacca

SEQ ID NO: 3954155 - RNA, 15 nt, Shigella flexneri 2a str. 301
uuucgcaaaccaaac

SEQ ID NO: 3954156 - RNA, 15 nt, Shigella flexneri 2a str. 301
uuucgccacccaguc

SEQ ID NO: 3954157 - RNA, 10 nt, Shigella flexneri 2a str. 301
uuucgccagc

SEQ ID NO: 3954158 - RNA, 14 nt, Shigella flexneri 2a str. 301
uuucgccagcaccg

SEQ ID NO: 3954159 - RNA, 18 nt, Shigella flexneri 2a str. 301
uuucgccgcauccggcaa

SEQ ID NO: 3954160 - RNA, 18 nt, Shigella flexneri 2a str. 301
uuugcaugacgaucaacc

SEQ ID NO: 3954161 - RNA, 16 nt, Shigella flexneri 2a str. 301
uuugcauuacugcuau

SEQ ID NO: 3954162 - RNA, 18 nt, Shigella flexneri 2a str. 301
uuugcauuacugcuaucu

SEQ ID NO: 3954163 - RNA, 19 nt, Shigella flexneri 2a str. 301
uuugcauucggauugcuau

SEQ ID NO: 3954164 - RNA, 18 nt, Shigella flexneri 2a str. 301
uuugccaaauaucuuaua

SEQ ID NO: 3954165 - RNA, 14 nt, Shigella flexneri 2a str. 301
uuugccacugccgg

SEQ ID NO: 3954166 - RNA, 17 nt, Shigella flexneri 2a str. 301
uuugccagaaauccagg

SEQ ID NO: 3954167 - RNA, 17 nt, Shigella flexneri 2a str. 301
uuugccagccgcagcuc

SEQ ID NO: 3954168 - RNA, 16 nt, Shigella flexneri 2a str. 301
uuugccaugcauaucc

SEQ ID NO: 3954169 - RNA, 17 nt, Shigella flexneri 2a str. 301
uuugccccuguugaaau

SEQ ID NO: 3954170 - RNA, 17 nt, Shigella flexneri 2a str. 301
uuugccgaggaagacaa

SEQ ID NO: 3954171 - RNA, 19 nt, Shigella flexneri 2a str. 301
uuugccgcagcaguugcca

SEQ ID NO: 3954172 - RNA, 18 nt, Shigella flexneri 2a str. 301
uuugccggaacauccggc

SEQ ID NO: 3954173 - RNA, 19 nt, Shigella flexneri 2a str. 301
uuugccgggcauuuaauuu

SEQ ID NO: 3954174 - RNA, 20 nt, Shigella flexneri 2a str. 301
uuugccuccccaacauauaa

SEQ ID NO: 3954175 - RNA, 22 nt, Shigella flexneri 2a str. 301
uuugccuccccaacauauaagu

SEQ ID NO: 3954176 - RNA, 15 nt, Shigella flexneri 2a str. 301
uuugccuuauugccu

SEQ ID NO: 3954177 - RNA, 20 nt, Shigella flexneri 2a str. 301
uuugcgaacgcguucacugc

SEQ ID NO: 3954178 - RNA, 20 nt, Shigella flexneri 2a str. 301
uuugcgagucugcuccagaa

SEQ ID NO: 3954179 - RNA, 14 nt, Shigella flexneri 2a str. 301
uuugcgcaaucaca

SEQ ID NO: 3954180 - RNA, 23 nt, Shigella flexneri 2a str. 301
uuugcgcauccagcguugagccc

SEQ ID NO: 3954181 - RNA, 15 nt, Shigella flexneri 2a str. 301
uuugcgccucgccau

SEQ ID NO: 3954182 - RNA, 16 nt, Shigella flexneri 2a str. 301
uuugcgcggcagucac

SEQ ID NO: 3954183 - RNA, 18 nt, Shigella flexneri 2a str. 301
uuugcgcguaaacaaaca

SEQ ID NO: 3954184 - RNA, 20 nt, Shigella flexneri 2a str. 301
uuugcgcuuuuggcaggaac

SEQ ID NO: 3954185 - RNA, 21 nt, Shigella flexneri 2a str. 301
uuugcggaucaacuuuguucu

SEQ ID NO: 3954186 - RNA, 15 nt, Shigella flexneri 2a str. 301
uuugcgguuaaaaau

SEQ ID NO: 3954187 - RNA, 21 nt, Shigella flexneri 2a str. 301
uuugcguccgguaauuuuuau

SEQ ID NO: 3954188 - RNA, 14 nt, Shigella flexneri 2a str. 301
uuugcguguuucag

SEQ ID NO: 3954189 - RNA, 20 nt, Shigella flexneri 2a str. 301
uuugcguuccaucagauuca

SEQ ID NO: 3954190 - RNA, 17 nt, Shigella flexneri 2a str. 301
uuugcguuugucauaaa

SEQ ID NO: 3954191 - RNA, 20 nt, Shigella flexneri 2a str. 301
uuugcuauccaguacauuga

SEQ ID NO: 3954192 - RNA, 16 nt, Shigella flexneri 2a str. 301
uuugcuaucgggaaua

SEQ ID NO: 3954193 - RNA, 21 nt, Shigella flexneri 2a str. 301
uuugcucaacccuuuccagcg

SEQ ID NO: 3954194 - RNA, 20 nt, Shigella flexneri 2a str. 301
uuugcucgcgacguaauuua

SEQ ID NO: 3954195 - RNA, 22 nt, Shigella flexneri 2a str. 301
uuugcuugccgguuauuuugcu

SEQ ID NO: 3954196 - RNA, 17 nt, Shigella flexneri 2a str. 301
uuuggaugagcaugcgg

SEQ ID NO: 3954197 - RNA, 18 nt, Shigella flexneri 2a str. 301
uuuggcaaacuacaaauc

SEQ ID NO: 3954198 - RNA, 21 nt, Shigella flexneri 2a str. 301
uuuggcaaacuacaaauccaa

SEQ ID NO: 3954199 - RNA, 17 nt, Shigella flexneri 2a str. 301
uuuggcaaaugcaucag

SEQ ID NO: 3954200 - RNA, 21 nt, Shigella flexneri 2a str. 301
uuuggcaaaugcaucagugac

SEQ ID NO: 3954201 - RNA, 17 nt, Shigella flexneri 2a str. 301
uuuggcaucaaucaacg

SEQ ID NO: 3954202 - RNA, 13 nt, Shigella flexneri 2a str. 301
uuuggccgcgcca

SEQ ID NO: 3954203 - RNA, 20 nt, Shigella flexneri 2a str. 301
uuuggcugagugaaucagaa

SEQ ID NO: 3954204 - RNA, 11 nt, Shigella flexneri 2a str. 301
uuuggcugccg

SEQ ID NO: 3954205 - RNA, 18 nt, Shigella flexneri 2a str. 301
uuuggcuggaguggugaa

SEQ ID NO: 3954206 - RNA, 17 nt, Shigella flexneri 2a str. 301
uuuggcugucaguucac

SEQ ID NO: 3954207 - RNA, 16 nt, Shigella flexneri 2a str. 301
uuuggugagaacacca

SEQ ID NO: 3954208 - RNA, 21 nt, Shigella flexneri 2a str. 301
uuuguacaggauauauuucau

SEQ ID NO: 3954209 - RNA, 15 nt, Shigella flexneri 2a str. 301
uuuguaucugcagau

SEQ ID NO: 3954210 - RNA, 20 nt, Shigella flexneri 2a str. 301
uuuguaugccuggcauuucu

SEQ ID NO: 3954211 - RNA, 12 nt, Shigella flexneri 2a str. 301
uuuguauuuuau

SEQ ID NO: 3954212 - RNA, 16 nt, Shigella flexneri 2a str. 301
uuugucaucaguuuca

SEQ ID NO: 3954213 - RNA, 20 nt, Shigella flexneri 2a str. 301
uuugucaugacgacaaggca

SEQ ID NO: 3954214 - RNA, 20 nt, Shigella flexneri 2a str. 301
uuuguccaccaauagcccau

SEQ ID NO: 3954215 - RNA, 15 nt, Shigella flexneri 2a str. 301
uuuguccccucauca

SEQ ID NO: 3954216 - RNA, 16 nt, Shigella flexneri 2a str. 301
uuugucgaacagguua

SEQ ID NO: 3954217 - RNA, 19 nt, Shigella flexneri 2a str. 301
uuugucgugggcaggaaaa

SEQ ID NO: 3954218 - RNA, 13 nt, Shigella flexneri 2a str. 301
uuugugcauagca

SEQ ID NO: 3954219 - RNA, 14 nt, Shigella flexneri 2a str. 301
uuugugucagcgcc

SEQ ID NO: 3954220 - RNA, 19 nt, Shigella flexneri 2a str. 301
uuuguugauaaacaaacag

SEQ ID NO: 3954221 - RNA, 14 nt, Shigella flexneri 2a str. 301
uuuguugauuuccc

SEQ ID NO: 3954222 - RNA, 17 nt, Shigella flexneri 2a str. 301
uuuguugcccagcgcau

SEQ ID NO: 3954223 - RNA, 20 nt, Shigella flexneri 2a str. 301
uuuguugcgcugaaacuuua

SEQ ID NO: 3954224 - RNA, 19 nt, Shigella flexneri 2a str. 301
uuuguuggcgaaaaucuuu

SEQ ID NO: 3954225 - RNA, 14 nt, Shigella flexneri 2a str. 301
uuuguuucugaauc

SEQ ID NO: 3954226 - RNA, 15 nt, Shigella flexneri 2a str. 301
uuuguuuguucuucu

SEQ ID NO: 3954227 - RNA, 17 nt, Shigella flexneri 2a str. 301
uuuuaaacgaauaguuu

SEQ ID NO: 3954228 - RNA, 20 nt, Shigella flexneri 2a str. 301
uuuuaaauaucaucaaaauu

SEQ ID NO: 3954229 - RNA, 11 nt, Shigella flexneri 2a str. 301
uuuuaacuuac

SEQ ID NO: 3954230 - RNA, 23 nt, Shigella flexneri 2a str. 301
uuuuaagauccaguugaccugcg

SEQ ID NO: 3954231 - RNA, 16 nt, Shigella flexneri 2a str. 301
uuuuaagcaagugcaa

SEQ ID NO: 3954232 - RNA, 12 nt, Shigella flexneri 2a str. 301
uuuuaagugaug

SEQ ID NO: 3954233 - RNA, 22 nt, Shigella flexneri 2a str. 301
uuuuaauagagauagccugauc

SEQ ID NO: 3954234 - RNA, 21 nt, Shigella flexneri 2a str. 301
uuuuaaucaucugauaucuca

SEQ ID NO: 3954235 - RNA, 13 nt, Shigella flexneri 2a str. 301
uuuuaaucgccau

SEQ ID NO: 3954236 - RNA, 16 nt, Shigella flexneri 2a str. 301
uuuuacaucuacaaaa

SEQ ID NO: 3954237 - RNA, 20 nt, Shigella flexneri 2a str. 301
uuuuacaucuacaaaaaacu

SEQ ID NO: 3954238 - RNA, 16 nt, Shigella flexneri 2a str. 301
uuuuacauguucaaaa

SEQ ID NO: 3954239 - RNA, 18 nt, Shigella flexneri 2a str. 301
uuuuacgucugcaauuua

SEQ ID NO: 3954240 - RNA, 17 nt, Shigella flexneri 2a str. 301
uuuuacuccacuuccug

SEQ ID NO: 3954241 - RNA, 20 nt, Shigella flexneri 2a str. 301
uuuuagcggaacgcagauau

SEQ ID NO: 3954242 - RNA, 22 nt, Shigella flexneri 2a str. 301
uuuuagcuggugacaaaguaca

SEQ ID NO: 3954243 - RNA, 17 nt, Shigella flexneri 2a str. 301
uuuuaguaucuauucau

SEQ ID NO: 3954244 - RNA, 23 nt, Shigella flexneri 2a str. 301
uuuuaguucacauagacccugcu

SEQ ID NO: 3954245 - RNA, 13 nt, Shigella flexneri 2a str. 301
uuuuaucccuucu

SEQ ID NO: 3954246 - RNA, 20 nt, Shigella flexneri 2a str. 301
uuuuaucucccuguauccca

SEQ ID NO: 3954247 - RNA, 18 nt, Shigella flexneri 2a str. 301
uuuuaucucuuacagaaa

SEQ ID NO: 3954248 - RNA, 18 nt, Shigella flexneri 2a str. 301
uuuuaucugaggcagugc

SEQ ID NO: 3954249 - RNA, 12 nt, Shigella flexneri 2a str. 301
uuuuaugcguuc

SEQ ID NO: 3954250 - RNA, 23 nt, Shigella flexneri 2a str. 301
uuuuauggaucuuugacugaaau

SEQ ID NO: 3954251 - RNA, 16 nt, Shigella flexneri 2a str. 301
uuuuauguucagauaa

SEQ ID NO: 3954252 - RNA, 21 nt, Shigella flexneri 2a str. 301
uuuuauuauucgcuaaucaau

SEQ ID NO: 3954253 - RNA, 19 nt, Shigella flexneri 2a str. 301
uuuuauugcguaaucuuuu

SEQ ID NO: 3954254 - RNA, 20 nt, Shigella flexneri 2a str. 301
uuuuauuucaguaauauaua

SEQ ID NO: 3954255 - RNA, 16 nt, Shigella flexneri 2a str. 301
uuuucaaccuaaagua

SEQ ID NO: 3954256 - RNA, 19 nt, Shigella flexneri 2a str. 301
uuuucaacgugucuuuuac

SEQ ID NO: 3954257 - RNA, 21 nt, Shigella flexneri 2a str. 301
uuuucaagugacauacucuuu

SEQ ID NO: 3954258 - RNA, 19 nt, Shigella flexneri 2a str. 301
uuuucaauaaccugcaaaa

SEQ ID NO: 3954259 - RNA, 16 nt, Staphylococcus aureus subsp. aureus Mu50
aaaaaagaacauaaaa

SEQ ID NO: 3954260 - RNA, 21 nt, Staphylococcus aureus subsp. aureus Mu50
aaaaaaguuaucugcuuuucu

SEQ ID NO: 3954261 - RNA, 14 nt, Staphylococcus aureus subsp. aureus Mu50
aaaaaauauuuaca

SEQ ID NO: 3954262 - RNA, 16 nt, Staphylococcus aureus subsp. aureus Mu50
aaaaaaucgaacaaau

SEQ ID NO: 3954263 - RNA, 18 nt, Staphylococcus aureus subsp. aureus Mu50
aaaaaaucgaacaaauga

SEQ ID NO: 3954264 - RNA, 13 nt, Staphylococcus aureus subsp. aureus Mu50
aaaaaaugaaugu

SEQ ID NO: 3954265 - RNA, 12 nt, Staphylococcus aureus subsp. aureus Mu50
aaaaaaugaugu

SEQ ID NO: 3954266 - RNA, 12 nt, Staphylococcus aureus subsp. aureus Mu50
aaaaaauggauu

SEQ ID NO: 3954267 - RNA, 16 nt, Staphylococcus aureus subsp. aureus Mu50
aaaaaauuaaaauguu

SEQ ID NO: 3954268 - RNA, 13 nt, Staphylococcus aureus subsp. aureus Mu50
aaaaaauuuaaau

SEQ ID NO: 3954269 - RNA, 17 nt, Staphylococcus aureus subsp. aureus Mu50
aaaaaauuuaauguuuu

SEQ ID NO: 3954270 - RNA, 13 nt, Staphylococcus aureus subsp. aureus Mu50
aaaaacaaaaaaa

SEQ ID NO: 3954271 - RNA, 19 nt, Staphylococcus aureus subsp. aureus Mu50
aaaaacaaaaaaaccgaac

SEQ ID NO: 3954272 - RNA, 14 nt, Staphylococcus aureus subsp. aureus Mu50
aaaaacaauaaaau

SEQ ID NO: 3954273 - RNA, 18 nt, Staphylococcus aureus subsp. aureus Mu50
aaaaacaauaaaauuacu

SEQ ID NO: 3954274 - RNA, 21 nt, Staphylococcus aureus subsp. aureus Mu50
aaaaacagcaguaagauauuu

SEQ ID NO: 3954275 - RNA, 18 nt, Staphylococcus aureus subsp. aureus Mu50
aaaaacaguguagcacaa

SEQ ID NO: 3954276 - RNA, 15 nt, Staphylococcus aureus subsp. aureus Mu50
aaaaacaucauuucu

SEQ ID NO: 3954277 - RNA, 20 nt, Staphylococcus aureus subsp. aureus Mu50
aaaaacaucuacaucaaauu

SEQ ID NO: 3954278 - RNA, 23 nt, Staphylococcus aureus subsp. aureus Mu50
aaaaacauuaaccaguauaauuu

SEQ ID NO: 3954279 - RNA, 14 nt, Staphylococcus aureus subsp. aureus Mu50
aaaaaccacgcaca

SEQ ID NO: 3954280 - RNA, 21 nt, Staphylococcus aureus subsp. aureus Mu50
aaaaaccgaacaucugaaaaa

SEQ ID NO: 3954281 - RNA, 20 nt, Staphylococcus aureus subsp. aureus Mu50
aaaaacgcuuuuaaaccgug

SEQ ID NO: 3954282 - RNA, 23 nt, Staphylococcus aureus subsp. aureus Mu50
aaaaacgguacagauaagaauau

SEQ ID NO: 3954283 - RNA, 17 nt, Staphylococcus aureus subsp. aureus Mu50
aaaaacuucuuaacuug

SEQ ID NO: 3954284 - RNA, 12 nt, Staphylococcus aureus subsp. aureus Mu50
aaaaagaacaua

SEQ ID NO: 3954285 - RNA, 18 nt, Staphylococcus aureus subsp. aureus Mu50
aaaaagacaugagauuau

SEQ ID NO: 3954286 - RNA, 13 nt, Staphylococcus aureus subsp. aureus Mu50
aaaaagaugaaaa

SEQ ID NO: 3954287 - RNA, 20 nt, Staphylococcus aureus subsp. aureus Mu50
aaaaagcaguaaguugauuu

SEQ ID NO: 3954288 - RNA, 23 nt, Staphylococcus aureus subsp. aureus Mu50
aaaaagcggacugaaagaaaagu

SEQ ID NO: 3954289 - RNA, 15 nt, Staphylococcus aureus subsp. aureus Mu50
aaaaagcucaauccu

SEQ ID NO: 3954290 - RNA, 19 nt, Staphylococcus aureus subsp. aureus Mu50
aaaaagcugauuucuauca

SEQ ID NO: 3954291 - RNA, 19 nt, Staphylococcus aureus subsp. aureus Mu50
aaaaaggaagaacagcaca

SEQ ID NO: 3954292 - RNA, 20 nt, Staphylococcus aureus subsp. aureus Mu50
aaaaaguaaaaucuuuaaca

SEQ ID NO: 3954293 - RNA, 15 nt, Staphylococcus aureus subsp. aureus Mu50
aaaaagucuuucucg

SEQ ID NO: 3954294 - RNA, 19 nt, Staphylococcus aureus subsp. aureus Mu50
aaaaagugauaauuaaaau

SEQ ID NO: 3954295 - RNA, 21 nt, Staphylococcus aureus subsp. aureus Mu50
aaaaagugcauauuuaauaca

SEQ ID NO: 3954296 - RNA, 16 nt, Staphylococcus aureus subsp. aureus Mu50
aaaaauaacuccucca

SEQ ID NO: 3954297 - RNA, 14 nt, Staphylococcus aureus subsp. aureus Mu50
aaaaauaauagcaa

SEQ ID NO: 3954298 - RNA, 15 nt, Staphylococcus aureus subsp. aureus Mu50
aaaaauaauagcaaa

SEQ ID NO: 3954299 - RNA, 14 nt, Staphylococcus aureus subsp. aureus Mu50
aaaaauaauuaaau

SEQ ID NO: 3954300 - RNA, 15 nt, Staphylococcus aureus subsp. aureus Mu50
aaaaauaauuaugaa

SEQ ID NO: 3954301 - RNA, 11 nt, Staphylococcus aureus subsp. aureus Mu50
aaaaauaauug

SEQ ID NO: 3954302 - RNA, 21 nt, Staphylococcus aureus subsp. aureus Mu50
aaaaauacguuuaauguauaa

SEQ ID NO: 3954303 - RNA, 12 nt, Staphylococcus aureus subsp. aureus Mu50
aaaaauacuuuu

SEQ ID NO: 3954304 - RNA, 23 nt, Staphylococcus aureus subsp. aureus Mu50
aaaaauagcguaauuauuauaau

SEQ ID NO: 3954305 - RNA, 12 nt, Staphylococcus aureus subsp. aureus Mu50
aaaaauauccug

SEQ ID NO: 3954306 - RNA, 12 nt, Staphylococcus aureus subsp. aureus Mu50
aaaaauauguau

SEQ ID NO: 3954307 - RNA, 20 nt, Staphylococcus aureus subsp. aureus Mu50
aaaaauauugcguuuaauuu

SEQ ID NO: 3954308 - RNA, 13 nt, Staphylococcus aureus subsp. aureus Mu50
aaaaauauuuaaa

SEQ ID NO: 3954309 - RNA, 14 nt, Staphylococcus aureus subsp. aureus Mu50
aaaaauauuuaaac

SEQ ID NO: 3954310 - RNA, 17 nt, Staphylococcus aureus subsp. aureus Mu50
aaaaaucacgcuaacau

SEQ ID NO: 3954311 - RNA, 20 nt, Staphylococcus aureus subsp. aureus Mu50
aaaaauccggaacauuaaaa

SEQ ID NO: 3954312 - RNA, 21 nt, Staphylococcus aureus subsp. aureus Mu50
aaaaaucgaacuagacaagau

SEQ ID NO: 3954313 - RNA, 17 nt, Staphylococcus aureus subsp. aureus Mu50
aaaaaucgaauuuucaa

SEQ ID NO: 3954314 - RNA, 16 nt, Staphylococcus aureus subsp. aureus Mu50
aaaaaucuuaugaugu

SEQ ID NO: 3954315 - RNA, 18 nt, Staphylococcus aureus subsp. aureus Mu50
aaaaaucuucuccaauca

SEQ ID NO: 3954316 - RNA, 22 nt, Staphylococcus aureus subsp. aureus Mu50
aaaaaucuucuccaaucaucau

SEQ ID NO: 3954317 - RNA, 20 nt, Staphylococcus aureus subsp. aureus Mu50
aaaaaucuuuugauagcuaa

SEQ ID NO: 3954318 - RNA, 19 nt, Staphylococcus aureus subsp. aureus Mu50
aaaaaugaagaauacaaau

SEQ ID NO: 3954319 - RNA, 15 nt, Staphylococcus aureus subsp. aureus Mu50
aaaaaugaauauaau

SEQ ID NO: 3954320 - RNA, 12 nt, Staphylococcus aureus subsp. aureus Mu50
aaaaaugaugua

SEQ ID NO: 3954321 - RNA, 21 nt, Staphylococcus aureus subsp. aureus Mu50
aaaaaugccgagauuauuaug

SEQ ID NO: 3954322 - RNA, 22 nt, Staphylococcus aureus subsp. aureus Mu50
aaaaaugcucaaguugauuauu

SEQ ID NO: 3954323 - RNA, 19 nt, Staphylococcus aureus subsp. aureus Mu50
aaaaaugcugguaaauguu

SEQ ID NO: 3954324 - RNA, 22 nt, Staphylococcus aureus subsp. aureus Mu50
aaaaauggaaccacgucuuaau

SEQ ID NO: 3954325 - RNA, 12 nt, Staphylococcus aureus subsp. aureus Mu50
aaaaauggcgaa

SEQ ID NO: 3954326 - RNA, 21 nt, Staphylococcus aureus subsp. aureus Mu50
aaaaauggugauccgccuuga

SEQ ID NO: 3954327 - RNA, 17 nt, Staphylococcus aureus subsp. aureus Mu50
aaaaauguaaauaaaaa

SEQ ID NO: 3954328 - RNA, 12 nt, Staphylococcus aureus subsp. aureus Mu50
aaaaauuaaaaa

SEQ ID NO: 3954329 - RNA, 15 nt, Staphylococcus aureus subsp. aureus Mu50
aaaaauuaaaaaaca

SEQ ID NO: 3954330 - RNA, 16 nt, Staphylococcus aureus subsp. aureus Mu50
aaaaauuaaaaaacaa

SEQ ID NO: 3954331 - RNA, 14 nt, Staphylococcus aureus subsp. aureus Mu50
aaaaauuaaaaugu

SEQ ID NO: 3954332 - RNA, 18 nt, Staphylococcus aureus subsp. aureus Mu50
aaaaauuauuaaaaaaau

SEQ ID NO: 3954333 - RNA, 13 nt, Staphylococcus aureus subsp. aureus Mu50
aaaaauucauaau

SEQ ID NO: 3954334 - RNA, 16 nt, Staphylococcus aureus subsp. aureus Mu50
aaaaauugauauugca

SEQ ID NO: 3954335 - RNA, 19 nt, Staphylococcus aureus subsp. aureus Mu50
aaaaauugcaaugcuauca

SEQ ID NO: 3954336 - RNA, 21 nt, Staphylococcus aureus subsp. aureus Mu50
aaaaauugcaaugcuaucaug

SEQ ID NO: 3954337 - RNA, 18 nt, Staphylococcus aureus subsp. aureus Mu50
aaaaauugcuauauuagu

SEQ ID NO: 3954338 - RNA, 12 nt, Staphylococcus aureus subsp. aureus Mu50
aaaaauuguaaa

SEQ ID NO: 3954339 - RNA, 13 nt, Staphylococcus aureus subsp. aureus Mu50
aaaaauuuauuca

SEQ ID NO: 3954340 - RNA, 16 nt, Staphylococcus aureus subsp. aureus Mu50
aaaaauuucaaaaaua

SEQ ID NO: 3954341 - RNA, 12 nt, Staphylococcus aureus subsp. aureus Mu50
aaaaauuucaau

SEQ ID NO: 3954342 - RNA, 14 nt, Staphylococcus aureus subsp. aureus Mu50
aaaaauuucaauaa

SEQ ID NO: 3954343 - RNA, 22 nt, Staphylococcus aureus subsp. aureus Mu50
aaaaauuucgccucaucuaauu

SEQ ID NO: 3954344 - RNA, 15 nt, Staphylococcus aureus subsp. aureus Mu50
aaaacaaaaaauauc

SEQ ID NO: 3954345 - RNA, 16 nt, Staphylococcus aureus subsp. aureus Mu50
aaaacaaaaaauaucu

SEQ ID NO: 3954346 - RNA, 22 nt, Staphylococcus aureus subsp. aureus Mu50
aaaacaaaaacgguaauuucua

SEQ ID NO: 3954347 - RNA, 18 nt, Staphylococcus aureus subsp. aureus Mu50
aaaaguuguaauuuaaaa

SEQ ID NO: 3954348 - RNA, 19 nt, Staphylococcus aureus subsp. aureus Mu50
aaaaguuguaauuuaaaau

SEQ ID NO: 3954349 - RNA, 20 nt, Staphylococcus aureus subsp. aureus Mu50
aaaaguuuaagucaguccau

SEQ ID NO: 3954350 - RNA, 18 nt, Staphylococcus aureus subsp. aureus Mu50
aaaaguuuguauauucuu

SEQ ID NO: 3954351 - RNA, 13 nt, Staphylococcus aureus subsp. aureus Mu50
aaaauaaaaaaau

SEQ ID NO: 3954352 - RNA, 15 nt, Staphylococcus aureus subsp. aureus Mu50
aaaauaaaaaaccaa

SEQ ID NO: 3954353 - RNA, 17 nt, Staphylococcus aureus subsp. aureus Mu50
aaaauaaaaaaugcacu

SEQ ID NO: 3954354 - RNA, 15 nt, Staphylococcus aureus subsp. aureus Mu50
aaaauaaaaaugccg

SEQ ID NO: 3954355 - RNA, 14 nt, Staphylococcus aureus subsp. aureus Mu50
aaaauaaaacaaau

SEQ ID NO: 3954356 - RNA, 16 nt, Staphylococcus aureus subsp. aureus Mu50
aaaauaaaacgacuca

SEQ ID NO: 3954357 - RNA, 15 nt, Staphylococcus aureus subsp. aureus Mu50
aaaauaaaaucaacu

SEQ ID NO: 3954358 - RNA, 13 nt, Staphylococcus aureus subsp. aureus Mu50
aaaauaaaauggu

SEQ ID NO: 3954359 - RNA, 19 nt, Staphylococcus aureus subsp. aureus Mu50
aaaauaaaauuaacgagcu

SEQ ID NO: 3954360 - RNA, 23 nt, Staphylococcus aureus subsp. aureus Mu50
aaaauaaaucauacgagaaauua

SEQ ID NO: 3954361 - RNA, 13 nt, Staphylococcus aureus subsp. aureus Mu50
aaaauaacauguu

SEQ ID NO: 3954362 - RNA, 19 nt, Staphylococcus aureus subsp. aureus Mu50
aaaauaaccgcuuaauucu

SEQ ID NO: 3954363 - RNA, 19 nt, Staphylococcus aureus subsp. aureus Mu50
aaaauaacugcuaauuuuu

SEQ ID NO: 3954364 - RNA, 23 nt, Staphylococcus aureus subsp. aureus Mu50
aaaauaacugcuaauuuuuucau

SEQ ID NO: 3954365 - RNA, 16 nt, Staphylococcus aureus subsp. aureus Mu50
aaaauaauagauaaua

SEQ ID NO: 3954366 - RNA, 16 nt, Staphylococcus aureus subsp. aureus Mu50
aaaauaauaugaauuu

SEQ ID NO: 3954367 - RNA, 13 nt, Staphylococcus aureus subsp. aureus Mu50
aaaauaauuaaau

SEQ ID NO: 3954368 - RNA, 16 nt, Staphylococcus aureus subsp. aureus Mu50
aaaauaauuaaauaaa

SEQ ID NO: 3954369 - RNA, 15 nt, Staphylococcus aureus subsp. aureus Mu50
aaaauaauuguucuu

SEQ ID NO: 3954370 - RNA, 15 nt, Staphylococcus aureus subsp. aureus Mu50
aaaauaauuuuauau

SEQ ID NO: 3954371 - RNA, 15 nt, Staphylococcus aureus subsp. aureus Mu50
aaaauacaaauuaca

SEQ ID NO: 3954372 - RNA, 13 nt, Staphylococcus aureus subsp. aureus Mu50
aaaauacauaaua

SEQ ID NO: 3954373 - RNA, 19 nt, Staphylococcus aureus subsp. aureus Mu50
aaaauacauaauuaacuuu

SEQ ID NO: 3954374 - RNA, 16 nt, Staphylococcus aureus subsp. aureus Mu50
aaaauacgauuuguuc

SEQ ID NO: 3954375 - RNA, 15 nt, Staphylococcus aureus subsp. aureus Mu50
aaaauacuauacuga

SEQ ID NO: 3954376 - RNA, 16 nt, Staphylococcus aureus subsp. aureus Mu50
aaaauacuauacugau

SEQ ID NO: 3954377 - RNA, 19 nt, Staphylococcus aureus subsp. aureus Mu50
aaaauacucccuucaacau

SEQ ID NO: 3954378 - RNA, 13 nt, Staphylococcus aureus subsp. aureus Mu50
aaaauagaaaaau

SEQ ID NO: 3954379 - RNA, 14 nt, Staphylococcus aureus subsp. aureus Mu50
aaaauagaaaaauu

SEQ ID NO: 3954380 - RNA, 19 nt, Staphylococcus aureus subsp. aureus Mu50
aaaauagaaaaauuucaaa

SEQ ID NO: 3954381 - RNA, 13 nt, Staphylococcus aureus subsp. aureus Mu50
aaaauagaaagaa

SEQ ID NO: 3954382 - RNA, 20 nt, Staphylococcus aureus subsp. aureus Mu50
aaaauagccauauucauauu

SEQ ID NO: 3954383 - RNA, 15 nt, Staphylococcus aureus subsp. aureus Mu50
aaaauagcuauuaaa

SEQ ID NO: 3954384 - RNA, 16 nt, Staphylococcus aureus subsp. aureus Mu50
aaaauagcuauuaaaa

SEQ ID NO: 3954385 - RNA, 20 nt, Staphylococcus aureus subsp. aureus Mu50
aaaauagcuauuaaaauaga

SEQ ID NO: 3954386 - RNA, 16 nt, Staphylococcus aureus subsp. aureus Mu50
aaaauaguucuuuaaa

SEQ ID NO: 3954387 - RNA, 21 nt, Staphylococcus aureus subsp. aureus Mu50
aaaauaguucuuuaaauuaua

SEQ ID NO: 3954388 - RNA, 24 nt, Staphylococcus aureus subsp. aureus Mu50
aaaauaguucuuuaaauuauauac

SEQ ID NO: 3954389 - RNA, 21 nt, Staphylococcus aureus subsp. aureus Mu50
aaaauauagcuauuacuauaa

SEQ ID NO: 3954390 - RNA, 22 nt, Staphylococcus aureus subsp. aureus Mu50
aaaauauaguggugguacuuuu

SEQ ID NO: 3954391 - RNA, 15 nt, Staphylococcus aureus subsp. aureus Mu50
aaaauauaugaauaa

SEQ ID NO: 3954392 - RNA, 20 nt, Staphylococcus aureus subsp. aureus Mu50
aaaauaucaaaauauaaaau

SEQ ID NO: 3954393 - RNA, 23 nt, Staphylococcus aureus subsp. aureus Mu50
aaaauaucaauuuauuauuaacu

SEQ ID NO: 3954394 - RNA, 12 nt, Staphylococcus aureus subsp. aureus Mu50
aaaauaucauuu

SEQ ID NO: 3954395 - RNA, 14 nt, Staphylococcus aureus subsp. aureus Mu50
aaaauaucauuucu

SEQ ID NO: 3954396 - RNA, 20 nt, Staphylococcus aureus subsp. aureus Mu50
aaaauaugauugcaaauuau

SEQ ID NO: 3954397 - RNA, 17 nt, Staphylococcus aureus subsp. aureus Mu50
aaaauaugauuuaaaau

SEQ ID NO: 3954398 - RNA, 22 nt, Staphylococcus aureus subsp. aureus Mu50
aaaauauuacuaacaaccguuu

SEQ ID NO: 3954399 - RNA, 15 nt, Staphylococcus aureus subsp. aureus Mu50
aaaauauugaauaau

SEQ ID NO: 3954400 - RNA, 18 nt, Staphylococcus aureus subsp. aureus Mu50
aaaauauuuaaacuagua

SEQ ID NO: 3954401 - RNA, 14 nt, Staphylococcus aureus subsp. aureus Mu50
aaaauauuuacauu

SEQ ID NO: 3954402 - RNA, 14 nt, Staphylococcus aureus subsp. aureus Mu50
aaaaucaaagaggc

SEQ ID NO: 3954403 - RNA, 21 nt, Staphylococcus aureus subsp. aureus Mu50
aaaaucaaagaggcuuuaaaa

SEQ ID NO: 3954404 - RNA, 16 nt, Staphylococcus aureus subsp. aureus Mu50
aaaaucaacuuuucua

SEQ ID NO: 3954405 - RNA, 18 nt, Staphylococcus aureus subsp. aureus Mu50
aaaaucacgcuaacauuc

SEQ ID NO: 3954406 - RNA, 19 nt, Staphylococcus aureus subsp. aureus Mu50
aaaaucauccauaaaaaua

SEQ ID NO: 3954407 - RNA, 18 nt, Staphylococcus aureus subsp. aureus Mu50
aaaaucaucuuaacaacu

SEQ ID NO: 3954408 - RNA, 21 nt, Staphylococcus aureus subsp. aureus Mu50
aaaaucaucuuaacaacuuua

SEQ ID NO: 3954409 - RNA, 15 nt, Staphylococcus aureus subsp. aureus Mu50
aaaaucauuaauaau

SEQ ID NO: 3954410 - RNA, 15 nt, Staphylococcus aureus subsp. aureus Mu50
aaaauccugaaauua

SEQ ID NO: 3954411 - RNA, 22 nt, Staphylococcus aureus subsp. aureus Mu50
aaaaucgaacaaaugaaaaagu

SEQ ID NO: 3954412 - RNA, 18 nt, Staphylococcus aureus subsp. aureus Mu50
aaaaucggcuuucuaagu

SEQ ID NO: 3954413 - RNA, 20 nt, Staphylococcus aureus subsp. aureus Mu50
aaaaucgguuugauuaaaau

SEQ ID NO: 3954414 - RNA, 20 nt, Staphylococcus aureus subsp. aureus Mu50
aaaaucguuauaaguacaaa

SEQ ID NO: 3954415 - RNA, 23 nt, Staphylococcus aureus subsp. aureus Mu50
aaaaucucauaauaauucaguaa

SEQ ID NO: 3954416 - RNA, 20 nt, Staphylococcus aureus subsp. aureus Mu50
aaaaucucgacacuauacca

SEQ ID NO: 3954417 - RNA, 13 nt, Staphylococcus aureus subsp. aureus Mu50
aaaaucugcuuua

SEQ ID NO: 3954418 - RNA, 22 nt, Staphylococcus aureus subsp. aureus Mu50
aaaaucugcuuuauuuuaucau

SEQ ID NO: 3954419 - RNA, 17 nt, Staphylococcus aureus subsp. aureus Mu50
aaaaucuuuaacauuug

SEQ ID NO: 3954420 - RNA, 13 nt, Staphylococcus aureus subsp. aureus Mu50
aaaaugaaaugaa

SEQ ID NO: 3954421 - RNA, 23 nt, Staphylococcus aureus subsp. aureus Mu50
aaaaugaagaauacaaauauuaa

SEQ ID NO: 3954422 - RNA, 18 nt, Staphylococcus aureus subsp. aureus Mu50
aaaaugaauaauugcuaa

SEQ ID NO: 3954423 - RNA, 22 nt, Staphylococcus aureus subsp. aureus Mu50
aaaaugaauauaauaacaauca

SEQ ID NO: 3954424 - RNA, 12 nt, Staphylococcus aureus subsp. aureus Mu50
aaaaugaaugaa

SEQ ID NO: 3954425 - RNA, 19 nt, Staphylococcus aureus subsp. aureus Mu50
aaaaugaauguuaagacau

SEQ ID NO: 3954426 - RNA, 22 nt, Staphylococcus aureus subsp. aureus Mu50
aaaaugacuaccuguuggcuuu

SEQ ID NO: 3954427 - RNA, 15 nt, Staphylococcus aureus subsp. aureus Mu50
aaaaugaguacaaca

SEQ ID NO: 3954428 - RNA, 17 nt, Staphylococcus aureus subsp. aureus Mu50
aaaaugaguacaacaua

SEQ ID NO: 3954429 - RNA, 23 nt, Staphylococcus aureus subsp. aureus Mu50
aaaaugcaauuuuucacuuauaa

SEQ ID NO: 3954430 - RNA, 13 nt, Staphylococcus aureus subsp. aureus Mu50
aaaaugcacugag

SEQ ID NO: 3954431 - RNA, 15 nt, Staphylococcus aureus subsp. aureus Mu50
aaaaugcauagcucu

SEQ ID NO: 3954432 - RNA, 16 nt, Staphylococcus aureus subsp. aureus Mu50
aaaaugcauuacuacu

SEQ ID NO: 3954433 - RNA, 13 nt, Staphylococcus aureus subsp. aureus Mu50
aaaaugccaacua

SEQ ID NO: 3954434 - RNA, 21 nt, Staphylococcus aureus subsp. aureus Mu50
aaaaugcgcuuccaauuuaaa

SEQ ID NO: 3954435 - RNA, 19 nt, Staphylococcus aureus subsp. aureus Mu50
aaacauaccugcauauuca

SEQ ID NO: 3954436 - RNA, 21 nt, Staphylococcus aureus subsp. aureus Mu50
aaacaucauuucugaaguuau

SEQ ID NO: 3954437 - RNA, 21 nt, Staphylococcus aureus subsp. aureus Mu50
aaacaugcuuggacauauacu

SEQ ID NO: 3954438 - RNA, 20 nt, Staphylococcus aureus subsp. aureus Mu50
aaacauggucaaucacuccu

SEQ ID NO: 3954439 - RNA, 23 nt, Staphylococcus aureus subsp. aureus Mu50
aaacaugguuuucuuuuuaucau

SEQ ID NO: 3954440 - RNA, 19 nt, Staphylococcus aureus subsp. aureus Mu50
aaacauguacaauuuuuaa

SEQ ID NO: 3954441 - RNA, 21 nt, Staphylococcus aureus subsp. aureus Mu50
aaacauguacaauuuuuaaaa

SEQ ID NO: 3954442 - RNA, 22 nt, Staphylococcus aureus subsp. aureus Mu50
aaacauguguaugaucaagcug

SEQ ID NO: 3954443 - RNA, 15 nt, Staphylococcus aureus subsp. aureus Mu50
aaacauuaaucuaua

SEQ ID NO: 3954444 - RNA, 17 nt, Staphylococcus aureus subsp. aureus Mu50
aaacauuaaucuauaua

SEQ ID NO: 3954445 - RNA, 23 nt, Staphylococcus aureus subsp. aureus Mu50
aaacauuaaucuauauaaaaacu

SEQ ID NO: 3954446 - RNA, 19 nt, Staphylococcus aureus subsp. aureus Mu50
aaacauugcuuaacuuccu

SEQ ID NO: 3954447 - RNA, 22 nt, Staphylococcus aureus subsp. aureus Mu50
aaacauugcuuaacuuccuuuu

SEQ ID NO: 3954448 - RNA, 23 nt, Staphylococcus aureus subsp. aureus Mu50
aaacauuuauauagauugccauu

SEQ ID NO: 3954449 - RNA, 22 nt, Staphylococcus aureus subsp. aureus Mu50
aaacauuucgguaugauauuuc

SEQ ID NO: 3954450 - RNA, 23 nt, Staphylococcus aureus subsp. aureus Mu50
aaacauuucgguaugauauuucu

SEQ ID NO: 3954451 - RNA, 13 nt, Staphylococcus aureus subsp. aureus Mu50
aaacauuuuugaa

SEQ ID NO: 3954452 - RNA, 14 nt, Staphylococcus aureus subsp. aureus Mu50
aaaccaauaauccg

SEQ ID NO: 3954453 - RNA, 13 nt, Staphylococcus aureus subsp. aureus Mu50
aaaccaauacgaa

SEQ ID NO: 3954454 - RNA, 18 nt, Staphylococcus aureus subsp. aureus Mu50
aaaccacgcacaucuaag

SEQ ID NO: 3954455 - RNA, 19 nt, Staphylococcus aureus subsp. aureus Mu50
aaaccauaaguaaaacugc

SEQ ID NO: 3954456 - RNA, 17 nt, Staphylococcus aureus subsp. aureus Mu50
aaaccauugaaugaauc

SEQ ID NO: 3954457 - RNA, 21 nt, Staphylococcus aureus subsp. aureus Mu50
aaaccauuuucaagaggacaa

SEQ ID NO: 3954458 - RNA, 17 nt, Staphylococcus aureus subsp. aureus Mu50
aaaccgaggaaauccuu

SEQ ID NO: 3954459 - RNA, 22 nt, Staphylococcus aureus subsp. aureus Mu50
aaaccgccaacuaauguuaaaa

SEQ ID NO: 3954460 - RNA, 20 nt, Staphylococcus aureus subsp. aureus Mu50
aaaccguauagucauuacau

SEQ ID NO: 3954461 - RNA, 16 nt, Staphylococcus aureus subsp. aureus Mu50
aaaccguauuauugga

SEQ ID NO: 3954462 - RNA, 23 nt, Staphylococcus aureus subsp. aureus Mu50
aaaccgugagggacgucaucaug

SEQ ID NO: 3954463 - RNA, 15 nt, Staphylococcus aureus subsp. aureus Mu50
aaaccuaaucuacca

SEQ ID NO: 3954464 - RNA, 13 nt, Staphylococcus aureus subsp. aureus Mu50
aaaccuacuaaua

SEQ ID NO: 3954465 - RNA, 16 nt, Staphylococcus aureus subsp. aureus Mu50
aaaccuagggauaauu

SEQ ID NO: 3954466 - RNA, 20 nt, Staphylococcus aureus subsp. aureus Mu50
aaaccuauucccaaaaugau

SEQ ID NO: 3954467 - RNA, 20 nt, Staphylococcus aureus subsp. aureus Mu50
aaaccucaacauuaaaaugu

SEQ ID NO: 3954468 - RNA, 12 nt, Staphylococcus aureus subsp. aureus Mu50
aaaccucuaaau

SEQ ID NO: 3954469 - RNA, 16 nt, Staphylococcus aureus subsp. aureus Mu50
aaaccugggacauuaa

SEQ ID NO: 3954470 - RNA, 17 nt, Staphylococcus aureus subsp. aureus Mu50
aaaccugggacauuaau

SEQ ID NO: 3954471 - RNA, 17 nt, Staphylococcus aureus subsp. aureus Mu50
aaaccuuacccaaaaaa

SEQ ID NO: 3954472 - RNA, 21 nt, Staphylococcus aureus subsp. aureus Mu50
aaaccuuggcuucauguucua

SEQ ID NO: 3954473 - RNA, 15 nt, Staphylococcus aureus subsp. aureus Mu50
aaaccuuuucaaauu

SEQ ID NO: 3954474 - RNA, 17 nt, Staphylococcus aureus subsp. aureus Mu50
aaacgacauuguuuagu

SEQ ID NO: 3954475 - RNA, 19 nt, Staphylococcus aureus subsp. aureus Mu50
aaacgacucauuauaaaug

SEQ ID NO: 3954476 - RNA, 16 nt, Staphylococcus aureus subsp. aureus Mu50
aaacgagacaucaucu

SEQ ID NO: 3954477 - RNA, 19 nt, Staphylococcus aureus subsp. aureus Mu50
aaacgauaagaauuaacaa

SEQ ID NO: 3954478 - RNA, 14 nt, Staphylococcus aureus subsp. aureus Mu50
aaacgauaauaaua

SEQ ID NO: 3954479 - RNA, 15 nt, Staphylococcus aureus subsp. aureus Mu50
aaacgauaauaauaa

SEQ ID NO: 3954480 - RNA, 13 nt, Staphylococcus aureus subsp. aureus Mu50
aaacgauacugcu

SEQ ID NO: 3954481 - RNA, 17 nt, Staphylococcus aureus subsp. aureus Mu50
aaacgauucauuauaug

SEQ ID NO: 3954482 - RNA, 20 nt, Staphylococcus aureus subsp. aureus Mu50
aaacgauugauagacauaac

SEQ ID NO: 3954483 - RNA, 21 nt, Staphylococcus aureus subsp. aureus Mu50
aaacgcacuaucaaugacauc

SEQ ID NO: 3954484 - RNA, 19 nt, Staphylococcus aureus subsp. aureus Mu50
aaacgcacuauuuuuauaa

SEQ ID NO: 3954485 - RNA, 14 nt, Staphylococcus aureus subsp. aureus Mu50
aaacgcugauuuaa

SEQ ID NO: 3954486 - RNA, 13 nt, Staphylococcus aureus subsp. aureus Mu50
aaacgcuucauag

SEQ ID NO: 3954487 - RNA, 13 nt, Staphylococcus aureus subsp. aureus Mu50
aaacggaaauaac

SEQ ID NO: 3954488 - RNA, 12 nt, Staphylococcus aureus subsp. aureus Mu50
aaacggagcaac

SEQ ID NO: 3954489 - RNA, 16 nt, Staphylococcus aureus subsp. aureus Mu50
aaacguaucauuuaaa

SEQ ID NO: 3954490 - RNA, 22 nt, Staphylococcus aureus subsp. aureus Mu50
aaacguccaaacacaaauaaag

SEQ ID NO: 3954491 - RNA, 22 nt, Staphylococcus aureus subsp. aureus Mu50
aaacgucgugucugaauacacg

SEQ ID NO: 3954492 - RNA, 13 nt, Staphylococcus aureus subsp. aureus Mu50
aaacgugauuuua

SEQ ID NO: 3954493 - RNA, 22 nt, Staphylococcus aureus subsp. aureus Mu50
aaacgugcaaauaaaaaaguua

SEQ ID NO: 3954494 - RNA, 18 nt, Staphylococcus aureus subsp. aureus Mu50
aaacguuaguacuuugau

SEQ ID NO: 3954495 - RNA, 14 nt, Staphylococcus aureus subsp. aureus Mu50
aaacguucaaucgu

SEQ ID NO: 3954496 - RNA, 18 nt, Staphylococcus aureus subsp. aureus Mu50
aaacguugaguauuacuu

SEQ ID NO: 3954497 - RNA, 14 nt, Staphylococcus aureus subsp. aureus Mu50
aaacuaaauuaaaa

SEQ ID NO: 3954498 - RNA, 15 nt, Staphylococcus aureus subsp. aureus Mu50
aaacuaaauuaaaag

SEQ ID NO: 3954499 - RNA, 16 nt, Staphylococcus aureus subsp. aureus Mu50
aaacuaaauuaaaagu

SEQ ID NO: 3954500 - RNA, 17 nt, Staphylococcus aureus subsp. aureus Mu50
aaacuacaaguggauau

SEQ ID NO: 3954501 - RNA, 15 nt, Staphylococcus aureus subsp. aureus Mu50
aaacuacgaauucuc

SEQ ID NO: 3954502 - RNA, 13 nt, Staphylococcus aureus subsp. aureus Mu50
aaacuagcaguaa

SEQ ID NO: 3954503 - RNA, 19 nt, Staphylococcus aureus subsp. aureus Mu50
aaacuauaauaaagauuau

SEQ ID NO: 3954504 - RNA, 21 nt, Staphylococcus aureus subsp. aureus Mu50
aaacuauaauaauuggaauca

SEQ ID NO: 3954505 - RNA, 15 nt, Staphylococcus aureus subsp. aureus Mu50
aaacuaucugauuaa

SEQ ID NO: 3954506 - RNA, 14 nt, Staphylococcus aureus subsp. aureus Mu50
aaacuauuuuaaaa

SEQ ID NO: 3954507 - RNA, 19 nt, Staphylococcus aureus subsp. aureus Mu50
aaacuauuuuaaaaaugcu

SEQ ID NO: 3954508 - RNA, 22 nt, Staphylococcus aureus subsp. aureus Mu50
aaacucgcccccguaauaauuu

SEQ ID NO: 3954509 - RNA, 16 nt, Staphylococcus aureus subsp. aureus Mu50
aaacucuaaaaguugu

SEQ ID NO: 3954510 - RNA, 21 nt, Staphylococcus aureus subsp. aureus Mu50
aaacucuaaaaguuguaauuu

SEQ ID NO: 3954511 - RNA, 14 nt, Staphylococcus aureus subsp. aureus Mu50
aaacucuguuuguc

SEQ ID NO: 3954512 - RNA, 15 nt, Staphylococcus aureus subsp. aureus Mu50
aaacucuuacaagua

SEQ ID NO: 3954513 - RNA, 14 nt, Staphylococcus aureus subsp. aureus Mu50
aaacugaaucgauu

SEQ ID NO: 3954514 - RNA, 15 nt, Staphylococcus aureus subsp. aureus Mu50
aaacugaguucaauu

SEQ ID NO: 3954515 - RNA, 22 nt, Staphylococcus aureus subsp. aureus Mu50
aaacugaguucaauuaaauuau

SEQ ID NO: 3954516 - RNA, 15 nt, Staphylococcus aureus subsp. aureus Mu50
aaacuuaaaaaugaa

SEQ ID NO: 3954517 - RNA, 17 nt, Staphylococcus aureus subsp. aureus Mu50
aaacuuacauuacauau

SEQ ID NO: 3954518 - RNA, 10 nt, Staphylococcus aureus subsp. aureus Mu50
aaacuuauaa

SEQ ID NO: 3954519 - RNA, 15 nt, Staphylococcus aureus subsp. aureus Mu50
aaacuuauaacuuua

SEQ ID NO: 3954520 - RNA, 16 nt, Staphylococcus aureus subsp. aureus Mu50
aaacuuauaacuuuau

SEQ ID NO: 3954521 - RNA, 22 nt, Staphylococcus aureus subsp. aureus Mu50
aaacuuccugcuuuuuuuauaa

SEQ ID NO: 3954522 - RNA, 23 nt, Staphylococcus aureus subsp. aureus Mu50
aaaggugauauuugcuagucaua

SEQ ID NO: 3954523 - RNA, 15 nt, Staphylococcus aureus subsp. aureus Mu50
aaaggugugggcuuu

SEQ ID NO: 3954524 - RNA, 23 nt, Staphylococcus aureus subsp. aureus Mu50
aaaggugugggcuuuauuaucau

SEQ ID NO: 3954525 - RNA, 14 nt, Staphylococcus aureus subsp. aureus Mu50
aaagguuaaauauu

SEQ ID NO: 3954526 - RNA, 23 nt, Staphylococcus aureus subsp. aureus Mu50
aaagguuguuuuucaucauuaaa

SEQ ID NO: 3954527 - RNA, 12 nt, Staphylococcus aureus subsp. aureus Mu50
aaaguaaaauau

SEQ ID NO: 3954528 - RNA, 18 nt, Staphylococcus aureus subsp. aureus Mu50
aaaguaaaauauacuuga

SEQ ID NO: 3954529 - RNA, 13 nt, Staphylococcus aureus subsp. aureus Mu50
aaaguaaauuaca

SEQ ID NO: 3954530 - RNA, 13 nt, Staphylococcus aureus subsp. aureus Mu50
aaaguaaguaaaa

SEQ ID NO: 3954531 - RNA, 15 nt, Staphylococcus aureus subsp. aureus Mu50
aaaguaaguaaaaua

SEQ ID NO: 3954532 - RNA, 13 nt, Staphylococcus aureus subsp. aureus Mu50
aaaguaauaugag

SEQ ID NO: 3954533 - RNA, 13 nt, Staphylococcus aureus subsp. aureus Mu50
aaaguaaugcugu

SEQ ID NO: 3954534 - RNA, 17 nt, Staphylococcus aureus subsp. aureus Mu50
aaaguaauuaaauacuu

SEQ ID NO: 3954535 - RNA, 21 nt, Staphylococcus aureus subsp. aureus Mu50
aaaguaccuaaaauagaaaaa

SEQ ID NO: 3954536 - RNA, 12 nt, Staphylococcus aureus subsp. aureus Mu50
aaaguacucaag

SEQ ID NO: 3954537 - RNA, 13 nt, Staphylococcus aureus subsp. aureus Mu50
aaaguacuuacaa

SEQ ID NO: 3954538 - RNA, 15 nt, Staphylococcus aureus subsp. aureus Mu50
aaaguacuuacaaau

SEQ ID NO: 3954539 - RNA, 19 nt, Staphylococcus aureus subsp. aureus Mu50
aaaguacuuacaaauauac

SEQ ID NO: 3954540 - RNA, 14 nt, Staphylococcus aureus subsp. aureus Mu50
aaaguacuuuaaaa

SEQ ID NO: 3954541 - RNA, 19 nt, Staphylococcus aureus subsp. aureus Mu50
aaaguacuuuaaaauugua

SEQ ID NO: 3954542 - RNA, 13 nt, Staphylococcus aureus subsp. aureus Mu50
aaaguagauauug

SEQ ID NO: 3954543 - RNA, 16 nt, Staphylococcus aureus subsp. aureus Mu50
aaaguauaaaccaaau

SEQ ID NO: 3954544 - RNA, 14 nt, Staphylococcus aureus subsp. aureus Mu50
aaaguauaugaauc

SEQ ID NO: 3954545 - RNA, 15 nt, Staphylococcus aureus subsp. aureus Mu50
aaaguauauugcuua

SEQ ID NO: 3954546 - RNA, 22 nt, Staphylococcus aureus subsp. aureus Mu50
aaaguaucgccaaucuauugca

SEQ ID NO: 3954547 - RNA, 15 nt, Staphylococcus aureus subsp. aureus Mu50
aaaguaucuaugaaa

SEQ ID NO: 3954548 - RNA, 21 nt, Staphylococcus aureus subsp. aureus Mu50
aaaguaucuaugaaauuuuuu

SEQ ID NO: 3954549 - RNA, 22 nt, Staphylococcus aureus subsp. aureus Mu50
aaaguaucuaugaaauuuuuua

SEQ ID NO: 3954550 - RNA, 15 nt, Staphylococcus aureus subsp. aureus Mu50
aaaguaugaguuauu

SEQ ID NO: 3954551 - RNA, 14 nt, Staphylococcus aureus subsp. aureus Mu50
aaaguauuacuuua

SEQ ID NO: 3954552 - RNA, 21 nt, Staphylococcus aureus subsp. aureus Mu50
aaaguauuagauauauuugaa

SEQ ID NO: 3954553 - RNA, 13 nt, Staphylococcus aureus subsp. aureus Mu50
aaagucaaaaaau

SEQ ID NO: 3954554 - RNA, 14 nt, Staphylococcus aureus subsp. aureus Mu50
aaagucaauuuaaa

SEQ ID NO: 3954555 - RNA, 18 nt, Staphylococcus aureus subsp. aureus Mu50
aaagucacaguguaauca

SEQ ID NO: 3954556 - RNA, 20 nt, Staphylococcus aureus subsp. aureus Mu50
aaagucauaggcuugccaau

SEQ ID NO: 3954557 - RNA, 15 nt, Staphylococcus aureus subsp. aureus Mu50
aaagucgucucaaua

SEQ ID NO: 3954558 - RNA, 20 nt, Staphylococcus aureus subsp. aureus Mu50
aaagucguuguugaaauuaa

SEQ ID NO: 3954559 - RNA, 15 nt, Staphylococcus aureus subsp. aureus Mu50
aaagucugucugaau

SEQ ID NO: 3954560 - RNA, 21 nt, Staphylococcus aureus subsp. aureus Mu50
aaagucuguugguuuaucagc

SEQ ID NO: 3954561 - RNA, 14 nt, Staphylococcus aureus subsp. aureus Mu50
aaagucuucaucuu

SEQ ID NO: 3954562 - RNA, 24 nt, Staphylococcus aureus subsp. aureus Mu50
aaagucuuucucggcgauaaaaug

SEQ ID NO: 3954563 - RNA, 19 nt, Staphylococcus aureus subsp. aureus Mu50
aaagugaaaacuucucuau

SEQ ID NO: 3954564 - RNA, 13 nt, Staphylococcus aureus subsp. aureus Mu50
aaagugaauugua

SEQ ID NO: 3954565 - RNA, 22 nt, Staphylococcus aureus subsp. aureus Mu50
aaagugauaauuaaaauaagau

SEQ ID NO: 3954566 - RNA, 14 nt, Staphylococcus aureus subsp. aureus Mu50
aaagugauucccaa

SEQ ID NO: 3954567 - RNA, 14 nt, Staphylococcus aureus subsp. aureus Mu50
aaagugauuuaaaa

SEQ ID NO: 3954568 - RNA, 16 nt, Staphylococcus aureus subsp. aureus Mu50
aaagugcgauuaucag

SEQ ID NO: 3954569 - RNA, 18 nt, Staphylococcus aureus subsp. aureus Mu50
aaagugcgguuauuuaua

SEQ ID NO: 3954570 - RNA, 15 nt, Staphylococcus aureus subsp. aureus Mu50
aaagugguuuuacug

SEQ ID NO: 3954571 - RNA, 21 nt, Staphylococcus aureus subsp. aureus Mu50
aaaguguaauguuccccugaa

SEQ ID NO: 3954572 - RNA, 21 nt, Staphylococcus aureus subsp. aureus Mu50
aaagugucuaacgcuguuuca

SEQ ID NO: 3954573 - RNA, 16 nt, Staphylococcus aureus subsp. aureus Mu50
aaaguguuaugaauua

SEQ ID NO: 3954574 - RNA, 17 nt, Staphylococcus aureus subsp. aureus Mu50
aaaguguuaugaauuag

SEQ ID NO: 3954575 - RNA, 13 nt, Staphylococcus aureus subsp. aureus Mu50
aaaguguuucaac

SEQ ID NO: 3954576 - RNA, 15 nt, Staphylococcus aureus subsp. aureus Mu50
aaaguguuucaacau

SEQ ID NO: 3954577 - RNA, 14 nt, Staphylococcus aureus subsp. aureus Mu50
aaaguuaaagacua

SEQ ID NO: 3954578 - RNA, 17 nt, Staphylococcus aureus subsp. aureus Mu50
aaaguuacaugcucuuu

SEQ ID NO: 3954579 - RNA, 20 nt, Staphylococcus aureus subsp. aureus Mu50
aaaguuagacuaaaaaacua

SEQ ID NO: 3954580 - RNA, 14 nt, Staphylococcus aureus subsp. aureus Mu50
aaaguuauaaauua

SEQ ID NO: 3954581 - RNA, 15 nt, Staphylococcus aureus subsp. aureus Mu50
aaaguuauaaauuau

SEQ ID NO: 3954582 - RNA, 14 nt, Staphylococcus aureus subsp. aureus Mu50
aaaguuauauaaau

SEQ ID NO: 3954583 - RNA, 18 nt, Staphylococcus aureus subsp. aureus Mu50
aaaguuauaucaucaaca

SEQ ID NO: 3954584 - RNA, 16 nt, Staphylococcus aureus subsp. aureus Mu50
aaaguuaucugcuuuu

SEQ ID NO: 3954585 - RNA, 18 nt, Staphylococcus aureus subsp. aureus Mu50
aaaguucauuacaaacuu

SEQ ID NO: 3954586 - RNA, 17 nt, Staphylococcus aureus subsp. aureus Mu50
aaaguuguaauuuaaaa

SEQ ID NO: 3954587 - RNA, 12 nt, Staphylococcus aureus subsp. aureus Mu50
aaaguuuaaagu

SEQ ID NO: 3954588 - RNA, 14 nt, Staphylococcus aureus subsp. aureus Mu50
aaaguuuauacuua

SEQ ID NO: 3954589 - RNA, 16 nt, Staphylococcus aureus subsp. aureus Mu50
aaaguuuauacuuaau

SEQ ID NO: 3954590 - RNA, 15 nt, Staphylococcus aureus subsp. aureus Mu50
aaaguuucccaagca

SEQ ID NO: 3954591 - RNA, 11 nt, Staphylococcus aureus subsp. aureus Mu50
aaaguuucucc

SEQ ID NO: 3954592 - RNA, 13 nt, Staphylococcus aureus subsp. aureus Mu50
aaaguuucuccac

SEQ ID NO: 3954593 - RNA, 15 nt, Staphylococcus aureus subsp. aureus Mu50
aaaguuucuccaccu

SEQ ID NO: 3954594 - RNA, 16 nt, Staphylococcus aureus subsp. aureus Mu50
aaaguuuguauauucu

SEQ ID NO: 3954595 - RNA, 22 nt, Staphylococcus aureus subsp. aureus Mu50
aaaguuuguauauucuuuuuaa

SEQ ID NO: 3954596 - RNA, 18 nt, Staphylococcus aureus subsp. aureus Mu50
aaaguuuucauuuaacau

SEQ ID NO: 3954597 - RNA, 22 nt, Staphylococcus aureus subsp. aureus Mu50
aaaguuuucauuuaacauguau

SEQ ID NO: 3954598 - RNA, 20 nt, Staphylococcus aureus subsp. aureus Mu50
aaaguuuuguucaauaugau

SEQ ID NO: 3954599 - RNA, 13 nt, Staphylococcus aureus subsp. aureus Mu50
aaauaaaaaaugc

SEQ ID NO: 3954600 - RNA, 12 nt, Staphylococcus aureus subsp. aureus Mu50
aaauaaaacaag

SEQ ID NO: 3954601 - RNA, 13 nt, Staphylococcus aureus subsp. aureus Mu50
aaauaaaacaaga

SEQ ID NO: 3954602 - RNA, 21 nt, Staphylococcus aureus subsp. aureus Mu50
aaauaaaacgacucauuauaa

SEQ ID NO: 3954603 - RNA, 14 nt, Staphylococcus aureus subsp. aureus Mu50
aaauaaaauuaaaa

SEQ ID NO: 3954604 - RNA, 15 nt, Staphylococcus aureus subsp. aureus Mu50
aaauaaaauuaaaac

SEQ ID NO: 3954605 - RNA, 22 nt, Staphylococcus aureus subsp. aureus Mu50
aaauaaacgauugauuaucaua

SEQ ID NO: 3954606 - RNA, 14 nt, Staphylococcus aureus subsp. aureus Mu50
aaauaaauaagcaa

SEQ ID NO: 3954607 - RNA, 16 nt, Staphylococcus aureus subsp. aureus Mu50
aaauaaauacaauaga

SEQ ID NO: 3954608 - RNA, 22 nt, Staphylococcus aureus subsp. aureus Mu50
aaauaaaugacuucacauuuau

SEQ ID NO: 3954609 - RNA, 12 nt, Staphylococcus aureus subsp. aureus Mu50
aaauaaauuaaa

SEQ ID NO: 3954610 - RNA, 15 nt, Staphylococcus aureus subsp. aureus Mu50
aaauauauuuguaua

SEQ ID NO: 3954611 - RNA, 17 nt, Staphylococcus aureus subsp. aureus Mu50
aaauaucaguaauaaua

SEQ ID NO: 3954612 - RNA, 21 nt, Staphylococcus aureus subsp. aureus Mu50
aaauaucaguaauaauacgcu

SEQ ID NO: 3954613 - RNA, 19 nt, Staphylococcus aureus subsp. aureus Mu50
aaauaucauaccguacaaa

SEQ ID NO: 3954614 - RNA, 18 nt, Staphylococcus aureus subsp. aureus Mu50
aaauaucaugcaaaacua

SEQ ID NO: 3954615 - RNA, 21 nt, Staphylococcus aureus subsp. aureus Mu50
aaauauccuggaauauuaaca

SEQ ID NO: 3954616 - RNA, 20 nt, Staphylococcus aureus subsp. aureus Mu50
aaauaucgagaggguacacu

SEQ ID NO: 3954617 - RNA, 17 nt, Staphylococcus aureus subsp. aureus Mu50
aaauaucuaaacaauuc

SEQ ID NO: 3954618 - RNA, 16 nt, Staphylococcus aureus subsp. aureus Mu50
aaauaucuuuuucuaa

SEQ ID NO: 3954619 - RNA, 18 nt, Staphylococcus aureus subsp. aureus Mu50
aaauaucuuuuuguuuau

SEQ ID NO: 3954620 - RNA, 18 nt, Staphylococcus aureus subsp. aureus Mu50
aaauaugaauaaugcaau

SEQ ID NO: 3954621 - RNA, 16 nt, Staphylococcus aureus subsp. aureus Mu50
aaauaugauguuaaaa

SEQ ID NO: 3954622 - RNA, 18 nt, Staphylococcus aureus subsp. aureus Mu50
aaauaugauguuaaaaaa

SEQ ID NO: 3954623 - RNA, 13 nt, Staphylococcus aureus subsp. aureus Mu50
aaauaugauuuaa

SEQ ID NO: 3954624 - RNA, 20 nt, Staphylococcus aureus subsp. aureus Mu50
aaauaugauuuaaaauauaa

SEQ ID NO: 3954625 - RNA, 15 nt, Staphylococcus aureus subsp. aureus Mu50
aaauauggauuuuga

SEQ ID NO: 3954626 - RNA, 21 nt, Staphylococcus aureus subsp. aureus Mu50
aaauaugguuucuuauuaaau

SEQ ID NO: 3954627 - RNA, 22 nt, Staphylococcus aureus subsp. aureus Mu50
aaauaugguuucuuauuaaaua

SEQ ID NO: 3954628 - RNA, 23 nt, Staphylococcus aureus subsp. aureus Mu50
aaauauguaaucagguuuaaaca

SEQ ID NO: 3954629 - RNA, 23 nt, Staphylococcus aureus subsp. aureus Mu50
aaauauguauguuuuaucaauau

SEQ ID NO: 3954630 - RNA, 12 nt, Staphylococcus aureus subsp. aureus Mu50
aaauauuaaaaa

SEQ ID NO: 3954631 - RNA, 14 nt, Staphylococcus aureus subsp. aureus Mu50
aaauauuaaauuau

SEQ ID NO: 3954632 - RNA, 15 nt, Staphylococcus aureus subsp. aureus Mu50
aaauauuaaauuaug

SEQ ID NO: 3954633 - RNA, 15 nt, Staphylococcus aureus subsp. aureus Mu50
aaauauuaaauuauu

SEQ ID NO: 3954634 - RNA, 16 nt, Staphylococcus aureus subsp. aureus Mu50
aaauauuacuaacaac

SEQ ID NO: 3954635 - RNA, 18 nt, Staphylococcus aureus subsp. aureus Mu50
aaauauuauuaaaucaaa

SEQ ID NO: 3954636 - RNA, 11 nt, Staphylococcus aureus subsp. aureus Mu50
aaauauuauuu

SEQ ID NO: 3954637 - RNA, 24 nt, Staphylococcus aureus subsp. aureus Mu50
aaauauucacgacuugauagcauu

SEQ ID NO: 3954638 - RNA, 12 nt, Staphylococcus aureus subsp. aureus Mu50
aaauauuccuua

SEQ ID NO: 3954639 - RNA, 12 nt, Staphylococcus aureus subsp. aureus Mu50
aaauauucuuau

SEQ ID NO: 3954640 - RNA, 14 nt, Staphylococcus aureus subsp. aureus Mu50
aaauauucuuaucu

SEQ ID NO: 3954641 - RNA, 22 nt, Staphylococcus aureus subsp. aureus Mu50
aaauauucuuuaauauagauuu

SEQ ID NO: 3954642 - RNA, 14 nt, Staphylococcus aureus subsp. aureus Mu50
aaauauugaacaau

SEQ ID NO: 3954643 - RNA, 19 nt, Staphylococcus aureus subsp. aureus Mu50
aaauauugaagaugcuuua

SEQ ID NO: 3954644 - RNA, 17 nt, Staphylococcus aureus subsp. aureus Mu50
aaauauugaauaaucau

SEQ ID NO: 3954645 - RNA, 16 nt, Staphylococcus aureus subsp. aureus Mu50
aaauauugauauaaaa

SEQ ID NO: 3954646 - RNA, 17 nt, Staphylococcus aureus subsp. aureus Mu50
aaauauugauauaaaaa

SEQ ID NO: 3954647 - RNA, 21 nt, Staphylococcus aureus subsp. aureus Mu50
aaauauugauucuagugaaau

SEQ ID NO: 3954648 - RNA, 16 nt, Staphylococcus aureus subsp. aureus Mu50
aaauauuggaauacuc

SEQ ID NO: 3954649 - RNA, 17 nt, Staphylococcus aureus subsp. aureus Mu50
aaauauuguaaucacua

SEQ ID NO: 3954650 - RNA, 15 nt, Staphylococcus aureus subsp. aureus Mu50
aaauauuuaaaauau

SEQ ID NO: 3954651 - RNA, 19 nt, Staphylococcus aureus subsp. aureus Mu50
aaauauuuaaaauauuauu

SEQ ID NO: 3954652 - RNA, 13 nt, Staphylococcus aureus subsp. aureus Mu50
aaauauuuaaacu

SEQ ID NO: 3954653 - RNA, 19 nt, Staphylococcus aureus subsp. aureus Mu50
aaauauuuaaccuuuaaaa

SEQ ID NO: 3954654 - RNA, 20 nt, Staphylococcus aureus subsp. aureus Mu50
aaauauuuaaccuuuaaaac

SEQ ID NO: 3954655 - RNA, 11 nt, Staphylococcus aureus subsp. aureus Mu50
aaauauuuaau

SEQ ID NO: 3954656 - RNA, 13 nt, Staphylococcus aureus subsp. aureus Mu50
aaauauuuagauu

SEQ ID NO: 3954657 - RNA, 23 nt, Staphylococcus aureus subsp. aureus Mu50
aaauauuuagauuggucaaacuu

SEQ ID NO: 3954658 - RNA, 13 nt, Staphylococcus aureus subsp. aureus Mu50
aaauauuuaucuu

SEQ ID NO: 3954659 - RNA, 22 nt, Staphylococcus aureus subsp. aureus Mu50
aaauauuucuaaaccauuuuca

SEQ ID NO: 3954660 - RNA, 16 nt, Staphylococcus aureus subsp. aureus Mu50
aaauauuugaaaauuu

SEQ ID NO: 3954661 - RNA, 17 nt, Staphylococcus aureus subsp. aureus Mu50
aaauauuugaaaauuuc

SEQ ID NO: 3954662 - RNA, 19 nt, Staphylococcus aureus subsp. aureus Mu50
aaauauuugaaaauuucac

SEQ ID NO: 3954663 - RNA, 20 nt, Staphylococcus aureus subsp. aureus Mu50
aaauauuugaaaauuucacc

SEQ ID NO: 3954664 - RNA, 15 nt, Staphylococcus aureus subsp. aureus Mu50
aaauauuuuaucugu

SEQ ID NO: 3954665 - RNA, 18 nt, Staphylococcus aureus subsp. aureus Mu50
aaauauuuuaucuguaaa

SEQ ID NO: 3954666 - RNA, 22 nt, Staphylococcus aureus subsp. aureus Mu50
aaauauuuuuaauuauuuuaaa

SEQ ID NO: 3954667 - RNA, 18 nt, Staphylococcus aureus subsp. aureus Mu50
aaaucaaacuuuucagca

SEQ ID NO: 3954668 - RNA, 11 nt, Staphylococcus aureus subsp. aureus Mu50
aaaucaaagag

SEQ ID NO: 3954669 - RNA, 14 nt, Staphylococcus aureus subsp. aureus Mu50
aaaucaaagaggaa

SEQ ID NO: 3954670 - RNA, 17 nt, Staphylococcus aureus subsp. aureus Mu50
aaaucaaauacaucaau

SEQ ID NO: 3954671 - RNA, 21 nt, Staphylococcus aureus subsp. aureus Mu50
aaaucaaauauacuuuuacca

SEQ ID NO: 3954672 - RNA, 15 nt, Staphylococcus aureus subsp. aureus Mu50
aaaucaacuuuucua

SEQ ID NO: 3954673 - RNA, 12 nt, Staphylococcus aureus subsp. aureus Mu50
aaaucaagaaau

SEQ ID NO: 3954674 - RNA, 13 nt, Staphylococcus aureus subsp. aureus Mu50
aaaucaauaccaa

SEQ ID NO: 3954675 - RNA, 16 nt, Staphylococcus aureus subsp. aureus Mu50
aaaucaauccaucaau

SEQ ID NO: 3954676 - RNA, 20 nt, Staphylococcus aureus subsp. aureus Mu50
aaaucacauaugauaauuaa

SEQ ID NO: 3954677 - RNA, 18 nt, Staphylococcus aureus subsp. aureus Mu50
aaaucaccagauuuuaag

SEQ ID NO: 3954678 - RNA, 20 nt, Staphylococcus aureus subsp. aureus Mu50
aaaucaccuuuuuuaacuuu

SEQ ID NO: 3954679 - RNA, 14 nt, Staphylococcus aureus subsp. aureus Mu50
aaaucacgccauaa

SEQ ID NO: 3954680 - RNA, 23 nt, Staphylococcus aureus subsp. aureus Mu50
aaaucacgcuaacauucagugca

SEQ ID NO: 3954681 - RNA, 15 nt, Staphylococcus aureus subsp. aureus Mu50
aaaucacugcuuuca

SEQ ID NO: 3954682 - RNA, 15 nt, Staphylococcus aureus subsp. aureus Mu50
aaaucaguaauauca

SEQ ID NO: 3954683 - RNA, 18 nt, Staphylococcus aureus subsp. aureus Mu50
aaaucagucauucacaua

SEQ ID NO: 3954684 - RNA, 20 nt, Staphylococcus aureus subsp. aureus Mu50
aaaucaguuuuuaaaucaaa

SEQ ID NO: 3954685 - RNA, 13 nt, Staphylococcus aureus subsp. aureus Mu50
aaaucauaaauaa

SEQ ID NO: 3954686 - RNA, 14 nt, Staphylococcus aureus subsp. aureus Mu50
aaaucauaaauaac

SEQ ID NO: 3954687 - RNA, 17 nt, Staphylococcus aureus subsp. aureus Mu50
aaaucauacgagaaauu

SEQ ID NO: 3954688 - RNA, 11 nt, Staphylococcus aureus subsp. aureus Mu50
aaaucaucuua

SEQ ID NO: 3954689 - RNA, 13 nt, Staphylococcus aureus subsp. aureus Mu50
aaaucaucuuaac

SEQ ID NO: 3954690 - RNA, 21 nt, Staphylococcus aureus subsp. aureus Mu50
aaaucaucuuaugacugcuuu

SEQ ID NO: 3954691 - RNA, 22 nt, Staphylococcus aureus subsp. aureus Mu50
aaaucaugacauaaaacuuaca

SEQ ID NO: 3954692 - RNA, 13 nt, Staphylococcus aureus subsp. aureus Mu50
aaaucauuaauaa

SEQ ID NO: 3954693 - RNA, 18 nt, Staphylococcus aureus subsp. aureus Mu50
aaaucauuaguuguauca

SEQ ID NO: 3954694 - RNA, 16 nt, Staphylococcus aureus subsp. aureus Mu50
aaaucauucauuugca

SEQ ID NO: 3954695 - RNA, 19 nt, Staphylococcus aureus subsp. aureus Mu50
aaaucauucuuuauagaaa

SEQ ID NO: 3954696 - RNA, 17 nt, Staphylococcus aureus subsp. aureus Mu50
aaaucauuuaaauuagu

SEQ ID NO: 3954697 - RNA, 20 nt, Staphylococcus aureus subsp. aureus Mu50
aaaucauuuaaauuaguuau

SEQ ID NO: 3954698 - RNA, 19 nt, Staphylococcus aureus subsp. aureus Mu50
aaaugaugcaguaaaacca

SEQ ID NO: 3954699 - RNA, 20 nt, Staphylococcus aureus subsp. aureus Mu50
aaaugauguaacguuucuuu

SEQ ID NO: 3954700 - RNA, 13 nt, Staphylococcus aureus subsp. aureus Mu50
aaaugauuaaagu

SEQ ID NO: 3954701 - RNA, 13 nt, Staphylococcus aureus subsp. aureus Mu50
aaaugauuaauaa

SEQ ID NO: 3954702 - RNA, 18 nt, Staphylococcus aureus subsp. aureus Mu50
aaaugauuguuuuaagug

SEQ ID NO: 3954703 - RNA, 14 nt, Staphylococcus aureus subsp. aureus Mu50
aaaugauuuauucu

SEQ ID NO: 3954704 - RNA, 19 nt, Staphylococcus aureus subsp. aureus Mu50
aaaugauuuauucuaaaua

SEQ ID NO: 3954705 - RNA, 16 nt, Staphylococcus aureus subsp. aureus Mu50
aaaugcaaagacuaaa

SEQ ID NO: 3954706 - RNA, 18 nt, Staphylococcus aureus subsp. aureus Mu50
aaaugcaaagacuaaaaa

SEQ ID NO: 3954707 - RNA, 22 nt, Staphylococcus aureus subsp. aureus Mu50
aaaugcaauacaccuauuacac

SEQ ID NO: 3954708 - RNA, 21 nt, Staphylococcus aureus subsp. aureus Mu50
aaaugcaauacauuaauauaa

SEQ ID NO: 3954709 - RNA, 19 nt, Staphylococcus aureus subsp. aureus Mu50
aaaugcacgagcaacaucu

SEQ ID NO: 3954710 - RNA, 21 nt, Staphylococcus aureus subsp. aureus Mu50
aaaugcacgagcaacaucuuu

SEQ ID NO: 3954711 - RNA, 20 nt, Staphylococcus aureus subsp. aureus Mu50
aaaugcacugagcaacaaaa

SEQ ID NO: 3954712 - RNA, 19 nt, Staphylococcus aureus subsp. aureus Mu50
aaaugcagcuguauaacca

SEQ ID NO: 3954713 - RNA, 13 nt, Staphylococcus aureus subsp. aureus Mu50
aaaugcauuacua

SEQ ID NO: 3954714 - RNA, 18 nt, Staphylococcus aureus subsp. aureus Mu50
aaaugcauuacuacuuua

SEQ ID NO: 3954715 - RNA, 21 nt, Staphylococcus aureus subsp. aureus Mu50
aaaugccaacuauaccuaggg

SEQ ID NO: 3954716 - RNA, 20 nt, Staphylococcus aureus subsp. aureus Mu50
aaaugccgagauuauuaugu

SEQ ID NO: 3954717 - RNA, 22 nt, Staphylococcus aureus subsp. aureus Mu50
aaaugccgcuucuaauuuuuca

SEQ ID NO: 3954718 - RNA, 20 nt, Staphylococcus aureus subsp. aureus Mu50
aaaugcgacguuguucucuc

SEQ ID NO: 3954719 - RNA, 20 nt, Staphylococcus aureus subsp. aureus Mu50
aaaugcgcuuccaauuuaaa

SEQ ID NO: 3954720 - RNA, 21 nt, Staphylococcus aureus subsp. aureus Mu50
aaaugcuauauuuagaaugau

SEQ ID NO: 3954721 - RNA, 22 nt, Staphylococcus aureus subsp. aureus Mu50
aaaugcucaaguugauuauucu

SEQ ID NO: 3954722 - RNA, 21 nt, Staphylococcus aureus subsp. aureus Mu50
aaaugcuggguaauaaauugu

SEQ ID NO: 3954723 - RNA, 21 nt, Staphylococcus aureus subsp. aureus Mu50
aaaugcugguaaauguugaua

SEQ ID NO: 3954724 - RNA, 18 nt, Staphylococcus aureus subsp. aureus Mu50
aaaugcuuaagaaauuuu

SEQ ID NO: 3954725 - RNA, 20 nt, Staphylococcus aureus subsp. aureus Mu50
aaaugcuuaagaaauuuuuu

SEQ ID NO: 3954726 - RNA, 20 nt, Staphylococcus aureus subsp. aureus Mu50
aaaugcuuaauaaaaucaaa

SEQ ID NO: 3954727 - RNA, 22 nt, Staphylococcus aureus subsp. aureus Mu50
aaaugcuuaauuuguuuuaaau

SEQ ID NO: 3954728 - RNA, 12 nt, Staphylococcus aureus subsp. aureus Mu50
aaaugcuuauau

SEQ ID NO: 3954729 - RNA, 13 nt, Staphylococcus aureus subsp. aureus Mu50
aaaugcuuauaua

SEQ ID NO: 3954730 - RNA, 21 nt, Staphylococcus aureus subsp. aureus Mu50
aaaugcuucugguucuucaau

SEQ ID NO: 3954731 - RNA, 23 nt, Staphylococcus aureus subsp. aureus Mu50
aaauggcgaauagcgauuuuaaa

SEQ ID NO: 3954732 - RNA, 20 nt, Staphylococcus aureus subsp. aureus Mu50
aaauggcuccauuuaauuug

SEQ ID NO: 3954733 - RNA, 16 nt, Staphylococcus aureus subsp. aureus Mu50
aaauggugaacuaaau

SEQ ID NO: 3954734 - RNA, 21 nt, Staphylococcus aureus subsp. aureus Mu50
aaauggugcgaauaauaauac

SEQ ID NO: 3954735 - RNA, 19 nt, Staphylococcus aureus subsp. aureus Mu50
aaauguaaauaaaaauuau

SEQ ID NO: 3954736 - RNA, 20 nt, Staphylococcus aureus subsp. aureus Mu50
aaauguaaauaaaaauuaua

SEQ ID NO: 3954737 - RNA, 12 nt, Staphylococcus aureus subsp. aureus Mu50
aaauguagauua

SEQ ID NO: 3954738 - RNA, 13 nt, Staphylococcus aureus subsp. aureus Mu50
aaauguauuuuua

SEQ ID NO: 3954739 - RNA, 15 nt, Staphylococcus aureus subsp. aureus Mu50
aaauguauuuuuacu

SEQ ID NO: 3954740 - RNA, 19 nt, Staphylococcus aureus subsp. aureus Mu50
aaaugucaguuuugaagaa

SEQ ID NO: 3954741 - RNA, 14 nt, Staphylococcus aureus subsp. aureus Mu50
aaaugucauaguau

SEQ ID NO: 3954742 - RNA, 13 nt, Staphylococcus aureus subsp. aureus Mu50
aaaugucauuuga

SEQ ID NO: 3954743 - RNA, 19 nt, Staphylococcus aureus subsp. aureus Mu50
aaauguccgacuugauaaa

SEQ ID NO: 3954744 - RNA, 17 nt, Staphylococcus aureus subsp. aureus Mu50
aaaugucguauauguaa

SEQ ID NO: 3954745 - RNA, 14 nt, Staphylococcus aureus subsp. aureus Mu50
aaaugucuuucaaa

SEQ ID NO: 3954746 - RNA, 16 nt, Staphylococcus aureus subsp. aureus Mu50
aaaugucuuucaaaua

SEQ ID NO: 3954747 - RNA, 18 nt, Staphylococcus aureus subsp. aureus Mu50
aaaugucuuucaaauaca

SEQ ID NO: 3954748 - RNA, 18 nt, Staphylococcus aureus subsp. aureus Mu50
aaaugugcaauuagaaua

SEQ ID NO: 3954749 - RNA, 19 nt, Staphylococcus aureus subsp. aureus Mu50
aaaugugcaauuagaauau

SEQ ID NO: 3954750 - RNA, 22 nt, Staphylococcus aureus subsp. aureus Mu50
aaaugugcaauuagaauauaug

SEQ ID NO: 3954751 - RNA, 16 nt, Staphylococcus aureus subsp. aureus Mu50
aaauguguuuucaaca

SEQ ID NO: 3954752 - RNA, 15 nt, Staphylococcus aureus subsp. aureus Mu50
aaauguuaaagauua

SEQ ID NO: 3954753 - RNA, 13 nt, Staphylococcus aureus subsp. aureus Mu50
aaauguuaacgau

SEQ ID NO: 3954754 - RNA, 15 nt, Staphylococcus aureus subsp. aureus Mu50
aaauguuaacgauag

SEQ ID NO: 3954755 - RNA, 18 nt, Staphylococcus aureus subsp. aureus Mu50
aaauguuacacaaauuaa

SEQ ID NO: 3954756 - RNA, 22 nt, Staphylococcus aureus subsp. aureus Mu50
aaauguuauuaaccaucaugac

SEQ ID NO: 3954757 - RNA, 14 nt, Staphylococcus aureus subsp. aureus Mu50
aaauguuauugcuu

SEQ ID NO: 3954758 - RNA, 15 nt, Staphylococcus aureus subsp. aureus Mu50
aaauguuauugcuua

SEQ ID NO: 3954759 - RNA, 22 nt, Staphylococcus aureus subsp. aureus Mu50
aaauguuauugcuuauuuuugu

SEQ ID NO: 3954760 - RNA, 20 nt, Staphylococcus aureus subsp. aureus Mu50
aaauguucuggaauaccuaa

SEQ ID NO: 3954761 - RNA, 17 nt, Staphylococcus aureus subsp. aureus Mu50
aaauguugaauguggaa

SEQ ID NO: 3954762 - RNA, 13 nt, Staphylococcus aureus subsp. aureus Mu50
aaauguuuauauc

SEQ ID NO: 3954763 - RNA, 20 nt, Staphylococcus aureus subsp. aureus Mu50
aaauguuuaucaauucccug

SEQ ID NO: 3954764 - RNA, 16 nt, Staphylococcus aureus subsp. aureus Mu50
aaauuaaaaaacaaaa

SEQ ID NO: 3954765 - RNA, 19 nt, Staphylococcus aureus subsp. aureus Mu50
aaauuaaaaaacaauaaaa

SEQ ID NO: 3954766 - RNA, 18 nt, Staphylococcus aureus subsp. aureus Mu50
aaauuaaaaagguacuaa

SEQ ID NO: 3954767 - RNA, 19 nt, Staphylococcus aureus subsp. aureus Mu50
aaauuaaaacagcaaauaa

SEQ ID NO: 3954768 - RNA, 15 nt, Staphylococcus aureus subsp. aureus Mu50
aaauuaaaacuuuca

SEQ ID NO: 3954769 - RNA, 13 nt, Staphylococcus aureus subsp. aureus Mu50
aaauuaacuagug

SEQ ID NO: 3954770 - RNA, 17 nt, Staphylococcus aureus subsp. aureus Mu50
aaauuaacuuaaaauuu

SEQ ID NO: 3954771 - RNA, 20 nt, Staphylococcus aureus subsp. aureus Mu50
aaauuaacuuaaaauuuaaa

SEQ ID NO: 3954772 - RNA, 22 nt, Staphylococcus aureus subsp. aureus Mu50
aaauuaacuuaaaauuuaaaua

SEQ ID NO: 3954773 - RNA, 21 nt, Staphylococcus aureus subsp. aureus Mu50
aaauuaacuuagguuauuaua

SEQ ID NO: 3954774 - RNA, 22 nt, Staphylococcus aureus subsp. aureus Mu50
aaauuaacuuagguuauuauaa

SEQ ID NO: 3954775 - RNA, 24 nt, Staphylococcus aureus subsp. aureus Mu50
aaauuaacuuagguuauuauaaaa

SEQ ID NO: 3954776 - RNA, 17 nt, Staphylococcus aureus subsp. aureus Mu50
aaauuaagaagaaauac

SEQ ID NO: 3954777 - RNA, 21 nt, Staphylococcus aureus subsp. aureus Mu50
aaauuaagaagaaauacuuga

SEQ ID NO: 3954778 - RNA, 13 nt, Staphylococcus aureus subsp. aureus Mu50
aaauuaagaauaa

SEQ ID NO: 3954779 - RNA, 15 nt, Staphylococcus aureus subsp. aureus Mu50
aaauuaauagagaaa

SEQ ID NO: 3954780 - RNA, 19 nt, Staphylococcus aureus subsp. aureus Mu50
aaauuaauaugaacaaaaa

SEQ ID NO: 3954781 - RNA, 16 nt, Staphylococcus aureus subsp. aureus Mu50
aaauuaauugcuuuca

SEQ ID NO: 3954782 - RNA, 17 nt, Staphylococcus aureus subsp. aureus Mu50
aaauuacaaauuaucua

SEQ ID NO: 3954783 - RNA, 21 nt, Staphylococcus aureus subsp. aureus Mu50
aaauuacaacuuuuagaguuu

SEQ ID NO: 3954784 - RNA, 15 nt, Staphylococcus aureus subsp. aureus Mu50
aaauuacacccuuua

SEQ ID NO: 3954785 - RNA, 15 nt, Staphylococcus aureus subsp. aureus Mu50
aaauuuaaaagaaaa

SEQ ID NO: 3954786 - RNA, 12 nt, Staphylococcus aureus subsp. aureus Mu50
aaauuuaaaaua

SEQ ID NO: 3954787 - RNA, 14 nt, Staphylococcus aureus subsp. aureus Mu50
aaauuuaaaauaau

SEQ ID NO: 3954788 - RNA, 11 nt, Staphylococcus aureus subsp. aureus Mu50
aaauuuaaaua

SEQ ID NO: 3954789 - RNA, 16 nt, Staphylococcus aureus subsp. aureus Mu50
aaauuuaaauauugaa

SEQ ID NO: 3954790 - RNA, 17 nt, Staphylococcus aureus subsp. aureus Mu50
aaauuuaagaaugcgaa

SEQ ID NO: 3954791 - RNA, 12 nt, Staphylococcus aureus subsp. aureus Mu50
aaauuuaauauu

SEQ ID NO: 3954792 - RNA, 13 nt, Staphylococcus aureus subsp. aureus Mu50
aaauuuaccaguu

SEQ ID NO: 3954793 - RNA, 22 nt, Staphylococcus aureus subsp. aureus Mu50
aaauuuacgaaaguagaauuau

SEQ ID NO: 3954794 - RNA, 22 nt, Staphylococcus aureus subsp. aureus Mu50
aaauuuaggcaugucaaaucgg

SEQ ID NO: 3954795 - RNA, 16 nt, Staphylococcus aureus subsp. aureus Mu50
aaauuuaguaucucau

SEQ ID NO: 3954796 - RNA, 14 nt, Staphylococcus aureus subsp. aureus Mu50
aaauuuauuauaaa

SEQ ID NO: 3954797 - RNA, 22 nt, Staphylococcus aureus subsp. aureus Mu50
aaauuuauuauaaaauagaagu

SEQ ID NO: 3954798 - RNA, 15 nt, Staphylococcus aureus subsp. aureus Mu50
aaauuuauucaaaau

SEQ ID NO: 3954799 - RNA, 13 nt, Staphylococcus aureus subsp. aureus Mu50
aaauuuauuuuua

SEQ ID NO: 3954800 - RNA, 12 nt, Staphylococcus aureus subsp. aureus Mu50
aaauuucaaaaa

SEQ ID NO: 3954801 - RNA, 15 nt, Staphylococcus aureus subsp. aureus Mu50
aaauuucaaaaauag

SEQ ID NO: 3954802 - RNA, 17 nt, Staphylococcus aureus subsp. aureus Mu50
aaauuucaggcguuaau

SEQ ID NO: 3954803 - RNA, 22 nt, Staphylococcus aureus subsp. aureus Mu50
aaauuucauaaaguuuauuuau

SEQ ID NO: 3954804 - RNA, 15 nt, Staphylococcus aureus subsp. aureus Mu50
aaauuucgacaucua

SEQ ID NO: 3954805 - RNA, 16 nt, Staphylococcus aureus subsp. aureus Mu50
aaauuucgacaucuag

SEQ ID NO: 3954806 - RNA, 15 nt, Staphylococcus aureus subsp. aureus Mu50
aaauuucgauuaauu

SEQ ID NO: 3954807 - RNA, 19 nt, Staphylococcus aureus subsp. aureus Mu50
aaauuucgccucaucuaau

SEQ ID NO: 3954808 - RNA, 23 nt, Staphylococcus aureus subsp. aureus Mu50
aaauuucgccucaucuaauuuau

SEQ ID NO: 3954809 - RNA, 18 nt, Staphylococcus aureus subsp. aureus Mu50
aaauuucuguaaccaaaa

SEQ ID NO: 3954810 - RNA, 16 nt, Staphylococcus aureus subsp. aureus Mu50
aaauuuguaccaaaua

SEQ ID NO: 3954811 - RNA, 22 nt, Staphylococcus aureus subsp. aureus Mu50
aaauuuguaccaaauaaauuaa

SEQ ID NO: 3954812 - RNA, 19 nt, Staphylococcus aureus subsp. aureus Mu50
aaauuuguguucaaaucac

SEQ ID NO: 3954813 - RNA, 19 nt, Staphylococcus aureus subsp. aureus Mu50
aaauuuuaucuaaacauuu

SEQ ID NO: 3954814 - RNA, 19 nt, Staphylococcus aureus subsp. aureus Mu50
aaauuuucguguuaauaac

SEQ ID NO: 3954815 - RNA, 22 nt, Staphylococcus aureus subsp. aureus Mu50
aaauuuucuguuuaauuaaaau

SEQ ID NO: 3954816 - RNA, 12 nt, Staphylococcus aureus subsp. aureus Mu50
aaauuuugaaga

SEQ ID NO: 3954817 - RNA, 15 nt, Staphylococcus aureus subsp. aureus Mu50
aaauuuugaagaagu

SEQ ID NO: 3954818 - RNA, 17 nt, Staphylococcus aureus subsp. aureus Mu50
aaauuuugcgaaaauau

SEQ ID NO: 3954819 - RNA, 20 nt, Staphylococcus aureus subsp. aureus Mu50
aaauuuuggaccucuugaaa

SEQ ID NO: 3954820 - RNA, 17 nt, Staphylococcus aureus subsp. aureus Mu50
aaauuuuucacuucaaa

SEQ ID NO: 3954821 - RNA, 23 nt, Staphylococcus aureus subsp. aureus Mu50
aaauuuuucacuucaaacaaagg

SEQ ID NO: 3954822 - RNA, 19 nt, Staphylococcus aureus subsp. aureus Mu50
aaauuuuuuagugaaaaag

SEQ ID NO: 3954823 - RNA, 14 nt, Staphylococcus aureus subsp. aureus Mu50
aacaaaaagaauuu

SEQ ID NO: 3954824 - RNA, 18 nt, Staphylococcus aureus subsp. aureus Mu50
aacaaaaagguucuccac

SEQ ID NO: 3954825 - RNA, 19 nt, Staphylococcus aureus subsp. aureus Mu50
aacaaaaagguucuccacc

SEQ ID NO: 3954826 - RNA, 14 nt, Staphylococcus aureus subsp. aureus Mu50
aacaaaagaaaguu

SEQ ID NO: 3954827 - RNA, 13 nt, Staphylococcus aureus subsp. aureus Mu50
aacaaaagauguu

SEQ ID NO: 3954828 - RNA, 22 nt, Staphylococcus aureus subsp. aureus Mu50
aacaaaauuaagaagaaauacu

SEQ ID NO: 3954829 - RNA, 23 nt, Staphylococcus aureus subsp. aureus Mu50
aacaaaauuaagaagaaauacuu

SEQ ID NO: 3954830 - RNA, 14 nt, Staphylococcus aureus subsp. aureus Mu50
aacaaacauaaaua

SEQ ID NO: 3954831 - RNA, 15 nt, Staphylococcus aureus subsp. aureus Mu50
aacaaacgcugauuu

SEQ ID NO: 3954832 - RNA, 12 nt, Staphylococcus aureus subsp. aureus Mu50
aacaaagaagcu

SEQ ID NO: 3954833 - RNA, 23 nt, Staphylococcus aureus subsp. aureus Mu50
aacaaaguaauccccgaagcaca

SEQ ID NO: 3954834 - RNA, 17 nt, Staphylococcus aureus subsp. aureus Mu50
aacaaagugcaauuauu

SEQ ID NO: 3954835 - RNA, 21 nt, Staphylococcus aureus subsp. aureus Mu50
aacaaagugcaauuauuucaa

SEQ ID NO: 3954836 - RNA, 15 nt, Staphylococcus aureus subsp. aureus Mu50
aacaaauaguucaaa

SEQ ID NO: 3954837 - RNA, 21 nt, Staphylococcus aureus subsp. aureus Mu50
aacaaauauaauguauaaaac

SEQ ID NO: 3954838 - RNA, 24 nt, Staphylococcus aureus subsp. aureus Mu50
aacaaauauaauguauaaaacaga

SEQ ID NO: 3954839 - RNA, 16 nt, Staphylococcus aureus subsp. aureus Mu50
aacaaaucgauuaauu

SEQ ID NO: 3954840 - RNA, 18 nt, Staphylococcus aureus subsp. aureus Mu50
aacaaaucuauaaauauc

SEQ ID NO: 3954841 - RNA, 15 nt, Staphylococcus aureus subsp. aureus Mu50
aacaaaucuuuuaaa

SEQ ID NO: 3954842 - RNA, 17 nt, Staphylococcus aureus subsp. aureus Mu50
aacaaauucauauuaac

SEQ ID NO: 3954843 - RNA, 19 nt, Staphylococcus aureus subsp. aureus Mu50
aacaaauucauauuaacug

SEQ ID NO: 3954844 - RNA, 15 nt, Staphylococcus aureus subsp. aureus Mu50
aacaacaaucaaauu

SEQ ID NO: 3954845 - RNA, 12 nt, Staphylococcus aureus subsp. aureus Mu50
aacaacuaagau

SEQ ID NO: 3954846 - RNA, 14 nt, Staphylococcus aureus subsp. aureus Mu50
aacaacuacuuaaa

SEQ ID NO: 3954847 - RNA, 16 nt, Staphylococcus aureus subsp. aureus Mu50
aacaacuuuauuauac

SEQ ID NO: 3954848 - RNA, 14 nt, Staphylococcus aureus subsp. aureus Mu50
aacaagcaucauga

SEQ ID NO: 3954849 - RNA, 18 nt, Staphylococcus aureus subsp. aureus Mu50
aacaagcauuuuucaauu

SEQ ID NO: 3954850 - RNA, 22 nt, Staphylococcus aureus subsp. aureus Mu50
aacaagcauuuuucaauuauag

SEQ ID NO: 3954851 - RNA, 16 nt, Staphylococcus aureus subsp. aureus Mu50
aacaagccuuaaaaua

SEQ ID NO: 3954852 - RNA, 20 nt, Staphylococcus aureus subsp. aureus Mu50
aacaagcuuuucauuuuuau

SEQ ID NO: 3954853 - RNA, 22 nt, Staphylococcus aureus subsp. aureus Mu50
aacaagcuuuuuucaauucuag

SEQ ID NO: 3954854 - RNA, 23 nt, Staphylococcus aureus subsp. aureus Mu50
aacaagguguucgggaauuuuuu

SEQ ID NO: 3954855 - RNA, 12 nt, Staphylococcus aureus subsp. aureus Mu50
aacaaguacaau

SEQ ID NO: 3954856 - RNA, 20 nt, Staphylococcus aureus subsp. aureus Mu50
aacaaguacaauaauaccuu

SEQ ID NO: 3954857 - RNA, 22 nt, Staphylococcus aureus subsp. aureus Mu50
aacaaguaguaugucauucuag

SEQ ID NO: 3954858 - RNA, 16 nt, Staphylococcus aureus subsp. aureus Mu50
aacaauaaaaaaccaa

SEQ ID NO: 3954859 - RNA, 14 nt, Staphylococcus aureus subsp. aureus Mu50
aacaauaacaccug

SEQ ID NO: 3954860 - RNA, 13 nt, Staphylococcus aureus subsp. aureus Mu50
aacaauaauaugc

SEQ ID NO: 3954861 - RNA, 17 nt, Staphylococcus aureus subsp. aureus Mu50
aacaauaauuuaauauu

SEQ ID NO: 3954862 - RNA, 17 nt, Staphylococcus aureus subsp. aureus Mu50
aacaauacauaaugguu

SEQ ID NO: 3954863 - RNA, 19 nt, Staphylococcus aureus subsp. aureus Mu50
aacaauaccgcgauaaaua

SEQ ID NO: 3954864 - RNA, 12 nt, Staphylococcus aureus subsp. aureus Mu50
aacaauacuacu

SEQ ID NO: 3954865 - RNA, 19 nt, Staphylococcus aureus subsp. aureus Mu50
aacaauagguacaacuaaa

SEQ ID NO: 3954866 - RNA, 21 nt, Staphylococcus aureus subsp. aureus Mu50
aacaauagguacaacuaaaua

SEQ ID NO: 3954867 - RNA, 13 nt, Staphylococcus aureus subsp. aureus Mu50
aacaauauaauau

SEQ ID NO: 3954868 - RNA, 14 nt, Staphylococcus aureus subsp. aureus Mu50
aacaauauaauaua

SEQ ID NO: 3954869 - RNA, 16 nt, Staphylococcus aureus subsp. aureus Mu50
aacaauauaauauaca

SEQ ID NO: 3954870 - RNA, 21 nt, Staphylococcus aureus subsp. aureus Mu50
aacaauauuaaauuucugaac

SEQ ID NO: 3954871 - RNA, 20 nt, Staphylococcus aureus subsp. aureus Mu50
aacaauauucguaaauccuu

SEQ ID NO: 3954872 - RNA, 12 nt, Staphylococcus aureus subsp. aureus Mu50
aacaauauugac

SEQ ID NO: 3954873 - RNA, 15 nt, Staphylococcus aureus subsp. aureus Mu50
aacaucugaaaaaau

SEQ ID NO: 3954874 - RNA, 17 nt, Staphylococcus aureus subsp. aureus Mu50
aacaucugaaaaaauua

SEQ ID NO: 3954875 - RNA, 17 nt, Staphylococcus aureus subsp. aureus Mu50
aacaucuugauauucau

SEQ ID NO: 3954876 - RNA, 21 nt, Staphylococcus aureus subsp. aureus Mu50
aacaucuuuuguuguuuuuga

SEQ ID NO: 3954877 - RNA, 12 nt, Staphylococcus aureus subsp. aureus Mu50
aacaugaacaau

SEQ ID NO: 3954878 - RNA, 14 nt, Staphylococcus aureus subsp. aureus Mu50
aacaugaacaauca

SEQ ID NO: 3954879 - RNA, 23 nt, Staphylococcus aureus subsp. aureus Mu50
aacaugaacaaucagauaaguua

SEQ ID NO: 3954880 - RNA, 20 nt, Staphylococcus aureus subsp. aureus Mu50
aacaugaaugauauugauuu

SEQ ID NO: 3954881 - RNA, 18 nt, Staphylococcus aureus subsp. aureus Mu50
aacaugaccuaauauauu

SEQ ID NO: 3954882 - RNA, 13 nt, Staphylococcus aureus subsp. aureus Mu50
aacaugauacgua

SEQ ID NO: 3954883 - RNA, 23 nt, Staphylococcus aureus subsp. aureus Mu50
aacaugauacgugguuuuauuug

SEQ ID NO: 3954884 - RNA, 16 nt, Staphylococcus aureus subsp. aureus Mu50
aacaugauacugaaau

SEQ ID NO: 3954885 - RNA, 20 nt, Staphylococcus aureus subsp. aureus Mu50
aacaugauucaugauauguu

SEQ ID NO: 3954886 - RNA, 14 nt, Staphylococcus aureus subsp. aureus Mu50
aacaugauugaaau

SEQ ID NO: 3954887 - RNA, 23 nt, Staphylococcus aureus subsp. aureus Mu50
aacaugguuuucuuuuuaucaug

SEQ ID NO: 3954888 - RNA, 13 nt, Staphylococcus aureus subsp. aureus Mu50
aacauguacaauu

SEQ ID NO: 3954889 - RNA, 23 nt, Staphylococcus aureus subsp. aureus Mu50
aacauguacaauuuuuaaaaacc

SEQ ID NO: 3954890 - RNA, 15 nt, Staphylococcus aureus subsp. aureus Mu50
aacauguauuuagua

SEQ ID NO: 3954891 - RNA, 14 nt, Staphylococcus aureus subsp. aureus Mu50
aacaugugcaagua

SEQ ID NO: 3954892 - RNA, 16 nt, Staphylococcus aureus subsp. aureus Mu50
aacauguguaugauca

SEQ ID NO: 3954893 - RNA, 20 nt, Staphylococcus aureus subsp. aureus Mu50
aacauguuccgcuacaaaac

SEQ ID NO: 3954894 - RNA, 22 nt, Staphylococcus aureus subsp. aureus Mu50
aacauguuccgcuacaaaacau

SEQ ID NO: 3954895 - RNA, 12 nt, Staphylococcus aureus subsp. aureus Mu50
aacauuaaaaau

SEQ ID NO: 3954896 - RNA, 20 nt, Staphylococcus aureus subsp. aureus Mu50
aacauuaaaauaauuaaaua

SEQ ID NO: 3954897 - RNA, 21 nt, Staphylococcus aureus subsp. aureus Mu50
aacauuaaaauaauuaaauaa

SEQ ID NO: 3954898 - RNA, 12 nt, Staphylococcus aureus subsp. aureus Mu50
aacauuaaaaug

SEQ ID NO: 3954899 - RNA, 13 nt, Staphylococcus aureus subsp. aureus Mu50
aacauuaaaaugu

SEQ ID NO: 3954900 - RNA, 13 nt, Staphylococcus aureus subsp. aureus Mu50
aacauuaaauuau

SEQ ID NO: 3954901 - RNA, 16 nt, Staphylococcus aureus subsp. aureus Mu50
aacauuaaauuauuag

SEQ ID NO: 3954902 - RNA, 14 nt, Staphylococcus aureus subsp. aureus Mu50
aacauuaauaaaua

SEQ ID NO: 3954903 - RNA, 17 nt, Staphylococcus aureus subsp. aureus Mu50
aacauuaauaaauaaua

SEQ ID NO: 3954904 - RNA, 23 nt, Staphylococcus aureus subsp. aureus Mu50
aacauuaaucuauauaaaaacug

SEQ ID NO: 3954905 - RNA, 22 nt, Staphylococcus aureus subsp. aureus Mu50
aacauuacuaauugaucagcau

SEQ ID NO: 3954906 - RNA, 13 nt, Staphylococcus aureus subsp. aureus Mu50
aacauuacuuuaa

SEQ ID NO: 3954907 - RNA, 23 nt, Staphylococcus aureus subsp. aureus Mu50
aacauuacuuuaacaguuguaau

SEQ ID NO: 3954908 - RNA, 17 nt, Staphylococcus aureus subsp. aureus Mu50
aacauuagcaugauaaa

SEQ ID NO: 3954909 - RNA, 14 nt, Staphylococcus aureus subsp. aureus Mu50
aacauuauuuauau

SEQ ID NO: 3954910 - RNA, 13 nt, Staphylococcus aureus subsp. aureus Mu50
aacauuauuuuug

SEQ ID NO: 3954911 - RNA, 19 nt, Staphylococcus aureus subsp. aureus Mu50
aacauucccuuaauaauaa

SEQ ID NO: 3954912 - RNA, 19 nt, Staphylococcus aureus subsp. aureus Mu50
aacauucuucaaaaaauaa

SEQ ID NO: 3954913 - RNA, 23 nt, Staphylococcus aureus subsp. aureus Mu50
aacauugaacgauaacaauuuau

SEQ ID NO: 3954914 - RNA, 15 nt, Staphylococcus aureus subsp. aureus Mu50
aacauugagauuauc

SEQ ID NO: 3954915 - RNA, 20 nt, Staphylococcus aureus subsp. aureus Mu50
aacauugagauuaucuuuag

SEQ ID NO: 3954916 - RNA, 14 nt, Staphylococcus aureus subsp. aureus Mu50
aacauuuaaaaaau

SEQ ID NO: 3954917 - RNA, 16 nt, Staphylococcus aureus subsp. aureus Mu50
aacauuuaagaaacgu

SEQ ID NO: 3954918 - RNA, 19 nt, Staphylococcus aureus subsp. aureus Mu50
aacauuuauucuuucucua

SEQ ID NO: 3954919 - RNA, 13 nt, Staphylococcus aureus subsp. aureus Mu50
aacauuugucaua

SEQ ID NO: 3954920 - RNA, 22 nt, Staphylococcus aureus subsp. aureus Mu50
aacauuuguuggaagccuucaa

SEQ ID NO: 3954921 - RNA, 13 nt, Staphylococcus aureus subsp. aureus Mu50
aacauuuugaguc

SEQ ID NO: 3954922 - RNA, 21 nt, Staphylococcus aureus subsp. aureus Mu50
aacauuuugccccucauucac

SEQ ID NO: 3954923 - RNA, 22 nt, Staphylococcus aureus subsp. aureus Mu50
aacauuuugccccucauucaca

SEQ ID NO: 3954924 - RNA, 18 nt, Staphylococcus aureus subsp. aureus Mu50
aacauuuuugaauuuaau

SEQ ID NO: 3954925 - RNA, 20 nt, Staphylococcus aureus subsp. aureus Mu50
aacauuuuuuauagcaaauu

SEQ ID NO: 3954926 - RNA, 23 nt, Staphylococcus aureus subsp. aureus Mu50
aacauuuuuuauagcaaauugau

SEQ ID NO: 3954927 - RNA, 15 nt, Staphylococcus aureus subsp. aureus Mu50
aaccaaaaccaaaug

SEQ ID NO: 3954928 - RNA, 13 nt, Staphylococcus aureus subsp. aureus Mu50
aaccaaaauuaua

SEQ ID NO: 3954929 - RNA, 13 nt, Staphylococcus aureus subsp. aureus Mu50
aaccaaauaauug

SEQ ID NO: 3954930 - RNA, 18 nt, Staphylococcus aureus subsp. aureus Mu50
aaccaaaucggaauaaaa

SEQ ID NO: 3954931 - RNA, 23 nt, Staphylococcus aureus subsp. aureus Mu50
aaccaaaucggaauaaaauaaau

SEQ ID NO: 3954932 - RNA, 20 nt, Staphylococcus aureus subsp. aureus Mu50
aaccaauaauccgagucaua

SEQ ID NO: 3954933 - RNA, 17 nt, Staphylococcus aureus subsp. aureus Mu50
aaccaauccaauauaca

SEQ ID NO: 3954934 - RNA, 14 nt, Staphylococcus aureus subsp. aureus Mu50
aaccaauuaauugu

SEQ ID NO: 3954935 - RNA, 21 nt, Staphylococcus aureus subsp. aureus Mu50
aaccaauuuuaacuuauauac

SEQ ID NO: 3954936 - RNA, 18 nt, Staphylococcus aureus subsp. aureus Mu50
aaccaccaguauaaccau

SEQ ID NO: 3954937 - RNA, 24 nt, Staphylococcus aureus subsp. aureus Mu50
aaccaccuacgcccaucaucacug

SEQ ID NO: 3954938 - RNA, 16 nt, Staphylococcus aureus subsp. aureus Mu50
aaccacgcaucaugua

SEQ ID NO: 3954939 - RNA, 22 nt, Staphylococcus aureus subsp. aureus Mu50
aaccacuuuuuuguucaaucac

SEQ ID NO: 3954940 - RNA, 16 nt, Staphylococcus aureus subsp. aureus Mu50
aaccagcuaaaccauc

SEQ ID NO: 3954941 - RNA, 19 nt, Staphylococcus aureus subsp. aureus Mu50
aaccagcuaaaccaucugu

SEQ ID NO: 3954942 - RNA, 22 nt, Staphylococcus aureus subsp. aureus Mu50
aaccagcuuacugcuuuuuuau

SEQ ID NO: 3954943 - RNA, 17 nt, Staphylococcus aureus subsp. aureus Mu50
aaccaguucgaaaauua

SEQ ID NO: 3954944 - RNA, 21 nt, Staphylococcus aureus subsp. aureus Mu50
aaccaguucgaaaauuauaca

SEQ ID NO: 3954945 - RNA, 14 nt, Staphylococcus aureus subsp. aureus Mu50
aaccauaaugaaca

SEQ ID NO: 3954946 - RNA, 21 nt, Staphylococcus aureus subsp. aureus Mu50
aaccauacucuaacuuaccau

SEQ ID NO: 3954947 - RNA, 21 nt, Staphylococcus aureus subsp. aureus Mu50
aaccaucauucauauggaaua

SEQ ID NO: 3954948 - RNA, 12 nt, Staphylococcus aureus subsp. aureus Mu50
aaccaucugugu

SEQ ID NO: 3954949 - RNA, 23 nt, Staphylococcus aureus subsp. aureus Mu50
aaccaucugugucagcauucaua

SEQ ID NO: 3954950 - RNA, 16 nt, Staphylococcus aureus subsp. aureus Mu50
aaccauguaaaauuag

SEQ ID NO: 3954951 - RNA, 22 nt, Staphylococcus aureus subsp. aureus Mu50
aaccauucgaaagccaauuaau

SEQ ID NO: 3954952 - RNA, 19 nt, Staphylococcus aureus subsp. aureus Mu50
aaccauugaaugaauccca

SEQ ID NO: 3954953 - RNA, 21 nt, Staphylococcus aureus subsp. aureus Mu50
aaccauugaaugaaucccaua

SEQ ID NO: 3954954 - RNA, 16 nt, Staphylococcus aureus subsp. aureus Mu50
aaccauuuaaaaauug

SEQ ID NO: 3954955 - RNA, 14 nt, Staphylococcus aureus subsp. aureus Mu50
aaccauuucaucau

SEQ ID NO: 3954956 - RNA, 15 nt, Staphylococcus aureus subsp. aureus Mu50
aaccauuucaucaua

SEQ ID NO: 3954957 - RNA, 16 nt, Staphylococcus aureus subsp. aureus Mu50
aaccauuuuauuuuaa

SEQ ID NO: 3954958 - RNA, 22 nt, Staphylococcus aureus subsp. aureus Mu50
aaccauuuuuuuaucuguagaa

SEQ ID NO: 3954959 - RNA, 18 nt, Staphylococcus aureus subsp. aureus Mu50
aacccacauuaaauauua

SEQ ID NO: 3954960 - RNA, 20 nt, Staphylococcus aureus subsp. aureus Mu50
aacuaaagguauucuauuuu

SEQ ID NO: 3954961 - RNA, 22 nt, Staphylococcus aureus subsp. aureus Mu50
aacuaaauacgagcguugguaa

SEQ ID NO: 3954962 - RNA, 19 nt, Staphylococcus aureus subsp. aureus Mu50
aacuaacuaauaacucgcu

SEQ ID NO: 3954963 - RNA, 12 nt, Staphylococcus aureus subsp. aureus Mu50
aacuaagauaua

SEQ ID NO: 3954964 - RNA, 14 nt, Staphylococcus aureus subsp. aureus Mu50
aacuaagauauauu

SEQ ID NO: 3954965 - RNA, 16 nt, Staphylococcus aureus subsp. aureus Mu50
aacuaauaacaaauag

SEQ ID NO: 3954966 - RNA, 20 nt, Staphylococcus aureus subsp. aureus Mu50
aacuaauaauuuguaauucc

SEQ ID NO: 3954967 - RNA, 17 nt, Staphylococcus aureus subsp. aureus Mu50
aacuaauagcauuugua

SEQ ID NO: 3954968 - RNA, 20 nt, Staphylococcus aureus subsp. aureus Mu50
aacuaaucguguauuauuga

SEQ ID NO: 3954969 - RNA, 14 nt, Staphylococcus aureus subsp. aureus Mu50
aacuaaugucgcac

SEQ ID NO: 3954970 - RNA, 13 nt, Staphylococcus aureus subsp. aureus Mu50
aacuaauuuaaag

SEQ ID NO: 3954971 - RNA, 16 nt, Staphylococcus aureus subsp. aureus Mu50
aacuaauuuaaagcau

SEQ ID NO: 3954972 - RNA, 21 nt, Staphylococcus aureus subsp. aureus Mu50
aacuaauuuaaagcaucauau

SEQ ID NO: 3954973 - RNA, 13 nt, Staphylococcus aureus subsp. aureus Mu50
aacuaauuuagac

SEQ ID NO: 3954974 - RNA, 22 nt, Staphylococcus aureus subsp. aureus Mu50
aacuacacacguagaaagaugu

SEQ ID NO: 3954975 - RNA, 23 nt, Staphylococcus aureus subsp. aureus Mu50
aacuacgauaccggcaacugguc

SEQ ID NO: 3954976 - RNA, 16 nt, Staphylococcus aureus subsp. aureus Mu50
aacuacgcauuuuaaa

SEQ ID NO: 3954977 - RNA, 23 nt, Staphylococcus aureus subsp. aureus Mu50
aacuacgcauuuuaaauaaaaug

SEQ ID NO: 3954978 - RNA, 16 nt, Staphylococcus aureus subsp. aureus Mu50
aacuacugcaacacca

SEQ ID NO: 3954979 - RNA, 18 nt, Staphylococcus aureus subsp. aureus Mu50
aacuacuuaaauuaagaa

SEQ ID NO: 3954980 - RNA, 13 nt, Staphylococcus aureus subsp. aureus Mu50
aacuacuucauca

SEQ ID NO: 3954981 - RNA, 18 nt, Staphylococcus aureus subsp. aureus Mu50
aacuagaaaacauaaaua

SEQ ID NO: 3954982 - RNA, 15 nt, Staphylococcus aureus subsp. aureus Mu50
aacuagaaugauuaa

SEQ ID NO: 3954983 - RNA, 18 nt, Staphylococcus aureus subsp. aureus Mu50
aacuagcaguaauauguu

SEQ ID NO: 3954984 - RNA, 15 nt, Staphylococcus aureus subsp. aureus Mu50
aacuauaaccuauua

SEQ ID NO: 3954985 - RNA, 18 nt, Staphylococcus aureus subsp. aureus Mu50
aacuauaauaaagauuau

SEQ ID NO: 3954986 - RNA, 19 nt, Staphylococcus aureus subsp. aureus Mu50
aacuauaauaaagauuaua

SEQ ID NO: 3954987 - RNA, 18 nt, Staphylococcus aureus subsp. aureus Mu50
aacuauguuacuuauaua

SEQ ID NO: 3954988 - RNA, 19 nt, Staphylococcus aureus subsp. aureus Mu50
aacuauuaauggcaccaua

SEQ ID NO: 3954989 - RNA, 12 nt, Staphylococcus aureus subsp. aureus Mu50
aacuauucccac

SEQ ID NO: 3954990 - RNA, 15 nt, Staphylococcus aureus subsp. aureus Mu50
aacuauugaaaauag

SEQ ID NO: 3954991 - RNA, 16 nt, Staphylococcus aureus subsp. aureus Mu50
aacucauacaaauuuu

SEQ ID NO: 3954992 - RNA, 16 nt, Staphylococcus aureus subsp. aureus Mu50
aacucauaccaaaaac

SEQ ID NO: 3954993 - RNA, 19 nt, Staphylococcus aureus subsp. aureus Mu50
aacucaugcauaagaaaua

SEQ ID NO: 3954994 - RNA, 21 nt, Staphylococcus aureus subsp. aureus Mu50
aacucaugcauaagaaauacu

SEQ ID NO: 3954995 - RNA, 22 nt, Staphylococcus aureus subsp. aureus Mu50
aacucaugcauaagaaauacua

SEQ ID NO: 3954996 - RNA, 20 nt, Staphylococcus aureus subsp. aureus Mu50
aacucgcauugccuguagaa

SEQ ID NO: 3954997 - RNA, 23 nt, Staphylococcus aureus subsp. aureus Mu50
aacucgcgagaccuauaagucuc

SEQ ID NO: 3954998 - RNA, 20 nt, Staphylococcus aureus subsp. aureus Mu50
aacucguuauagauaaguag

SEQ ID NO: 3954999 - RNA, 22 nt, Staphylococcus aureus subsp. aureus Mu50
aacucuaaaagccaucuuaccu

SEQ ID NO: 3955000 - RNA, 16 nt, Staphylococcus aureus subsp. aureus Mu50
aacucuaaauauaaua

SEQ ID NO: 3955001 - RNA, 24 nt, Staphylococcus aureus subsp. aureus Mu50
aacucuaaauauaauagaaauaau

SEQ ID NO: 3955002 - RNA, 14 nt, Staphylococcus aureus subsp. aureus Mu50
aacucucuaaaaag

SEQ ID NO: 3955003 - RNA, 22 nt, Staphylococcus aureus subsp. aureus Mu50
aacucugauauugaucugauuu

SEQ ID NO: 3955004 - RNA, 21 nt, Staphylococcus aureus subsp. aureus Mu50
aacucuuuuaacccacauuaa

SEQ ID NO: 3955005 - RNA, 19 nt, Staphylococcus aureus subsp. aureus Mu50
aacugacccuugucaguuu

SEQ ID NO: 3955006 - RNA, 23 nt, Staphylococcus aureus subsp. aureus Mu50
aacugaguucaauuaaauuauau

SEQ ID NO: 3955007 - RNA, 23 nt, Staphylococcus aureus subsp. aureus Mu50
aacugauaauacuguuuaaauaa

SEQ ID NO: 3955008 - RNA, 12 nt, Staphylococcus aureus subsp. aureus Mu50
aacugauaauug

SEQ ID NO: 3955009 - RNA, 21 nt, Staphylococcus aureus subsp. aureus Mu50
aacugaucauuuucauuuaau

SEQ ID NO: 3955010 - RNA, 13 nt, Staphylococcus aureus subsp. aureus Mu50
aacugauuuuguu

SEQ ID NO: 3955011 - RNA, 17 nt, Staphylococcus aureus subsp. aureus Mu50
aacugauuuuguuucaa

SEQ ID NO: 3955012 - RNA, 18 nt, Staphylococcus aureus subsp. aureus Mu50
aacugcaaacuugauuca

SEQ ID NO: 3955013 - RNA, 20 nt, Staphylococcus aureus subsp. aureus Mu50
aacugcaaagccauguguag

SEQ ID NO: 3955014 - RNA, 19 nt, Staphylococcus aureus subsp. aureus Mu50
aacugcaauaauuacuaac

SEQ ID NO: 3955015 - RNA, 14 nt, Staphylococcus aureus subsp. aureus Mu50
aacugcauaaaagc

SEQ ID NO: 3955016 - RNA, 15 nt, Staphylococcus aureus subsp. aureus Mu50
aacugcauauaaagu

SEQ ID NO: 3955017 - RNA, 16 nt, Staphylococcus aureus subsp. aureus Mu50
aacugccuaauacacu

SEQ ID NO: 3955018 - RNA, 18 nt, Staphylococcus aureus subsp. aureus Mu50
aacugcugcuaaaauaaa

SEQ ID NO: 3955019 - RNA, 19 nt, Staphylococcus aureus subsp. aureus Mu50
aacugcugcuaaaauaaaa

SEQ ID NO: 3955020 - RNA, 14 nt, Staphylococcus aureus subsp. aureus Mu50
aacuggaacuuaca

SEQ ID NO: 3955021 - RNA, 18 nt, Staphylococcus aureus subsp. aureus Mu50
aacuggaacuuacaaguc

SEQ ID NO: 3955022 - RNA, 16 nt, Staphylococcus aureus subsp. aureus Mu50
aacugguugauaaaua

SEQ ID NO: 3955023 - RNA, 13 nt, Staphylococcus aureus subsp. aureus Mu50
aacuguaaaacau

SEQ ID NO: 3955024 - RNA, 23 nt, Staphylococcus aureus subsp. aureus Mu50
aacuguaacgugaggcccauaaa

SEQ ID NO: 3955025 - RNA, 23 nt, Staphylococcus aureus subsp. aureus Mu50
aacuguaugccgccuaauaauaa

SEQ ID NO: 3955026 - RNA, 22 nt, Staphylococcus aureus subsp. aureus Mu50
aacugucgcucauccucauuaa

SEQ ID NO: 3955027 - RNA, 20 nt, Staphylococcus aureus subsp. aureus Mu50
aacugugauauuaauugaaa

SEQ ID NO: 3955028 - RNA, 23 nt, Staphylococcus aureus subsp. aureus Mu50
aacugugauauuaauugaaaaac

SEQ ID NO: 3955029 - RNA, 17 nt, Staphylococcus aureus subsp. aureus Mu50
aacuguuaaacucauac

SEQ ID NO: 3955030 - RNA, 22 nt, Staphylococcus aureus subsp. aureus Mu50
aacuguucuuucgucuuguaaa

SEQ ID NO: 3955031 - RNA, 23 nt, Staphylococcus aureus subsp. aureus Mu50
aacuguucuuucgucuuguaaac

SEQ ID NO: 3955032 - RNA, 15 nt, Staphylococcus aureus subsp. aureus Mu50
aacuguuuaucauga

SEQ ID NO: 3955033 - RNA, 18 nt, Staphylococcus aureus subsp. aureus Mu50
aacuguuucuguaaaagu

SEQ ID NO: 3955034 - RNA, 13 nt, Staphylococcus aureus subsp. aureus Mu50
aacuuaaaaauga

SEQ ID NO: 3955035 - RNA, 23 nt, Staphylococcus aureus subsp. aureus Mu50
aacuuaaaaaugaaaugaaguau

SEQ ID NO: 3955036 - RNA, 13 nt, Staphylococcus aureus subsp. aureus Mu50
aacuuaaaacuau

SEQ ID NO: 3955037 - RNA, 15 nt, Staphylococcus aureus subsp. aureus Mu50
aacuuaaaauuuaaa

SEQ ID NO: 3955038 - RNA, 12 nt, Staphylococcus aureus subsp. aureus Mu50
aacuuaaauauc

SEQ ID NO: 3955039 - RNA, 20 nt, Staphylococcus aureus subsp. aureus Mu50
aacuuaaauaucgacaaauu

SEQ ID NO: 3955040 - RNA, 21 nt, Staphylococcus aureus subsp. aureus Mu50
aacuuaauacgauaauaacua

SEQ ID NO: 3955041 - RNA, 17 nt, Staphylococcus aureus subsp. aureus Mu50
aacuuaaucaagcuagc

SEQ ID NO: 3955042 - RNA, 13 nt, Staphylococcus aureus subsp. aureus Mu50
aacuuaauuaaaa

SEQ ID NO: 3955043 - RNA, 22 nt, Staphylococcus aureus subsp. aureus Mu50
aacuuaauuaaaaaaagauuag

SEQ ID NO: 3955044 - RNA, 24 nt, Staphylococcus aureus subsp. aureus Mu50
aacuuaauuaaaaaaagauuagua

SEQ ID NO: 3955045 - RNA, 22 nt, Staphylococcus aureus subsp. aureus Mu50
aacuuaccaugaugagauaaaa

SEQ ID NO: 3955046 - RNA, 14 nt, Staphylococcus aureus subsp. aureus Mu50
aacuuacuuuugua

SEQ ID NO: 3955047 - RNA, 20 nt, Staphylococcus aureus subsp. aureus Mu50
aagaaugccuuuuauuuauc

SEQ ID NO: 3955048 - RNA, 17 nt, Staphylococcus aureus subsp. aureus Mu50
aagaaugcgaagauuuu

SEQ ID NO: 3955049 - RNA, 19 nt, Staphylococcus aureus subsp. aureus Mu50
aagaaugcgaagauuuuua

SEQ ID NO: 3955050 - RNA, 18 nt, Staphylococcus aureus subsp. aureus Mu50
aagaauguuucauaugca

SEQ ID NO: 3955051 - RNA, 22 nt, Staphylococcus aureus subsp. aureus Mu50
aagaauuaacaacaaauauaau

SEQ ID NO: 3955052 - RNA, 23 nt, Staphylococcus aureus subsp. aureus Mu50
aagaauuaauucgccuaaauggu

SEQ ID NO: 3955053 - RNA, 17 nt, Staphylococcus aureus subsp. aureus Mu50
aagaauuguugaucaug

SEQ ID NO: 3955054 - RNA, 12 nt, Staphylococcus aureus subsp. aureus Mu50
aagaauuuaaaa

SEQ ID NO: 3955055 - RNA, 15 nt, Staphylococcus aureus subsp. aureus Mu50
aagaauuuaaaagag

SEQ ID NO: 3955056 - RNA, 16 nt, Staphylococcus aureus subsp. aureus Mu50
aagaauuuaaaagaga

SEQ ID NO: 3955057 - RNA, 17 nt, Staphylococcus aureus subsp. aureus Mu50
aagaauuucgaaaagaa

SEQ ID NO: 3955058 - RNA, 19 nt, Staphylococcus aureus subsp. aureus Mu50
aagaauuucgaaaagaaau

SEQ ID NO: 3955059 - RNA, 20 nt, Staphylococcus aureus subsp. aureus Mu50
aagaauuucgaaaagaaauu

SEQ ID NO: 3955060 - RNA, 11 nt, Staphylococcus aureus subsp. aureus Mu50
aagacagaaau

SEQ ID NO: 3955061 - RNA, 21 nt, Staphylococcus aureus subsp. aureus Mu50
aagacagcuucucauugaaau

SEQ ID NO: 3955062 - RNA, 19 nt, Staphylococcus aureus subsp. aureus Mu50
aagacauacagucaauaca

SEQ ID NO: 3955063 - RNA, 21 nt, Staphylococcus aureus subsp. aureus Mu50
aagacauacucacaaaaaaca

SEQ ID NO: 3955064 - RNA, 15 nt, Staphylococcus aureus subsp. aureus Mu50
aagacaugagauuau

SEQ ID NO: 3955065 - RNA, 14 nt, Staphylococcus aureus subsp. aureus Mu50
aagacauuuaaaua

SEQ ID NO: 3955066 - RNA, 22 nt, Staphylococcus aureus subsp. aureus Mu50
aagaccaaauauuuuaucugua

SEQ ID NO: 3955067 - RNA, 13 nt, Staphylococcus aureus subsp. aureus Mu50
aagaccauuuuau

SEQ ID NO: 3955068 - RNA, 19 nt, Staphylococcus aureus subsp. aureus Mu50
aagaccauuuuauauuuua

SEQ ID NO: 3955069 - RNA, 20 nt, Staphylococcus aureus subsp. aureus Mu50
aagaccauuuuauauuuuag

SEQ ID NO: 3955070 - RNA, 21 nt, Staphylococcus aureus subsp. aureus Mu50
aagaccauuuuauauuuuagu

SEQ ID NO: 3955071 - RNA, 17 nt, Staphylococcus aureus subsp. aureus Mu50
aagaccccgaaaagagg

SEQ ID NO: 3955072 - RNA, 21 nt, Staphylococcus aureus subsp. aureus Mu50
aagaccguauccuguguaaaa

SEQ ID NO: 3955073 - RNA, 23 nt, Staphylococcus aureus subsp. aureus Mu50
aagaccuucuucucuaaucacuu

SEQ ID NO: 3955074 - RNA, 22 nt, Staphylococcus aureus subsp. aureus Mu50
aagacgauuuauuaguuuuuac

SEQ ID NO: 3955075 - RNA, 20 nt, Staphylococcus aureus subsp. aureus Mu50
aagacugauuaauuauugag

SEQ ID NO: 3955076 - RNA, 22 nt, Staphylococcus aureus subsp. aureus Mu50
aagacugauuaauuauugagaa

SEQ ID NO: 3955077 - RNA, 11 nt, Staphylococcus aureus subsp. aureus Mu50
aagacugccau

SEQ ID NO: 3955078 - RNA, 22 nt, Staphylococcus aureus subsp. aureus Mu50
aagacuucguugcacuuuaaua

SEQ ID NO: 3955079 - RNA, 18 nt, Staphylococcus aureus subsp. aureus Mu50
aagagaacuuuucaaaca

SEQ ID NO: 3955080 - RNA, 21 nt, Staphylococcus aureus subsp. aureus Mu50
aagagaaucgaaccaaauuuu

SEQ ID NO: 3955081 - RNA, 14 nt, Staphylococcus aureus subsp. aureus Mu50
aagagaauuuuaau

SEQ ID NO: 3955082 - RNA, 20 nt, Staphylococcus aureus subsp. aureus Mu50
aagagcaagugucaaauacg

SEQ ID NO: 3955083 - RNA, 14 nt, Staphylococcus aureus subsp. aureus Mu50
aagagcaauuaaag

SEQ ID NO: 3955084 - RNA, 24 nt, Staphylococcus aureus subsp. aureus Mu50
aagagccacuaaugauuuauuaug

SEQ ID NO: 3955085 - RNA, 22 nt, Staphylococcus aureus subsp. aureus Mu50
aagaggacaacuaauaacaaau

SEQ ID NO: 3955086 - RNA, 21 nt, Staphylococcus aureus subsp. aureus Mu50
aagaggcgccacaacauguuu

SEQ ID NO: 3955087 - RNA, 13 nt, Staphylococcus aureus subsp. aureus Mu50
aagagguuugaca

SEQ ID NO: 3955088 - RNA, 21 nt, Staphylococcus aureus subsp. aureus Mu50
aagaguacagcgguuuguaug

SEQ ID NO: 3955089 - RNA, 17 nt, Staphylococcus aureus subsp. aureus Mu50
aagauaacgagugaaaa

SEQ ID NO: 3955090 - RNA, 21 nt, Staphylococcus aureus subsp. aureus Mu50
aagauaacuagcaaaugcacu

SEQ ID NO: 3955091 - RNA, 14 nt, Staphylococcus aureus subsp. aureus Mu50
aagauaauauuaaa

SEQ ID NO: 3955092 - RNA, 16 nt, Staphylococcus aureus subsp. aureus Mu50
aagauaauuuucaauu

SEQ ID NO: 3955093 - RNA, 21 nt, Staphylococcus aureus subsp. aureus Mu50
aagauacguugauguaauucu

SEQ ID NO: 3955094 - RNA, 22 nt, Staphylococcus aureus subsp. aureus Mu50
aagauagagcccuuagcaauau

SEQ ID NO: 3955095 - RNA, 17 nt, Staphylococcus aureus subsp. aureus Mu50
aagauagauaaaucaag

SEQ ID NO: 3955096 - RNA, 16 nt, Staphylococcus aureus subsp. aureus Mu50
aagauaggauuuacac

SEQ ID NO: 3955097 - RNA, 17 nt, Staphylococcus aureus subsp. aureus Mu50
aagauagguuuauuucu

SEQ ID NO: 3955098 - RNA, 20 nt, Staphylococcus aureus subsp. aureus Mu50
aagauagguuuauuucugac

SEQ ID NO: 3955099 - RNA, 22 nt, Staphylococcus aureus subsp. aureus Mu50
aagauagguuuauuucugacaa

SEQ ID NO: 3955100 - RNA, 13 nt, Staphylococcus aureus subsp. aureus Mu50
aagauauccauua

SEQ ID NO: 3955101 - RNA, 16 nt, Staphylococcus aureus subsp. aureus Mu50
aagauauguuuauauu

SEQ ID NO: 3955102 - RNA, 21 nt, Staphylococcus aureus subsp. aureus Mu50
aagauauguuuauauugcaaa

SEQ ID NO: 3955103 - RNA, 14 nt, Staphylococcus aureus subsp. aureus Mu50
aagauauuuccaaa

SEQ ID NO: 3955104 - RNA, 21 nt, Staphylococcus aureus subsp. aureus Mu50
aagaucacacgacauguaggu

SEQ ID NO: 3955105 - RNA, 18 nt, Staphylococcus aureus subsp. aureus Mu50
aagaucauuuucaacaua

SEQ ID NO: 3955106 - RNA, 21 nt, Staphylococcus aureus subsp. aureus Mu50
aagaugaaauauucuuuaaua

SEQ ID NO: 3955107 - RNA, 18 nt, Staphylococcus aureus subsp. aureus Mu50
aagaugccucaguuagaa

SEQ ID NO: 3955108 - RNA, 15 nt, Staphylococcus aureus subsp. aureus Mu50
aagaugcucauugca

SEQ ID NO: 3955109 - RNA, 15 nt, Staphylococcus aureus subsp. aureus Mu50
aagaugcuuuaauua

SEQ ID NO: 3955110 - RNA, 18 nt, Staphylococcus aureus subsp. aureus Mu50
aagaugcuuuaauuaaag

SEQ ID NO: 3955111 - RNA, 20 nt, Staphylococcus aureus subsp. aureus Mu50
aagaugcuuuaauuaaaguu

SEQ ID NO: 3955112 - RNA, 21 nt, Staphylococcus aureus subsp. aureus Mu50
aagaugcuuuaauuaaaguua

SEQ ID NO: 3955113 - RNA, 19 nt, Staphylococcus aureus subsp. aureus Mu50
aagauggcugcaucaauau

SEQ ID NO: 3955114 - RNA, 23 nt, Staphylococcus aureus subsp. aureus Mu50
aagaugguuugaguaaauuaaua

SEQ ID NO: 3955115 - RNA, 15 nt, Staphylococcus aureus subsp. aureus Mu50
aagauguauaugaau

SEQ ID NO: 3955116 - RNA, 21 nt, Staphylococcus aureus subsp. aureus Mu50
aagauguauaugaauuuuaua

SEQ ID NO: 3955117 - RNA, 16 nt, Staphylococcus aureus subsp. aureus Mu50
aagaugucgaaaagua

SEQ ID NO: 3955118 - RNA, 22 nt, Staphylococcus aureus subsp. aureus Mu50
aagaugugcaucccgaaaguua

SEQ ID NO: 3955119 - RNA, 21 nt, Staphylococcus aureus subsp. aureus Mu50
aagauguuugcaacauauuuu

SEQ ID NO: 3955120 - RNA, 22 nt, Staphylococcus aureus subsp. aureus Mu50
aagauuagaugauauuuaacaa

SEQ ID NO: 3955121 - RNA, 16 nt, Staphylococcus aureus subsp. aureus Mu50
aagauuaugaaaacau

SEQ ID NO: 3955122 - RNA, 14 nt, Staphylococcus aureus subsp. aureus Mu50
aagauuauuauuac

SEQ ID NO: 3955123 - RNA, 19 nt, Staphylococcus aureus subsp. aureus Mu50
aagauuauuugcgauauca

SEQ ID NO: 3955124 - RNA, 13 nt, Staphylococcus aureus subsp. aureus Mu50
aagauuuuaacuu

SEQ ID NO: 3955125 - RNA, 14 nt, Staphylococcus aureus subsp. aureus Mu50
aagcaauacgauug

SEQ ID NO: 3955126 - RNA, 20 nt, Staphylococcus aureus subsp. aureus Mu50
aagcaauacgauugcaauug

SEQ ID NO: 3955127 - RNA, 15 nt, Staphylococcus aureus subsp. aureus Mu50
aagcacgauaaaaau

SEQ ID NO: 3955128 - RNA, 13 nt, Staphylococcus aureus subsp. aureus Mu50
aagcauaccuaca

SEQ ID NO: 3955129 - RNA, 15 nt, Staphylococcus aureus subsp. aureus Mu50
aagcauaccuacaga

SEQ ID NO: 3955130 - RNA, 14 nt, Staphylococcus aureus subsp. aureus Mu50
aagcauauuucuaa

SEQ ID NO: 3955131 - RNA, 17 nt, Staphylococcus aureus subsp. aureus Mu50
aagcauauuucuaaauu

SEQ ID NO: 3955132 - RNA, 14 nt, Staphylococcus aureus subsp. aureus Mu50
aagcaucauauaca

SEQ ID NO: 3955133 - RNA, 17 nt, Staphylococcus aureus subsp. aureus Mu50
aagcaucauauacauac

SEQ ID NO: 3955134 - RNA, 19 nt, Staphylococcus aureus subsp. aureus Mu50
aagguguucgggaauuuuu

SEQ ID NO: 3955135 - RNA, 13 nt, Staphylococcus aureus subsp. aureus Mu50
aagguguugaaaa

SEQ ID NO: 3955136 - RNA, 22 nt, Staphylococcus aureus subsp. aureus Mu50
aagguuaauuggguuuaauaac

SEQ ID NO: 3955137 - RNA, 23 nt, Staphylococcus aureus subsp. aureus Mu50
aagguucuuuuuuuaccuaauug

SEQ ID NO: 3955138 - RNA, 17 nt, Staphylococcus aureus subsp. aureus Mu50
aagguuguucuauacau

SEQ ID NO: 3955139 - RNA, 22 nt, Staphylococcus aureus subsp. aureus Mu50
aagguuguuuuucaucauuaaa

SEQ ID NO: 3955140 - RNA, 12 nt, Staphylococcus aureus subsp. aureus Mu50
aaguaaaacugc

SEQ ID NO: 3955141 - RNA, 14 nt, Staphylococcus aureus subsp. aureus Mu50
aaguaaaaguuuug

SEQ ID NO: 3955142 - RNA, 14 nt, Staphylococcus aureus subsp. aureus Mu50
aaguaaaauaaaaa

SEQ ID NO: 3955143 - RNA, 15 nt, Staphylococcus aureus subsp. aureus Mu50
aaguaaaauauacuu

SEQ ID NO: 3955144 - RNA, 16 nt, Staphylococcus aureus subsp. aureus Mu50
aaguaacucaagugau

SEQ ID NO: 3955145 - RNA, 16 nt, Staphylococcus aureus subsp. aureus Mu50
aaguaagcaccuguua

SEQ ID NO: 3955146 - RNA, 18 nt, Staphylococcus aureus subsp. aureus Mu50
aaguaagcagagccauaa

SEQ ID NO: 3955147 - RNA, 12 nt, Staphylococcus aureus subsp. aureus Mu50
aaguaaguaaaa

SEQ ID NO: 3955148 - RNA, 15 nt, Staphylococcus aureus subsp. aureus Mu50
aaguaaguaaaauaa

SEQ ID NO: 3955149 - RNA, 15 nt, Staphylococcus aureus subsp. aureus Mu50
aaguaauaauauaaa

SEQ ID NO: 3955150 - RNA, 20 nt, Staphylococcus aureus subsp. aureus Mu50
aaguaauaauauaaauaaaa

SEQ ID NO: 3955151 - RNA, 15 nt, Staphylococcus aureus subsp. aureus Mu50
aaguaauauauaaaa

SEQ ID NO: 3955152 - RNA, 21 nt, Staphylococcus aureus subsp. aureus Mu50
aaguaauaugagugaaaguuu

SEQ ID NO: 3955153 - RNA, 14 nt, Staphylococcus aureus subsp. aureus Mu50
aaguaaucauaaua

SEQ ID NO: 3955154 - RNA, 22 nt, Staphylococcus aureus subsp. aureus Mu50
aaguaauccccgaagcacagaa

SEQ ID NO: 3955155 - RNA, 17 nt, Staphylococcus aureus subsp. aureus Mu50
aaguaauggauugauaa

SEQ ID NO: 3955156 - RNA, 23 nt, Staphylococcus aureus subsp. aureus Mu50
aaguaauggauugauaauagcuu

SEQ ID NO: 3955157 - RNA, 13 nt, Staphylococcus aureus subsp. aureus Mu50
aaguaauguuaaa

SEQ ID NO: 3955158 - RNA, 15 nt, Staphylococcus aureus subsp. aureus Mu50
aaguaauuaaauacu

SEQ ID NO: 3955159 - RNA, 13 nt, Staphylococcus aureus subsp. aureus Mu50
aaguaauuuaauu

SEQ ID NO: 3955160 - RNA, 14 nt, Staphylococcus aureus subsp. aureus Mu50
aaguacaaauaaua

SEQ ID NO: 3955161 - RNA, 17 nt, Staphylococcus aureus subsp. aureus Mu50
aaguacacgaauaccaa

SEQ ID NO: 3955162 - RNA, 18 nt, Staphylococcus aureus subsp. aureus Mu50
aaguacacgaauaccaag

SEQ ID NO: 3955163 - RNA, 14 nt, Staphylococcus aureus subsp. aureus Mu50
aaguacauaaaugc

SEQ ID NO: 3955164 - RNA, 21 nt, Staphylococcus aureus subsp. aureus Mu50
aaguacauaaaugcuaaaagu

SEQ ID NO: 3955165 - RNA, 15 nt, Staphylococcus aureus subsp. aureus Mu50
aaguaccaucucuau

SEQ ID NO: 3955166 - RNA, 15 nt, Staphylococcus aureus subsp. aureus Mu50
aaguaccuaaaauag

SEQ ID NO: 3955167 - RNA, 18 nt, Staphylococcus aureus subsp. aureus Mu50
aaguaccuaaaauagaaa

SEQ ID NO: 3955168 - RNA, 19 nt, Staphylococcus aureus subsp. aureus Mu50
aaguaccuaaaauagaaaa

SEQ ID NO: 3955169 - RNA, 22 nt, Staphylococcus aureus subsp. aureus Mu50
aaguacgacgguauaaaaaaau

SEQ ID NO: 3955170 - RNA, 14 nt, Staphylococcus aureus subsp. aureus Mu50
aaguacgcaauuua

SEQ ID NO: 3955171 - RNA, 22 nt, Staphylococcus aureus subsp. aureus Mu50
aaguacgcaauuuaauauuaua

SEQ ID NO: 3955172 - RNA, 17 nt, Staphylococcus aureus subsp. aureus Mu50
aaguacuuacaaauaua

SEQ ID NO: 3955173 - RNA, 20 nt, Staphylococcus aureus subsp. aureus Mu50
aaguacuuuaaaauuguaua

SEQ ID NO: 3955174 - RNA, 14 nt, Staphylococcus aureus subsp. aureus Mu50
aaguacuuuaccac

SEQ ID NO: 3955175 - RNA, 16 nt, Staphylococcus aureus subsp. aureus Mu50
aaguacuuuaccacga

SEQ ID NO: 3955176 - RNA, 15 nt, Staphylococcus aureus subsp. aureus Mu50
aaguagaaaauauga

SEQ ID NO: 3955177 - RNA, 16 nt, Staphylococcus aureus subsp. aureus Mu50
aaguagacauugaaag

SEQ ID NO: 3955178 - RNA, 14 nt, Staphylococcus aureus subsp. aureus Mu50
aaguagauauugaa

SEQ ID NO: 3955179 - RNA, 17 nt, Staphylococcus aureus subsp. aureus Mu50
aaguaguggauaaucac

SEQ ID NO: 3955180 - RNA, 18 nt, Staphylococcus aureus subsp. aureus Mu50
aaguaguucagcaaguuu

SEQ ID NO: 3955181 - RNA, 18 nt, Staphylococcus aureus subsp. aureus Mu50
aaguaguuguuauauucu

SEQ ID NO: 3955182 - RNA, 13 nt, Staphylococcus aureus subsp. aureus Mu50
aaguaguuucauu

SEQ ID NO: 3955183 - RNA, 18 nt, Staphylococcus aureus subsp. aureus Mu50
aaguauaagguugaagaa

SEQ ID NO: 3955184 - RNA, 17 nt, Staphylococcus aureus subsp. aureus Mu50
aaguauacuaaacuuuu

SEQ ID NO: 3955185 - RNA, 14 nt, Staphylococcus aureus subsp. aureus Mu50
aaguauagcuuuua

SEQ ID NO: 3955186 - RNA, 14 nt, Staphylococcus aureus subsp. aureus Mu50
aaguauaucuuuga

SEQ ID NO: 3955187 - RNA, 21 nt, Staphylococcus aureus subsp. aureus Mu50
aaguauaugaaucgauauaau

SEQ ID NO: 3955188 - RNA, 20 nt, Staphylococcus aureus subsp. aureus Mu50
aaguauauugcuuauguaca

SEQ ID NO: 3955189 - RNA, 17 nt, Staphylococcus aureus subsp. aureus Mu50
aaguaucauaauuuugu

SEQ ID NO: 3955190 - RNA, 18 nt, Staphylococcus aureus subsp. aureus Mu50
aaguaucgccaaucuauu

SEQ ID NO: 3955191 - RNA, 19 nt, Staphylococcus aureus subsp. aureus Mu50
aaguaucgccaaucuauug

SEQ ID NO: 3955192 - RNA, 23 nt, Staphylococcus aureus subsp. aureus Mu50
aaguaucgccaaucuauugcaau

SEQ ID NO: 3955193 - RNA, 20 nt, Staphylococcus aureus subsp. aureus Mu50
aaguaucgccaucauucacc

SEQ ID NO: 3955194 - RNA, 20 nt, Staphylococcus aureus subsp. aureus Mu50
aaguaucuaugaaauuuuuu

SEQ ID NO: 3955195 - RNA, 19 nt, Staphylococcus aureus subsp. aureus Mu50
aaguaucugugaauaugcu

SEQ ID NO: 3955196 - RNA, 16 nt, Staphylococcus aureus subsp. aureus Mu50
aaguaugaguuauuaa

SEQ ID NO: 3955197 - RNA, 17 nt, Staphylococcus aureus subsp. aureus Mu50
aaguaugauagaugaua

SEQ ID NO: 3955198 - RNA, 21 nt, Staphylococcus aureus subsp. aureus Mu50
aaguaugauagaugauacauu

SEQ ID NO: 3955199 - RNA, 16 nt, Staphylococcus aureus subsp. aureus Mu50
aaguauggaaguuguu

SEQ ID NO: 3955200 - RNA, 14 nt, Staphylococcus aureus subsp. aureus Mu50
aaguauggcaguuu

SEQ ID NO: 3955201 - RNA, 19 nt, Staphylococcus aureus subsp. aureus Mu50
aaguauggcgaaauguuuu

SEQ ID NO: 3955202 - RNA, 22 nt, Staphylococcus aureus subsp. aureus Mu50
aaguauggcgaaauguuuugga

SEQ ID NO: 3955203 - RNA, 17 nt, Staphylococcus aureus subsp. aureus Mu50
aaguauuagauauauuu

SEQ ID NO: 3955204 - RNA, 23 nt, Staphylococcus aureus subsp. aureus Mu50
aaguauuaugauugcuuauuuau

SEQ ID NO: 3955205 - RNA, 17 nt, Staphylococcus aureus subsp. aureus Mu50
aaguauugccaaauuuc

SEQ ID NO: 3955206 - RNA, 13 nt, Staphylococcus aureus subsp. aureus Mu50
aaguauuuaaaua

SEQ ID NO: 3955207 - RNA, 16 nt, Staphylococcus aureus subsp. aureus Mu50
aaguauuuaaauaaca

SEQ ID NO: 3955208 - RNA, 23 nt, Staphylococcus aureus subsp. aureus Mu50
aaguauuuucuuaguuugacauc

SEQ ID NO: 3955209 - RNA, 17 nt, Staphylococcus aureus subsp. aureus Mu50
aagucaauaauuuuauc

SEQ ID NO: 3955210 - RNA, 15 nt, Staphylococcus aureus subsp. aureus Mu50
aagucacaguguaau

SEQ ID NO: 3955211 - RNA, 18 nt, Staphylococcus aureus subsp. aureus Mu50
aagucacuugucaugccg

SEQ ID NO: 3955212 - RNA, 14 nt, Staphylococcus aureus subsp. aureus Mu50
aagucagcuuacaa

SEQ ID NO: 3955213 - RNA, 22 nt, Staphylococcus aureus subsp. aureus Mu50
aagucaguauaaguuucuggca

SEQ ID NO: 3955214 - RNA, 13 nt, Staphylococcus aureus subsp. aureus Mu50
aagucauuaaaug

SEQ ID NO: 3955215 - RNA, 15 nt, Staphylococcus aureus subsp. aureus Mu50
aagucauuaaaugua

SEQ ID NO: 3955216 - RNA, 16 nt, Staphylococcus aureus subsp. aureus Mu50
aagucauuaaauguac

SEQ ID NO: 3955217 - RNA, 21 nt, Staphylococcus aureus subsp. aureus Mu50
aagucguaucauauauugacu

SEQ ID NO: 3955218 - RNA, 17 nt, Staphylococcus aureus subsp. aureus Mu50
aagucguucaauuguug

SEQ ID NO: 3955219 - RNA, 19 nt, Staphylococcus aureus subsp. aureus Mu50
aagucuaacaguuaauaug

SEQ ID NO: 3955220 - RNA, 16 nt, Staphylococcus aureus subsp. aureus Mu50
aagucuagcauuagaa

SEQ ID NO: 3955221 - RNA, 19 nt, Staphylococcus aureus subsp. aureus Mu50
aagucuaguucgaacacac

SEQ ID NO: 3955222 - RNA, 22 nt, Staphylococcus aureus subsp. aureus Mu50
aaguuucgcagcuuuauaaugu

SEQ ID NO: 3955223 - RNA, 22 nt, Staphylococcus aureus subsp. aureus Mu50
aaguuucgcugcuacaccaccu

SEQ ID NO: 3955224 - RNA, 21 nt, Staphylococcus aureus subsp. aureus Mu50
aaguuugguuucuuaacauaa

SEQ ID NO: 3955225 - RNA, 13 nt, Staphylococcus aureus subsp. aureus Mu50
aaguuuucauuua

SEQ ID NO: 3955226 - RNA, 23 nt, Staphylococcus aureus subsp. aureus Mu50
aaguuuuucaggguuuaagauuu

SEQ ID NO: 3955227 - RNA, 15 nt, Staphylococcus aureus subsp. aureus Mu50
aaguuuuugaauauc

SEQ ID NO: 3955228 - RNA, 21 nt, Staphylococcus aureus subsp. aureus Mu50
aauaaaaaaaucacgcuaaca

SEQ ID NO: 3955229 - RNA, 14 nt, Staphylococcus aureus subsp. aureus Mu50
aauaaaaaaaugau

SEQ ID NO: 3955230 - RNA, 19 nt, Staphylococcus aureus subsp. aureus Mu50
aauaaaaacucuaaaaguu

SEQ ID NO: 3955231 - RNA, 16 nt, Staphylococcus aureus subsp. aureus Mu50
aauaaaaaggagcgac

SEQ ID NO: 3955232 - RNA, 15 nt, Staphylococcus aureus subsp. aureus Mu50
aauaaaaauacauaa

SEQ ID NO: 3955233 - RNA, 17 nt, Staphylococcus aureus subsp. aureus Mu50
aauaaaaauacauaauu

SEQ ID NO: 3955234 - RNA, 21 nt, Staphylococcus aureus subsp. aureus Mu50
aauaaaaaugccgagauuauu

SEQ ID NO: 3955235 - RNA, 19 nt, Staphylococcus aureus subsp. aureus Mu50
aauaaaaauuauauaaauu

SEQ ID NO: 3955236 - RNA, 13 nt, Staphylococcus aureus subsp. aureus Mu50
aauaaaacaaauu

SEQ ID NO: 3955237 - RNA, 20 nt, Staphylococcus aureus subsp. aureus Mu50
aauaaaacgcuucauauaaa

SEQ ID NO: 3955238 - RNA, 14 nt, Staphylococcus aureus subsp. aureus Mu50
aauaaaacuuauaa

SEQ ID NO: 3955239 - RNA, 13 nt, Staphylococcus aureus subsp. aureus Mu50
aauaaaaggcuuu

SEQ ID NO: 3955240 - RNA, 18 nt, Staphylococcus aureus subsp. aureus Mu50
aauaaaaggcuuuguuaa

SEQ ID NO: 3955241 - RNA, 19 nt, Staphylococcus aureus subsp. aureus Mu50
aauaaaaggcuuuguuaaa

SEQ ID NO: 3955242 - RNA, 18 nt, Staphylococcus aureus subsp. aureus Mu50
aauaaaagucgauaaaua

SEQ ID NO: 3955243 - RNA, 17 nt, Staphylococcus aureus subsp. aureus Mu50
aauaaaaguuaccuacu

SEQ ID NO: 3955244 - RNA, 15 nt, Staphylococcus aureus subsp. aureus Mu50
aauaaaaugcuacaa

SEQ ID NO: 3955245 - RNA, 23 nt, Staphylococcus aureus subsp. aureus Mu50
aauaaaauuacuugaauauuauu

SEQ ID NO: 3955246 - RNA, 16 nt, Staphylococcus aureus subsp. aureus Mu50
aauaaacaacuaaagg

SEQ ID NO: 3955247 - RNA, 15 nt, Staphylococcus aureus subsp. aureus Mu50
aauaaacaacugcaa

SEQ ID NO: 3955248 - RNA, 20 nt, Staphylococcus aureus subsp. aureus Mu50
aauaaacgauugauuaucau

SEQ ID NO: 3955249 - RNA, 22 nt, Staphylococcus aureus subsp. aureus Mu50
aauaaagcugauuuuucauuga

SEQ ID NO: 3955250 - RNA, 17 nt, Staphylococcus aureus subsp. aureus Mu50
aauaaaggcaacaaaua

SEQ ID NO: 3955251 - RNA, 16 nt, Staphylococcus aureus subsp. aureus Mu50
aauaaauaaacaacug

SEQ ID NO: 3955252 - RNA, 18 nt, Staphylococcus aureus subsp. aureus Mu50
aauaaauaagcaaucaua

SEQ ID NO: 3955253 - RNA, 19 nt, Staphylococcus aureus subsp. aureus Mu50
aauaaauaagcaaucauaa

SEQ ID NO: 3955254 - RNA, 14 nt, Staphylococcus aureus subsp. aureus Mu50
aauaaauacaaugu

SEQ ID NO: 3955255 - RNA, 16 nt, Staphylococcus aureus subsp. aureus Mu50
aauaaauacaauguua

SEQ ID NO: 3955256 - RNA, 22 nt, Staphylococcus aureus subsp. aureus Mu50
aauaaauagacugccaauaaaa

SEQ ID NO: 3955257 - RNA, 17 nt, Staphylococcus aureus subsp. aureus Mu50
aauaaauagauaauaua

SEQ ID NO: 3955258 - RNA, 21 nt, Staphylococcus aureus subsp. aureus Mu50
aauaaaucacgccauaaucuu

SEQ ID NO: 3955259 - RNA, 20 nt, Staphylococcus aureus subsp. aureus Mu50
aauaaaucaguaguuuuaaa

SEQ ID NO: 3955260 - RNA, 20 nt, Staphylococcus aureus subsp. aureus Mu50
aauaaaucauacgagaaauu

SEQ ID NO: 3955261 - RNA, 17 nt, Staphylococcus aureus subsp. aureus Mu50
aauaaaucuaucuacuc

SEQ ID NO: 3955262 - RNA, 18 nt, Staphylococcus aureus subsp. aureus Mu50
aauaaaucuaucuacuca

SEQ ID NO: 3955263 - RNA, 17 nt, Staphylococcus aureus subsp. aureus Mu50
aauaaaugacauuuaau

SEQ ID NO: 3955264 - RNA, 14 nt, Staphylococcus aureus subsp. aureus Mu50
aauaaauguuaaag

SEQ ID NO: 3955265 - RNA, 20 nt, Staphylococcus aureus subsp. aureus Mu50
aauaaauguuaaagauuauu

SEQ ID NO: 3955266 - RNA, 13 nt, Staphylococcus aureus subsp. aureus Mu50
aauaaauuaaauu

SEQ ID NO: 3955267 - RNA, 21 nt, Staphylococcus aureus subsp. aureus Mu50
aauaaauuaugaaagugaauu

SEQ ID NO: 3955268 - RNA, 13 nt, Staphylococcus aureus subsp. aureus Mu50
aauaaauucucuu

SEQ ID NO: 3955269 - RNA, 23 nt, Staphylococcus aureus subsp. aureus Mu50
aauaaauugcacgucuuguauca

SEQ ID NO: 3955270 - RNA, 18 nt, Staphylococcus aureus subsp. aureus Mu50
aauaaauuguaugaauaa

SEQ ID NO: 3955271 - RNA, 19 nt, Staphylococcus aureus subsp. aureus Mu50
aauaaauuguaugaauaau

SEQ ID NO: 3955272 - RNA, 19 nt, Staphylococcus aureus subsp. aureus Mu50
aauaaauuguauuucuuaa

SEQ ID NO: 3955273 - RNA, 21 nt, Staphylococcus aureus subsp. aureus Mu50
aauaaauuuagauauuauaaa

SEQ ID NO: 3955274 - RNA, 13 nt, Staphylococcus aureus subsp. aureus Mu50
aauaaauuuuaua

SEQ ID NO: 3955275 - RNA, 20 nt, Staphylococcus aureus subsp. aureus Mu50
aauaaauuuugcgaaaauau

SEQ ID NO: 3955276 - RNA, 17 nt, Staphylococcus aureus subsp. aureus Mu50
aauaacaaaauuaaaua

SEQ ID NO: 3955277 - RNA, 21 nt, Staphylococcus aureus subsp. aureus Mu50
aauaacaaucaaagagccaga

SEQ ID NO: 3955278 - RNA, 23 nt, Staphylococcus aureus subsp. aureus Mu50
aauaacacaugcacuuuauuaaa

SEQ ID NO: 3955279 - RNA, 15 nt, Staphylococcus aureus subsp. aureus Mu50
aauaacaccaauuga

SEQ ID NO: 3955280 - RNA, 16 nt, Staphylococcus aureus subsp. aureus Mu50
aauaacaccaauugaa

SEQ ID NO: 3955281 - RNA, 18 nt, Staphylococcus aureus subsp. aureus Mu50
aauaacaccuuucauuug

SEQ ID NO: 3955282 - RNA, 23 nt, Staphylococcus aureus subsp. aureus Mu50
aauaacaccuuucauuuggaaac

SEQ ID NO: 3955283 - RNA, 19 nt, Staphylococcus aureus subsp. aureus Mu50
aauaacacgauuugguuga

SEQ ID NO: 3955284 - RNA, 19 nt, Staphylococcus aureus subsp. aureus Mu50
aauaacaggugcuuacuuu

SEQ ID NO: 3955285 - RNA, 18 nt, Staphylococcus aureus subsp. aureus Mu50
aauaacaguuaauuauac

SEQ ID NO: 3955286 - RNA, 13 nt, Staphylococcus aureus subsp. aureus Mu50
aauaacaucuaaa

SEQ ID NO: 3955287 - RNA, 12 nt, Staphylococcus aureus subsp. aureus Mu50
aauaacauguuu

SEQ ID NO: 3955288 - RNA, 17 nt, Staphylococcus aureus subsp. aureus Mu50
aauaacauguuuguggc

SEQ ID NO: 3955289 - RNA, 21 nt, Staphylococcus aureus subsp. aureus Mu50
aauaaccaccaucccauuaaa

SEQ ID NO: 3955290 - RNA, 23 nt, Staphylococcus aureus subsp. aureus Mu50
aauaaccacuuugaauugguuga

SEQ ID NO: 3955291 - RNA, 14 nt, Staphylococcus aureus subsp. aureus Mu50
aauaaccauguaaa

SEQ ID NO: 3955292 - RNA, 23 nt, Staphylococcus aureus subsp. aureus Mu50
aauaaccauguaaaauuagcaag

SEQ ID NO: 3955293 - RNA, 17 nt, Staphylococcus aureus subsp. aureus Mu50
aauaaccauuucaucau

SEQ ID NO: 3955294 - RNA, 18 nt, Staphylococcus aureus subsp. aureus Mu50
aauaacccgaacacaaaa

SEQ ID NO: 3955295 - RNA, 18 nt, Staphylococcus aureus subsp. aureus Mu50
aauaaccgcuuaauucuu

SEQ ID NO: 3955296 - RNA, 17 nt, Staphylococcus aureus subsp. aureus Mu50
aauaaccuuuaaaacau

SEQ ID NO: 3955297 - RNA, 15 nt, Staphylococcus aureus subsp. aureus Mu50
aauaacguuaauaua

SEQ ID NO: 3955298 - RNA, 22 nt, Staphylococcus aureus subsp. aureus Mu50
aauaacuagauguucacauucu

SEQ ID NO: 3955299 - RNA, 21 nt, Staphylococcus aureus subsp. aureus Mu50
aauaacucgcuucguucuaaa

SEQ ID NO: 3955300 - RNA, 14 nt, Staphylococcus aureus subsp. aureus Mu50
aauaacugcuaauu

SEQ ID NO: 3955301 - RNA, 16 nt, Staphylococcus aureus subsp. aureus Mu50
aauaacuggcaaauca

SEQ ID NO: 3955302 - RNA, 19 nt, Staphylococcus aureus subsp. aureus Mu50
aauaacuggcaaaucaaac

SEQ ID NO: 3955303 - RNA, 20 nt, Staphylococcus aureus subsp. aureus Mu50
aauaacuggcaaaucaaaca

SEQ ID NO: 3955304 - RNA, 15 nt, Staphylococcus aureus subsp. aureus Mu50
aauaacuguuuauca

SEQ ID NO: 3955305 - RNA, 20 nt, Staphylococcus aureus subsp. aureus Mu50
aauaagacuucccuauaugu

SEQ ID NO: 3955306 - RNA, 13 nt, Staphylococcus aureus subsp. aureus Mu50
aauaagcauuaau

SEQ ID NO: 3955307 - RNA, 14 nt, Staphylococcus aureus subsp. aureus Mu50
aauaagcgcaauua

SEQ ID NO: 3955308 - RNA, 17 nt, Staphylococcus aureus subsp. aureus Mu50
aauaagcgcaauuaaaa

SEQ ID NO: 3955309 - RNA, 19 nt, Staphylococcus aureus subsp. aureus Mu50
aauacacuugauaaaacua

SEQ ID NO: 3955310 - RNA, 12 nt, Staphylococcus aureus subsp. aureus Mu50
aauacagaugau

SEQ ID NO: 3955311 - RNA, 16 nt, Staphylococcus aureus subsp. aureus Mu50
aauacagaugaugcuu

SEQ ID NO: 3955312 - RNA, 16 nt, Staphylococcus aureus subsp. aureus Mu50
aauacauaauaaaaag

SEQ ID NO: 3955313 - RNA, 13 nt, Staphylococcus aureus subsp. aureus Mu50
aauacauaaucau

SEQ ID NO: 3955314 - RNA, 16 nt, Staphylococcus aureus subsp. aureus Mu50
aauacauaauuaacuu

SEQ ID NO: 3955315 - RNA, 13 nt, Staphylococcus aureus subsp. aureus Mu50
aauacauacugau

SEQ ID NO: 3955316 - RNA, 17 nt, Staphylococcus aureus subsp. aureus Mu50
aauacauacugauuaaa

SEQ ID NO: 3955317 - RNA, 19 nt, Staphylococcus aureus subsp. aureus Mu50
aauacauaucggcccauaa

SEQ ID NO: 3955318 - RNA, 21 nt, Staphylococcus aureus subsp. aureus Mu50
aauacauaucggcccauaaua

SEQ ID NO: 3955319 - RNA, 16 nt, Staphylococcus aureus subsp. aureus Mu50
aauacaucaauaucuu

SEQ ID NO: 3955320 - RNA, 16 nt, Staphylococcus aureus subsp. aureus Mu50
aauacauccauacuuc

SEQ ID NO: 3955321 - RNA, 11 nt, Staphylococcus aureus subsp. aureus Mu50
aauacaucuaa

SEQ ID NO: 3955322 - RNA, 15 nt, Staphylococcus aureus subsp. aureus Mu50
aauacaucuaauaaa

SEQ ID NO: 3955323 - RNA, 17 nt, Staphylococcus aureus subsp. aureus Mu50
aauacaucuaauaaaua

SEQ ID NO: 3955324 - RNA, 19 nt, Staphylococcus aureus subsp. aureus Mu50
aauacaucuaauaaauaua

SEQ ID NO: 3955325 - RNA, 17 nt, Staphylococcus aureus subsp. aureus Mu50
aauacauuaauauaaau

SEQ ID NO: 3955326 - RNA, 18 nt, Staphylococcus aureus subsp. aureus Mu50
aauacauuauguucuuca

SEQ ID NO: 3955327 - RNA, 17 nt, Staphylococcus aureus subsp. aureus Mu50
aauacauuucaaaaaaa

SEQ ID NO: 3955328 - RNA, 15 nt, Staphylococcus aureus subsp. aureus Mu50
aauacauuuugcucu

SEQ ID NO: 3955329 - RNA, 13 nt, Staphylococcus aureus subsp. aureus Mu50
aauacauuuuuau

SEQ ID NO: 3955330 - RNA, 21 nt, Staphylococcus aureus subsp. aureus Mu50
aauacauuuuuauacaacuuc

SEQ ID NO: 3955331 - RNA, 13 nt, Staphylococcus aureus subsp. aureus Mu50
aauaccaauugcu

SEQ ID NO: 3955332 - RNA, 14 nt, Staphylococcus aureus subsp. aureus Mu50
aauaccaauugcuu

SEQ ID NO: 3955333 - RNA, 16 nt, Staphylococcus aureus subsp. aureus Mu50
aauaccacuuaaucgu

SEQ ID NO: 3955334 - RNA, 17 nt, Staphylococcus aureus subsp. aureus Mu50
aauaccauaauuaaaua

SEQ ID NO: 3955335 - RNA, 16 nt, Staphylococcus aureus subsp. aureus Mu50
aauaccccaaauagug

SEQ ID NO: 3955336 - RNA, 18 nt, Staphylococcus aureus subsp. aureus Mu50
aauaccgccuacuguuuc

SEQ ID NO: 3955337 - RNA, 18 nt, Staphylococcus aureus subsp. aureus Mu50
aauaccuaaccauaacaa

SEQ ID NO: 3955338 - RNA, 19 nt, Staphylococcus aureus subsp. aureus Mu50
aauaccuaucccuguaaaa

SEQ ID NO: 3955339 - RNA, 23 nt, Staphylococcus aureus subsp. aureus Mu50
aauaccuaucccuguaaaaccau

SEQ ID NO: 3955340 - RNA, 23 nt, Staphylococcus aureus subsp. aureus Mu50
aauaccuaugauauaugcugcaa

SEQ ID NO: 3955341 - RNA, 23 nt, Staphylococcus aureus subsp. aureus Mu50
aauaccuuugccguauuucaaau

SEQ ID NO: 3955342 - RNA, 15 nt, Staphylococcus aureus subsp. aureus Mu50
aauaccuuuuucuaa

SEQ ID NO: 3955343 - RNA, 22 nt, Staphylococcus aureus subsp. aureus Mu50
aauaccuuuuucuaaaccaaca

SEQ ID NO: 3955344 - RNA, 21 nt, Staphylococcus aureus subsp. aureus Mu50
aauacgaaguguuauaaauag

SEQ ID NO: 3955345 - RNA, 13 nt, Staphylococcus aureus subsp. aureus Mu50
aauacgaaguuuc

SEQ ID NO: 3955346 - RNA, 22 nt, Staphylococcus aureus subsp. aureus Mu50
aauacgacaccaacauauuuua

SEQ ID NO: 3955347 - RNA, 16 nt, Staphylococcus aureus subsp. aureus Mu50
aauacgcuugauaaaa

SEQ ID NO: 3955348 - RNA, 22 nt, Staphylococcus aureus subsp. aureus Mu50
aauacguaucaagaaaaaguuu

SEQ ID NO: 3955349 - RNA, 15 nt, Staphylococcus aureus subsp. aureus Mu50
aauacgucaucuuua

SEQ ID NO: 3955350 - RNA, 17 nt, Staphylococcus aureus subsp. aureus Mu50
aauacguguguuuucuu

SEQ ID NO: 3955351 - RNA, 19 nt, Staphylococcus aureus subsp. aureus Mu50
aauacguuuaauaaugguu

SEQ ID NO: 3955352 - RNA, 17 nt, Staphylococcus aureus subsp. aureus Mu50
aauacguuuugcuaauu

SEQ ID NO: 3955353 - RNA, 15 nt, Staphylococcus aureus subsp. aureus Mu50
aauacuaaaaguguu

SEQ ID NO: 3955354 - RNA, 18 nt, Staphylococcus aureus subsp. aureus Mu50
aauacuaacugaagacac

SEQ ID NO: 3955355 - RNA, 19 nt, Staphylococcus aureus subsp. aureus Mu50
aauacuaagauuagcuaug

SEQ ID NO: 3955356 - RNA, 21 nt, Staphylococcus aureus subsp. aureus Mu50
aauacuaagauuagcuaugaa

SEQ ID NO: 3955357 - RNA, 14 nt, Staphylococcus aureus subsp. aureus Mu50
aauacuaaucaaag

SEQ ID NO: 3955358 - RNA, 18 nt, Staphylococcus aureus subsp. aureus Mu50
aauacuaaucaaagaaaa

SEQ ID NO: 3955359 - RNA, 21 nt, Staphylococcus aureus subsp. aureus Mu50
aauacuacacuccccuuauca

SEQ ID NO: 3955360 - RNA, 14 nt, Staphylococcus aureus subsp. aureus Mu50
aauacuacauauaa

SEQ ID NO: 3955361 - RNA, 20 nt, Staphylococcus aureus subsp. aureus Mu50
aauacuacauauaaugccaa

SEQ ID NO: 3955362 - RNA, 22 nt, Staphylococcus aureus subsp. aureus Mu50
aauacuaccguuuuuauauacu

SEQ ID NO: 3955363 - RNA, 17 nt, Staphylococcus aureus subsp. aureus Mu50
aauacuaccuuccauuu

SEQ ID NO: 3955364 - RNA, 21 nt, Staphylococcus aureus subsp. aureus Mu50
aauacuacuguugacauuuga

SEQ ID NO: 3955365 - RNA, 24 nt, Staphylococcus aureus subsp. aureus Mu50
aauacuacuuaaugacuucuuuau

SEQ ID NO: 3955366 - RNA, 14 nt, Staphylococcus aureus subsp. aureus Mu50
aauacuauacugau

SEQ ID NO: 3955367 - RNA, 19 nt, Staphylococcus aureus subsp. aureus Mu50
aauacuauacugaugaaaa

SEQ ID NO: 3955368 - RNA, 14 nt, Staphylococcus aureus subsp. aureus Mu50
aauacuauauauaa

SEQ ID NO: 3955369 - RNA, 19 nt, Staphylococcus aureus subsp. aureus Mu50
aauacuauaugaaaagaga

SEQ ID NO: 3955370 - RNA, 21 nt, Staphylococcus aureus subsp. aureus Mu50
aauacucaacacgauagucau

SEQ ID NO: 3955371 - RNA, 12 nt, Staphylococcus aureus subsp. aureus Mu50
aauacucacauu

SEQ ID NO: 3955372 - RNA, 14 nt, Staphylococcus aureus subsp. aureus Mu50
aauacucaguuuau

SEQ ID NO: 3955373 - RNA, 15 nt, Staphylococcus aureus subsp. aureus Mu50
aauacucaguuuauu

SEQ ID NO: 3955374 - RNA, 22 nt, Staphylococcus aureus subsp. aureus Mu50
aauacucaguuuauugaggaua

SEQ ID NO: 3955375 - RNA, 18 nt, Staphylococcus aureus subsp. aureus Mu50
aauacucccgcauuauua

SEQ ID NO: 3955376 - RNA, 13 nt, Staphylococcus aureus subsp. aureus Mu50
aauacucuucaau

SEQ ID NO: 3955377 - RNA, 16 nt, Staphylococcus aureus subsp. aureus Mu50
aauacuguauuuuaac

SEQ ID NO: 3955378 - RNA, 21 nt, Staphylococcus aureus subsp. aureus Mu50
aauacuguauuuuaacgucau

SEQ ID NO: 3955379 - RNA, 17 nt, Staphylococcus aureus subsp. aureus Mu50
aauacuguuuaaauaaa

SEQ ID NO: 3955380 - RNA, 19 nt, Staphylococcus aureus subsp. aureus Mu50
aauacuguuuaaauaaaau

SEQ ID NO: 3955381 - RNA, 14 nt, Staphylococcus aureus subsp. aureus Mu50
aauacuucaccaca

SEQ ID NO: 3955382 - RNA, 16 nt, Staphylococcus aureus subsp. aureus Mu50
aauacuucauauccuu

SEQ ID NO: 3955383 - RNA, 13 nt, Staphylococcus aureus subsp. aureus Mu50
aauacuucguuau

SEQ ID NO: 3955384 - RNA, 19 nt, Staphylococcus aureus subsp. aureus Mu50
aauacuucuuguucgauaa

SEQ ID NO: 3955385 - RNA, 16 nt, Staphylococcus aureus subsp. aureus Mu50
aauacuuuauuugaua

SEQ ID NO: 3955386 - RNA, 16 nt, Staphylococcus aureus subsp. aureus Mu50
aauacuuucaaacaaa

SEQ ID NO: 3955387 - RNA, 20 nt, Staphylococcus aureus subsp. aureus Mu50
aauacuuucaaacaaaucuu

SEQ ID NO: 3955388 - RNA, 16 nt, Staphylococcus aureus subsp. aureus Mu50
aauacuuucacuuuuu

SEQ ID NO: 3955389 - RNA, 22 nt, Staphylococcus aureus subsp. aureus Mu50
aauacuuucacuuuuuauauca

SEQ ID NO: 3955390 - RNA, 14 nt, Staphylococcus aureus subsp. aureus Mu50
aauacuuuucucga

SEQ ID NO: 3955391 - RNA, 13 nt, Staphylococcus aureus subsp. aureus Mu50
aauacuuuuuaac

SEQ ID NO: 3955392 - RNA, 15 nt, Staphylococcus aureus subsp. aureus Mu50
aauacuuuuuaacug

SEQ ID NO: 3955393 - RNA, 17 nt, Staphylococcus aureus subsp. aureus Mu50
aauacuuuuuaacuggu

SEQ ID NO: 3955394 - RNA, 17 nt, Staphylococcus aureus subsp. aureus Mu50
aauagaaaaauuucaaa

SEQ ID NO: 3955395 - RNA, 12 nt, Staphylococcus aureus subsp. aureus Mu50
aauagaaauaau

SEQ ID NO: 3955396 - RNA, 22 nt, Staphylococcus aureus subsp. aureus Mu50
aauagaaaugacgauaccuuua

SEQ ID NO: 3955397 - RNA, 22 nt, Staphylococcus aureus subsp. aureus Mu50
aauauauuaacaacuuuauuau

SEQ ID NO: 3955398 - RNA, 17 nt, Staphylococcus aureus subsp. aureus Mu50
aauauauuuauuuuuga

SEQ ID NO: 3955399 - RNA, 13 nt, Staphylococcus aureus subsp. aureus Mu50
aauauauuuggag

SEQ ID NO: 3955400 - RNA, 12 nt, Staphylococcus aureus subsp. aureus Mu50
aauaucaaaaua

SEQ ID NO: 3955401 - RNA, 13 nt, Staphylococcus aureus subsp. aureus Mu50
aauaucaaaauau

SEQ ID NO: 3955402 - RNA, 18 nt, Staphylococcus aureus subsp. aureus Mu50
aauaucaaaauauaaaau

SEQ ID NO: 3955403 - RNA, 11 nt, Staphylococcus aureus subsp. aureus Mu50
aauaucaauuu

SEQ ID NO: 3955404 - RNA, 21 nt, Staphylococcus aureus subsp. aureus Mu50
aauaucaccuuuuuuaagauc

SEQ ID NO: 3955405 - RNA, 20 nt, Staphylococcus aureus subsp. aureus Mu50
aauaucacgaucuuuaaagu

SEQ ID NO: 3955406 - RNA, 17 nt, Staphylococcus aureus subsp. aureus Mu50
aauaucauaaaugcaua

SEQ ID NO: 3955407 - RNA, 16 nt, Staphylococcus aureus subsp. aureus Mu50
aauaucauauucaaaa

SEQ ID NO: 3955408 - RNA, 14 nt, Staphylococcus aureus subsp. aureus Mu50
aauaucauauuuga

SEQ ID NO: 3955409 - RNA, 15 nt, Staphylococcus aureus subsp. aureus Mu50
aauaucauauuugaa

SEQ ID NO: 3955410 - RNA, 20 nt, Staphylococcus aureus subsp. aureus Mu50
aauaucaucauuuaaauauu

SEQ ID NO: 3955411 - RNA, 17 nt, Staphylococcus aureus subsp. aureus Mu50
aauaucaucuuguuguu

SEQ ID NO: 3955412 - RNA, 17 nt, Staphylococcus aureus subsp. aureus Mu50
aauaucaugcaaaacua

SEQ ID NO: 3955413 - RNA, 20 nt, Staphylococcus aureus subsp. aureus Mu50
aauaucaugggcaguaauuu

SEQ ID NO: 3955414 - RNA, 15 nt, Staphylococcus aureus subsp. aureus Mu50
aauauccaaaauccu

SEQ ID NO: 3955415 - RNA, 15 nt, Staphylococcus aureus subsp. aureus Mu50
aauaucgacaaauua

SEQ ID NO: 3955416 - RNA, 17 nt, Staphylococcus aureus subsp. aureus Mu50
aauaucgaugacuuugu

SEQ ID NO: 3955417 - RNA, 20 nt, Staphylococcus aureus subsp. aureus Mu50
aauaucgauuuuggcacaua

SEQ ID NO: 3955418 - RNA, 24 nt, Staphylococcus aureus subsp. aureus Mu50
aauaucuaauucuguuucaaagcu

SEQ ID NO: 3955419 - RNA, 15 nt, Staphylococcus aureus subsp. aureus Mu50
aauaucugucaaagg

SEQ ID NO: 3955420 - RNA, 16 nt, Staphylococcus aureus subsp. aureus Mu50
aauaucuguugcauua

SEQ ID NO: 3955421 - RNA, 22 nt, Staphylococcus aureus subsp. aureus Mu50
aauaucuguugcauuaagugca

SEQ ID NO: 3955422 - RNA, 17 nt, Staphylococcus aureus subsp. aureus Mu50
aauaucuuaaagaauua

SEQ ID NO: 3955423 - RNA, 18 nt, Staphylococcus aureus subsp. aureus Mu50
aauaucuuacuacuuaau

SEQ ID NO: 3955424 - RNA, 23 nt, Staphylococcus aureus subsp. aureus Mu50
aauaucuuacugcuguuuuuuau

SEQ ID NO: 3955425 - RNA, 15 nt, Staphylococcus aureus subsp. aureus Mu50
aauaucuucuucuaa

SEQ ID NO: 3955426 - RNA, 22 nt, Staphylococcus aureus subsp. aureus Mu50
aauaucuucuucuaaccacuuc

SEQ ID NO: 3955427 - RNA, 17 nt, Staphylococcus aureus subsp. aureus Mu50
aauaucuuuuucuaagu

SEQ ID NO: 3955428 - RNA, 22 nt, Staphylococcus aureus subsp. aureus Mu50
aauaucuuuuucuaaguuuguu

SEQ ID NO: 3955429 - RNA, 18 nt, Staphylococcus aureus subsp. aureus Mu50
aauaugaacaaaaaauaa

SEQ ID NO: 3955430 - RNA, 19 nt, Staphylococcus aureus subsp. aureus Mu50
aauaugaaggcuuuuuguu

SEQ ID NO: 3955431 - RNA, 16 nt, Staphylococcus aureus subsp. aureus Mu50
aauaugaauaaugcaa

SEQ ID NO: 3955432 - RNA, 19 nt, Staphylococcus aureus subsp. aureus Mu50
aauaugaauaaugcaauug

SEQ ID NO: 3955433 - RNA, 16 nt, Staphylococcus aureus subsp. aureus Mu50
aauaugaaucuagaau

SEQ ID NO: 3955434 - RNA, 22 nt, Staphylococcus aureus subsp. aureus Mu50
aauaugaaucuagaauauaaca

SEQ ID NO: 3955435 - RNA, 21 nt, Staphylococcus aureus subsp. aureus Mu50
aauaugaccuuuaugugcauc

SEQ ID NO: 3955436 - RNA, 21 nt, Staphylococcus aureus subsp. aureus Mu50
aauaugacgcgugaauuaaaa

SEQ ID NO: 3955437 - RNA, 16 nt, Staphylococcus aureus subsp. aureus Mu50
aauaugagauuaucug

SEQ ID NO: 3955438 - RNA, 12 nt, Staphylococcus aureus subsp. aureus Mu50
aauaugauauua

SEQ ID NO: 3955439 - RNA, 17 nt, Staphylococcus aureus subsp. aureus Mu50
aauaugauguuaaaaaa

SEQ ID NO: 3955440 - RNA, 23 nt, Staphylococcus aureus subsp. aureus Mu50
aauaugauguuaaaaaauaugua

SEQ ID NO: 3955441 - RNA, 17 nt, Staphylococcus aureus subsp. aureus Mu50
aauaugauugcaaauua

SEQ ID NO: 3955442 - RNA, 21 nt, Staphylococcus aureus subsp. aureus Mu50
aauaugauugcaaauuaucau

SEQ ID NO: 3955443 - RNA, 22 nt, Staphylococcus aureus subsp. aureus Mu50
aauaugauugcaaauuaucauu

SEQ ID NO: 3955444 - RNA, 16 nt, Staphylococcus aureus subsp. aureus Mu50
aauaugguuucuuauu

SEQ ID NO: 3955445 - RNA, 21 nt, Staphylococcus aureus subsp. aureus Mu50
aauaugucuagacuuauuuga

SEQ ID NO: 3955446 - RNA, 11 nt, Staphylococcus aureus subsp. aureus Mu50
aauauuaaaau

SEQ ID NO: 3955447 - RNA, 13 nt, Staphylococcus aureus subsp. aureus Mu50
aauauuaaauuau

SEQ ID NO: 3955448 - RNA, 14 nt, Staphylococcus aureus subsp. aureus Mu50
aauauuaaauucau

SEQ ID NO: 3955449 - RNA, 22 nt, Staphylococcus aureus subsp. aureus Mu50
aauauuaagauguauaugaauu

SEQ ID NO: 3955450 - RNA, 17 nt, Staphylococcus aureus subsp. aureus Mu50
aauauuauaaccaccag

SEQ ID NO: 3955451 - RNA, 17 nt, Staphylococcus aureus subsp. aureus Mu50
aauauuauuaaaucaaa

SEQ ID NO: 3955452 - RNA, 18 nt, Staphylococcus aureus subsp. aureus Mu50
aauauuauucauaauaua

SEQ ID NO: 3955453 - RNA, 23 nt, Staphylococcus aureus subsp. aureus Mu50
aauauuauucuuuauauuuguga

SEQ ID NO: 3955454 - RNA, 18 nt, Staphylococcus aureus subsp. aureus Mu50
aauauuauuuugcaauug

SEQ ID NO: 3955455 - RNA, 13 nt, Staphylococcus aureus subsp. aureus Mu50
aauauuauuuuua

SEQ ID NO: 3955456 - RNA, 19 nt, Staphylococcus aureus subsp. aureus Mu50
aauauuauuuuuaagugau

SEQ ID NO: 3955457 - RNA, 21 nt, Staphylococcus aureus subsp. aureus Mu50
aauauuauuuuuaagugauga

SEQ ID NO: 3955458 - RNA, 16 nt, Staphylococcus aureus subsp. aureus Mu50
aauauucaauaauuca

SEQ ID NO: 3955459 - RNA, 22 nt, Staphylococcus aureus subsp. aureus Mu50
aauauucuaugcucuacgaagu

SEQ ID NO: 3955460 - RNA, 13 nt, Staphylococcus aureus subsp. aureus Mu50
aauauucuuauca

SEQ ID NO: 3955461 - RNA, 21 nt, Staphylococcus aureus subsp. aureus Mu50
aauauucuuuaauauagauuu

SEQ ID NO: 3955462 - RNA, 16 nt, Staphylococcus aureus subsp. aureus Mu50
aauauucuuucguuuu

SEQ ID NO: 3955463 - RNA, 12 nt, Staphylococcus aureus subsp. aureus Mu50
aauauugaauaa

SEQ ID NO: 3955464 - RNA, 15 nt, Staphylococcus aureus subsp. aureus Mu50
aauauugauaucgaa

SEQ ID NO: 3955465 - RNA, 19 nt, Staphylococcus aureus subsp. aureus Mu50
aauauugaugaauaaauag

SEQ ID NO: 3955466 - RNA, 16 nt, Staphylococcus aureus subsp. aureus Mu50
aauauugcguuuaauu

SEQ ID NO: 3955467 - RNA, 16 nt, Staphylococcus aureus subsp. aureus Mu50
aauauuggacuuugcu

SEQ ID NO: 3955468 - RNA, 17 nt, Staphylococcus aureus subsp. aureus Mu50
aauauuuaaaauauuau

SEQ ID NO: 3955469 - RNA, 17 nt, Staphylococcus aureus subsp. aureus Mu50
aauauuuaaauuuuaag

SEQ ID NO: 3955470 - RNA, 18 nt, Staphylococcus aureus subsp. aureus Mu50
aauauuuaaauuuuaagu

SEQ ID NO: 3955471 - RNA, 18 nt, Staphylococcus aureus subsp. aureus Mu50
aauauuuaaccuuuaaaa

SEQ ID NO: 3955472 - RNA, 21 nt, Staphylococcus aureus subsp. aureus Mu50
aauauuuacauugccacuuuu

SEQ ID NO: 3955473 - RNA, 21 nt, Staphylococcus aureus subsp. aureus Mu50
aauauuuagauuggucaaacu

SEQ ID NO: 3955474 - RNA, 17 nt, Staphylococcus aureus subsp. aureus Mu50
aauauuuauauuaaaua

SEQ ID NO: 3955475 - RNA, 19 nt, Staphylococcus aureus subsp. aureus Mu50
aauauuuauauuaaauacu

SEQ ID NO: 3955476 - RNA, 22 nt, Staphylococcus aureus subsp. aureus Mu50
aauauuuauauuaaauacuaua

SEQ ID NO: 3955477 - RNA, 21 nt, Staphylococcus aureus subsp. aureus Mu50
aauauuuaucaauaaaucagu

SEQ ID NO: 3955478 - RNA, 23 nt, Staphylococcus aureus subsp. aureus Mu50
aauauuuaucaauaaaucaguag

SEQ ID NO: 3955479 - RNA, 21 nt, Staphylococcus aureus subsp. aureus Mu50
aauauuuauuguuuuuaaaau

SEQ ID NO: 3955480 - RNA, 20 nt, Staphylococcus aureus subsp. aureus Mu50
aauauuucccuaugaaauaa

SEQ ID NO: 3955481 - RNA, 17 nt, Staphylococcus aureus subsp. aureus Mu50
aauauuucuaaaccauu

SEQ ID NO: 3955482 - RNA, 21 nt, Staphylococcus aureus subsp. aureus Mu50
aauauuucuaaaccauuuuca

SEQ ID NO: 3955483 - RNA, 11 nt, Staphylococcus aureus subsp. aureus Mu50
aauauuucugg

SEQ ID NO: 3955484 - RNA, 18 nt, Staphylococcus aureus subsp. aureus Mu50
aaucauuaguuaugugcu

SEQ ID NO: 3955485 - RNA, 14 nt, Staphylococcus aureus subsp. aureus Mu50
aaucauucacuuca

SEQ ID NO: 3955486 - RNA, 19 nt, Staphylococcus aureus subsp. aureus Mu50
aaucauucacuucaaguua

SEQ ID NO: 3955487 - RNA, 15 nt, Staphylococcus aureus subsp. aureus Mu50
aaucauucguuuaau

SEQ ID NO: 3955488 - RNA, 15 nt, Staphylococcus aureus subsp. aureus Mu50
aaucauucuuuauag

SEQ ID NO: 3955489 - RNA, 14 nt, Staphylococcus aureus subsp. aureus Mu50
aaucauugguuuca

SEQ ID NO: 3955490 - RNA, 16 nt, Staphylococcus aureus subsp. aureus Mu50
aaucauugguuucauc

SEQ ID NO: 3955491 - RNA, 15 nt, Staphylococcus aureus subsp. aureus Mu50
aaucauuguggcuuu

SEQ ID NO: 3955492 - RNA, 20 nt, Staphylococcus aureus subsp. aureus Mu50
aaucauuguguauuguuuua

SEQ ID NO: 3955493 - RNA, 15 nt, Staphylococcus aureus subsp. aureus Mu50
aaucauuucguucau

SEQ ID NO: 3955494 - RNA, 14 nt, Staphylococcus aureus subsp. aureus Mu50
aaucauuuguguau

SEQ ID NO: 3955495 - RNA, 23 nt, Staphylococcus aureus subsp. aureus Mu50
aaucauuuguguauaaaugucau

SEQ ID NO: 3955496 - RNA, 18 nt, Staphylococcus aureus subsp. aureus Mu50
aauccaaaaucuuuacuu

SEQ ID NO: 3955497 - RNA, 19 nt, Staphylococcus aureus subsp. aureus Mu50
aauccaaagcugaauuuua

SEQ ID NO: 3955498 - RNA, 17 nt, Staphylococcus aureus subsp. aureus Mu50
aauccaagcaaucuuag

SEQ ID NO: 3955499 - RNA, 17 nt, Staphylococcus aureus subsp. aureus Mu50
aauccaauauacaaugc

SEQ ID NO: 3955500 - RNA, 23 nt, Staphylococcus aureus subsp. aureus Mu50
aauccaucaauaccauaauuaaa

SEQ ID NO: 3955501 - RNA, 18 nt, Staphylococcus aureus subsp. aureus Mu50
aauccauucuucuuguuu

SEQ ID NO: 3955502 - RNA, 22 nt, Staphylococcus aureus subsp. aureus Mu50
aaucccaaguuacaauaucaua

SEQ ID NO: 3955503 - RNA, 14 nt, Staphylococcus aureus subsp. aureus Mu50
aaucccauaaugac

SEQ ID NO: 3955504 - RNA, 15 nt, Staphylococcus aureus subsp. aureus Mu50
aaucccauaccuaca

SEQ ID NO: 3955505 - RNA, 12 nt, Staphylococcus aureus subsp. aureus Mu50
aaucccuucaaa

SEQ ID NO: 3955506 - RNA, 14 nt, Staphylococcus aureus subsp. aureus Mu50
aaucccuucaaaau

SEQ ID NO: 3955507 - RNA, 20 nt, Staphylococcus aureus subsp. aureus Mu50
aaucccuucaaaauuuugac

SEQ ID NO: 3955508 - RNA, 21 nt, Staphylococcus aureus subsp. aureus Mu50
aauccgauucacucuguaaua

SEQ ID NO: 3955509 - RNA, 13 nt, Staphylococcus aureus subsp. aureus Mu50
aauccguuaaaau

SEQ ID NO: 3955510 - RNA, 15 nt, Staphylococcus aureus subsp. aureus Mu50
aauccguuaaaauuu

SEQ ID NO: 3955511 - RNA, 21 nt, Staphylococcus aureus subsp. aureus Mu50
aauccuauggcgcaauuuuua

SEQ ID NO: 3955512 - RNA, 21 nt, Staphylococcus aureus subsp. aureus Mu50
aauccucacaaauuugaauau

SEQ ID NO: 3955513 - RNA, 22 nt, Staphylococcus aureus subsp. aureus Mu50
aauccucacaaauuugaauaua

SEQ ID NO: 3955514 - RNA, 23 nt, Staphylococcus aureus subsp. aureus Mu50
aauccucaguuauaccauauuua

SEQ ID NO: 3955515 - RNA, 20 nt, Staphylococcus aureus subsp. aureus Mu50
aauccuucuccaaaaauaau

SEQ ID NO: 3955516 - RNA, 17 nt, Staphylococcus aureus subsp. aureus Mu50
aauccuuggaaacgaua

SEQ ID NO: 3955517 - RNA, 15 nt, Staphylococcus aureus subsp. aureus Mu50
aauccuuuauauuua

SEQ ID NO: 3955518 - RNA, 17 nt, Staphylococcus aureus subsp. aureus Mu50
aauccuuuguuuguaag

SEQ ID NO: 3955519 - RNA, 12 nt, Staphylococcus aureus subsp. aureus Mu50
aaucgaaaauau

SEQ ID NO: 3955520 - RNA, 14 nt, Staphylococcus aureus subsp. aureus Mu50
aaucgaacagaaaa

SEQ ID NO: 3955521 - RNA, 15 nt, Staphylococcus aureus subsp. aureus Mu50
aaucgaacagaaaau

SEQ ID NO: 3955522 - RNA, 14 nt, Staphylococcus aureus subsp. aureus Mu50
aaucgaacauaaau

SEQ ID NO: 3955523 - RNA, 17 nt, Staphylococcus aureus subsp. aureus Mu50
aaucgaguuugaaauaa

SEQ ID NO: 3955524 - RNA, 16 nt, Staphylococcus aureus subsp. aureus Mu50
aaucgauacuaauauc

SEQ ID NO: 3955525 - RNA, 20 nt, Staphylococcus aureus subsp. aureus Mu50
aaucgauauaaugaaguuau

SEQ ID NO: 3955526 - RNA, 21 nt, Staphylococcus aureus subsp. aureus Mu50
aaucgauuaagaaugcaccaa

SEQ ID NO: 3955527 - RNA, 16 nt, Staphylococcus aureus subsp. aureus Mu50
aaucgcagcaaugaca

SEQ ID NO: 3955528 - RNA, 17 nt, Staphylococcus aureus subsp. aureus Mu50
aaucgcauuguuaaaga

SEQ ID NO: 3955529 - RNA, 15 nt, Staphylococcus aureus subsp. aureus Mu50
aaucgcauuuaaaua

SEQ ID NO: 3955530 - RNA, 15 nt, Staphylococcus aureus subsp. aureus Mu50
aaucgccuacuauaa

SEQ ID NO: 3955531 - RNA, 23 nt, Staphylococcus aureus subsp. aureus Mu50
aaucgcuucgguuaacuguucua

SEQ ID NO: 3955532 - RNA, 16 nt, Staphylococcus aureus subsp. aureus Mu50
aaucggaauaaaauaa

SEQ ID NO: 3955533 - RNA, 16 nt, Staphylococcus aureus subsp. aureus Mu50
aaucggcuuucuaagu

SEQ ID NO: 3955534 - RNA, 19 nt, Staphylococcus aureus subsp. aureus Mu50
aaucguaaacauaaugaca

SEQ ID NO: 3955535 - RNA, 20 nt, Staphylococcus aureus subsp. aureus Mu50
aaucguaacauaucagcuuu

SEQ ID NO: 3955536 - RNA, 15 nt, Staphylococcus aureus subsp. aureus Mu50
aaucguaggaugcuu

SEQ ID NO: 3955537 - RNA, 16 nt, Staphylococcus aureus subsp. aureus Mu50
aaucguaggaugcuuc

SEQ ID NO: 3955538 - RNA, 21 nt, Staphylococcus aureus subsp. aureus Mu50
aaucguauuagccaauaaaau

SEQ ID NO: 3955539 - RNA, 17 nt, Staphylococcus aureus subsp. aureus Mu50
aaucguauuuuuaagcu

SEQ ID NO: 3955540 - RNA, 18 nt, Staphylococcus aureus subsp. aureus Mu50
aaucgugcccauaugauu

SEQ ID NO: 3955541 - RNA, 15 nt, Staphylococcus aureus subsp. aureus Mu50
aaucgugcuguuauc

SEQ ID NO: 3955542 - RNA, 14 nt, Staphylococcus aureus subsp. aureus Mu50
aaucguuaaggaaa

SEQ ID NO: 3955543 - RNA, 17 nt, Staphylococcus aureus subsp. aureus Mu50
aaucguuaauuuccaau

SEQ ID NO: 3955544 - RNA, 20 nt, Staphylococcus aureus subsp. aureus Mu50
aaucguuccaacaacuaaga

SEQ ID NO: 3955545 - RNA, 15 nt, Staphylococcus aureus subsp. aureus Mu50
aaucguugaaaaaua

SEQ ID NO: 3955546 - RNA, 14 nt, Staphylococcus aureus subsp. aureus Mu50
aaucguuugccaua

SEQ ID NO: 3955547 - RNA, 16 nt, Staphylococcus aureus subsp. aureus Mu50
aaucuaaacuauaaua

SEQ ID NO: 3955548 - RNA, 22 nt, Staphylococcus aureus subsp. aureus Mu50
aaucuaacuggaaaugauaauu

SEQ ID NO: 3955549 - RNA, 19 nt, Staphylococcus aureus subsp. aureus Mu50
aaucuaaggccauuuguag

SEQ ID NO: 3955550 - RNA, 14 nt, Staphylococcus aureus subsp. aureus Mu50
aaucuaauacauac

SEQ ID NO: 3955551 - RNA, 21 nt, Staphylococcus aureus subsp. aureus Mu50
aaucuaauacuuucaaacaaa

SEQ ID NO: 3955552 - RNA, 23 nt, Staphylococcus aureus subsp. aureus Mu50
aaucuaauacuuucaaacaaauc

SEQ ID NO: 3955553 - RNA, 12 nt, Staphylococcus aureus subsp. aureus Mu50
aaucuacaauau

SEQ ID NO: 3955554 - RNA, 14 nt, Staphylococcus aureus subsp. aureus Mu50
aaucuacaauauua

SEQ ID NO: 3955555 - RNA, 13 nt, Staphylococcus aureus subsp. aureus Mu50
aaucuaccauguu

SEQ ID NO: 3955556 - RNA, 15 nt, Staphylococcus aureus subsp. aureus Mu50
aaucuagaccuucaa

SEQ ID NO: 3955557 - RNA, 13 nt, Staphylococcus aureus subsp. aureus Mu50
aaucuauaaauau

SEQ ID NO: 3955558 - RNA, 15 nt, Staphylococcus aureus subsp. aureus Mu50
aaucuauaccauucc

SEQ ID NO: 3955559 - RNA, 21 nt, Staphylococcus aureus subsp. aureus Mu50
aaucuauauaaaguugacaau

SEQ ID NO: 3955560 - RNA, 16 nt, Staphylococcus aureus subsp. aureus Mu50
aaucuauauaaauguu

SEQ ID NO: 3955561 - RNA, 22 nt, Staphylococcus aureus subsp. aureus Mu50
aaucuauauaaauguuuauauc

SEQ ID NO: 3955562 - RNA, 21 nt, Staphylococcus aureus subsp. aureus Mu50
aaucuauuaaugcucuauaua

SEQ ID NO: 3955563 - RNA, 14 nt, Staphylococcus aureus subsp. aureus Mu50
aaucuauugcaaua

SEQ ID NO: 3955564 - RNA, 15 nt, Staphylococcus aureus subsp. aureus Mu50
aaucuauugcaauau

SEQ ID NO: 3955565 - RNA, 16 nt, Staphylococcus aureus subsp. aureus Mu50
aaucuauugugauaua

SEQ ID NO: 3955566 - RNA, 13 nt, Staphylococcus aureus subsp. aureus Mu50
aaucucaucuaac

SEQ ID NO: 3955567 - RNA, 20 nt, Staphylococcus aureus subsp. aureus Mu50
aaucucauucuuuaauauaa

SEQ ID NO: 3955568 - RNA, 15 nt, Staphylococcus aureus subsp. aureus Mu50
aaucuccuugcucau

SEQ ID NO: 3955569 - RNA, 23 nt, Staphylococcus aureus subsp. aureus Mu50
aaucuccuugcucaugagcacaa

SEQ ID NO: 3955570 - RNA, 19 nt, Staphylococcus aureus subsp. aureus Mu50
aaucucuuuagaugagauu

SEQ ID NO: 3955571 - RNA, 19 nt, Staphylococcus aureus subsp. aureus Mu50
aaucucuuuuugauuauau

SEQ ID NO: 3955572 - RNA, 12 nt, Staphylococcus aureus subsp. aureus Mu50
aaugagauuauu

SEQ ID NO: 3955573 - RNA, 16 nt, Staphylococcus aureus subsp. aureus Mu50
aaugagcguuccauua

SEQ ID NO: 3955574 - RNA, 17 nt, Staphylococcus aureus subsp. aureus Mu50
aaugagcuuuucuaaug

SEQ ID NO: 3955575 - RNA, 18 nt, Staphylococcus aureus subsp. aureus Mu50
aaugagcuuuucuaaugc

SEQ ID NO: 3955576 - RNA, 14 nt, Staphylococcus aureus subsp. aureus Mu50
aaugaguacaacau

SEQ ID NO: 3955577 - RNA, 15 nt, Staphylococcus aureus subsp. aureus Mu50
aaugaguacaacaua

SEQ ID NO: 3955578 - RNA, 18 nt, Staphylococcus aureus subsp. aureus Mu50
aaugagugcuuauuuguu

SEQ ID NO: 3955579 - RNA, 16 nt, Staphylococcus aureus subsp. aureus Mu50
aaugauaaagagccac

SEQ ID NO: 3955580 - RNA, 16 nt, Staphylococcus aureus subsp. aureus Mu50
aaugauaauccaccaa

SEQ ID NO: 3955581 - RNA, 21 nt, Staphylococcus aureus subsp. aureus Mu50
aaugauaauccaccaaauaca

SEQ ID NO: 3955582 - RNA, 14 nt, Staphylococcus aureus subsp. aureus Mu50
aaugauaauuuaau

SEQ ID NO: 3955583 - RNA, 17 nt, Staphylococcus aureus subsp. aureus Mu50
aaugauaccuuuaaauc

SEQ ID NO: 3955584 - RNA, 19 nt, Staphylococcus aureus subsp. aureus Mu50
aaugauagaugcuggcuua

SEQ ID NO: 3955585 - RNA, 15 nt, Staphylococcus aureus subsp. aureus Mu50
aaugauagcuaaaca

SEQ ID NO: 3955586 - RNA, 20 nt, Staphylococcus aureus subsp. aureus Mu50
aaugauagcuaaacauuuua

SEQ ID NO: 3955587 - RNA, 15 nt, Staphylococcus aureus subsp. aureus Mu50
aaugauagugaauaa

SEQ ID NO: 3955588 - RNA, 17 nt, Staphylococcus aureus subsp. aureus Mu50
aaugauagugaauaaug

SEQ ID NO: 3955589 - RNA, 21 nt, Staphylococcus aureus subsp. aureus Mu50
aaugauaucugacauuucauc

SEQ ID NO: 3955590 - RNA, 16 nt, Staphylococcus aureus subsp. aureus Mu50
aaugauauugauuuga

SEQ ID NO: 3955591 - RNA, 18 nt, Staphylococcus aureus subsp. aureus Mu50
aaugaucaucuauauuua

SEQ ID NO: 3955592 - RNA, 19 nt, Staphylococcus aureus subsp. aureus Mu50
aaugaucguuagcuaaucg

SEQ ID NO: 3955593 - RNA, 14 nt, Staphylococcus aureus subsp. aureus Mu50
aaugaugacaucaa

SEQ ID NO: 3955594 - RNA, 20 nt, Staphylococcus aureus subsp. aureus Mu50
aaugaugacaucaauaucuu

SEQ ID NO: 3955595 - RNA, 23 nt, Staphylococcus aureus subsp. aureus Mu50
aaugaugaguauacuuacugaaa

SEQ ID NO: 3955596 - RNA, 20 nt, Staphylococcus aureus subsp. aureus Mu50
aaugaugcauaagauuuuga

SEQ ID NO: 3955597 - RNA, 17 nt, Staphylococcus aureus subsp. aureus Mu50
aaugauggguaguuaau

SEQ ID NO: 3955598 - RNA, 17 nt, Staphylococcus aureus subsp. aureus Mu50
aaugauggguauuuugu

SEQ ID NO: 3955599 - RNA, 19 nt, Staphylococcus aureus subsp. aureus Mu50
aaugauggguauuuuguuc

SEQ ID NO: 3955600 - RNA, 15 nt, Staphylococcus aureus subsp. aureus Mu50
aaugauguauuuuag

SEQ ID NO: 3955601 - RNA, 12 nt, Staphylococcus aureus subsp. aureus Mu50
aaugauuauaaa

SEQ ID NO: 3955602 - RNA, 14 nt, Staphylococcus aureus subsp. aureus Mu50
aaugauuauaaaua

SEQ ID NO: 3955603 - RNA, 17 nt, Staphylococcus aureus subsp. aureus Mu50
aaugauuauaaauacau

SEQ ID NO: 3955604 - RNA, 21 nt, Staphylococcus aureus subsp. aureus Mu50
aaugauucuuaucuuuaauca

SEQ ID NO: 3955605 - RNA, 23 nt, Staphylococcus aureus subsp. aureus Mu50
aaugauucuuaucuuuaaucaaa

SEQ ID NO: 3955606 - RNA, 22 nt, Staphylococcus aureus subsp. aureus Mu50
aaugauugaauauuguuguaaa

SEQ ID NO: 3955607 - RNA, 18 nt, Staphylococcus aureus subsp. aureus Mu50
aaugauugacgauuuaau

SEQ ID NO: 3955608 - RNA, 19 nt, Staphylococcus aureus subsp. aureus Mu50
aaugauugacgauuuaauu

SEQ ID NO: 3955609 - RNA, 15 nt, Staphylococcus aureus subsp. aureus Mu50
aaugauugcauugau

SEQ ID NO: 3955610 - RNA, 17 nt, Staphylococcus aureus subsp. aureus Mu50
aaugauuguaauaucua

SEQ ID NO: 3955611 - RNA, 14 nt, Staphylococcus aureus subsp. aureus Mu50
aaugauuuaauaaa

SEQ ID NO: 3955612 - RNA, 12 nt, Staphylococcus aureus subsp. aureus Mu50
aaugauuuauaa

SEQ ID NO: 3955613 - RNA, 15 nt, Staphylococcus aureus subsp. aureus Mu50
aaugauuugugguaa

SEQ ID NO: 3955614 - RNA, 20 nt, Staphylococcus aureus subsp. aureus Mu50
aaugauuuuauaauauuauu

SEQ ID NO: 3955615 - RNA, 13 nt, Staphylococcus aureus subsp. aureus Mu50
aaugauuuugcuu

SEQ ID NO: 3955616 - RNA, 22 nt, Staphylococcus aureus subsp. aureus Mu50
aaugauuuuucaucaauaucaa

SEQ ID NO: 3955617 - RNA, 16 nt, Staphylococcus aureus subsp. aureus Mu50
aaugcaacuaaaacua

SEQ ID NO: 3955618 - RNA, 16 nt, Staphylococcus aureus subsp. aureus Mu50
aaugcaacuugaucau

SEQ ID NO: 3955619 - RNA, 21 nt, Staphylococcus aureus subsp. aureus Mu50
aaugcaaguuggcggggcccc

SEQ ID NO: 3955620 - RNA, 16 nt, Staphylococcus aureus subsp. aureus Mu50
aaugcaccugugauaa

SEQ ID NO: 3955621 - RNA, 18 nt, Staphylococcus aureus subsp. aureus Mu50
aaugcacugagcaacaaa

SEQ ID NO: 3955622 - RNA, 23 nt, Staphylococcus aureus subsp. aureus Mu50
aaugcagauucuucaccaacuuu

SEQ ID NO: 3955623 - RNA, 20 nt, Staphylococcus aureus subsp. aureus Mu50
aaugcagcuguauaaccaua

SEQ ID NO: 3955624 - RNA, 22 nt, Staphylococcus aureus subsp. aureus Mu50
aaugcauggaaaagugcgauua

SEQ ID NO: 3955625 - RNA, 21 nt, Staphylococcus aureus subsp. aureus Mu50
aaugcauguggacguugaucu

SEQ ID NO: 3955626 - RNA, 17 nt, Staphylococcus aureus subsp. aureus Mu50
aaugcauuuaauuuaau

SEQ ID NO: 3955627 - RNA, 16 nt, Staphylococcus aureus subsp. aureus Mu50
aaugccaaauauagua

SEQ ID NO: 3955628 - RNA, 20 nt, Staphylococcus aureus subsp. aureus Mu50
aaugccaagaagacauugga

SEQ ID NO: 3955629 - RNA, 13 nt, Staphylococcus aureus subsp. aureus Mu50
aaugccauaccug

SEQ ID NO: 3955630 - RNA, 21 nt, Staphylococcus aureus subsp. aureus Mu50
aaugccauuguuauccaaaac

SEQ ID NO: 3955631 - RNA, 23 nt, Staphylococcus aureus subsp. aureus Mu50
aaugccauuguuauccaaaacau

SEQ ID NO: 3955632 - RNA, 16 nt, Staphylococcus aureus subsp. aureus Mu50
aaugccgcuucuaauu

SEQ ID NO: 3955633 - RNA, 14 nt, Staphylococcus aureus subsp. aureus Mu50
aaugccuaauuugu

SEQ ID NO: 3955634 - RNA, 22 nt, Staphylococcus aureus subsp. aureus Mu50
aaugccuacagauuuuaaaaau

SEQ ID NO: 3955635 - RNA, 20 nt, Staphylococcus aureus subsp. aureus Mu50
aaugccugcccuuuagucau

SEQ ID NO: 3955636 - RNA, 16 nt, Staphylococcus aureus subsp. aureus Mu50
aaugcgacaucgccaa

SEQ ID NO: 3955637 - RNA, 20 nt, Staphylococcus aureus subsp. aureus Mu50
aaugcgcuuccaauuuaaaa

SEQ ID NO: 3955638 - RNA, 19 nt, Staphylococcus aureus subsp. aureus Mu50
aaugcuaauacuaaucaaa

SEQ ID NO: 3955639 - RNA, 18 nt, Staphylococcus aureus subsp. aureus Mu50
aaugcuacuauuaaauaa

SEQ ID NO: 3955640 - RNA, 22 nt, Staphylococcus aureus subsp. aureus Mu50
aaugcuauauuuagaaugauga

SEQ ID NO: 3955641 - RNA, 13 nt, Staphylococcus aureus subsp. aureus Mu50
aaugcuaucaugc

SEQ ID NO: 3955642 - RNA, 18 nt, Staphylococcus aureus subsp. aureus Mu50
aaugcucccuucaaaguu

SEQ ID NO: 3955643 - RNA, 15 nt, Staphylococcus aureus subsp. aureus Mu50
aaugcuguuuuaugg

SEQ ID NO: 3955644 - RNA, 16 nt, Staphylococcus aureus subsp. aureus Mu50
aaugcuuaaaaacaau

SEQ ID NO: 3955645 - RNA, 22 nt, Staphylococcus aureus subsp. aureus Mu50
aaugcuuaauuuguuuuaaaua

SEQ ID NO: 3955646 - RNA, 23 nt, Staphylococcus aureus subsp. aureus Mu50
aaugcuuaauuuguuuuaaauac

SEQ ID NO: 3955647 - RNA, 13 nt, Staphylococcus aureus subsp. aureus Mu50
aaugcuuauauaa

SEQ ID NO: 3955648 - RNA, 16 nt, Staphylococcus aureus subsp. aureus Mu50
aaugcuucaaauguaa

SEQ ID NO: 3955649 - RNA, 22 nt, Staphylococcus aureus subsp. aureus Mu50
aaugcuucugguucuucaauau

SEQ ID NO: 3955650 - RNA, 14 nt, Staphylococcus aureus subsp. aureus Mu50
aauggaguauauca

SEQ ID NO: 3955651 - RNA, 15 nt, Staphylococcus aureus subsp. aureus Mu50
aauggaugaauauau

SEQ ID NO: 3955652 - RNA, 19 nt, Staphylococcus aureus subsp. aureus Mu50
aauggauuauuaugccuuu

SEQ ID NO: 3955653 - RNA, 20 nt, Staphylococcus aureus subsp. aureus Mu50
aauggauuuggucaaguuuu

SEQ ID NO: 3955654 - RNA, 14 nt, Staphylococcus aureus subsp. aureus Mu50
aauggcaccauacu

SEQ ID NO: 3955655 - RNA, 22 nt, Staphylococcus aureus subsp. aureus Mu50
aauggcacuuaauauaaggaag

SEQ ID NO: 3955656 - RNA, 13 nt, Staphylococcus aureus subsp. aureus Mu50
aauggccauuuga

SEQ ID NO: 3955657 - RNA, 13 nt, Staphylococcus aureus subsp. aureus Mu50
aauggcuccauuu

SEQ ID NO: 3955658 - RNA, 20 nt, Staphylococcus aureus subsp. aureus Mu50
aaugggcgugccauuaaaau

SEQ ID NO: 3955659 - RNA, 22 nt, Staphylococcus aureus subsp. aureus Mu50
aauuaaaacagcaaauaaaauc

SEQ ID NO: 3955660 - RNA, 14 nt, Staphylococcus aureus subsp. aureus Mu50
aauuaaaacuauaa

SEQ ID NO: 3955661 - RNA, 18 nt, Staphylococcus aureus subsp. aureus Mu50
aauuaaaacuauaauaaa

SEQ ID NO: 3955662 - RNA, 21 nt, Staphylococcus aureus subsp. aureus Mu50
aauuaaaacuauaauaaagau

SEQ ID NO: 3955663 - RNA, 20 nt, Staphylococcus aureus subsp. aureus Mu50
aauuaaaauaagauauauaa

SEQ ID NO: 3955664 - RNA, 15 nt, Staphylococcus aureus subsp. aureus Mu50
aauuaaaauguuaau

SEQ ID NO: 3955665 - RNA, 14 nt, Staphylococcus aureus subsp. aureus Mu50
aauuaaaauucucu

SEQ ID NO: 3955666 - RNA, 15 nt, Staphylococcus aureus subsp. aureus Mu50
aauuaaaauucucuu

SEQ ID NO: 3955667 - RNA, 21 nt, Staphylococcus aureus subsp. aureus Mu50
aauuaaacaagccuuaaaaua

SEQ ID NO: 3955668 - RNA, 23 nt, Staphylococcus aureus subsp. aureus Mu50
aauuaaacaagccuuaaaauauu

SEQ ID NO: 3955669 - RNA, 20 nt, Staphylococcus aureus subsp. aureus Mu50
aauuaaacauuuagauuuca

SEQ ID NO: 3955670 - RNA, 23 nt, Staphylococcus aureus subsp. aureus Mu50
aauuaaacgcucaacuauauaua

SEQ ID NO: 3955671 - RNA, 14 nt, Staphylococcus aureus subsp. aureus Mu50
aauuaaacuaauag

SEQ ID NO: 3955672 - RNA, 17 nt, Staphylococcus aureus subsp. aureus Mu50
aauuaaagauuaaaaua

SEQ ID NO: 3955673 - RNA, 20 nt, Staphylococcus aureus subsp. aureus Mu50
aauuaaagcuagaaacaaug

SEQ ID NO: 3955674 - RNA, 20 nt, Staphylococcus aureus subsp. aureus Mu50
aauuaaagucaauuuaaaua

SEQ ID NO: 3955675 - RNA, 15 nt, Staphylococcus aureus subsp. aureus Mu50
aauuaaaguggaaag

SEQ ID NO: 3955676 - RNA, 14 nt, Staphylococcus aureus subsp. aureus Mu50
aauuaaaguuaaag

SEQ ID NO: 3955677 - RNA, 15 nt, Staphylococcus aureus subsp. aureus Mu50
aauuaaauaaugaua

SEQ ID NO: 3955678 - RNA, 18 nt, Staphylococcus aureus subsp. aureus Mu50
aauuaaauuauauguuuu

SEQ ID NO: 3955679 - RNA, 14 nt, Staphylococcus aureus subsp. aureus Mu50
aauuaaauucaaau

SEQ ID NO: 3955680 - RNA, 13 nt, Staphylococcus aureus subsp. aureus Mu50
aauuaaauuuugu

SEQ ID NO: 3955681 - RNA, 17 nt, Staphylococcus aureus subsp. aureus Mu50
aauuaacaacaaauaua

SEQ ID NO: 3955682 - RNA, 11 nt, Staphylococcus aureus subsp. aureus Mu50
aauuaacaaua

SEQ ID NO: 3955683 - RNA, 12 nt, Staphylococcus aureus subsp. aureus Mu50
aauuaacaauau

SEQ ID NO: 3955684 - RNA, 16 nt, Staphylococcus aureus subsp. aureus Mu50
aauuaacaauauuaaa

SEQ ID NO: 3955685 - RNA, 19 nt, Staphylococcus aureus subsp. aureus Mu50
aauuaacaauauuaaauuu

SEQ ID NO: 3955686 - RNA, 19 nt, Staphylococcus aureus subsp. aureus Mu50
aauuaaccuugauuuaauu

SEQ ID NO: 3955687 - RNA, 23 nt, Staphylococcus aureus subsp. aureus Mu50
aauuaaccuugauuuaauuuuua

SEQ ID NO: 3955688 - RNA, 16 nt, Staphylococcus aureus subsp. aureus Mu50
aauuaacuaguguaau

SEQ ID NO: 3955689 - RNA, 22 nt, Staphylococcus aureus subsp. aureus Mu50
aauuaacuuaaaauuuaaauau

SEQ ID NO: 3955690 - RNA, 12 nt, Staphylococcus aureus subsp. aureus Mu50
aauuaagaaaag

SEQ ID NO: 3955691 - RNA, 14 nt, Staphylococcus aureus subsp. aureus Mu50
aauuaagaaaaguu

SEQ ID NO: 3955692 - RNA, 21 nt, Staphylococcus aureus subsp. aureus Mu50
aauuaagauguugaguuguaa

SEQ ID NO: 3955693 - RNA, 13 nt, Staphylococcus aureus subsp. aureus Mu50
aauuaaguuaaaa

SEQ ID NO: 3955694 - RNA, 16 nt, Staphylococcus aureus subsp. aureus Mu50
aauuaaguuaaaauaa

SEQ ID NO: 3955695 - RNA, 12 nt, Staphylococcus aureus subsp. aureus Mu50
aauuaauaaaaa

SEQ ID NO: 3955696 - RNA, 11 nt, Staphylococcus aureus subsp. aureus Mu50
aauuaauaauu

SEQ ID NO: 3955697 - RNA, 15 nt, Staphylococcus aureus subsp. aureus Mu50
aauuaauacaucaau

SEQ ID NO: 3955698 - RNA, 16 nt, Staphylococcus aureus subsp. aureus Mu50
aauuaaucaauuuaau

SEQ ID NO: 3955699 - RNA, 16 nt, Staphylococcus aureus subsp. aureus Mu50
aauuaauccaucuaca

SEQ ID NO: 3955700 - RNA, 14 nt, Staphylococcus aureus subsp. aureus Mu50
aauuaaucccuuca

SEQ ID NO: 3955701 - RNA, 18 nt, Staphylococcus aureus subsp. aureus Mu50
aauuaaucccuucaaaau

SEQ ID NO: 3955702 - RNA, 13 nt, Staphylococcus aureus subsp. aureus Mu50
aauuaaugauaaa

SEQ ID NO: 3955703 - RNA, 12 nt, Staphylococcus aureus subsp. aureus Mu50
aauuaauguaau

SEQ ID NO: 3955704 - RNA, 18 nt, Staphylococcus aureus subsp. aureus Mu50
aauuaauguucaaaaaau

SEQ ID NO: 3955705 - RNA, 21 nt, Staphylococcus aureus subsp. aureus Mu50
aauuaauguucaaaaaaugaa

SEQ ID NO: 3955706 - RNA, 13 nt, Staphylococcus aureus subsp. aureus Mu50
aauuaauuaaaau

SEQ ID NO: 3955707 - RNA, 14 nt, Staphylococcus aureus subsp. aureus Mu50
aauuaauuacuuuc

SEQ ID NO: 3955708 - RNA, 20 nt, Staphylococcus aureus subsp. aureus Mu50
aauuaauuacuuucauugua

SEQ ID NO: 3955709 - RNA, 13 nt, Staphylococcus aureus subsp. aureus Mu50
aauuaauuaucau

SEQ ID NO: 3955710 - RNA, 19 nt, Staphylococcus aureus subsp. aureus Mu50
aauuaauuaucauaaagau

SEQ ID NO: 3955711 - RNA, 12 nt, Staphylococcus aureus subsp. aureus Mu50
aauuaauuaucu

SEQ ID NO: 3955712 - RNA, 14 nt, Staphylococcus aureus subsp. aureus Mu50
aauuaauuaucuua

SEQ ID NO: 3955713 - RNA, 19 nt, Staphylococcus aureus subsp. aureus Mu50
aauuaauuauuauauaaua

SEQ ID NO: 3955714 - RNA, 18 nt, Staphylococcus aureus subsp. aureus Mu50
aauuaauugcuuucacau

SEQ ID NO: 3955715 - RNA, 20 nt, Staphylococcus aureus subsp. aureus Mu50
aauuaauuuagucauuacaa

SEQ ID NO: 3955716 - RNA, 13 nt, Staphylococcus aureus subsp. aureus Mu50
aauuacaacuuuu

SEQ ID NO: 3955717 - RNA, 14 nt, Staphylococcus aureus subsp. aureus Mu50
aauuacaacuuuua

SEQ ID NO: 3955718 - RNA, 18 nt, Staphylococcus aureus subsp. aureus Mu50
aauuacacccuuuaaauu

SEQ ID NO: 3955719 - RNA, 21 nt, Staphylococcus aureus subsp. aureus Mu50
aauuacacccuuuaaauuuaa

SEQ ID NO: 3955720 - RNA, 21 nt, Staphylococcus aureus subsp. aureus Mu50
aauuacacuacgcugaugaau

SEQ ID NO: 3955721 - RNA, 21 nt, Staphylococcus aureus subsp. aureus Mu50
aauuacagcgugauucaucua

SEQ ID NO: 3955722 - RNA, 21 nt, Staphylococcus aureus subsp. aureus Mu50
aauuacauuacgcucaucacc

SEQ ID NO: 3955723 - RNA, 14 nt, Staphylococcus aureus subsp. aureus Mu50
aauuaccaaugaau

SEQ ID NO: 3955724 - RNA, 22 nt, Staphylococcus aureus subsp. aureus Mu50
aauuaccaaugaauaaauugau

SEQ ID NO: 3955725 - RNA, 19 nt, Staphylococcus aureus subsp. aureus Mu50
aauuacuaaccuaaagaua

SEQ ID NO: 3955726 - RNA, 14 nt, Staphylococcus aureus subsp. aureus Mu50
aauuacucuuuuuc

SEQ ID NO: 3955727 - RNA, 21 nt, Staphylococcus aureus subsp. aureus Mu50
aauuacucuuuuucuuucaua

SEQ ID NO: 3955728 - RNA, 18 nt, Staphylococcus aureus subsp. aureus Mu50
aauuacuguaaauaugaa

SEQ ID NO: 3955729 - RNA, 21 nt, Staphylococcus aureus subsp. aureus Mu50
aauuacugucuuuccauaaua

SEQ ID NO: 3955730 - RNA, 20 nt, Staphylococcus aureus subsp. aureus Mu50
aauuacuugaauauuauuca

SEQ ID NO: 3955731 - RNA, 13 nt, Staphylococcus aureus subsp. aureus Mu50
aauuagaaauucu

SEQ ID NO: 3955732 - RNA, 19 nt, Staphylococcus aureus subsp. aureus Mu50
aauuagaaccaucauucau

SEQ ID NO: 3955733 - RNA, 21 nt, Staphylococcus aureus subsp. aureus Mu50
aauuagaaccaucauucauau

SEQ ID NO: 3955734 - RNA, 17 nt, Staphylococcus aureus subsp. aureus Mu50
aauuagauuuuaugcuu

SEQ ID NO: 3955735 - RNA, 21 nt, Staphylococcus aureus subsp. aureus Mu50
aauuagauuuuaugcuuuacu

SEQ ID NO: 3955736 - RNA, 22 nt, Staphylococcus aureus subsp. aureus Mu50
aauuagauuuuaugcuuuacuu

SEQ ID NO: 3955737 - RNA, 14 nt, Staphylococcus aureus subsp. aureus Mu50
aauuagauuuuguu

SEQ ID NO: 3955738 - RNA, 20 nt, Staphylococcus aureus subsp. aureus Mu50
aauuagauuuuguuguacuu

SEQ ID NO: 3955739 - RNA, 21 nt, Staphylococcus aureus subsp. aureus Mu50
aauuaggaacuacgucauacu

SEQ ID NO: 3955740 - RNA, 19 nt, Staphylococcus aureus subsp. aureus Mu50
aauuagggugaacaguuag

SEQ ID NO: 3955741 - RNA, 17 nt, Staphylococcus aureus subsp. aureus Mu50
aauuaggucauuuuuau

SEQ ID NO: 3955742 - RNA, 14 nt, Staphylococcus aureus subsp. aureus Mu50
aauuagucccauua

SEQ ID NO: 3955743 - RNA, 18 nt, Staphylococcus aureus subsp. aureus Mu50
aauuaguucguguuugaa

SEQ ID NO: 3955744 - RNA, 21 nt, Staphylococcus aureus subsp. aureus Mu50
aauuaguuuuuguuuacagau

SEQ ID NO: 3955745 - RNA, 20 nt, Staphylococcus aureus subsp. aureus Mu50
aauuauaaccgcuacaauua

SEQ ID NO: 3955746 - RNA, 14 nt, Staphylococcus aureus subsp. aureus Mu50
aauuauaauaaaac

SEQ ID NO: 3955747 - RNA, 17 nt, Staphylococcus aureus subsp. aureus Mu50
aauucugaaaucaguuu

SEQ ID NO: 3955748 - RNA, 17 nt, Staphylococcus aureus subsp. aureus Mu50
aauucuggauuaaaccc

SEQ ID NO: 3955749 - RNA, 20 nt, Staphylococcus aureus subsp. aureus Mu50
aauucugguuuaaugagcuu

SEQ ID NO: 3955750 - RNA, 17 nt, Staphylococcus aureus subsp. aureus Mu50
aauucugugagguaaaa

SEQ ID NO: 3955751 - RNA, 15 nt, Staphylococcus aureus subsp. aureus Mu50
aauucuuauaaaaua

SEQ ID NO: 3955752 - RNA, 16 nt, Staphylococcus aureus subsp. aureus Mu50
aauucuucaaauuuaa

SEQ ID NO: 3955753 - RNA, 21 nt, Staphylococcus aureus subsp. aureus Mu50
aauucuucaaccauuuguucu

SEQ ID NO: 3955754 - RNA, 21 nt, Staphylococcus aureus subsp. aureus Mu50
aauucuucaauuucauuuuug

SEQ ID NO: 3955755 - RNA, 12 nt, Staphylococcus aureus subsp. aureus Mu50
aauucuucauca

SEQ ID NO: 3955756 - RNA, 18 nt, Staphylococcus aureus subsp. aureus Mu50
aauucuucaucaauaacu

SEQ ID NO: 3955757 - RNA, 22 nt, Staphylococcus aureus subsp. aureus Mu50
aauucuucaucaauaacuauaa

SEQ ID NO: 3955758 - RNA, 21 nt, Staphylococcus aureus subsp. aureus Mu50
aauucuucaucuucuucaaaa

SEQ ID NO: 3955759 - RNA, 16 nt, Staphylococcus aureus subsp. aureus Mu50
aauucuuguuugauuu

SEQ ID NO: 3955760 - RNA, 15 nt, Staphylococcus aureus subsp. aureus Mu50
aauucuuuuguaauu

SEQ ID NO: 3955761 - RNA, 12 nt, Staphylococcus aureus subsp. aureus Mu50
aauucuuuuuca

SEQ ID NO: 3955762 - RNA, 18 nt, Staphylococcus aureus subsp. aureus Mu50
aauucuuuuucagcuaau

SEQ ID NO: 3955763 - RNA, 11 nt, Staphylococcus aureus subsp. aureus Mu50
aauugaaaauc

SEQ ID NO: 3955764 - RNA, 13 nt, Staphylococcus aureus subsp. aureus Mu50
aauugaaaugaua

SEQ ID NO: 3955765 - RNA, 15 nt, Staphylococcus aureus subsp. aureus Mu50
aauugaaauuaacug

SEQ ID NO: 3955766 - RNA, 13 nt, Staphylococcus aureus subsp. aureus Mu50
aauugaacuuugu

SEQ ID NO: 3955767 - RNA, 18 nt, Staphylococcus aureus subsp. aureus Mu50
aauugaaggccauuuuua

SEQ ID NO: 3955768 - RNA, 22 nt, Staphylococcus aureus subsp. aureus Mu50
aauugaaggccauuuuuauuua

SEQ ID NO: 3955769 - RNA, 18 nt, Staphylococcus aureus subsp. aureus Mu50
aauugaaguacauuaaaa

SEQ ID NO: 3955770 - RNA, 13 nt, Staphylococcus aureus subsp. aureus Mu50
aauugaauagguc

SEQ ID NO: 3955771 - RNA, 23 nt, Staphylococcus aureus subsp. aureus Mu50
aauugaauauuuuucaauuaaau

SEQ ID NO: 3955772 - RNA, 16 nt, Staphylococcus aureus subsp. aureus Mu50
aauugaaucaaauaca

SEQ ID NO: 3955773 - RNA, 13 nt, Staphylococcus aureus subsp. aureus Mu50
aauugaaugaaaa

SEQ ID NO: 3955774 - RNA, 14 nt, Staphylococcus aureus subsp. aureus Mu50
aauugaaugaaaaa

SEQ ID NO: 3955775 - RNA, 15 nt, Staphylococcus aureus subsp. aureus Mu50
aauugaaugaaaaua

SEQ ID NO: 3955776 - RNA, 21 nt, Staphylococcus aureus subsp. aureus Mu50
aauugaauugauuauaaugau

SEQ ID NO: 3955777 - RNA, 20 nt, Staphylococcus aureus subsp. aureus Mu50
aauugacaguuuccauaaau

SEQ ID NO: 3955778 - RNA, 15 nt, Staphylococcus aureus subsp. aureus Mu50
aauugacuuuaauug

SEQ ID NO: 3955779 - RNA, 19 nt, Staphylococcus aureus subsp. aureus Mu50
aauugacuuuaauugcucu

SEQ ID NO: 3955780 - RNA, 16 nt, Staphylococcus aureus subsp. aureus Mu50
aauugagaaguauuau

SEQ ID NO: 3955781 - RNA, 16 nt, Staphylococcus aureus subsp. aureus Mu50
aauugaguauauucaa

SEQ ID NO: 3955782 - RNA, 11 nt, Staphylococcus aureus subsp. aureus Mu50
aauugaguauu

SEQ ID NO: 3955783 - RNA, 16 nt, Staphylococcus aureus subsp. aureus Mu50
aauugaguauuaaauu

SEQ ID NO: 3955784 - RNA, 20 nt, Staphylococcus aureus subsp. aureus Mu50
aauugaguauuaaauuugaa

SEQ ID NO: 3955785 - RNA, 22 nt, Staphylococcus aureus subsp. aureus Mu50
aauugaguuguugcaacuugug

SEQ ID NO: 3955786 - RNA, 15 nt, Staphylococcus aureus subsp. aureus Mu50
aauugauauugcaaa

SEQ ID NO: 3955787 - RNA, 14 nt, Staphylococcus aureus subsp. aureus Mu50
aauugauggcuucu

SEQ ID NO: 3955788 - RNA, 17 nt, Staphylococcus aureus subsp. aureus Mu50
aauugauggcuucucuu

SEQ ID NO: 3955789 - RNA, 21 nt, Staphylococcus aureus subsp. aureus Mu50
aauugaugucacauaugacuu

SEQ ID NO: 3955790 - RNA, 18 nt, Staphylococcus aureus subsp. aureus Mu50
aauugaugugccuuucua

SEQ ID NO: 3955791 - RNA, 14 nt, Staphylococcus aureus subsp. aureus Mu50
aauugauuaaauaa

SEQ ID NO: 3955792 - RNA, 17 nt, Staphylococcus aureus subsp. aureus Mu50
aauugauuaaauaaauu

SEQ ID NO: 3955793 - RNA, 18 nt, Staphylococcus aureus subsp. aureus Mu50
aauugauuacaccacuua

SEQ ID NO: 3955794 - RNA, 16 nt, Staphylococcus aureus subsp. aureus Mu50
aauugauuauaaugau

SEQ ID NO: 3955795 - RNA, 20 nt, Staphylococcus aureus subsp. aureus Mu50
aauugauucucuguagauau

SEQ ID NO: 3955796 - RNA, 14 nt, Staphylococcus aureus subsp. aureus Mu50
aauugauucuuugg

SEQ ID NO: 3955797 - RNA, 13 nt, Staphylococcus aureus subsp. aureus Mu50
aauugauugcucu

SEQ ID NO: 3955798 - RNA, 14 nt, Staphylococcus aureus subsp. aureus Mu50
aauugauugucaua

SEQ ID NO: 3955799 - RNA, 23 nt, Staphylococcus aureus subsp. aureus Mu50
aauugauuuugcugccaaaaagu

SEQ ID NO: 3955800 - RNA, 17 nt, Staphylococcus aureus subsp. aureus Mu50
aauugcaaaguaacaau

SEQ ID NO: 3955801 - RNA, 20 nt, Staphylococcus aureus subsp. aureus Mu50
aauugcauagcuaaauaaau

SEQ ID NO: 3955802 - RNA, 16 nt, Staphylococcus aureus subsp. aureus Mu50
aauugcauuacuacaa

SEQ ID NO: 3955803 - RNA, 20 nt, Staphylococcus aureus subsp. aureus Mu50
aauugccuuaucagcauuaa

SEQ ID NO: 3955804 - RNA, 21 nt, Staphylococcus aureus subsp. aureus Mu50
aauugccuuucauuuuagcaa

SEQ ID NO: 3955805 - RNA, 19 nt, Staphylococcus aureus subsp. aureus Mu50
aauugcuaaaaaaauuaaa

SEQ ID NO: 3955806 - RNA, 22 nt, Staphylococcus aureus subsp. aureus Mu50
aauugcuauauuaguauaauuu

SEQ ID NO: 3955807 - RNA, 14 nt, Staphylococcus aureus subsp. aureus Mu50
aauugcuuaauauc

SEQ ID NO: 3955808 - RNA, 21 nt, Staphylococcus aureus subsp. aureus Mu50
aauugcuugaaauuauuauuu

SEQ ID NO: 3955809 - RNA, 17 nt, Staphylococcus aureus subsp. aureus Mu50
aauugcuuguucuuucu

SEQ ID NO: 3955810 - RNA, 22 nt, Staphylococcus aureus subsp. aureus Mu50
aauugcuuguuuuaaaugaccu

SEQ ID NO: 3955811 - RNA, 18 nt, Staphylococcus aureus subsp. aureus Mu50
aauugcuuucacauuguu

SEQ ID NO: 3955812 - RNA, 16 nt, Staphylococcus aureus subsp. aureus Mu50
aauuggaacacgaaau

SEQ ID NO: 3955813 - RNA, 22 nt, Staphylococcus aureus subsp. aureus Mu50
aauuggaaucaucuuuuugaaa

SEQ ID NO: 3955814 - RNA, 20 nt, Staphylococcus aureus subsp. aureus Mu50
aauuggauguaauagagaag

SEQ ID NO: 3955815 - RNA, 22 nt, Staphylococcus aureus subsp. aureus Mu50
aauuggcaacggcacauucaua

SEQ ID NO: 3955816 - RNA, 16 nt, Staphylococcus aureus subsp. aureus Mu50
aauuggcagauagaau

SEQ ID NO: 3955817 - RNA, 19 nt, Staphylococcus aureus subsp. aureus Mu50
aauugggaaauauuugaaa

SEQ ID NO: 3955818 - RNA, 14 nt, Staphylococcus aureus subsp. aureus Mu50
aauuggguuuaaua

SEQ ID NO: 3955819 - RNA, 18 nt, Staphylococcus aureus subsp. aureus Mu50
aauugguaaaaaucucaa

SEQ ID NO: 3955820 - RNA, 20 nt, Staphylococcus aureus subsp. aureus Mu50
aauugguuuggauaaaauga

SEQ ID NO: 3955821 - RNA, 22 nt, Staphylococcus aureus subsp. aureus Mu50
aauugguuuggauaaaaugaua

SEQ ID NO: 3955822 - RNA, 14 nt, Staphylococcus aureus subsp. aureus Mu50
aauugguuuucaug

SEQ ID NO: 3955823 - RNA, 19 nt, Staphylococcus aureus subsp. aureus Mu50
aauugguuuuuagugaaaa

SEQ ID NO: 3955824 - RNA, 23 nt, Staphylococcus aureus subsp. aureus Mu50
aauugguuuuuagugaaaagaac

SEQ ID NO: 3955825 - RNA, 22 nt, Staphylococcus aureus subsp. aureus Mu50
aauuguaaagcaugaauagcuu

SEQ ID NO: 3955826 - RNA, 12 nt, Staphylococcus aureus subsp. aureus Mu50
aauuguaaaucu

SEQ ID NO: 3955827 - RNA, 20 nt, Staphylococcus aureus subsp. aureus Mu50
aauuguaaucuauuuucugc

SEQ ID NO: 3955828 - RNA, 16 nt, Staphylococcus aureus subsp. aureus Mu50
aauuguaguaaugaag

SEQ ID NO: 3955829 - RNA, 16 nt, Staphylococcus aureus subsp. aureus Mu50
aauuguaugaauaaua

SEQ ID NO: 3955830 - RNA, 13 nt, Staphylococcus aureus subsp. aureus Mu50
aauuguauuucuu

SEQ ID NO: 3955831 - RNA, 15 nt, Staphylococcus aureus subsp. aureus Mu50
aauuguauuucuuaa

SEQ ID NO: 3955832 - RNA, 23 nt, Staphylococcus aureus subsp. aureus Mu50
aauugucguucucguguaaaaug

SEQ ID NO: 3955833 - RNA, 13 nt, Staphylococcus aureus subsp. aureus Mu50
aauugucuuuaua

SEQ ID NO: 3955834 - RNA, 16 nt, Staphylococcus aureus subsp. aureus Mu50
aauugucuuuauaaaa

SEQ ID NO: 3955835 - RNA, 14 nt, Staphylococcus aureus subsp. aureus Mu50
aauuucgacaucua

SEQ ID NO: 3955836 - RNA, 21 nt, Staphylococcus aureus subsp. aureus Mu50
aauuucgacaucuagaugaaa

SEQ ID NO: 3955837 - RNA, 18 nt, Staphylococcus aureus subsp. aureus Mu50
aauuucgauuuucaccaa

SEQ ID NO: 3955838 - RNA, 13 nt, Staphylococcus aureus subsp. aureus Mu50
aauuucgcacaau

SEQ ID NO: 3955839 - RNA, 14 nt, Staphylococcus aureus subsp. aureus Mu50
aauuucgcaguagc

SEQ ID NO: 3955840 - RNA, 11 nt, Staphylococcus aureus subsp. aureus Mu50
aauuucuaaua

SEQ ID NO: 3955841 - RNA, 20 nt, Staphylococcus aureus subsp. aureus Mu50
aauuucucacugcuguucuu

SEQ ID NO: 3955842 - RNA, 17 nt, Staphylococcus aureus subsp. aureus Mu50
aauuucuccaaguacac

SEQ ID NO: 3955843 - RNA, 21 nt, Staphylococcus aureus subsp. aureus Mu50
aauuucucccguuugauuuca

SEQ ID NO: 3955844 - RNA, 17 nt, Staphylococcus aureus subsp. aureus Mu50
aauuucugcuucuuuua

SEQ ID NO: 3955845 - RNA, 14 nt, Staphylococcus aureus subsp. aureus Mu50
aauuucuuuaaagu

SEQ ID NO: 3955846 - RNA, 16 nt, Staphylococcus aureus subsp. aureus Mu50
aauuucuuuaaagucu

SEQ ID NO: 3955847 - RNA, 14 nt, Staphylococcus aureus subsp. aureus Mu50
aauuucuuuaagug

SEQ ID NO: 3955848 - RNA, 19 nt, Staphylococcus aureus subsp. aureus Mu50
aauuugaaaguaaauuaca

SEQ ID NO: 3955849 - RNA, 13 nt, Staphylococcus aureus subsp. aureus Mu50
aauuugaaauaua

SEQ ID NO: 3955850 - RNA, 17 nt, Staphylococcus aureus subsp. aureus Mu50
aauuugaaauauaccaa

SEQ ID NO: 3955851 - RNA, 12 nt, Staphylococcus aureus subsp. aureus Mu50
aauuugaaauug

SEQ ID NO: 3955852 - RNA, 15 nt, Staphylococcus aureus subsp. aureus Mu50
aauuugaaauugaca

SEQ ID NO: 3955853 - RNA, 21 nt, Staphylococcus aureus subsp. aureus Mu50
aauuugaauauacuuaauuua

SEQ ID NO: 3955854 - RNA, 13 nt, Staphylococcus aureus subsp. aureus Mu50
aauuugaauaugg

SEQ ID NO: 3955855 - RNA, 18 nt, Staphylococcus aureus subsp. aureus Mu50
aauuugaauugacuuaca

SEQ ID NO: 3955856 - RNA, 15 nt, Staphylococcus aureus subsp. aureus Mu50
aauuugagaaaugaa

SEQ ID NO: 3955857 - RNA, 21 nt, Staphylococcus aureus subsp. aureus Mu50
aauuugagccauuguuauuau

SEQ ID NO: 3955858 - RNA, 17 nt, Staphylococcus aureus subsp. aureus Mu50
aauuugaggauacauaa

SEQ ID NO: 3955859 - RNA, 24 nt, Staphylococcus aureus subsp. aureus Mu50
aauuugaggauacauaaaucuaau

SEQ ID NO: 3955860 - RNA, 19 nt, Staphylococcus aureus subsp. aureus Mu50
aauuugauguucuugaaaa

SEQ ID NO: 3955861 - RNA, 12 nt, Staphylococcus aureus subsp. aureus Mu50
aauuugauuaaa

SEQ ID NO: 3955862 - RNA, 17 nt, Staphylococcus aureus subsp. aureus Mu50
aauuugauuaaauucau

SEQ ID NO: 3955863 - RNA, 16 nt, Staphylococcus aureus subsp. aureus Mu50
aauuugauuaaauucu

SEQ ID NO: 3955864 - RNA, 16 nt, Staphylococcus aureus subsp. aureus Mu50
aauuugcaaaaucaac

SEQ ID NO: 3955865 - RNA, 16 nt, Staphylococcus aureus subsp. aureus Mu50
aauuuggucauauaaa

SEQ ID NO: 3955866 - RNA, 17 nt, Staphylococcus aureus subsp. aureus Mu50
aauuugguuaacauccu

SEQ ID NO: 3955867 - RNA, 14 nt, Staphylococcus aureus subsp. aureus Mu50
aauuuguaaagaca

SEQ ID NO: 3955868 - RNA, 18 nt, Staphylococcus aureus subsp. aureus Mu50
aauuuguaacuauugaaa

SEQ ID NO: 3955869 - RNA, 21 nt, Staphylococcus aureus subsp. aureus Mu50
aauuuguaacuauugaaaaua

SEQ ID NO: 3955870 - RNA, 14 nt, Staphylococcus aureus subsp. aureus Mu50
aauuuguaauacaa

SEQ ID NO: 3955871 - RNA, 14 nt, Staphylococcus aureus subsp. aureus Mu50
aauuuguaauuccu

SEQ ID NO: 3955872 - RNA, 13 nt, Staphylococcus aureus subsp. aureus Mu50
aauuuguaccaaa

SEQ ID NO: 3955873 - RNA, 20 nt, Staphylococcus aureus subsp. aureus Mu50
aauuuguguucaaaucacaa

SEQ ID NO: 3955874 - RNA, 16 nt, Staphylococcus aureus subsp. aureus Mu50
aauuuguuuuaaauac

SEQ ID NO: 3955875 - RNA, 23 nt, Staphylococcus aureus subsp. aureus Mu50
aauuuuaaaaauaaaaaaccaau

SEQ ID NO: 3955876 - RNA, 15 nt, Staphylococcus aureus subsp. aureus Mu50
aauuuuaaaauaaau

SEQ ID NO: 3955877 - RNA, 21 nt, Staphylococcus aureus subsp. aureus Mu50
aauuuuaaauauugauauaaa

SEQ ID NO: 3955878 - RNA, 11 nt, Staphylococcus aureus subsp. aureus Mu50
aauuuuaaauc

SEQ ID NO: 3955879 - RNA, 22 nt, Staphylococcus aureus subsp. aureus Mu50
aauuuuaaugggcgugccauua

SEQ ID NO: 3955880 - RNA, 22 nt, Staphylococcus aureus subsp. aureus Mu50
aauuuuaauuaauuaucauaaa

SEQ ID NO: 3955881 - RNA, 15 nt, Staphylococcus aureus subsp. aureus Mu50
aauuuuaccaucaau

SEQ ID NO: 3955882 - RNA, 22 nt, Staphylococcus aureus subsp. aureus Mu50
aauuuuaccuucgcauacuuuu

SEQ ID NO: 3955883 - RNA, 20 nt, Staphylococcus aureus subsp. aureus Mu50
aauuuuacuaguguauauaa

SEQ ID NO: 3955884 - RNA, 23 nt, Staphylococcus aureus subsp. aureus Mu50
aauuuuagugaaugggucauuaa

SEQ ID NO: 3955885 - RNA, 20 nt, Staphylococcus aureus subsp. aureus Mu50
aauuuuauaaauuaaaugca

SEQ ID NO: 3955886 - RNA, 12 nt, Staphylococcus aureus subsp. aureus Mu50
aauuuuauacua

SEQ ID NO: 3955887 - RNA, 13 nt, Staphylococcus aureus subsp. aureus Mu50
aauuuuauauauc

SEQ ID NO: 3955888 - RNA, 16 nt, Staphylococcus aureus subsp. aureus Mu50
aauuuucaauuagaaa

SEQ ID NO: 3955889 - RNA, 11 nt, Staphylococcus aureus subsp. aureus Mu50
aauuuucagaa

SEQ ID NO: 3955890 - RNA, 16 nt, Staphylococcus aureus subsp. aureus Mu50
aauuuucauuguuuca

SEQ ID NO: 3955891 - RNA, 19 nt, Staphylococcus aureus subsp. aureus Mu50
aauuuuccuuccaauaaua

SEQ ID NO: 3955892 - RNA, 13 nt, Staphylococcus aureus subsp. aureus Mu50
aauuuucuaaaua

SEQ ID NO: 3955893 - RNA, 14 nt, Staphylococcus aureus subsp. aureus Mu50
aauuuucuaaaugu

SEQ ID NO: 3955894 - RNA, 14 nt, Staphylococcus aureus subsp. aureus Mu50
aauuuucucauuaa

SEQ ID NO: 3955895 - RNA, 19 nt, Staphylococcus aureus subsp. aureus Mu50
aauuuucuguuuaauuaaa

SEQ ID NO: 3955896 - RNA, 21 nt, Staphylococcus aureus subsp. aureus Mu50
aauuuucuguuuaauuaaaau

SEQ ID NO: 3955897 - RNA, 15 nt, Staphylococcus aureus subsp. aureus Mu50
aauuuucuugccauc

SEQ ID NO: 3955898 - RNA, 12 nt, Staphylococcus aureus subsp. aureus Mu50
aauuuucuuuuu

SEQ ID NO: 3955899 - RNA, 20 nt, Staphylococcus aureus subsp. aureus Mu50
aauuuugacauaaaaaauaa

SEQ ID NO: 3955900 - RNA, 12 nt, Staphylococcus aureus subsp. aureus Mu50
aauuuugauaua

SEQ ID NO: 3955901 - RNA, 13 nt, Staphylococcus aureus subsp. aureus Mu50
aauuuuguaauua

SEQ ID NO: 3955902 - RNA, 17 nt, Staphylococcus aureus subsp. aureus Mu50
aauuuuuaacaaaauau

SEQ ID NO: 3955903 - RNA, 12 nt, Staphylococcus aureus subsp. aureus Mu50
aauuuuuaaugu

SEQ ID NO: 3955904 - RNA, 23 nt, Staphylococcus aureus subsp. aureus Mu50
aauuuuuaguuagggaaauguag

SEQ ID NO: 3955905 - RNA, 15 nt, Staphylococcus aureus subsp. aureus Mu50
aauuuuuaugcauua

SEQ ID NO: 3955906 - RNA, 19 nt, Staphylococcus aureus subsp. aureus Mu50
aauuuuuaugcauuauaga

SEQ ID NO: 3955907 - RNA, 14 nt, Staphylococcus aureus subsp. aureus Mu50
aauuuuuauucugu

SEQ ID NO: 3955908 - RNA, 15 nt, Staphylococcus aureus subsp. aureus Mu50
aauuuuuauuuuuag

SEQ ID NO: 3955909 - RNA, 16 nt, Staphylococcus aureus subsp. aureus Mu50
aauuuuuauuuuuagu

SEQ ID NO: 3955910 - RNA, 18 nt, Staphylococcus aureus subsp. aureus Mu50
aauuuuucacuucaaaca

SEQ ID NO: 3955911 - RNA, 13 nt, Staphylococcus aureus subsp. aureus Mu50
aauuuuucauaua

SEQ ID NO: 3955912 - RNA, 13 nt, Staphylococcus aureus subsp. aureus Mu50
aauuuuucauuaa

SEQ ID NO: 3955913 - RNA, 19 nt, Staphylococcus aureus subsp. aureus Mu50
aauuuuucauuaauacaag

SEQ ID NO: 3955914 - RNA, 21 nt, Staphylococcus aureus subsp. aureus Mu50
aauuuuuccgauugagcuuuc

SEQ ID NO: 3955915 - RNA, 20 nt, Staphylococcus aureus subsp. aureus Mu50
aauuuuucuaaaugauuuau

SEQ ID NO: 3955916 - RNA, 21 nt, Staphylococcus aureus subsp. aureus Mu50
aauuuuucuucuuuuuuaucu

SEQ ID NO: 3955917 - RNA, 17 nt, Staphylococcus aureus subsp. aureus Mu50
aauuuuugggaagaaua

SEQ ID NO: 3955918 - RNA, 16 nt, Staphylococcus aureus subsp. aureus Mu50
aauuuuuuauuaagac

SEQ ID NO: 3955919 - RNA, 21 nt, Staphylococcus aureus subsp. aureus Mu50
aauuuuuucaucauucaaacu

SEQ ID NO: 3955920 - RNA, 17 nt, Staphylococcus aureus subsp. aureus Mu50
aauuuuuugugccucuu

SEQ ID NO: 3955921 - RNA, 14 nt, Staphylococcus aureus subsp. aureus Mu50
aauuuuuuucauaa

SEQ ID NO: 3955922 - RNA, 15 nt, Staphylococcus aureus subsp. aureus Mu50
aauuuuuuuuauuaa

SEQ ID NO: 3955923 - RNA, 23 nt, Staphylococcus aureus subsp. aureus Mu50
acaagucuaguucgaacacacac

SEQ ID NO: 3955924 - RNA, 18 nt, Staphylococcus aureus subsp. aureus Mu50
acaagucuuuacucuaca

SEQ ID NO: 3955925 - RNA, 22 nt, Staphylococcus aureus subsp. aureus Mu50
acaagucuuuacucuacacuca

SEQ ID NO: 3955926 - RNA, 21 nt, Staphylococcus aureus subsp. aureus Mu50
acaaguugaucaaaaauguua

SEQ ID NO: 3955927 - RNA, 18 nt, Staphylococcus aureus subsp. aureus Mu50
acaaguugcacauuauaa

SEQ ID NO: 3955928 - RNA, 16 nt, Staphylococcus aureus subsp. aureus Mu50
acaaguugcugaauaa

SEQ ID NO: 3955929 - RNA, 20 nt, Staphylococcus aureus subsp. aureus Mu50
acaaguugcugaauaaaaua

SEQ ID NO: 3955930 - RNA, 15 nt, Staphylococcus aureus subsp. aureus Mu50
acaaguuguucaauu

SEQ ID NO: 3955931 - RNA, 21 nt, Staphylococcus aureus subsp. aureus Mu50
acaaguuuacagguugaauaa

SEQ ID NO: 3955932 - RNA, 11 nt, Staphylococcus aureus subsp. aureus Mu50
acaauaaaauu

SEQ ID NO: 3955933 - RNA, 15 nt, Staphylococcus aureus subsp. aureus Mu50
acaauaacuguucuu

SEQ ID NO: 3955934 - RNA, 17 nt, Staphylococcus aureus subsp. aureus Mu50
acaauaacuguucuuuc

SEQ ID NO: 3955935 - RNA, 20 nt, Staphylococcus aureus subsp. aureus Mu50
acaauaagcgcaauuaaaag

SEQ ID NO: 3955936 - RNA, 17 nt, Staphylococcus aureus subsp. aureus Mu50
acaauaauaccuucaau

SEQ ID NO: 3955937 - RNA, 16 nt, Staphylococcus aureus subsp. aureus Mu50
acaauaaugugcaagu

SEQ ID NO: 3955938 - RNA, 16 nt, Staphylococcus aureus subsp. aureus Mu50
acaauaauuuaauauu

SEQ ID NO: 3955939 - RNA, 22 nt, Staphylococcus aureus subsp. aureus Mu50
acaauaauuucgcaguagcugc

SEQ ID NO: 3955940 - RNA, 16 nt, Staphylococcus aureus subsp. aureus Mu50
acaauacauaaugguu

SEQ ID NO: 3955941 - RNA, 18 nt, Staphylococcus aureus subsp. aureus Mu50
acaauaccgcgauaaaua

SEQ ID NO: 3955942 - RNA, 23 nt, Staphylococcus aureus subsp. aureus Mu50
acaauaccgcgauaaauaacuuu

SEQ ID NO: 3955943 - RNA, 15 nt, Staphylococcus aureus subsp. aureus Mu50
acaauacgaaaucaa

SEQ ID NO: 3955944 - RNA, 17 nt, Staphylococcus aureus subsp. aureus Mu50
acaauacgaaaucaaaa

SEQ ID NO: 3955945 - RNA, 22 nt, Staphylococcus aureus subsp. aureus Mu50
acaauacgaaaucaaaaauaau

SEQ ID NO: 3955946 - RNA, 14 nt, Staphylococcus aureus subsp. aureus Mu50
acaauacgaugaug

SEQ ID NO: 3955947 - RNA, 17 nt, Staphylococcus aureus subsp. aureus Mu50
acaauauaauauacaca

SEQ ID NO: 3955948 - RNA, 21 nt, Staphylococcus aureus subsp. aureus Mu50
acaauaugaauuggauguaau

SEQ ID NO: 3955949 - RNA, 22 nt, Staphylococcus aureus subsp. aureus Mu50
acaauaugauuaauaaaguaau

SEQ ID NO: 3955950 - RNA, 15 nt, Staphylococcus aureus subsp. aureus Mu50
acaauauuaaaauua

SEQ ID NO: 3955951 - RNA, 18 nt, Staphylococcus aureus subsp. aureus Mu50
acaauauuaaaauuaaaa

SEQ ID NO: 3955952 - RNA, 19 nt, Staphylococcus aureus subsp. aureus Mu50
acaauauuaaaauuaaaac

SEQ ID NO: 3955953 - RNA, 18 nt, Staphylococcus aureus subsp. aureus Mu50
acaauauucguaaauccu

SEQ ID NO: 3955954 - RNA, 20 nt, Staphylococcus aureus subsp. aureus Mu50
acaauauucguaaauccuuu

SEQ ID NO: 3955955 - RNA, 21 nt, Staphylococcus aureus subsp. aureus Mu50
acaauauucguaaauccuuua

SEQ ID NO: 3955956 - RNA, 14 nt, Staphylococcus aureus subsp. aureus Mu50
acaauauugacuuu

SEQ ID NO: 3955957 - RNA, 13 nt, Staphylococcus aureus subsp. aureus Mu50
acaauauuuuuac

SEQ ID NO: 3955958 - RNA, 24 nt, Staphylococcus aureus subsp. aureus Mu50
acaaucaaauuacaaauuaucuag

SEQ ID NO: 3955959 - RNA, 18 nt, Staphylococcus aureus subsp. aureus Mu50
acaaucaacuuagaauuu

SEQ ID NO: 3955960 - RNA, 21 nt, Staphylococcus aureus subsp. aureus Mu50
acaaucaacuuagaauuuaca

SEQ ID NO: 3955961 - RNA, 13 nt, Staphylococcus aureus subsp. aureus Mu50
acaaucacagcaa

SEQ ID NO: 3955962 - RNA, 14 nt, Staphylococcus aureus subsp. aureus Mu50
acaaucacagcaau

SEQ ID NO: 3955963 - RNA, 15 nt, Staphylococcus aureus subsp. aureus Mu50
acaaucacagcaaua

SEQ ID NO: 3955964 - RNA, 18 nt, Staphylococcus aureus subsp. aureus Mu50
acaaucacagcaauaaua

SEQ ID NO: 3955965 - RNA, 19 nt, Staphylococcus aureus subsp. aureus Mu50
acaaucacagcaauaauaa

SEQ ID NO: 3955966 - RNA, 19 nt, Staphylococcus aureus subsp. aureus Mu50
acaaucagauaaguuacua

SEQ ID NO: 3955967 - RNA, 24 nt, Staphylococcus aureus subsp. aureus Mu50
acaaucagauaaguuacuagcauu

SEQ ID NO: 3955968 - RNA, 20 nt, Staphylococcus aureus subsp. aureus Mu50
acaaucggaagcauauuucu

SEQ ID NO: 3955969 - RNA, 14 nt, Staphylococcus aureus subsp. aureus Mu50
acaaucguuuuaau

SEQ ID NO: 3955970 - RNA, 19 nt, Staphylococcus aureus subsp. aureus Mu50
acaaucguuuuaaugccug

SEQ ID NO: 3955971 - RNA, 20 nt, Staphylococcus aureus subsp. aureus Mu50
acaaucuguucauaauguaa

SEQ ID NO: 3955972 - RNA, 16 nt, Staphylococcus aureus subsp. aureus Mu50
acaaucuuaucauaau

SEQ ID NO: 3955973 - RNA, 20 nt, Staphylococcus aureus subsp. aureus Mu50
acaaucuuaucauaaucuuc

SEQ ID NO: 3955974 - RNA, 21 nt, Staphylococcus aureus subsp. aureus Mu50
acaaucuuuuucaugcuauuu

SEQ ID NO: 3955975 - RNA, 18 nt, Staphylococcus aureus subsp. aureus Mu50
acaaugaauuguuaguuu

SEQ ID NO: 3955976 - RNA, 23 nt, Staphylococcus aureus subsp. aureus Mu50
acaaugaauuucuaauuuaguau

SEQ ID NO: 3955977 - RNA, 15 nt, Staphylococcus aureus subsp. aureus Mu50
acaaugauuaaaauu

SEQ ID NO: 3955978 - RNA, 16 nt, Staphylococcus aureus subsp. aureus Mu50
acaaugauuaaaauua

SEQ ID NO: 3955979 - RNA, 15 nt, Staphylococcus aureus subsp. aureus Mu50
acaaugauuacuuua

SEQ ID NO: 3955980 - RNA, 13 nt, Staphylococcus aureus subsp. aureus Mu50
acaaugcagcugu

SEQ ID NO: 3955981 - RNA, 15 nt, Staphylococcus aureus subsp. aureus Mu50
acaaugcagcuguau

SEQ ID NO: 3955982 - RNA, 21 nt, Staphylococcus aureus subsp. aureus Mu50
acaauggaugccgcucuuuuu

SEQ ID NO: 3955983 - RNA, 16 nt, Staphylococcus aureus subsp. aureus Mu50
acaauuaaagugaaua

SEQ ID NO: 3955984 - RNA, 16 nt, Staphylococcus aureus subsp. aureus Mu50
acaauuauaaaugauu

SEQ ID NO: 3955985 - RNA, 18 nt, Staphylococcus aureus subsp. aureus Mu50
acaauuauaaaugauuaa

SEQ ID NO: 3955986 - RNA, 18 nt, Staphylococcus aureus subsp. aureus Mu50
acaauuccccaaagccuu

SEQ ID NO: 3955987 - RNA, 22 nt, Staphylococcus aureus subsp. aureus Mu50
acaauugauugcucuaagcauu

SEQ ID NO: 3955988 - RNA, 15 nt, Staphylococcus aureus subsp. aureus Mu50
acaauugcuaaucca

SEQ ID NO: 3955989 - RNA, 16 nt, Staphylococcus aureus subsp. aureus Mu50
acaauugcuaauccau

SEQ ID NO: 3955990 - RNA, 22 nt, Staphylococcus aureus subsp. aureus Mu50
acaauuguauaaugugcgucac

SEQ ID NO: 3955991 - RNA, 13 nt, Staphylococcus aureus subsp. aureus Mu50
acaauuuaaacgc

SEQ ID NO: 3955992 - RNA, 17 nt, Staphylococcus aureus subsp. aureus Mu50
acaauuuaaacgcacua

SEQ ID NO: 3955993 - RNA, 20 nt, Staphylococcus aureus subsp. aureus Mu50
acaauuuagcaaauauuucu

SEQ ID NO: 3955994 - RNA, 17 nt, Staphylococcus aureus subsp. aureus Mu50
acaauuuauuaaaacga

SEQ ID NO: 3955995 - RNA, 16 nt, Staphylococcus aureus subsp. aureus Mu50
acaauuuuaaaucuuu

SEQ ID NO: 3955996 - RNA, 23 nt, Staphylococcus aureus subsp. aureus Mu50
acaauuuuaccuucgcauacuuu

SEQ ID NO: 3955997 - RNA, 22 nt, Staphylococcus aureus subsp. aureus Mu50
acaauuuuccuuccaauaauaa

SEQ ID NO: 3955998 - RNA, 17 nt, Staphylococcus aureus subsp. aureus Mu50
acaauuuugacuacuaa

SEQ ID NO: 3955999 - RNA, 20 nt, Staphylococcus aureus subsp. aureus Mu50
acaauuuugacuacuaaucu

SEQ ID NO: 3956000 - RNA, 13 nt, Staphylococcus aureus subsp. aureus Mu50
acaauuuuuaaaa

SEQ ID NO: 3956001 - RNA, 16 nt, Staphylococcus aureus subsp. aureus Mu50
acaauuuuuaaaaacc

SEQ ID NO: 3956002 - RNA, 12 nt, Staphylococcus aureus subsp. aureus Mu50
acacaaagaauu

SEQ ID NO: 3956003 - RNA, 23 nt, Staphylococcus aureus subsp. aureus Mu50
acacaaauaaaggcaacaaauau

SEQ ID NO: 3956004 - RNA, 17 nt, Staphylococcus aureus subsp. aureus Mu50
acacaaauuaaaacucg

SEQ ID NO: 3956005 - RNA, 22 nt, Staphylococcus aureus subsp. aureus Mu50
acacaaauuuuuuguaaacaug

SEQ ID NO: 3956006 - RNA, 19 nt, Staphylococcus aureus subsp. aureus Mu50
acacacaugauaauuuuua

SEQ ID NO: 3956007 - RNA, 20 nt, Staphylococcus aureus subsp. aureus Mu50
acacacaugauaauuuuuag

SEQ ID NO: 3956008 - RNA, 15 nt, Staphylococcus aureus subsp. aureus Mu50
acacacccaaauuua

SEQ ID NO: 3956009 - RNA, 20 nt, Staphylococcus aureus subsp. aureus Mu50
acacacuuauaaucuauaaa

SEQ ID NO: 3956010 - RNA, 15 nt, Staphylococcus aureus subsp. aureus Mu50
acaguuacuucaguu

SEQ ID NO: 3956011 - RNA, 14 nt, Staphylococcus aureus subsp. aureus Mu50
acaguuauauauuc

SEQ ID NO: 3956012 - RNA, 21 nt, Staphylococcus aureus subsp. aureus Mu50
acaguuaugccugaagcgcuu

SEQ ID NO: 3956013 - RNA, 20 nt, Staphylococcus aureus subsp. aureus Mu50
acaguucuauagguuuauaa

SEQ ID NO: 3956014 - RNA, 19 nt, Staphylococcus aureus subsp. aureus Mu50
acaguuuccauaaauaaaa

SEQ ID NO: 3956015 - RNA, 20 nt, Staphylococcus aureus subsp. aureus Mu50
acaguuucuuggucugcugu

SEQ ID NO: 3956016 - RNA, 13 nt, Staphylococcus aureus subsp. aureus Mu50
acaguuuuaaaga

SEQ ID NO: 3956017 - RNA, 22 nt, Staphylococcus aureus subsp. aureus Mu50
acaguuuuacuauaaugaugua

SEQ ID NO: 3956018 - RNA, 23 nt, Staphylococcus aureus subsp. aureus Mu50
acaguuuuauuaucuuuguaaau

SEQ ID NO: 3956019 - RNA, 14 nt, Staphylococcus aureus subsp. aureus Mu50
acaguuuuuauauu

SEQ ID NO: 3956020 - RNA, 19 nt, Staphylococcus aureus subsp. aureus Mu50
acaguuuuuauauuaagac

SEQ ID NO: 3956021 - RNA, 17 nt, Staphylococcus aureus subsp. aureus Mu50
acauaaaaaaacgucgu

SEQ ID NO: 3956022 - RNA, 19 nt, Staphylococcus aureus subsp. aureus Mu50
acauaaaaaugcucaaguu

SEQ ID NO: 3956023 - RNA, 16 nt, Staphylococcus aureus subsp. aureus Mu50
acauaaaacuuacauu

SEQ ID NO: 3956024 - RNA, 15 nt, Staphylococcus aureus subsp. aureus Mu50
acauaaaauuaacuu

SEQ ID NO: 3956025 - RNA, 13 nt, Staphylococcus aureus subsp. aureus Mu50
acauaaaauuuaa

SEQ ID NO: 3956026 - RNA, 22 nt, Staphylococcus aureus subsp. aureus Mu50
acauaaauaagcaguaagauga

SEQ ID NO: 3956027 - RNA, 12 nt, Staphylococcus aureus subsp. aureus Mu50
acauaaaucaau

SEQ ID NO: 3956028 - RNA, 23 nt, Staphylococcus aureus subsp. aureus Mu50
acauaaaucuaauacuuucaaac

SEQ ID NO: 3956029 - RNA, 14 nt, Staphylococcus aureus subsp. aureus Mu50
acauaacacaaguu

SEQ ID NO: 3956030 - RNA, 19 nt, Staphylococcus aureus subsp. aureus Mu50
acauaaccuaauucgccau

SEQ ID NO: 3956031 - RNA, 14 nt, Staphylococcus aureus subsp. aureus Mu50
acauaacuaugcuu

SEQ ID NO: 3956032 - RNA, 16 nt, Staphylococcus aureus subsp. aureus Mu50
acauaauagacuuaua

SEQ ID NO: 3956033 - RNA, 17 nt, Staphylococcus aureus subsp. aureus Mu50
acauaauagacuuauau

SEQ ID NO: 3956034 - RNA, 21 nt, Staphylococcus aureus subsp. aureus Mu50
acauaauauuucuuaccauuu

SEQ ID NO: 3956035 - RNA, 16 nt, Staphylococcus aureus subsp. aureus Mu50
acauaaucauugugua

SEQ ID NO: 3956036 - RNA, 22 nt, Staphylococcus aureus subsp. aureus Mu50
acauaaucauuguguauuguuu

SEQ ID NO: 3956037 - RNA, 12 nt, Staphylococcus aureus subsp. aureus Mu50
acauaaugacau

SEQ ID NO: 3956038 - RNA, 20 nt, Staphylococcus aureus subsp. aureus Mu50
acauaauuaacuuucuuuug

SEQ ID NO: 3956039 - RNA, 20 nt, Staphylococcus aureus subsp. aureus Mu50
acauaauuaccuuuccauuc

SEQ ID NO: 3956040 - RNA, 12 nt, Staphylococcus aureus subsp. aureus Mu50
acauaauucaau

SEQ ID NO: 3956041 - RNA, 16 nt, Staphylococcus aureus subsp. aureus Mu50
acauaauuuaucaauu

SEQ ID NO: 3956042 - RNA, 20 nt, Staphylococcus aureus subsp. aureus Mu50
acauaauuuaucaauuucua

SEQ ID NO: 3956043 - RNA, 16 nt, Staphylococcus aureus subsp. aureus Mu50
acauaauuuaucugca

SEQ ID NO: 3956044 - RNA, 18 nt, Staphylococcus aureus subsp. aureus Mu50
acauaauuuuuauuuaca

SEQ ID NO: 3956045 - RNA, 12 nt, Staphylococcus aureus subsp. aureus Mu50
acauacagucaa

SEQ ID NO: 3956046 - RNA, 16 nt, Staphylococcus aureus subsp. aureus Mu50
acauacagucaauaca

SEQ ID NO: 3956047 - RNA, 15 nt, Staphylococcus aureus subsp. aureus Mu50
acauacauuuugaaa

SEQ ID NO: 3956048 - RNA, 19 nt, Staphylococcus aureus subsp. aureus Mu50
acauaccacacuuuaaaca

SEQ ID NO: 3956049 - RNA, 21 nt, Staphylococcus aureus subsp. aureus Mu50
acauaccacacuuuaaacaag

SEQ ID NO: 3956050 - RNA, 14 nt, Staphylococcus aureus subsp. aureus Mu50
acauacguuauuuu

SEQ ID NO: 3956051 - RNA, 16 nt, Staphylococcus aureus subsp. aureus Mu50
acauacuauaaaaauu

SEQ ID NO: 3956052 - RNA, 14 nt, Staphylococcus aureus subsp. aureus Mu50
acauacugauuaaa

SEQ ID NO: 3956053 - RNA, 15 nt, Staphylococcus aureus subsp. aureus Mu50
acauacugauuaaac

SEQ ID NO: 3956054 - RNA, 17 nt, Staphylococcus aureus subsp. aureus Mu50
acauagacacuuaacuu

SEQ ID NO: 3956055 - RNA, 20 nt, Staphylococcus aureus subsp. aureus Mu50
acauagcuuaauaauuaaua

SEQ ID NO: 3956056 - RNA, 19 nt, Staphylococcus aureus subsp. aureus Mu50
acauagguauaaucauuua

SEQ ID NO: 3956057 - RNA, 18 nt, Staphylococcus aureus subsp. aureus Mu50
acauauaaaaaauuauua

SEQ ID NO: 3956058 - RNA, 19 nt, Staphylococcus aureus subsp. aureus Mu50
acauauaaaaaauuauuaa

SEQ ID NO: 3956059 - RNA, 12 nt, Staphylococcus aureus subsp. aureus Mu50
acauauaaauca

SEQ ID NO: 3956060 - RNA, 13 nt, Staphylococcus aureus subsp. aureus Mu50
acauauaauaugu

SEQ ID NO: 3956061 - RNA, 15 nt, Staphylococcus aureus subsp. aureus Mu50
acauaugacuuuauu

SEQ ID NO: 3956062 - RNA, 14 nt, Staphylococcus aureus subsp. aureus Mu50
acauaugcagugac

SEQ ID NO: 3956063 - RNA, 19 nt, Staphylococcus aureus subsp. aureus Mu50
acauauguguaugauagaa

SEQ ID NO: 3956064 - RNA, 14 nt, Staphylococcus aureus subsp. aureus Mu50
acauauucauaaua

SEQ ID NO: 3956065 - RNA, 17 nt, Staphylococcus aureus subsp. aureus Mu50
acauauucauaauaucg

SEQ ID NO: 3956066 - RNA, 19 nt, Staphylococcus aureus subsp. aureus Mu50
acauauuuauacugaucaa

SEQ ID NO: 3956067 - RNA, 17 nt, Staphylococcus aureus subsp. aureus Mu50
acauauuuuaacuauga

SEQ ID NO: 3956068 - RNA, 18 nt, Staphylococcus aureus subsp. aureus Mu50
acauauuuuaacuaugaa

SEQ ID NO: 3956069 - RNA, 12 nt, Staphylococcus aureus subsp. aureus Mu50
acauauuuucac

SEQ ID NO: 3956070 - RNA, 15 nt, Staphylococcus aureus subsp. aureus Mu50
acauauuuucacaau

SEQ ID NO: 3956071 - RNA, 15 nt, Staphylococcus aureus subsp. aureus Mu50
acauauuuuuuaaau

SEQ ID NO: 3956072 - RNA, 18 nt, Staphylococcus aureus subsp. aureus Mu50
acaucaaauagacaccaa

SEQ ID NO: 3956073 - RNA, 14 nt, Staphylococcus aureus subsp. aureus Mu50
acaucaaauuuuuc

SEQ ID NO: 3956074 - RNA, 20 nt, Staphylococcus aureus subsp. aureus Mu50
acaucaaauuuuucgacauc

SEQ ID NO: 3956075 - RNA, 13 nt, Staphylococcus aureus subsp. aureus Mu50
acaucaauaucuu

SEQ ID NO: 3956076 - RNA, 14 nt, Staphylococcus aureus subsp. aureus Mu50
acaucaauaucuuc

SEQ ID NO: 3956077 - RNA, 15 nt, Staphylococcus aureus subsp. aureus Mu50
acaucaauaucuucu

SEQ ID NO: 3956078 - RNA, 14 nt, Staphylococcus aureus subsp. aureus Mu50
acaucaauuacucu

SEQ ID NO: 3956079 - RNA, 21 nt, Staphylococcus aureus subsp. aureus Mu50
acaucacuauacgcaaucauu

SEQ ID NO: 3956080 - RNA, 17 nt, Staphylococcus aureus subsp. aureus Mu50
acaucagauauaaguag

SEQ ID NO: 3956081 - RNA, 15 nt, Staphylococcus aureus subsp. aureus Mu50
acaucauaauaaauc

SEQ ID NO: 3956082 - RNA, 21 nt, Staphylococcus aureus subsp. aureus Mu50
acaucauaauaaaucuaucua

SEQ ID NO: 3956083 - RNA, 13 nt, Staphylococcus aureus subsp. aureus Mu50
acaucaucaaguu

SEQ ID NO: 3956084 - RNA, 19 nt, Staphylococcus aureus subsp. aureus Mu50
acaucaucuauaauaccua

SEQ ID NO: 3956085 - RNA, 15 nt, Staphylococcus aureus subsp. aureus Mu50
acaucaucuuuaauu

SEQ ID NO: 3956086 - RNA, 23 nt, Staphylococcus aureus subsp. aureus Mu50
acaucaugugucuuccaaucaac

SEQ ID NO: 3956087 - RNA, 14 nt, Staphylococcus aureus subsp. aureus Mu50
acaucauuaaauau

SEQ ID NO: 3956088 - RNA, 15 nt, Staphylococcus aureus subsp. aureus Mu50
acaucauuaaauauu

SEQ ID NO: 3956089 - RNA, 16 nt, Staphylococcus aureus subsp. aureus Mu50
acaucauuaaauauuu

SEQ ID NO: 3956090 - RNA, 22 nt, Staphylococcus aureus subsp. aureus Mu50
acaucauugauagauagaaauu

SEQ ID NO: 3956091 - RNA, 16 nt, Staphylococcus aureus subsp. aureus Mu50
acaucauuucugaagu

SEQ ID NO: 3956092 - RNA, 17 nt, Staphylococcus aureus subsp. aureus Mu50
acauccacuuuauaauu

SEQ ID NO: 3956093 - RNA, 19 nt, Staphylococcus aureus subsp. aureus Mu50
acauccucauaauuaucau

SEQ ID NO: 3956094 - RNA, 20 nt, Staphylococcus aureus subsp. aureus Mu50
acauccucauaauuaucaua

SEQ ID NO: 3956095 - RNA, 22 nt, Staphylococcus aureus subsp. aureus Mu50
acauccucauaauuaucauaua

SEQ ID NO: 3956096 - RNA, 19 nt, Staphylococcus aureus subsp. aureus Mu50
acaucgcauaauaucuuac

SEQ ID NO: 3956097 - RNA, 22 nt, Staphylococcus aureus subsp. aureus Mu50
acaucgccaauuugauuaguaa

SEQ ID NO: 3956098 - RNA, 14 nt, Staphylococcus aureus subsp. aureus Mu50
acaucggaauucaa

SEQ ID NO: 3956099 - RNA, 14 nt, Staphylococcus aureus subsp. aureus Mu50
acaucuaauaaaua

SEQ ID NO: 3956100 - RNA, 18 nt, Staphylococcus aureus subsp. aureus Mu50
acaucuacaucaaauuuu

SEQ ID NO: 3956101 - RNA, 21 nt, Staphylococcus aureus subsp. aureus Mu50
acaucuauguggcuacuugaa

SEQ ID NO: 3956102 - RNA, 13 nt, Staphylococcus aureus subsp. aureus Mu50
acaucugaaaaaa

SEQ ID NO: 3956103 - RNA, 14 nt, Staphylococcus aureus subsp. aureus Mu50
acaucugaaaaaau

SEQ ID NO: 3956104 - RNA, 14 nt, Staphylococcus aureus subsp. aureus Mu50
acaucuucauguau

SEQ ID NO: 3956105 - RNA, 17 nt, Staphylococcus aureus subsp. aureus Mu50
acaucuucauguaugaa

SEQ ID NO: 3956106 - RNA, 13 nt, Staphylococcus aureus subsp. aureus Mu50
acaucuuuuuaaa

SEQ ID NO: 3956107 - RNA, 13 nt, Staphylococcus aureus subsp. aureus Mu50
acaucuuuuugau

SEQ ID NO: 3956108 - RNA, 14 nt, Staphylococcus aureus subsp. aureus Mu50
acaugaacaaucag

SEQ ID NO: 3956109 - RNA, 18 nt, Staphylococcus aureus subsp. aureus Mu50
acaugaaugauauugauu

SEQ ID NO: 3956110 - RNA, 16 nt, Staphylococcus aureus subsp. aureus Mu50
acaugaauuuuaauau

SEQ ID NO: 3956111 - RNA, 14 nt, Staphylococcus aureus subsp. aureus Mu50
acaugacauucauu

SEQ ID NO: 3956112 - RNA, 16 nt, Staphylococcus aureus subsp. aureus Mu50
acaugacauucauuua

SEQ ID NO: 3956113 - RNA, 22 nt, Staphylococcus aureus subsp. aureus Mu50
acaugacauucauuuaguuaaa

SEQ ID NO: 3956114 - RNA, 11 nt, Staphylococcus aureus subsp. aureus Mu50
acaugagauua

SEQ ID NO: 3956115 - RNA, 22 nt, Staphylococcus aureus subsp. aureus Mu50
acaugagauuauuuuuuuaaau

SEQ ID NO: 3956116 - RNA, 19 nt, Staphylococcus aureus subsp. aureus Mu50
acaugauucaugauauguu

SEQ ID NO: 3956117 - RNA, 19 nt, Staphylococcus aureus subsp. aureus Mu50
acaugcacuuuauuaaaaa

SEQ ID NO: 3956118 - RNA, 14 nt, Staphylococcus aureus subsp. aureus Mu50
acaugccaauggaa

SEQ ID NO: 3956119 - RNA, 19 nt, Staphylococcus aureus subsp. aureus Mu50
acaugcuuggacauauacu

SEQ ID NO: 3956120 - RNA, 15 nt, Staphylococcus aureus subsp. aureus Mu50
acauggucaaucacu

SEQ ID NO: 3956121 - RNA, 13 nt, Staphylococcus aureus subsp. aureus Mu50
acauguacaauuu

SEQ ID NO: 3956122 - RNA, 13 nt, Staphylococcus aureus subsp. aureus Mu50
acauguacauuau

SEQ ID NO: 3956123 - RNA, 20 nt, Staphylococcus aureus subsp. aureus Mu50
acauguacguuuuuuuaaau

SEQ ID NO: 3956124 - RNA, 21 nt, Staphylococcus aureus subsp. aureus Mu50
acauguacguuuuuuuaaaua

SEQ ID NO: 3956125 - RNA, 18 nt, Staphylococcus aureus subsp. aureus Mu50
acauguauuggccaaaca

SEQ ID NO: 3956126 - RNA, 20 nt, Staphylococcus aureus subsp. aureus Mu50
acauguauuggccaaacaac

SEQ ID NO: 3956127 - RNA, 22 nt, Staphylococcus aureus subsp. aureus Mu50
acauguauuuaguaucaugaua

SEQ ID NO: 3956128 - RNA, 12 nt, Staphylococcus aureus subsp. aureus Mu50
acaugugaaaua

SEQ ID NO: 3956129 - RNA, 20 nt, Staphylococcus aureus subsp. aureus Mu50
acauguuacugaugaacaua

SEQ ID NO: 3956130 - RNA, 16 nt, Staphylococcus aureus subsp. aureus Mu50
acauguuccgcuacaa

SEQ ID NO: 3956131 - RNA, 20 nt, Staphylococcus aureus subsp. aureus Mu50
acauguuuggaugaacaaaa

SEQ ID NO: 3956132 - RNA, 19 nt, Staphylococcus aureus subsp. aureus Mu50
acauuaaaacaauaauuua

SEQ ID NO: 3956133 - RNA, 15 nt, Staphylococcus aureus subsp. aureus Mu50
acauuaaaaugauau

SEQ ID NO: 3956134 - RNA, 16 nt, Staphylococcus aureus subsp. aureus Mu50
acauuaaaauguguuu

SEQ ID NO: 3956135 - RNA, 23 nt, Staphylococcus aureus subsp. aureus Mu50
acauuaaagaaaauaucugaaaa

SEQ ID NO: 3956136 - RNA, 12 nt, Staphylococcus aureus subsp. aureus Mu50
acauuaaauuau

SEQ ID NO: 3956137 - RNA, 14 nt, Staphylococcus aureus subsp. aureus Mu50
acauuaaguuaaac

SEQ ID NO: 3956138 - RNA, 19 nt, Staphylococcus aureus subsp. aureus Mu50
acauuaaugauagcaauga

SEQ ID NO: 3956139 - RNA, 16 nt, Staphylococcus aureus subsp. aureus Mu50
acauuagcaugauaaa

SEQ ID NO: 3956140 - RNA, 17 nt, Staphylococcus aureus subsp. aureus Mu50
acauuagcaugauaaag

SEQ ID NO: 3956141 - RNA, 16 nt, Staphylococcus aureus subsp. aureus Mu50
acauuagcauuaaauu

SEQ ID NO: 3956142 - RNA, 21 nt, Staphylococcus aureus subsp. aureus Mu50
acauuauaauggacuaauuua

SEQ ID NO: 3956143 - RNA, 20 nt, Staphylococcus aureus subsp. aureus Mu50
acauuauguucuucaccagu

SEQ ID NO: 3956144 - RNA, 13 nt, Staphylococcus aureus subsp. aureus Mu50
acauuauuaaaua

SEQ ID NO: 3956145 - RNA, 22 nt, Staphylococcus aureus subsp. aureus Mu50
acauuauugaaauuuuuaauau

SEQ ID NO: 3956146 - RNA, 16 nt, Staphylococcus aureus subsp. aureus Mu50
acauuauuuauauuua

SEQ ID NO: 3956147 - RNA, 19 nt, Staphylococcus aureus subsp. aureus Mu50
acauuauuuauauuuagaa

SEQ ID NO: 3956148 - RNA, 14 nt, Staphylococcus aureus subsp. aureus Mu50
acauucaaauaaau

SEQ ID NO: 3956149 - RNA, 20 nt, Staphylococcus aureus subsp. aureus Mu50
acauucagugcaaugauagc

SEQ ID NO: 3956150 - RNA, 20 nt, Staphylococcus aureus subsp. aureus Mu50
acauucauaccgaagaaacu

SEQ ID NO: 3956151 - RNA, 22 nt, Staphylococcus aureus subsp. aureus Mu50
acauucauaccgaagaaacuaa

SEQ ID NO: 3956152 - RNA, 20 nt, Staphylococcus aureus subsp. aureus Mu50
acauucauuuaguuaaauac

SEQ ID NO: 3956153 - RNA, 21 nt, Staphylococcus aureus subsp. aureus Mu50
acauucauuuaguuaaauaca

SEQ ID NO: 3956154 - RNA, 13 nt, Staphylococcus aureus subsp. aureus Mu50
acauuccucuauu

SEQ ID NO: 3956155 - RNA, 16 nt, Staphylococcus aureus subsp. aureus Mu50
acauuccucuauugua

SEQ ID NO: 3956156 - RNA, 22 nt, Staphylococcus aureus subsp. aureus Mu50
acauucgagcuaggguuaaaau

SEQ ID NO: 3956157 - RNA, 12 nt, Staphylococcus aureus subsp. aureus Mu50
acauucuaugua

SEQ ID NO: 3956158 - RNA, 21 nt, Staphylococcus aureus subsp. aureus Mu50
acauucuuauuugaaaugaua

SEQ ID NO: 3956159 - RNA, 13 nt, Staphylococcus aureus subsp. aureus Mu50
acauucuucaaaa

SEQ ID NO: 3956160 - RNA, 14 nt, Staphylococcus aureus subsp. aureus Mu50
acauucuucaaaaa

SEQ ID NO: 3956161 - RNA, 16 nt, Staphylococcus aureus subsp. aureus Mu50
acauucuucaaaaaau

SEQ ID NO: 3956162 - RNA, 18 nt, Staphylococcus aureus subsp. aureus Mu50
acauucuugaauaaauuu

SEQ ID NO: 3956163 - RNA, 21 nt, Staphylococcus aureus subsp. aureus Mu50
acauucuugaauaaauuuuau

SEQ ID NO: 3956164 - RNA, 21 nt, Staphylococcus aureus subsp. aureus Mu50
acauugaacgauaacaauuua

SEQ ID NO: 3956165 - RNA, 16 nt, Staphylococcus aureus subsp. aureus Mu50
acauugaauaaaugaa

SEQ ID NO: 3956166 - RNA, 18 nt, Staphylococcus aureus subsp. aureus Mu50
acauugagauuaucuuua

SEQ ID NO: 3956167 - RNA, 16 nt, Staphylococcus aureus subsp. aureus Mu50
acauugauaaaauaau

SEQ ID NO: 3956168 - RNA, 19 nt, Staphylococcus aureus subsp. aureus Mu50
acauugccacuuuuguguu

SEQ ID NO: 3956169 - RNA, 15 nt, Staphylococcus aureus subsp. aureus Mu50
acauugguuuuuacu

SEQ ID NO: 3956170 - RNA, 16 nt, Staphylococcus aureus subsp. aureus Mu50
acauugguuuuuacua

SEQ ID NO: 3956171 - RNA, 15 nt, Staphylococcus aureus subsp. aureus Mu50
acauuguaaaaugcu

SEQ ID NO: 3956172 - RNA, 22 nt, Staphylococcus aureus subsp. aureus Mu50
acauuguaaaaugcucccuuca

SEQ ID NO: 3956173 - RNA, 15 nt, Staphylococcus aureus subsp. aureus Mu50
acauugugaaaguuu

SEQ ID NO: 3956174 - RNA, 22 nt, Staphylococcus aureus subsp. aureus Mu50
acauugugaaaguuuuugucuu

SEQ ID NO: 3956175 - RNA, 12 nt, Staphylococcus aureus subsp. aureus Mu50
acauuuaaaaaa

SEQ ID NO: 3956176 - RNA, 14 nt, Staphylococcus aureus subsp. aureus Mu50
acauuuaagaaacg

SEQ ID NO: 3956177 - RNA, 22 nt, Staphylococcus aureus subsp. aureus Mu50
acauuuaagaaacgucuuaauu

SEQ ID NO: 3956178 - RNA, 14 nt, Staphylococcus aureus subsp. aureus Mu50
acauuuaauacuuu

SEQ ID NO: 3956179 - RNA, 17 nt, Staphylococcus aureus subsp. aureus Mu50
acauuuauucuuucucu

SEQ ID NO: 3956180 - RNA, 20 nt, Staphylococcus aureus subsp. aureus Mu50
acauuuauucuuucucuauu

SEQ ID NO: 3956181 - RNA, 21 nt, Staphylococcus aureus subsp. aureus Mu50
acauuuauucuuucucuauua

SEQ ID NO: 3956182 - RNA, 14 nt, Staphylococcus aureus subsp. aureus Mu50
acauuuauuuucaa

SEQ ID NO: 3956183 - RNA, 21 nt, Staphylococcus aureus subsp. aureus Mu50
acauuuauuuucaauaaauaa

SEQ ID NO: 3956184 - RNA, 17 nt, Staphylococcus aureus subsp. aureus Mu50
acauuucagcauuugcu

SEQ ID NO: 3956185 - RNA, 22 nt, Staphylococcus aureus subsp. aureus Mu50
acauuucgguaugauauuucua

SEQ ID NO: 3956186 - RNA, 16 nt, Staphylococcus aureus subsp. aureus Mu50
accauuccaaaaauug

SEQ ID NO: 3956187 - RNA, 18 nt, Staphylococcus aureus subsp. aureus Mu50
accauuccaaaaauugua

SEQ ID NO: 3956188 - RNA, 20 nt, Staphylococcus aureus subsp. aureus Mu50
accauucuaccaguugauuu

SEQ ID NO: 3956189 - RNA, 19 nt, Staphylococcus aureus subsp. aureus Mu50
accauugcacaguuucauc

SEQ ID NO: 3956190 - RNA, 21 nt, Staphylococcus aureus subsp. aureus Mu50
accauugcacaguuucaucuu

SEQ ID NO: 3956191 - RNA, 16 nt, Staphylococcus aureus subsp. aureus Mu50
accauuguauuauccu

SEQ ID NO: 3956192 - RNA, 21 nt, Staphylococcus aureus subsp. aureus Mu50
accauugugaauaauuucagu

SEQ ID NO: 3956193 - RNA, 14 nt, Staphylococcus aureus subsp. aureus Mu50
accauuuaaaaauu

SEQ ID NO: 3956194 - RNA, 11 nt, Staphylococcus aureus subsp. aureus Mu50
accauuuacuu

SEQ ID NO: 3956195 - RNA, 21 nt, Staphylococcus aureus subsp. aureus Mu50
accauuucguguuccaauuuu

SEQ ID NO: 3956196 - RNA, 21 nt, Staphylococcus aureus subsp. aureus Mu50
accauuugcuggcgcaaugau

SEQ ID NO: 3956197 - RNA, 16 nt, Staphylococcus aureus subsp. aureus Mu50
accauuuuauauuuua

SEQ ID NO: 3956198 - RNA, 13 nt, Staphylococcus aureus subsp. aureus Mu50
acccaaaaaauug

SEQ ID NO: 3956199 - RNA, 12 nt, Staphylococcus aureus subsp. aureus Mu50
acccaaauuaua

SEQ ID NO: 3956200 - RNA, 20 nt, Staphylococcus aureus subsp. aureus Mu50
acccaaguccggcugaaggg

SEQ ID NO: 3956201 - RNA, 21 nt, Staphylococcus aureus subsp. aureus Mu50
acccacacagguaaauuuaaa

SEQ ID NO: 3956202 - RNA, 21 nt, Staphylococcus aureus subsp. aureus Mu50
acccacauuaaauauuauuuu

SEQ ID NO: 3956203 - RNA, 12 nt, Staphylococcus aureus subsp. aureus Mu50
acccaccacauu

SEQ ID NO: 3956204 - RNA, 15 nt, Staphylococcus aureus subsp. aureus Mu50
acccaccacauuugg

SEQ ID NO: 3956205 - RNA, 16 nt, Staphylococcus aureus subsp. aureus Mu50
acccauaauuuaaaug

SEQ ID NO: 3956206 - RNA, 18 nt, Staphylococcus aureus subsp. aureus Mu50
acccauaauuuaaaugau

SEQ ID NO: 3956207 - RNA, 15 nt, Staphylococcus aureus subsp. aureus Mu50
acccauauaauuugg

SEQ ID NO: 3956208 - RNA, 13 nt, Staphylococcus aureus subsp. aureus Mu50
acccauauuaaau

SEQ ID NO: 3956209 - RNA, 21 nt, Staphylococcus aureus subsp. aureus Mu50
acccaucauguacaguuacuu

SEQ ID NO: 3956210 - RNA, 16 nt, Staphylococcus aureus subsp. aureus Mu50
acccauggauucugau

SEQ ID NO: 3956211 - RNA, 23 nt, Staphylococcus aureus subsp. aureus Mu50
acccauuuuuuuccaagcaucau

SEQ ID NO: 3956212 - RNA, 20 nt, Staphylococcus aureus subsp. aureus Mu50
accccaacuugcacauuauc

SEQ ID NO: 3956213 - RNA, 13 nt, Staphylococcus aureus subsp. aureus Mu50
accccuuuauuuu

SEQ ID NO: 3956214 - RNA, 23 nt, Staphylococcus aureus subsp. aureus Mu50
acccuaauuuguuaguuuaaguc

SEQ ID NO: 3956215 - RNA, 13 nt, Staphylococcus aureus subsp. aureus Mu50
acccucauuuuua

SEQ ID NO: 3956216 - RNA, 21 nt, Staphylococcus aureus subsp. aureus Mu50
acccucauuuuuauaaauuuu

SEQ ID NO: 3956217 - RNA, 20 nt, Staphylococcus aureus subsp. aureus Mu50
acccuugucaguuuuuuuau

SEQ ID NO: 3956218 - RNA, 13 nt, Staphylococcus aureus subsp. aureus Mu50
acccuuuaaacau

SEQ ID NO: 3956219 - RNA, 18 nt, Staphylococcus aureus subsp. aureus Mu50
acccuuuaaauuuaacuc

SEQ ID NO: 3956220 - RNA, 16 nt, Staphylococcus aureus subsp. aureus Mu50
accgaauaauuuugau

SEQ ID NO: 3956221 - RNA, 16 nt, Staphylococcus aureus subsp. aureus Mu50
accgaguauugcugca

SEQ ID NO: 3956222 - RNA, 17 nt, Staphylococcus aureus subsp. aureus Mu50
accgcacuucuauauua

SEQ ID NO: 3956223 - RNA, 23 nt, Staphylococcus aureus subsp. aureus Mu50
accgcacuucuauauuaauagaa

SEQ ID NO: 3956224 - RNA, 19 nt, Staphylococcus aureus subsp. aureus Mu50
accgccaacuaauguuaaa

SEQ ID NO: 3956225 - RNA, 16 nt, Staphylococcus aureus subsp. aureus Mu50
accgcuuaauucuuca

SEQ ID NO: 3956226 - RNA, 19 nt, Staphylococcus aureus subsp. aureus Mu50
accgcuucucgccuaauua

SEQ ID NO: 3956227 - RNA, 16 nt, Staphylococcus aureus subsp. aureus Mu50
accggcauauaaucca

SEQ ID NO: 3956228 - RNA, 16 nt, Staphylococcus aureus subsp. aureus Mu50
accguaacauauguac

SEQ ID NO: 3956229 - RNA, 19 nt, Staphylococcus aureus subsp. aureus Mu50
accguaacuauaugaaaug

SEQ ID NO: 3956230 - RNA, 14 nt, Staphylococcus aureus subsp. aureus Mu50
accguaaucuuuua

SEQ ID NO: 3956231 - RNA, 22 nt, Staphylococcus aureus subsp. aureus Mu50
accguauuauuggauuugaagu

SEQ ID NO: 3956232 - RNA, 15 nt, Staphylococcus aureus subsp. aureus Mu50
accgucacaaaccau

SEQ ID NO: 3956233 - RNA, 17 nt, Staphylococcus aureus subsp. aureus Mu50
accgugguucaaaaauc

SEQ ID NO: 3956234 - RNA, 19 nt, Staphylococcus aureus subsp. aureus Mu50
accguguuguugaauaauu

SEQ ID NO: 3956235 - RNA, 13 nt, Staphylococcus aureus subsp. aureus Mu50
accguuaaaauau

SEQ ID NO: 3956236 - RNA, 20 nt, Staphylococcus aureus subsp. aureus Mu50
accguuuuuuauaaaucauu

SEQ ID NO: 3956237 - RNA, 18 nt, Staphylococcus aureus subsp. aureus Mu50
accuaaaauacccauuuu

SEQ ID NO: 3956238 - RNA, 20 nt, Staphylococcus aureus subsp. aureus Mu50
accuaaagauaauauuaaau

SEQ ID NO: 3956239 - RNA, 18 nt, Staphylococcus aureus subsp. aureus Mu50
accuaaaugauuaauaac

SEQ ID NO: 3956240 - RNA, 18 nt, Staphylococcus aureus subsp. aureus Mu50
accuaagcaagauaauag

SEQ ID NO: 3956241 - RNA, 16 nt, Staphylococcus aureus subsp. aureus Mu50
accuaaggcuaaugau

SEQ ID NO: 3956242 - RNA, 16 nt, Staphylococcus aureus subsp. aureus Mu50
accuaaguuaauuuau

SEQ ID NO: 3956243 - RNA, 22 nt, Staphylococcus aureus subsp. aureus Mu50
accuaaguuaauuuaucguuua

SEQ ID NO: 3956244 - RNA, 17 nt, Staphylococcus aureus subsp. aureus Mu50
accuaauucaauaccua

SEQ ID NO: 3956245 - RNA, 18 nt, Staphylococcus aureus subsp. aureus Mu50
accuaauucauauauacu

SEQ ID NO: 3956246 - RNA, 18 nt, Staphylococcus aureus subsp. aureus Mu50
accuaauucgccaucuuu

SEQ ID NO: 3956247 - RNA, 20 nt, Staphylococcus aureus subsp. aureus Mu50
accuaauucgccaucuuuuu

SEQ ID NO: 3956248 - RNA, 22 nt, Staphylococcus aureus subsp. aureus Mu50
accuaauugaaggccauuuuua

SEQ ID NO: 3956249 - RNA, 22 nt, Staphylococcus aureus subsp. aureus Mu50
accuaauuguuaagagguuuug

SEQ ID NO: 3956250 - RNA, 12 nt, Staphylococcus aureus subsp. aureus Mu50
accuacaaauau

SEQ ID NO: 3956251 - RNA, 14 nt, Staphylococcus aureus subsp. aureus Mu50
accuacaaauauuu

SEQ ID NO: 3956252 - RNA, 14 nt, Staphylococcus aureus subsp. aureus Mu50
accuacaacaccaa

SEQ ID NO: 3956253 - RNA, 19 nt, Staphylococcus aureus subsp. aureus Mu50
accuacaacaccaauugaa

SEQ ID NO: 3956254 - RNA, 20 nt, Staphylococcus aureus subsp. aureus Mu50
accuacaacgaagaauccua

SEQ ID NO: 3956255 - RNA, 21 nt, Staphylococcus aureus subsp. aureus Mu50
accuacacgaccaagacgaac

SEQ ID NO: 3956256 - RNA, 16 nt, Staphylococcus aureus subsp. aureus Mu50
accuacacggucccaa

SEQ ID NO: 3956257 - RNA, 15 nt, Staphylococcus aureus subsp. aureus Mu50
accuacagauaaagc

SEQ ID NO: 3956258 - RNA, 21 nt, Staphylococcus aureus subsp. aureus Mu50
accuacgauucgaaauaggua

SEQ ID NO: 3956259 - RNA, 19 nt, Staphylococcus aureus subsp. aureus Mu50
accuacuaauauauuaauu

SEQ ID NO: 3956260 - RNA, 17 nt, Staphylococcus aureus subsp. aureus Mu50
accuacuuuuucaauau

SEQ ID NO: 3956261 - RNA, 19 nt, Staphylococcus aureus subsp. aureus Mu50
accuagggauaauuuuauu

SEQ ID NO: 3956262 - RNA, 13 nt, Staphylococcus aureus subsp. aureus Mu50
accuauaccucgu

SEQ ID NO: 3956263 - RNA, 18 nt, Staphylococcus aureus subsp. aureus Mu50
accuaugauauaugcugc

SEQ ID NO: 3956264 - RNA, 16 nt, Staphylococcus aureus subsp. aureus Mu50
accuauuaauaucaua

SEQ ID NO: 3956265 - RNA, 20 nt, Staphylococcus aureus subsp. aureus Mu50
accuauucccaaaaugauug

SEQ ID NO: 3956266 - RNA, 17 nt, Staphylococcus aureus subsp. aureus Mu50
accuauuccuaauaaau

SEQ ID NO: 3956267 - RNA, 12 nt, Staphylococcus aureus subsp. aureus Mu50
accuauuguauu

SEQ ID NO: 3956268 - RNA, 17 nt, Staphylococcus aureus subsp. aureus Mu50
accuauuuuuugagcac

SEQ ID NO: 3956269 - RNA, 15 nt, Staphylococcus aureus subsp. aureus Mu50
accucuaaauaaaau

SEQ ID NO: 3956270 - RNA, 23 nt, Staphylococcus aureus subsp. aureus Mu50
accucuaaguucaccuaaaugau

SEQ ID NO: 3956271 - RNA, 16 nt, Staphylococcus aureus subsp. aureus Mu50
accucuacauuauauu

SEQ ID NO: 3956272 - RNA, 12 nt, Staphylococcus aureus subsp. aureus Mu50
accucuuuuguu

SEQ ID NO: 3956273 - RNA, 16 nt, Staphylococcus aureus subsp. aureus Mu50
acguaucauuuaaaau

SEQ ID NO: 3956274 - RNA, 14 nt, Staphylococcus aureus subsp. aureus Mu50
acgucaacagcaua

SEQ ID NO: 3956275 - RNA, 19 nt, Staphylococcus aureus subsp. aureus Mu50
acgucacuuuauuaaauaa

SEQ ID NO: 3956276 - RNA, 22 nt, Staphylococcus aureus subsp. aureus Mu50
acgucauacuaucuacaauaac

SEQ ID NO: 3956277 - RNA, 23 nt, Staphylococcus aureus subsp. aureus Mu50
acgucauauguuuuauaauaaau

SEQ ID NO: 3956278 - RNA, 20 nt, Staphylococcus aureus subsp. aureus Mu50
acgucgaauguuucuucguu

SEQ ID NO: 3956279 - RNA, 21 nt, Staphylococcus aureus subsp. aureus Mu50
acgucuuuccauuuaucaaca

SEQ ID NO: 3956280 - RNA, 22 nt, Staphylococcus aureus subsp. aureus Mu50
acgugacauuuucaaguuuaaa

SEQ ID NO: 3956281 - RNA, 19 nt, Staphylococcus aureus subsp. aureus Mu50
acgugauaaugacucaagu

SEQ ID NO: 3956282 - RNA, 18 nt, Staphylococcus aureus subsp. aureus Mu50
acgugcauuguaauacca

SEQ ID NO: 3956283 - RNA, 19 nt, Staphylococcus aureus subsp. aureus Mu50
acgugcugccuuuuugcuu

SEQ ID NO: 3956284 - RNA, 13 nt, Staphylococcus aureus subsp. aureus Mu50
acgugcuuuaaag

SEQ ID NO: 3956285 - RNA, 15 nt, Staphylococcus aureus subsp. aureus Mu50
acguggucuacuucg

SEQ ID NO: 3956286 - RNA, 18 nt, Staphylococcus aureus subsp. aureus Mu50
acgugguugguuaccauc

SEQ ID NO: 3956287 - RNA, 16 nt, Staphylococcus aureus subsp. aureus Mu50
acguguaaauguuaaa

SEQ ID NO: 3956288 - RNA, 18 nt, Staphylococcus aureus subsp. aureus Mu50
acguguauuguauuuuaa

SEQ ID NO: 3956289 - RNA, 21 nt, Staphylococcus aureus subsp. aureus Mu50
acguguguuuucuuuucaaaa

SEQ ID NO: 3956290 - RNA, 18 nt, Staphylococcus aureus subsp. aureus Mu50
acguuauucguuaacaau

SEQ ID NO: 3956291 - RNA, 14 nt, Staphylococcus aureus subsp. aureus Mu50
acguucauggauuc

SEQ ID NO: 3956292 - RNA, 19 nt, Staphylococcus aureus subsp. aureus Mu50
acguucuugguauuuuuua

SEQ ID NO: 3956293 - RNA, 22 nt, Staphylococcus aureus subsp. aureus Mu50
acguucuugguauuuuuuaaau

SEQ ID NO: 3956294 - RNA, 23 nt, Staphylococcus aureus subsp. aureus Mu50
acguucuugguauuuuuuaaaug

SEQ ID NO: 3956295 - RNA, 24 nt, Staphylococcus aureus subsp. aureus Mu50
acguugaguauuacuugaaaauag

SEQ ID NO: 3956296 - RNA, 16 nt, Staphylococcus aureus subsp. aureus Mu50
acguugauuaacacau

SEQ ID NO: 3956297 - RNA, 21 nt, Staphylococcus aureus subsp. aureus Mu50
acguuuaauaccuaugauaua

SEQ ID NO: 3956298 - RNA, 15 nt, Staphylococcus aureus subsp. aureus Mu50
acguuuccaaucuau

SEQ ID NO: 3956299 - RNA, 17 nt, Staphylococcus aureus subsp. aureus Mu50
acguuucguugcugaua

SEQ ID NO: 3956300 - RNA, 22 nt, Staphylococcus aureus subsp. aureus Mu50
acguuucguugcugauacccaa

SEQ ID NO: 3956301 - RNA, 17 nt, Staphylococcus aureus subsp. aureus Mu50
acguuugcaugaggaua

SEQ ID NO: 3956302 - RNA, 20 nt, Staphylococcus aureus subsp. aureus Mu50
acguuuuaaagguuaaauau

SEQ ID NO: 3956303 - RNA, 12 nt, Staphylococcus aureus subsp. aureus Mu50
acguuuuaaaua

SEQ ID NO: 3956304 - RNA, 13 nt, Staphylococcus aureus subsp. aureus Mu50
acguuuuaaauaa

SEQ ID NO: 3956305 - RNA, 17 nt, Staphylococcus aureus subsp. aureus Mu50
acguuuuagacauaaaa

SEQ ID NO: 3956306 - RNA, 17 nt, Staphylococcus aureus subsp. aureus Mu50
acguuuucacuucgcca

SEQ ID NO: 3956307 - RNA, 17 nt, Staphylococcus aureus subsp. aureus Mu50
acguuuuccaugaguuu

SEQ ID NO: 3956308 - RNA, 21 nt, Staphylococcus aureus subsp. aureus Mu50
acguuuuucuuuaaacgcauc

SEQ ID NO: 3956309 - RNA, 15 nt, Staphylococcus aureus subsp. aureus Mu50
acguuuuugaaucag

SEQ ID NO: 3956310 - RNA, 20 nt, Staphylococcus aureus subsp. aureus Mu50
acuaaaacaugauacguggu

SEQ ID NO: 3956311 - RNA, 18 nt, Staphylococcus aureus subsp. aureus Mu50
acuaaaacgauaauaaua

SEQ ID NO: 3956312 - RNA, 19 nt, Staphylococcus aureus subsp. aureus Mu50
acuaaaacgauaauaauaa

SEQ ID NO: 3956313 - RNA, 14 nt, Staphylococcus aureus subsp. aureus Mu50
acuaaaaguguuau

SEQ ID NO: 3956314 - RNA, 19 nt, Staphylococcus aureus subsp. aureus Mu50
acuaaaaguguuaugaauu

SEQ ID NO: 3956315 - RNA, 13 nt, Staphylococcus aureus subsp. aureus Mu50
acuaaaaucacuu

SEQ ID NO: 3956316 - RNA, 14 nt, Staphylococcus aureus subsp. aureus Mu50
acuaaacauugcuu

SEQ ID NO: 3956317 - RNA, 21 nt, Staphylococcus aureus subsp. aureus Mu50
acuaaaccgauuaauauaaua

SEQ ID NO: 3956318 - RNA, 13 nt, Staphylococcus aureus subsp. aureus Mu50
acuaaacgauaaa

SEQ ID NO: 3956319 - RNA, 16 nt, Staphylococcus aureus subsp. aureus Mu50
acuaaacgauaaauua

SEQ ID NO: 3956320 - RNA, 21 nt, Staphylococcus aureus subsp. aureus Mu50
acuaaacgauaaauuaacuua

SEQ ID NO: 3956321 - RNA, 14 nt, Staphylococcus aureus subsp. aureus Mu50
acuaaacuuuucuu

SEQ ID NO: 3956322 - RNA, 18 nt, Staphylococcus aureus subsp. aureus Mu50
acuaaagguauucuauuu

SEQ ID NO: 3956323 - RNA, 14 nt, Staphylococcus aureus subsp. aureus Mu50
acuaaauaugcuuu

SEQ ID NO: 3956324 - RNA, 13 nt, Staphylococcus aureus subsp. aureus Mu50
acuaaaucauuuu

SEQ ID NO: 3956325 - RNA, 22 nt, Staphylococcus aureus subsp. aureus Mu50
acuaaaugaauugcuuguucuu

SEQ ID NO: 3956326 - RNA, 17 nt, Staphylococcus aureus subsp. aureus Mu50
acuaaauguucuggaau

SEQ ID NO: 3956327 - RNA, 22 nt, Staphylococcus aureus subsp. aureus Mu50
acuaaauguucuggaauaccua

SEQ ID NO: 3956328 - RNA, 14 nt, Staphylococcus aureus subsp. aureus Mu50
acuaaauuaaaagu

SEQ ID NO: 3956329 - RNA, 18 nt, Staphylococcus aureus subsp. aureus Mu50
acuaacaaccguuuuaag

SEQ ID NO: 3956330 - RNA, 20 nt, Staphylococcus aureus subsp. aureus Mu50
acuaacauguuauugcuuau

SEQ ID NO: 3956331 - RNA, 22 nt, Staphylococcus aureus subsp. aureus Mu50
acuaacguaaaggugauauuug

SEQ ID NO: 3956332 - RNA, 14 nt, Staphylococcus aureus subsp. aureus Mu50
acuaacguuuuaaa

SEQ ID NO: 3956333 - RNA, 15 nt, Staphylococcus aureus subsp. aureus Mu50
acuaacugaagacac

SEQ ID NO: 3956334 - RNA, 21 nt, Staphylococcus aureus subsp. aureus Mu50
acuaagauaucuggauuaacu

SEQ ID NO: 3956335 - RNA, 19 nt, Staphylococcus aureus subsp. aureus Mu50
acuaagauuagcuaugaag

SEQ ID NO: 3956336 - RNA, 22 nt, Staphylococcus aureus subsp. aureus Mu50
acuaagcuuucauuaauuuuuc

SEQ ID NO: 3956337 - RNA, 23 nt, Staphylococcus aureus subsp. aureus Mu50
acuaagcuuucauuaauuuuuca

SEQ ID NO: 3956338 - RNA, 22 nt, Staphylococcus aureus subsp. aureus Mu50
acuaagucguucaauuguugau

SEQ ID NO: 3956339 - RNA, 19 nt, Staphylococcus aureus subsp. aureus Mu50
acuaaguuauuuaguacau

SEQ ID NO: 3956340 - RNA, 20 nt, Staphylococcus aureus subsp. aureus Mu50
acuaaguuauuuaguacaua

SEQ ID NO: 3956341 - RNA, 13 nt, Staphylococcus aureus subsp. aureus Mu50
acuaaguuuguuu

SEQ ID NO: 3956342 - RNA, 14 nt, Staphylococcus aureus subsp. aureus Mu50
acuaauaauugucc

SEQ ID NO: 3956343 - RNA, 19 nt, Staphylococcus aureus subsp. aureus Mu50
acuaauauauuaauuuuac

SEQ ID NO: 3956344 - RNA, 22 nt, Staphylococcus aureus subsp. aureus Mu50
acuaauaugauugguuugugau

SEQ ID NO: 3956345 - RNA, 15 nt, Staphylococcus aureus subsp. aureus Mu50
acuaauauuucuuag

SEQ ID NO: 3956346 - RNA, 20 nt, Staphylococcus aureus subsp. aureus Mu50
acuaaucguuccaacaacua

SEQ ID NO: 3956347 - RNA, 22 nt, Staphylococcus aureus subsp. aureus Mu50
acuaaucguuguggcuuuuuau

SEQ ID NO: 3956348 - RNA, 16 nt, Staphylococcus aureus subsp. aureus Mu50
acuaaugauaguacau

SEQ ID NO: 3956349 - RNA, 22 nt, Staphylococcus aureus subsp. aureus Mu50
acuaauggauaugauaaccaaa

SEQ ID NO: 3956350 - RNA, 21 nt, Staphylococcus aureus subsp. aureus Mu50
acuaauguuaaucaaaauuau

SEQ ID NO: 3956351 - RNA, 17 nt, Staphylococcus aureus subsp. aureus Mu50
acuaauugaucagcauu

SEQ ID NO: 3956352 - RNA, 13 nt, Staphylococcus aureus subsp. aureus Mu50
acuaauuuaaagc

SEQ ID NO: 3956353 - RNA, 17 nt, Staphylococcus aureus subsp. aureus Mu50
acuaauuuaaagcauca

SEQ ID NO: 3956354 - RNA, 18 nt, Staphylococcus aureus subsp. aureus Mu50
acuaauuuaaagcaucau

SEQ ID NO: 3956355 - RNA, 15 nt, Staphylococcus aureus subsp. aureus Mu50
acuaauuuagacauc

SEQ ID NO: 3956356 - RNA, 18 nt, Staphylococcus aureus subsp. aureus Mu50
acuaauuuagacaucauu

SEQ ID NO: 3956357 - RNA, 20 nt, Staphylococcus aureus subsp. aureus Mu50
acuaauuuagacaucauugu

SEQ ID NO: 3956358 - RNA, 22 nt, Staphylococcus aureus subsp. aureus Mu50
acuaauuuagacaucauuguuu

SEQ ID NO: 3956359 - RNA, 14 nt, Staphylococcus aureus subsp. aureus Mu50
acuaauuuauuaau

SEQ ID NO: 3956360 - RNA, 21 nt, Staphylococcus aureus subsp. aureus Mu50
acucauacaaauuuuuuuuau

SEQ ID NO: 3956361 - RNA, 21 nt, Staphylococcus aureus subsp. aureus Mu50
acucauccauugaucuuuuau

SEQ ID NO: 3956362 - RNA, 21 nt, Staphylococcus aureus subsp. aureus Mu50
acucaucuguccgauaucuuu

SEQ ID NO: 3956363 - RNA, 13 nt, Staphylococcus aureus subsp. aureus Mu50
acucauuauaaau

SEQ ID NO: 3956364 - RNA, 23 nt, Staphylococcus aureus subsp. aureus Mu50
acucauuauaaaugaaucgcuuu

SEQ ID NO: 3956365 - RNA, 12 nt, Staphylococcus aureus subsp. aureus Mu50
acucauuuucug

SEQ ID NO: 3956366 - RNA, 20 nt, Staphylococcus aureus subsp. aureus Mu50
acucccgcaaauauuaaauu

SEQ ID NO: 3956367 - RNA, 14 nt, Staphylococcus aureus subsp. aureus Mu50
acucccuucaacau

SEQ ID NO: 3956368 - RNA, 15 nt, Staphylococcus aureus subsp. aureus Mu50
acuccguugaauuca

SEQ ID NO: 3956369 - RNA, 18 nt, Staphylococcus aureus subsp. aureus Mu50
acuccguugaauucaacg

SEQ ID NO: 3956370 - RNA, 13 nt, Staphylococcus aureus subsp. aureus Mu50
acuccuccaaagc

SEQ ID NO: 3956371 - RNA, 15 nt, Staphylococcus aureus subsp. aureus Mu50
acuccucuauuuuau

SEQ ID NO: 3956372 - RNA, 15 nt, Staphylococcus aureus subsp. aureus Mu50
acuccuuaaacaaau

SEQ ID NO: 3956373 - RNA, 19 nt, Staphylococcus aureus subsp. aureus Mu50
acuccuuaaacaaauaaau

SEQ ID NO: 3956374 - RNA, 15 nt, Staphylococcus aureus subsp. aureus Mu50
acuccuuauuuuucg

SEQ ID NO: 3956375 - RNA, 13 nt, Staphylococcus aureus subsp. aureus Mu50
acucgaaaccagc

SEQ ID NO: 3956376 - RNA, 16 nt, Staphylococcus aureus subsp. aureus Mu50
acucggggaauuuuua

SEQ ID NO: 3956377 - RNA, 17 nt, Staphylococcus aureus subsp. aureus Mu50
acucggggaauuuuuau

SEQ ID NO: 3956378 - RNA, 20 nt, Staphylococcus aureus subsp. aureus Mu50
acucggggaauuuuuaugca

SEQ ID NO: 3956379 - RNA, 15 nt, Staphylococcus aureus subsp. aureus Mu50
acucguaaauuuuau

SEQ ID NO: 3956380 - RNA, 19 nt, Staphylococcus aureus subsp. aureus Mu50
acucguaaauuuuaucuaa

SEQ ID NO: 3956381 - RNA, 24 nt, Staphylococcus aureus subsp. aureus Mu50
acucguaaauuuuaucuaaacauu

SEQ ID NO: 3956382 - RNA, 15 nt, Staphylococcus aureus subsp. aureus Mu50
acucguaaucauagc

SEQ ID NO: 3956383 - RNA, 16 nt, Staphylococcus aureus subsp. aureus Mu50
acucguuauucaauau

SEQ ID NO: 3956384 - RNA, 20 nt, Staphylococcus aureus subsp. aureus Mu50
acucguugaccuuguucuuu

SEQ ID NO: 3956385 - RNA, 16 nt, Staphylococcus aureus subsp. aureus Mu50
acucguugcacucuuu

SEQ ID NO: 3956386 - RNA, 14 nt, Staphylococcus aureus subsp. aureus Mu50
acucuaaaaguugu

SEQ ID NO: 3956387 - RNA, 15 nt, Staphylococcus aureus subsp. aureus Mu50
acucuaaaaguugua

SEQ ID NO: 3956388 - RNA, 19 nt, Staphylococcus aureus subsp. aureus Mu50
acucuaaaaguuguaauuu

SEQ ID NO: 3956389 - RNA, 22 nt, Staphylococcus aureus subsp. aureus Mu50
acucuaaaaguuguaauuuaaa

SEQ ID NO: 3956390 - RNA, 12 nt, Staphylococcus aureus subsp. aureus Mu50
acucuaaaggaa

SEQ ID NO: 3956391 - RNA, 18 nt, Staphylococcus aureus subsp. aureus Mu50
acucuaaauauaauagaa

SEQ ID NO: 3956392 - RNA, 17 nt, Staphylococcus aureus subsp. aureus Mu50
acucuacacucaaacaa

SEQ ID NO: 3956393 - RNA, 14 nt, Staphylococcus aureus subsp. aureus Mu50
acucugauauugau

SEQ ID NO: 3956394 - RNA, 22 nt, Staphylococcus aureus subsp. aureus Mu50
acucugauauugaucugauuuc

SEQ ID NO: 3956395 - RNA, 15 nt, Staphylococcus aureus subsp. aureus Mu50
acucugauuacauau

SEQ ID NO: 3956396 - RNA, 22 nt, Staphylococcus aureus subsp. aureus Mu50
acucuucaguacgaacaacuaa

SEQ ID NO: 3956397 - RNA, 24 nt, Staphylococcus aureus subsp. aureus Mu50
acucuucaguacgaacaacuaaca

SEQ ID NO: 3956398 - RNA, 15 nt, Staphylococcus aureus subsp. aureus Mu50
acucuucguuuuaau

SEQ ID NO: 3956399 - RNA, 13 nt, Staphylococcus aureus subsp. aureus Mu50
acucuuuuucuuu

SEQ ID NO: 3956400 - RNA, 16 nt, Staphylococcus aureus subsp. aureus Mu50
acucuuuuucuuucau

SEQ ID NO: 3956401 - RNA, 20 nt, Staphylococcus aureus subsp. aureus Mu50
acucuuuuucuuucauaauu

SEQ ID NO: 3956402 - RNA, 21 nt, Staphylococcus aureus subsp. aureus Mu50
acucuuuuucuuucauaauua

SEQ ID NO: 3956403 - RNA, 18 nt, Staphylococcus aureus subsp. aureus Mu50
acugaaacuaaauuaaaa

SEQ ID NO: 3956404 - RNA, 13 nt, Staphylococcus aureus subsp. aureus Mu50
acugaaauuuuuc

SEQ ID NO: 3956405 - RNA, 15 nt, Staphylococcus aureus subsp. aureus Mu50
acugaaauuuuuccg

SEQ ID NO: 3956406 - RNA, 21 nt, Staphylococcus aureus subsp. aureus Mu50
acugaagacaccuuaucacuu

SEQ ID NO: 3956407 - RNA, 18 nt, Staphylococcus aureus subsp. aureus Mu50
acugaaugcuaauacuaa

SEQ ID NO: 3956408 - RNA, 12 nt, Staphylococcus aureus subsp. aureus Mu50
acugaauuuuaa

SEQ ID NO: 3956409 - RNA, 15 nt, Staphylococcus aureus subsp. aureus Mu50
acugaauuuuaacua

SEQ ID NO: 3956410 - RNA, 17 nt, Staphylococcus aureus subsp. aureus Mu50
acugacuaauaaaacuu

SEQ ID NO: 3956411 - RNA, 19 nt, Staphylococcus aureus subsp. aureus Mu50
acugagcaacaaaagaugu

SEQ ID NO: 3956412 - RNA, 16 nt, Staphylococcus aureus subsp. aureus Mu50
acugaguuuuaaugaa

SEQ ID NO: 3956413 - RNA, 16 nt, Staphylococcus aureus subsp. aureus Mu50
acugauaaaaggggaa

SEQ ID NO: 3956414 - RNA, 16 nt, Staphylococcus aureus subsp. aureus Mu50
acugauauuuagaaua

SEQ ID NO: 3956415 - RNA, 21 nt, Staphylococcus aureus subsp. aureus Mu50
acugaugaaaacuuaaaaaug

SEQ ID NO: 3956416 - RNA, 19 nt, Staphylococcus aureus subsp. aureus Mu50
acugaugaacauaccugca

SEQ ID NO: 3956417 - RNA, 23 nt, Staphylococcus aureus subsp. aureus Mu50
acugauggaaaauuauuugauau

SEQ ID NO: 3956418 - RNA, 13 nt, Staphylococcus aureus subsp. aureus Mu50
acugauuaaacug

SEQ ID NO: 3956419 - RNA, 12 nt, Staphylococcus aureus subsp. aureus Mu50
acugauugaaug

SEQ ID NO: 3956420 - RNA, 23 nt, Staphylococcus aureus subsp. aureus Mu50
acugauuuauugauaaauauuga

SEQ ID NO: 3956421 - RNA, 21 nt, Staphylococcus aureus subsp. aureus Mu50
acugcaacaccacacagcauu

SEQ ID NO: 3956422 - RNA, 13 nt, Staphylococcus aureus subsp. aureus Mu50
acugcaauuauuu

SEQ ID NO: 3956423 - RNA, 16 nt, Staphylococcus aureus subsp. aureus Mu50
acugcacaucauaaua

SEQ ID NO: 3956424 - RNA, 20 nt, Staphylococcus aureus subsp. aureus Mu50
acugcaccgauaucauauaa

SEQ ID NO: 3956425 - RNA, 15 nt, Staphylococcus aureus subsp. aureus Mu50
acugcaccuccaacc

SEQ ID NO: 3956426 - RNA, 19 nt, Staphylococcus aureus subsp. aureus Mu50
acugcaccuccaaccgcuu

SEQ ID NO: 3956427 - RNA, 18 nt, Staphylococcus aureus subsp. aureus Mu50
acugcacggauaccuacu

SEQ ID NO: 3956428 - RNA, 14 nt, Staphylococcus aureus subsp. aureus Mu50
acugcacuuuuauu

SEQ ID NO: 3956429 - RNA, 16 nt, Staphylococcus aureus subsp. aureus Mu50
acugcauauaaaguca

SEQ ID NO: 3956430 - RNA, 22 nt, Staphylococcus aureus subsp. aureus Mu50
acugccaaaaugguuaaaaucg

SEQ ID NO: 3956431 - RNA, 16 nt, Staphylococcus aureus subsp. aureus Mu50
acugccaauaaaaugc

SEQ ID NO: 3956432 - RNA, 17 nt, Staphylococcus aureus subsp. aureus Mu50
acugccauauguuuuag

SEQ ID NO: 3956433 - RNA, 13 nt, Staphylococcus aureus subsp. aureus Mu50
acugcuaauauua

SEQ ID NO: 3956434 - RNA, 20 nt, Staphylococcus aureus subsp. aureus Mu50
acugcuaauauuagauaucu

SEQ ID NO: 3956435 - RNA, 22 nt, Staphylococcus aureus subsp. aureus Mu50
acugcuaauuuuuucaucauuc

SEQ ID NO: 3956436 - RNA, 16 nt, Staphylococcus aureus subsp. aureus Mu50
acugcucuuuauauau

SEQ ID NO: 3956437 - RNA, 20 nt, Staphylococcus aureus subsp. aureus Mu50
acugcucuuuauauauaaaa

SEQ ID NO: 3956438 - RNA, 19 nt, Staphylococcus aureus subsp. aureus Mu50
acugcugcuaaaauaaaau

SEQ ID NO: 3956439 - RNA, 20 nt, Staphylococcus aureus subsp. aureus Mu50
acugcuguucucuauuuaua

SEQ ID NO: 3956440 - RNA, 15 nt, Staphylococcus aureus subsp. aureus Mu50
acugcuguucuuuuu

SEQ ID NO: 3956441 - RNA, 17 nt, Staphylococcus aureus subsp. aureus Mu50
acugcuguucuuuuuau

SEQ ID NO: 3956442 - RNA, 16 nt, Staphylococcus aureus subsp. aureus Mu50
acugcuuucaaguaau

SEQ ID NO: 3956443 - RNA, 23 nt, Staphylococcus aureus subsp. aureus Mu50
acugcuuuuuuauucuaauacaa

SEQ ID NO: 3956444 - RNA, 21 nt, Staphylococcus aureus subsp. aureus Mu50
acuggaucgcccauacuaaau

SEQ ID NO: 3956445 - RNA, 18 nt, Staphylococcus aureus subsp. aureus Mu50
acugggacauagaucaau

SEQ ID NO: 3956446 - RNA, 14 nt, Staphylococcus aureus subsp. aureus Mu50
acugguugauaaau

SEQ ID NO: 3956447 - RNA, 19 nt, Staphylococcus aureus subsp. aureus Mu50
acugguugauaaauaaacu

SEQ ID NO: 3956448 - RNA, 14 nt, Staphylococcus aureus subsp. aureus Mu50
acuucccaaucgau

SEQ ID NO: 3956449 - RNA, 20 nt, Staphylococcus aureus subsp. aureus Mu50
acuucccuuuggaagcaauu

SEQ ID NO: 3956450 - RNA, 16 nt, Staphylococcus aureus subsp. aureus Mu50
acuuccuaaaauuuac

SEQ ID NO: 3956451 - RNA, 18 nt, Staphylococcus aureus subsp. aureus Mu50
acuuccugcuuuuuuuau

SEQ ID NO: 3956452 - RNA, 13 nt, Staphylococcus aureus subsp. aureus Mu50
acuuccuuuuuau

SEQ ID NO: 3956453 - RNA, 18 nt, Staphylococcus aureus subsp. aureus Mu50
acuucgauaugauuaaag

SEQ ID NO: 3956454 - RNA, 17 nt, Staphylococcus aureus subsp. aureus Mu50
acuucgccaagccaucu

SEQ ID NO: 3956455 - RNA, 19 nt, Staphylococcus aureus subsp. aureus Mu50
acuucgccaagccaucuuu

SEQ ID NO: 3956456 - RNA, 14 nt, Staphylococcus aureus subsp. aureus Mu50
acuucguuauaugg

SEQ ID NO: 3956457 - RNA, 14 nt, Staphylococcus aureus subsp. aureus Mu50
acuucuaauaguaa

SEQ ID NO: 3956458 - RNA, 15 nt, Staphylococcus aureus subsp. aureus Mu50
acuucuaauaguaau

SEQ ID NO: 3956459 - RNA, 15 nt, Staphylococcus aureus subsp. aureus Mu50
acuucuaauuugcaa

SEQ ID NO: 3956460 - RNA, 17 nt, Staphylococcus aureus subsp. aureus Mu50
acuucuaauuugcaaaa

SEQ ID NO: 3956461 - RNA, 22 nt, Staphylococcus aureus subsp. aureus Mu50
acuucuaauuugcaaaaucaac

SEQ ID NO: 3956462 - RNA, 13 nt, Staphylococcus aureus subsp. aureus Mu50
acuucuauuuuau

SEQ ID NO: 3956463 - RNA, 17 nt, Staphylococcus aureus subsp. aureus Mu50
acuucucaauuuaguau

SEQ ID NO: 3956464 - RNA, 21 nt, Staphylococcus aureus subsp. aureus Mu50
acuucucaauuuaguauaaau

SEQ ID NO: 3956465 - RNA, 19 nt, Staphylococcus aureus subsp. aureus Mu50
acuucucaucgaauucauu

SEQ ID NO: 3956466 - RNA, 11 nt, Staphylococcus aureus subsp. aureus Mu50
acuucucuauc

SEQ ID NO: 3956467 - RNA, 21 nt, Staphylococcus aureus subsp. aureus Mu50
acuucucucuuauuaaaaaag

SEQ ID NO: 3956468 - RNA, 15 nt, Staphylococcus aureus subsp. aureus Mu50
acuucugauucuuca

SEQ ID NO: 3956469 - RNA, 13 nt, Staphylococcus aureus subsp. aureus Mu50
acuucuuaaaaua

SEQ ID NO: 3956470 - RNA, 14 nt, Staphylococcus aureus subsp. aureus Mu50
acuucuuaaaauau

SEQ ID NO: 3956471 - RNA, 19 nt, Staphylococcus aureus subsp. aureus Mu50
acuucuuaaaauaugauuu

SEQ ID NO: 3956472 - RNA, 20 nt, Staphylococcus aureus subsp. aureus Mu50
acuucuucaggugauucauu

SEQ ID NO: 3956473 - RNA, 17 nt, Staphylococcus aureus subsp. aureus Mu50
acuucuuguucgauaau

SEQ ID NO: 3956474 - RNA, 13 nt, Staphylococcus aureus subsp. aureus Mu50
acuucuuucaaaa

SEQ ID NO: 3956475 - RNA, 16 nt, Staphylococcus aureus subsp. aureus Mu50
acuucuuucaaaaaca

SEQ ID NO: 3956476 - RNA, 16 nt, Staphylococcus aureus subsp. aureus Mu50
acuucuuucaauuaau

SEQ ID NO: 3956477 - RNA, 14 nt, Staphylococcus aureus subsp. aureus Mu50
acuucuuuugcaaa

SEQ ID NO: 3956478 - RNA, 21 nt, Staphylococcus aureus subsp. aureus Mu50
acuucuuuugcaaaacgcauu

SEQ ID NO: 3956479 - RNA, 14 nt, Staphylococcus aureus subsp. aureus Mu50
acuucuuuuguuuu

SEQ ID NO: 3956480 - RNA, 16 nt, Staphylococcus aureus subsp. aureus Mu50
acuucuuuuguuuuac

SEQ ID NO: 3956481 - RNA, 18 nt, Staphylococcus aureus subsp. aureus Mu50
acuugaauaccuuuuauu

SEQ ID NO: 3956482 - RNA, 21 nt, Staphylococcus aureus subsp. aureus Mu50
acuugaauaccuuuuauuauu

SEQ ID NO: 3956483 - RNA, 23 nt, Staphylococcus aureus subsp. aureus Mu50
acuugaauauagcugugauuuga

SEQ ID NO: 3956484 - RNA, 22 nt, Staphylococcus aureus subsp. aureus Mu50
acuugaccacuuuuguuaaaaa

SEQ ID NO: 3956485 - RNA, 18 nt, Staphylococcus aureus subsp. aureus Mu50
acuugauaaaaaaugaau

SEQ ID NO: 3956486 - RNA, 19 nt, Staphylococcus aureus subsp. aureus Mu50
acuugauaaaaaaugaaug

SEQ ID NO: 3956487 - RNA, 16 nt, Staphylococcus aureus subsp. aureus Mu50
acuugauaaaacuaau

SEQ ID NO: 3956488 - RNA, 15 nt, Staphylococcus aureus subsp. aureus Mu50
acuugauagcauuuc

SEQ ID NO: 3956489 - RNA, 13 nt, Staphylococcus aureus subsp. aureus Mu50
acuugauaucauc

SEQ ID NO: 3956490 - RNA, 15 nt, Staphylococcus aureus subsp. aureus Mu50
acuugaugaaacuga

SEQ ID NO: 3956491 - RNA, 16 nt, Staphylococcus aureus subsp. aureus Mu50
acuugaugaaacugau

SEQ ID NO: 3956492 - RNA, 16 nt, Staphylococcus aureus subsp. aureus Mu50
acuugauucuacuuca

SEQ ID NO: 3956493 - RNA, 16 nt, Staphylococcus aureus subsp. aureus Mu50
acuugcucuaauucaa

SEQ ID NO: 3956494 - RNA, 22 nt, Staphylococcus aureus subsp. aureus Mu50
acuugcucuaauucaaugauuu

SEQ ID NO: 3956495 - RNA, 17 nt, Staphylococcus aureus subsp. aureus Mu50
acuuggaaauguauaug

SEQ ID NO: 3956496 - RNA, 22 nt, Staphylococcus aureus subsp. aureus Mu50
acuuggauuaccguuaaaaaag

SEQ ID NO: 3956497 - RNA, 19 nt, Staphylococcus aureus subsp. aureus Mu50
acuuggauucaaaugacau

SEQ ID NO: 3956498 - RNA, 13 nt, Staphylococcus aureus subsp. aureus Mu50
acuuggauuuuaa

SEQ ID NO: 3956499 - RNA, 14 nt, Staphylococcus aureus subsp. aureus Mu50
acuuggccuaaguu

SEQ ID NO: 3956500 - RNA, 21 nt, Staphylococcus aureus subsp. aureus Mu50
acuuggcgacauuuguaaaua

SEQ ID NO: 3956501 - RNA, 19 nt, Staphylococcus aureus subsp. aureus Mu50
acuuguaaauuuauuuuua

SEQ ID NO: 3956502 - RNA, 15 nt, Staphylococcus aureus subsp. aureus Mu50
acuuguaauauaaca

SEQ ID NO: 3956503 - RNA, 18 nt, Staphylococcus aureus subsp. aureus Mu50
acuuguaauauaacaagu

SEQ ID NO: 3956504 - RNA, 14 nt, Staphylococcus aureus subsp. aureus Mu50
acuuguaauauuau

SEQ ID NO: 3956505 - RNA, 15 nt, Staphylococcus aureus subsp. aureus Mu50
acuuguaauauuaua

SEQ ID NO: 3956506 - RNA, 23 nt, Staphylococcus aureus subsp. aureus Mu50
acuuguaauauuauaaccaccag

SEQ ID NO: 3956507 - RNA, 22 nt, Staphylococcus aureus subsp. aureus Mu50
acuuguccguuuuauauuuauu

SEQ ID NO: 3956508 - RNA, 18 nt, Staphylococcus aureus subsp. aureus Mu50
acuugucguauucuucaa

SEQ ID NO: 3956509 - RNA, 18 nt, Staphylococcus aureus subsp. aureus Mu50
acuugugauauauaacca

SEQ ID NO: 3956510 - RNA, 19 nt, Staphylococcus aureus subsp. aureus Mu50
acuuguugauauauauuuu

SEQ ID NO: 3956511 - RNA, 13 nt, Staphylococcus aureus subsp. aureus Mu50
acuuguuuccuac

SEQ ID NO: 3956512 - RNA, 15 nt, Staphylococcus aureus subsp. aureus Mu50
acuuuaaaauuguau

SEQ ID NO: 3956513 - RNA, 20 nt, Staphylococcus aureus subsp. aureus Mu50
acuuuaacauaucgcgcauc

SEQ ID NO: 3956514 - RNA, 22 nt, Staphylococcus aureus subsp. aureus Mu50
acuuuaacauaucgcgcaucaa

SEQ ID NO: 3956515 - RNA, 12 nt, Staphylococcus aureus subsp. aureus Mu50
acuuuaauaaug

SEQ ID NO: 3956516 - RNA, 20 nt, Staphylococcus aureus subsp. aureus Mu50
acuuuaauaccagcauccau

SEQ ID NO: 3956517 - RNA, 22 nt, Staphylococcus aureus subsp. aureus Mu50
acuuuaauacuaccguuuuuau

SEQ ID NO: 3956518 - RNA, 23 nt, Staphylococcus aureus subsp. aureus Mu50
acuuuaauaucagguacaaaugg

SEQ ID NO: 3956519 - RNA, 13 nt, Staphylococcus aureus subsp. aureus Mu50
acuuuaauuuuuc

SEQ ID NO: 3956520 - RNA, 20 nt, Staphylococcus aureus subsp. aureus Mu50
acuuuaccaauaucaugcaa

SEQ ID NO: 3956521 - RNA, 13 nt, Staphylococcus aureus subsp. aureus Mu50
acuuuaccaucuu

SEQ ID NO: 3956522 - RNA, 16 nt, Staphylococcus aureus subsp. aureus Mu50
acuuuacccucuuuag

SEQ ID NO: 3956523 - RNA, 18 nt, Staphylococcus aureus subsp. aureus Mu50
acuuuacccucuuuaguu

SEQ ID NO: 3956524 - RNA, 18 nt, Staphylococcus aureus subsp. aureus Mu50
acuuuacgauaaauagug

SEQ ID NO: 3956525 - RNA, 15 nt, Staphylococcus aureus subsp. aureus Mu50
acuuuagaaagugau

SEQ ID NO: 3956526 - RNA, 22 nt, Staphylococcus aureus subsp. aureus Mu50
acuuuagaaagugauucccaaa

SEQ ID NO: 3956527 - RNA, 19 nt, Staphylococcus aureus subsp. aureus Mu50
acuuuagcauauucgcuua

SEQ ID NO: 3956528 - RNA, 13 nt, Staphylococcus aureus subsp. aureus Mu50
acuuuaguauauu

SEQ ID NO: 3956529 - RNA, 14 nt, Staphylococcus aureus subsp. aureus Mu50
acuuuauuaaaaau

SEQ ID NO: 3956530 - RNA, 20 nt, Staphylococcus aureus subsp. aureus Mu50
acuuucaaacaaaucuuuua

SEQ ID NO: 3956531 - RNA, 23 nt, Staphylococcus aureus subsp. aureus Mu50
acuuucaaacaaaucuuuuaaau

SEQ ID NO: 3956532 - RNA, 17 nt, Staphylococcus aureus subsp. aureus Mu50
acuuucaaauaauguga

SEQ ID NO: 3956533 - RNA, 15 nt, Staphylococcus aureus subsp. aureus Mu50
acuuucccuacugcu

SEQ ID NO: 3956534 - RNA, 18 nt, Staphylococcus aureus subsp. aureus Mu50
acuuuccgccuucaaucc

SEQ ID NO: 3956535 - RNA, 23 nt, Staphylococcus aureus subsp. aureus Mu50
acuuucgaucuucuaauucguuu

SEQ ID NO: 3956536 - RNA, 13 nt, Staphylococcus aureus subsp. aureus Mu50
agaaauuuuaaaa

SEQ ID NO: 3956537 - RNA, 14 nt, Staphylococcus aureus subsp. aureus Mu50
agaaauuuuaaaau

SEQ ID NO: 3956538 - RNA, 12 nt, Staphylococcus aureus subsp. aureus Mu50
agaaauuuuuca

SEQ ID NO: 3956539 - RNA, 15 nt, Staphylococcus aureus subsp. aureus Mu50
agaaauuuuucacuu

SEQ ID NO: 3956540 - RNA, 12 nt, Staphylococcus aureus subsp. aureus Mu50
agaacaaaaugu

SEQ ID NO: 3956541 - RNA, 17 nt, Staphylococcus aureus subsp. aureus Mu50
agaacaaucaauacaga

SEQ ID NO: 3956542 - RNA, 16 nt, Staphylococcus aureus subsp. aureus Mu50
agaacagcacauuuuu

SEQ ID NO: 3956543 - RNA, 13 nt, Staphylococcus aureus subsp. aureus Mu50
agaacauaaaaaa

SEQ ID NO: 3956544 - RNA, 15 nt, Staphylococcus aureus subsp. aureus Mu50
agaacauaaaaaaac

SEQ ID NO: 3956545 - RNA, 23 nt, Staphylococcus aureus subsp. aureus Mu50
agaacaugauacugaaauuucau

SEQ ID NO: 3956546 - RNA, 15 nt, Staphylococcus aureus subsp. aureus Mu50
agaaccaaaauuaua

SEQ ID NO: 3956547 - RNA, 16 nt, Staphylococcus aureus subsp. aureus Mu50
agaaccaaaauuauau

SEQ ID NO: 3956548 - RNA, 15 nt, Staphylococcus aureus subsp. aureus Mu50
agaaccaacaauaaa

SEQ ID NO: 3956549 - RNA, 21 nt, Staphylococcus aureus subsp. aureus Mu50
agaaccauuucuaguuuucau

SEQ ID NO: 3956550 - RNA, 18 nt, Staphylococcus aureus subsp. aureus Mu50
agaaccuauuuuuuauau

SEQ ID NO: 3956551 - RNA, 21 nt, Staphylococcus aureus subsp. aureus Mu50
agaaccuugaaugauauuaac

SEQ ID NO: 3956552 - RNA, 15 nt, Staphylococcus aureus subsp. aureus Mu50
agaaccuuuaaaagu

SEQ ID NO: 3956553 - RNA, 18 nt, Staphylococcus aureus subsp. aureus Mu50
agaaccuuuaaaaguaac

SEQ ID NO: 3956554 - RNA, 21 nt, Staphylococcus aureus subsp. aureus Mu50
agaaccuuuaaaaguaacaua

SEQ ID NO: 3956555 - RNA, 13 nt, Staphylococcus aureus subsp. aureus Mu50
agaaccuuucuug

SEQ ID NO: 3956556 - RNA, 19 nt, Staphylococcus aureus subsp. aureus Mu50
agaaccuuuuuguuuucaa

SEQ ID NO: 3956557 - RNA, 14 nt, Staphylococcus aureus subsp. aureus Mu50
agaacgagaauuuc

SEQ ID NO: 3956558 - RNA, 13 nt, Staphylococcus aureus subsp. aureus Mu50
agaacgcuuuauu

SEQ ID NO: 3956559 - RNA, 16 nt, Staphylococcus aureus subsp. aureus Mu50
agaacguaauguuaca

SEQ ID NO: 3956560 - RNA, 15 nt, Staphylococcus aureus subsp. aureus Mu50
agaacguucuaaggu

SEQ ID NO: 3956561 - RNA, 13 nt, Staphylococcus aureus subsp. aureus Mu50
agaacuaauguaa

SEQ ID NO: 3956562 - RNA, 22 nt, Staphylococcus aureus subsp. aureus Mu50
agaacuacgcauuuuaaauaaa

SEQ ID NO: 3956563 - RNA, 19 nt, Staphylococcus aureus subsp. aureus Mu50
agaacuaucgauacuaaac

SEQ ID NO: 3956564 - RNA, 13 nt, Staphylococcus aureus subsp. aureus Mu50
agaacuaugaaua

SEQ ID NO: 3956565 - RNA, 15 nt, Staphylococcus aureus subsp. aureus Mu50
agaacuauuuuaaau

SEQ ID NO: 3956566 - RNA, 19 nt, Staphylococcus aureus subsp. aureus Mu50
agaacuauuuuaaauuaca

SEQ ID NO: 3956567 - RNA, 21 nt, Staphylococcus aureus subsp. aureus Mu50
agaacuauuuuaaauuacaac

SEQ ID NO: 3956568 - RNA, 23 nt, Staphylococcus aureus subsp. aureus Mu50
agaacuuuaaaaauugcaaugcu

SEQ ID NO: 3956569 - RNA, 15 nt, Staphylococcus aureus subsp. aureus Mu50
agaacuuuucaaaca

SEQ ID NO: 3956570 - RNA, 19 nt, Staphylococcus aureus subsp. aureus Mu50
agaacuuuucaaacaauac

SEQ ID NO: 3956571 - RNA, 16 nt, Staphylococcus aureus subsp. aureus Mu50
agaagaaacuuaauca

SEQ ID NO: 3956572 - RNA, 13 nt, Staphylococcus aureus subsp. aureus Mu50
agaagaaauauau

SEQ ID NO: 3956573 - RNA, 18 nt, Staphylococcus aureus subsp. aureus Mu50
agaagaauucucuauuca

SEQ ID NO: 3956574 - RNA, 18 nt, Staphylococcus aureus subsp. aureus Mu50
agaagccucuugccuuga

SEQ ID NO: 3956575 - RNA, 15 nt, Staphylococcus aureus subsp. aureus Mu50
agaagcugacgaaaa

SEQ ID NO: 3956576 - RNA, 13 nt, Staphylococcus aureus subsp. aureus Mu50
agaaguauuauga

SEQ ID NO: 3956577 - RNA, 17 nt, Staphylococcus aureus subsp. aureus Mu50
agaagugccguauucuu

SEQ ID NO: 3956578 - RNA, 14 nt, Staphylococcus aureus subsp. aureus Mu50
agaaguuguuuaga

SEQ ID NO: 3956579 - RNA, 15 nt, Staphylococcus aureus subsp. aureus Mu50
agaaguuuuuugauu

SEQ ID NO: 3956580 - RNA, 13 nt, Staphylococcus aureus subsp. aureus Mu50
agaauaaaaaagu

SEQ ID NO: 3956581 - RNA, 12 nt, Staphylococcus aureus subsp. aureus Mu50
agaauaaaaggc

SEQ ID NO: 3956582 - RNA, 15 nt, Staphylococcus aureus subsp. aureus Mu50
agaauaaaaggcuuu

SEQ ID NO: 3956583 - RNA, 14 nt, Staphylococcus aureus subsp. aureus Mu50
agaauaaacuuuau

SEQ ID NO: 3956584 - RNA, 14 nt, Staphylococcus aureus subsp. aureus Mu50
agaauacaaauauu

SEQ ID NO: 3956585 - RNA, 16 nt, Staphylococcus aureus subsp. aureus Mu50
agaauacaaauauuaa

SEQ ID NO: 3956586 - RNA, 17 nt, Staphylococcus aureus subsp. aureus Mu50
agaauacaaauauuaag

SEQ ID NO: 3956587 - RNA, 13 nt, Staphylococcus aureus subsp. aureus Mu50
agaauacuaaaag

SEQ ID NO: 3956588 - RNA, 17 nt, Staphylococcus aureus subsp. aureus Mu50
agaauacuaaaaguguu

SEQ ID NO: 3956589 - RNA, 17 nt, Staphylococcus aureus subsp. aureus Mu50
agaauaguuaccaaaau

SEQ ID NO: 3956590 - RNA, 18 nt, Staphylococcus aureus subsp. aureus Mu50
agaauaguuaccaaaauu

SEQ ID NO: 3956591 - RNA, 21 nt, Staphylococcus aureus subsp. aureus Mu50
agaauaguuaccaaaauuuga

SEQ ID NO: 3956592 - RNA, 15 nt, Staphylococcus aureus subsp. aureus Mu50
agaauauaagugauu

SEQ ID NO: 3956593 - RNA, 11 nt, Staphylococcus aureus subsp. aureus Mu50
agaauauuaac

SEQ ID NO: 3956594 - RNA, 22 nt, Staphylococcus aureus subsp. aureus Mu50
agaauauuaagauguauaugaa

SEQ ID NO: 3956595 - RNA, 13 nt, Staphylococcus aureus subsp. aureus Mu50
agaauauucagau

SEQ ID NO: 3956596 - RNA, 19 nt, Staphylococcus aureus subsp. aureus Mu50
agaauauucagauuuucga

SEQ ID NO: 3956597 - RNA, 18 nt, Staphylococcus aureus subsp. aureus Mu50
agaaucaaccguuuuauu

SEQ ID NO: 3956598 - RNA, 17 nt, Staphylococcus aureus subsp. aureus Mu50
agaaucaaguaauucau

SEQ ID NO: 3956599 - RNA, 19 nt, Staphylococcus aureus subsp. aureus Mu50
agaaucaauuauugaaaac

SEQ ID NO: 3956600 - RNA, 20 nt, Staphylococcus aureus subsp. aureus Mu50
agaauccuaugccaaauaac

SEQ ID NO: 3956601 - RNA, 18 nt, Staphylococcus aureus subsp. aureus Mu50
agaaugaacuucucuuag

SEQ ID NO: 3956602 - RNA, 15 nt, Staphylococcus aureus subsp. aureus Mu50
agaaugauacuguau

SEQ ID NO: 3956603 - RNA, 23 nt, Staphylococcus aureus subsp. aureus Mu50
agaaugccguaacccauggauuc

SEQ ID NO: 3956604 - RNA, 17 nt, Staphylococcus aureus subsp. aureus Mu50
agaaugcgauuuccuuu

SEQ ID NO: 3956605 - RNA, 12 nt, Staphylococcus aureus subsp. aureus Mu50
agaauuaacaac

SEQ ID NO: 3956606 - RNA, 15 nt, Staphylococcus aureus subsp. aureus Mu50
agaauuaacaacaaa

SEQ ID NO: 3956607 - RNA, 20 nt, Staphylococcus aureus subsp. aureus Mu50
agaauuaacaacaaauauaa

SEQ ID NO: 3956608 - RNA, 13 nt, Staphylococcus aureus subsp. aureus Mu50
agaauuaauaauu

SEQ ID NO: 3956609 - RNA, 23 nt, Staphylococcus aureus subsp. aureus Mu50
agaauuaauaauuuuuuuccuuu

SEQ ID NO: 3956610 - RNA, 20 nt, Staphylococcus aureus subsp. aureus Mu50
agaauuaguacuugaaacau

SEQ ID NO: 3956611 - RNA, 12 nt, Staphylococcus aureus subsp. aureus Mu50
agaauuauucaa

SEQ ID NO: 3956612 - RNA, 14 nt, Staphylococcus aureus subsp. aureus Mu50
agaauuauuuagaa

SEQ ID NO: 3956613 - RNA, 17 nt, Staphylococcus aureus subsp. aureus Mu50
agaauuauuuuggacug

SEQ ID NO: 3956614 - RNA, 19 nt, Staphylococcus aureus subsp. aureus Mu50
agaauucacgcaauaucau

SEQ ID NO: 3956615 - RNA, 17 nt, Staphylococcus aureus subsp. aureus Mu50
agaauucagcugaugcu

SEQ ID NO: 3956616 - RNA, 13 nt, Staphylococcus aureus subsp. aureus Mu50
agaauucauuaau

SEQ ID NO: 3956617 - RNA, 19 nt, Staphylococcus aureus subsp. aureus Mu50
agaauucuaaaagaauuau

SEQ ID NO: 3956618 - RNA, 15 nt, Staphylococcus aureus subsp. aureus Mu50
agaauugcaacgcau

SEQ ID NO: 3956619 - RNA, 21 nt, Staphylococcus aureus subsp. aureus Mu50
agaauugcaacgcaucacaaa

SEQ ID NO: 3956620 - RNA, 15 nt, Staphylococcus aureus subsp. aureus Mu50
agaauuuaaaagaga

SEQ ID NO: 3956621 - RNA, 14 nt, Staphylococcus aureus subsp. aureus Mu50
agaauuucaucaaa

SEQ ID NO: 3956622 - RNA, 17 nt, Staphylococcus aureus subsp. aureus Mu50
agaauuucaucaaaucc

SEQ ID NO: 3956623 - RNA, 16 nt, Staphylococcus aureus subsp. aureus Mu50
agaauuucgaaaagaa

SEQ ID NO: 3956624 - RNA, 19 nt, Staphylococcus aureus subsp. aureus Mu50
agaauuucgaaaagaaauu

SEQ ID NO: 3956625 - RNA, 17 nt, Staphylococcus aureus subsp. aureus Mu50
agauagcggauuuauuu

SEQ ID NO: 3956626 - RNA, 14 nt, Staphylococcus aureus subsp. aureus Mu50
agauagcuauauuu

SEQ ID NO: 3956627 - RNA, 19 nt, Staphylococcus aureus subsp. aureus Mu50
agauaggaaacuuaaauau

SEQ ID NO: 3956628 - RNA, 13 nt, Staphylococcus aureus subsp. aureus Mu50
agauaggauuuac

SEQ ID NO: 3956629 - RNA, 15 nt, Staphylococcus aureus subsp. aureus Mu50
agauaggauuuacac

SEQ ID NO: 3956630 - RNA, 15 nt, Staphylococcus aureus subsp. aureus Mu50
agauaggauuugcac

SEQ ID NO: 3956631 - RNA, 17 nt, Staphylococcus aureus subsp. aureus Mu50
agauauaaacauuuaua

SEQ ID NO: 3956632 - RNA, 13 nt, Staphylococcus aureus subsp. aureus Mu50
agauauagaauuc

SEQ ID NO: 3956633 - RNA, 23 nt, Staphylococcus aureus subsp. aureus Mu50
agauauagcaucuaugauuguau

SEQ ID NO: 3956634 - RNA, 15 nt, Staphylococcus aureus subsp. aureus Mu50
agauauauuugaaag

SEQ ID NO: 3956635 - RNA, 13 nt, Staphylococcus aureus subsp. aureus Mu50
agauaucauaaua

SEQ ID NO: 3956636 - RNA, 18 nt, Staphylococcus aureus subsp. aureus Mu50
agauaucuuaaucuaaaa

SEQ ID NO: 3956637 - RNA, 22 nt, Staphylococcus aureus subsp. aureus Mu50
agauaucuuaaucuaaaaauag

SEQ ID NO: 3956638 - RNA, 16 nt, Staphylococcus aureus subsp. aureus Mu50
agauaucuuauaacaa

SEQ ID NO: 3956639 - RNA, 17 nt, Staphylococcus aureus subsp. aureus Mu50
agauauuuucuucucaa

SEQ ID NO: 3956640 - RNA, 14 nt, Staphylococcus aureus subsp. aureus Mu50
agaucaauaucacu

SEQ ID NO: 3956641 - RNA, 21 nt, Staphylococcus aureus subsp. aureus Mu50
agaucaauaucacuaucagcu

SEQ ID NO: 3956642 - RNA, 21 nt, Staphylococcus aureus subsp. aureus Mu50
agauccauaaggauuuuuaau

SEQ ID NO: 3956643 - RNA, 21 nt, Staphylococcus aureus subsp. aureus Mu50
agaucucaauccaauuaaaua

SEQ ID NO: 3956644 - RNA, 21 nt, Staphylococcus aureus subsp. aureus Mu50
agaucuuuguaugcaucaguu

SEQ ID NO: 3956645 - RNA, 21 nt, Staphylococcus aureus subsp. aureus Mu50
agaugaaauauucuuuaauau

SEQ ID NO: 3956646 - RNA, 13 nt, Staphylococcus aureus subsp. aureus Mu50
agaugaauaaugu

SEQ ID NO: 3956647 - RNA, 15 nt, Staphylococcus aureus subsp. aureus Mu50
agaugaauaauguuu

SEQ ID NO: 3956648 - RNA, 21 nt, Staphylococcus aureus subsp. aureus Mu50
agaugaauaauguuuccauuu

SEQ ID NO: 3956649 - RNA, 22 nt, Staphylococcus aureus subsp. aureus Mu50
agaugacugaaccaauccaaua

SEQ ID NO: 3956650 - RNA, 13 nt, Staphylococcus aureus subsp. aureus Mu50
agaugagaaagua

SEQ ID NO: 3956651 - RNA, 17 nt, Staphylococcus aureus subsp. aureus Mu50
agaugagauuucguuag

SEQ ID NO: 3956652 - RNA, 16 nt, Staphylococcus aureus subsp. aureus Mu50
agaugaggcgauaaaa

SEQ ID NO: 3956653 - RNA, 19 nt, Staphylococcus aureus subsp. aureus Mu50
agaugaggcgauaaaagaa

SEQ ID NO: 3956654 - RNA, 16 nt, Staphylococcus aureus subsp. aureus Mu50
agaugauacauucuau

SEQ ID NO: 3956655 - RNA, 19 nt, Staphylococcus aureus subsp. aureus Mu50
agaugauauuuaacaaaau

SEQ ID NO: 3956656 - RNA, 21 nt, Staphylococcus aureus subsp. aureus Mu50
agaugaucagggaaaucaucu

SEQ ID NO: 3956657 - RNA, 15 nt, Staphylococcus aureus subsp. aureus Mu50
agaugaugcuucgca

SEQ ID NO: 3956658 - RNA, 15 nt, Staphylococcus aureus subsp. aureus Mu50
agaugaugcuucuca

SEQ ID NO: 3956659 - RNA, 16 nt, Staphylococcus aureus subsp. aureus Mu50
agaugauucuuaucau

SEQ ID NO: 3956660 - RNA, 16 nt, Staphylococcus aureus subsp. aureus Mu50
agaugauugucuagca

SEQ ID NO: 3956661 - RNA, 13 nt, Staphylococcus aureus subsp. aureus Mu50
agaugcauaaaaa

SEQ ID NO: 3956662 - RNA, 15 nt, Staphylococcus aureus subsp. aureus Mu50
agaugcauaaaaaaa

SEQ ID NO: 3956663 - RNA, 16 nt, Staphylococcus aureus subsp. aureus Mu50
agaugcauaaaaaaag

SEQ ID NO: 3956664 - RNA, 16 nt, Staphylococcus aureus subsp. aureus Mu50
agaugcauaaaaaccu

SEQ ID NO: 3956665 - RNA, 17 nt, Staphylococcus aureus subsp. aureus Mu50
agaugcauaaaaaccua

SEQ ID NO: 3956666 - RNA, 15 nt, Staphylococcus aureus subsp. aureus Mu50
agaugcuaauguaau

SEQ ID NO: 3956667 - RNA, 18 nt, Staphylococcus aureus subsp. aureus Mu50
agaugcucauugcauuuc

SEQ ID NO: 3956668 - RNA, 17 nt, Staphylococcus aureus subsp. aureus Mu50
agaugcuuuaauuaaag

SEQ ID NO: 3956669 - RNA, 22 nt, Staphylococcus aureus subsp. aureus Mu50
agauggacaguuuuuauauuaa

SEQ ID NO: 3956670 - RNA, 17 nt, Staphylococcus aureus subsp. aureus Mu50
agauggcuuuuuuugcu

SEQ ID NO: 3956671 - RNA, 18 nt, Staphylococcus aureus subsp. aureus Mu50
agaugucgaaaaguauau

SEQ ID NO: 3956672 - RNA, 19 nt, Staphylococcus aureus subsp. aureus Mu50
agaugucgaaaaguauaug

SEQ ID NO: 3956673 - RNA, 21 nt, Staphylococcus aureus subsp. aureus Mu50
agaugucgaaaaguauaugaa

SEQ ID NO: 3956674 - RNA, 18 nt, Staphylococcus aureus subsp. aureus Mu50
agaugugaugcuugaaug

SEQ ID NO: 3956675 - RNA, 21 nt, Staphylococcus aureus subsp. aureus Mu50
agauguugguucaucaaacaa

SEQ ID NO: 3956676 - RNA, 15 nt, Staphylococcus aureus subsp. aureus Mu50
agauguuucaaaaua

SEQ ID NO: 3956677 - RNA, 19 nt, Staphylococcus aureus subsp. aureus Mu50
agauguuucaaaauaauuu

SEQ ID NO: 3956678 - RNA, 22 nt, Staphylococcus aureus subsp. aureus Mu50
agauguuugcaacauauuuuca

SEQ ID NO: 3956679 - RNA, 12 nt, Staphylococcus aureus subsp. aureus Mu50
agauuagagaag

SEQ ID NO: 3956680 - RNA, 24 nt, Staphylococcus aureus subsp. aureus Mu50
agauuaguguagggggcauuauua

SEQ ID NO: 3956681 - RNA, 21 nt, Staphylococcus aureus subsp. aureus Mu50
agauuaugaaaacauuauuaa

SEQ ID NO: 3956682 - RNA, 19 nt, Staphylococcus aureus subsp. aureus Mu50
agauuaugacaacauaaca

SEQ ID NO: 3956683 - RNA, 13 nt, Staphylococcus aureus subsp. aureus Mu50
agauuauuaugug

SEQ ID NO: 3956684 - RNA, 22 nt, Staphylococcus aureus subsp. aureus Mu50
agauuauugguugaaauuaauu

SEQ ID NO: 3956685 - RNA, 23 nt, Staphylococcus aureus subsp. aureus Mu50
agauuauuuaaaacuuguaaauu

SEQ ID NO: 3956686 - RNA, 14 nt, Staphylococcus aureus subsp. aureus Mu50
agauuauuuuuuua

SEQ ID NO: 3956687 - RNA, 14 nt, Staphylococcus aureus subsp. aureus Mu50
agauucaaacguuu

SEQ ID NO: 3956688 - RNA, 20 nt, Staphylococcus aureus subsp. aureus Mu50
agauucaaacguuuucacuu

SEQ ID NO: 3956689 - RNA, 19 nt, Staphylococcus aureus subsp. aureus Mu50
agauucggaaaauaugaua

SEQ ID NO: 3956690 - RNA, 22 nt, Staphylococcus aureus subsp. aureus Mu50
agauucggaaaauaugauaacu

SEQ ID NO: 3956691 - RNA, 16 nt, Staphylococcus aureus subsp. aureus Mu50
agauugaaaaaauaac

SEQ ID NO: 3956692 - RNA, 14 nt, Staphylococcus aureus subsp. aureus Mu50
agauugagaauuca

SEQ ID NO: 3956693 - RNA, 21 nt, Staphylococcus aureus subsp. aureus Mu50
agauugauauaaauuaucaga

SEQ ID NO: 3956694 - RNA, 15 nt, Staphylococcus aureus subsp. aureus Mu50
agauuggaagggcau

SEQ ID NO: 3956695 - RNA, 18 nt, Staphylococcus aureus subsp. aureus Mu50
agauuggcugugcuauaa

SEQ ID NO: 3956696 - RNA, 19 nt, Staphylococcus aureus subsp. aureus Mu50
agauuuaguuuuuuuaaag

SEQ ID NO: 3956697 - RNA, 22 nt, Staphylococcus aureus subsp. aureus Mu50
agauuuaguuuuuuuaaaguuu

SEQ ID NO: 3956698 - RNA, 19 nt, Staphylococcus aureus subsp. aureus Mu50
agauuuauuaaauauaugc

SEQ ID NO: 3956699 - RNA, 13 nt, Staphylococcus aureus subsp. aureus Mu50
agauuugaaauuu

SEQ ID NO: 3956700 - RNA, 17 nt, Staphylococcus aureus subsp. aureus Mu50
agauuuguagcuugaau

SEQ ID NO: 3956701 - RNA, 16 nt, Staphylococcus aureus subsp. aureus Mu50
agauuuguauuuugcg

SEQ ID NO: 3956702 - RNA, 20 nt, Staphylococcus aureus subsp. aureus Mu50
agauuuuaaaaauucauaau

SEQ ID NO: 3956703 - RNA, 17 nt, Staphylococcus aureus subsp. aureus Mu50
agauuuuaaacgcucau

SEQ ID NO: 3956704 - RNA, 21 nt, Staphylococcus aureus subsp. aureus Mu50
agauuuuaaacgcucaucacu

SEQ ID NO: 3956705 - RNA, 15 nt, Staphylococcus aureus subsp. aureus Mu50
agauuuucaacacac

SEQ ID NO: 3956706 - RNA, 13 nt, Staphylococcus aureus subsp. aureus Mu50
agauuuuguugua

SEQ ID NO: 3956707 - RNA, 19 nt, Staphylococcus aureus subsp. aureus Mu50
agcaaaaauucuaacugca

SEQ ID NO: 3956708 - RNA, 21 nt, Staphylococcus aureus subsp. aureus Mu50
agcaaaauuauguaaaaaaua

SEQ ID NO: 3956709 - RNA, 16 nt, Staphylococcus aureus subsp. aureus Mu50
agcaaagcaaauuagu

SEQ ID NO: 3956710 - RNA, 17 nt, Staphylococcus aureus subsp. aureus Mu50
agcaaagguugcugcag

SEQ ID NO: 3956711 - RNA, 15 nt, Staphylococcus aureus subsp. aureus Mu50
agcaaauaaaaucau

SEQ ID NO: 3956712 - RNA, 20 nt, Staphylococcus aureus subsp. aureus Mu50
agccuacuuugucugcaauu

SEQ ID NO: 3956713 - RNA, 13 nt, Staphylococcus aureus subsp. aureus Mu50
agccuauccauuc

SEQ ID NO: 3956714 - RNA, 15 nt, Staphylococcus aureus subsp. aureus Mu50
agccuauccauucaa

SEQ ID NO: 3956715 - RNA, 22 nt, Staphylococcus aureus subsp. aureus Mu50
agccuauuuaaaagacaaucuc

SEQ ID NO: 3956716 - RNA, 17 nt, Staphylococcus aureus subsp. aureus Mu50
agccucuugccuugaaa

SEQ ID NO: 3956717 - RNA, 17 nt, Staphylococcus aureus subsp. aureus Mu50
agccuuaauaucaugca

SEQ ID NO: 3956718 - RNA, 22 nt, Staphylococcus aureus subsp. aureus Mu50
agcgaaaguaucuaugaaauuu

SEQ ID NO: 3956719 - RNA, 18 nt, Staphylococcus aureus subsp. aureus Mu50
agcgaccgugguucaaaa

SEQ ID NO: 3956720 - RNA, 18 nt, Staphylococcus aureus subsp. aureus Mu50
agcgauaccuuuaauauc

SEQ ID NO: 3956721 - RNA, 23 nt, Staphylococcus aureus subsp. aureus Mu50
agcgauaccuuuaauaucuaauu

SEQ ID NO: 3956722 - RNA, 20 nt, Staphylococcus aureus subsp. aureus Mu50
agcgaucauuagcaauuuca

SEQ ID NO: 3956723 - RNA, 20 nt, Staphylococcus aureus subsp. aureus Mu50
agcgaucuuuuuuauuuaau

SEQ ID NO: 3956724 - RNA, 12 nt, Staphylococcus aureus subsp. aureus Mu50
agcgauuaaaug

SEQ ID NO: 3956725 - RNA, 17 nt, Staphylococcus aureus subsp. aureus Mu50
agcgauuuccaucauuu

SEQ ID NO: 3956726 - RNA, 22 nt, Staphylococcus aureus subsp. aureus Mu50
agcgauuuuaaagaaaaguuua

SEQ ID NO: 3956727 - RNA, 22 nt, Staphylococcus aureus subsp. aureus Mu50
agcgcaagagauaagaaaauac

SEQ ID NO: 3956728 - RNA, 17 nt, Staphylococcus aureus subsp. aureus Mu50
agcgcaggcgaaccgaa

SEQ ID NO: 3956729 - RNA, 17 nt, Staphylococcus aureus subsp. aureus Mu50
agcgcagugaccucagg

SEQ ID NO: 3956730 - RNA, 20 nt, Staphylococcus aureus subsp. aureus Mu50
agcgcauaaauuuucuguuu

SEQ ID NO: 3956731 - RNA, 21 nt, Staphylococcus aureus subsp. aureus Mu50
agcgccuaugugaugguaaau

SEQ ID NO: 3956732 - RNA, 17 nt, Staphylococcus aureus subsp. aureus Mu50
agcgcgcuuauugaaaa

SEQ ID NO: 3956733 - RNA, 19 nt, Staphylococcus aureus subsp. aureus Mu50
agcggaauacagaugaugc

SEQ ID NO: 3956734 - RNA, 18 nt, Staphylococcus aureus subsp. aureus Mu50
agcggugugaauugauuu

SEQ ID NO: 3956735 - RNA, 12 nt, Staphylococcus aureus subsp. aureus Mu50
agcguaaaguuu

SEQ ID NO: 3956736 - RNA, 18 nt, Staphylococcus aureus subsp. aureus Mu50
agcguaauuauuauaaua

SEQ ID NO: 3956737 - RNA, 15 nt, Staphylococcus aureus subsp. aureus Mu50
agcguacgauauagu

SEQ ID NO: 3956738 - RNA, 16 nt, Staphylococcus aureus subsp. aureus Mu50
agcguauuuuaaugau

SEQ ID NO: 3956739 - RNA, 22 nt, Staphylococcus aureus subsp. aureus Mu50
agcguccucuugugaaauuaga

SEQ ID NO: 3956740 - RNA, 19 nt, Staphylococcus aureus subsp. aureus Mu50
agcgugauucaucuauuau

SEQ ID NO: 3956741 - RNA, 17 nt, Staphylococcus aureus subsp. aureus Mu50
agcguucucuaauuuca

SEQ ID NO: 3956742 - RNA, 18 nt, Staphylococcus aureus subsp. aureus Mu50
agcuaacucuuuguauaa

SEQ ID NO: 3956743 - RNA, 13 nt, Staphylococcus aureus subsp. aureus Mu50
agcuaaguuaaau

SEQ ID NO: 3956744 - RNA, 16 nt, Staphylococcus aureus subsp. aureus Mu50
agcuaauaucaauaau

SEQ ID NO: 3956745 - RNA, 13 nt, Staphylococcus aureus subsp. aureus Mu50
agcuaaugcaagc

SEQ ID NO: 3956746 - RNA, 22 nt, Staphylococcus aureus subsp. aureus Mu50
agcuaauguguacuuaaaaaua

SEQ ID NO: 3956747 - RNA, 19 nt, Staphylococcus aureus subsp. aureus Mu50
agcuaauucauauucaaau

SEQ ID NO: 3956748 - RNA, 21 nt, Staphylococcus aureus subsp. aureus Mu50
agcuaauuucuaauacauacu

SEQ ID NO: 3956749 - RNA, 22 nt, Staphylococcus aureus subsp. aureus Mu50
agcuaauuucuaauacauacug

SEQ ID NO: 3956750 - RNA, 15 nt, Staphylococcus aureus subsp. aureus Mu50
agcuacaauuaaagu

SEQ ID NO: 3956751 - RNA, 16 nt, Staphylococcus aureus subsp. aureus Mu50
agcuacaauuuucuca

SEQ ID NO: 3956752 - RNA, 18 nt, Staphylococcus aureus subsp. aureus Mu50
agcuacccuauuuuacaa

SEQ ID NO: 3956753 - RNA, 18 nt, Staphylococcus aureus subsp. aureus Mu50
agcuagaaacaaugcgaa

SEQ ID NO: 3956754 - RNA, 16 nt, Staphylococcus aureus subsp. aureus Mu50
agcuauaaaaaaucuu

SEQ ID NO: 3956755 - RNA, 12 nt, Staphylococcus aureus subsp. aureus Mu50
agcuauaaaagu

SEQ ID NO: 3956756 - RNA, 18 nt, Staphylococcus aureus subsp. aureus Mu50
agcuauaaaaguacuuua

SEQ ID NO: 3956757 - RNA, 14 nt, Staphylococcus aureus subsp. aureus Mu50
agcuauacucauuu

SEQ ID NO: 3956758 - RNA, 14 nt, Staphylococcus aureus subsp. aureus Mu50
agcuauccaauacu

SEQ ID NO: 3956759 - RNA, 15 nt, Staphylococcus aureus subsp. aureus Mu50
agcuaucguaaacaa

SEQ ID NO: 3956760 - RNA, 17 nt, Staphylococcus aureus subsp. aureus Mu50
agcuaucuucagauucc

SEQ ID NO: 3956761 - RNA, 14 nt, Staphylococcus aureus subsp. aureus Mu50
agcuauuaaaauag

SEQ ID NO: 3956762 - RNA, 20 nt, Staphylococcus aureus subsp. aureus Mu50
agcucaauugaaucuuuguu

SEQ ID NO: 3956763 - RNA, 19 nt, Staphylococcus aureus subsp. aureus Mu50
agcucgcggccuuuuuuau

SEQ ID NO: 3956764 - RNA, 16 nt, Staphylococcus aureus subsp. aureus Mu50
agcucguuaaaucaca

SEQ ID NO: 3956765 - RNA, 19 nt, Staphylococcus aureus subsp. aureus Mu50
agcucuuaaaucacuagcu

SEQ ID NO: 3956766 - RNA, 16 nt, Staphylococcus aureus subsp. aureus Mu50
agcucuuuuuugauuu

SEQ ID NO: 3956767 - RNA, 16 nt, Staphylococcus aureus subsp. aureus Mu50
agcugaacguaaguuu

SEQ ID NO: 3956768 - RNA, 18 nt, Staphylococcus aureus subsp. aureus Mu50
agcugaauuuuagugaau

SEQ ID NO: 3956769 - RNA, 18 nt, Staphylococcus aureus subsp. aureus Mu50
agcugauuccauuucgau

SEQ ID NO: 3956770 - RNA, 19 nt, Staphylococcus aureus subsp. aureus Mu50
agcugauuucuaucaaaua

SEQ ID NO: 3956771 - RNA, 13 nt, Staphylococcus aureus subsp. aureus Mu50
agcugauuuuuca

SEQ ID NO: 3956772 - RNA, 14 nt, Staphylococcus aureus subsp. aureus Mu50
agcugcaauuuuag

SEQ ID NO: 3956773 - RNA, 14 nt, Staphylococcus aureus subsp. aureus Mu50
agcugcgauauaac

SEQ ID NO: 3956774 - RNA, 16 nt, Staphylococcus aureus subsp. aureus Mu50
agcugucauaccuuuu

SEQ ID NO: 3956775 - RNA, 21 nt, Staphylococcus aureus subsp. aureus Mu50
agcuguuggugaguguuucau

SEQ ID NO: 3956776 - RNA, 13 nt, Staphylococcus aureus subsp. aureus Mu50
agcuuaauuuuau

SEQ ID NO: 3956777 - RNA, 21 nt, Staphylococcus aureus subsp. aureus Mu50
agcuuagucaauguauauuua

SEQ ID NO: 3956778 - RNA, 13 nt, Staphylococcus aureus subsp. aureus Mu50
agcuuaucaacga

SEQ ID NO: 3956779 - RNA, 20 nt, Staphylococcus aureus subsp. aureus Mu50
agcuuaucaacgauuuuguc

SEQ ID NO: 3956780 - RNA, 14 nt, Staphylococcus aureus subsp. aureus Mu50
agcuucaguuaaau

SEQ ID NO: 3956781 - RNA, 16 nt, Staphylococcus aureus subsp. aureus Mu50
agcuucucauugaaau

SEQ ID NO: 3956782 - RNA, 17 nt, Staphylococcus aureus subsp. aureus Mu50
agcuucucauugaaauc

SEQ ID NO: 3956783 - RNA, 20 nt, Staphylococcus aureus subsp. aureus Mu50
agcuucuguguuggggccca

SEQ ID NO: 3956784 - RNA, 14 nt, Staphylococcus aureus subsp. aureus Mu50
agcuucuuuaaaua

SEQ ID NO: 3956785 - RNA, 15 nt, Staphylococcus aureus subsp. aureus Mu50
agcuucuuuaacaau

SEQ ID NO: 3956786 - RNA, 16 nt, Staphylococcus aureus subsp. aureus Mu50
agcuucuuuaacaauu

SEQ ID NO: 3956787 - RNA, 17 nt, Staphylococcus aureus subsp. aureus Mu50
agcuugaauaauauauu

SEQ ID NO: 3956788 - RNA, 18 nt, Staphylococcus aureus subsp. aureus Mu50
agcuugaccgccuaugau

SEQ ID NO: 3956789 - RNA, 16 nt, Staphylococcus aureus subsp. aureus Mu50
agcuugcuguucaaca

SEQ ID NO: 3956790 - RNA, 18 nt, Staphylococcus aureus subsp. aureus Mu50
agcuugcuguucaacauc

SEQ ID NO: 3956791 - RNA, 22 nt, Staphylococcus aureus subsp. aureus Mu50
agcuugcuuacaauaaucacuu

SEQ ID NO: 3956792 - RNA, 20 nt, Staphylococcus aureus subsp. aureus Mu50
agcuugggacagaaaacaaa

SEQ ID NO: 3956793 - RNA, 16 nt, Staphylococcus aureus subsp. aureus Mu50
agcuuguaaaucacga

SEQ ID NO: 3956794 - RNA, 17 nt, Staphylococcus aureus subsp. aureus Mu50
agcuuguaaaucacgau

SEQ ID NO: 3956795 - RNA, 14 nt, Staphylococcus aureus subsp. aureus Mu50
agcuuguaacaagc

SEQ ID NO: 3956796 - RNA, 20 nt, Staphylococcus aureus subsp. aureus Mu50
agcuuguaauccuuguucua

SEQ ID NO: 3956797 - RNA, 23 nt, Staphylococcus aureus subsp. aureus Mu50
agcuuguacacauccucauaauu

SEQ ID NO: 3956798 - RNA, 11 nt, Staphylococcus aureus subsp. aureus Mu50
agcuuucaguu

SEQ ID NO: 3956799 - RNA, 21 nt, Staphylococcus aureus subsp. aureus Mu50
agcuuucguuucuuuuauauc

SEQ ID NO: 3956800 - RNA, 17 nt, Staphylococcus aureus subsp. aureus Mu50
agguaauuuaacauuuu

SEQ ID NO: 3956801 - RNA, 18 nt, Staphylococcus aureus subsp. aureus Mu50
agguaauuuaacauuuuu

SEQ ID NO: 3956802 - RNA, 14 nt, Staphylococcus aureus subsp. aureus Mu50
agguauaaucauuu

SEQ ID NO: 3956803 - RNA, 15 nt, Staphylococcus aureus subsp. aureus Mu50
agguauacacaaauu

SEQ ID NO: 3956804 - RNA, 22 nt, Staphylococcus aureus subsp. aureus Mu50
agguauagcaaguuuauaaauu

SEQ ID NO: 3956805 - RNA, 21 nt, Staphylococcus aureus subsp. aureus Mu50
agguauaggugcaguuaaauu

SEQ ID NO: 3956806 - RNA, 17 nt, Staphylococcus aureus subsp. aureus Mu50
agguaugaaauaacaau

SEQ ID NO: 3956807 - RNA, 13 nt, Staphylococcus aureus subsp. aureus Mu50
aggucaaaaaauu

SEQ ID NO: 3956808 - RNA, 19 nt, Staphylococcus aureus subsp. aureus Mu50
aggucaaaaaauuaaucaa

SEQ ID NO: 3956809 - RNA, 22 nt, Staphylococcus aureus subsp. aureus Mu50
aggucaucugaugaggcaauau

SEQ ID NO: 3956810 - RNA, 17 nt, Staphylococcus aureus subsp. aureus Mu50
agguccuuucacauacc

SEQ ID NO: 3956811 - RNA, 18 nt, Staphylococcus aureus subsp. aureus Mu50
aggucuacgaucaaaauc

SEQ ID NO: 3956812 - RNA, 14 nt, Staphylococcus aureus subsp. aureus Mu50
aggugauaauguac

SEQ ID NO: 3956813 - RNA, 19 nt, Staphylococcus aureus subsp. aureus Mu50
aggugauugaacaauaaua

SEQ ID NO: 3956814 - RNA, 19 nt, Staphylococcus aureus subsp. aureus Mu50
aggugcaguuaaauuaaac

SEQ ID NO: 3956815 - RNA, 19 nt, Staphylococcus aureus subsp. aureus Mu50
agguguggaguaaagauca

SEQ ID NO: 3956816 - RNA, 20 nt, Staphylococcus aureus subsp. aureus Mu50
agguuaaauauuuaauugga

SEQ ID NO: 3956817 - RNA, 21 nt, Staphylococcus aureus subsp. aureus Mu50
agguuaacauuugucauaaua

SEQ ID NO: 3956818 - RNA, 14 nt, Staphylococcus aureus subsp. aureus Mu50
agguuauauuuaaa

SEQ ID NO: 3956819 - RNA, 16 nt, Staphylococcus aureus subsp. aureus Mu50
agguuauauuuaaaug

SEQ ID NO: 3956820 - RNA, 16 nt, Staphylococcus aureus subsp. aureus Mu50
agguuauuauaaaaua

SEQ ID NO: 3956821 - RNA, 19 nt, Staphylococcus aureus subsp. aureus Mu50
agguuauuauaaaauaaau

SEQ ID NO: 3956822 - RNA, 16 nt, Staphylococcus aureus subsp. aureus Mu50
agguucaguagaauug

SEQ ID NO: 3956823 - RNA, 16 nt, Staphylococcus aureus subsp. aureus Mu50
agguucaucuuuaugc

SEQ ID NO: 3956824 - RNA, 15 nt, Staphylococcus aureus subsp. aureus Mu50
agguucauuauuuaa

SEQ ID NO: 3956825 - RNA, 15 nt, Staphylococcus aureus subsp. aureus Mu50
agguucuucaucuuu

SEQ ID NO: 3956826 - RNA, 14 nt, Staphylococcus aureus subsp. aureus Mu50
agguugaagaagga

SEQ ID NO: 3956827 - RNA, 14 nt, Staphylococcus aureus subsp. aureus Mu50
agguugaauuucuu

SEQ ID NO: 3956828 - RNA, 14 nt, Staphylococcus aureus subsp. aureus Mu50
agguugauuucugc

SEQ ID NO: 3956829 - RNA, 19 nt, Staphylococcus aureus subsp. aureus Mu50
agguuguucuauacauucc

SEQ ID NO: 3956830 - RNA, 18 nt, Staphylococcus aureus subsp. aureus Mu50
agguuguuuuucaucauu

SEQ ID NO: 3956831 - RNA, 15 nt, Staphylococcus aureus subsp. aureus Mu50
agguuuauaaaaaau

SEQ ID NO: 3956832 - RNA, 19 nt, Staphylococcus aureus subsp. aureus Mu50
agguuuauaaaaaaucagu

SEQ ID NO: 3956833 - RNA, 18 nt, Staphylococcus aureus subsp. aureus Mu50
agguuuguaagacaacaa

SEQ ID NO: 3956834 - RNA, 16 nt, Staphylococcus aureus subsp. aureus Mu50
agguuuucgccaauaa

SEQ ID NO: 3956835 - RNA, 14 nt, Staphylococcus aureus subsp. aureus Mu50
aguaaaauaaaaaa

SEQ ID NO: 3956836 - RNA, 21 nt, Staphylococcus aureus subsp. aureus Mu50
aguaaagggagguauauacaa

SEQ ID NO: 3956837 - RNA, 22 nt, Staphylococcus aureus subsp. aureus Mu50
aguaaagggagguauauacaau

SEQ ID NO: 3956838 - RNA, 12 nt, Staphylococcus aureus subsp. aureus Mu50
aguaaauguuuu

SEQ ID NO: 3956839 - RNA, 22 nt, Staphylococcus aureus subsp. aureus Mu50
aguaaauguuuuauguauuuau

SEQ ID NO: 3956840 - RNA, 17 nt, Staphylococcus aureus subsp. aureus Mu50
aguaacauacuauaaaa

SEQ ID NO: 3956841 - RNA, 23 nt, Staphylococcus aureus subsp. aureus Mu50
aguaacauacuauaaaaauuuau

SEQ ID NO: 3956842 - RNA, 12 nt, Staphylococcus aureus subsp. aureus Mu50
aguaacuuuguc

SEQ ID NO: 3956843 - RNA, 23 nt, Staphylococcus aureus subsp. aureus Mu50
aguaacuuugucuguauuauuau

SEQ ID NO: 3956844 - RNA, 16 nt, Staphylococcus aureus subsp. aureus Mu50
aguaagacgauuucaa

SEQ ID NO: 3956845 - RNA, 17 nt, Staphylococcus aureus subsp. aureus Mu50
aguaagauauuuccaaa

SEQ ID NO: 3956846 - RNA, 17 nt, Staphylococcus aureus subsp. aureus Mu50
aguaagauuauuuucaa

SEQ ID NO: 3956847 - RNA, 20 nt, Staphylococcus aureus subsp. aureus Mu50
aguaagauuauuuucaauua

SEQ ID NO: 3956848 - RNA, 19 nt, Staphylococcus aureus subsp. aureus Mu50
aguaagcagagccauaaug

SEQ ID NO: 3956849 - RNA, 17 nt, Staphylococcus aureus subsp. aureus Mu50
aguaaguaauaaaauaa

SEQ ID NO: 3956850 - RNA, 22 nt, Staphylococcus aureus subsp. aureus Mu50
aguaauaaaauaaaaaaaugau

SEQ ID NO: 3956851 - RNA, 15 nt, Staphylococcus aureus subsp. aureus Mu50
aguaauaacaucuaa

SEQ ID NO: 3956852 - RNA, 17 nt, Staphylococcus aureus subsp. aureus Mu50
aguaauaaguaauaauu

SEQ ID NO: 3956853 - RNA, 18 nt, Staphylococcus aureus subsp. aureus Mu50
aguaauaauauaaauaaa

SEQ ID NO: 3956854 - RNA, 15 nt, Staphylococcus aureus subsp. aureus Mu50
aguaauauauaaaag

SEQ ID NO: 3956855 - RNA, 22 nt, Staphylococcus aureus subsp. aureus Mu50
aguaauauguugcuuaucaaca

SEQ ID NO: 3956856 - RNA, 17 nt, Staphylococcus aureus subsp. aureus Mu50
aguaauauucaacuugu

SEQ ID NO: 3956857 - RNA, 17 nt, Staphylococcus aureus subsp. aureus Mu50
aguaaucaguuacucua

SEQ ID NO: 3956858 - RNA, 20 nt, Staphylococcus aureus subsp. aureus Mu50
aguaaucguaucuucacuug

SEQ ID NO: 3956859 - RNA, 20 nt, Staphylococcus aureus subsp. aureus Mu50
aguaaucuuguuuucauuua

SEQ ID NO: 3956860 - RNA, 22 nt, Staphylococcus aureus subsp. aureus Mu50
aguaaucuuguuuucauuuaaa

SEQ ID NO: 3956861 - RNA, 18 nt, Staphylococcus aureus subsp. aureus Mu50
aguaaugaccaauagcaa

SEQ ID NO: 3956862 - RNA, 23 nt, Staphylococcus aureus subsp. aureus Mu50
aguaaugaccggcauauaaucca

SEQ ID NO: 3956863 - RNA, 14 nt, Staphylococcus aureus subsp. aureus Mu50
aguaaugauuaacu

SEQ ID NO: 3956864 - RNA, 21 nt, Staphylococcus aureus subsp. aureus Mu50
aguaaugcuguacuauauuca

SEQ ID NO: 3956865 - RNA, 18 nt, Staphylococcus aureus subsp. aureus Mu50
aguaauguuccauauaac

SEQ ID NO: 3956866 - RNA, 19 nt, Staphylococcus aureus subsp. aureus Mu50
aguaauucuucaucuucuu

SEQ ID NO: 3956867 - RNA, 22 nt, Staphylococcus aureus subsp. aureus Mu50
aguaauuuucauuguuucagcu

SEQ ID NO: 3956868 - RNA, 15 nt, Staphylococcus aureus subsp. aureus Mu50
aguacaaauaacaaa

SEQ ID NO: 3956869 - RNA, 22 nt, Staphylococcus aureus subsp. aureus Mu50
aguacaaguugaucaaaaaugu

SEQ ID NO: 3956870 - RNA, 12 nt, Staphylococcus aureus subsp. aureus Mu50
aguacaauaaua

SEQ ID NO: 3956871 - RNA, 21 nt, Staphylococcus aureus subsp. aureus Mu50
aguacaauaauaccuucaauu

SEQ ID NO: 3956872 - RNA, 17 nt, Staphylococcus aureus subsp. aureus Mu50
aguacaguuaguggcau

SEQ ID NO: 3956873 - RNA, 23 nt, Staphylococcus aureus subsp. aureus Mu50
aguacauuuauuuucaauaaaua

SEQ ID NO: 3956874 - RNA, 18 nt, Staphylococcus aureus subsp. aureus Mu50
aguaccaaagaaaucacc

SEQ ID NO: 3956875 - RNA, 16 nt, Staphylococcus aureus subsp. aureus Mu50
aguaccaucucuauuu

SEQ ID NO: 3956876 - RNA, 19 nt, Staphylococcus aureus subsp. aureus Mu50
aguaccauguuuuuuaagu

SEQ ID NO: 3956877 - RNA, 16 nt, Staphylococcus aureus subsp. aureus Mu50
aguacccagaaugcga

SEQ ID NO: 3956878 - RNA, 19 nt, Staphylococcus aureus subsp. aureus Mu50
aguaccuaaaauagaaaaa

SEQ ID NO: 3956879 - RNA, 21 nt, Staphylococcus aureus subsp. aureus Mu50
aguaccuaaaauagaaaaauu

SEQ ID NO: 3956880 - RNA, 12 nt, Staphylococcus aureus subsp. aureus Mu50
aguacgauuauu

SEQ ID NO: 3956881 - RNA, 22 nt, Staphylococcus aureus subsp. aureus Mu50
aguacgauuauuuggauaauuu

SEQ ID NO: 3956882 - RNA, 16 nt, Staphylococcus aureus subsp. aureus Mu50
aguacgguuauuuaau

SEQ ID NO: 3956883 - RNA, 16 nt, Staphylococcus aureus subsp. aureus Mu50
aguacuaaaaguauga

SEQ ID NO: 3956884 - RNA, 17 nt, Staphylococcus aureus subsp. aureus Mu50
aguacuaagcuuucauu

SEQ ID NO: 3956885 - RNA, 15 nt, Staphylococcus aureus subsp. aureus Mu50
aguacucuuuuaccu

SEQ ID NO: 3956886 - RNA, 19 nt, Staphylococcus aureus subsp. aureus Mu50
aguacuuaauuuaaauugu

SEQ ID NO: 3956887 - RNA, 15 nt, Staphylococcus aureus subsp. aureus Mu50
agucgauaaguuuuu

SEQ ID NO: 3956888 - RNA, 19 nt, Staphylococcus aureus subsp. aureus Mu50
agucgcaauggcaauugau

SEQ ID NO: 3956889 - RNA, 17 nt, Staphylococcus aureus subsp. aureus Mu50
agucggggccccaacac

SEQ ID NO: 3956890 - RNA, 18 nt, Staphylococcus aureus subsp. aureus Mu50
agucggggccccaacaca

SEQ ID NO: 3956891 - RNA, 21 nt, Staphylococcus aureus subsp. aureus Mu50
agucguucaauuguugauuug

SEQ ID NO: 3956892 - RNA, 18 nt, Staphylococcus aureus subsp. aureus Mu50
agucguucucuuaaauau

SEQ ID NO: 3956893 - RNA, 19 nt, Staphylococcus aureus subsp. aureus Mu50
agucguuguugaaauuaaa

SEQ ID NO: 3956894 - RNA, 18 nt, Staphylococcus aureus subsp. aureus Mu50
agucguuuguacuucacu

SEQ ID NO: 3956895 - RNA, 14 nt, Staphylococcus aureus subsp. aureus Mu50
agucuaacaguuaa

SEQ ID NO: 3956896 - RNA, 22 nt, Staphylococcus aureus subsp. aureus Mu50
agucuacaguaaauugauucuu

SEQ ID NO: 3956897 - RNA, 20 nt, Staphylococcus aureus subsp. aureus Mu50
agucuaggacauugauuucu

SEQ ID NO: 3956898 - RNA, 13 nt, Staphylococcus aureus subsp. aureus Mu50
agucuaugaauaa

SEQ ID NO: 3956899 - RNA, 15 nt, Staphylococcus aureus subsp. aureus Mu50
agucucguaauaaug

SEQ ID NO: 3956900 - RNA, 17 nt, Staphylococcus aureus subsp. aureus Mu50
agucucuaaaacuuuuu

SEQ ID NO: 3956901 - RNA, 16 nt, Staphylococcus aureus subsp. aureus Mu50
agucucuuuugauaaa

SEQ ID NO: 3956902 - RNA, 12 nt, Staphylococcus aureus subsp. aureus Mu50
agucugcucuuu

SEQ ID NO: 3956903 - RNA, 21 nt, Staphylococcus aureus subsp. aureus Mu50
agucuguauauggcgauaaca

SEQ ID NO: 3956904 - RNA, 13 nt, Staphylococcus aureus subsp. aureus Mu50
agucuguugguuu

SEQ ID NO: 3956905 - RNA, 22 nt, Staphylococcus aureus subsp. aureus Mu50
agucuuaacaaauuaaaaaggu

SEQ ID NO: 3956906 - RNA, 22 nt, Staphylococcus aureus subsp. aureus Mu50
agucuuagacauuguaaaaugc

SEQ ID NO: 3956907 - RNA, 23 nt, Staphylococcus aureus subsp. aureus Mu50
agucuuagacauuguaaaaugcu

SEQ ID NO: 3956908 - RNA, 14 nt, Staphylococcus aureus subsp. aureus Mu50
agucuuauuuuuau

SEQ ID NO: 3956909 - RNA, 22 nt, Staphylococcus aureus subsp. aureus Mu50
agucuucuuacugcaauuauuu

SEQ ID NO: 3956910 - RNA, 20 nt, Staphylococcus aureus subsp. aureus Mu50
agucuugugauaauucuuca

SEQ ID NO: 3956911 - RNA, 18 nt, Staphylococcus aureus subsp. aureus Mu50
agucuuuacucuacacuc

SEQ ID NO: 3956912 - RNA, 20 nt, Staphylococcus aureus subsp. aureus Mu50
agucuuuuuauuuuaauauu

SEQ ID NO: 3956913 - RNA, 22 nt, Staphylococcus aureus subsp. aureus Mu50
agucuuuuuauuuuaauauuuu

SEQ ID NO: 3956914 - RNA, 18 nt, Staphylococcus aureus subsp. aureus Mu50
agugaaaacuucucuauc

SEQ ID NO: 3956915 - RNA, 13 nt, Staphylococcus aureus subsp. aureus Mu50
agugaaaagaaca

SEQ ID NO: 3956916 - RNA, 16 nt, Staphylococcus aureus subsp. aureus Mu50
agugaaaguauuagau

SEQ ID NO: 3956917 - RNA, 17 nt, Staphylococcus aureus subsp. aureus Mu50
agugaaaguauuagaua

SEQ ID NO: 3956918 - RNA, 19 nt, Staphylococcus aureus subsp. aureus Mu50
agugaaagucguuguugaa

SEQ ID NO: 3956919 - RNA, 22 nt, Staphylococcus aureus subsp. aureus Mu50
agugaaagucguuguugaaauu

SEQ ID NO: 3956920 - RNA, 14 nt, Staphylococcus aureus subsp. aureus Mu50
agugaaauaccucc

SEQ ID NO: 3956921 - RNA, 19 nt, Staphylococcus aureus subsp. aureus Mu50
agugaaauaucaagauguu

SEQ ID NO: 3956922 - RNA, 16 nt, Staphylococcus aureus subsp. aureus Mu50
agugaaaucauuuaaa

SEQ ID NO: 3956923 - RNA, 16 nt, Staphylococcus aureus subsp. aureus Mu50
agugaaguacgacggu

SEQ ID NO: 3956924 - RNA, 19 nt, Staphylococcus aureus subsp. aureus Mu50
agugaaucuaaacuauaau

SEQ ID NO: 3956925 - RNA, 22 nt, Staphylococcus aureus subsp. aureus Mu50
agugaaucuaaacuauaauaau

SEQ ID NO: 3956926 - RNA, 21 nt, Staphylococcus aureus subsp. aureus Mu50
agugaaucuucuaauuaagaa

SEQ ID NO: 3956927 - RNA, 14 nt, Staphylococcus aureus subsp. aureus Mu50
agugaccucagguu

SEQ ID NO: 3956928 - RNA, 20 nt, Staphylococcus aureus subsp. aureus Mu50
agugacuuuuauaauucuaa

SEQ ID NO: 3956929 - RNA, 16 nt, Staphylococcus aureus subsp. aureus Mu50
agugagcguauuauua

SEQ ID NO: 3956930 - RNA, 23 nt, Staphylococcus aureus subsp. aureus Mu50
agugagcguauuauuauugaaau

SEQ ID NO: 3956931 - RNA, 16 nt, Staphylococcus aureus subsp. aureus Mu50
agugauaaauaaugca

SEQ ID NO: 3956932 - RNA, 13 nt, Staphylococcus aureus subsp. aureus Mu50
agugauaauuaaa

SEQ ID NO: 3956933 - RNA, 17 nt, Staphylococcus aureus subsp. aureus Mu50
agugaucuuuuuuauau

SEQ ID NO: 3956934 - RNA, 23 nt, Staphylococcus aureus subsp. aureus Mu50
agugaugugauguguuguuuuaa

SEQ ID NO: 3956935 - RNA, 12 nt, Staphylococcus aureus subsp. aureus Mu50
agugauucccaa

SEQ ID NO: 3956936 - RNA, 14 nt, Staphylococcus aureus subsp. aureus Mu50
agugauuuaaaaaa

SEQ ID NO: 3956937 - RNA, 15 nt, Staphylococcus aureus subsp. aureus Mu50
agugauuuaaaaaau

SEQ ID NO: 3956938 - RNA, 21 nt, Staphylococcus aureus subsp. aureus Mu50
agugcaaguaauuuaauuggu

SEQ ID NO: 3956939 - RNA, 18 nt, Staphylococcus aureus subsp. aureus Mu50
agugcaaguccaaauaau

SEQ ID NO: 3956940 - RNA, 13 nt, Staphylococcus aureus subsp. aureus Mu50
agugcaauuauuu

SEQ ID NO: 3956941 - RNA, 14 nt, Staphylococcus aureus subsp. aureus Mu50
agugcaauuauuuc

SEQ ID NO: 3956942 - RNA, 14 nt, Staphylococcus aureus subsp. aureus Mu50
agugcauuuuuuau

SEQ ID NO: 3956943 - RNA, 21 nt, Staphylococcus aureus subsp. aureus Mu50
agugcauuuuuuauuuuacuu

SEQ ID NO: 3956944 - RNA, 22 nt, Staphylococcus aureus subsp. aureus Mu50
agugccuugccaugauuuaagg

SEQ ID NO: 3956945 - RNA, 13 nt, Staphylococcus aureus subsp. aureus Mu50
agugcuaagaggu

SEQ ID NO: 3956946 - RNA, 16 nt, Staphylococcus aureus subsp. aureus Mu50
agugcucuugcaauag

SEQ ID NO: 3956947 - RNA, 18 nt, Staphylococcus aureus subsp. aureus Mu50
agugcucuugcaauagca

SEQ ID NO: 3956948 - RNA, 21 nt, Staphylococcus aureus subsp. aureus Mu50
agugcuuauuuguuuauuagu

SEQ ID NO: 3956949 - RNA, 14 nt, Staphylococcus aureus subsp. aureus Mu50
agugcuuccauuaa

SEQ ID NO: 3956950 - RNA, 19 nt, Staphylococcus aureus subsp. aureus Mu50
agugcuugauuaacauuuu

SEQ ID NO: 3956951 - RNA, 12 nt, Staphylococcus aureus subsp. aureus Mu50
agugcuuuuuca

SEQ ID NO: 3956952 - RNA, 16 nt, Staphylococcus aureus subsp. aureus Mu50
agugcuuuuucaaaau

SEQ ID NO: 3956953 - RNA, 21 nt, Staphylococcus aureus subsp. aureus Mu50
aguggaaaggaggagauuguu

SEQ ID NO: 3956954 - RNA, 13 nt, Staphylococcus aureus subsp. aureus Mu50
aguggaaaugaua

SEQ ID NO: 3956955 - RNA, 17 nt, Staphylococcus aureus subsp. aureus Mu50
aguggaagacaaugauu

SEQ ID NO: 3956956 - RNA, 13 nt, Staphylococcus aureus subsp. aureus Mu50
aguggauuacaga

SEQ ID NO: 3956957 - RNA, 24 nt, Staphylococcus aureus subsp. aureus Mu50
aguggauuuucucccauacugauu

SEQ ID NO: 3956958 - RNA, 13 nt, Staphylococcus aureus subsp. aureus Mu50
aguggcaaacauu

SEQ ID NO: 3956959 - RNA, 15 nt, Staphylococcus aureus subsp. aureus Mu50
aguggcaaacauuuc

SEQ ID NO: 3956960 - RNA, 17 nt, Staphylococcus aureus subsp. aureus Mu50
agugguaaaaaguuuaa

SEQ ID NO: 3956961 - RNA, 20 nt, Staphylococcus aureus subsp. aureus Mu50
agugguaaaaaguuuaaagu

SEQ ID NO: 3956962 - RNA, 22 nt, Staphylococcus aureus subsp. aureus Mu50
agugguagccaauaucauauuu

SEQ ID NO: 3956963 - RNA, 23 nt, Staphylococcus aureus subsp. aureus Mu50
agugguuguaggcuuuuuauuuu

SEQ ID NO: 3956964 - RNA, 22 nt, Staphylococcus aureus subsp. aureus Mu50
agugguuguucccauuuuuaaa

SEQ ID NO: 3956965 - RNA, 18 nt, Staphylococcus aureus subsp. aureus Mu50
agugguuuucuuuauuuu

SEQ ID NO: 3956966 - RNA, 21 nt, Staphylococcus aureus subsp. aureus Mu50
agugguuuucuuuauuuuaaa

SEQ ID NO: 3956967 - RNA, 16 nt, Staphylococcus aureus subsp. aureus Mu50
aguguagcacaagauu

SEQ ID NO: 3956968 - RNA, 19 nt, Staphylococcus aureus subsp. aureus Mu50
aguguagccaaauaaauuu

SEQ ID NO: 3956969 - RNA, 19 nt, Staphylococcus aureus subsp. aureus Mu50
aguguagggggcauuauua

SEQ ID NO: 3956970 - RNA, 14 nt, Staphylococcus aureus subsp. aureus Mu50
aguguauucauuuu

SEQ ID NO: 3956971 - RNA, 14 nt, Staphylococcus aureus subsp. aureus Mu50
agugucacaaagaa

SEQ ID NO: 3956972 - RNA, 21 nt, Staphylococcus aureus subsp. aureus Mu50
agugucaugcuuaauuuaugu

SEQ ID NO: 3956973 - RNA, 16 nt, Staphylococcus aureus subsp. aureus Mu50
agugucgagauuuuau

SEQ ID NO: 3956974 - RNA, 13 nt, Staphylococcus aureus subsp. aureus Mu50
aguuguugcaaau

SEQ ID NO: 3956975 - RNA, 15 nt, Staphylococcus aureus subsp. aureus Mu50
aguuguugcaacuug

SEQ ID NO: 3956976 - RNA, 14 nt, Staphylococcus aureus subsp. aureus Mu50
aguuguugcuuugg

SEQ ID NO: 3956977 - RNA, 21 nt, Staphylococcus aureus subsp. aureus Mu50
aguuguuucuccaguuuuugg

SEQ ID NO: 3956978 - RNA, 11 nt, Staphylococcus aureus subsp. aureus Mu50
aguuuaaaaau

SEQ ID NO: 3956979 - RNA, 14 nt, Staphylococcus aureus subsp. aureus Mu50
aguuuaaaguauaa

SEQ ID NO: 3956980 - RNA, 13 nt, Staphylococcus aureus subsp. aureus Mu50
aguuuaacaauac

SEQ ID NO: 3956981 - RNA, 12 nt, Staphylococcus aureus subsp. aureus Mu50
aguuuaagucua

SEQ ID NO: 3956982 - RNA, 19 nt, Staphylococcus aureus subsp. aureus Mu50
aguuuacagguugaauaaa

SEQ ID NO: 3956983 - RNA, 16 nt, Staphylococcus aureus subsp. aureus Mu50
aguuuacgaucauaaa

SEQ ID NO: 3956984 - RNA, 19 nt, Staphylococcus aureus subsp. aureus Mu50
aguuuagguugauuucugc

SEQ ID NO: 3956985 - RNA, 13 nt, Staphylococcus aureus subsp. aureus Mu50
aguuuauuaauau

SEQ ID NO: 3956986 - RNA, 19 nt, Staphylococcus aureus subsp. aureus Mu50
aguuuauuaauauuaguga

SEQ ID NO: 3956987 - RNA, 23 nt, Staphylococcus aureus subsp. aureus Mu50
aguuuauugccgguuaaauuauu

SEQ ID NO: 3956988 - RNA, 19 nt, Staphylococcus aureus subsp. aureus Mu50
aguuucaaucgcauuuugu

SEQ ID NO: 3956989 - RNA, 21 nt, Staphylococcus aureus subsp. aureus Mu50
aguuucaucaaguauaaaugu

SEQ ID NO: 3956990 - RNA, 22 nt, Staphylococcus aureus subsp. aureus Mu50
aguuucaucaaguauaaauguu

SEQ ID NO: 3956991 - RNA, 20 nt, Staphylococcus aureus subsp. aureus Mu50
aguuuccauaaauaaaaugc

SEQ ID NO: 3956992 - RNA, 22 nt, Staphylococcus aureus subsp. aureus Mu50
aguuuccauaaauaaaaugcua

SEQ ID NO: 3956993 - RNA, 17 nt, Staphylococcus aureus subsp. aureus Mu50
aguuuccauauuuuuua

SEQ ID NO: 3956994 - RNA, 14 nt, Staphylococcus aureus subsp. aureus Mu50
aguuucggaaaaag

SEQ ID NO: 3956995 - RNA, 20 nt, Staphylococcus aureus subsp. aureus Mu50
aguuucggaaaaagaugaaa

SEQ ID NO: 3956996 - RNA, 20 nt, Staphylococcus aureus subsp. aureus Mu50
aguuucguuguacaguaaua

SEQ ID NO: 3956997 - RNA, 14 nt, Staphylococcus aureus subsp. aureus Mu50
aguuucguuuucaa

SEQ ID NO: 3956998 - RNA, 19 nt, Staphylococcus aureus subsp. aureus Mu50
aguuucuacuguauaagug

SEQ ID NO: 3956999 - RNA, 20 nt, Staphylococcus aureus subsp. aureus Mu50
aguuucuauagaauuuuuca

SEQ ID NO: 3957000 - RNA, 22 nt, Staphylococcus aureus subsp. aureus Mu50
aguuucugacuuuuaaaaaaca

SEQ ID NO: 3957001 - RNA, 14 nt, Staphylococcus aureus subsp. aureus Mu50
aguuucugagaaga

SEQ ID NO: 3957002 - RNA, 18 nt, Staphylococcus aureus subsp. aureus Mu50
aguuucugagaagaaaua

SEQ ID NO: 3957003 - RNA, 17 nt, Staphylococcus aureus subsp. aureus Mu50
aguuugaaggugauaau

SEQ ID NO: 3957004 - RNA, 16 nt, Staphylococcus aureus subsp. aureus Mu50
aguuugaaucauuuga

SEQ ID NO: 3957005 - RNA, 22 nt, Staphylococcus aureus subsp. aureus Mu50
aguuugauaugcucucuucaaa

SEQ ID NO: 3957006 - RNA, 17 nt, Staphylococcus aureus subsp. aureus Mu50
aguuugaucauaauuca

SEQ ID NO: 3957007 - RNA, 14 nt, Staphylococcus aureus subsp. aureus Mu50
aguuuguaauaauu

SEQ ID NO: 3957008 - RNA, 14 nt, Staphylococcus aureus subsp. aureus Mu50
aguuuguaauauug

SEQ ID NO: 3957009 - RNA, 17 nt, Staphylococcus aureus subsp. aureus Mu50
aguuuguccuuuaagaa

SEQ ID NO: 3957010 - RNA, 16 nt, Staphylococcus aureus subsp. aureus Mu50
aguuuguuuucuuucg

SEQ ID NO: 3957011 - RNA, 14 nt, Staphylococcus aureus subsp. aureus Mu50
aguuuuaaugaacu

SEQ ID NO: 3957012 - RNA, 16 nt, Staphylococcus aureus subsp. aureus Mu50
aguuuuacugagggau

SEQ ID NO: 3957013 - RNA, 17 nt, Staphylococcus aureus subsp. aureus Mu50
aguuuucaauuuauuaa

SEQ ID NO: 3957014 - RNA, 15 nt, Staphylococcus aureus subsp. aureus Mu50
aguuuucucuauuga

SEQ ID NO: 3957015 - RNA, 16 nt, Staphylococcus aureus subsp. aureus Mu50
aguuuucuucacugcu

SEQ ID NO: 3957016 - RNA, 17 nt, Staphylococcus aureus subsp. aureus Mu50
aguuuugaaccuaaauu

SEQ ID NO: 3957017 - RNA, 19 nt, Staphylococcus aureus subsp. aureus Mu50
aguuuuggucaaguaaaug

SEQ ID NO: 3957018 - RNA, 13 nt, Staphylococcus aureus subsp. aureus Mu50
aguuuuuaaaauu

SEQ ID NO: 3957019 - RNA, 16 nt, Staphylococcus aureus subsp. aureus Mu50
aguuuuuaaaauuauc

SEQ ID NO: 3957020 - RNA, 14 nt, Staphylococcus aureus subsp. aureus Mu50
aguuuuuaaaucaa

SEQ ID NO: 3957021 - RNA, 20 nt, Staphylococcus aureus subsp. aureus Mu50
aguuuuucaggguuuaagau

SEQ ID NO: 3957022 - RNA, 13 nt, Staphylococcus aureus subsp. aureus Mu50
aguuuuuuaaaau

SEQ ID NO: 3957023 - RNA, 20 nt, Staphylococcus aureus subsp. aureus Mu50
aguuuuuuaaaauaaugaua

SEQ ID NO: 3957024 - RNA, 21 nt, Staphylococcus aureus subsp. aureus Mu50
aguuuuuuaaaauaaugauau

SEQ ID NO: 3957025 - RNA, 22 nt, Staphylococcus aureus subsp. aureus Mu50
aguuuuuuaaaauaaugauaua

SEQ ID NO: 3957026 - RNA, 20 nt, Staphylococcus aureus subsp. aureus Mu50
aguuuuuuagucucguaaua

SEQ ID NO: 3957027 - RNA, 19 nt, Staphylococcus aureus subsp. aureus Mu50
aguuuuuuuaaaguuuaaa

SEQ ID NO: 3957028 - RNA, 15 nt, Staphylococcus aureus subsp. aureus Mu50
aguuuuuuuauaagc

SEQ ID NO: 3957029 - RNA, 13 nt, Staphylococcus aureus subsp. aureus Mu50
auaaaaaaagaga

SEQ ID NO: 3957030 - RNA, 14 nt, Staphylococcus aureus subsp. aureus Mu50
auaaaaaaagagac

SEQ ID NO: 3957031 - RNA, 14 nt, Staphylococcus aureus subsp. aureus Mu50
auaaaaaaaucccu

SEQ ID NO: 3957032 - RNA, 17 nt, Staphylococcus aureus subsp. aureus Mu50
auaaaaaaccaagugca

SEQ ID NO: 3957033 - RNA, 19 nt, Staphylococcus aureus subsp. aureus Mu50
auaaaaaacgguacagaua

SEQ ID NO: 3957034 - RNA, 14 nt, Staphylococcus aureus subsp. aureus Mu50
auaaaaaaucuuuu

SEQ ID NO: 3957035 - RNA, 19 nt, Staphylococcus aureus subsp. aureus Mu50
auaaaaacaaaagaaaguu

SEQ ID NO: 3957036 - RNA, 19 nt, Staphylococcus aureus subsp. aureus Mu50
auaaaaacucuaaaaguug

SEQ ID NO: 3957037 - RNA, 21 nt, Staphylococcus aureus subsp. aureus Mu50
auaaaaaggagcgacaaugga

SEQ ID NO: 3957038 - RNA, 16 nt, Staphylococcus aureus subsp. aureus Mu50
auaaaaagugaaagua

SEQ ID NO: 3957039 - RNA, 18 nt, Staphylococcus aureus subsp. aureus Mu50
auaaaaagugaaaguauu

SEQ ID NO: 3957040 - RNA, 13 nt, Staphylococcus aureus subsp. aureus Mu50
auaaaaaucuuau

SEQ ID NO: 3957041 - RNA, 18 nt, Staphylococcus aureus subsp. aureus Mu50
auaaaaaucuuaugaugu

SEQ ID NO: 3957042 - RNA, 19 nt, Staphylococcus aureus subsp. aureus Mu50
auaaaaaucuuaugauguc

SEQ ID NO: 3957043 - RNA, 16 nt, Staphylococcus aureus subsp. aureus Mu50
auaaaaaugcucaagu

SEQ ID NO: 3957044 - RNA, 17 nt, Staphylococcus aureus subsp. aureus Mu50
auaaaaauuauauaaau

SEQ ID NO: 3957045 - RNA, 13 nt, Staphylococcus aureus subsp. aureus Mu50
auaaaaauuuauu

SEQ ID NO: 3957046 - RNA, 15 nt, Staphylococcus aureus subsp. aureus Mu50
auaaaaauuuauuca

SEQ ID NO: 3957047 - RNA, 17 nt, Staphylococcus aureus subsp. aureus Mu50
auaaaaauuuauucaaa

SEQ ID NO: 3957048 - RNA, 14 nt, Staphylococcus aureus subsp. aureus Mu50
auaaaacaaauuau

SEQ ID NO: 3957049 - RNA, 13 nt, Staphylococcus aureus subsp. aureus Mu50
auaaaacagaauu

SEQ ID NO: 3957050 - RNA, 23 nt, Staphylococcus aureus subsp. aureus Mu50
auaaaacaguaaguaauaaaaua

SEQ ID NO: 3957051 - RNA, 15 nt, Staphylococcus aureus subsp. aureus Mu50
auaaaacaucaucgu

SEQ ID NO: 3957052 - RNA, 16 nt, Staphylococcus aureus subsp. aureus Mu50
auaaaaccgguacuuu

SEQ ID NO: 3957053 - RNA, 20 nt, Staphylococcus aureus subsp. aureus Mu50
auaaaacuaaugauaguaca

SEQ ID NO: 3957054 - RNA, 16 nt, Staphylococcus aureus subsp. aureus Mu50
auaaaacuauguguau

SEQ ID NO: 3957055 - RNA, 22 nt, Staphylococcus aureus subsp. aureus Mu50
auaaaacuauguguauaugugg

SEQ ID NO: 3957056 - RNA, 15 nt, Staphylococcus aureus subsp. aureus Mu50
auaaaacuuauaacu

SEQ ID NO: 3957057 - RNA, 14 nt, Staphylococcus aureus subsp. aureus Mu50
auaaaagcaacaau

SEQ ID NO: 3957058 - RNA, 15 nt, Staphylococcus aureus subsp. aureus Mu50
auaaaagccaugaua

SEQ ID NO: 3957059 - RNA, 20 nt, Staphylococcus aureus subsp. aureus Mu50
auaaaagccaugauacgaug

SEQ ID NO: 3957060 - RNA, 17 nt, Staphylococcus aureus subsp. aureus Mu50
auaaaagcccaccuaaa

SEQ ID NO: 3957061 - RNA, 19 nt, Staphylococcus aureus subsp. aureus Mu50
auaaaagccucuaaugauu

SEQ ID NO: 3957062 - RNA, 22 nt, Staphylococcus aureus subsp. aureus Mu50
auaaaucauuaguuguaucagu

SEQ ID NO: 3957063 - RNA, 21 nt, Staphylococcus aureus subsp. aureus Mu50
auaaaucauucuuuauagaaa

SEQ ID NO: 3957064 - RNA, 20 nt, Staphylococcus aureus subsp. aureus Mu50
auaaauccuaagucuuuuaa

SEQ ID NO: 3957065 - RNA, 15 nt, Staphylococcus aureus subsp. aureus Mu50
auaaaucgauaaaau

SEQ ID NO: 3957066 - RNA, 18 nt, Staphylococcus aureus subsp. aureus Mu50
auaaaucguguuaauucu

SEQ ID NO: 3957067 - RNA, 19 nt, Staphylococcus aureus subsp. aureus Mu50
auaaaucuaauacuuucaa

SEQ ID NO: 3957068 - RNA, 15 nt, Staphylococcus aureus subsp. aureus Mu50
auaaaugaauugucu

SEQ ID NO: 3957069 - RNA, 15 nt, Staphylococcus aureus subsp. aureus Mu50
auaaaugacauuuaa

SEQ ID NO: 3957070 - RNA, 19 nt, Staphylococcus aureus subsp. aureus Mu50
auaaaugacauuuaauacu

SEQ ID NO: 3957071 - RNA, 17 nt, Staphylococcus aureus subsp. aureus Mu50
auaaaugacugaauuaa

SEQ ID NO: 3957072 - RNA, 13 nt, Staphylococcus aureus subsp. aureus Mu50
auaaaugauuaaa

SEQ ID NO: 3957073 - RNA, 20 nt, Staphylococcus aureus subsp. aureus Mu50
auaaaugcacaaacaaaagc

SEQ ID NO: 3957074 - RNA, 19 nt, Staphylococcus aureus subsp. aureus Mu50
auaaaugcuauauuuagaa

SEQ ID NO: 3957075 - RNA, 13 nt, Staphylococcus aureus subsp. aureus Mu50
auaaaugucacug

SEQ ID NO: 3957076 - RNA, 16 nt, Staphylococcus aureus subsp. aureus Mu50
auaaaugucauaguau

SEQ ID NO: 3957077 - RNA, 22 nt, Staphylococcus aureus subsp. aureus Mu50
auaaauguccgacuugauaaaa

SEQ ID NO: 3957078 - RNA, 22 nt, Staphylococcus aureus subsp. aureus Mu50
auaaauguuaaagauuauuauu

SEQ ID NO: 3957079 - RNA, 22 nt, Staphylococcus aureus subsp. aureus Mu50
auaaauguuauuaaccaucaug

SEQ ID NO: 3957080 - RNA, 19 nt, Staphylococcus aureus subsp. aureus Mu50
auaaauguuauugcuuauu

SEQ ID NO: 3957081 - RNA, 19 nt, Staphylococcus aureus subsp. aureus Mu50
auaaauuaaaugcaauaca

SEQ ID NO: 3957082 - RNA, 21 nt, Staphylococcus aureus subsp. aureus Mu50
auaaauuaaaugcaauacauu

SEQ ID NO: 3957083 - RNA, 13 nt, Staphylococcus aureus subsp. aureus Mu50
auaaauuaaauuu

SEQ ID NO: 3957084 - RNA, 15 nt, Staphylococcus aureus subsp. aureus Mu50
auaaauuaaauuuug

SEQ ID NO: 3957085 - RNA, 15 nt, Staphylococcus aureus subsp. aureus Mu50
auaaauuaauugcuu

SEQ ID NO: 3957086 - RNA, 16 nt, Staphylococcus aureus subsp. aureus Mu50
auaaauuacccacauc

SEQ ID NO: 3957087 - RNA, 15 nt, Staphylococcus aureus subsp. aureus Mu50
auaaauuagaugaaa

SEQ ID NO: 3957088 - RNA, 16 nt, Staphylococcus aureus subsp. aureus Mu50
auaaauuagaugaaau

SEQ ID NO: 3957089 - RNA, 17 nt, Staphylococcus aureus subsp. aureus Mu50
auaaauuagaugaaaug

SEQ ID NO: 3957090 - RNA, 18 nt, Staphylococcus aureus subsp. aureus Mu50
auaaauuaggucauuuuu

SEQ ID NO: 3957091 - RNA, 14 nt, Staphylococcus aureus subsp. aureus Mu50
auaaauuaguuuuu

SEQ ID NO: 3957092 - RNA, 23 nt, Staphylococcus aureus subsp. aureus Mu50
auaaauuauauuuauuuguacau

SEQ ID NO: 3957093 - RNA, 16 nt, Staphylococcus aureus subsp. aureus Mu50
auaaauucccauguau

SEQ ID NO: 3957094 - RNA, 20 nt, Staphylococcus aureus subsp. aureus Mu50
auaaauugaaguacauuaaa

SEQ ID NO: 3957095 - RNA, 21 nt, Staphylococcus aureus subsp. aureus Mu50
auaaauugaaguacauuaaaa

SEQ ID NO: 3957096 - RNA, 22 nt, Staphylococcus aureus subsp. aureus Mu50
auaaauugaaguacauuaaaac

SEQ ID NO: 3957097 - RNA, 20 nt, Staphylococcus aureus subsp. aureus Mu50
auaaauugaguuuuuuaaaa

SEQ ID NO: 3957098 - RNA, 23 nt, Staphylococcus aureus subsp. aureus Mu50
auaaauugaguuuuuuaaaauaa

SEQ ID NO: 3957099 - RNA, 17 nt, Staphylococcus aureus subsp. aureus Mu50
auaaauuguaugaauaa

SEQ ID NO: 3957100 - RNA, 22 nt, Staphylococcus aureus subsp. aureus Mu50
auaaauuuagauauuauaaaaa

SEQ ID NO: 3957101 - RNA, 16 nt, Staphylococcus aureus subsp. aureus Mu50
auaaauuucaagguau

SEQ ID NO: 3957102 - RNA, 22 nt, Staphylococcus aureus subsp. aureus Mu50
auaaauuucaagguauacacaa

SEQ ID NO: 3957103 - RNA, 19 nt, Staphylococcus aureus subsp. aureus Mu50
auaaauuugguacauaaua

SEQ ID NO: 3957104 - RNA, 21 nt, Staphylococcus aureus subsp. aureus Mu50
auaaauuuguaccaaauaaau

SEQ ID NO: 3957105 - RNA, 23 nt, Staphylococcus aureus subsp. aureus Mu50
auaaauuuucuguuuaauuaaaa

SEQ ID NO: 3957106 - RNA, 21 nt, Staphylococcus aureus subsp. aureus Mu50
auaaauuuugaauuacagauu

SEQ ID NO: 3957107 - RNA, 18 nt, Staphylococcus aureus subsp. aureus Mu50
auaaauuuuuaguuaaag

SEQ ID NO: 3957108 - RNA, 13 nt, Staphylococcus aureus subsp. aureus Mu50
auaacaaaaauug

SEQ ID NO: 3957109 - RNA, 17 nt, Staphylococcus aureus subsp. aureus Mu50
auaacaaaaauugcuau

SEQ ID NO: 3957110 - RNA, 23 nt, Staphylococcus aureus subsp. aureus Mu50
auaacaaaaauugcuauauuagu

SEQ ID NO: 3957111 - RNA, 18 nt, Staphylococcus aureus subsp. aureus Mu50
auaacaaaauuaaauaug

SEQ ID NO: 3957112 - RNA, 16 nt, Staphylococcus aureus subsp. aureus Mu50
auaacaacgauaauug

SEQ ID NO: 3957113 - RNA, 18 nt, Staphylococcus aureus subsp. aureus Mu50
auaacaacuacuuaaauu

SEQ ID NO: 3957114 - RNA, 14 nt, Staphylococcus aureus subsp. aureus Mu50
auaacaagaaguaa

SEQ ID NO: 3957115 - RNA, 17 nt, Staphylococcus aureus subsp. aureus Mu50
auaacaagaaguaaugu

SEQ ID NO: 3957116 - RNA, 20 nt, Staphylococcus aureus subsp. aureus Mu50
auaacaaguauaaaugcagc

SEQ ID NO: 3957117 - RNA, 22 nt, Staphylococcus aureus subsp. aureus Mu50
auaacaauagugacuuuuauaa

SEQ ID NO: 3957118 - RNA, 22 nt, Staphylococcus aureus subsp. aureus Mu50
auaacaaugcagcuguauuuaa

SEQ ID NO: 3957119 - RNA, 13 nt, Staphylococcus aureus subsp. aureus Mu50
auaacaauuuuaa

SEQ ID NO: 3957120 - RNA, 14 nt, Staphylococcus aureus subsp. aureus Mu50
auaacaauuuuaaa

SEQ ID NO: 3957121 - RNA, 21 nt, Staphylococcus aureus subsp. aureus Mu50
auaacaauuuuaaaucuuuua

SEQ ID NO: 3957122 - RNA, 15 nt, Staphylococcus aureus subsp. aureus Mu50
auaacaccaauuaaa

SEQ ID NO: 3957123 - RNA, 17 nt, Staphylococcus aureus subsp. aureus Mu50
auaacaccaauuaaauc

SEQ ID NO: 3957124 - RNA, 13 nt, Staphylococcus aureus subsp. aureus Mu50
auaacaccuacug

SEQ ID NO: 3957125 - RNA, 15 nt, Staphylococcus aureus subsp. aureus Mu50
auaacaccuuucauu

SEQ ID NO: 3957126 - RNA, 18 nt, Staphylococcus aureus subsp. aureus Mu50
auaacaccuuucauuugg

SEQ ID NO: 3957127 - RNA, 14 nt, Staphylococcus aureus subsp. aureus Mu50
auaacacgauaauu

SEQ ID NO: 3957128 - RNA, 18 nt, Staphylococcus aureus subsp. aureus Mu50
auaacaguuaauuauacc

SEQ ID NO: 3957129 - RNA, 19 nt, Staphylococcus aureus subsp. aureus Mu50
auaacaguuaauuauaccg

SEQ ID NO: 3957130 - RNA, 21 nt, Staphylococcus aureus subsp. aureus Mu50
auaacauccccuucuugagca

SEQ ID NO: 3957131 - RNA, 15 nt, Staphylococcus aureus subsp. aureus Mu50
auaacaucuaaauuu

SEQ ID NO: 3957132 - RNA, 16 nt, Staphylococcus aureus subsp. aureus Mu50
auaacaugaccuaaua

SEQ ID NO: 3957133 - RNA, 17 nt, Staphylococcus aureus subsp. aureus Mu50
auaacauuaaaaugaua

SEQ ID NO: 3957134 - RNA, 17 nt, Staphylococcus aureus subsp. aureus Mu50
auaacauucuucaaaaa

SEQ ID NO: 3957135 - RNA, 20 nt, Staphylococcus aureus subsp. aureus Mu50
auaacauucuucaaaaaaua

SEQ ID NO: 3957136 - RNA, 22 nt, Staphylococcus aureus subsp. aureus Mu50
auaacauucuucaaaaaauaau

SEQ ID NO: 3957137 - RNA, 23 nt, Staphylococcus aureus subsp. aureus Mu50
auaacauucuucaaaaaauaaua

SEQ ID NO: 3957138 - RNA, 12 nt, Staphylococcus aureus subsp. aureus Mu50
auaacauuuaag

SEQ ID NO: 3957139 - RNA, 17 nt, Staphylococcus aureus subsp. aureus Mu50
auaaccaaaccauaagu

SEQ ID NO: 3957140 - RNA, 14 nt, Staphylococcus aureus subsp. aureus Mu50
auaaccauaaugaa

SEQ ID NO: 3957141 - RNA, 17 nt, Staphylococcus aureus subsp. aureus Mu50
auaaccauaguaauaaa

SEQ ID NO: 3957142 - RNA, 18 nt, Staphylococcus aureus subsp. aureus Mu50
auaaccauaguaauaaaa

SEQ ID NO: 3957143 - RNA, 20 nt, Staphylococcus aureus subsp. aureus Mu50
auaaccauaguaauaaaaug

SEQ ID NO: 3957144 - RNA, 16 nt, Staphylococcus aureus subsp. aureus Mu50
auaaccauuucaucau

SEQ ID NO: 3957145 - RNA, 16 nt, Staphylococcus aureus subsp. aureus Mu50
auaacccauuuucaaa

SEQ ID NO: 3957146 - RNA, 18 nt, Staphylococcus aureus subsp. aureus Mu50
auaacccauuuucaaaac

SEQ ID NO: 3957147 - RNA, 14 nt, Staphylococcus aureus subsp. aureus Mu50
auaaccgaaauauu

SEQ ID NO: 3957148 - RNA, 15 nt, Staphylococcus aureus subsp. aureus Mu50
auaaccuagguuaaa

SEQ ID NO: 3957149 - RNA, 19 nt, Staphylococcus aureus subsp. aureus Mu50
auaauacuacauauaaugc

SEQ ID NO: 3957150 - RNA, 16 nt, Staphylococcus aureus subsp. aureus Mu50
auaauacuguauuuua

SEQ ID NO: 3957151 - RNA, 18 nt, Staphylococcus aureus subsp. aureus Mu50
auaauacuguauuuuaac

SEQ ID NO: 3957152 - RNA, 15 nt, Staphylococcus aureus subsp. aureus Mu50
auaauacuguuuaaa

SEQ ID NO: 3957153 - RNA, 17 nt, Staphylococcus aureus subsp. aureus Mu50
auaauacuguuuaaaua

SEQ ID NO: 3957154 - RNA, 17 nt, Staphylococcus aureus subsp. aureus Mu50
auaauagaaagcgcauu

SEQ ID NO: 3957155 - RNA, 14 nt, Staphylococcus aureus subsp. aureus Mu50
auaauagacuuaua

SEQ ID NO: 3957156 - RNA, 19 nt, Staphylococcus aureus subsp. aureus Mu50
auaauagacuuauauuaau

SEQ ID NO: 3957157 - RNA, 15 nt, Staphylococcus aureus subsp. aureus Mu50
auaauagauaauagu

SEQ ID NO: 3957158 - RNA, 14 nt, Staphylococcus aureus subsp. aureus Mu50
auaauagcaaaauu

SEQ ID NO: 3957159 - RNA, 15 nt, Staphylococcus aureus subsp. aureus Mu50
auaauagcaaaauua

SEQ ID NO: 3957160 - RNA, 17 nt, Staphylococcus aureus subsp. aureus Mu50
auaauagcaaaauuaug

SEQ ID NO: 3957161 - RNA, 18 nt, Staphylococcus aureus subsp. aureus Mu50
auaauagccauucgaugc

SEQ ID NO: 3957162 - RNA, 15 nt, Staphylococcus aureus subsp. aureus Mu50
auaauauaaaaacaa

SEQ ID NO: 3957163 - RNA, 17 nt, Staphylococcus aureus subsp. aureus Mu50
auaauauaaaaacaaaa

SEQ ID NO: 3957164 - RNA, 15 nt, Staphylococcus aureus subsp. aureus Mu50
auaauauaaaacgau

SEQ ID NO: 3957165 - RNA, 16 nt, Staphylococcus aureus subsp. aureus Mu50
auaauauaaauaaaag

SEQ ID NO: 3957166 - RNA, 14 nt, Staphylococcus aureus subsp. aureus Mu50
auaauauacacaaa

SEQ ID NO: 3957167 - RNA, 16 nt, Staphylococcus aureus subsp. aureus Mu50
auaauauacacaaaaa

SEQ ID NO: 3957168 - RNA, 20 nt, Staphylococcus aureus subsp. aureus Mu50
auaauauuaaauugcguacu

SEQ ID NO: 3957169 - RNA, 19 nt, Staphylococcus aureus subsp. aureus Mu50
auaauauugaugaauaaau

SEQ ID NO: 3957170 - RNA, 15 nt, Staphylococcus aureus subsp. aureus Mu50
auaauauuggacuuu

SEQ ID NO: 3957171 - RNA, 18 nt, Staphylococcus aureus subsp. aureus Mu50
auaauauuucuuaccauu

SEQ ID NO: 3957172 - RNA, 22 nt, Staphylococcus aureus subsp. aureus Mu50
auaaucaaaccaccaaaaauca

SEQ ID NO: 3957173 - RNA, 23 nt, Staphylococcus aureus subsp. aureus Mu50
auaaucaacaaagugcaauuauu

SEQ ID NO: 3957174 - RNA, 18 nt, Staphylococcus aureus subsp. aureus Mu50
auaaucaagaauauaagu

SEQ ID NO: 3957175 - RNA, 13 nt, Staphylococcus aureus subsp. aureus Mu50
auaaucacauuaa

SEQ ID NO: 3957176 - RNA, 21 nt, Staphylococcus aureus subsp. aureus Mu50
auaaucacuuggcgacauuug

SEQ ID NO: 3957177 - RNA, 22 nt, Staphylococcus aureus subsp. aureus Mu50
auaaucacuuggcgacauuugu

SEQ ID NO: 3957178 - RNA, 13 nt, Staphylococcus aureus subsp. aureus Mu50
auaaucauccaua

SEQ ID NO: 3957179 - RNA, 18 nt, Staphylococcus aureus subsp. aureus Mu50
auaaucauccauauaugc

SEQ ID NO: 3957180 - RNA, 15 nt, Staphylococcus aureus subsp. aureus Mu50
auaaucauuaguuau

SEQ ID NO: 3957181 - RNA, 13 nt, Staphylococcus aureus subsp. aureus Mu50
auaaucauuuaaa

SEQ ID NO: 3957182 - RNA, 21 nt, Staphylococcus aureus subsp. aureus Mu50
auaauccaagauauauaacua

SEQ ID NO: 3957183 - RNA, 17 nt, Staphylococcus aureus subsp. aureus Mu50
auaauccauucuucuug

SEQ ID NO: 3957184 - RNA, 19 nt, Staphylococcus aureus subsp. aureus Mu50
auaauccauucuucuuguu

SEQ ID NO: 3957185 - RNA, 21 nt, Staphylococcus aureus subsp. aureus Mu50
auaauccgagucauacucauc

SEQ ID NO: 3957186 - RNA, 16 nt, Staphylococcus aureus subsp. aureus Mu50
auaaucgaacauaaau

SEQ ID NO: 3957187 - RNA, 18 nt, Staphylococcus aureus subsp. aureus Mu50
auaaucgaacauaaauaa

SEQ ID NO: 3957188 - RNA, 20 nt, Staphylococcus aureus subsp. aureus Mu50
auaaucgaacauaaauaaac

SEQ ID NO: 3957189 - RNA, 20 nt, Staphylococcus aureus subsp. aureus Mu50
auaaucguauucauaucauu

SEQ ID NO: 3957190 - RNA, 22 nt, Staphylococcus aureus subsp. aureus Mu50
auaaucguuaaaacacccugcu

SEQ ID NO: 3957191 - RNA, 18 nt, Staphylococcus aureus subsp. aureus Mu50
auaaucucauucuuuaau

SEQ ID NO: 3957192 - RNA, 21 nt, Staphylococcus aureus subsp. aureus Mu50
auaaucucauucuuuaauaua

SEQ ID NO: 3957193 - RNA, 15 nt, Staphylococcus aureus subsp. aureus Mu50
auaaucucuucaauu

SEQ ID NO: 3957194 - RNA, 19 nt, Staphylococcus aureus subsp. aureus Mu50
auaaucucuucaauuuauu

SEQ ID NO: 3957195 - RNA, 12 nt, Staphylococcus aureus subsp. aureus Mu50
auaaucucuuua

SEQ ID NO: 3957196 - RNA, 14 nt, Staphylococcus aureus subsp. aureus Mu50
auaaucuucaguau

SEQ ID NO: 3957197 - RNA, 14 nt, Staphylococcus aureus subsp. aureus Mu50
auaaucuuuaacau

SEQ ID NO: 3957198 - RNA, 15 nt, Staphylococcus aureus subsp. aureus Mu50
auaaucuuuaacauu

SEQ ID NO: 3957199 - RNA, 16 nt, Staphylococcus aureus subsp. aureus Mu50
auaaucuuuauuaaua

SEQ ID NO: 3957200 - RNA, 13 nt, Staphylococcus aureus subsp. aureus Mu50
auaaucuuuuuua

SEQ ID NO: 3957201 - RNA, 15 nt, Staphylococcus aureus subsp. aureus Mu50
auaaucuuuuuuacu

SEQ ID NO: 3957202 - RNA, 16 nt, Staphylococcus aureus subsp. aureus Mu50
auaaucuuuuuuacua

SEQ ID NO: 3957203 - RNA, 17 nt, Staphylococcus aureus subsp. aureus Mu50
auaaugaacaacaaauu

SEQ ID NO: 3957204 - RNA, 15 nt, Staphylococcus aureus subsp. aureus Mu50
auaaugaacgauauu

SEQ ID NO: 3957205 - RNA, 21 nt, Staphylococcus aureus subsp. aureus Mu50
auaaugaacgauauucuacau

SEQ ID NO: 3957206 - RNA, 19 nt, Staphylococcus aureus subsp. aureus Mu50
auaaugaauaauuaaaaaa

SEQ ID NO: 3957207 - RNA, 14 nt, Staphylococcus aureus subsp. aureus Mu50
auaaugaauaguaa

SEQ ID NO: 3957208 - RNA, 15 nt, Staphylococcus aureus subsp. aureus Mu50
auaaugaauaguaau

SEQ ID NO: 3957209 - RNA, 16 nt, Staphylococcus aureus subsp. aureus Mu50
auaaugaauucauuca

SEQ ID NO: 3957210 - RNA, 17 nt, Staphylococcus aureus subsp. aureus Mu50
auaaugacgagaauuaa

SEQ ID NO: 3957211 - RNA, 18 nt, Staphylococcus aureus subsp. aureus Mu50
auaaugacucaagugaau

SEQ ID NO: 3957212 - RNA, 14 nt, Staphylococcus aureus subsp. aureus Mu50
auaaugaucaagua

SEQ ID NO: 3957213 - RNA, 18 nt, Staphylococcus aureus subsp. aureus Mu50
auaaugcagauucuucac

SEQ ID NO: 3957214 - RNA, 14 nt, Staphylococcus aureus subsp. aureus Mu50
auaaugcuauauuu

SEQ ID NO: 3957215 - RNA, 15 nt, Staphylococcus aureus subsp. aureus Mu50
auaaugcuauauuuc

SEQ ID NO: 3957216 - RNA, 14 nt, Staphylococcus aureus subsp. aureus Mu50
auaauggacgguau

SEQ ID NO: 3957217 - RNA, 16 nt, Staphylococcus aureus subsp. aureus Mu50
auaaugggaauuguau

SEQ ID NO: 3957218 - RNA, 15 nt, Staphylococcus aureus subsp. aureus Mu50
auaaugguucuauaa

SEQ ID NO: 3957219 - RNA, 20 nt, Staphylococcus aureus subsp. aureus Mu50
auaaugguucucugucaaau

SEQ ID NO: 3957220 - RNA, 21 nt, Staphylococcus aureus subsp. aureus Mu50
auaauguaagcgaauacaaua

SEQ ID NO: 3957221 - RNA, 13 nt, Staphylococcus aureus subsp. aureus Mu50
auaauguacacuu

SEQ ID NO: 3957222 - RNA, 16 nt, Staphylococcus aureus subsp. aureus Mu50
auaauguacauguaua

SEQ ID NO: 3957223 - RNA, 18 nt, Staphylococcus aureus subsp. aureus Mu50
auaauguacauguauaaa

SEQ ID NO: 3957224 - RNA, 16 nt, Staphylococcus aureus subsp. aureus Mu50
auaauguauaaaacag

SEQ ID NO: 3957225 - RNA, 19 nt, Staphylococcus aureus subsp. aureus Mu50
auaauguauaaaacagaau

SEQ ID NO: 3957226 - RNA, 22 nt, Staphylococcus aureus subsp. aureus Mu50
auaauguauaaaacagaauuuc

SEQ ID NO: 3957227 - RNA, 13 nt, Staphylococcus aureus subsp. aureus Mu50
auaauguaucauu

SEQ ID NO: 3957228 - RNA, 16 nt, Staphylococcus aureus subsp. aureus Mu50
auaaugucuuacuuuu

SEQ ID NO: 3957229 - RNA, 20 nt, Staphylococcus aureus subsp. aureus Mu50
auaaugucuuacuuuuaaau

SEQ ID NO: 3957230 - RNA, 22 nt, Staphylococcus aureus subsp. aureus Mu50
auaaugucuuacuuuuaaauua

SEQ ID NO: 3957231 - RNA, 14 nt, Staphylococcus aureus subsp. aureus Mu50
auaauguucccuua

SEQ ID NO: 3957232 - RNA, 20 nt, Staphylococcus aureus subsp. aureus Mu50
auaauguuuccugauauuuc

SEQ ID NO: 3957233 - RNA, 15 nt, Staphylococcus aureus subsp. aureus Mu50
auaauuaaacauuua

SEQ ID NO: 3957234 - RNA, 18 nt, Staphylococcus aureus subsp. aureus Mu50
auaauuaaacuaauagca

SEQ ID NO: 3957235 - RNA, 12 nt, Staphylococcus aureus subsp. aureus Mu50
auaauuaaauaa

SEQ ID NO: 3957236 - RNA, 16 nt, Staphylococcus aureus subsp. aureus Mu50
auaauuaaauaaaaau

SEQ ID NO: 3957237 - RNA, 20 nt, Staphylococcus aureus subsp. aureus Mu50
auacauaucggcccauaaua

SEQ ID NO: 3957238 - RNA, 23 nt, Staphylococcus aureus subsp. aureus Mu50
auacauaucggcccauaauagcu

SEQ ID NO: 3957239 - RNA, 12 nt, Staphylococcus aureus subsp. aureus Mu50
auacauaucuuu

SEQ ID NO: 3957240 - RNA, 22 nt, Staphylococcus aureus subsp. aureus Mu50
auacaucggaauucaaccaauu

SEQ ID NO: 3957241 - RNA, 17 nt, Staphylococcus aureus subsp. aureus Mu50
auacaugccaauggaag

SEQ ID NO: 3957242 - RNA, 16 nt, Staphylococcus aureus subsp. aureus Mu50
auacaugguacugcuu

SEQ ID NO: 3957243 - RNA, 19 nt, Staphylococcus aureus subsp. aureus Mu50
auacaugugggauaucuuc

SEQ ID NO: 3957244 - RNA, 16 nt, Staphylococcus aureus subsp. aureus Mu50
auacauuaauauaaau

SEQ ID NO: 3957245 - RNA, 12 nt, Staphylococcus aureus subsp. aureus Mu50
auacauuauuaa

SEQ ID NO: 3957246 - RNA, 21 nt, Staphylococcus aureus subsp. aureus Mu50
auacauuccaaaguaccaucu

SEQ ID NO: 3957247 - RNA, 12 nt, Staphylococcus aureus subsp. aureus Mu50
auacauugauaa

SEQ ID NO: 3957248 - RNA, 17 nt, Staphylococcus aureus subsp. aureus Mu50
auacauugauaaauuuu

SEQ ID NO: 3957249 - RNA, 13 nt, Staphylococcus aureus subsp. aureus Mu50
auacauuucaaaa

SEQ ID NO: 3957250 - RNA, 15 nt, Staphylococcus aureus subsp. aureus Mu50
auacauuucaaaaaa

SEQ ID NO: 3957251 - RNA, 20 nt, Staphylococcus aureus subsp. aureus Mu50
auacauuuugcucuaaacuu

SEQ ID NO: 3957252 - RNA, 12 nt, Staphylococcus aureus subsp. aureus Mu50
auacauuuuuau

SEQ ID NO: 3957253 - RNA, 14 nt, Staphylococcus aureus subsp. aureus Mu50
auaccaaaaacauu

SEQ ID NO: 3957254 - RNA, 16 nt, Staphylococcus aureus subsp. aureus Mu50
auaccaaaaacauuaa

SEQ ID NO: 3957255 - RNA, 18 nt, Staphylococcus aureus subsp. aureus Mu50
auaccaaacugccuaaua

SEQ ID NO: 3957256 - RNA, 22 nt, Staphylococcus aureus subsp. aureus Mu50
auaccaaccaaaaccaaaugaa

SEQ ID NO: 3957257 - RNA, 21 nt, Staphylococcus aureus subsp. aureus Mu50
auaccaacugucgguucaucu

SEQ ID NO: 3957258 - RNA, 14 nt, Staphylococcus aureus subsp. aureus Mu50
auaccaauaauuac

SEQ ID NO: 3957259 - RNA, 22 nt, Staphylococcus aureus subsp. aureus Mu50
auaccaauugcugauauaauag

SEQ ID NO: 3957260 - RNA, 16 nt, Staphylococcus aureus subsp. aureus Mu50
auaccaauuguuucag

SEQ ID NO: 3957261 - RNA, 18 nt, Staphylococcus aureus subsp. aureus Mu50
auaccacacuuuaaacaa

SEQ ID NO: 3957262 - RNA, 19 nt, Staphylococcus aureus subsp. aureus Mu50
auaccacacuuuaaacaag

SEQ ID NO: 3957263 - RNA, 21 nt, Staphylococcus aureus subsp. aureus Mu50
auaccacaucgcauaauaucu

SEQ ID NO: 3957264 - RNA, 22 nt, Staphylococcus aureus subsp. aureus Mu50
auaccacgacucauuagauaaa

SEQ ID NO: 3957265 - RNA, 19 nt, Staphylococcus aureus subsp. aureus Mu50
auaccacuugaauacuuuu

SEQ ID NO: 3957266 - RNA, 22 nt, Staphylococcus aureus subsp. aureus Mu50
auaccacuugaauacuuuuuaa

SEQ ID NO: 3957267 - RNA, 19 nt, Staphylococcus aureus subsp. aureus Mu50
auaccaguggaaauuaugu

SEQ ID NO: 3957268 - RNA, 13 nt, Staphylococcus aureus subsp. aureus Mu50
auaccauaauuaa

SEQ ID NO: 3957269 - RNA, 16 nt, Staphylococcus aureus subsp. aureus Mu50
auaccauuccaaaaau

SEQ ID NO: 3957270 - RNA, 17 nt, Staphylococcus aureus subsp. aureus Mu50
auaccauugugaugaua

SEQ ID NO: 3957271 - RNA, 20 nt, Staphylococcus aureus subsp. aureus Mu50
auaccauugugaugauaauu

SEQ ID NO: 3957272 - RNA, 22 nt, Staphylococcus aureus subsp. aureus Mu50
auaccauugugaugauaauuaa

SEQ ID NO: 3957273 - RNA, 18 nt, Staphylococcus aureus subsp. aureus Mu50
auacccgcgauacugcca

SEQ ID NO: 3957274 - RNA, 17 nt, Staphylococcus aureus subsp. aureus Mu50
auacccuacuauauauc

SEQ ID NO: 3957275 - RNA, 17 nt, Staphylococcus aureus subsp. aureus Mu50
auaccggcaaauaacaa

SEQ ID NO: 3957276 - RNA, 17 nt, Staphylococcus aureus subsp. aureus Mu50
auaccuaaaauacccau

SEQ ID NO: 3957277 - RNA, 14 nt, Staphylococcus aureus subsp. aureus Mu50
auaccuaauugcuu

SEQ ID NO: 3957278 - RNA, 16 nt, Staphylococcus aureus subsp. aureus Mu50
auaccuaccacaauaa

SEQ ID NO: 3957279 - RNA, 20 nt, Staphylococcus aureus subsp. aureus Mu50
auaccucauccgccaauuaa

SEQ ID NO: 3957280 - RNA, 13 nt, Staphylococcus aureus subsp. aureus Mu50
auaccucuacauu

SEQ ID NO: 3957281 - RNA, 16 nt, Staphylococcus aureus subsp. aureus Mu50
auaccucuacauuaua

SEQ ID NO: 3957282 - RNA, 15 nt, Staphylococcus aureus subsp. aureus Mu50
auaccugcauauuca

SEQ ID NO: 3957283 - RNA, 22 nt, Staphylococcus aureus subsp. aureus Mu50
auaccugguucgauuguaauaa

SEQ ID NO: 3957284 - RNA, 12 nt, Staphylococcus aureus subsp. aureus Mu50
auaccuuuaaua

SEQ ID NO: 3957285 - RNA, 14 nt, Staphylococcus aureus subsp. aureus Mu50
auaccuuuaauauc

SEQ ID NO: 3957286 - RNA, 15 nt, Staphylococcus aureus subsp. aureus Mu50
auaccuuuaauaucu

SEQ ID NO: 3957287 - RNA, 12 nt, Staphylococcus aureus subsp. aureus Mu50
auaccuuuaauu

SEQ ID NO: 3957288 - RNA, 19 nt, Staphylococcus aureus subsp. aureus Mu50
auaccuuuacuuucauuac

SEQ ID NO: 3957289 - RNA, 14 nt, Staphylococcus aureus subsp. aureus Mu50
auaccuuuauuauu

SEQ ID NO: 3957290 - RNA, 19 nt, Staphylococcus aureus subsp. aureus Mu50
auaccuuugccguauuuca

SEQ ID NO: 3957291 - RNA, 21 nt, Staphylococcus aureus subsp. aureus Mu50
auaccuuuuaauuuaguuaua

SEQ ID NO: 3957292 - RNA, 19 nt, Staphylococcus aureus subsp. aureus Mu50
auaccuuuugcuagugcuu

SEQ ID NO: 3957293 - RNA, 14 nt, Staphylococcus aureus subsp. aureus Mu50
auaccuuuuucuaa

SEQ ID NO: 3957294 - RNA, 16 nt, Staphylococcus aureus subsp. aureus Mu50
auaccuuuuucuacca

SEQ ID NO: 3957295 - RNA, 22 nt, Staphylococcus aureus subsp. aureus Mu50
auaccuuuuucuaccaauaauu

SEQ ID NO: 3957296 - RNA, 14 nt, Staphylococcus aureus subsp. aureus Mu50
auacgaauuaaaau

SEQ ID NO: 3957297 - RNA, 16 nt, Staphylococcus aureus subsp. aureus Mu50
auacgaauuaaaauaa

SEQ ID NO: 3957298 - RNA, 13 nt, Staphylococcus aureus subsp. aureus Mu50
auacgacaaucac

SEQ ID NO: 3957299 - RNA, 14 nt, Staphylococcus aureus subsp. aureus Mu50
auacgacuugaaau

SEQ ID NO: 3957300 - RNA, 23 nt, Staphylococcus aureus subsp. aureus Mu50
auacgacuugaaaucuuuuguaa

SEQ ID NO: 3957301 - RNA, 16 nt, Staphylococcus aureus subsp. aureus Mu50
auacgauugcaauugc

SEQ ID NO: 3957302 - RNA, 22 nt, Staphylococcus aureus subsp. aureus Mu50
auacgcaaucauuguaaaugau

SEQ ID NO: 3957303 - RNA, 15 nt, Staphylococcus aureus subsp. aureus Mu50
auacgcaaugauuau

SEQ ID NO: 3957304 - RNA, 12 nt, Staphylococcus aureus subsp. aureus Mu50
auacgccaaaua

SEQ ID NO: 3957305 - RNA, 18 nt, Staphylococcus aureus subsp. aureus Mu50
auacgccuaaauauuuac

SEQ ID NO: 3957306 - RNA, 20 nt, Staphylococcus aureus subsp. aureus Mu50
auacgcgcuucaucaaugga

SEQ ID NO: 3957307 - RNA, 14 nt, Staphylococcus aureus subsp. aureus Mu50
auacgcuuuuuaaa

SEQ ID NO: 3957308 - RNA, 15 nt, Staphylococcus aureus subsp. aureus Mu50
auacgcuuuuuaaaa

SEQ ID NO: 3957309 - RNA, 19 nt, Staphylococcus aureus subsp. aureus Mu50
auacgcuuuuuaaaaaauu

SEQ ID NO: 3957310 - RNA, 20 nt, Staphylococcus aureus subsp. aureus Mu50
auacguaaacacuuuaguau

SEQ ID NO: 3957311 - RNA, 13 nt, Staphylococcus aureus subsp. aureus Mu50
auacguaaauggu

SEQ ID NO: 3957312 - RNA, 17 nt, Staphylococcus aureus subsp. aureus Mu50
auacguaucaaaauuuu

SEQ ID NO: 3957313 - RNA, 15 nt, Staphylococcus aureus subsp. aureus Mu50
auacgugcuuuaaag

SEQ ID NO: 3957314 - RNA, 16 nt, Staphylococcus aureus subsp. aureus Mu50
auacgugcuuuaaagu

SEQ ID NO: 3957315 - RNA, 22 nt, Staphylococcus aureus subsp. aureus Mu50
auacguguguuuucuuuucaaa

SEQ ID NO: 3957316 - RNA, 20 nt, Staphylococcus aureus subsp. aureus Mu50
auacguuauuucaauaauaa

SEQ ID NO: 3957317 - RNA, 18 nt, Staphylococcus aureus subsp. aureus Mu50
auacguugauguaauucu

SEQ ID NO: 3957318 - RNA, 19 nt, Staphylococcus aureus subsp. aureus Mu50
auacguugauguaauucug

SEQ ID NO: 3957319 - RNA, 17 nt, Staphylococcus aureus subsp. aureus Mu50
auacguuuccaaucuau

SEQ ID NO: 3957320 - RNA, 21 nt, Staphylococcus aureus subsp. aureus Mu50
auacguuuugcuaauucaaga

SEQ ID NO: 3957321 - RNA, 17 nt, Staphylococcus aureus subsp. aureus Mu50
auacuaaauugagaagu

SEQ ID NO: 3957322 - RNA, 15 nt, Staphylococcus aureus subsp. aureus Mu50
auacuaaauuugaaa

SEQ ID NO: 3957323 - RNA, 13 nt, Staphylococcus aureus subsp. aureus Mu50
auacuaacaauua

SEQ ID NO: 3957324 - RNA, 13 nt, Staphylococcus aureus subsp. aureus Mu50
auacuaacuauau

SEQ ID NO: 3957325 - RNA, 17 nt, Staphylococcus aureus subsp. aureus Mu50
auagaugcauaaaaacc

SEQ ID NO: 3957326 - RNA, 18 nt, Staphylococcus aureus subsp. aureus Mu50
auagaugcauaaaaaccu

SEQ ID NO: 3957327 - RNA, 22 nt, Staphylococcus aureus subsp. aureus Mu50
auagaugcuaauguaaucugaa

SEQ ID NO: 3957328 - RNA, 20 nt, Staphylococcus aureus subsp. aureus Mu50
auagaugugucuuuuauuau

SEQ ID NO: 3957329 - RNA, 15 nt, Staphylococcus aureus subsp. aureus Mu50
auagauuauauuauc

SEQ ID NO: 3957330 - RNA, 17 nt, Staphylococcus aureus subsp. aureus Mu50
auagauuauauuaucau

SEQ ID NO: 3957331 - RNA, 19 nt, Staphylococcus aureus subsp. aureus Mu50
auagauucugauacagaac

SEQ ID NO: 3957332 - RNA, 13 nt, Staphylococcus aureus subsp. aureus Mu50
auagauugaaaaa

SEQ ID NO: 3957333 - RNA, 21 nt, Staphylococcus aureus subsp. aureus Mu50
auagauugccauucauacacu

SEQ ID NO: 3957334 - RNA, 19 nt, Staphylococcus aureus subsp. aureus Mu50
auagauuguauuuaauaag

SEQ ID NO: 3957335 - RNA, 19 nt, Staphylococcus aureus subsp. aureus Mu50
auagcaaaauuauguaaaa

SEQ ID NO: 3957336 - RNA, 21 nt, Staphylococcus aureus subsp. aureus Mu50
auagcaaaauuauguaaaaaa

SEQ ID NO: 3957337 - RNA, 18 nt, Staphylococcus aureus subsp. aureus Mu50
auagcaaccauauuuuua

SEQ ID NO: 3957338 - RNA, 19 nt, Staphylococcus aureus subsp. aureus Mu50
auagcaaccauauuuuuag

SEQ ID NO: 3957339 - RNA, 17 nt, Staphylococcus aureus subsp. aureus Mu50
auagcaauuuucgauau

SEQ ID NO: 3957340 - RNA, 24 nt, Staphylococcus aureus subsp. aureus Mu50
auagcagggugcuaaauuuacgaa

SEQ ID NO: 3957341 - RNA, 20 nt, Staphylococcus aureus subsp. aureus Mu50
auagcagguggcauccauau

SEQ ID NO: 3957342 - RNA, 21 nt, Staphylococcus aureus subsp. aureus Mu50
auagcauaaaaagagguuuuc

SEQ ID NO: 3957343 - RNA, 22 nt, Staphylococcus aureus subsp. aureus Mu50
auagcaucuaugauuguaugac

SEQ ID NO: 3957344 - RNA, 22 nt, Staphylococcus aureus subsp. aureus Mu50
auagcauuucuuuauuagaaug

SEQ ID NO: 3957345 - RNA, 19 nt, Staphylococcus aureus subsp. aureus Mu50
auagccguuaacaucagua

SEQ ID NO: 3957346 - RNA, 17 nt, Staphylococcus aureus subsp. aureus Mu50
auagccuauuuaaaaga

SEQ ID NO: 3957347 - RNA, 20 nt, Staphylococcus aureus subsp. aureus Mu50
auagcgcucuggauuuuucu

SEQ ID NO: 3957348 - RNA, 23 nt, Staphylococcus aureus subsp. aureus Mu50
auagcgcucuggauuuuucuuau

SEQ ID NO: 3957349 - RNA, 21 nt, Staphylococcus aureus subsp. aureus Mu50
auagcggugugaauugauuuu

SEQ ID NO: 3957350 - RNA, 14 nt, Staphylococcus aureus subsp. aureus Mu50
auagcgguuuaaaa

SEQ ID NO: 3957351 - RNA, 16 nt, Staphylococcus aureus subsp. aureus Mu50
auagcguaauuauuau

SEQ ID NO: 3957352 - RNA, 13 nt, Staphylococcus aureus subsp. aureus Mu50
auagcgugauuuu

SEQ ID NO: 3957353 - RNA, 15 nt, Staphylococcus aureus subsp. aureus Mu50
auagcuaaacauuuu

SEQ ID NO: 3957354 - RNA, 15 nt, Staphylococcus aureus subsp. aureus Mu50
auagcuaaagcuugc

SEQ ID NO: 3957355 - RNA, 13 nt, Staphylococcus aureus subsp. aureus Mu50
auagcuaaauaaa

SEQ ID NO: 3957356 - RNA, 17 nt, Staphylococcus aureus subsp. aureus Mu50
auagcuaaugcauuauu

SEQ ID NO: 3957357 - RNA, 18 nt, Staphylococcus aureus subsp. aureus Mu50
auagcuaaugcauuauua

SEQ ID NO: 3957358 - RNA, 14 nt, Staphylococcus aureus subsp. aureus Mu50
auagcuacaauuaa

SEQ ID NO: 3957359 - RNA, 13 nt, Staphylococcus aureus subsp. aureus Mu50
auagcuauauuua

SEQ ID NO: 3957360 - RNA, 18 nt, Staphylococcus aureus subsp. aureus Mu50
auagcuauuacuauaaaa

SEQ ID NO: 3957361 - RNA, 16 nt, Staphylococcus aureus subsp. aureus Mu50
auagcucuauggcuuc

SEQ ID NO: 3957362 - RNA, 21 nt, Staphylococcus aureus subsp. aureus Mu50
auagcucuucuuuuucuugca

SEQ ID NO: 3957363 - RNA, 22 nt, Staphylococcus aureus subsp. aureus Mu50
auagcuuucguuucuuuuauau

SEQ ID NO: 3957364 - RNA, 17 nt, Staphylococcus aureus subsp. aureus Mu50
auaggaaacuuaaauau

SEQ ID NO: 3957365 - RNA, 15 nt, Staphylococcus aureus subsp. aureus Mu50
auaggaauacaugag

SEQ ID NO: 3957366 - RNA, 18 nt, Staphylococcus aureus subsp. aureus Mu50
auaggaauacaugaguaa

SEQ ID NO: 3957367 - RNA, 22 nt, Staphylococcus aureus subsp. aureus Mu50
auaggauauuuuuuaauaauca

SEQ ID NO: 3957368 - RNA, 19 nt, Staphylococcus aureus subsp. aureus Mu50
auaggauuuacaccuauac

SEQ ID NO: 3957369 - RNA, 24 nt, Staphylococcus aureus subsp. aureus Mu50
auaggauuuacaccuauaccucgu

SEQ ID NO: 3957370 - RNA, 24 nt, Staphylococcus aureus subsp. aureus Mu50
auaggauuugcaccuauaccucgu

SEQ ID NO: 3957371 - RNA, 17 nt, Staphylococcus aureus subsp. aureus Mu50
auaggcgcgaaaugacc

SEQ ID NO: 3957372 - RNA, 18 nt, Staphylococcus aureus subsp. aureus Mu50
auaggcuugccaauguga

SEQ ID NO: 3957373 - RNA, 14 nt, Staphylococcus aureus subsp. aureus Mu50
auagguaacuaaaa

SEQ ID NO: 3957374 - RNA, 14 nt, Staphylococcus aureus subsp. aureus Mu50
auagguauaagaau

SEQ ID NO: 3957375 - RNA, 15 nt, Staphylococcus aureus subsp. aureus Mu50
auagguauaaucauu

SEQ ID NO: 3957376 - RNA, 17 nt, Staphylococcus aureus subsp. aureus Mu50
auaggugauuauauaua

SEQ ID NO: 3957377 - RNA, 22 nt, Staphylococcus aureus subsp. aureus Mu50
auaggugauuauauauauuaaa

SEQ ID NO: 3957378 - RNA, 17 nt, Staphylococcus aureus subsp. aureus Mu50
auaggugcaguuaaauu

SEQ ID NO: 3957379 - RNA, 19 nt, Staphylococcus aureus subsp. aureus Mu50
auagguucaucuuuaugca

SEQ ID NO: 3957380 - RNA, 19 nt, Staphylococcus aureus subsp. aureus Mu50
auaguaaaauaaauacaau

SEQ ID NO: 3957381 - RNA, 17 nt, Staphylococcus aureus subsp. aureus Mu50
auaguaaagugaaauaa

SEQ ID NO: 3957382 - RNA, 18 nt, Staphylococcus aureus subsp. aureus Mu50
auaguaagguuugaacuc

SEQ ID NO: 3957383 - RNA, 16 nt, Staphylococcus aureus subsp. aureus Mu50
auaguaauaaaagucg

SEQ ID NO: 3957384 - RNA, 13 nt, Staphylococcus aureus subsp. aureus Mu50
auaguaauaaaau

SEQ ID NO: 3957385 - RNA, 19 nt, Staphylococcus aureus subsp. aureus Mu50
auaguaauaaaaugaugau

SEQ ID NO: 3957386 - RNA, 13 nt, Staphylococcus aureus subsp. aureus Mu50
auaguaaucgauu

SEQ ID NO: 3957387 - RNA, 23 nt, Staphylococcus aureus subsp. aureus Mu50
auaguaaucucucgcuaaauuua

SEQ ID NO: 3957388 - RNA, 14 nt, Staphylococcus aureus subsp. aureus Mu50
auaguaauuguuau

SEQ ID NO: 3957389 - RNA, 19 nt, Staphylococcus aureus subsp. aureus Mu50
auaguaccaagcuucauua

SEQ ID NO: 3957390 - RNA, 19 nt, Staphylococcus aureus subsp. aureus Mu50
auaguacuaagcuuucauu

SEQ ID NO: 3957391 - RNA, 19 nt, Staphylococcus aureus subsp. aureus Mu50
auaguacuuaauuuaaauu

SEQ ID NO: 3957392 - RNA, 19 nt, Staphylococcus aureus subsp. aureus Mu50
auaguaggguauugaaaua

SEQ ID NO: 3957393 - RNA, 23 nt, Staphylococcus aureus subsp. aureus Mu50
auaguauuaacuauaaauagaag

SEQ ID NO: 3957394 - RNA, 14 nt, Staphylococcus aureus subsp. aureus Mu50
auagucacuuuuaa

SEQ ID NO: 3957395 - RNA, 20 nt, Staphylococcus aureus subsp. aureus Mu50
auagucauaacgauuguugc

SEQ ID NO: 3957396 - RNA, 23 nt, Staphylococcus aureus subsp. aureus Mu50
auaguccggggccccaacaaaga

SEQ ID NO: 3957397 - RNA, 14 nt, Staphylococcus aureus subsp. aureus Mu50
auaguccuucccac

SEQ ID NO: 3957398 - RNA, 17 nt, Staphylococcus aureus subsp. aureus Mu50
auagugcuuuuucaaaa

SEQ ID NO: 3957399 - RNA, 16 nt, Staphylococcus aureus subsp. aureus Mu50
auagugguaaaaaguu

SEQ ID NO: 3957400 - RNA, 18 nt, Staphylococcus aureus subsp. aureus Mu50
auagugguaaaaaguuua

SEQ ID NO: 3957401 - RNA, 23 nt, Staphylococcus aureus subsp. aureus Mu50
auagugguaaaaaguuuaaagua

SEQ ID NO: 3957402 - RNA, 18 nt, Staphylococcus aureus subsp. aureus Mu50
auaguggugguacuuuuu

SEQ ID NO: 3957403 - RNA, 18 nt, Staphylococcus aureus subsp. aureus Mu50
auagugugucauaaugaa

SEQ ID NO: 3957404 - RNA, 14 nt, Staphylococcus aureus subsp. aureus Mu50
auaguuaccaaaau

SEQ ID NO: 3957405 - RNA, 15 nt, Staphylococcus aureus subsp. aureus Mu50
auaguuaccaaaauu

SEQ ID NO: 3957406 - RNA, 18 nt, Staphylococcus aureus subsp. aureus Mu50
auaguuauuaaaucuuuu

SEQ ID NO: 3957407 - RNA, 17 nt, Staphylococcus aureus subsp. aureus Mu50
auaguucaaaauacuca

SEQ ID NO: 3957408 - RNA, 22 nt, Staphylococcus aureus subsp. aureus Mu50
auaguucaaauugaacuucuuu

SEQ ID NO: 3957409 - RNA, 14 nt, Staphylococcus aureus subsp. aureus Mu50
auaguucuauauaa

SEQ ID NO: 3957410 - RNA, 20 nt, Staphylococcus aureus subsp. aureus Mu50
auaguucuuuaaauuauaua

SEQ ID NO: 3957411 - RNA, 19 nt, Staphylococcus aureus subsp. aureus Mu50
auaguugaucaaaaagaca

SEQ ID NO: 3957412 - RNA, 13 nt, Staphylococcus aureus subsp. aureus Mu50
auauaugaaauau

SEQ ID NO: 3957413 - RNA, 14 nt, Staphylococcus aureus subsp. aureus Mu50
auauaugaaauauu

SEQ ID NO: 3957414 - RNA, 15 nt, Staphylococcus aureus subsp. aureus Mu50
auauaugaaauauuu

SEQ ID NO: 3957415 - RNA, 14 nt, Staphylococcus aureus subsp. aureus Mu50
auauaugauaaaua

SEQ ID NO: 3957416 - RNA, 16 nt, Staphylococcus aureus subsp. aureus Mu50
auauauguaacauaaa

SEQ ID NO: 3957417 - RNA, 19 nt, Staphylococcus aureus subsp. aureus Mu50
auauauguaacauaaagcu

SEQ ID NO: 3957418 - RNA, 20 nt, Staphylococcus aureus subsp. aureus Mu50
auauauguauaacauuauua

SEQ ID NO: 3957419 - RNA, 15 nt, Staphylococcus aureus subsp. aureus Mu50
auauauuaaaguaaa

SEQ ID NO: 3957420 - RNA, 19 nt, Staphylococcus aureus subsp. aureus Mu50
auauauuaacaacuuuauu

SEQ ID NO: 3957421 - RNA, 14 nt, Staphylococcus aureus subsp. aureus Mu50
auauauuauaaccc

SEQ ID NO: 3957422 - RNA, 20 nt, Staphylococcus aureus subsp. aureus Mu50
auauauucaauaauuauuaa

SEQ ID NO: 3957423 - RNA, 23 nt, Staphylococcus aureus subsp. aureus Mu50
auauauugacucgaccuuuauau

SEQ ID NO: 3957424 - RNA, 22 nt, Staphylococcus aureus subsp. aureus Mu50
auauauugucgacuuuuagauu

SEQ ID NO: 3957425 - RNA, 13 nt, Staphylococcus aureus subsp. aureus Mu50
auaucaaaaaaua

SEQ ID NO: 3957426 - RNA, 13 nt, Staphylococcus aureus subsp. aureus Mu50
auaucaaauacau

SEQ ID NO: 3957427 - RNA, 14 nt, Staphylococcus aureus subsp. aureus Mu50
auaucaaauacauu

SEQ ID NO: 3957428 - RNA, 23 nt, Staphylococcus aureus subsp. aureus Mu50
auaucaaauuggacugaugcauu

SEQ ID NO: 3957429 - RNA, 14 nt, Staphylococcus aureus subsp. aureus Mu50
auaucaagauguuu

SEQ ID NO: 3957430 - RNA, 11 nt, Staphylococcus aureus subsp. aureus Mu50
auaucaauaau

SEQ ID NO: 3957431 - RNA, 16 nt, Staphylococcus aureus subsp. aureus Mu50
auaucaauaaugcugc

SEQ ID NO: 3957432 - RNA, 18 nt, Staphylococcus aureus subsp. aureus Mu50
auaucaauaauucguuga

SEQ ID NO: 3957433 - RNA, 21 nt, Staphylococcus aureus subsp. aureus Mu50
auaucaauuuauuauuaacug

SEQ ID NO: 3957434 - RNA, 18 nt, Staphylococcus aureus subsp. aureus Mu50
auaucaauuuuuacuaaa

SEQ ID NO: 3957435 - RNA, 16 nt, Staphylococcus aureus subsp. aureus Mu50
auaucacaacacauaa

SEQ ID NO: 3957436 - RNA, 21 nt, Staphylococcus aureus subsp. aureus Mu50
auaucacaacacauaaauuaa

SEQ ID NO: 3957437 - RNA, 14 nt, Staphylococcus aureus subsp. aureus Mu50
auaucaccuuuuuu

SEQ ID NO: 3957438 - RNA, 16 nt, Staphylococcus aureus subsp. aureus Mu50
auaucaccuuuuuuaa

SEQ ID NO: 3957439 - RNA, 19 nt, Staphylococcus aureus subsp. aureus Mu50
auaucacugaaugcuaaua

SEQ ID NO: 3957440 - RNA, 21 nt, Staphylococcus aureus subsp. aureus Mu50
auaucagcuuguuucagguuu

SEQ ID NO: 3957441 - RNA, 15 nt, Staphylococcus aureus subsp. aureus Mu50
auaucagcuuuuuca

SEQ ID NO: 3957442 - RNA, 15 nt, Staphylococcus aureus subsp. aureus Mu50
auaucaguaauaaua

SEQ ID NO: 3957443 - RNA, 20 nt, Staphylococcus aureus subsp. aureus Mu50
auaucaguaauaauacgcuu

SEQ ID NO: 3957444 - RNA, 15 nt, Staphylococcus aureus subsp. aureus Mu50
auaucauacgcaacu

SEQ ID NO: 3957445 - RNA, 16 nt, Staphylococcus aureus subsp. aureus Mu50
auaucauauaaugguu

SEQ ID NO: 3957446 - RNA, 18 nt, Staphylococcus aureus subsp. aureus Mu50
auaucauauucaaaauaa

SEQ ID NO: 3957447 - RNA, 23 nt, Staphylococcus aureus subsp. aureus Mu50
auaucauauucaaaauaacuuau

SEQ ID NO: 3957448 - RNA, 15 nt, Staphylococcus aureus subsp. aureus Mu50
auaucaucauuuaaa

SEQ ID NO: 3957449 - RNA, 17 nt, Staphylococcus aureus subsp. aureus Mu50
auaucaucauuuaaaua

SEQ ID NO: 3957450 - RNA, 14 nt, Staphylococcus aureus subsp. aureus Mu50
auaucaucucuaug

SEQ ID NO: 3957451 - RNA, 17 nt, Staphylococcus aureus subsp. aureus Mu50
auaucaugcaaaacuaa

SEQ ID NO: 3957452 - RNA, 15 nt, Staphylococcus aureus subsp. aureus Mu50
auaucaugcaaaaua

SEQ ID NO: 3957453 - RNA, 13 nt, Staphylococcus aureus subsp. aureus Mu50
auaucauucugug

SEQ ID NO: 3957454 - RNA, 21 nt, Staphylococcus aureus subsp. aureus Mu50
auaucauucuguguaaauaua

SEQ ID NO: 3957455 - RNA, 17 nt, Staphylococcus aureus subsp. aureus Mu50
auauccauuaugaugua

SEQ ID NO: 3957456 - RNA, 20 nt, Staphylococcus aureus subsp. aureus Mu50
auauccauucaauguuuaau

SEQ ID NO: 3957457 - RNA, 17 nt, Staphylococcus aureus subsp. aureus Mu50
auauccugccaauauau

SEQ ID NO: 3957458 - RNA, 15 nt, Staphylococcus aureus subsp. aureus Mu50
auauccuguuucaua

SEQ ID NO: 3957459 - RNA, 17 nt, Staphylococcus aureus subsp. aureus Mu50
auauccuucaaagauuu

SEQ ID NO: 3957460 - RNA, 14 nt, Staphylococcus aureus subsp. aureus Mu50
auaucgacaaauua

SEQ ID NO: 3957461 - RNA, 22 nt, Staphylococcus aureus subsp. aureus Mu50
auaucgacaaauuaaaaaacaa

SEQ ID NO: 3957462 - RNA, 23 nt, Staphylococcus aureus subsp. aureus Mu50
auaucgagaggguacacuucaac

SEQ ID NO: 3957463 - RNA, 14 nt, Staphylococcus aureus subsp. aureus Mu50
auaucgauaaaugu

SEQ ID NO: 3957464 - RNA, 18 nt, Staphylococcus aureus subsp. aureus Mu50
auaucgcgcaucaaaaau

SEQ ID NO: 3957465 - RNA, 17 nt, Staphylococcus aureus subsp. aureus Mu50
auaucgcuuuugaaguu

SEQ ID NO: 3957466 - RNA, 23 nt, Staphylococcus aureus subsp. aureus Mu50
auaucggaaguuaggcaacuaaa

SEQ ID NO: 3957467 - RNA, 16 nt, Staphylococcus aureus subsp. aureus Mu50
auaucgucguaacucu

SEQ ID NO: 3957468 - RNA, 22 nt, Staphylococcus aureus subsp. aureus Mu50
auaucgucguaacucuuuaauu

SEQ ID NO: 3957469 - RNA, 19 nt, Staphylococcus aureus subsp. aureus Mu50
auaucuaagucgauaaguu

SEQ ID NO: 3957470 - RNA, 20 nt, Staphylococcus aureus subsp. aureus Mu50
auaucuaagucgauaaguuu

SEQ ID NO: 3957471 - RNA, 16 nt, Staphylococcus aureus subsp. aureus Mu50
auaucuaaugcaacuu

SEQ ID NO: 3957472 - RNA, 18 nt, Staphylococcus aureus subsp. aureus Mu50
auaucuaauucguaauuu

SEQ ID NO: 3957473 - RNA, 14 nt, Staphylococcus aureus subsp. aureus Mu50
auaucuacagagaa

SEQ ID NO: 3957474 - RNA, 20 nt, Staphylococcus aureus subsp. aureus Mu50
auaucuacagagaaucaauu

SEQ ID NO: 3957475 - RNA, 15 nt, Staphylococcus aureus subsp. aureus Mu50
auaucuauuuaucau

SEQ ID NO: 3957476 - RNA, 14 nt, Staphylococcus aureus subsp. aureus Mu50
auaucucaaagauu

SEQ ID NO: 3957477 - RNA, 14 nt, Staphylococcus aureus subsp. aureus Mu50
auaucucaagauau

SEQ ID NO: 3957478 - RNA, 15 nt, Staphylococcus aureus subsp. aureus Mu50
auaucucaagauauc

SEQ ID NO: 3957479 - RNA, 22 nt, Staphylococcus aureus subsp. aureus Mu50
auaucugaaaaaccaauacgaa

SEQ ID NO: 3957480 - RNA, 15 nt, Staphylococcus aureus subsp. aureus Mu50
auaucugucaaaggu

SEQ ID NO: 3957481 - RNA, 17 nt, Staphylococcus aureus subsp. aureus Mu50
auaucuuaaagaauuaa

SEQ ID NO: 3957482 - RNA, 18 nt, Staphylococcus aureus subsp. aureus Mu50
auaucuuaaguacauaaa

SEQ ID NO: 3957483 - RNA, 14 nt, Staphylococcus aureus subsp. aureus Mu50
auaucuuaaucuaa

SEQ ID NO: 3957484 - RNA, 23 nt, Staphylococcus aureus subsp. aureus Mu50
auaucuuaaucuaaaaauagaug

SEQ ID NO: 3957485 - RNA, 18 nt, Staphylococcus aureus subsp. aureus Mu50
auaucuuacugcuguuuu

SEQ ID NO: 3957486 - RNA, 21 nt, Staphylococcus aureus subsp. aureus Mu50
auaucuuaugauacuuugaaa

SEQ ID NO: 3957487 - RNA, 17 nt, Staphylococcus aureus subsp. aureus Mu50
auaucuucauuuaaaag

SEQ ID NO: 3957488 - RNA, 18 nt, Staphylococcus aureus subsp. aureus Mu50
auaucuucauuuaaaagu

SEQ ID NO: 3957489 - RNA, 12 nt, Staphylococcus aureus subsp. aureus Mu50
auaucuucugau

SEQ ID NO: 3957490 - RNA, 19 nt, Staphylococcus aureus subsp. aureus Mu50
auaucuucuuuauuuacac

SEQ ID NO: 3957491 - RNA, 14 nt, Staphylococcus aureus subsp. aureus Mu50
auaucuucuuuuaa

SEQ ID NO: 3957492 - RNA, 17 nt, Staphylococcus aureus subsp. aureus Mu50
auaucuucuuuuaauau

SEQ ID NO: 3957493 - RNA, 14 nt, Staphylococcus aureus subsp. aureus Mu50
auaucuuuaucauu

SEQ ID NO: 3957494 - RNA, 18 nt, Staphylococcus aureus subsp. aureus Mu50
auaucuuuaucauuauuc

SEQ ID NO: 3957495 - RNA, 17 nt, Staphylococcus aureus subsp. aureus Mu50
auaucuuuauuuuuuau

SEQ ID NO: 3957496 - RNA, 12 nt, Staphylococcus aureus subsp. aureus Mu50
auaucuuucaau

SEQ ID NO: 3957497 - RNA, 14 nt, Staphylococcus aureus subsp. aureus Mu50
auaucuuucaauua

SEQ ID NO: 3957498 - RNA, 18 nt, Staphylococcus aureus subsp. aureus Mu50
auaucuuucaauuaauuu

SEQ ID NO: 3957499 - RNA, 15 nt, Staphylococcus aureus subsp. aureus Mu50
auaucuuucugaaga

SEQ ID NO: 3957500 - RNA, 23 nt, Staphylococcus aureus subsp. aureus Mu50
auauucaaaaggauaagaacgag

SEQ ID NO: 3957501 - RNA, 15 nt, Staphylococcus aureus subsp. aureus Mu50
auauucaaaauaacu

SEQ ID NO: 3957502 - RNA, 16 nt, Staphylococcus aureus subsp. aureus Mu50
auauucaaauuuacca

SEQ ID NO: 3957503 - RNA, 17 nt, Staphylococcus aureus subsp. aureus Mu50
auauucaauaauuauua

SEQ ID NO: 3957504 - RNA, 12 nt, Staphylococcus aureus subsp. aureus Mu50
auauucaaugau

SEQ ID NO: 3957505 - RNA, 14 nt, Staphylococcus aureus subsp. aureus Mu50
auauucacaucuuu

SEQ ID NO: 3957506 - RNA, 20 nt, Staphylococcus aureus subsp. aureus Mu50
auauucaccuacaacaccaa

SEQ ID NO: 3957507 - RNA, 21 nt, Staphylococcus aureus subsp. aureus Mu50
auauucaccuacaacaccaau

SEQ ID NO: 3957508 - RNA, 18 nt, Staphylococcus aureus subsp. aureus Mu50
auauucacgauauaacau

SEQ ID NO: 3957509 - RNA, 16 nt, Staphylococcus aureus subsp. aureus Mu50
auauucaguauaugua

SEQ ID NO: 3957510 - RNA, 16 nt, Staphylococcus aureus subsp. aureus Mu50
auauucauucuagcau

SEQ ID NO: 3957511 - RNA, 22 nt, Staphylococcus aureus subsp. aureus Mu50
auauuccuuacuaaguaaccaa

SEQ ID NO: 3957512 - RNA, 22 nt, Staphylococcus aureus subsp. aureus Mu50
auauucgauacauaaaacauca

SEQ ID NO: 3957513 - RNA, 19 nt, Staphylococcus aureus subsp. aureus Mu50
auauucgcgaacguuauuu

SEQ ID NO: 3957514 - RNA, 19 nt, Staphylococcus aureus subsp. aureus Mu50
auauucguaaauccuuuau

SEQ ID NO: 3957515 - RNA, 14 nt, Staphylococcus aureus subsp. aureus Mu50
auauucguuacaaa

SEQ ID NO: 3957516 - RNA, 16 nt, Staphylococcus aureus subsp. aureus Mu50
auauucguuacaaaug

SEQ ID NO: 3957517 - RNA, 13 nt, Staphylococcus aureus subsp. aureus Mu50
auauucuaaaaaa

SEQ ID NO: 3957518 - RNA, 14 nt, Staphylococcus aureus subsp. aureus Mu50
auauucuaaaaaau

SEQ ID NO: 3957519 - RNA, 21 nt, Staphylococcus aureus subsp. aureus Mu50
auauucuaaaaaauuaaaaau

SEQ ID NO: 3957520 - RNA, 18 nt, Staphylococcus aureus subsp. aureus Mu50
auauucuacaugaaucaa

SEQ ID NO: 3957521 - RNA, 21 nt, Staphylococcus aureus subsp. aureus Mu50
auauucuagauucauauuuau

SEQ ID NO: 3957522 - RNA, 15 nt, Staphylococcus aureus subsp. aureus Mu50
auauucuauuguugu

SEQ ID NO: 3957523 - RNA, 22 nt, Staphylococcus aureus subsp. aureus Mu50
auauucucugcuucuaaaacau

SEQ ID NO: 3957524 - RNA, 17 nt, Staphylococcus aureus subsp. aureus Mu50
auauucuuaucauucau

SEQ ID NO: 3957525 - RNA, 12 nt, Staphylococcus aureus subsp. aureus Mu50
auauucuuaucu

SEQ ID NO: 3957526 - RNA, 11 nt, Staphylococcus aureus subsp. aureus Mu50
auauucuuuuu

SEQ ID NO: 3957527 - RNA, 13 nt, Staphylococcus aureus subsp. aureus Mu50
auauucuuuuuaa

SEQ ID NO: 3957528 - RNA, 18 nt, Staphylococcus aureus subsp. aureus Mu50
auauugaacaauucuuca

SEQ ID NO: 3957529 - RNA, 16 nt, Staphylococcus aureus subsp. aureus Mu50
auauugaagaugcuuu

SEQ ID NO: 3957530 - RNA, 18 nt, Staphylococcus aureus subsp. aureus Mu50
auauugaauugaaaaauu

SEQ ID NO: 3957531 - RNA, 19 nt, Staphylococcus aureus subsp. aureus Mu50
auauugaggaucaaaaguu

SEQ ID NO: 3957532 - RNA, 11 nt, Staphylococcus aureus subsp. aureus Mu50
auauugauagc

SEQ ID NO: 3957533 - RNA, 15 nt, Staphylococcus aureus subsp. aureus Mu50
auauugauagcaccg

SEQ ID NO: 3957534 - RNA, 13 nt, Staphylococcus aureus subsp. aureus Mu50
auauugcaaaaau

SEQ ID NO: 3957535 - RNA, 16 nt, Staphylococcus aureus subsp. aureus Mu50
auauugcaaaaauaau

SEQ ID NO: 3957536 - RNA, 22 nt, Staphylococcus aureus subsp. aureus Mu50
auauugcaaaaauaauaugaau

SEQ ID NO: 3957537 - RNA, 14 nt, Staphylococcus aureus subsp. aureus Mu50
auauugcaaaacuu

SEQ ID NO: 3957538 - RNA, 16 nt, Staphylococcus aureus subsp. aureus Mu50
auauugcgaaaaauaa

SEQ ID NO: 3957539 - RNA, 14 nt, Staphylococcus aureus subsp. aureus Mu50
auauugcguuuaau

SEQ ID NO: 3957540 - RNA, 18 nt, Staphylococcus aureus subsp. aureus Mu50
auauugcguuuaauuuac

SEQ ID NO: 3957541 - RNA, 16 nt, Staphylococcus aureus subsp. aureus Mu50
auauuggcuugcuuca

SEQ ID NO: 3957542 - RNA, 23 nt, Staphylococcus aureus subsp. aureus Mu50
auauuggcuugcuucauuauaua

SEQ ID NO: 3957543 - RNA, 15 nt, Staphylococcus aureus subsp. aureus Mu50
auauuguaaucacua

SEQ ID NO: 3957544 - RNA, 17 nt, Staphylococcus aureus subsp. aureus Mu50
auauugucgacuuuuag

SEQ ID NO: 3957545 - RNA, 18 nt, Staphylococcus aureus subsp. aureus Mu50
auauuguuaaaauuugaa

SEQ ID NO: 3957546 - RNA, 14 nt, Staphylococcus aureus subsp. aureus Mu50
auauuguuaaguag

SEQ ID NO: 3957547 - RNA, 12 nt, Staphylococcus aureus subsp. aureus Mu50
auauuuaaaaua

SEQ ID NO: 3957548 - RNA, 12 nt, Staphylococcus aureus subsp. aureus Mu50
auauuuaaacuc

SEQ ID NO: 3957549 - RNA, 14 nt, Staphylococcus aureus subsp. aureus Mu50
auauuuaaaugucu

SEQ ID NO: 3957550 - RNA, 19 nt, Staphylococcus aureus subsp. aureus Mu50
auauuuaaaugucuuucaa

SEQ ID NO: 3957551 - RNA, 12 nt, Staphylococcus aureus subsp. aureus Mu50
auauuuaacauu

SEQ ID NO: 3957552 - RNA, 14 nt, Staphylococcus aureus subsp. aureus Mu50
auauuuaacauuuu

SEQ ID NO: 3957553 - RNA, 17 nt, Staphylococcus aureus subsp. aureus Mu50
auauuuacacagaauga

SEQ ID NO: 3957554 - RNA, 18 nt, Staphylococcus aureus subsp. aureus Mu50
auauuuagaauaagaaau

SEQ ID NO: 3957555 - RNA, 13 nt, Staphylococcus aureus subsp. aureus Mu50
auauuuagauacu

SEQ ID NO: 3957556 - RNA, 21 nt, Staphylococcus aureus subsp. aureus Mu50
auauuuagauacugaauuuua

SEQ ID NO: 3957557 - RNA, 20 nt, Staphylococcus aureus subsp. aureus Mu50
auauuuagauuggucaaacu

SEQ ID NO: 3957558 - RNA, 16 nt, Staphylococcus aureus subsp. aureus Mu50
auauuuagauuuauaa

SEQ ID NO: 3957559 - RNA, 21 nt, Staphylococcus aureus subsp. aureus Mu50
auauuuaggacgugccuuaac

SEQ ID NO: 3957560 - RNA, 17 nt, Staphylococcus aureus subsp. aureus Mu50
auauuuaguuaauuauu

SEQ ID NO: 3957561 - RNA, 22 nt, Staphylococcus aureus subsp. aureus Mu50
auauuuauuaguugugguuguu

SEQ ID NO: 3957562 - RNA, 12 nt, Staphylococcus aureus subsp. aureus Mu50
auauuuauucua

SEQ ID NO: 3957563 - RNA, 19 nt, Staphylococcus aureus subsp. aureus Mu50
auauuuauucuaaguuaaa

SEQ ID NO: 3957564 - RNA, 14 nt, Staphylococcus aureus subsp. aureus Mu50
auauuuauuuuaau

SEQ ID NO: 3957565 - RNA, 14 nt, Staphylococcus aureus subsp. aureus Mu50
auauuuauuuuaua

SEQ ID NO: 3957566 - RNA, 17 nt, Staphylococcus aureus subsp. aureus Mu50
auauuuauuuuauaaua

SEQ ID NO: 3957567 - RNA, 17 nt, Staphylococcus aureus subsp. aureus Mu50
auauuucccuaugaaau

SEQ ID NO: 3957568 - RNA, 16 nt, Staphylococcus aureus subsp. aureus Mu50
auauuucgguauuuua

SEQ ID NO: 3957569 - RNA, 19 nt, Staphylococcus aureus subsp. aureus Mu50
auauuucgguauuuuaaau

SEQ ID NO: 3957570 - RNA, 16 nt, Staphylococcus aureus subsp. aureus Mu50
auauuucuaaaccauu

SEQ ID NO: 3957571 - RNA, 12 nt, Staphylococcus aureus subsp. aureus Mu50
auauuucuaaau

SEQ ID NO: 3957572 - RNA, 22 nt, Staphylococcus aureus subsp. aureus Mu50
auauuucucauacuauaagcaa

SEQ ID NO: 3957573 - RNA, 15 nt, Staphylococcus aureus subsp. aureus Mu50
auauuucuuaccauu

SEQ ID NO: 3957574 - RNA, 18 nt, Staphylococcus aureus subsp. aureus Mu50
auauuugaaaauuucacc

SEQ ID NO: 3957575 - RNA, 21 nt, Staphylococcus aureus subsp. aureus Mu50
auauuugaacgagcaccuuuu

SEQ ID NO: 3957576 - RNA, 16 nt, Staphylococcus aureus subsp. aureus Mu50
auauuugauaacaaaa

SEQ ID NO: 3957577 - RNA, 16 nt, Staphylococcus aureus subsp. aureus Mu50
auauuuguauaugcaa

SEQ ID NO: 3957578 - RNA, 14 nt, Staphylococcus aureus subsp. aureus Mu50
auauuuuaaaaagu

SEQ ID NO: 3957579 - RNA, 12 nt, Staphylococcus aureus subsp. aureus Mu50
auauuuuaaacg

SEQ ID NO: 3957580 - RNA, 14 nt, Staphylococcus aureus subsp. aureus Mu50
auauuuuaguucac

SEQ ID NO: 3957581 - RNA, 20 nt, Staphylococcus aureus subsp. aureus Mu50
auauuuuauuagaauauuca

SEQ ID NO: 3957582 - RNA, 14 nt, Staphylococcus aureus subsp. aureus Mu50
auauuuucugcgau

SEQ ID NO: 3957583 - RNA, 22 nt, Staphylococcus aureus subsp. aureus Mu50
auauuuucugcgauauagcuuu

SEQ ID NO: 3957584 - RNA, 23 nt, Staphylococcus aureus subsp. aureus Mu50
auauuuucugcgauauagcuuug

SEQ ID NO: 3957585 - RNA, 11 nt, Staphylococcus aureus subsp. aureus Mu50
auauuuucuua

SEQ ID NO: 3957586 - RNA, 19 nt, Staphylococcus aureus subsp. aureus Mu50
auauuuucuuagaaaauca

SEQ ID NO: 3957587 - RNA, 13 nt, Staphylococcus aureus subsp. aureus Mu50
auauuuuguuaau

SEQ ID NO: 3957588 - RNA, 11 nt, Staphylococcus aureus subsp. aureus Mu50
aucaauauuua

SEQ ID NO: 3957589 - RNA, 12 nt, Staphylococcus aureus subsp. aureus Mu50
aucaauccauca

SEQ ID NO: 3957590 - RNA, 17 nt, Staphylococcus aureus subsp. aureus Mu50
aucaauccaucaauacc

SEQ ID NO: 3957591 - RNA, 23 nt, Staphylococcus aureus subsp. aureus Mu50
aucaaucgcuuuagcaauugaau

SEQ ID NO: 3957592 - RNA, 19 nt, Staphylococcus aureus subsp. aureus Mu50
aucaauuacucuuuuucuu

SEQ ID NO: 3957593 - RNA, 13 nt, Staphylococcus aureus subsp. aureus Mu50
aucaauuagccaa

SEQ ID NO: 3957594 - RNA, 20 nt, Staphylococcus aureus subsp. aureus Mu50
aucaauuagccaauaccgaa

SEQ ID NO: 3957595 - RNA, 19 nt, Staphylococcus aureus subsp. aureus Mu50
aucaauuauugaaaacaaa

SEQ ID NO: 3957596 - RNA, 17 nt, Staphylococcus aureus subsp. aureus Mu50
aucaauuuaguccuucu

SEQ ID NO: 3957597 - RNA, 16 nt, Staphylococcus aureus subsp. aureus Mu50
aucaauuuauuauuaa

SEQ ID NO: 3957598 - RNA, 22 nt, Staphylococcus aureus subsp. aureus Mu50
aucaauuuauuauuaacuguac

SEQ ID NO: 3957599 - RNA, 16 nt, Staphylococcus aureus subsp. aureus Mu50
aucaauuucuauuuca

SEQ ID NO: 3957600 - RNA, 17 nt, Staphylococcus aureus subsp. aureus Mu50
aucaauuucuauuucac

SEQ ID NO: 3957601 - RNA, 18 nt, Staphylococcus aureus subsp. aureus Mu50
aucaauuucuauuucacu

SEQ ID NO: 3957602 - RNA, 15 nt, Staphylococcus aureus subsp. aureus Mu50
aucaauuucucuuuc

SEQ ID NO: 3957603 - RNA, 15 nt, Staphylococcus aureus subsp. aureus Mu50
aucacaacacauaaa

SEQ ID NO: 3957604 - RNA, 22 nt, Staphylococcus aureus subsp. aureus Mu50
aucacaauacgaaaucaaaaau

SEQ ID NO: 3957605 - RNA, 22 nt, Staphylococcus aureus subsp. aureus Mu50
aucacacgacauguagguaauu

SEQ ID NO: 3957606 - RNA, 20 nt, Staphylococcus aureus subsp. aureus Mu50
aucacacgcauacaggaaau

SEQ ID NO: 3957607 - RNA, 15 nt, Staphylococcus aureus subsp. aureus Mu50
aucacagcaauaaua

SEQ ID NO: 3957608 - RNA, 16 nt, Staphylococcus aureus subsp. aureus Mu50
aucacagcaauaauaa

SEQ ID NO: 3957609 - RNA, 17 nt, Staphylococcus aureus subsp. aureus Mu50
aucacagcaauaauaau

SEQ ID NO: 3957610 - RNA, 22 nt, Staphylococcus aureus subsp. aureus Mu50
aucacaguguugaauuucaaaa

SEQ ID NO: 3957611 - RNA, 13 nt, Staphylococcus aureus subsp. aureus Mu50
aucacaucauacc

SEQ ID NO: 3957612 - RNA, 20 nt, Staphylococcus aureus subsp. aureus Mu50
aucacaucauaccaauccga

SEQ ID NO: 3957613 - RNA, 14 nt, Staphylococcus aureus subsp. aureus Mu50
aucaccagauuuua

SEQ ID NO: 3957614 - RNA, 17 nt, Staphylococcus aureus subsp. aureus Mu50
aucaccauacuaaaaca

SEQ ID NO: 3957615 - RNA, 21 nt, Staphylococcus aureus subsp. aureus Mu50
aucaccuauuaggauccaauu

SEQ ID NO: 3957616 - RNA, 19 nt, Staphylococcus aureus subsp. aureus Mu50
aucaccugaugaauagaua

SEQ ID NO: 3957617 - RNA, 17 nt, Staphylococcus aureus subsp. aureus Mu50
aucaccuuuuauccccu

SEQ ID NO: 3957618 - RNA, 17 nt, Staphylococcus aureus subsp. aureus Mu50
aucaccuuuuuuaacuu

SEQ ID NO: 3957619 - RNA, 15 nt, Staphylococcus aureus subsp. aureus Mu50
aucacgaucuuuaaa

SEQ ID NO: 3957620 - RNA, 16 nt, Staphylococcus aureus subsp. aureus Mu50
aucacgauuuucaagu

SEQ ID NO: 3957621 - RNA, 23 nt, Staphylococcus aureus subsp. aureus Mu50
aucacgauuuucaaguaaugaua

SEQ ID NO: 3957622 - RNA, 15 nt, Staphylococcus aureus subsp. aureus Mu50
aucacgccauaaucu

SEQ ID NO: 3957623 - RNA, 14 nt, Staphylococcus aureus subsp. aureus Mu50
aucacgugauaaug

SEQ ID NO: 3957624 - RNA, 17 nt, Staphylococcus aureus subsp. aureus Mu50
aucacuaaaguaaauaa

SEQ ID NO: 3957625 - RNA, 20 nt, Staphylococcus aureus subsp. aureus Mu50
aucacuaaaguaaauaacac

SEQ ID NO: 3957626 - RNA, 16 nt, Staphylococcus aureus subsp. aureus Mu50
aucacucaacauauua

SEQ ID NO: 3957627 - RNA, 22 nt, Staphylococcus aureus subsp. aureus Mu50
aucacuccucuauuuuaugauu

SEQ ID NO: 3957628 - RNA, 21 nt, Staphylococcus aureus subsp. aureus Mu50
aucacugaaugcuaauacuaa

SEQ ID NO: 3957629 - RNA, 17 nt, Staphylococcus aureus subsp. aureus Mu50
aucacugcauauaaagu

SEQ ID NO: 3957630 - RNA, 13 nt, Staphylococcus aureus subsp. aureus Mu50
aucacugcuuuca

SEQ ID NO: 3957631 - RNA, 15 nt, Staphylococcus aureus subsp. aureus Mu50
aucacuguagauuca

SEQ ID NO: 3957632 - RNA, 21 nt, Staphylococcus aureus subsp. aureus Mu50
aucacuugcuguugcaauaaa

SEQ ID NO: 3957633 - RNA, 17 nt, Staphylococcus aureus subsp. aureus Mu50
aucacuuggaauaauac

SEQ ID NO: 3957634 - RNA, 17 nt, Staphylococcus aureus subsp. aureus Mu50
aucacuugguaaaacau

SEQ ID NO: 3957635 - RNA, 21 nt, Staphylococcus aureus subsp. aureus Mu50
aucacuuuaggguucauugcu

SEQ ID NO: 3957636 - RNA, 14 nt, Staphylococcus aureus subsp. aureus Mu50
aucagaaucaagua

SEQ ID NO: 3957637 - RNA, 16 nt, Staphylococcus aureus subsp. aureus Mu50
aucagacuaaaaugaa

SEQ ID NO: 3957638 - RNA, 15 nt, Staphylococcus aureus subsp. aureus Mu50
aucagcuaaauauuu

SEQ ID NO: 3957639 - RNA, 16 nt, Staphylococcus aureus subsp. aureus Mu50
aucagcuauaaaagua

SEQ ID NO: 3957640 - RNA, 23 nt, Staphylococcus aureus subsp. aureus Mu50
aucagcuuuggcgacauaaauac

SEQ ID NO: 3957641 - RNA, 13 nt, Staphylococcus aureus subsp. aureus Mu50
aucagcuuuuuca

SEQ ID NO: 3957642 - RNA, 21 nt, Staphylococcus aureus subsp. aureus Mu50
aucaguaauaauguaguaguu

SEQ ID NO: 3957643 - RNA, 23 nt, Staphylococcus aureus subsp. aureus Mu50
aucaguaccaaagaaaucaccag

SEQ ID NO: 3957644 - RNA, 13 nt, Staphylococcus aureus subsp. aureus Mu50
aucaguaguuuua

SEQ ID NO: 3957645 - RNA, 16 nt, Staphylococcus aureus subsp. aureus Mu50
aucaguauaaucagca

SEQ ID NO: 3957646 - RNA, 17 nt, Staphylococcus aureus subsp. aureus Mu50
aucaguauuuacuuuuc

SEQ ID NO: 3957647 - RNA, 13 nt, Staphylococcus aureus subsp. aureus Mu50
aucagucauucac

SEQ ID NO: 3957648 - RNA, 14 nt, Staphylococcus aureus subsp. aureus Mu50
aucagucucuaaaa

SEQ ID NO: 3957649 - RNA, 17 nt, Staphylococcus aureus subsp. aureus Mu50
aucagugugauuuugga

SEQ ID NO: 3957650 - RNA, 14 nt, Staphylococcus aureus subsp. aureus Mu50
aucaguuaauaauu

SEQ ID NO: 3957651 - RNA, 15 nt, Staphylococcus aureus subsp. aureus Mu50
aucaguuaauaauuu

SEQ ID NO: 3957652 - RNA, 12 nt, Staphylococcus aureus subsp. aureus Mu50
aucaguuauuuu

SEQ ID NO: 3957653 - RNA, 15 nt, Staphylococcus aureus subsp. aureus Mu50
aucaguuauuuuaau

SEQ ID NO: 3957654 - RNA, 20 nt, Staphylococcus aureus subsp. aureus Mu50
aucaguuguguaauaaagca

SEQ ID NO: 3957655 - RNA, 22 nt, Staphylococcus aureus subsp. aureus Mu50
aucaguuucaucaaguauaaau

SEQ ID NO: 3957656 - RNA, 21 nt, Staphylococcus aureus subsp. aureus Mu50
aucaguuuccgcacaagcauc

SEQ ID NO: 3957657 - RNA, 23 nt, Staphylococcus aureus subsp. aureus Mu50
aucaguuuccgcacaagcaucua

SEQ ID NO: 3957658 - RNA, 13 nt, Staphylococcus aureus subsp. aureus Mu50
aucaguuuuuaaa

SEQ ID NO: 3957659 - RNA, 17 nt, Staphylococcus aureus subsp. aureus Mu50
aucaguuuuugaauauu

SEQ ID NO: 3957660 - RNA, 13 nt, Staphylococcus aureus subsp. aureus Mu50
aucauaaaguaaa

SEQ ID NO: 3957661 - RNA, 17 nt, Staphylococcus aureus subsp. aureus Mu50
aucauaaauauuuucug

SEQ ID NO: 3957662 - RNA, 24 nt, Staphylococcus aureus subsp. aureus Mu50
aucauaaauauuuucugcgauaua

SEQ ID NO: 3957663 - RNA, 13 nt, Staphylococcus aureus subsp. aureus Mu50
aucauaaaugacg

SEQ ID NO: 3957664 - RNA, 21 nt, Staphylococcus aureus subsp. aureus Mu50
aucauaaauguuauuaaccau

SEQ ID NO: 3957665 - RNA, 23 nt, Staphylococcus aureus subsp. aureus Mu50
aucauaaauguuauuaaccauca

SEQ ID NO: 3957666 - RNA, 13 nt, Staphylococcus aureus subsp. aureus Mu50
aucauaauauuga

SEQ ID NO: 3957667 - RNA, 17 nt, Staphylococcus aureus subsp. aureus Mu50
aucauaauuuuguuuug

SEQ ID NO: 3957668 - RNA, 18 nt, Staphylococcus aureus subsp. aureus Mu50
aucauaccaaaaaguauu

SEQ ID NO: 3957669 - RNA, 16 nt, Staphylococcus aureus subsp. aureus Mu50
aucauaccaauccgaa

SEQ ID NO: 3957670 - RNA, 15 nt, Staphylococcus aureus subsp. aureus Mu50
aucauacgagaaauu

SEQ ID NO: 3957671 - RNA, 15 nt, Staphylococcus aureus subsp. aureus Mu50
aucauacuucaauaa

SEQ ID NO: 3957672 - RNA, 15 nt, Staphylococcus aureus subsp. aureus Mu50
aucauagacaauguu

SEQ ID NO: 3957673 - RNA, 22 nt, Staphylococcus aureus subsp. aureus Mu50
aucauagacaauguucuuuuca

SEQ ID NO: 3957674 - RNA, 14 nt, Staphylococcus aureus subsp. aureus Mu50
aucauagaggcaca

SEQ ID NO: 3957675 - RNA, 17 nt, Staphylococcus aureus subsp. aureus Mu50
aucauauaaaucaaaua

SEQ ID NO: 3957676 - RNA, 20 nt, Staphylococcus aureus subsp. aureus Mu50
auccaagugacaacauuauu

SEQ ID NO: 3957677 - RNA, 13 nt, Staphylococcus aureus subsp. aureus Mu50
auccaauguauaa

SEQ ID NO: 3957678 - RNA, 22 nt, Staphylococcus aureus subsp. aureus Mu50
auccaauuuaauagcuuguaca

SEQ ID NO: 3957679 - RNA, 14 nt, Staphylococcus aureus subsp. aureus Mu50
auccaccaaauaca

SEQ ID NO: 3957680 - RNA, 16 nt, Staphylococcus aureus subsp. aureus Mu50
auccaccaaauacagu

SEQ ID NO: 3957681 - RNA, 15 nt, Staphylococcus aureus subsp. aureus Mu50
auccacgguuuacca

SEQ ID NO: 3957682 - RNA, 19 nt, Staphylococcus aureus subsp. aureus Mu50
auccagcgacauguccugu

SEQ ID NO: 3957683 - RNA, 15 nt, Staphylococcus aureus subsp. aureus Mu50
auccauaaaaauacg

SEQ ID NO: 3957684 - RNA, 19 nt, Staphylococcus aureus subsp. aureus Mu50
auccaucaauaccauaauu

SEQ ID NO: 3957685 - RNA, 13 nt, Staphylococcus aureus subsp. aureus Mu50
auccauucaaugu

SEQ ID NO: 3957686 - RNA, 14 nt, Staphylococcus aureus subsp. aureus Mu50
auccauucaauguu

SEQ ID NO: 3957687 - RNA, 21 nt, Staphylococcus aureus subsp. aureus Mu50
auccauucuaacgguaaauaa

SEQ ID NO: 3957688 - RNA, 22 nt, Staphylococcus aureus subsp. aureus Mu50
auccauugcacuaugcauaaua

SEQ ID NO: 3957689 - RNA, 21 nt, Staphylococcus aureus subsp. aureus Mu50
aucccaaguuacaauaucaua

SEQ ID NO: 3957690 - RNA, 19 nt, Staphylococcus aureus subsp. aureus Mu50
aucccauaacaaucauuuc

SEQ ID NO: 3957691 - RNA, 14 nt, Staphylococcus aureus subsp. aureus Mu50
aucccauuuuaaag

SEQ ID NO: 3957692 - RNA, 19 nt, Staphylococcus aureus subsp. aureus Mu50
auccccagccauuuguugu

SEQ ID NO: 3957693 - RNA, 23 nt, Staphylococcus aureus subsp. aureus Mu50
aucccccgccacuaugugaagug

SEQ ID NO: 3957694 - RNA, 17 nt, Staphylococcus aureus subsp. aureus Mu50
auccccgagcaauucuu

SEQ ID NO: 3957695 - RNA, 18 nt, Staphylococcus aureus subsp. aureus Mu50
aucccgaaaguuagacua

SEQ ID NO: 3957696 - RNA, 15 nt, Staphylococcus aureus subsp. aureus Mu50
aucccucuaucaaau

SEQ ID NO: 3957697 - RNA, 16 nt, Staphylococcus aureus subsp. aureus Mu50
aucccucuaucaaauu

SEQ ID NO: 3957698 - RNA, 20 nt, Staphylococcus aureus subsp. aureus Mu50
aucccucuaucaaauuacca

SEQ ID NO: 3957699 - RNA, 15 nt, Staphylococcus aureus subsp. aureus Mu50
aucccuguaaaacca

SEQ ID NO: 3957700 - RNA, 16 nt, Staphylococcus aureus subsp. aureus Mu50
aucccuguaaaaccau

SEQ ID NO: 3957701 - RNA, 19 nt, Staphylococcus aureus subsp. aureus Mu50
aucccuuuuagcauaauua

SEQ ID NO: 3957702 - RNA, 20 nt, Staphylococcus aureus subsp. aureus Mu50
aucccuuuuagcauaauuag

SEQ ID NO: 3957703 - RNA, 21 nt, Staphylococcus aureus subsp. aureus Mu50
auccgaauucuccguuaauuu

SEQ ID NO: 3957704 - RNA, 20 nt, Staphylococcus aureus subsp. aureus Mu50
auccuaaaaagcucaauccu

SEQ ID NO: 3957705 - RNA, 17 nt, Staphylococcus aureus subsp. aureus Mu50
auccuaaauuauaaaua

SEQ ID NO: 3957706 - RNA, 14 nt, Staphylococcus aureus subsp. aureus Mu50
auccuaauuuuucu

SEQ ID NO: 3957707 - RNA, 17 nt, Staphylococcus aureus subsp. aureus Mu50
auccuaauuuuucucca

SEQ ID NO: 3957708 - RNA, 20 nt, Staphylococcus aureus subsp. aureus Mu50
auccuauggcgcaauuuuua

SEQ ID NO: 3957709 - RNA, 21 nt, Staphylococcus aureus subsp. aureus Mu50
auccuauggcgcaauuuuuaa

SEQ ID NO: 3957710 - RNA, 15 nt, Staphylococcus aureus subsp. aureus Mu50
auccucaaauauauu

SEQ ID NO: 3957711 - RNA, 16 nt, Staphylococcus aureus subsp. aureus Mu50
auccucaguuauacca

SEQ ID NO: 3957712 - RNA, 14 nt, Staphylococcus aureus subsp. aureus Mu50
auccucauaauuau

SEQ ID NO: 3957713 - RNA, 16 nt, Staphylococcus aureus subsp. aureus Mu50
auccucauaauuauca

SEQ ID NO: 3957714 - RNA, 23 nt, Staphylococcus aureus subsp. aureus Mu50
auccucgguauuuaauguuuuag

SEQ ID NO: 3957715 - RNA, 15 nt, Staphylococcus aureus subsp. aureus Mu50
auccugccaauauau

SEQ ID NO: 3957716 - RNA, 16 nt, Staphylococcus aureus subsp. aureus Mu50
auccugccaauauauu

SEQ ID NO: 3957717 - RNA, 17 nt, Staphylococcus aureus subsp. aureus Mu50
auccugccaauauauuc

SEQ ID NO: 3957718 - RNA, 19 nt, Staphylococcus aureus subsp. aureus Mu50
auccugccaauauauucac

SEQ ID NO: 3957719 - RNA, 19 nt, Staphylococcus aureus subsp. aureus Mu50
auccugcuuauuaauuguu

SEQ ID NO: 3957720 - RNA, 15 nt, Staphylococcus aureus subsp. aureus Mu50
auccuggaauauuaa

SEQ ID NO: 3957721 - RNA, 16 nt, Staphylococcus aureus subsp. aureus Mu50
auccuggaauauuaac

SEQ ID NO: 3957722 - RNA, 20 nt, Staphylococcus aureus subsp. aureus Mu50
auccuggaauauuaacacca

SEQ ID NO: 3957723 - RNA, 14 nt, Staphylococcus aureus subsp. aureus Mu50
auccuguguaaaau

SEQ ID NO: 3957724 - RNA, 21 nt, Staphylococcus aureus subsp. aureus Mu50
auccuguguaaaauaaaucau

SEQ ID NO: 3957725 - RNA, 11 nt, Staphylococcus aureus subsp. aureus Mu50
auccuuaaaug

SEQ ID NO: 3957726 - RNA, 17 nt, Staphylococcus aureus subsp. aureus Mu50
auccuuaauugcucuuc

SEQ ID NO: 3957727 - RNA, 20 nt, Staphylococcus aureus subsp. aureus Mu50
auccuuaccuuuuaaaccug

SEQ ID NO: 3957728 - RNA, 20 nt, Staphylococcus aureus subsp. aureus Mu50
auccuucaaagauuuuaccu

SEQ ID NO: 3957729 - RNA, 17 nt, Staphylococcus aureus subsp. aureus Mu50
auccuugcuaucaaacu

SEQ ID NO: 3957730 - RNA, 19 nt, Staphylococcus aureus subsp. aureus Mu50
auccuuguucuauuugaua

SEQ ID NO: 3957731 - RNA, 22 nt, Staphylococcus aureus subsp. aureus Mu50
auccuuugauguuuucuauaau

SEQ ID NO: 3957732 - RNA, 14 nt, Staphylococcus aureus subsp. aureus Mu50
auccuuuuugacuc

SEQ ID NO: 3957733 - RNA, 17 nt, Staphylococcus aureus subsp. aureus Mu50
aucgaacauaaauaaac

SEQ ID NO: 3957734 - RNA, 14 nt, Staphylococcus aureus subsp. aureus Mu50
aucgaacuagacaa

SEQ ID NO: 3957735 - RNA, 22 nt, Staphylococcus aureus subsp. aureus Mu50
aucgaagggcggucaauuuuac

SEQ ID NO: 3957736 - RNA, 18 nt, Staphylococcus aureus subsp. aureus Mu50
aucgaauuaagaaaaguu

SEQ ID NO: 3957737 - RNA, 14 nt, Staphylococcus aureus subsp. aureus Mu50
aucgaauucauuug

SEQ ID NO: 3957738 - RNA, 18 nt, Staphylococcus aureus subsp. aureus Mu50
aucgaauugguaaaaauc

SEQ ID NO: 3957739 - RNA, 14 nt, Staphylococcus aureus subsp. aureus Mu50
aucgaauuuucaaa

SEQ ID NO: 3957740 - RNA, 22 nt, Staphylococcus aureus subsp. aureus Mu50
aucgaauuuucaaagacguaca

SEQ ID NO: 3957741 - RNA, 20 nt, Staphylococcus aureus subsp. aureus Mu50
aucgacauagcguauugauu

SEQ ID NO: 3957742 - RNA, 23 nt, Staphylococcus aureus subsp. aureus Mu50
aucgacuaauuuuucuuucaggc

SEQ ID NO: 3957743 - RNA, 22 nt, Staphylococcus aureus subsp. aureus Mu50
aucgagcguaauggauuauuau

SEQ ID NO: 3957744 - RNA, 16 nt, Staphylococcus aureus subsp. aureus Mu50
aucgauacuaauaucu

SEQ ID NO: 3957745 - RNA, 13 nt, Staphylococcus aureus subsp. aureus Mu50
aucgauacuuuuu

SEQ ID NO: 3957746 - RNA, 16 nt, Staphylococcus aureus subsp. aureus Mu50
aucgauauagcauaaa

SEQ ID NO: 3957747 - RNA, 17 nt, Staphylococcus aureus subsp. aureus Mu50
aucgauauucuccaacu

SEQ ID NO: 3957748 - RNA, 18 nt, Staphylococcus aureus subsp. aureus Mu50
aucgaugacuuugucuuu

SEQ ID NO: 3957749 - RNA, 20 nt, Staphylococcus aureus subsp. aureus Mu50
aucgauuaagaaugcaccaa

SEQ ID NO: 3957750 - RNA, 23 nt, Staphylococcus aureus subsp. aureus Mu50
aucgauuaagaaugcaccaacaa

SEQ ID NO: 3957751 - RNA, 14 nt, Staphylococcus aureus subsp. aureus Mu50
aucgauuaguuuuu

SEQ ID NO: 3957752 - RNA, 18 nt, Staphylococcus aureus subsp. aureus Mu50
aucgauugccauagaaau

SEQ ID NO: 3957753 - RNA, 14 nt, Staphylococcus aureus subsp. aureus Mu50
aucgauuuaucauu

SEQ ID NO: 3957754 - RNA, 22 nt, Staphylococcus aureus subsp. aureus Mu50
aucgauuuuaucgaaauauuua

SEQ ID NO: 3957755 - RNA, 22 nt, Staphylococcus aureus subsp. aureus Mu50
aucgauuuuggcacauaaauca

SEQ ID NO: 3957756 - RNA, 23 nt, Staphylococcus aureus subsp. aureus Mu50
aucgauuuuggcacauaaaucaa

SEQ ID NO: 3957757 - RNA, 15 nt, Staphylococcus aureus subsp. aureus Mu50
aucgcauuuaaauau

SEQ ID NO: 3957758 - RNA, 14 nt, Staphylococcus aureus subsp. aureus Mu50
aucgcauuuuguuu

SEQ ID NO: 3957759 - RNA, 15 nt, Staphylococcus aureus subsp. aureus Mu50
aucgccaaucuauug

SEQ ID NO: 3957760 - RNA, 13 nt, Staphylococcus aureus subsp. aureus Mu50
aucgccuaaaaau

SEQ ID NO: 3957761 - RNA, 14 nt, Staphylococcus aureus subsp. aureus Mu50
aucgcgauuauuac

SEQ ID NO: 3957762 - RNA, 14 nt, Staphylococcus aureus subsp. aureus Mu50
aucgcuugcuucuu

SEQ ID NO: 3957763 - RNA, 14 nt, Staphylococcus aureus subsp. aureus Mu50
aucucuauuuuuua

SEQ ID NO: 3957764 - RNA, 15 nt, Staphylococcus aureus subsp. aureus Mu50
aucucuauuuuuuau

SEQ ID NO: 3957765 - RNA, 11 nt, Staphylococcus aureus subsp. aureus Mu50
aucucugaaaa

SEQ ID NO: 3957766 - RNA, 17 nt, Staphylococcus aureus subsp. aureus Mu50
aucucugcuuuaauaua

SEQ ID NO: 3957767 - RNA, 22 nt, Staphylococcus aureus subsp. aureus Mu50
aucucugcuuuaauauaauuau

SEQ ID NO: 3957768 - RNA, 16 nt, Staphylococcus aureus subsp. aureus Mu50
aucucuucaauuuauu

SEQ ID NO: 3957769 - RNA, 18 nt, Staphylococcus aureus subsp. aureus Mu50
aucucuucaauuuauuuu

SEQ ID NO: 3957770 - RNA, 20 nt, Staphylococcus aureus subsp. aureus Mu50
aucucuucaauuuauuuuua

SEQ ID NO: 3957771 - RNA, 20 nt, Staphylococcus aureus subsp. aureus Mu50
aucucuucugucuaaaaaca

SEQ ID NO: 3957772 - RNA, 16 nt, Staphylococcus aureus subsp. aureus Mu50
aucucuuuucuauuca

SEQ ID NO: 3957773 - RNA, 17 nt, Staphylococcus aureus subsp. aureus Mu50
aucucuuuuugauuaua

SEQ ID NO: 3957774 - RNA, 21 nt, Staphylococcus aureus subsp. aureus Mu50
aucucuuuuugauuauauuua

SEQ ID NO: 3957775 - RNA, 19 nt, Staphylococcus aureus subsp. aureus Mu50
aucugaaaauaucacugaa

SEQ ID NO: 3957776 - RNA, 14 nt, Staphylococcus aureus subsp. aureus Mu50
aucugacauuuaaa

SEQ ID NO: 3957777 - RNA, 18 nt, Staphylococcus aureus subsp. aureus Mu50
aucugacauuucaucaau

SEQ ID NO: 3957778 - RNA, 23 nt, Staphylococcus aureus subsp. aureus Mu50
aucugacauuucaucaauaauuu

SEQ ID NO: 3957779 - RNA, 17 nt, Staphylococcus aureus subsp. aureus Mu50
aucugcaacgauuuuaa

SEQ ID NO: 3957780 - RNA, 13 nt, Staphylococcus aureus subsp. aureus Mu50
aucugcauuuaau

SEQ ID NO: 3957781 - RNA, 14 nt, Staphylococcus aureus subsp. aureus Mu50
aucugcuuuucuau

SEQ ID NO: 3957782 - RNA, 19 nt, Staphylococcus aureus subsp. aureus Mu50
aucuggaauaccuaaccau

SEQ ID NO: 3957783 - RNA, 23 nt, Staphylococcus aureus subsp. aureus Mu50
aucuggaauaccuaaccauaaca

SEQ ID NO: 3957784 - RNA, 16 nt, Staphylococcus aureus subsp. aureus Mu50
aucuggcaaauugccu

SEQ ID NO: 3957785 - RNA, 22 nt, Staphylococcus aureus subsp. aureus Mu50
aucuguaacaaagucucuagua

SEQ ID NO: 3957786 - RNA, 18 nt, Staphylococcus aureus subsp. aureus Mu50
aucuguaacauaaacaau

SEQ ID NO: 3957787 - RNA, 17 nt, Staphylococcus aureus subsp. aureus Mu50
aucuguaacuaauauga

SEQ ID NO: 3957788 - RNA, 22 nt, Staphylococcus aureus subsp. aureus Mu50
aucuguaccguuuuuuauaaau

SEQ ID NO: 3957789 - RNA, 19 nt, Staphylococcus aureus subsp. aureus Mu50
aucuguacuucuaauuugc

SEQ ID NO: 3957790 - RNA, 16 nt, Staphylococcus aureus subsp. aureus Mu50
aucuguagaaacacuu

SEQ ID NO: 3957791 - RNA, 16 nt, Staphylococcus aureus subsp. aureus Mu50
aucuguagguaagaaa

SEQ ID NO: 3957792 - RNA, 14 nt, Staphylococcus aureus subsp. aureus Mu50
aucuguaucaaaau

SEQ ID NO: 3957793 - RNA, 21 nt, Staphylococcus aureus subsp. aureus Mu50
aucuguuacagguuuuaaaau

SEQ ID NO: 3957794 - RNA, 14 nt, Staphylococcus aureus subsp. aureus Mu50
aucuguucauaaug

SEQ ID NO: 3957795 - RNA, 16 nt, Staphylococcus aureus subsp. aureus Mu50
aucuguugucaucaug

SEQ ID NO: 3957796 - RNA, 15 nt, Staphylococcus aureus subsp. aureus Mu50
aucuguuguuauaua

SEQ ID NO: 3957797 - RNA, 15 nt, Staphylococcus aureus subsp. aureus Mu50
aucuuaaagaauuaa

SEQ ID NO: 3957798 - RNA, 20 nt, Staphylococcus aureus subsp. aureus Mu50
aucuuaaagauuuuucagcu

SEQ ID NO: 3957799 - RNA, 22 nt, Staphylococcus aureus subsp. aureus Mu50
aucuuaaagcauaucucaagau

SEQ ID NO: 3957800 - RNA, 21 nt, Staphylococcus aureus subsp. aureus Mu50
aucuuaaguacauaaaugcua

SEQ ID NO: 3957801 - RNA, 14 nt, Staphylococcus aureus subsp. aureus Mu50
aucuuaagucauca

SEQ ID NO: 3957802 - RNA, 23 nt, Staphylococcus aureus subsp. aureus Mu50
aucuuaaucgcucuaaauaguag

SEQ ID NO: 3957803 - RNA, 15 nt, Staphylococcus aureus subsp. aureus Mu50
aucuuaaucuaaaaa

SEQ ID NO: 3957804 - RNA, 16 nt, Staphylococcus aureus subsp. aureus Mu50
aucuuacuacuuaauu

SEQ ID NO: 3957805 - RNA, 20 nt, Staphylococcus aureus subsp. aureus Mu50
aucuuacugcugcuuuuaau

SEQ ID NO: 3957806 - RNA, 20 nt, Staphylococcus aureus subsp. aureus Mu50
aucuuacugcuguuuuuuau

SEQ ID NO: 3957807 - RNA, 21 nt, Staphylococcus aureus subsp. aureus Mu50
aucuuagacgcuguuuuaaau

SEQ ID NO: 3957808 - RNA, 19 nt, Staphylococcus aureus subsp. aureus Mu50
aucuuaggugucaucgcuu

SEQ ID NO: 3957809 - RNA, 16 nt, Staphylococcus aureus subsp. aureus Mu50
aucuuaguacaaaauu

SEQ ID NO: 3957810 - RNA, 21 nt, Staphylococcus aureus subsp. aureus Mu50
aucuuaguuaaaauucaguau

SEQ ID NO: 3957811 - RNA, 20 nt, Staphylococcus aureus subsp. aureus Mu50
aucuuauaacaaaaauugcu

SEQ ID NO: 3957812 - RNA, 22 nt, Staphylococcus aureus subsp. aureus Mu50
aucuuauaacaaaaauugcuau

SEQ ID NO: 3957813 - RNA, 17 nt, Staphylococcus aureus subsp. aureus Mu50
aucuuaugacugcuuuu

SEQ ID NO: 3957814 - RNA, 18 nt, Staphylococcus aureus subsp. aureus Mu50
aucuuaugacugcuuuuu

SEQ ID NO: 3957815 - RNA, 20 nt, Staphylococcus aureus subsp. aureus Mu50
aucuuaugacugcuuuuuau

SEQ ID NO: 3957816 - RNA, 18 nt, Staphylococcus aureus subsp. aureus Mu50
aucuuaugauacuuugaa

SEQ ID NO: 3957817 - RNA, 20 nt, Staphylococcus aureus subsp. aureus Mu50
aucuuaugauacuuugaaag

SEQ ID NO: 3957818 - RNA, 22 nt, Staphylococcus aureus subsp. aureus Mu50
aucuuaugauacuuugaaagaa

SEQ ID NO: 3957819 - RNA, 19 nt, Staphylococcus aureus subsp. aureus Mu50
aucuuaugaugucauguau

SEQ ID NO: 3957820 - RNA, 13 nt, Staphylococcus aureus subsp. aureus Mu50
aucuuauuauuaa

SEQ ID NO: 3957821 - RNA, 14 nt, Staphylococcus aureus subsp. aureus Mu50
aucuuauuauuaau

SEQ ID NO: 3957822 - RNA, 22 nt, Staphylococcus aureus subsp. aureus Mu50
aucuucaacauaacucaaauau

SEQ ID NO: 3957823 - RNA, 16 nt, Staphylococcus aureus subsp. aureus Mu50
aucuucacacuuuuag

SEQ ID NO: 3957824 - RNA, 15 nt, Staphylococcus aureus subsp. aureus Mu50
aucuucaguuauuug

SEQ ID NO: 3957825 - RNA, 15 nt, Staphylococcus aureus subsp. aureus Mu50
aucuucaucauugua

SEQ ID NO: 3957826 - RNA, 14 nt, Staphylococcus aureus subsp. aureus Mu50
aucuucaugaacag

SEQ ID NO: 3957827 - RNA, 12 nt, Staphylococcus aureus subsp. aureus Mu50
aucuucauguau

SEQ ID NO: 3957828 - RNA, 14 nt, Staphylococcus aureus subsp. aureus Mu50
aucuucauuuaaaa

SEQ ID NO: 3957829 - RNA, 17 nt, Staphylococcus aureus subsp. aureus Mu50
aucuucgacaacugauu

SEQ ID NO: 3957830 - RNA, 16 nt, Staphylococcus aureus subsp. aureus Mu50
aucuucgacuacaagu

SEQ ID NO: 3957831 - RNA, 15 nt, Staphylococcus aureus subsp. aureus Mu50
aucuucuaauuaaga

SEQ ID NO: 3957832 - RNA, 17 nt, Staphylococcus aureus subsp. aureus Mu50
aucuucuaguaauucuu

SEQ ID NO: 3957833 - RNA, 19 nt, Staphylococcus aureus subsp. aureus Mu50
aucuucuaguaauucuuca

SEQ ID NO: 3957834 - RNA, 20 nt, Staphylococcus aureus subsp. aureus Mu50
aucuucuaguaauucuucau

SEQ ID NO: 3957835 - RNA, 18 nt, Staphylococcus aureus subsp. aureus Mu50
aucuucugauacaucauc

SEQ ID NO: 3957836 - RNA, 22 nt, Staphylococcus aureus subsp. aureus Mu50
aucuucuggauagguaucacua

SEQ ID NO: 3957837 - RNA, 21 nt, Staphylococcus aureus subsp. aureus Mu50
aucuucuuuuaauauuugaua

SEQ ID NO: 3957838 - RNA, 15 nt, Staphylococcus aureus subsp. aureus Mu50
aucuucuuuuucuac

SEQ ID NO: 3957839 - RNA, 19 nt, Staphylococcus aureus subsp. aureus Mu50
aucuugauuauauuuuucu

SEQ ID NO: 3957840 - RNA, 17 nt, Staphylococcus aureus subsp. aureus Mu50
aucuugauuuuauaaau

SEQ ID NO: 3957841 - RNA, 15 nt, Staphylococcus aureus subsp. aureus Mu50
aucuugcaaguauuu

SEQ ID NO: 3957842 - RNA, 20 nt, Staphylococcus aureus subsp. aureus Mu50
aucuugcuuauugauauaag

SEQ ID NO: 3957843 - RNA, 16 nt, Staphylococcus aureus subsp. aureus Mu50
aucuugcuuggauaau

SEQ ID NO: 3957844 - RNA, 21 nt, Staphylococcus aureus subsp. aureus Mu50
aucuugcuuggauaauugcau

SEQ ID NO: 3957845 - RNA, 22 nt, Staphylococcus aureus subsp. aureus Mu50
aucuugcuuggauaauugcauu

SEQ ID NO: 3957846 - RNA, 23 nt, Staphylococcus aureus subsp. aureus Mu50
aucuugucuaguucgauuuuuua

SEQ ID NO: 3957847 - RNA, 19 nt, Staphylococcus aureus subsp. aureus Mu50
aucuuguuuucauuuaaaa

SEQ ID NO: 3957848 - RNA, 17 nt, Staphylococcus aureus subsp. aureus Mu50
aucuuuaaagaaaauuu

SEQ ID NO: 3957849 - RNA, 14 nt, Staphylococcus aureus subsp. aureus Mu50
aucuuuaaauguau

SEQ ID NO: 3957850 - RNA, 14 nt, Staphylococcus aureus subsp. aureus Mu50
augaauaaauacaa

SEQ ID NO: 3957851 - RNA, 18 nt, Staphylococcus aureus subsp. aureus Mu50
augaauaaauagauaaua

SEQ ID NO: 3957852 - RNA, 21 nt, Staphylococcus aureus subsp. aureus Mu50
augaauaaauagauaauauau

SEQ ID NO: 3957853 - RNA, 18 nt, Staphylococcus aureus subsp. aureus Mu50
augaauaagucuaauguu

SEQ ID NO: 3957854 - RNA, 18 nt, Staphylococcus aureus subsp. aureus Mu50
augaauaaucaaaguucg

SEQ ID NO: 3957855 - RNA, 15 nt, Staphylococcus aureus subsp. aureus Mu50
augaauaaugcaauu

SEQ ID NO: 3957856 - RNA, 20 nt, Staphylococcus aureus subsp. aureus Mu50
augaauaauguuuccauuua

SEQ ID NO: 3957857 - RNA, 22 nt, Staphylococcus aureus subsp. aureus Mu50
augaauaauuagauuuaaaaug

SEQ ID NO: 3957858 - RNA, 18 nt, Staphylococcus aureus subsp. aureus Mu50
augaauaauugcuaaaau

SEQ ID NO: 3957859 - RNA, 13 nt, Staphylococcus aureus subsp. aureus Mu50
augaauagaugau

SEQ ID NO: 3957860 - RNA, 16 nt, Staphylococcus aureus subsp. aureus Mu50
augaaucaacaauuua

SEQ ID NO: 3957861 - RNA, 13 nt, Staphylococcus aureus subsp. aureus Mu50
augaaucaauugc

SEQ ID NO: 3957862 - RNA, 22 nt, Staphylococcus aureus subsp. aureus Mu50
augaaucagaugauuuaauucu

SEQ ID NO: 3957863 - RNA, 12 nt, Staphylococcus aureus subsp. aureus Mu50
augaaucauuuu

SEQ ID NO: 3957864 - RNA, 22 nt, Staphylococcus aureus subsp. aureus Mu50
augaaucccauaacaaucauuu

SEQ ID NO: 3957865 - RNA, 23 nt, Staphylococcus aureus subsp. aureus Mu50
augaaucccauaacaaucauuuc

SEQ ID NO: 3957866 - RNA, 19 nt, Staphylococcus aureus subsp. aureus Mu50
augaaucccauaaugacua

SEQ ID NO: 3957867 - RNA, 15 nt, Staphylococcus aureus subsp. aureus Mu50
augaaucgauauaau

SEQ ID NO: 3957868 - RNA, 18 nt, Staphylococcus aureus subsp. aureus Mu50
augaaucuagaauauaac

SEQ ID NO: 3957869 - RNA, 19 nt, Staphylococcus aureus subsp. aureus Mu50
augaaugccuaauuuugug

SEQ ID NO: 3957870 - RNA, 21 nt, Staphylococcus aureus subsp. aureus Mu50
augaaugccuaauuuugugaa

SEQ ID NO: 3957871 - RNA, 22 nt, Staphylococcus aureus subsp. aureus Mu50
augaauggcaaucuauauaaau

SEQ ID NO: 3957872 - RNA, 16 nt, Staphylococcus aureus subsp. aureus Mu50
augaauguuaagacau

SEQ ID NO: 3957873 - RNA, 14 nt, Staphylococcus aureus subsp. aureus Mu50
augaauuaauagcu

SEQ ID NO: 3957874 - RNA, 23 nt, Staphylococcus aureus subsp. aureus Mu50
augaauugaguauuaaauuugaa

SEQ ID NO: 3957875 - RNA, 21 nt, Staphylococcus aureus subsp. aureus Mu50
augaauugcuuguuuuaaaug

SEQ ID NO: 3957876 - RNA, 19 nt, Staphylococcus aureus subsp. aureus Mu50
augaauugucuuaauaugc

SEQ ID NO: 3957877 - RNA, 21 nt, Staphylococcus aureus subsp. aureus Mu50
augaauuguuaguuuucuuaa

SEQ ID NO: 3957878 - RNA, 18 nt, Staphylococcus aureus subsp. aureus Mu50
augaauuguuguacaugu

SEQ ID NO: 3957879 - RNA, 20 nt, Staphylococcus aureus subsp. aureus Mu50
augaauuguuguacauguau

SEQ ID NO: 3957880 - RNA, 20 nt, Staphylococcus aureus subsp. aureus Mu50
augaauuuacuccuuacaau

SEQ ID NO: 3957881 - RNA, 22 nt, Staphylococcus aureus subsp. aureus Mu50
augaauuuagaugcauaaaaaa

SEQ ID NO: 3957882 - RNA, 19 nt, Staphylococcus aureus subsp. aureus Mu50
augaauuuagcaucaaaaa

SEQ ID NO: 3957883 - RNA, 19 nt, Staphylococcus aureus subsp. aureus Mu50
augaauuucuaauuuagua

SEQ ID NO: 3957884 - RNA, 16 nt, Staphylococcus aureus subsp. aureus Mu50
augaauuuuaauauau

SEQ ID NO: 3957885 - RNA, 13 nt, Staphylococcus aureus subsp. aureus Mu50
augaauuuuauaa

SEQ ID NO: 3957886 - RNA, 15 nt, Staphylococcus aureus subsp. aureus Mu50
augaauuuuauaaau

SEQ ID NO: 3957887 - RNA, 14 nt, Staphylococcus aureus subsp. aureus Mu50
augaauuuuuauuu

SEQ ID NO: 3957888 - RNA, 15 nt, Staphylococcus aureus subsp. aureus Mu50
augacaaauuaucac

SEQ ID NO: 3957889 - RNA, 22 nt, Staphylococcus aureus subsp. aureus Mu50
augacaacuucacgcaaaacaa

SEQ ID NO: 3957890 - RNA, 14 nt, Staphylococcus aureus subsp. aureus Mu50
augacacauacacc

SEQ ID NO: 3957891 - RNA, 19 nt, Staphylococcus aureus subsp. aureus Mu50
augacagcaucaucaauuu

SEQ ID NO: 3957892 - RNA, 15 nt, Staphylococcus aureus subsp. aureus Mu50
augacaguaaucaaa

SEQ ID NO: 3957893 - RNA, 15 nt, Staphylococcus aureus subsp. aureus Mu50
augacaucaauaucu

SEQ ID NO: 3957894 - RNA, 15 nt, Staphylococcus aureus subsp. aureus Mu50
augacauccauacaa

SEQ ID NO: 3957895 - RNA, 15 nt, Staphylococcus aureus subsp. aureus Mu50
augacauuuaauacu

SEQ ID NO: 3957896 - RNA, 18 nt, Staphylococcus aureus subsp. aureus Mu50
augacauuuaauacuuuu

SEQ ID NO: 3957897 - RNA, 20 nt, Staphylococcus aureus subsp. aureus Mu50
augacauuuaauacuuuucu

SEQ ID NO: 3957898 - RNA, 21 nt, Staphylococcus aureus subsp. aureus Mu50
augacauuuaauacuuuucuc

SEQ ID NO: 3957899 - RNA, 13 nt, Staphylococcus aureus subsp. aureus Mu50
augaccaauauuc

SEQ ID NO: 3957900 - RNA, 19 nt, Staphylococcus aureus subsp. aureus Mu50
augaccaugauauauaaca

SEQ ID NO: 3957901 - RNA, 16 nt, Staphylococcus aureus subsp. aureus Mu50
augaccuaauauauua

SEQ ID NO: 3957902 - RNA, 16 nt, Staphylococcus aureus subsp. aureus Mu50
augaccuuaauauaac

SEQ ID NO: 3957903 - RNA, 16 nt, Staphylococcus aureus subsp. aureus Mu50
augacgaacgauagau

SEQ ID NO: 3957904 - RNA, 20 nt, Staphylococcus aureus subsp. aureus Mu50
augacgagaauuaaagucug

SEQ ID NO: 3957905 - RNA, 16 nt, Staphylococcus aureus subsp. aureus Mu50
augacgauaccuuuaa

SEQ ID NO: 3957906 - RNA, 16 nt, Staphylococcus aureus subsp. aureus Mu50
augacgugcuuuuaaa

SEQ ID NO: 3957907 - RNA, 14 nt, Staphylococcus aureus subsp. aureus Mu50
augacuaacgaaaa

SEQ ID NO: 3957908 - RNA, 13 nt, Staphylococcus aureus subsp. aureus Mu50
augacucacuaau

SEQ ID NO: 3957909 - RNA, 18 nt, Staphylococcus aureus subsp. aureus Mu50
augacugagaaaaauauu

SEQ ID NO: 3957910 - RNA, 22 nt, Staphylococcus aureus subsp. aureus Mu50
augacugagaaaaauauuucua

SEQ ID NO: 3957911 - RNA, 13 nt, Staphylococcus aureus subsp. aureus Mu50
augacugcaaaua

SEQ ID NO: 3957912 - RNA, 15 nt, Staphylococcus aureus subsp. aureus Mu50
augacuuauuuuuca

SEQ ID NO: 3957913 - RNA, 18 nt, Staphylococcus aureus subsp. aureus Mu50
augacuuauuuuucauca

SEQ ID NO: 3957914 - RNA, 19 nt, Staphylococcus aureus subsp. aureus Mu50
augacuuauuuuucaucau

SEQ ID NO: 3957915 - RNA, 22 nt, Staphylococcus aureus subsp. aureus Mu50
augacuuauuuuucaucauuua

SEQ ID NO: 3957916 - RNA, 16 nt, Staphylococcus aureus subsp. aureus Mu50
augacuucacauuuau

SEQ ID NO: 3957917 - RNA, 15 nt, Staphylococcus aureus subsp. aureus Mu50
augacuucuuuauau

SEQ ID NO: 3957918 - RNA, 16 nt, Staphylococcus aureus subsp. aureus Mu50
augacuuuuuauuagu

SEQ ID NO: 3957919 - RNA, 15 nt, Staphylococcus aureus subsp. aureus Mu50
augagaagcugucuu

SEQ ID NO: 3957920 - RNA, 14 nt, Staphylococcus aureus subsp. aureus Mu50
augagauuauucug

SEQ ID NO: 3957921 - RNA, 18 nt, Staphylococcus aureus subsp. aureus Mu50
augaggaucaacugaaau

SEQ ID NO: 3957922 - RNA, 16 nt, Staphylococcus aureus subsp. aureus Mu50
augaguaugacgaaau

SEQ ID NO: 3957923 - RNA, 20 nt, Staphylococcus aureus subsp. aureus Mu50
augaguucuaguuuuuuuua

SEQ ID NO: 3957924 - RNA, 20 nt, Staphylococcus aureus subsp. aureus Mu50
augaguuguucagauuugua

SEQ ID NO: 3957925 - RNA, 15 nt, Staphylococcus aureus subsp. aureus Mu50
augaguuuaaaaaua

SEQ ID NO: 3957926 - RNA, 19 nt, Staphylococcus aureus subsp. aureus Mu50
augauaaaaauaaaaccga

SEQ ID NO: 3957927 - RNA, 22 nt, Staphylococcus aureus subsp. aureus Mu50
augauaaagagccacuaaugau

SEQ ID NO: 3957928 - RNA, 20 nt, Staphylococcus aureus subsp. aureus Mu50
augauaaccaaucaucgcaa

SEQ ID NO: 3957929 - RNA, 12 nt, Staphylococcus aureus subsp. aureus Mu50
augauaaccauu

SEQ ID NO: 3957930 - RNA, 15 nt, Staphylococcus aureus subsp. aureus Mu50
augauaaguggauuu

SEQ ID NO: 3957931 - RNA, 14 nt, Staphylococcus aureus subsp. aureus Mu50
augauaauaagaau

SEQ ID NO: 3957932 - RNA, 16 nt, Staphylococcus aureus subsp. aureus Mu50
augauaauaagaauau

SEQ ID NO: 3957933 - RNA, 22 nt, Staphylococcus aureus subsp. aureus Mu50
augauaauccaccaaauacagu

SEQ ID NO: 3957934 - RNA, 15 nt, Staphylococcus aureus subsp. aureus Mu50
augauaauuaaugcc

SEQ ID NO: 3957935 - RNA, 18 nt, Staphylococcus aureus subsp. aureus Mu50
augauaauuaaugccauu

SEQ ID NO: 3957936 - RNA, 16 nt, Staphylococcus aureus subsp. aureus Mu50
augauaauuaauuaaa

SEQ ID NO: 3957937 - RNA, 15 nt, Staphylococcus aureus subsp. aureus Mu50
augcauauauauaua

SEQ ID NO: 3957938 - RNA, 16 nt, Staphylococcus aureus subsp. aureus Mu50
augcauauauauauag

SEQ ID NO: 3957939 - RNA, 16 nt, Staphylococcus aureus subsp. aureus Mu50
augcaugcgcaaaagc

SEQ ID NO: 3957940 - RNA, 17 nt, Staphylococcus aureus subsp. aureus Mu50
augcaugcgcaaaagcg

SEQ ID NO: 3957941 - RNA, 24 nt, Staphylococcus aureus subsp. aureus Mu50
augcaugcgcaaaagcgcaggcga

SEQ ID NO: 3957942 - RNA, 18 nt, Staphylococcus aureus subsp. aureus Mu50
augcaugcuucucaauuu

SEQ ID NO: 3957943 - RNA, 20 nt, Staphylococcus aureus subsp. aureus Mu50
augcaugcuucucaauuugu

SEQ ID NO: 3957944 - RNA, 21 nt, Staphylococcus aureus subsp. aureus Mu50
augcauuacuacuuuauaaau

SEQ ID NO: 3957945 - RNA, 17 nt, Staphylococcus aureus subsp. aureus Mu50
augcauuauuauaauag

SEQ ID NO: 3957946 - RNA, 13 nt, Staphylococcus aureus subsp. aureus Mu50
augcauucaauau

SEQ ID NO: 3957947 - RNA, 14 nt, Staphylococcus aureus subsp. aureus Mu50
augcauuuaauuua

SEQ ID NO: 3957948 - RNA, 17 nt, Staphylococcus aureus subsp. aureus Mu50
augcauuuaauuuaauu

SEQ ID NO: 3957949 - RNA, 13 nt, Staphylococcus aureus subsp. aureus Mu50
augccaacuauac

SEQ ID NO: 3957950 - RNA, 21 nt, Staphylococcus aureus subsp. aureus Mu50
augccaccguggaauuuacca

SEQ ID NO: 3957951 - RNA, 18 nt, Staphylococcus aureus subsp. aureus Mu50
augccacgcucauuuucu

SEQ ID NO: 3957952 - RNA, 19 nt, Staphylococcus aureus subsp. aureus Mu50
augccagcuucuaacaaau

SEQ ID NO: 3957953 - RNA, 17 nt, Staphylococcus aureus subsp. aureus Mu50
augccauaccugcaccu

SEQ ID NO: 3957954 - RNA, 13 nt, Staphylococcus aureus subsp. aureus Mu50
augccgccuaaua

SEQ ID NO: 3957955 - RNA, 15 nt, Staphylococcus aureus subsp. aureus Mu50
augccggucauaaca

SEQ ID NO: 3957956 - RNA, 18 nt, Staphylococcus aureus subsp. aureus Mu50
augccucaguuagaagau

SEQ ID NO: 3957957 - RNA, 20 nt, Staphylococcus aureus subsp. aureus Mu50
augccuuaugucauauacua

SEQ ID NO: 3957958 - RNA, 18 nt, Staphylococcus aureus subsp. aureus Mu50
augccuuuuauuuaucuu

SEQ ID NO: 3957959 - RNA, 22 nt, Staphylococcus aureus subsp. aureus Mu50
augccuuuuauuuaucuuuuaa

SEQ ID NO: 3957960 - RNA, 22 nt, Staphylococcus aureus subsp. aureus Mu50
augcgauucucauuuacuugau

SEQ ID NO: 3957961 - RNA, 15 nt, Staphylococcus aureus subsp. aureus Mu50
augcgcaaugaaaac

SEQ ID NO: 3957962 - RNA, 19 nt, Staphylococcus aureus subsp. aureus Mu50
augcguggugugaauguuu

SEQ ID NO: 3957963 - RNA, 17 nt, Staphylococcus aureus subsp. aureus Mu50
augcuaaaaauauugaa

SEQ ID NO: 3957964 - RNA, 13 nt, Staphylococcus aureus subsp. aureus Mu50
augcuaaacuugc

SEQ ID NO: 3957965 - RNA, 20 nt, Staphylococcus aureus subsp. aureus Mu50
augcuaauacuaaucaaaga

SEQ ID NO: 3957966 - RNA, 18 nt, Staphylococcus aureus subsp. aureus Mu50
augcuagaaaguaaugcu

SEQ ID NO: 3957967 - RNA, 19 nt, Staphylococcus aureus subsp. aureus Mu50
augcuagcuuucuuuuuca

SEQ ID NO: 3957968 - RNA, 23 nt, Staphylococcus aureus subsp. aureus Mu50
augcuagcuuucuuuuucaucuu

SEQ ID NO: 3957969 - RNA, 16 nt, Staphylococcus aureus subsp. aureus Mu50
augcuauauuucggua

SEQ ID NO: 3957970 - RNA, 22 nt, Staphylococcus aureus subsp. aureus Mu50
augcuauauuucgguauuuuaa

SEQ ID NO: 3957971 - RNA, 18 nt, Staphylococcus aureus subsp. aureus Mu50
augcuaucucuaccauuu

SEQ ID NO: 3957972 - RNA, 18 nt, Staphylococcus aureus subsp. aureus Mu50
augcucaaguugauuauu

SEQ ID NO: 3957973 - RNA, 20 nt, Staphylococcus aureus subsp. aureus Mu50
augcucacuuuuuaaaguaa

SEQ ID NO: 3957974 - RNA, 16 nt, Staphylococcus aureus subsp. aureus Mu50
augcucccuucaaagu

SEQ ID NO: 3957975 - RNA, 21 nt, Staphylococcus aureus subsp. aureus Mu50
augcucccuucaaaguuuuca

SEQ ID NO: 3957976 - RNA, 15 nt, Staphylococcus aureus subsp. aureus Mu50
augcucguauagaaa

SEQ ID NO: 3957977 - RNA, 14 nt, Staphylococcus aureus subsp. aureus Mu50
augcucuacaaagu

SEQ ID NO: 3957978 - RNA, 15 nt, Staphylococcus aureus subsp. aureus Mu50
augcucuacaaaguu

SEQ ID NO: 3957979 - RNA, 21 nt, Staphylococcus aureus subsp. aureus Mu50
augcucuauauauccauucaa

SEQ ID NO: 3957980 - RNA, 16 nt, Staphylococcus aureus subsp. aureus Mu50
augcucucuucaaagu

SEQ ID NO: 3957981 - RNA, 17 nt, Staphylococcus aureus subsp. aureus Mu50
augcugauaauuuuucu

SEQ ID NO: 3957982 - RNA, 14 nt, Staphylococcus aureus subsp. aureus Mu50
augcuggguaauaa

SEQ ID NO: 3957983 - RNA, 13 nt, Staphylococcus aureus subsp. aureus Mu50
augcuguacuaua

SEQ ID NO: 3957984 - RNA, 22 nt, Staphylococcus aureus subsp. aureus Mu50
augcuguacuauauucaaugau

SEQ ID NO: 3957985 - RNA, 20 nt, Staphylococcus aureus subsp. aureus Mu50
augcuguguaucaucauaau

SEQ ID NO: 3957986 - RNA, 23 nt, Staphylococcus aureus subsp. aureus Mu50
augcuuauauaaacaaaaaucua

SEQ ID NO: 3957987 - RNA, 13 nt, Staphylococcus aureus subsp. aureus Mu50
augcuucaauauu

SEQ ID NO: 3957988 - RNA, 18 nt, Staphylococcus aureus subsp. aureus Mu50
augcuucaauauucuuau

SEQ ID NO: 3957989 - RNA, 19 nt, Staphylococcus aureus subsp. aureus Mu50
augcuucaauauucuuauc

SEQ ID NO: 3957990 - RNA, 21 nt, Staphylococcus aureus subsp. aureus Mu50
augcuucaauauucuuaucau

SEQ ID NO: 3957991 - RNA, 18 nt, Staphylococcus aureus subsp. aureus Mu50
augcuuccuuuuuguuau

SEQ ID NO: 3957992 - RNA, 15 nt, Staphylococcus aureus subsp. aureus Mu50
augcuucuaacugaa

SEQ ID NO: 3957993 - RNA, 19 nt, Staphylococcus aureus subsp. aureus Mu50
augcuucucacaacugcau

SEQ ID NO: 3957994 - RNA, 22 nt, Staphylococcus aureus subsp. aureus Mu50
augcuucucacaacugcauaua

SEQ ID NO: 3957995 - RNA, 21 nt, Staphylococcus aureus subsp. aureus Mu50
augcuucugguucuucaauau

SEQ ID NO: 3957996 - RNA, 15 nt, Staphylococcus aureus subsp. aureus Mu50
augcuugaauguuug

SEQ ID NO: 3957997 - RNA, 17 nt, Staphylococcus aureus subsp. aureus Mu50
augcuuguacaaaaaau

SEQ ID NO: 3957998 - RNA, 22 nt, Staphylococcus aureus subsp. aureus Mu50
augcuuguacaaaaaauuguaa

SEQ ID NO: 3957999 - RNA, 20 nt, Staphylococcus aureus subsp. aureus Mu50
augcuuguugugaauaaaau

SEQ ID NO: 3958000 - RNA, 17 nt, Staphylococcus aureus subsp. aureus Mu50
augcuuuaauuaaaguu

SEQ ID NO: 3958001 - RNA, 20 nt, Staphylococcus aureus subsp. aureus Mu50
augcuuuuuuuacaauauga

SEQ ID NO: 3958002 - RNA, 23 nt, Staphylococcus aureus subsp. aureus Mu50
augcuuuuuuuacaauaugauua

SEQ ID NO: 3958003 - RNA, 13 nt, Staphylococcus aureus subsp. aureus Mu50
auggaaaaguuuu

SEQ ID NO: 3958004 - RNA, 16 nt, Staphylococcus aureus subsp. aureus Mu50
auggaaaaguuuuuua

SEQ ID NO: 3958005 - RNA, 23 nt, Staphylococcus aureus subsp. aureus Mu50
auggaaaaguuuuuuacuuuuca

SEQ ID NO: 3958006 - RNA, 16 nt, Staphylococcus aureus subsp. aureus Mu50
auggaaagacguuuuu

SEQ ID NO: 3958007 - RNA, 15 nt, Staphylococcus aureus subsp. aureus Mu50
auggaaaguaauaag

SEQ ID NO: 3958008 - RNA, 15 nt, Staphylococcus aureus subsp. aureus Mu50
auggacuaauuuauu

SEQ ID NO: 3958009 - RNA, 13 nt, Staphylococcus aureus subsp. aureus Mu50
auggagcaugauu

SEQ ID NO: 3958010 - RNA, 16 nt, Staphylococcus aureus subsp. aureus Mu50
auggagcggaagauag

SEQ ID NO: 3958011 - RNA, 18 nt, Staphylococcus aureus subsp. aureus Mu50
auggagcggaagauagga

SEQ ID NO: 3958012 - RNA, 16 nt, Staphylococcus aureus subsp. aureus Mu50
auggauacuuaaagau

SEQ ID NO: 3958013 - RNA, 18 nt, Staphylococcus aureus subsp. aureus Mu50
auggauacuuaaagauuu

SEQ ID NO: 3958014 - RNA, 16 nt, Staphylococcus aureus subsp. aureus Mu50
auggaugaauauauug

SEQ ID NO: 3958015 - RNA, 19 nt, Staphylococcus aureus subsp. aureus Mu50
auggaugccgcucuuuuuu

SEQ ID NO: 3958016 - RNA, 20 nt, Staphylococcus aureus subsp. aureus Mu50
auggaugccgcucuuuuuua

SEQ ID NO: 3958017 - RNA, 23 nt, Staphylococcus aureus subsp. aureus Mu50
auggauuacagcguaacuaaaga

SEQ ID NO: 3958018 - RNA, 20 nt, Staphylococcus aureus subsp. aureus Mu50
auggauuuggucaaguuuug

SEQ ID NO: 3958019 - RNA, 17 nt, Staphylococcus aureus subsp. aureus Mu50
auggcaaucuauauaaa

SEQ ID NO: 3958020 - RNA, 22 nt, Staphylococcus aureus subsp. aureus Mu50
auggcacuuaauauaaggaaga

SEQ ID NO: 3958021 - RNA, 23 nt, Staphylococcus aureus subsp. aureus Mu50
auggcaguaguugacugaacgaa

SEQ ID NO: 3958022 - RNA, 23 nt, Staphylococcus aureus subsp. aureus Mu50
auggcaguuuuggcgaaccauac

SEQ ID NO: 3958023 - RNA, 14 nt, Staphylococcus aureus subsp. aureus Mu50
auggcauuauugcc

SEQ ID NO: 3958024 - RNA, 16 nt, Staphylococcus aureus subsp. aureus Mu50
augucacauaugacuu

SEQ ID NO: 3958025 - RNA, 17 nt, Staphylococcus aureus subsp. aureus Mu50
augucacugcaaacaca

SEQ ID NO: 3958026 - RNA, 18 nt, Staphylococcus aureus subsp. aureus Mu50
augucacuguuaaagaug

SEQ ID NO: 3958027 - RNA, 18 nt, Staphylococcus aureus subsp. aureus Mu50
augucaguuuugaagaau

SEQ ID NO: 3958028 - RNA, 16 nt, Staphylococcus aureus subsp. aureus Mu50
augucauagccuauuu

SEQ ID NO: 3958029 - RNA, 19 nt, Staphylococcus aureus subsp. aureus Mu50
augucauauacuauauguc

SEQ ID NO: 3958030 - RNA, 23 nt, Staphylococcus aureus subsp. aureus Mu50
augucauaucuuuauuugauucu

SEQ ID NO: 3958031 - RNA, 13 nt, Staphylococcus aureus subsp. aureus Mu50
augucauaugcac

SEQ ID NO: 3958032 - RNA, 15 nt, Staphylococcus aureus subsp. aureus Mu50
augucaugaaaauaa

SEQ ID NO: 3958033 - RNA, 15 nt, Staphylococcus aureus subsp. aureus Mu50
augucaugucuagau

SEQ ID NO: 3958034 - RNA, 20 nt, Staphylococcus aureus subsp. aureus Mu50
augucaugucuagauuuuaa

SEQ ID NO: 3958035 - RNA, 13 nt, Staphylococcus aureus subsp. aureus Mu50
augucauucuagu

SEQ ID NO: 3958036 - RNA, 23 nt, Staphylococcus aureus subsp. aureus Mu50
auguccaucuuuuauuaaagaaa

SEQ ID NO: 3958037 - RNA, 18 nt, Staphylococcus aureus subsp. aureus Mu50
augucccagauucauauc

SEQ ID NO: 3958038 - RNA, 20 nt, Staphylococcus aureus subsp. aureus Mu50
augucccguuuaccuuaaau

SEQ ID NO: 3958039 - RNA, 16 nt, Staphylococcus aureus subsp. aureus Mu50
augucgaaaauagcua

SEQ ID NO: 3958040 - RNA, 16 nt, Staphylococcus aureus subsp. aureus Mu50
augucgauauuucuag

SEQ ID NO: 3958041 - RNA, 17 nt, Staphylococcus aureus subsp. aureus Mu50
augucgaucuaacaauu

SEQ ID NO: 3958042 - RNA, 17 nt, Staphylococcus aureus subsp. aureus Mu50
augucgcacuauaaaau

SEQ ID NO: 3958043 - RNA, 23 nt, Staphylococcus aureus subsp. aureus Mu50
augucgcacuauaaaauucacca

SEQ ID NO: 3958044 - RNA, 14 nt, Staphylococcus aureus subsp. aureus Mu50
augucuaaaaaugu

SEQ ID NO: 3958045 - RNA, 14 nt, Staphylococcus aureus subsp. aureus Mu50
augucucuuucuuu

SEQ ID NO: 3958046 - RNA, 22 nt, Staphylococcus aureus subsp. aureus Mu50
augucuuaggcgcuacaauguu

SEQ ID NO: 3958047 - RNA, 17 nt, Staphylococcus aureus subsp. aureus Mu50
augucuucauaaucgua

SEQ ID NO: 3958048 - RNA, 13 nt, Staphylococcus aureus subsp. aureus Mu50
augucuuucaaau

SEQ ID NO: 3958049 - RNA, 15 nt, Staphylococcus aureus subsp. aureus Mu50
augucuuugaaaaac

SEQ ID NO: 3958050 - RNA, 13 nt, Staphylococcus aureus subsp. aureus Mu50
augugaaaauuua

SEQ ID NO: 3958051 - RNA, 15 nt, Staphylococcus aureus subsp. aureus Mu50
augugacauaccagu

SEQ ID NO: 3958052 - RNA, 12 nt, Staphylococcus aureus subsp. aureus Mu50
augugaugauua

SEQ ID NO: 3958053 - RNA, 17 nt, Staphylococcus aureus subsp. aureus Mu50
augugaugcuugaaugu

SEQ ID NO: 3958054 - RNA, 20 nt, Staphylococcus aureus subsp. aureus Mu50
augugaugcuugaauguuug

SEQ ID NO: 3958055 - RNA, 21 nt, Staphylococcus aureus subsp. aureus Mu50
augugauuaauuucauguuca

SEQ ID NO: 3958056 - RNA, 17 nt, Staphylococcus aureus subsp. aureus Mu50
augugcaucauuuauau

SEQ ID NO: 3958057 - RNA, 20 nt, Staphylococcus aureus subsp. aureus Mu50
augugccguaucuauaaaaa

SEQ ID NO: 3958058 - RNA, 18 nt, Staphylococcus aureus subsp. aureus Mu50
augugccuuucuaauauu

SEQ ID NO: 3958059 - RNA, 17 nt, Staphylococcus aureus subsp. aureus Mu50
augugcgucacucacuu

SEQ ID NO: 3958060 - RNA, 16 nt, Staphylococcus aureus subsp. aureus Mu50
augugcuaaucuauuu

SEQ ID NO: 3958061 - RNA, 15 nt, Staphylococcus aureus subsp. aureus Mu50
augugcuaccuacuu

SEQ ID NO: 3958062 - RNA, 21 nt, Staphylococcus aureus subsp. aureus Mu50
augugcuuguaacaagcuuuu

SEQ ID NO: 3958063 - RNA, 14 nt, Staphylococcus aureus subsp. aureus Mu50
augugcuuuaucaa

SEQ ID NO: 3958064 - RNA, 19 nt, Staphylococcus aureus subsp. aureus Mu50
augugcuuuguuuaucaau

SEQ ID NO: 3958065 - RNA, 14 nt, Staphylococcus aureus subsp. aureus Mu50
auguggcacucaua

SEQ ID NO: 3958066 - RNA, 17 nt, Staphylococcus aureus subsp. aureus Mu50
auguggguguaccaauu

SEQ ID NO: 3958067 - RNA, 22 nt, Staphylococcus aureus subsp. aureus Mu50
auguggguguaccaauugauuu

SEQ ID NO: 3958068 - RNA, 17 nt, Staphylococcus aureus subsp. aureus Mu50
augugguggcuauauaa

SEQ ID NO: 3958069 - RNA, 18 nt, Staphylococcus aureus subsp. aureus Mu50
augugucacaaugaccau

SEQ ID NO: 3958070 - RNA, 18 nt, Staphylococcus aureus subsp. aureus Mu50
augugucauaauccauuc

SEQ ID NO: 3958071 - RNA, 20 nt, Staphylococcus aureus subsp. aureus Mu50
augugucauaauccauucuu

SEQ ID NO: 3958072 - RNA, 15 nt, Staphylococcus aureus subsp. aureus Mu50
auguguuaaaccaac

SEQ ID NO: 3958073 - RNA, 24 nt, Staphylococcus aureus subsp. aureus Mu50
auguguuaaucaacguauauaagu

SEQ ID NO: 3958074 - RNA, 18 nt, Staphylococcus aureus subsp. aureus Mu50
auguguuauguuagauga

SEQ ID NO: 3958075 - RNA, 22 nt, Staphylococcus aureus subsp. aureus Mu50
auguguugcauuacuaucuuca

SEQ ID NO: 3958076 - RNA, 16 nt, Staphylococcus aureus subsp. aureus Mu50
auguguugugauauau

SEQ ID NO: 3958077 - RNA, 14 nt, Staphylococcus aureus subsp. aureus Mu50
auguguuguuuuaa

SEQ ID NO: 3958078 - RNA, 21 nt, Staphylococcus aureus subsp. aureus Mu50
auguguuguuuuaauuguuca

SEQ ID NO: 3958079 - RNA, 15 nt, Staphylococcus aureus subsp. aureus Mu50
auguguuuuaauaau

SEQ ID NO: 3958080 - RNA, 14 nt, Staphylococcus aureus subsp. aureus Mu50
auguguuuucaaca

SEQ ID NO: 3958081 - RNA, 19 nt, Staphylococcus aureus subsp. aureus Mu50
auguuaaaauaacugcuaa

SEQ ID NO: 3958082 - RNA, 17 nt, Staphylococcus aureus subsp. aureus Mu50
auguuaaagauuauuau

SEQ ID NO: 3958083 - RNA, 17 nt, Staphylococcus aureus subsp. aureus Mu50
auguuaaaucgauacug

SEQ ID NO: 3958084 - RNA, 11 nt, Staphylococcus aureus subsp. aureus Mu50
auguuaaauua

SEQ ID NO: 3958085 - RNA, 17 nt, Staphylococcus aureus subsp. aureus Mu50
auguuaacugcaaacuu

SEQ ID NO: 3958086 - RNA, 12 nt, Staphylococcus aureus subsp. aureus Mu50
auguuaauaaug

SEQ ID NO: 3958087 - RNA, 14 nt, Staphylococcus aureus subsp. aureus Mu50
auguuacacaaauu

SEQ ID NO: 3958088 - RNA, 19 nt, Staphylococcus aureus subsp. aureus Mu50
auguuacacaaauuaaaac

SEQ ID NO: 3958089 - RNA, 16 nt, Staphylococcus aureus subsp. aureus Mu50
auguuacuuauauauu

SEQ ID NO: 3958090 - RNA, 17 nt, Staphylococcus aureus subsp. aureus Mu50
auguuacuuauauauuc

SEQ ID NO: 3958091 - RNA, 21 nt, Staphylococcus aureus subsp. aureus Mu50
auguuagaugacuuugucaua

SEQ ID NO: 3958092 - RNA, 15 nt, Staphylococcus aureus subsp. aureus Mu50
auguuauaaaaugaa

SEQ ID NO: 3958093 - RNA, 20 nt, Staphylococcus aureus subsp. aureus Mu50
auguuauauuaaacuuauaa

SEQ ID NO: 3958094 - RNA, 21 nt, Staphylococcus aureus subsp. aureus Mu50
auguuauauuaaacuuauaac

SEQ ID NO: 3958095 - RNA, 13 nt, Staphylococcus aureus subsp. aureus Mu50
auguuaucgauau

SEQ ID NO: 3958096 - RNA, 20 nt, Staphylococcus aureus subsp. aureus Mu50
auguuaucgauauagcauaa

SEQ ID NO: 3958097 - RNA, 15 nt, Staphylococcus aureus subsp. aureus Mu50
auguuauuaaccauc

SEQ ID NO: 3958098 - RNA, 22 nt, Staphylococcus aureus subsp. aureus Mu50
auguuauugcuuauguuuuuaa

SEQ ID NO: 3958099 - RNA, 20 nt, Staphylococcus aureus subsp. aureus Mu50
auguuauuguuccaaucuuu

SEQ ID NO: 3958100 - RNA, 22 nt, Staphylococcus aureus subsp. aureus Mu50
auguucaaauguaguuaagaua

SEQ ID NO: 3958101 - RNA, 12 nt, Staphylococcus aureus subsp. aureus Mu50
auguucauaaua

SEQ ID NO: 3958102 - RNA, 13 nt, Staphylococcus aureus subsp. aureus Mu50
auguucaucaaca

SEQ ID NO: 3958103 - RNA, 18 nt, Staphylococcus aureus subsp. aureus Mu50
auguucaucaacaugaua

SEQ ID NO: 3958104 - RNA, 20 nt, Staphylococcus aureus subsp. aureus Mu50
auguuccauauaaccuauuu

SEQ ID NO: 3958105 - RNA, 18 nt, Staphylococcus aureus subsp. aureus Mu50
auguuccccauuaauuaa

SEQ ID NO: 3958106 - RNA, 17 nt, Staphylococcus aureus subsp. aureus Mu50
auguucccuuaccauuu

SEQ ID NO: 3958107 - RNA, 16 nt, Staphylococcus aureus subsp. aureus Mu50
auguuccgcuacaaaa

SEQ ID NO: 3958108 - RNA, 20 nt, Staphylococcus aureus subsp. aureus Mu50
auguuccuuguuuuaaacuu

SEQ ID NO: 3958109 - RNA, 21 nt, Staphylococcus aureus subsp. aureus Mu50
auguucgauuauucuuaauuu

SEQ ID NO: 3958110 - RNA, 20 nt, Staphylococcus aureus subsp. aureus Mu50
auguucuuauaaaaaacaau

SEQ ID NO: 3958111 - RNA, 15 nt, Staphylococcus aureus subsp. aureus Mu50
auguugaaagugaca

SEQ ID NO: 3958112 - RNA, 20 nt, Staphylococcus aureus subsp. aureus Mu50
auuaaauuuuguauaaccuu

SEQ ID NO: 3958113 - RNA, 19 nt, Staphylococcus aureus subsp. aureus Mu50
auuaaauuuuguuaggaga

SEQ ID NO: 3958114 - RNA, 17 nt, Staphylococcus aureus subsp. aureus Mu50
auuaacaacaaauauaa

SEQ ID NO: 3958115 - RNA, 16 nt, Staphylococcus aureus subsp. aureus Mu50
auuaacacauucuuau

SEQ ID NO: 3958116 - RNA, 18 nt, Staphylococcus aureus subsp. aureus Mu50
auuaacacauucuuauuu

SEQ ID NO: 3958117 - RNA, 21 nt, Staphylococcus aureus subsp. aureus Mu50
auuaacaccagauaucauaau

SEQ ID NO: 3958118 - RNA, 20 nt, Staphylococcus aureus subsp. aureus Mu50
auuaacauaacuagcaauuu

SEQ ID NO: 3958119 - RNA, 22 nt, Staphylococcus aureus subsp. aureus Mu50
auuaacauuuugaaucauacga

SEQ ID NO: 3958120 - RNA, 17 nt, Staphylococcus aureus subsp. aureus Mu50
auuaaccaguauaauuu

SEQ ID NO: 3958121 - RNA, 13 nt, Staphylococcus aureus subsp. aureus Mu50
auuaacccaacuc

SEQ ID NO: 3958122 - RNA, 19 nt, Staphylococcus aureus subsp. aureus Mu50
auuaaccuugauuuaauuu

SEQ ID NO: 3958123 - RNA, 18 nt, Staphylococcus aureus subsp. aureus Mu50
auuaacuagugccucuuu

SEQ ID NO: 3958124 - RNA, 21 nt, Staphylococcus aureus subsp. aureus Mu50
auuaacuagugccucuuuuau

SEQ ID NO: 3958125 - RNA, 21 nt, Staphylococcus aureus subsp. aureus Mu50
auuaacugaccuaacaauuug

SEQ ID NO: 3958126 - RNA, 22 nt, Staphylococcus aureus subsp. aureus Mu50
auuaacuguaugccgccuaaua

SEQ ID NO: 3958127 - RNA, 20 nt, Staphylococcus aureus subsp. aureus Mu50
auuaacuguguauggcauaa

SEQ ID NO: 3958128 - RNA, 22 nt, Staphylococcus aureus subsp. aureus Mu50
auuaacuuaaaauuuaaauauu

SEQ ID NO: 3958129 - RNA, 21 nt, Staphylococcus aureus subsp. aureus Mu50
auuaacuuacuuuuguaaaaa

SEQ ID NO: 3958130 - RNA, 15 nt, Staphylococcus aureus subsp. aureus Mu50
auuaagaaaaucauu

SEQ ID NO: 3958131 - RNA, 22 nt, Staphylococcus aureus subsp. aureus Mu50
auuaagaaugcaccaacaauag

SEQ ID NO: 3958132 - RNA, 17 nt, Staphylococcus aureus subsp. aureus Mu50
auuaagacugauuaauu

SEQ ID NO: 3958133 - RNA, 17 nt, Staphylococcus aureus subsp. aureus Mu50
auuaagauguauaugaa

SEQ ID NO: 3958134 - RNA, 19 nt, Staphylococcus aureus subsp. aureus Mu50
auuaagauguauaugaauu

SEQ ID NO: 3958135 - RNA, 19 nt, Staphylococcus aureus subsp. aureus Mu50
auuaagauguugaguugua

SEQ ID NO: 3958136 - RNA, 16 nt, Staphylococcus aureus subsp. aureus Mu50
auuaagcaauguaacu

SEQ ID NO: 3958137 - RNA, 21 nt, Staphylococcus aureus subsp. aureus Mu50
auuaagccaucccaacuuaau

SEQ ID NO: 3958138 - RNA, 15 nt, Staphylococcus aureus subsp. aureus Mu50
auuaagcuaugcuuu

SEQ ID NO: 3958139 - RNA, 14 nt, Staphylococcus aureus subsp. aureus Mu50
auuaagcuuuguuu

SEQ ID NO: 3958140 - RNA, 13 nt, Staphylococcus aureus subsp. aureus Mu50
auuaaggauaguu

SEQ ID NO: 3958141 - RNA, 17 nt, Staphylococcus aureus subsp. aureus Mu50
auuaaggauaguucuuu

SEQ ID NO: 3958142 - RNA, 16 nt, Staphylococcus aureus subsp. aureus Mu50
auuaaggcuuuaguag

SEQ ID NO: 3958143 - RNA, 21 nt, Staphylococcus aureus subsp. aureus Mu50
auuaaggucauuuuuaauuga

SEQ ID NO: 3958144 - RNA, 17 nt, Staphylococcus aureus subsp. aureus Mu50
auuaaguaauagcaacc

SEQ ID NO: 3958145 - RNA, 20 nt, Staphylococcus aureus subsp. aureus Mu50
auuaaguugaaaaccucuuu

SEQ ID NO: 3958146 - RNA, 18 nt, Staphylococcus aureus subsp. aureus Mu50
auuaauaagcauuaaugu

SEQ ID NO: 3958147 - RNA, 15 nt, Staphylococcus aureus subsp. aureus Mu50
auuaauacaucaaua

SEQ ID NO: 3958148 - RNA, 16 nt, Staphylococcus aureus subsp. aureus Mu50
auuaauagagaaagaa

SEQ ID NO: 3958149 - RNA, 21 nt, Staphylococcus aureus subsp. aureus Mu50
auuaauagagacauuuuaucu

SEQ ID NO: 3958150 - RNA, 20 nt, Staphylococcus aureus subsp. aureus Mu50
auuaauaggauuauuaucaa

SEQ ID NO: 3958151 - RNA, 17 nt, Staphylococcus aureus subsp. aureus Mu50
auuaauaguacagucau

SEQ ID NO: 3958152 - RNA, 17 nt, Staphylococcus aureus subsp. aureus Mu50
auuaauauaaauaucaa

SEQ ID NO: 3958153 - RNA, 19 nt, Staphylococcus aureus subsp. aureus Mu50
auuaauauaaauaucaauu

SEQ ID NO: 3958154 - RNA, 15 nt, Staphylococcus aureus subsp. aureus Mu50
auuaauauccaaaau

SEQ ID NO: 3958155 - RNA, 21 nt, Staphylococcus aureus subsp. aureus Mu50
auuaauauccaaaauccugaa

SEQ ID NO: 3958156 - RNA, 15 nt, Staphylococcus aureus subsp. aureus Mu50
auuaauauuagugac

SEQ ID NO: 3958157 - RNA, 13 nt, Staphylococcus aureus subsp. aureus Mu50
auuaaucaauuua

SEQ ID NO: 3958158 - RNA, 15 nt, Staphylococcus aureus subsp. aureus Mu50
auuaaucccuucaaa

SEQ ID NO: 3958159 - RNA, 14 nt, Staphylococcus aureus subsp. aureus Mu50
auuaaucguauuuu

SEQ ID NO: 3958160 - RNA, 17 nt, Staphylococcus aureus subsp. aureus Mu50
auuaaucguauuuuuaa

SEQ ID NO: 3958161 - RNA, 17 nt, Staphylococcus aureus subsp. aureus Mu50
auuaaucguuaauguau

SEQ ID NO: 3958162 - RNA, 22 nt, Staphylococcus aureus subsp. aureus Mu50
auuaaucguuaauguauaaaaa

SEQ ID NO: 3958163 - RNA, 17 nt, Staphylococcus aureus subsp. aureus Mu50
auuaaugccauuguuau

SEQ ID NO: 3958164 - RNA, 17 nt, Staphylococcus aureus subsp. aureus Mu50
auuaauggcaacuaaga

SEQ ID NO: 3958165 - RNA, 15 nt, Staphylococcus aureus subsp. aureus Mu50
auuaaugguauugau

SEQ ID NO: 3958166 - RNA, 14 nt, Staphylococcus aureus subsp. aureus Mu50
auuaauguaaugau

SEQ ID NO: 3958167 - RNA, 20 nt, Staphylococcus aureus subsp. aureus Mu50
auuaauguucaaaaaaugaa

SEQ ID NO: 3958168 - RNA, 21 nt, Staphylococcus aureus subsp. aureus Mu50
auuaauguuucuucaauuguc

SEQ ID NO: 3958169 - RNA, 19 nt, Staphylococcus aureus subsp. aureus Mu50
auuaauuaaaauucucuuu

SEQ ID NO: 3958170 - RNA, 12 nt, Staphylococcus aureus subsp. aureus Mu50
auuaauuaacaa

SEQ ID NO: 3958171 - RNA, 19 nt, Staphylococcus aureus subsp. aureus Mu50
auuaauuacuuucauugua

SEQ ID NO: 3958172 - RNA, 22 nt, Staphylococcus aureus subsp. aureus Mu50
auuaauuacuuucauuguaaau

SEQ ID NO: 3958173 - RNA, 22 nt, Staphylococcus aureus subsp. aureus Mu50
auuaauuauaaguagugauuuu

SEQ ID NO: 3958174 - RNA, 15 nt, Staphylococcus aureus subsp. aureus Mu50
auuaauuaucauaaa

SEQ ID NO: 3958175 - RNA, 17 nt, Staphylococcus aureus subsp. aureus Mu50
auuaauuaucuuaaguc

SEQ ID NO: 3958176 - RNA, 23 nt, Staphylococcus aureus subsp. aureus Mu50
auuaauuccuggugcaauaauaa

SEQ ID NO: 3958177 - RNA, 21 nt, Staphylococcus aureus subsp. aureus Mu50
auuaauucgccuaaaugguuu

SEQ ID NO: 3958178 - RNA, 17 nt, Staphylococcus aureus subsp. aureus Mu50
auuaauugaaaaaccaa

SEQ ID NO: 3958179 - RNA, 20 nt, Staphylococcus aureus subsp. aureus Mu50
auuaauugaaaaaccaaguu

SEQ ID NO: 3958180 - RNA, 17 nt, Staphylococcus aureus subsp. aureus Mu50
auuaauugcuuucacau

SEQ ID NO: 3958181 - RNA, 22 nt, Staphylococcus aureus subsp. aureus Mu50
auuaauugcuuucacauuguuu

SEQ ID NO: 3958182 - RNA, 17 nt, Staphylococcus aureus subsp. aureus Mu50
auuaauuggauuaaaua

SEQ ID NO: 3958183 - RNA, 19 nt, Staphylococcus aureus subsp. aureus Mu50
auuaauuguaaagcaugaa

SEQ ID NO: 3958184 - RNA, 18 nt, Staphylococcus aureus subsp. aureus Mu50
auuaauuuagucauuaca

SEQ ID NO: 3958185 - RNA, 12 nt, Staphylococcus aureus subsp. aureus Mu50
auuaauuucauu

SEQ ID NO: 3958186 - RNA, 21 nt, Staphylococcus aureus subsp. aureus Mu50
auuaauuucauuguaacucaa

SEQ ID NO: 3958187 - RNA, 15 nt, Staphylococcus aureus subsp. aureus Mu50
auuaauuugaaugcc

SEQ ID NO: 3958188 - RNA, 14 nt, Staphylococcus aureus subsp. aureus Mu50
auuaauuuuaucuu

SEQ ID NO: 3958189 - RNA, 19 nt, Staphylococcus aureus subsp. aureus Mu50
auuaauuuucuuuuuuaau

SEQ ID NO: 3958190 - RNA, 22 nt, Staphylococcus aureus subsp. aureus Mu50
auuaauuuucuuuuuuaauucu

SEQ ID NO: 3958191 - RNA, 19 nt, Staphylococcus aureus subsp. aureus Mu50
auuaauuuuguaauuagga

SEQ ID NO: 3958192 - RNA, 12 nt, Staphylococcus aureus subsp. aureus Mu50
auuaauuuuuca

SEQ ID NO: 3958193 - RNA, 14 nt, Staphylococcus aureus subsp. aureus Mu50
auuaauuuuucaaa

SEQ ID NO: 3958194 - RNA, 16 nt, Staphylococcus aureus subsp. aureus Mu50
auuaauuuuucaaaug

SEQ ID NO: 3958195 - RNA, 15 nt, Staphylococcus aureus subsp. aureus Mu50
auuacaaaaguauga

SEQ ID NO: 3958196 - RNA, 19 nt, Staphylococcus aureus subsp. aureus Mu50
auuacaaaaucaccuuuuu

SEQ ID NO: 3958197 - RNA, 16 nt, Staphylococcus aureus subsp. aureus Mu50
auuacaacuuauucuu

SEQ ID NO: 3958198 - RNA, 21 nt, Staphylococcus aureus subsp. aureus Mu50
auuacaauaagcgcaauuaaa

SEQ ID NO: 3958199 - RNA, 17 nt, Staphylococcus aureus subsp. aureus Mu50
auuauaaaaacagcagu

SEQ ID NO: 3958200 - RNA, 18 nt, Staphylococcus aureus subsp. aureus Mu50
auuauaaaccuaaugcuu

SEQ ID NO: 3958201 - RNA, 21 nt, Staphylococcus aureus subsp. aureus Mu50
auuauaaaccuaaugcuuuaa

SEQ ID NO: 3958202 - RNA, 18 nt, Staphylococcus aureus subsp. aureus Mu50
auuauaaaugaaucgcuu

SEQ ID NO: 3958203 - RNA, 21 nt, Staphylococcus aureus subsp. aureus Mu50
auuauaaguugcauauaaaaa

SEQ ID NO: 3958204 - RNA, 15 nt, Staphylococcus aureus subsp. aureus Mu50
auuauaauaaaacuu

SEQ ID NO: 3958205 - RNA, 16 nt, Staphylococcus aureus subsp. aureus Mu50
auuauaauaaauagac

SEQ ID NO: 3958206 - RNA, 15 nt, Staphylococcus aureus subsp. aureus Mu50
auuauaauagcuuuc

SEQ ID NO: 3958207 - RNA, 22 nt, Staphylococcus aureus subsp. aureus Mu50
auuauaauagcuuucguuucuu

SEQ ID NO: 3958208 - RNA, 23 nt, Staphylococcus aureus subsp. aureus Mu50
auuauaauuuuguuucacuacgu

SEQ ID NO: 3958209 - RNA, 20 nt, Staphylococcus aureus subsp. aureus Mu50
auuauacaaauuauaaauuu

SEQ ID NO: 3958210 - RNA, 15 nt, Staphylococcus aureus subsp. aureus Mu50
auuauacuuuacauu

SEQ ID NO: 3958211 - RNA, 21 nt, Staphylococcus aureus subsp. aureus Mu50
auuauagaugacuguagaaaa

SEQ ID NO: 3958212 - RNA, 23 nt, Staphylococcus aureus subsp. aureus Mu50
auuauagcagguggcauccauau

SEQ ID NO: 3958213 - RNA, 17 nt, Staphylococcus aureus subsp. aureus Mu50
auuauagccuauccauu

SEQ ID NO: 3958214 - RNA, 19 nt, Staphylococcus aureus subsp. aureus Mu50
auuauagggcuguuuuuuu

SEQ ID NO: 3958215 - RNA, 21 nt, Staphylococcus aureus subsp. aureus Mu50
auuauagggcuguuuuuuuau

SEQ ID NO: 3958216 - RNA, 16 nt, Staphylococcus aureus subsp. aureus Mu50
auuauagguauaagaa

SEQ ID NO: 3958217 - RNA, 22 nt, Staphylococcus aureus subsp. aureus Mu50
auuauaguguucaagcuuuauu

SEQ ID NO: 3958218 - RNA, 14 nt, Staphylococcus aureus subsp. aureus Mu50
auuauaguuuagau

SEQ ID NO: 3958219 - RNA, 22 nt, Staphylococcus aureus subsp. aureus Mu50
auuauaguuuagauucacugua

SEQ ID NO: 3958220 - RNA, 16 nt, Staphylococcus aureus subsp. aureus Mu50
auuauauaauucuuca

SEQ ID NO: 3958221 - RNA, 21 nt, Staphylococcus aureus subsp. aureus Mu50
auuauauacuaguucaacuca

SEQ ID NO: 3958222 - RNA, 17 nt, Staphylococcus aureus subsp. aureus Mu50
auuauauagaaaacuag

SEQ ID NO: 3958223 - RNA, 13 nt, Staphylococcus aureus subsp. aureus Mu50
auuauauauauua

SEQ ID NO: 3958224 - RNA, 19 nt, Staphylococcus aureus subsp. aureus Mu50
auuauauauauuccacgcu

SEQ ID NO: 3958225 - RNA, 20 nt, Staphylococcus aureus subsp. aureus Mu50
auuauaucgucguaacucuu

SEQ ID NO: 3958226 - RNA, 17 nt, Staphylococcus aureus subsp. aureus Mu50
auuauaucuuuauauga

SEQ ID NO: 3958227 - RNA, 21 nt, Staphylococcus aureus subsp. aureus Mu50
auuauauggagcuacccuauu

SEQ ID NO: 3958228 - RNA, 16 nt, Staphylococcus aureus subsp. aureus Mu50
auuauauuuuucuuca

SEQ ID NO: 3958229 - RNA, 14 nt, Staphylococcus aureus subsp. aureus Mu50
auuaucaacauaau

SEQ ID NO: 3958230 - RNA, 15 nt, Staphylococcus aureus subsp. aureus Mu50
auuaucaacauaaua

SEQ ID NO: 3958231 - RNA, 15 nt, Staphylococcus aureus subsp. aureus Mu50
auuaucaauagauga

SEQ ID NO: 3958232 - RNA, 11 nt, Staphylococcus aureus subsp. aureus Mu50
auuaucaauug

SEQ ID NO: 3958233 - RNA, 18 nt, Staphylococcus aureus subsp. aureus Mu50
auuaucaccuucaaacuu

SEQ ID NO: 3958234 - RNA, 20 nt, Staphylococcus aureus subsp. aureus Mu50
auuaucagaaucaaguaauu

SEQ ID NO: 3958235 - RNA, 23 nt, Staphylococcus aureus subsp. aureus Mu50
auuaucagguuaacauuugucau

SEQ ID NO: 3958236 - RNA, 15 nt, Staphylococcus aureus subsp. aureus Mu50
auuaucauaaagaua

SEQ ID NO: 3958237 - RNA, 19 nt, Staphylococcus aureus subsp. aureus Mu50
auuaucauauaaaucaaau

SEQ ID NO: 3958238 - RNA, 18 nt, Staphylococcus aureus subsp. aureus Mu50
auuaucauaugaacaaua

SEQ ID NO: 3958239 - RNA, 19 nt, Staphylococcus aureus subsp. aureus Mu50
auuaucauaugugauuuaa

SEQ ID NO: 3958240 - RNA, 22 nt, Staphylococcus aureus subsp. aureus Mu50
auuaucauuacagauaauuauu

SEQ ID NO: 3958241 - RNA, 14 nt, Staphylococcus aureus subsp. aureus Mu50
auuaucauugauau

SEQ ID NO: 3958242 - RNA, 15 nt, Staphylococcus aureus subsp. aureus Mu50
auuaucauuguucau

SEQ ID NO: 3958243 - RNA, 13 nt, Staphylococcus aureus subsp. aureus Mu50
auuauccuacugc

SEQ ID NO: 3958244 - RNA, 18 nt, Staphylococcus aureus subsp. aureus Mu50
auuaucgaagaaacauua

SEQ ID NO: 3958245 - RNA, 20 nt, Staphylococcus aureus subsp. aureus Mu50
auuaucgaagaaacauuaua

SEQ ID NO: 3958246 - RNA, 18 nt, Staphylococcus aureus subsp. aureus Mu50
auuaucgaauuagauuua

SEQ ID NO: 3958247 - RNA, 15 nt, Staphylococcus aureus subsp. aureus Mu50
auuaucguaaaaaaa

SEQ ID NO: 3958248 - RNA, 21 nt, Staphylococcus aureus subsp. aureus Mu50
auuaucguaaaaaaacgucua

SEQ ID NO: 3958249 - RNA, 14 nt, Staphylococcus aureus subsp. aureus Mu50
auuaucuaaagaaa

SEQ ID NO: 3958250 - RNA, 22 nt, Staphylococcus aureus subsp. aureus Mu50
auuaucuaaagaaaucucuauc

SEQ ID NO: 3958251 - RNA, 14 nt, Staphylococcus aureus subsp. aureus Mu50
auuaucuauccauu

SEQ ID NO: 3958252 - RNA, 15 nt, Staphylococcus aureus subsp. aureus Mu50
auuaucuauccauuu

SEQ ID NO: 3958253 - RNA, 20 nt, Staphylococcus aureus subsp. aureus Mu50
auuaucuauccauuugguuu

SEQ ID NO: 3958254 - RNA, 14 nt, Staphylococcus aureus subsp. aureus Mu50
auuaucuguaauua

SEQ ID NO: 3958255 - RNA, 16 nt, Staphylococcus aureus subsp. aureus Mu50
auuaucuguaauuaau

SEQ ID NO: 3958256 - RNA, 15 nt, Staphylococcus aureus subsp. aureus Mu50
auuaucuucaucauu

SEQ ID NO: 3958257 - RNA, 21 nt, Staphylococcus aureus subsp. aureus Mu50
auuaucuuuaauuuacaauua

SEQ ID NO: 3958258 - RNA, 22 nt, Staphylococcus aureus subsp. aureus Mu50
auuaucuuuacgauaaacuaaa

SEQ ID NO: 3958259 - RNA, 22 nt, Staphylococcus aureus subsp. aureus Mu50
auuaucuuuaguauuucaucau

SEQ ID NO: 3958260 - RNA, 23 nt, Staphylococcus aureus subsp. aureus Mu50
auuaucuuuaguauuucaucauu

SEQ ID NO: 3958261 - RNA, 21 nt, Staphylococcus aureus subsp. aureus Mu50
auuaucuuuguaaauuuuuaa

SEQ ID NO: 3958262 - RNA, 14 nt, Staphylococcus aureus subsp. aureus Mu50
auuaugaaaaguaa

SEQ ID NO: 3958263 - RNA, 15 nt, Staphylococcus aureus subsp. aureus Mu50
auuaugaaaaguaaa

SEQ ID NO: 3958264 - RNA, 20 nt, Staphylococcus aureus subsp. aureus Mu50
auuaugauacgcuuuuuaaa

SEQ ID NO: 3958265 - RNA, 22 nt, Staphylococcus aureus subsp. aureus Mu50
auuaugauacgcuuuuuaaaaa

SEQ ID NO: 3958266 - RNA, 17 nt, Staphylococcus aureus subsp. aureus Mu50
auuaugauuauauuuuc

SEQ ID NO: 3958267 - RNA, 19 nt, Staphylococcus aureus subsp. aureus Mu50
auuaugauugcuuauuuau

SEQ ID NO: 3958268 - RNA, 16 nt, Staphylococcus aureus subsp. aureus Mu50
auuaugccuuugauuu

SEQ ID NO: 3958269 - RNA, 19 nt, Staphylococcus aureus subsp. aureus Mu50
auuaugccuuugauuuuac

SEQ ID NO: 3958270 - RNA, 15 nt, Staphylococcus aureus subsp. aureus Mu50
auuaugcuucaaagu

SEQ ID NO: 3958271 - RNA, 11 nt, Staphylococcus aureus subsp. aureus Mu50
auuauggagcg

SEQ ID NO: 3958272 - RNA, 15 nt, Staphylococcus aureus subsp. aureus Mu50
auuauggagcggaag

SEQ ID NO: 3958273 - RNA, 17 nt, Staphylococcus aureus subsp. aureus Mu50
auuauggagcggaagau

SEQ ID NO: 3958274 - RNA, 16 nt, Staphylococcus aureus subsp. aureus Mu50
auuaugguaauuaguu

SEQ ID NO: 3958275 - RNA, 14 nt, Staphylococcus aureus subsp. aureus Mu50
auuauguaaaaaau

SEQ ID NO: 3958276 - RNA, 16 nt, Staphylococcus aureus subsp. aureus Mu50
auuauguaaaaaauau

SEQ ID NO: 3958277 - RNA, 18 nt, Staphylococcus aureus subsp. aureus Mu50
auuauguaaaaaauaucu

SEQ ID NO: 3958278 - RNA, 22 nt, Staphylococcus aureus subsp. aureus Mu50
auuauguaaaaaauaucuuguc

SEQ ID NO: 3958279 - RNA, 24 nt, Staphylococcus aureus subsp. aureus Mu50
auuauguagugguucuuauacauu

SEQ ID NO: 3958280 - RNA, 23 nt, Staphylococcus aureus subsp. aureus Mu50
auuauguaucuauacaacaguaa

SEQ ID NO: 3958281 - RNA, 13 nt, Staphylococcus aureus subsp. aureus Mu50
auuauguauuuuu

SEQ ID NO: 3958282 - RNA, 13 nt, Staphylococcus aureus subsp. aureus Mu50
auuaugugacaua

SEQ ID NO: 3958283 - RNA, 14 nt, Staphylococcus aureus subsp. aureus Mu50
auuauguguauauu

SEQ ID NO: 3958284 - RNA, 13 nt, Staphylococcus aureus subsp. aureus Mu50
auuauuaaaugcu

SEQ ID NO: 3958285 - RNA, 19 nt, Staphylococcus aureus subsp. aureus Mu50
auuauuaaauuauggagcg

SEQ ID NO: 3958286 - RNA, 16 nt, Staphylococcus aureus subsp. aureus Mu50
auucacgaacauuacu

SEQ ID NO: 3958287 - RNA, 18 nt, Staphylococcus aureus subsp. aureus Mu50
auucacgacuugauagca

SEQ ID NO: 3958288 - RNA, 14 nt, Staphylococcus aureus subsp. aureus Mu50
auucacgauauaac

SEQ ID NO: 3958289 - RNA, 19 nt, Staphylococcus aureus subsp. aureus Mu50
auucacgauauaacauuaa

SEQ ID NO: 3958290 - RNA, 20 nt, Staphylococcus aureus subsp. aureus Mu50
auucacgcguucaaauguug

SEQ ID NO: 3958291 - RNA, 19 nt, Staphylococcus aureus subsp. aureus Mu50
auucacuacuuuuucaacu

SEQ ID NO: 3958292 - RNA, 20 nt, Staphylococcus aureus subsp. aureus Mu50
auucacuuuuuuuaauuuga

SEQ ID NO: 3958293 - RNA, 15 nt, Staphylococcus aureus subsp. aureus Mu50
auucaguauauguau

SEQ ID NO: 3958294 - RNA, 15 nt, Staphylococcus aureus subsp. aureus Mu50
auucaguaucuaaau

SEQ ID NO: 3958295 - RNA, 21 nt, Staphylococcus aureus subsp. aureus Mu50
auucagucaguaaaaauacau

SEQ ID NO: 3958296 - RNA, 14 nt, Staphylococcus aureus subsp. aureus Mu50
auucaguucaaaca

SEQ ID NO: 3958297 - RNA, 13 nt, Staphylococcus aureus subsp. aureus Mu50
auucauaaaauuu

SEQ ID NO: 3958298 - RNA, 15 nt, Staphylococcus aureus subsp. aureus Mu50
auucauaaaauuuaa

SEQ ID NO: 3958299 - RNA, 13 nt, Staphylococcus aureus subsp. aureus Mu50
auucauaaaugcu

SEQ ID NO: 3958300 - RNA, 20 nt, Staphylococcus aureus subsp. aureus Mu50
auucauacacugcacaucau

SEQ ID NO: 3958301 - RNA, 20 nt, Staphylococcus aureus subsp. aureus Mu50
auucauagaccuaugaauuu

SEQ ID NO: 3958302 - RNA, 15 nt, Staphylococcus aureus subsp. aureus Mu50
auucauauuuauauu

SEQ ID NO: 3958303 - RNA, 19 nt, Staphylococcus aureus subsp. aureus Mu50
auucaucgucucacuuaau

SEQ ID NO: 3958304 - RNA, 18 nt, Staphylococcus aureus subsp. aureus Mu50
auucaucucagcaauacu

SEQ ID NO: 3958305 - RNA, 16 nt, Staphylococcus aureus subsp. aureus Mu50
auucaucuguugauaa

SEQ ID NO: 3958306 - RNA, 23 nt, Staphylococcus aureus subsp. aureus Mu50
auucaucuugcaaguauuuucuu

SEQ ID NO: 3958307 - RNA, 12 nt, Staphylococcus aureus subsp. aureus Mu50
auucaugaauaa

SEQ ID NO: 3958308 - RNA, 14 nt, Staphylococcus aureus subsp. aureus Mu50
auucauguaaauag

SEQ ID NO: 3958309 - RNA, 16 nt, Staphylococcus aureus subsp. aureus Mu50
auucauguaaauaguu

SEQ ID NO: 3958310 - RNA, 13 nt, Staphylococcus aureus subsp. aureus Mu50
auucauuaagcuu

SEQ ID NO: 3958311 - RNA, 15 nt, Staphylococcus aureus subsp. aureus Mu50
auucauuaauaggau

SEQ ID NO: 3958312 - RNA, 21 nt, Staphylococcus aureus subsp. aureus Mu50
auucauuacuuggaaauguau

SEQ ID NO: 3958313 - RNA, 13 nt, Staphylococcus aureus subsp. aureus Mu50
auucauucaauac

SEQ ID NO: 3958314 - RNA, 22 nt, Staphylococcus aureus subsp. aureus Mu50
auucauucguacuuccaauacu

SEQ ID NO: 3958315 - RNA, 13 nt, Staphylococcus aureus subsp. aureus Mu50
auucauuuaaaaa

SEQ ID NO: 3958316 - RNA, 17 nt, Staphylococcus aureus subsp. aureus Mu50
auucauuuaaaaaucaa

SEQ ID NO: 3958317 - RNA, 16 nt, Staphylococcus aureus subsp. aureus Mu50
auucauuuauuuucuu

SEQ ID NO: 3958318 - RNA, 18 nt, Staphylococcus aureus subsp. aureus Mu50
auucauuucgauuaauuu

SEQ ID NO: 3958319 - RNA, 20 nt, Staphylococcus aureus subsp. aureus Mu50
auucauuuuauaaaucaaag

SEQ ID NO: 3958320 - RNA, 22 nt, Staphylococcus aureus subsp. aureus Mu50
auucauuuucuuuuucuugaag

SEQ ID NO: 3958321 - RNA, 21 nt, Staphylococcus aureus subsp. aureus Mu50
auuccaaaaauuguaaaaccu

SEQ ID NO: 3958322 - RNA, 22 nt, Staphylococcus aureus subsp. aureus Mu50
auuccaaagaaagcuaauauca

SEQ ID NO: 3958323 - RNA, 17 nt, Staphylococcus aureus subsp. aureus Mu50
auuccaagagaauuaau

SEQ ID NO: 3958324 - RNA, 12 nt, Staphylococcus aureus subsp. aureus Mu50
auuccaaucuau

SEQ ID NO: 3958325 - RNA, 19 nt, Staphylococcus aureus subsp. aureus Mu50
auuccaaucuauuuuaaac

SEQ ID NO: 3958326 - RNA, 22 nt, Staphylococcus aureus subsp. aureus Mu50
auuccaaucuauuuuaaacuca

SEQ ID NO: 3958327 - RNA, 18 nt, Staphylococcus aureus subsp. aureus Mu50
auuccacuacaaucauac

SEQ ID NO: 3958328 - RNA, 15 nt, Staphylococcus aureus subsp. aureus Mu50
auucccaaagcgaau

SEQ ID NO: 3958329 - RNA, 13 nt, Staphylococcus aureus subsp. aureus Mu50
auucccacucaau

SEQ ID NO: 3958330 - RNA, 12 nt, Staphylococcus aureus subsp. aureus Mu50
auuccuaauaaa

SEQ ID NO: 3958331 - RNA, 16 nt, Staphylococcus aureus subsp. aureus Mu50
auuccuaauuauauua

SEQ ID NO: 3958332 - RNA, 23 nt, Staphylococcus aureus subsp. aureus Mu50
auuccucuggaacuuuaauacca

SEQ ID NO: 3958333 - RNA, 14 nt, Staphylococcus aureus subsp. aureus Mu50
auuccugauacaau

SEQ ID NO: 3958334 - RNA, 18 nt, Staphylococcus aureus subsp. aureus Mu50
auuccuggugcaauaaua

SEQ ID NO: 3958335 - RNA, 13 nt, Staphylococcus aureus subsp. aureus Mu50
auuccuuaaaccg

SEQ ID NO: 3958336 - RNA, 18 nt, Staphylococcus aureus subsp. aureus Mu50
auuccuuggugucgaaau

SEQ ID NO: 3958337 - RNA, 13 nt, Staphylococcus aureus subsp. aureus Mu50
auucgaaaagaaa

SEQ ID NO: 3958338 - RNA, 15 nt, Staphylococcus aureus subsp. aureus Mu50
auucgaaaagaaauu

SEQ ID NO: 3958339 - RNA, 16 nt, Staphylococcus aureus subsp. aureus Mu50
auucgaaaagaaauuc

SEQ ID NO: 3958340 - RNA, 22 nt, Staphylococcus aureus subsp. aureus Mu50
auucgaaaagaaauucuacagg

SEQ ID NO: 3958341 - RNA, 17 nt, Staphylococcus aureus subsp. aureus Mu50
auucgaacuaucaauau

SEQ ID NO: 3958342 - RNA, 15 nt, Staphylococcus aureus subsp. aureus Mu50
auucgacucaaacaa

SEQ ID NO: 3958343 - RNA, 18 nt, Staphylococcus aureus subsp. aureus Mu50
auucgacucaaacaauaa

SEQ ID NO: 3958344 - RNA, 15 nt, Staphylococcus aureus subsp. aureus Mu50
auucgauaauauaac

SEQ ID NO: 3958345 - RNA, 22 nt, Staphylococcus aureus subsp. aureus Mu50
auucgaucguaguuguccauuu

SEQ ID NO: 3958346 - RNA, 18 nt, Staphylococcus aureus subsp. aureus Mu50
auucgaugacuuuuuaau

SEQ ID NO: 3958347 - RNA, 17 nt, Staphylococcus aureus subsp. aureus Mu50
auucgcuuguucaguaa

SEQ ID NO: 3958348 - RNA, 18 nt, Staphylococcus aureus subsp. aureus Mu50
auucgguccuuugauguu

SEQ ID NO: 3958349 - RNA, 23 nt, Staphylococcus aureus subsp. aureus Mu50
auucguaccaacucgcuauaugu

SEQ ID NO: 3958350 - RNA, 13 nt, Staphylococcus aureus subsp. aureus Mu50
auucguauucaaa

SEQ ID NO: 3958351 - RNA, 17 nt, Staphylococcus aureus subsp. aureus Mu50
auucgucuguuucauau

SEQ ID NO: 3958352 - RNA, 13 nt, Staphylococcus aureus subsp. aureus Mu50
auucguuaacaau

SEQ ID NO: 3958353 - RNA, 18 nt, Staphylococcus aureus subsp. aureus Mu50
auucuaaaaaauuaaaaa

SEQ ID NO: 3958354 - RNA, 22 nt, Staphylococcus aureus subsp. aureus Mu50
auucuaaaacggaaauaaccac

SEQ ID NO: 3958355 - RNA, 15 nt, Staphylococcus aureus subsp. aureus Mu50
auucuaaaagaauua

SEQ ID NO: 3958356 - RNA, 17 nt, Staphylococcus aureus subsp. aureus Mu50
auucuaaauaaucgaag

SEQ ID NO: 3958357 - RNA, 18 nt, Staphylococcus aureus subsp. aureus Mu50
auucuaaauauauuuuau

SEQ ID NO: 3958358 - RNA, 20 nt, Staphylococcus aureus subsp. aureus Mu50
auucuaaauauauuuuaugu

SEQ ID NO: 3958359 - RNA, 14 nt, Staphylococcus aureus subsp. aureus Mu50
auucuaacugcaaa

SEQ ID NO: 3958360 - RNA, 18 nt, Staphylococcus aureus subsp. aureus Mu50
auucuacagcaucaccua

SEQ ID NO: 3958361 - RNA, 12 nt, Staphylococcus aureus subsp. aureus Mu50
auucuacaggca

SEQ ID NO: 3958362 - RNA, 12 nt, Staphylococcus aureus subsp. aureus Mu50
auucuacaggua

SEQ ID NO: 3958363 - RNA, 14 nt, Staphylococcus aureus subsp. aureus Mu50
auucuacagguaau

SEQ ID NO: 3958364 - RNA, 17 nt, Staphylococcus aureus subsp. aureus Mu50
auucuacagguaaugca

SEQ ID NO: 3958365 - RNA, 21 nt, Staphylococcus aureus subsp. aureus Mu50
auucuacagguaaugcaaguu

SEQ ID NO: 3958366 - RNA, 22 nt, Staphylococcus aureus subsp. aureus Mu50
auucuagagauaacuagaauga

SEQ ID NO: 3958367 - RNA, 19 nt, Staphylococcus aureus subsp. aureus Mu50
auucuagauucauauuuau

SEQ ID NO: 3958368 - RNA, 19 nt, Staphylococcus aureus subsp. aureus Mu50
auucuagcaucgauguuau

SEQ ID NO: 3958369 - RNA, 16 nt, Staphylococcus aureus subsp. aureus Mu50
auucuagugaaauacc

SEQ ID NO: 3958370 - RNA, 12 nt, Staphylococcus aureus subsp. aureus Mu50
auucuauaauuu

SEQ ID NO: 3958371 - RNA, 15 nt, Staphylococcus aureus subsp. aureus Mu50
auucuauaauuuuaa

SEQ ID NO: 3958372 - RNA, 14 nt, Staphylococcus aureus subsp. aureus Mu50
auucuaucuauaaa

SEQ ID NO: 3958373 - RNA, 13 nt, Staphylococcus aureus subsp. aureus Mu50
auucuauuuuuca

SEQ ID NO: 3958374 - RNA, 15 nt, Staphylococcus aureus subsp. aureus Mu50
auugauuaaauaaau

SEQ ID NO: 3958375 - RNA, 19 nt, Staphylococcus aureus subsp. aureus Mu50
auugauucaagcaucauuu

SEQ ID NO: 3958376 - RNA, 17 nt, Staphylococcus aureus subsp. aureus Mu50
auugauucuacagcauc

SEQ ID NO: 3958377 - RNA, 22 nt, Staphylococcus aureus subsp. aureus Mu50
auugauucuacagcaucaccua

SEQ ID NO: 3958378 - RNA, 16 nt, Staphylococcus aureus subsp. aureus Mu50
auugauucuagugaaa

SEQ ID NO: 3958379 - RNA, 19 nt, Staphylococcus aureus subsp. aureus Mu50
auugauucuagugaaauac

SEQ ID NO: 3958380 - RNA, 19 nt, Staphylococcus aureus subsp. aureus Mu50
auugauugcucuaagcauu

SEQ ID NO: 3958381 - RNA, 21 nt, Staphylococcus aureus subsp. aureus Mu50
auugauuguaccaguaacaau

SEQ ID NO: 3958382 - RNA, 15 nt, Staphylococcus aureus subsp. aureus Mu50
auugauuguauuuuu

SEQ ID NO: 3958383 - RNA, 15 nt, Staphylococcus aureus subsp. aureus Mu50
auugcaaaaauaaua

SEQ ID NO: 3958384 - RNA, 22 nt, Staphylococcus aureus subsp. aureus Mu50
auugcaaaacuugcgcaugcuu

SEQ ID NO: 3958385 - RNA, 21 nt, Staphylococcus aureus subsp. aureus Mu50
auugcaaaguaacaauacgca

SEQ ID NO: 3958386 - RNA, 15 nt, Staphylococcus aureus subsp. aureus Mu50
auugcaaaugcaaua

SEQ ID NO: 3958387 - RNA, 23 nt, Staphylococcus aureus subsp. aureus Mu50
auugcaagacuuggugcccaagu

SEQ ID NO: 3958388 - RNA, 19 nt, Staphylococcus aureus subsp. aureus Mu50
auugcaaugcuaucaugcc

SEQ ID NO: 3958389 - RNA, 22 nt, Staphylococcus aureus subsp. aureus Mu50
auugcacgucuuguaucaacau

SEQ ID NO: 3958390 - RNA, 21 nt, Staphylococcus aureus subsp. aureus Mu50
auugcacuaugcauaauacca

SEQ ID NO: 3958391 - RNA, 22 nt, Staphylococcus aureus subsp. aureus Mu50
auugcacuaugcauaauaccaa

SEQ ID NO: 3958392 - RNA, 22 nt, Staphylococcus aureus subsp. aureus Mu50
auugcacuuuuuucauuucuuu

SEQ ID NO: 3958393 - RNA, 23 nt, Staphylococcus aureus subsp. aureus Mu50
auugcagguaaacggaauaacuu

SEQ ID NO: 3958394 - RNA, 15 nt, Staphylococcus aureus subsp. aureus Mu50
auugccauagaaaug

SEQ ID NO: 3958395 - RNA, 18 nt, Staphylococcus aureus subsp. aureus Mu50
auugccgguuaaauuauu

SEQ ID NO: 3958396 - RNA, 16 nt, Staphylococcus aureus subsp. aureus Mu50
auugccuaaccuguuu

SEQ ID NO: 3958397 - RNA, 21 nt, Staphylococcus aureus subsp. aureus Mu50
auugccuaaggacuuuaugcc

SEQ ID NO: 3958398 - RNA, 19 nt, Staphylococcus aureus subsp. aureus Mu50
auugcuaaaauaucaaaau

SEQ ID NO: 3958399 - RNA, 19 nt, Staphylococcus aureus subsp. aureus Mu50
auugcuaaacgcuaaaauu

SEQ ID NO: 3958400 - RNA, 14 nt, Staphylococcus aureus subsp. aureus Mu50
auugcuaauccaua

SEQ ID NO: 3958401 - RNA, 15 nt, Staphylococcus aureus subsp. aureus Mu50
auugcuauauuagua

SEQ ID NO: 3958402 - RNA, 21 nt, Staphylococcus aureus subsp. aureus Mu50
auugcuauauuaguauaauuu

SEQ ID NO: 3958403 - RNA, 17 nt, Staphylococcus aureus subsp. aureus Mu50
auugcucuaagcauuca

SEQ ID NO: 3958404 - RNA, 18 nt, Staphylococcus aureus subsp. aureus Mu50
auugcucuaauccaaaau

SEQ ID NO: 3958405 - RNA, 19 nt, Staphylococcus aureus subsp. aureus Mu50
auugcucuaauccaaaaua

SEQ ID NO: 3958406 - RNA, 18 nt, Staphylococcus aureus subsp. aureus Mu50
auugcugcuguacaauuu

SEQ ID NO: 3958407 - RNA, 20 nt, Staphylococcus aureus subsp. aureus Mu50
auugcugggcuaccgauugu

SEQ ID NO: 3958408 - RNA, 21 nt, Staphylococcus aureus subsp. aureus Mu50
auugcuuaacuuccuuuuuau

SEQ ID NO: 3958409 - RNA, 16 nt, Staphylococcus aureus subsp. aureus Mu50
auugcuuaauaucaug

SEQ ID NO: 3958410 - RNA, 20 nt, Staphylococcus aureus subsp. aureus Mu50
auugcuucuucgucgcugau

SEQ ID NO: 3958411 - RNA, 21 nt, Staphylococcus aureus subsp. aureus Mu50
auugcuuguccucuaaaacau

SEQ ID NO: 3958412 - RNA, 17 nt, Staphylococcus aureus subsp. aureus Mu50
auugcuuguucuuucuu

SEQ ID NO: 3958413 - RNA, 18 nt, Staphylococcus aureus subsp. aureus Mu50
auugcuuuacuaauuccg

SEQ ID NO: 3958414 - RNA, 20 nt, Staphylococcus aureus subsp. aureus Mu50
auuggaaucaucuuuuugaa

SEQ ID NO: 3958415 - RNA, 15 nt, Staphylococcus aureus subsp. aureus Mu50
auuggauaauuucuu

SEQ ID NO: 3958416 - RNA, 20 nt, Staphylococcus aureus subsp. aureus Mu50
auuggauaauuucuucuucu

SEQ ID NO: 3958417 - RNA, 20 nt, Staphylococcus aureus subsp. aureus Mu50
auuggauuaucgaauuagau

SEQ ID NO: 3958418 - RNA, 13 nt, Staphylococcus aureus subsp. aureus Mu50
auuggcauuuacg

SEQ ID NO: 3958419 - RNA, 18 nt, Staphylococcus aureus subsp. aureus Mu50
auuggcauuuacgaaguu

SEQ ID NO: 3958420 - RNA, 14 nt, Staphylococcus aureus subsp. aureus Mu50
auuggcuugcuuca

SEQ ID NO: 3958421 - RNA, 20 nt, Staphylococcus aureus subsp. aureus Mu50
auugggagcaaucaauacaa

SEQ ID NO: 3958422 - RNA, 15 nt, Staphylococcus aureus subsp. aureus Mu50
auugguuucaucaua

SEQ ID NO: 3958423 - RNA, 17 nt, Staphylococcus aureus subsp. aureus Mu50
auugguuuggauaaaau

SEQ ID NO: 3958424 - RNA, 16 nt, Staphylococcus aureus subsp. aureus Mu50
auugguuuuuagugaa

SEQ ID NO: 3958425 - RNA, 21 nt, Staphylococcus aureus subsp. aureus Mu50
auuguaaaaacguucaaucgu

SEQ ID NO: 3958426 - RNA, 18 nt, Staphylococcus aureus subsp. aureus Mu50
auuguaaaaauacauaau

SEQ ID NO: 3958427 - RNA, 21 nt, Staphylococcus aureus subsp. aureus Mu50
auuguaaaaauacauaauaaa

SEQ ID NO: 3958428 - RNA, 16 nt, Staphylococcus aureus subsp. aureus Mu50
auuguaaaacaaauua

SEQ ID NO: 3958429 - RNA, 13 nt, Staphylococcus aureus subsp. aureus Mu50
auuguaaaaugcu

SEQ ID NO: 3958430 - RNA, 21 nt, Staphylococcus aureus subsp. aureus Mu50
auuguaaagcaugaauagcuu

SEQ ID NO: 3958431 - RNA, 18 nt, Staphylococcus aureus subsp. aureus Mu50
auuguaaaucuuguugga

SEQ ID NO: 3958432 - RNA, 22 nt, Staphylococcus aureus subsp. aureus Mu50
auuguaaaugaucaucguauag

SEQ ID NO: 3958433 - RNA, 13 nt, Staphylococcus aureus subsp. aureus Mu50
auuguaaucuauu

SEQ ID NO: 3958434 - RNA, 14 nt, Staphylococcus aureus subsp. aureus Mu50
auuguaaucuauuu

SEQ ID NO: 3958435 - RNA, 16 nt, Staphylococcus aureus subsp. aureus Mu50
auuguaaucuauuuuc

SEQ ID NO: 3958436 - RNA, 15 nt, Staphylococcus aureus subsp. aureus Mu50
auuguaccaguaaca

SEQ ID NO: 3958437 - RNA, 22 nt, Staphylococcus aureus subsp. aureus Mu50
auuguacgcuucaauuauuuca

SEQ ID NO: 3958438 - RNA, 22 nt, Staphylococcus aureus subsp. aureus Mu50
auuguagccuccgccaccaaac

SEQ ID NO: 3958439 - RNA, 12 nt, Staphylococcus aureus subsp. aureus Mu50
auuguauaaugu

SEQ ID NO: 3958440 - RNA, 18 nt, Staphylococcus aureus subsp. aureus Mu50
auuguauagaauguguau

SEQ ID NO: 3958441 - RNA, 18 nt, Staphylococcus aureus subsp. aureus Mu50
auuguauguugaaaguga

SEQ ID NO: 3958442 - RNA, 19 nt, Staphylococcus aureus subsp. aureus Mu50
auuguauuuuucaagcauu

SEQ ID NO: 3958443 - RNA, 16 nt, Staphylococcus aureus subsp. aureus Mu50
auugucacaaucuguu

SEQ ID NO: 3958444 - RNA, 12 nt, Staphylococcus aureus subsp. aureus Mu50
auugucaucaug

SEQ ID NO: 3958445 - RNA, 17 nt, Staphylococcus aureus subsp. aureus Mu50
auugucgacuuuuagau

SEQ ID NO: 3958446 - RNA, 14 nt, Staphylococcus aureus subsp. aureus Mu50
auugucuuauaaga

SEQ ID NO: 3958447 - RNA, 23 nt, Staphylococcus aureus subsp. aureus Mu50
auugugaaaguuuuugucuuaau

SEQ ID NO: 3958448 - RNA, 14 nt, Staphylococcus aureus subsp. aureus Mu50
auugugaauaauuu

SEQ ID NO: 3958449 - RNA, 20 nt, Staphylococcus aureus subsp. aureus Mu50
auuguguaaugagauuauuc

SEQ ID NO: 3958450 - RNA, 18 nt, Staphylococcus aureus subsp. aureus Mu50
auuguguccauaaauauu

SEQ ID NO: 3958451 - RNA, 12 nt, Staphylococcus aureus subsp. aureus Mu50
auuguguugaau

SEQ ID NO: 3958452 - RNA, 17 nt, Staphylococcus aureus subsp. aureus Mu50
auuguguugaaucaaca

SEQ ID NO: 3958453 - RNA, 13 nt, Staphylococcus aureus subsp. aureus Mu50
auuguuaaacauu

SEQ ID NO: 3958454 - RNA, 16 nt, Staphylococcus aureus subsp. aureus Mu50
auuguuaaaucaccaa

SEQ ID NO: 3958455 - RNA, 15 nt, Staphylococcus aureus subsp. aureus Mu50
auuguuacuuuaacu

SEQ ID NO: 3958456 - RNA, 19 nt, Staphylococcus aureus subsp. aureus Mu50
auuguuauccaaaacauuu

SEQ ID NO: 3958457 - RNA, 16 nt, Staphylococcus aureus subsp. aureus Mu50
auuguuauuauaaacu

SEQ ID NO: 3958458 - RNA, 12 nt, Staphylococcus aureus subsp. aureus Mu50
auuguucuaaua

SEQ ID NO: 3958459 - RNA, 13 nt, Staphylococcus aureus subsp. aureus Mu50
auuguugcaaaau

SEQ ID NO: 3958460 - RNA, 19 nt, Staphylococcus aureus subsp. aureus Mu50
auuguugcaaaauacgauu

SEQ ID NO: 3958461 - RNA, 18 nt, Staphylococcus aureus subsp. aureus Mu50
auuuacaccuauaccucg

SEQ ID NO: 3958462 - RNA, 18 nt, Staphylococcus aureus subsp. aureus Mu50
auuuaccgucauuauauu

SEQ ID NO: 3958463 - RNA, 20 nt, Staphylococcus aureus subsp. aureus Mu50
auuuaccucuugauaaaaua

SEQ ID NO: 3958464 - RNA, 21 nt, Staphylococcus aureus subsp. aureus Mu50
auuuaccucuugauaaaauaa

SEQ ID NO: 3958465 - RNA, 15 nt, Staphylococcus aureus subsp. aureus Mu50
auuuaccuucuucua

SEQ ID NO: 3958466 - RNA, 15 nt, Staphylococcus aureus subsp. aureus Mu50
auuuacgaaaguaga

SEQ ID NO: 3958467 - RNA, 19 nt, Staphylococcus aureus subsp. aureus Mu50
auuuacuccuuacaauaaa

SEQ ID NO: 3958468 - RNA, 21 nt, Staphylococcus aureus subsp. aureus Mu50
auuuacuucuucuucagacca

SEQ ID NO: 3958469 - RNA, 15 nt, Staphylococcus aureus subsp. aureus Mu50
auuuacuugauuaga

SEQ ID NO: 3958470 - RNA, 21 nt, Staphylococcus aureus subsp. aureus Mu50
auuuagaaacuuccaacauau

SEQ ID NO: 3958471 - RNA, 18 nt, Staphylococcus aureus subsp. aureus Mu50
auuuagaauaaacuuuau

SEQ ID NO: 3958472 - RNA, 20 nt, Staphylococcus aureus subsp. aureus Mu50
auuuagaauaaacuuuaugg

SEQ ID NO: 3958473 - RNA, 12 nt, Staphylococcus aureus subsp. aureus Mu50
auuuagaauaag

SEQ ID NO: 3958474 - RNA, 21 nt, Staphylococcus aureus subsp. aureus Mu50
auuuagacaucauuguuuuag

SEQ ID NO: 3958475 - RNA, 20 nt, Staphylococcus aureus subsp. aureus Mu50
auuuagacuuggauaaaaau

SEQ ID NO: 3958476 - RNA, 20 nt, Staphylococcus aureus subsp. aureus Mu50
auuuagauacugaauuuuaa

SEQ ID NO: 3958477 - RNA, 23 nt, Staphylococcus aureus subsp. aureus Mu50
auuuagauacugaauuuuaacua

SEQ ID NO: 3958478 - RNA, 17 nt, Staphylococcus aureus subsp. aureus Mu50
auuuagaugauucuuau

SEQ ID NO: 3958479 - RNA, 18 nt, Staphylococcus aureus subsp. aureus Mu50
auuuagaugauucuuauc

SEQ ID NO: 3958480 - RNA, 15 nt, Staphylococcus aureus subsp. aureus Mu50
auuuagauucuuuuc

SEQ ID NO: 3958481 - RNA, 18 nt, Staphylococcus aureus subsp. aureus Mu50
auuuagcaaauauuucug

SEQ ID NO: 3958482 - RNA, 19 nt, Staphylococcus aureus subsp. aureus Mu50
auuuagcaucaaaaauaaa

SEQ ID NO: 3958483 - RNA, 19 nt, Staphylococcus aureus subsp. aureus Mu50
auuuaggaguauccugauu

SEQ ID NO: 3958484 - RNA, 21 nt, Staphylococcus aureus subsp. aureus Mu50
auuuaggaguauccugauuua

SEQ ID NO: 3958485 - RNA, 23 nt, Staphylococcus aureus subsp. aureus Mu50
auuuaggaguauccugauuuaau

SEQ ID NO: 3958486 - RNA, 17 nt, Staphylococcus aureus subsp. aureus Mu50
auuuaggcaugucaaau

SEQ ID NO: 3958487 - RNA, 18 nt, Staphylococcus aureus subsp. aureus Mu50
auuuaggcaugucaaauc

SEQ ID NO: 3958488 - RNA, 17 nt, Staphylococcus aureus subsp. aureus Mu50
auuuaguacauagaccu

SEQ ID NO: 3958489 - RNA, 16 nt, Staphylococcus aureus subsp. aureus Mu50
auuuaguauaaauaaa

SEQ ID NO: 3958490 - RNA, 15 nt, Staphylococcus aureus subsp. aureus Mu50
auuuaguaucaugau

SEQ ID NO: 3958491 - RNA, 16 nt, Staphylococcus aureus subsp. aureus Mu50
auuuaguaucuauaca

SEQ ID NO: 3958492 - RNA, 17 nt, Staphylococcus aureus subsp. aureus Mu50
auuuagucauuacaaau

SEQ ID NO: 3958493 - RNA, 18 nt, Staphylococcus aureus subsp. aureus Mu50
auuuagucauuacaaauc

SEQ ID NO: 3958494 - RNA, 13 nt, Staphylococcus aureus subsp. aureus Mu50
auuuaguuaaaua

SEQ ID NO: 3958495 - RNA, 17 nt, Staphylococcus aureus subsp. aureus Mu50
auuuaguuagcccuauu

SEQ ID NO: 3958496 - RNA, 13 nt, Staphylococcus aureus subsp. aureus Mu50
auuuaguuuuuuu

SEQ ID NO: 3958497 - RNA, 16 nt, Staphylococcus aureus subsp. aureus Mu50
auuuaguuuuuuuaaa

SEQ ID NO: 3958498 - RNA, 20 nt, Staphylococcus aureus subsp. aureus Mu50
auuuaguuuuuuuaaaguuu

SEQ ID NO: 3958499 - RNA, 21 nt, Staphylococcus aureus subsp. aureus Mu50
auuuaguuuuuuuaaaguuua

SEQ ID NO: 3958500 - RNA, 22 nt, Staphylococcus aureus subsp. aureus Mu50
auuuauaaaaacuuauuugcca

SEQ ID NO: 3958501 - RNA, 15 nt, Staphylococcus aureus subsp. aureus Mu50
auuuauaaacaauaa

SEQ ID NO: 3958502 - RNA, 14 nt, Staphylococcus aureus subsp. aureus Mu50
auuuauaacauuua

SEQ ID NO: 3958503 - RNA, 18 nt, Staphylococcus aureus subsp. aureus Mu50
auuuauaacauuuaagaa

SEQ ID NO: 3958504 - RNA, 21 nt, Staphylococcus aureus subsp. aureus Mu50
auuuauaacgacguaauccuu

SEQ ID NO: 3958505 - RNA, 14 nt, Staphylococcus aureus subsp. aureus Mu50
auuuauaacuuuaa

SEQ ID NO: 3958506 - RNA, 16 nt, Staphylococcus aureus subsp. aureus Mu50
auuuauacuaaauuga

SEQ ID NO: 3958507 - RNA, 14 nt, Staphylococcus aureus subsp. aureus Mu50
auuuauacuauaaa

SEQ ID NO: 3958508 - RNA, 19 nt, Staphylococcus aureus subsp. aureus Mu50
auuuauacuauaaauacaa

SEQ ID NO: 3958509 - RNA, 18 nt, Staphylococcus aureus subsp. aureus Mu50
auuuauacugaucaaaug

SEQ ID NO: 3958510 - RNA, 21 nt, Staphylococcus aureus subsp. aureus Mu50
auuuauacuugaugaaacuga

SEQ ID NO: 3958511 - RNA, 21 nt, Staphylococcus aureus subsp. aureus Mu50
auuuauaugauguucaauauu

SEQ ID NO: 3958512 - RNA, 17 nt, Staphylococcus aureus subsp. aureus Mu50
auuuauauuaaauacua

SEQ ID NO: 3958513 - RNA, 19 nt, Staphylococcus aureus subsp. aureus Mu50
auuuauauuuacacagaau

SEQ ID NO: 3958514 - RNA, 15 nt, Staphylococcus aureus subsp. aureus Mu50
auuuauauuuagaau

SEQ ID NO: 3958515 - RNA, 14 nt, Staphylococcus aureus subsp. aureus Mu50
auuuaucaauaaau

SEQ ID NO: 3958516 - RNA, 17 nt, Staphylococcus aureus subsp. aureus Mu50
auuuaucaauuucuauu

SEQ ID NO: 3958517 - RNA, 18 nt, Staphylococcus aureus subsp. aureus Mu50
auuuaucaauuucuauuu

SEQ ID NO: 3958518 - RNA, 12 nt, Staphylococcus aureus subsp. aureus Mu50
auuuaucauuau

SEQ ID NO: 3958519 - RNA, 22 nt, Staphylococcus aureus subsp. aureus Mu50
auuuaucgcgauuauuaccaua

SEQ ID NO: 3958520 - RNA, 21 nt, Staphylococcus aureus subsp. aureus Mu50
auuuaucuugauuuuauaaau

SEQ ID NO: 3958521 - RNA, 13 nt, Staphylococcus aureus subsp. aureus Mu50
auuuaucuuuuaa

SEQ ID NO: 3958522 - RNA, 16 nt, Staphylococcus aureus subsp. aureus Mu50
auuuaucuuuuaaaau

SEQ ID NO: 3958523 - RNA, 22 nt, Staphylococcus aureus subsp. aureus Mu50
auuuaugguguagcugaggauu

SEQ ID NO: 3958524 - RNA, 17 nt, Staphylococcus aureus subsp. aureus Mu50
auuuauguguuggcuuu

SEQ ID NO: 3958525 - RNA, 21 nt, Staphylococcus aureus subsp. aureus Mu50
auuuauguguugugauauaua

SEQ ID NO: 3958526 - RNA, 15 nt, Staphylococcus aureus subsp. aureus Mu50
auuuauguuuucuag

SEQ ID NO: 3958527 - RNA, 14 nt, Staphylococcus aureus subsp. aureus Mu50
auuuauuaguuuuu

SEQ ID NO: 3958528 - RNA, 18 nt, Staphylococcus aureus subsp. aureus Mu50
auuuauuauaauuguuca

SEQ ID NO: 3958529 - RNA, 17 nt, Staphylococcus aureus subsp. aureus Mu50
auuuauuauuaacugua

SEQ ID NO: 3958530 - RNA, 14 nt, Staphylococcus aureus subsp. aureus Mu50
auuuauuauuacca

SEQ ID NO: 3958531 - RNA, 15 nt, Staphylococcus aureus subsp. aureus Mu50
auuuauuauuaccau

SEQ ID NO: 3958532 - RNA, 13 nt, Staphylococcus aureus subsp. aureus Mu50
auuuauucaaaau

SEQ ID NO: 3958533 - RNA, 14 nt, Staphylococcus aureus subsp. aureus Mu50
auuuauucauaacg

SEQ ID NO: 3958534 - RNA, 16 nt, Staphylococcus aureus subsp. aureus Mu50
auuuauucuaaauaua

SEQ ID NO: 3958535 - RNA, 20 nt, Staphylococcus aureus subsp. aureus Mu50
auuuauucuaaauauauuuu

SEQ ID NO: 3958536 - RNA, 16 nt, Staphylococcus aureus subsp. aureus Mu50
auuuauuguuuuuaaa

SEQ ID NO: 3958537 - RNA, 17 nt, Staphylococcus aureus subsp. aureus Mu50
auuuauuguuuuuaaaa

SEQ ID NO: 3958538 - RNA, 15 nt, Staphylococcus aureus subsp. aureus Mu50
auuuauuuaaucgua

SEQ ID NO: 3958539 - RNA, 20 nt, Staphylococcus aureus subsp. aureus Mu50
auuuauuuauaaaauaaaau

SEQ ID NO: 3958540 - RNA, 23 nt, Staphylococcus aureus subsp. aureus Mu50
auuuauuucuuuuugucauuaau

SEQ ID NO: 3958541 - RNA, 17 nt, Staphylococcus aureus subsp. aureus Mu50
auuuauuuuauaauaac

SEQ ID NO: 3958542 - RNA, 15 nt, Staphylococcus aureus subsp. aureus Mu50
auuuauuuucuuugg

SEQ ID NO: 3958543 - RNA, 17 nt, Staphylococcus aureus subsp. aureus Mu50
auuuauuuucuuuggug

SEQ ID NO: 3958544 - RNA, 14 nt, Staphylococcus aureus subsp. aureus Mu50
auuuauuuugauua

SEQ ID NO: 3958545 - RNA, 17 nt, Staphylococcus aureus subsp. aureus Mu50
auuuauuuuugauagug

SEQ ID NO: 3958546 - RNA, 15 nt, Staphylococcus aureus subsp. aureus Mu50
auuucaaaaaaagcu

SEQ ID NO: 3958547 - RNA, 15 nt, Staphylococcus aureus subsp. aureus Mu50
auuucaacaaacaua

SEQ ID NO: 3958548 - RNA, 16 nt, Staphylococcus aureus subsp. aureus Mu50
auuucaacaaacauaa

SEQ ID NO: 3958549 - RNA, 23 nt, Staphylococcus aureus subsp. aureus Mu50
auuugaacgagcaccuuuugcuu

SEQ ID NO: 3958550 - RNA, 21 nt, Staphylococcus aureus subsp. aureus Mu50
auuugaauaagugguuguucc

SEQ ID NO: 3958551 - RNA, 18 nt, Staphylococcus aureus subsp. aureus Mu50
auuugaaugccuacagau

SEQ ID NO: 3958552 - RNA, 15 nt, Staphylococcus aureus subsp. aureus Mu50
auuugaauuaaagug

SEQ ID NO: 3958553 - RNA, 19 nt, Staphylococcus aureus subsp. aureus Mu50
auuugaauugacuuacauu

SEQ ID NO: 3958554 - RNA, 20 nt, Staphylococcus aureus subsp. aureus Mu50
auuugacacauuauugaaau

SEQ ID NO: 3958555 - RNA, 14 nt, Staphylococcus aureus subsp. aureus Mu50
auuugagaaaugaa

SEQ ID NO: 3958556 - RNA, 15 nt, Staphylococcus aureus subsp. aureus Mu50
auuugagaaaugaaa

SEQ ID NO: 3958557 - RNA, 18 nt, Staphylococcus aureus subsp. aureus Mu50
auuugaggauacauaaau

SEQ ID NO: 3958558 - RNA, 21 nt, Staphylococcus aureus subsp. aureus Mu50
auuugaggauacauaaaucua

SEQ ID NO: 3958559 - RNA, 17 nt, Staphylococcus aureus subsp. aureus Mu50
auuugauaaauaaaauu

SEQ ID NO: 3958560 - RNA, 17 nt, Staphylococcus aureus subsp. aureus Mu50
auuugauaagugaugug

SEQ ID NO: 3958561 - RNA, 22 nt, Staphylococcus aureus subsp. aureus Mu50
auuugauacaacuauauguguc

SEQ ID NO: 3958562 - RNA, 12 nt, Staphylococcus aureus subsp. aureus Mu50
auuugaucaacc

SEQ ID NO: 3958563 - RNA, 21 nt, Staphylococcus aureus subsp. aureus Mu50
auuugaucaaccuguucuuua

SEQ ID NO: 3958564 - RNA, 14 nt, Staphylococcus aureus subsp. aureus Mu50
auuugaucguugaa

SEQ ID NO: 3958565 - RNA, 18 nt, Staphylococcus aureus subsp. aureus Mu50
auuugaugguguuaaguu

SEQ ID NO: 3958566 - RNA, 16 nt, Staphylococcus aureus subsp. aureus Mu50
auuugauguucuugaa

SEQ ID NO: 3958567 - RNA, 19 nt, Staphylococcus aureus subsp. aureus Mu50
auuugauucauuacauguu

SEQ ID NO: 3958568 - RNA, 13 nt, Staphylococcus aureus subsp. aureus Mu50
auuugauucuuca

SEQ ID NO: 3958569 - RNA, 13 nt, Staphylococcus aureus subsp. aureus Mu50
auuugauuuagca

SEQ ID NO: 3958570 - RNA, 15 nt, Staphylococcus aureus subsp. aureus Mu50
auuugcaaaaucaac

SEQ ID NO: 3958571 - RNA, 21 nt, Staphylococcus aureus subsp. aureus Mu50
auuugcaaaaucaacccauca

SEQ ID NO: 3958572 - RNA, 21 nt, Staphylococcus aureus subsp. aureus Mu50
auuugcagaacguucuaaggu

SEQ ID NO: 3958573 - RNA, 23 nt, Staphylococcus aureus subsp. aureus Mu50
auuugccauauacacacuaagga

SEQ ID NO: 3958574 - RNA, 23 nt, Staphylococcus aureus subsp. aureus Mu50
auuugccccgccauucauaaaug

SEQ ID NO: 3958575 - RNA, 15 nt, Staphylococcus aureus subsp. aureus Mu50
auuugccuuuuuuau

SEQ ID NO: 3958576 - RNA, 21 nt, Staphylococcus aureus subsp. aureus Mu50
auuugcuguuaauaaaucauu

SEQ ID NO: 3958577 - RNA, 21 nt, Staphylococcus aureus subsp. aureus Mu50
auuuggauaauuuuuaacagc

SEQ ID NO: 3958578 - RNA, 19 nt, Staphylococcus aureus subsp. aureus Mu50
auuuggauauuuauuuuaa

SEQ ID NO: 3958579 - RNA, 16 nt, Staphylococcus aureus subsp. aureus Mu50
auuuggcgcuuuauga

SEQ ID NO: 3958580 - RNA, 15 nt, Staphylococcus aureus subsp. aureus Mu50
auuuggcguaaugau

SEQ ID NO: 3958581 - RNA, 20 nt, Staphylococcus aureus subsp. aureus Mu50
auuuggcucuauaucaaauu

SEQ ID NO: 3958582 - RNA, 23 nt, Staphylococcus aureus subsp. aureus Mu50
auuuggguaauguuuuuacaaau

SEQ ID NO: 3958583 - RNA, 15 nt, Staphylococcus aureus subsp. aureus Mu50
auuugguacauaaua

SEQ ID NO: 3958584 - RNA, 13 nt, Staphylococcus aureus subsp. aureus Mu50
auuuggucaaguu

SEQ ID NO: 3958585 - RNA, 19 nt, Staphylococcus aureus subsp. aureus Mu50
auuuggucauagaaauuuu

SEQ ID NO: 3958586 - RNA, 22 nt, Staphylococcus aureus subsp. aureus Mu50
auuugguggagaaccaaaaauu

SEQ ID NO: 3958587 - RNA, 23 nt, Staphylococcus aureus subsp. aureus Mu50
auuugguggagaaccuuuaaaag

SEQ ID NO: 3958588 - RNA, 21 nt, Staphylococcus aureus subsp. aureus Mu50
auuugguucuucuaucuuuuc

SEQ ID NO: 3958589 - RNA, 15 nt, Staphylococcus aureus subsp. aureus Mu50
auuugguugaacugu

SEQ ID NO: 3958590 - RNA, 15 nt, Staphylococcus aureus subsp. aureus Mu50
auuuguaaauauuuu

SEQ ID NO: 3958591 - RNA, 18 nt, Staphylococcus aureus subsp. aureus Mu50
auuuguaaauauuuuuua

SEQ ID NO: 3958592 - RNA, 23 nt, Staphylococcus aureus subsp. aureus Mu50
auuuguaaauauuuuuuaaaaug

SEQ ID NO: 3958593 - RNA, 20 nt, Staphylococcus aureus subsp. aureus Mu50
auuuguaacuauugaaaaua

SEQ ID NO: 3958594 - RNA, 14 nt, Staphylococcus aureus subsp. aureus Mu50
auuuguaauacaag

SEQ ID NO: 3958595 - RNA, 21 nt, Staphylococcus aureus subsp. aureus Mu50
auuuguaaucccauuuuaaag

SEQ ID NO: 3958596 - RNA, 20 nt, Staphylococcus aureus subsp. aureus Mu50
auuuguacaugaacaaauaa

SEQ ID NO: 3958597 - RNA, 21 nt, Staphylococcus aureus subsp. aureus Mu50
auuuguagcuugaauaauaua

SEQ ID NO: 3958598 - RNA, 14 nt, Staphylococcus aureus subsp. aureus Mu50
auuuguauuaauuu

SEQ ID NO: 3958599 - RNA, 21 nt, Staphylococcus aureus subsp. aureus Mu50
auuuguauuuugcgcuucuag

SEQ ID NO: 3958600 - RNA, 13 nt, Staphylococcus aureus subsp. aureus Mu50
auuugucauaaua

SEQ ID NO: 3958601 - RNA, 13 nt, Staphylococcus aureus subsp. aureus Mu50
auuugucauuucu

SEQ ID NO: 3958602 - RNA, 16 nt, Staphylococcus aureus subsp. aureus Mu50
auuugugcguuucaau

SEQ ID NO: 3958603 - RNA, 20 nt, Staphylococcus aureus subsp. aureus Mu50
auuuguggaaauaaaacaag

SEQ ID NO: 3958604 - RNA, 18 nt, Staphylococcus aureus subsp. aureus Mu50
auuugugguaaucaugua

SEQ ID NO: 3958605 - RNA, 14 nt, Staphylococcus aureus subsp. aureus Mu50
auuuguguauaaau

SEQ ID NO: 3958606 - RNA, 16 nt, Staphylococcus aureus subsp. aureus Mu50
auuuguguauaaaugu

SEQ ID NO: 3958607 - RNA, 19 nt, Staphylococcus aureus subsp. aureus Mu50
auuuguguauaaaugucau

SEQ ID NO: 3958608 - RNA, 21 nt, Staphylococcus aureus subsp. aureus Mu50
auuugugugcgauaagcaaaa

SEQ ID NO: 3958609 - RNA, 23 nt, Staphylococcus aureus subsp. aureus Mu50
auuuguguuuuuaauguuugcuu

SEQ ID NO: 3958610 - RNA, 19 nt, Staphylococcus aureus subsp. aureus Mu50
auuuguuaauuuaauaauu

SEQ ID NO: 3958611 - RNA, 15 nt, Staphylococcus aureus subsp. aureus Mu50
auuuguuacuucuaa

SEQ ID NO: 3958612 - RNA, 21 nt, Staphylococcus aureus subsp. aureus Mu50
auuuguucaaugauuuuauaa

SEQ ID NO: 3958613 - RNA, 13 nt, Staphylococcus aureus subsp. aureus Mu50
auuuguugauagu

SEQ ID NO: 3958614 - RNA, 24 nt, Staphylococcus aureus subsp. aureus Mu50
auuuguuuauuaguuauguuaguc

SEQ ID NO: 3958615 - RNA, 21 nt, Staphylococcus aureus subsp. aureus Mu50
auuuguuugauuuauuauuuc

SEQ ID NO: 3958616 - RNA, 16 nt, Staphylococcus aureus subsp. aureus Mu50
auuuguuuuaaauacu

SEQ ID NO: 3958617 - RNA, 21 nt, Staphylococcus aureus subsp. aureus Mu50
auuuuaaaaaaugaugcacua

SEQ ID NO: 3958618 - RNA, 16 nt, Staphylococcus aureus subsp. aureus Mu50
auuuuaaaaauaaaaa

SEQ ID NO: 3958619 - RNA, 15 nt, Staphylococcus aureus subsp. aureus Mu50
auuuuaaaaaugcug

SEQ ID NO: 3958620 - RNA, 19 nt, Staphylococcus aureus subsp. aureus Mu50
auuuuaaaaauucauaauc

SEQ ID NO: 3958621 - RNA, 22 nt, Staphylococcus aureus subsp. aureus Mu50
auuuuaaacaugaacaaucaga

SEQ ID NO: 3958622 - RNA, 18 nt, Staphylococcus aureus subsp. aureus Mu50
auuuuaaacguaucauuu

SEQ ID NO: 3958623 - RNA, 21 nt, Staphylococcus aureus subsp. aureus Mu50
auuuuaaacguaucauuuaaa

SEQ ID NO: 3958624 - RNA, 20 nt, Staphylococcus aureus subsp. aureus Mu50
auuuuaaagaaaaguuuaag

SEQ ID NO: 3958625 - RNA, 17 nt, Staphylococcus aureus subsp. aureus Mu50
auuuuaaauaaaaugca

SEQ ID NO: 3958626 - RNA, 21 nt, Staphylococcus aureus subsp. aureus Mu50
auuuuaaauauugauauaaaa

SEQ ID NO: 3958627 - RNA, 20 nt, Staphylococcus aureus subsp. aureus Mu50
auuuuaaaucuaauuauuca

SEQ ID NO: 3958628 - RNA, 12 nt, Staphylococcus aureus subsp. aureus Mu50
auuuuaaaucuu

SEQ ID NO: 3958629 - RNA, 22 nt, Staphylococcus aureus subsp. aureus Mu50
auuuuaaauucaacuaugaaau

SEQ ID NO: 3958630 - RNA, 19 nt, Staphylococcus aureus subsp. aureus Mu50
auuuuaacgucauuuuuaa

SEQ ID NO: 3958631 - RNA, 14 nt, Staphylococcus aureus subsp. aureus Mu50
auuuuaacuuaauu

SEQ ID NO: 3958632 - RNA, 19 nt, Staphylococcus aureus subsp. aureus Mu50
auuuuaacuuaauuaaaaa

SEQ ID NO: 3958633 - RNA, 13 nt, Staphylococcus aureus subsp. aureus Mu50
auuuuaacuuaua

SEQ ID NO: 3958634 - RNA, 13 nt, Staphylococcus aureus subsp. aureus Mu50
auuuuaauaaaau

SEQ ID NO: 3958635 - RNA, 13 nt, Staphylococcus aureus subsp. aureus Mu50
auuuuaauaacga

SEQ ID NO: 3958636 - RNA, 20 nt, Staphylococcus aureus subsp. aureus Mu50
auuuugacguuuuagacaua

SEQ ID NO: 3958637 - RNA, 14 nt, Staphylococcus aureus subsp. aureus Mu50
auuuugaguauuug

SEQ ID NO: 3958638 - RNA, 15 nt, Staphylococcus aureus subsp. aureus Mu50
auuuugauauaaaaa

SEQ ID NO: 3958639 - RNA, 18 nt, Staphylococcus aureus subsp. aureus Mu50
auuuugauauuuuucacg

SEQ ID NO: 3958640 - RNA, 20 nt, Staphylococcus aureus subsp. aureus Mu50
auuuugcaauugcaaugaau

SEQ ID NO: 3958641 - RNA, 20 nt, Staphylococcus aureus subsp. aureus Mu50
auuuugcgaaaauaucauuu

SEQ ID NO: 3958642 - RNA, 13 nt, Staphylococcus aureus subsp. aureus Mu50
auuuuggauuuuu

SEQ ID NO: 3958643 - RNA, 17 nt, Staphylococcus aureus subsp. aureus Mu50
auuuuggcacauaaauc

SEQ ID NO: 3958644 - RNA, 20 nt, Staphylococcus aureus subsp. aureus Mu50
auuuuggcacauaaaucaau

SEQ ID NO: 3958645 - RNA, 17 nt, Staphylococcus aureus subsp. aureus Mu50
auuuuggcuuaauagag

SEQ ID NO: 3958646 - RNA, 20 nt, Staphylococcus aureus subsp. aureus Mu50
auuuuguaagcucaugaauc

SEQ ID NO: 3958647 - RNA, 22 nt, Staphylococcus aureus subsp. aureus Mu50
auuuuguaauggcuauucgauu

SEQ ID NO: 3958648 - RNA, 15 nt, Staphylococcus aureus subsp. aureus Mu50
auuuuguauaaccuu

SEQ ID NO: 3958649 - RNA, 14 nt, Staphylococcus aureus subsp. aureus Mu50
auuuuguauuuuuc

SEQ ID NO: 3958650 - RNA, 17 nt, Staphylococcus aureus subsp. aureus Mu50
auuuuguauuuuucaaa

SEQ ID NO: 3958651 - RNA, 15 nt, Staphylococcus aureus subsp. aureus Mu50
auuuugugaauuuau

SEQ ID NO: 3958652 - RNA, 23 nt, Staphylococcus aureus subsp. aureus Mu50
auuuuguuaauaagcgcaucccu

SEQ ID NO: 3958653 - RNA, 23 nt, Staphylococcus aureus subsp. aureus Mu50
auuuuguucaguuaaaucuguau

SEQ ID NO: 3958654 - RNA, 23 nt, Staphylococcus aureus subsp. aureus Mu50
auuuuguuguacuuccuuccauu

SEQ ID NO: 3958655 - RNA, 14 nt, Staphylococcus aureus subsp. aureus Mu50
auuuuguuucaaac

SEQ ID NO: 3958656 - RNA, 14 nt, Staphylococcus aureus subsp. aureus Mu50
auuuuguuucaaca

SEQ ID NO: 3958657 - RNA, 15 nt, Staphylococcus aureus subsp. aureus Mu50
auuuuguuucaacau

SEQ ID NO: 3958658 - RNA, 18 nt, Staphylococcus aureus subsp. aureus Mu50
auuuuguuucaacauuuc

SEQ ID NO: 3958659 - RNA, 14 nt, Staphylococcus aureus subsp. aureus Mu50
auuuuguuucacua

SEQ ID NO: 3958660 - RNA, 12 nt, Staphylococcus aureus subsp. aureus Mu50
auuuuuaaaaau

SEQ ID NO: 3958661 - RNA, 11 nt, Staphylococcus aureus subsp. aureus Mu50
auuuuuaaaau

SEQ ID NO: 3958662 - RNA, 15 nt, Staphylococcus aureus subsp. aureus Mu50
auuuuuaaauuacua

SEQ ID NO: 3958663 - RNA, 22 nt, Staphylococcus aureus subsp. aureus Mu50
auuuuuaacagcgugaauauaa

SEQ ID NO: 3958664 - RNA, 15 nt, Staphylococcus aureus subsp. aureus Mu50
auuuuuaagcugcuc

SEQ ID NO: 3958665 - RNA, 12 nt, Staphylococcus aureus subsp. aureus Mu50
auuuuuaauaau

SEQ ID NO: 3958666 - RNA, 14 nt, Staphylococcus aureus subsp. aureus Mu50
auuuuuaauuauuu

SEQ ID NO: 3958667 - RNA, 17 nt, Staphylococcus aureus subsp. aureus Mu50
auuuuuaauuucuggua

SEQ ID NO: 3958668 - RNA, 16 nt, Staphylococcus aureus subsp. aureus Mu50
auuuuuacaaagugau

SEQ ID NO: 3958669 - RNA, 21 nt, Staphylococcus aureus subsp. aureus Mu50
auuuuuacaaagugauuuaaa

SEQ ID NO: 3958670 - RNA, 17 nt, Staphylococcus aureus subsp. aureus Mu50
auuuuuacuaaaucauu

SEQ ID NO: 3958671 - RNA, 15 nt, Staphylococcus aureus subsp. aureus Mu50
auuuuuagacauuaa

SEQ ID NO: 3958672 - RNA, 13 nt, Staphylococcus aureus subsp. aureus Mu50
auuuuuaguuaaa

SEQ ID NO: 3958673 - RNA, 18 nt, Staphylococcus aureus subsp. aureus Mu50
auuuuuaguuagaaagua

SEQ ID NO: 3958674 - RNA, 12 nt, Staphylococcus aureus subsp. aureus Mu50
auuuuuauaaau

SEQ ID NO: 3958675 - RNA, 14 nt, Staphylococcus aureus subsp. aureus Mu50
auuuuuauaaauuu

SEQ ID NO: 3958676 - RNA, 22 nt, Staphylococcus aureus subsp. aureus Mu50
auuuuuauagugucgagauuuu

SEQ ID NO: 3958677 - RNA, 14 nt, Staphylococcus aureus subsp. aureus Mu50
auuuuuaucaucau

SEQ ID NO: 3958678 - RNA, 13 nt, Staphylococcus aureus subsp. aureus Mu50
auuuuuaucaucu

SEQ ID NO: 3958679 - RNA, 20 nt, Staphylococcus aureus subsp. aureus Mu50
auuuuuaucccacuccuuau

SEQ ID NO: 3958680 - RNA, 13 nt, Staphylococcus aureus subsp. aureus Mu50
auuuuuauguuaa

SEQ ID NO: 3958681 - RNA, 13 nt, Staphylococcus aureus subsp. aureus Mu50
auuuuuauuuaua

SEQ ID NO: 3958682 - RNA, 17 nt, Staphylococcus aureus subsp. aureus Mu50
auuuuucauauuuuuua

SEQ ID NO: 3958683 - RNA, 15 nt, Staphylococcus aureus subsp. aureus Mu50
auuuuucaucaauau

SEQ ID NO: 3958684 - RNA, 17 nt, Staphylococcus aureus subsp. aureus Mu50
auuuuucauuaauacaa

SEQ ID NO: 3958685 - RNA, 22 nt, Staphylococcus aureus subsp. aureus Mu50
auuuuuccauaguggaauacuu

SEQ ID NO: 3958686 - RNA, 18 nt, Staphylococcus aureus subsp. aureus Mu50
auuuuucucaacaguuuc

SEQ ID NO: 3958687 - RNA, 14 nt, Staphylococcus aureus subsp. aureus Mu50
auuuuucuuauaaa

SEQ ID NO: 3958688 - RNA, 20 nt, Staphylococcus aureus subsp. aureus Mu50
auuuuucuuauaaaaaucuu

SEQ ID NO: 3958689 - RNA, 23 nt, Staphylococcus aureus subsp. aureus Mu50
auuuuucuucaguuaaaucuuua

SEQ ID NO: 3958690 - RNA, 15 nt, Staphylococcus aureus subsp. aureus Mu50
auuuuucuucuuuuu

SEQ ID NO: 3958691 - RNA, 17 nt, Staphylococcus aureus subsp. aureus Mu50
auuuuucuucuuuuuua

SEQ ID NO: 3958692 - RNA, 16 nt, Staphylococcus aureus subsp. aureus Mu50
auuuuugacuguuaaa

SEQ ID NO: 3958693 - RNA, 19 nt, Staphylococcus aureus subsp. aureus Mu50
auuuuugacuguuaaacaa

SEQ ID NO: 3958694 - RNA, 15 nt, Staphylococcus aureus subsp. aureus Mu50
auuuuugaguaauuu

SEQ ID NO: 3958695 - RNA, 14 nt, Staphylococcus aureus subsp. aureus Mu50
auuuuugauuuaau

SEQ ID NO: 3958696 - RNA, 17 nt, Staphylococcus aureus subsp. aureus Mu50
auuuuugauuuaauaau

SEQ ID NO: 3958697 - RNA, 18 nt, Staphylococcus aureus subsp. aureus Mu50
auuuuugcuauuucaaca

SEQ ID NO: 3958698 - RNA, 12 nt, Staphylococcus aureus subsp. aureus Mu50
auuuuuggcuua

SEQ ID NO: 3958699 - RNA, 15 nt, Staphylococcus aureus subsp. aureus Mu50
auuuuuuaauaauca

SEQ ID NO: 3958700 - RNA, 17 nt, Staphylococcus aureus subsp. aureus Mu50
auuuuuuaaugucuaaa

SEQ ID NO: 3958701 - RNA, 21 nt, Staphylococcus aureus subsp. aureus Mu50
auuuuuuaguaauaacaucua

SEQ ID NO: 3958702 - RNA, 20 nt, Staphylococcus aureus subsp. aureus Mu50
auuuuuuauuccgaacaugu

SEQ ID NO: 3958703 - RNA, 13 nt, Staphylococcus aureus subsp. aureus Mu50
auuuuuucaaugu

SEQ ID NO: 3958704 - RNA, 18 nt, Staphylococcus aureus subsp. aureus Mu50
auuuuuucaugauuuacu

SEQ ID NO: 3958705 - RNA, 17 nt, Staphylococcus aureus subsp. aureus Mu50
auuuuuucguuuuaaua

SEQ ID NO: 3958706 - RNA, 21 nt, Staphylococcus aureus subsp. aureus Mu50
auuuuuucuauggcacaaaug

SEQ ID NO: 3958707 - RNA, 14 nt, Staphylococcus aureus subsp. aureus Mu50
auuuuuugauaugg

SEQ ID NO: 3958708 - RNA, 21 nt, Staphylococcus aureus subsp. aureus Mu50
auuuuuuggagcguaaaguuu

SEQ ID NO: 3958709 - RNA, 17 nt, Staphylococcus aureus subsp. aureus Mu50
auuuuuuggucaccaaa

SEQ ID NO: 3958710 - RNA, 21 nt, Staphylococcus aureus subsp. aureus Mu50
auuuuuugguuucuauaaaga

SEQ ID NO: 3958711 - RNA, 23 nt, Staphylococcus aureus subsp. aureus Mu50
auuuuuuuaaaucuauauaaagu

SEQ ID NO: 3958712 - RNA, 19 nt, Staphylococcus aureus subsp. aureus Mu50
auuuuuuuacguaaucuaa

SEQ ID NO: 3958713 - RNA, 13 nt, Staphylococcus aureus subsp. aureus Mu50
auuuuuuuaugcu

SEQ ID NO: 3958714 - RNA, 22 nt, Staphylococcus aureus subsp. aureus Mu50
auuuuuuucguaacauuuaaaa

SEQ ID NO: 3958715 - RNA, 23 nt, Staphylococcus aureus subsp. aureus Mu50
auuuuuuucguaacauuuaaaaa

SEQ ID NO: 3958716 - RNA, 19 nt, Staphylococcus aureus subsp. aureus Mu50
auuuuuuuguacuuucuga

SEQ ID NO: 3958717 - RNA, 18 nt, Staphylococcus aureus subsp. aureus Mu50
caaaaaacgccuuuccau

SEQ ID NO: 3958718 - RNA, 21 nt, Staphylococcus aureus subsp. aureus Mu50
caaaaaauaauagcaaaauua

SEQ ID NO: 3958719 - RNA, 15 nt, Staphylococcus aureus subsp. aureus Mu50
caaaaaauuguauaa

SEQ ID NO: 3958720 - RNA, 19 nt, Staphylococcus aureus subsp. aureus Mu50
caaaaacaguuacaacuga

SEQ ID NO: 3958721 - RNA, 19 nt, Staphylococcus aureus subsp. aureus Mu50
caaaaacgguaauuucuau

SEQ ID NO: 3958722 - RNA, 13 nt, Staphylococcus aureus subsp. aureus Mu50
caaaaagaauuuc

SEQ ID NO: 3958723 - RNA, 19 nt, Staphylococcus aureus subsp. aureus Mu50
caaaaagacuuccaauaac

SEQ ID NO: 3958724 - RNA, 12 nt, Staphylococcus aureus subsp. aureus Mu50
caaaguuuucau

SEQ ID NO: 3958725 - RNA, 12 nt, Staphylococcus aureus subsp. aureus Mu50
caaauaaaaaag

SEQ ID NO: 3958726 - RNA, 18 nt, Staphylococcus aureus subsp. aureus Mu50
caaauaaaacgcuucaua

SEQ ID NO: 3958727 - RNA, 19 nt, Staphylococcus aureus subsp. aureus Mu50
caaauaaaacgcuucauau

SEQ ID NO: 3958728 - RNA, 19 nt, Staphylococcus aureus subsp. aureus Mu50
caaauaaacacaucuaugu

SEQ ID NO: 3958729 - RNA, 19 nt, Staphylococcus aureus subsp. aureus Mu50
caaauaaauaagugauaaa

SEQ ID NO: 3958730 - RNA, 14 nt, Staphylococcus aureus subsp. aureus Mu50
caaauaaaucaaac

SEQ ID NO: 3958731 - RNA, 12 nt, Staphylococcus aureus subsp. aureus Mu50
caaauaaauguc

SEQ ID NO: 3958732 - RNA, 15 nt, Staphylococcus aureus subsp. aureus Mu50
caaauaacaaacauu

SEQ ID NO: 3958733 - RNA, 19 nt, Staphylococcus aureus subsp. aureus Mu50
caaauaacguuaauauaau

SEQ ID NO: 3958734 - RNA, 18 nt, Staphylococcus aureus subsp. aureus Mu50
caaauaaugaugcauaag

SEQ ID NO: 3958735 - RNA, 14 nt, Staphylococcus aureus subsp. aureus Mu50
caaauaauuuacau

SEQ ID NO: 3958736 - RNA, 20 nt, Staphylococcus aureus subsp. aureus Mu50
caaauaauuuacauuaauuu

SEQ ID NO: 3958737 - RNA, 18 nt, Staphylococcus aureus subsp. aureus Mu50
caaauacauaaucauugu

SEQ ID NO: 3958738 - RNA, 21 nt, Staphylococcus aureus subsp. aureus Mu50
caaauacauaaucauugugua

SEQ ID NO: 3958739 - RNA, 17 nt, Staphylococcus aureus subsp. aureus Mu50
caaauacaucaauuucu

SEQ ID NO: 3958740 - RNA, 21 nt, Staphylococcus aureus subsp. aureus Mu50
caaauacaugugggauaucuu

SEQ ID NO: 3958741 - RNA, 10 nt, Staphylococcus aureus subsp. aureus Mu50
caaauacuuc

SEQ ID NO: 3958742 - RNA, 15 nt, Staphylococcus aureus subsp. aureus Mu50
caaauagacaccaaa

SEQ ID NO: 3958743 - RNA, 18 nt, Staphylococcus aureus subsp. aureus Mu50
caaauagacaccaaaaaa

SEQ ID NO: 3958744 - RNA, 15 nt, Staphylococcus aureus subsp. aureus Mu50
caaauauaaauaaaa

SEQ ID NO: 3958745 - RNA, 17 nt, Staphylococcus aureus subsp. aureus Mu50
caaauauaauguauaaa

SEQ ID NO: 3958746 - RNA, 17 nt, Staphylococcus aureus subsp. aureus Mu50
caaauauacuuuuacca

SEQ ID NO: 3958747 - RNA, 20 nt, Staphylococcus aureus subsp. aureus Mu50
caaauauaucuagccugaaa

SEQ ID NO: 3958748 - RNA, 14 nt, Staphylococcus aureus subsp. aureus Mu50
caaauauauuugua

SEQ ID NO: 3958749 - RNA, 14 nt, Staphylococcus aureus subsp. aureus Mu50
caaauaucuaaaca

SEQ ID NO: 3958750 - RNA, 13 nt, Staphylococcus aureus subsp. aureus Mu50
caaauaugagugg

SEQ ID NO: 3958751 - RNA, 12 nt, Staphylococcus aureus subsp. aureus Mu50
caaauauuaaau

SEQ ID NO: 3958752 - RNA, 15 nt, Staphylococcus aureus subsp. aureus Mu50
caaauauuauuaaau

SEQ ID NO: 3958753 - RNA, 18 nt, Staphylococcus aureus subsp. aureus Mu50
caaauauuauuaaaucaa

SEQ ID NO: 3958754 - RNA, 23 nt, Staphylococcus aureus subsp. aureus Mu50
caaauauuguagccuccgccacc

SEQ ID NO: 3958755 - RNA, 16 nt, Staphylococcus aureus subsp. aureus Mu50
caaauauuuuaucugu

SEQ ID NO: 3958756 - RNA, 14 nt, Staphylococcus aureus subsp. aureus Mu50
caaaucaaauacau

SEQ ID NO: 3958757 - RNA, 18 nt, Staphylococcus aureus subsp. aureus Mu50
caaaucaaauacaucaau

SEQ ID NO: 3958758 - RNA, 18 nt, Staphylococcus aureus subsp. aureus Mu50
caaaucgauauugagaau

SEQ ID NO: 3958759 - RNA, 14 nt, Staphylococcus aureus subsp. aureus Mu50
caaaucgauuaauu

SEQ ID NO: 3958760 - RNA, 16 nt, Staphylococcus aureus subsp. aureus Mu50
caaaucggaauaaaau

SEQ ID NO: 3958761 - RNA, 20 nt, Staphylococcus aureus subsp. aureus Mu50
caaaucggaauaaaauaaau

SEQ ID NO: 3958762 - RNA, 21 nt, Staphylococcus aureus subsp. aureus Mu50
caaaucguuucaugcacuuua

SEQ ID NO: 3958763 - RNA, 19 nt, Staphylococcus aureus subsp. aureus Mu50
caaaucucgucacauauaa

SEQ ID NO: 3958764 - RNA, 22 nt, Staphylococcus aureus subsp. aureus Mu50
caaaugaaaaaguaaaaucuuu

SEQ ID NO: 3958765 - RNA, 15 nt, Staphylococcus aureus subsp. aureus Mu50
caaaugaaauucuuu

SEQ ID NO: 3958766 - RNA, 15 nt, Staphylococcus aureus subsp. aureus Mu50
caaaugaauggagca

SEQ ID NO: 3958767 - RNA, 20 nt, Staphylococcus aureus subsp. aureus Mu50
caaaugaauggagcaugauu

SEQ ID NO: 3958768 - RNA, 17 nt, Staphylococcus aureus subsp. aureus Mu50
caaaugacauuuuaaau

SEQ ID NO: 3958769 - RNA, 17 nt, Staphylococcus aureus subsp. aureus Mu50
caaaugagcguuccauu

SEQ ID NO: 3958770 - RNA, 20 nt, Staphylococcus aureus subsp. aureus Mu50
caaaugagcguuccauuaau

SEQ ID NO: 3958771 - RNA, 15 nt, Staphylococcus aureus subsp. aureus Mu50
caaaugcaauaggau

SEQ ID NO: 3958772 - RNA, 16 nt, Staphylococcus aureus subsp. aureus Mu50
caaaugcucccuucaa

SEQ ID NO: 3958773 - RNA, 18 nt, Staphylococcus aureus subsp. aureus Mu50
caaauguaagaacgaaac

SEQ ID NO: 3958774 - RNA, 16 nt, Staphylococcus aureus subsp. aureus Mu50
caaauguauaaauaau

SEQ ID NO: 3958775 - RNA, 20 nt, Staphylococcus aureus subsp. aureus Mu50
caaauguugaauguggaaca

SEQ ID NO: 3958776 - RNA, 19 nt, Staphylococcus aureus subsp. aureus Mu50
caaauguugacuacucaau

SEQ ID NO: 3958777 - RNA, 14 nt, Staphylococcus aureus subsp. aureus Mu50
caaauguugauaau

SEQ ID NO: 3958778 - RNA, 18 nt, Staphylococcus aureus subsp. aureus Mu50
caaauuaauuaaaccaau

SEQ ID NO: 3958779 - RNA, 15 nt, Staphylococcus aureus subsp. aureus Mu50
caaauuacaaauuau

SEQ ID NO: 3958780 - RNA, 16 nt, Staphylococcus aureus subsp. aureus Mu50
caaauuacaaauuauc

SEQ ID NO: 3958781 - RNA, 21 nt, Staphylococcus aureus subsp. aureus Mu50
caaauuacugucuuuccauaa

SEQ ID NO: 3958782 - RNA, 21 nt, Staphylococcus aureus subsp. aureus Mu50
caaauuagucauccaaagaaa

SEQ ID NO: 3958783 - RNA, 16 nt, Staphylococcus aureus subsp. aureus Mu50
caaauuaguuugauau

SEQ ID NO: 3958784 - RNA, 14 nt, Staphylococcus aureus subsp. aureus Mu50
caaauuauaaauuu

SEQ ID NO: 3958785 - RNA, 15 nt, Staphylococcus aureus subsp. aureus Mu50
caaauuauuaacgca

SEQ ID NO: 3958786 - RNA, 15 nt, Staphylococcus aureus subsp. aureus Mu50
caaauucaacuuuaa

SEQ ID NO: 3958787 - RNA, 13 nt, Staphylococcus aureus subsp. aureus Mu50
caaauucauuugu

SEQ ID NO: 3958788 - RNA, 14 nt, Staphylococcus aureus subsp. aureus Mu50
caaauucauuugua

SEQ ID NO: 3958789 - RNA, 22 nt, Staphylococcus aureus subsp. aureus Mu50
caaauucauuuguauuaauuug

SEQ ID NO: 3958790 - RNA, 19 nt, Staphylococcus aureus subsp. aureus Mu50
caaauucgacucaaacaau

SEQ ID NO: 3958791 - RNA, 22 nt, Staphylococcus aureus subsp. aureus Mu50
caaauucgacucaaacaauaaa

SEQ ID NO: 3958792 - RNA, 18 nt, Staphylococcus aureus subsp. aureus Mu50
caaauugaacuuauaagu

SEQ ID NO: 3958793 - RNA, 17 nt, Staphylococcus aureus subsp. aureus Mu50
caaauugacgcauuaau

SEQ ID NO: 3958794 - RNA, 15 nt, Staphylococcus aureus subsp. aureus Mu50
caaauugcaaaguaa

SEQ ID NO: 3958795 - RNA, 13 nt, Staphylococcus aureus subsp. aureus Mu50
caaauugcaaugg

SEQ ID NO: 3958796 - RNA, 21 nt, Staphylococcus aureus subsp. aureus Mu50
caaauugcaauggcaaccuuu

SEQ ID NO: 3958797 - RNA, 16 nt, Staphylococcus aureus subsp. aureus Mu50
caaauugccuuucauu

SEQ ID NO: 3958798 - RNA, 17 nt, Staphylococcus aureus subsp. aureus Mu50
caaauugccuuucauuu

SEQ ID NO: 3958799 - RNA, 21 nt, Staphylococcus aureus subsp. aureus Mu50
caaauuggauaauuucuucuu

SEQ ID NO: 3958800 - RNA, 23 nt, Staphylococcus aureus subsp. aureus Mu50
caaauuggauaauuucuucuucu

SEQ ID NO: 3958801 - RNA, 17 nt, Staphylococcus aureus subsp. aureus Mu50
caaauuuaggcauguca

SEQ ID NO: 3958802 - RNA, 19 nt, Staphylococcus aureus subsp. aureus Mu50
caaauuuaggcaugucaaa

SEQ ID NO: 3958803 - RNA, 13 nt, Staphylococcus aureus subsp. aureus Mu50
caaauuucucuuu

SEQ ID NO: 3958804 - RNA, 21 nt, Staphylococcus aureus subsp. aureus Mu50
caaauuucucuuucaagaccu

SEQ ID NO: 3958805 - RNA, 20 nt, Staphylococcus aureus subsp. aureus Mu50
caaauuugaauauacuuaau

SEQ ID NO: 3958806 - RNA, 20 nt, Staphylococcus aureus subsp. aureus Mu50
caaauuugugauuaugcaua

SEQ ID NO: 3958807 - RNA, 13 nt, Staphylococcus aureus subsp. aureus Mu50
caaauuuuauacu

SEQ ID NO: 3958808 - RNA, 22 nt, Staphylococcus aureus subsp. aureus Mu50
caaauuuugaguauuugccuuu

SEQ ID NO: 3958809 - RNA, 15 nt, Staphylococcus aureus subsp. aureus Mu50
caaauuuuuuguaaa

SEQ ID NO: 3958810 - RNA, 12 nt, Staphylococcus aureus subsp. aureus Mu50
caacaaaaagaa

SEQ ID NO: 3958811 - RNA, 22 nt, Staphylococcus aureus subsp. aureus Mu50
caacaaacgcugauuuaauagc

SEQ ID NO: 3958812 - RNA, 17 nt, Staphylococcus aureus subsp. aureus Mu50
caacuugugguuggaag

SEQ ID NO: 3958813 - RNA, 23 nt, Staphylococcus aureus subsp. aureus Mu50
caacuugugguuggaagucugcu

SEQ ID NO: 3958814 - RNA, 15 nt, Staphylococcus aureus subsp. aureus Mu50
caacuuuaaucaaaa

SEQ ID NO: 3958815 - RNA, 23 nt, Staphylococcus aureus subsp. aureus Mu50
caacuuuaaucaaaaaagacuca

SEQ ID NO: 3958816 - RNA, 19 nt, Staphylococcus aureus subsp. aureus Mu50
caacuuuaauuuuucauua

SEQ ID NO: 3958817 - RNA, 15 nt, Staphylococcus aureus subsp. aureus Mu50
caacuuuacgauaaa

SEQ ID NO: 3958818 - RNA, 20 nt, Staphylococcus aureus subsp. aureus Mu50
caacuuuguuuucaguaacu

SEQ ID NO: 3958819 - RNA, 15 nt, Staphylococcus aureus subsp. aureus Mu50
caacuuuuagaguuu

SEQ ID NO: 3958820 - RNA, 22 nt, Staphylococcus aureus subsp. aureus Mu50
caacuuuuuaauaauacuucua

SEQ ID NO: 3958821 - RNA, 12 nt, Staphylococcus aureus subsp. aureus Mu50
caagaaaaaguu

SEQ ID NO: 3958822 - RNA, 19 nt, Staphylococcus aureus subsp. aureus Mu50
caagaaacaauucauuaau

SEQ ID NO: 3958823 - RNA, 20 nt, Staphylococcus aureus subsp. aureus Mu50
caagaaacaauucauuaaua

SEQ ID NO: 3958824 - RNA, 18 nt, Staphylococcus aureus subsp. aureus Mu50
caagaaauacucaguuua

SEQ ID NO: 3958825 - RNA, 17 nt, Staphylococcus aureus subsp. aureus Mu50
caagaaucucuaucaua

SEQ ID NO: 3958826 - RNA, 16 nt, Staphylococcus aureus subsp. aureus Mu50
caagaauggcuuaaca

SEQ ID NO: 3958827 - RNA, 18 nt, Staphylococcus aureus subsp. aureus Mu50
caagaaugugaugauuaa

SEQ ID NO: 3958828 - RNA, 20 nt, Staphylococcus aureus subsp. aureus Mu50
caagaaugugaugauuaauc

SEQ ID NO: 3958829 - RNA, 19 nt, Staphylococcus aureus subsp. aureus Mu50
caagagaauuaauaauuuu

SEQ ID NO: 3958830 - RNA, 16 nt, Staphylococcus aureus subsp. aureus Mu50
caagagauaagaaaau

SEQ ID NO: 3958831 - RNA, 23 nt, Staphylococcus aureus subsp. aureus Mu50
caagagauaagaaaauaccuaau

SEQ ID NO: 3958832 - RNA, 16 nt, Staphylococcus aureus subsp. aureus Mu50
caagagguaaaucugu

SEQ ID NO: 3958833 - RNA, 21 nt, Staphylococcus aureus subsp. aureus Mu50
caagagguaaaucuguuuaaa

SEQ ID NO: 3958834 - RNA, 15 nt, Staphylococcus aureus subsp. aureus Mu50
caagagguuuuauuu

SEQ ID NO: 3958835 - RNA, 13 nt, Staphylococcus aureus subsp. aureus Mu50
caagauaaaucau

SEQ ID NO: 3958836 - RNA, 20 nt, Staphylococcus aureus subsp. aureus Mu50
caagaugcucauugcauuuc

SEQ ID NO: 3958837 - RNA, 18 nt, Staphylococcus aureus subsp. aureus Mu50
caagaugguauugcuuua

SEQ ID NO: 3958838 - RNA, 18 nt, Staphylococcus aureus subsp. aureus Mu50
caagauuaugacaacaua

SEQ ID NO: 3958839 - RNA, 14 nt, Staphylococcus aureus subsp. aureus Mu50
caagcaucaugaaa

SEQ ID NO: 3958840 - RNA, 18 nt, Staphylococcus aureus subsp. aureus Mu50
caagccaagauaaaucau

SEQ ID NO: 3958841 - RNA, 19 nt, Staphylococcus aureus subsp. aureus Mu50
caagccaucaauauugaua

SEQ ID NO: 3958842 - RNA, 15 nt, Staphylococcus aureus subsp. aureus Mu50
caagccguugguugu

SEQ ID NO: 3958843 - RNA, 18 nt, Staphylococcus aureus subsp. aureus Mu50
caagcguuucuugaucua

SEQ ID NO: 3958844 - RNA, 22 nt, Staphylococcus aureus subsp. aureus Mu50
caagcugagcuuuaauuuuuug

SEQ ID NO: 3958845 - RNA, 13 nt, Staphylococcus aureus subsp. aureus Mu50
caagcuuaauaag

SEQ ID NO: 3958846 - RNA, 22 nt, Staphylococcus aureus subsp. aureus Mu50
caagcuuaauaagcugaaauaa

SEQ ID NO: 3958847 - RNA, 17 nt, Staphylococcus aureus subsp. aureus Mu50
caagcuuuuuaggaaug

SEQ ID NO: 3958848 - RNA, 16 nt, Staphylococcus aureus subsp. aureus Mu50
caaggauguuauaaaa

SEQ ID NO: 3958849 - RNA, 19 nt, Staphylococcus aureus subsp. aureus Mu50
caagguaguuggcugauag

SEQ ID NO: 3958850 - RNA, 22 nt, Staphylococcus aureus subsp. aureus Mu50
caagguguucgggaauuuuuua

SEQ ID NO: 3958851 - RNA, 12 nt, Staphylococcus aureus subsp. aureus Mu50
caagguuucaag

SEQ ID NO: 3958852 - RNA, 21 nt, Staphylococcus aureus subsp. aureus Mu50
caagguuuucgccaauaaaac

SEQ ID NO: 3958853 - RNA, 13 nt, Staphylococcus aureus subsp. aureus Mu50
caaguaaauguuu

SEQ ID NO: 3958854 - RNA, 15 nt, Staphylococcus aureus subsp. aureus Mu50
caaguaaauguuuua

SEQ ID NO: 3958855 - RNA, 17 nt, Staphylococcus aureus subsp. aureus Mu50
caaguaaauguuuuaug

SEQ ID NO: 3958856 - RNA, 18 nt, Staphylococcus aureus subsp. aureus Mu50
caaguaauuuaauugguu

SEQ ID NO: 3958857 - RNA, 20 nt, Staphylococcus aureus subsp. aureus Mu50
caaguaugagacgcauugca

SEQ ID NO: 3958858 - RNA, 14 nt, Staphylococcus aureus subsp. aureus Mu50
caagucauuaucca

SEQ ID NO: 3958859 - RNA, 13 nt, Staphylococcus aureus subsp. aureus Mu50
caaguccaaauaa

SEQ ID NO: 3958860 - RNA, 22 nt, Staphylococcus aureus subsp. aureus Mu50
caagucguucucuuaaauauga

SEQ ID NO: 3958861 - RNA, 17 nt, Staphylococcus aureus subsp. aureus Mu50
caagucuaguucgaaca

SEQ ID NO: 3958862 - RNA, 20 nt, Staphylococcus aureus subsp. aureus Mu50
caagugacuuaauaucauau

SEQ ID NO: 3958863 - RNA, 14 nt, Staphylococcus aureus subsp. aureus Mu50
caagugcagauguu

SEQ ID NO: 3958864 - RNA, 20 nt, Staphylococcus aureus subsp. aureus Mu50
caagugcuugguuaaaguua

SEQ ID NO: 3958865 - RNA, 23 nt, Staphylococcus aureus subsp. aureus Mu50
caaguguaucgcccauaccacca

SEQ ID NO: 3958866 - RNA, 15 nt, Staphylococcus aureus subsp. aureus Mu50
caaguuacaauauca

SEQ ID NO: 3958867 - RNA, 20 nt, Staphylococcus aureus subsp. aureus Mu50
caaguucaccguaaucuuuu

SEQ ID NO: 3958868 - RNA, 17 nt, Staphylococcus aureus subsp. aureus Mu50
caaguugcacauuauaa

SEQ ID NO: 3958869 - RNA, 23 nt, Staphylococcus aureus subsp. aureus Mu50
caaguuggcggggccccaacaca

SEQ ID NO: 3958870 - RNA, 14 nt, Staphylococcus aureus subsp. aureus Mu50
caaguuguuuuuug

SEQ ID NO: 3958871 - RNA, 16 nt, Staphylococcus aureus subsp. aureus Mu50
caaguuguuuuuuguu

SEQ ID NO: 3958872 - RNA, 13 nt, Staphylococcus aureus subsp. aureus Mu50
caaguuuaaaaua

SEQ ID NO: 3958873 - RNA, 15 nt, Staphylococcus aureus subsp. aureus Mu50
caaguuuaaaauacg

SEQ ID NO: 3958874 - RNA, 21 nt, Staphylococcus aureus subsp. aureus Mu50
caaguuuacagguugaauaaa

SEQ ID NO: 3958875 - RNA, 17 nt, Staphylococcus aureus subsp. aureus Mu50
caaguuuacgaucauaa

SEQ ID NO: 3958876 - RNA, 24 nt, Staphylococcus aureus subsp. aureus Mu50
caaguuuaguaucuccaucaaagu

SEQ ID NO: 3958877 - RNA, 19 nt, Staphylococcus aureus subsp. aureus Mu50
caaguuuauaaauuucgau

SEQ ID NO: 3958878 - RNA, 16 nt, Staphylococcus aureus subsp. aureus Mu50
caaguuuauaaucuuu

SEQ ID NO: 3958879 - RNA, 22 nt, Staphylococcus aureus subsp. aureus Mu50
caaguuucauggggcuuaugca

SEQ ID NO: 3958880 - RNA, 19 nt, Staphylococcus aureus subsp. aureus Mu50
caaguuuucggcuagauuu

SEQ ID NO: 3958881 - RNA, 11 nt, Staphylococcus aureus subsp. aureus Mu50
caauaaaaaug

SEQ ID NO: 3958882 - RNA, 13 nt, Staphylococcus aureus subsp. aureus Mu50
caauaaaaugcaa

SEQ ID NO: 3958883 - RNA, 20 nt, Staphylococcus aureus subsp. aureus Mu50
caauaaaaugcaauuuuuca

SEQ ID NO: 3958884 - RNA, 14 nt, Staphylococcus aureus subsp. aureus Mu50
caauaaaauuacuu

SEQ ID NO: 3958885 - RNA, 21 nt, Staphylococcus aureus subsp. aureus Mu50
caauaaaauuggaacacgaaa

SEQ ID NO: 3958886 - RNA, 15 nt, Staphylococcus aureus subsp. aureus Mu50
caauaaauuaugaaa

SEQ ID NO: 3958887 - RNA, 16 nt, Staphylococcus aureus subsp. aureus Mu50
caauaacaccaauuga

SEQ ID NO: 3958888 - RNA, 15 nt, Staphylococcus aureus subsp. aureus Mu50
caauaacaggugcuu

SEQ ID NO: 3958889 - RNA, 21 nt, Staphylococcus aureus subsp. aureus Mu50
caauaacaggugcuuacuuuu

SEQ ID NO: 3958890 - RNA, 17 nt, Staphylococcus aureus subsp. aureus Mu50
caauaaccccugucacu

SEQ ID NO: 3958891 - RNA, 23 nt, Staphylococcus aureus subsp. aureus Mu50
caauaaccccugucacuaaugga

SEQ ID NO: 3958892 - RNA, 17 nt, Staphylococcus aureus subsp. aureus Mu50
caauaagcgcaauuaaa

SEQ ID NO: 3958893 - RNA, 22 nt, Staphylococcus aureus subsp. aureus Mu50
caauaauaaaccuaaagauaua

SEQ ID NO: 3958894 - RNA, 16 nt, Staphylococcus aureus subsp. aureus Mu50
caauaaugugucaaau

SEQ ID NO: 3958895 - RNA, 19 nt, Staphylococcus aureus subsp. aureus Mu50
caauaauuacuaaccuaaa

SEQ ID NO: 3958896 - RNA, 16 nt, Staphylococcus aureus subsp. aureus Mu50
caauaauuagucauca

SEQ ID NO: 3958897 - RNA, 23 nt, Staphylococcus aureus subsp. aureus Mu50
caauaauucaucaaguugauaau

SEQ ID NO: 3958898 - RNA, 19 nt, Staphylococcus aureus subsp. aureus Mu50
caauaauugaugaaagacu

SEQ ID NO: 3958899 - RNA, 16 nt, Staphylococcus aureus subsp. aureus Mu50
caaugugagauauaaa

SEQ ID NO: 3958900 - RNA, 17 nt, Staphylococcus aureus subsp. aureus Mu50
caaugugagauauaaag

SEQ ID NO: 3958901 - RNA, 21 nt, Staphylococcus aureus subsp. aureus Mu50
caauguuaggugcuugguuaa

SEQ ID NO: 3958902 - RNA, 14 nt, Staphylococcus aureus subsp. aureus Mu50
caauguucaauuca

SEQ ID NO: 3958903 - RNA, 13 nt, Staphylococcus aureus subsp. aureus Mu50
caauguugcuugu

SEQ ID NO: 3958904 - RNA, 23 nt, Staphylococcus aureus subsp. aureus Mu50
caauguuuaauuuucuaaauaua

SEQ ID NO: 3958905 - RNA, 15 nt, Staphylococcus aureus subsp. aureus Mu50
caauuaaaacuauaa

SEQ ID NO: 3958906 - RNA, 17 nt, Staphylococcus aureus subsp. aureus Mu50
caauuaaaacuauaaua

SEQ ID NO: 3958907 - RNA, 23 nt, Staphylococcus aureus subsp. aureus Mu50
caauuaaaauuuguuaauuuaau

SEQ ID NO: 3958908 - RNA, 13 nt, Staphylococcus aureus subsp. aureus Mu50
caauuaaagucaa

SEQ ID NO: 3958909 - RNA, 13 nt, Staphylococcus aureus subsp. aureus Mu50
caauuaaauguuu

SEQ ID NO: 3958910 - RNA, 19 nt, Staphylococcus aureus subsp. aureus Mu50
caauuaaccuugauuuaau

SEQ ID NO: 3958911 - RNA, 14 nt, Staphylococcus aureus subsp. aureus Mu50
caauuaauaaacac

SEQ ID NO: 3958912 - RNA, 20 nt, Staphylococcus aureus subsp. aureus Mu50
caauuaaucggaucauuauu

SEQ ID NO: 3958913 - RNA, 21 nt, Staphylococcus aureus subsp. aureus Mu50
caauuaaucggaucauuauuu

SEQ ID NO: 3958914 - RNA, 22 nt, Staphylococcus aureus subsp. aureus Mu50
caauuaaucggaucauuauuua

SEQ ID NO: 3958915 - RNA, 17 nt, Staphylococcus aureus subsp. aureus Mu50
caauuaaugauaaaccg

SEQ ID NO: 3958916 - RNA, 18 nt, Staphylococcus aureus subsp. aureus Mu50
caauuaauguaaugauac

SEQ ID NO: 3958917 - RNA, 14 nt, Staphylococcus aureus subsp. aureus Mu50
caauuaauuguaaa

SEQ ID NO: 3958918 - RNA, 20 nt, Staphylococcus aureus subsp. aureus Mu50
caauuaauuuagucauuaca

SEQ ID NO: 3958919 - RNA, 18 nt, Staphylococcus aureus subsp. aureus Mu50
caauuaccaaugaauaaa

SEQ ID NO: 3958920 - RNA, 19 nt, Staphylococcus aureus subsp. aureus Mu50
caauuagaaaauuucucac

SEQ ID NO: 3958921 - RNA, 22 nt, Staphylococcus aureus subsp. aureus Mu50
caauuagccccaguauagaagc

SEQ ID NO: 3958922 - RNA, 17 nt, Staphylococcus aureus subsp. aureus Mu50
caauuauaaaugauuaa

SEQ ID NO: 3958923 - RNA, 18 nt, Staphylococcus aureus subsp. aureus Mu50
caauuaucaacauaauau

SEQ ID NO: 3958924 - RNA, 14 nt, Staphylococcus aureus subsp. aureus Mu50
caauuauggauaaa

SEQ ID NO: 3958925 - RNA, 19 nt, Staphylococcus aureus subsp. aureus Mu50
caauuauugaaaacaaaaa

SEQ ID NO: 3958926 - RNA, 13 nt, Staphylococcus aureus subsp. aureus Mu50
caauuauuucaau

SEQ ID NO: 3958927 - RNA, 16 nt, Staphylococcus aureus subsp. aureus Mu50
caauuauuuuucaaau

SEQ ID NO: 3958928 - RNA, 22 nt, Staphylococcus aureus subsp. aureus Mu50
caauucauuaauaggauuauua

SEQ ID NO: 3958929 - RNA, 15 nt, Staphylococcus aureus subsp. aureus Mu50
caauucgcauuaaau

SEQ ID NO: 3958930 - RNA, 21 nt, Staphylococcus aureus subsp. aureus Mu50
caauucgcucacaugugaaau

SEQ ID NO: 3958931 - RNA, 17 nt, Staphylococcus aureus subsp. aureus Mu50
caauucggauuauauuu

SEQ ID NO: 3958932 - RNA, 21 nt, Staphylococcus aureus subsp. aureus Mu50
caauucugugagguaaaacua

SEQ ID NO: 3958933 - RNA, 20 nt, Staphylococcus aureus subsp. aureus Mu50
caauugaaucuuuguuauau

SEQ ID NO: 3958934 - RNA, 16 nt, Staphylococcus aureus subsp. aureus Mu50
caauugaaugaaguaa

SEQ ID NO: 3958935 - RNA, 22 nt, Staphylococcus aureus subsp. aureus Mu50
caauugaaugaaguaauauaua

SEQ ID NO: 3958936 - RNA, 12 nt, Staphylococcus aureus subsp. aureus Mu50
caauugcaauga

SEQ ID NO: 3958937 - RNA, 14 nt, Staphylococcus aureus subsp. aureus Mu50
caauugcaaugaau

SEQ ID NO: 3958938 - RNA, 15 nt, Staphylococcus aureus subsp. aureus Mu50
caauugcaaugaaua

SEQ ID NO: 3958939 - RNA, 24 nt, Staphylococcus aureus subsp. aureus Mu50
caauugcaaugaauaacaagaaaa

SEQ ID NO: 3958940 - RNA, 13 nt, Staphylococcus aureus subsp. aureus Mu50
caauugcauacgu

SEQ ID NO: 3958941 - RNA, 19 nt, Staphylococcus aureus subsp. aureus Mu50
caauuuaaauaaguuacuc

SEQ ID NO: 3958942 - RNA, 22 nt, Staphylococcus aureus subsp. aureus Mu50
caauuuauuauuaacuguaccu

SEQ ID NO: 3958943 - RNA, 21 nt, Staphylococcus aureus subsp. aureus Mu50
caauuucgauugcguuuucua

SEQ ID NO: 3958944 - RNA, 22 nt, Staphylococcus aureus subsp. aureus Mu50
caauuucuaggccacuaagacc

SEQ ID NO: 3958945 - RNA, 13 nt, Staphylococcus aureus subsp. aureus Mu50
caauuucuguaau

SEQ ID NO: 3958946 - RNA, 18 nt, Staphylococcus aureus subsp. aureus Mu50
caauuucuucauuuucau

SEQ ID NO: 3958947 - RNA, 23 nt, Staphylococcus aureus subsp. aureus Mu50
caauuugcuguccacuauauccu

SEQ ID NO: 3958948 - RNA, 15 nt, Staphylococcus aureus subsp. aureus Mu50
caauuuggaaauauc

SEQ ID NO: 3958949 - RNA, 19 nt, Staphylococcus aureus subsp. aureus Mu50
caauuuggucauauaaaca

SEQ ID NO: 3958950 - RNA, 20 nt, Staphylococcus aureus subsp. aureus Mu50
caauuuguaacuauugaaaa

SEQ ID NO: 3958951 - RNA, 22 nt, Staphylococcus aureus subsp. aureus Mu50
caauuuguccuucgcuaugacc

SEQ ID NO: 3958952 - RNA, 17 nt, Staphylococcus aureus subsp. aureus Mu50
caauuuuaaaucuuuua

SEQ ID NO: 3958953 - RNA, 21 nt, Staphylococcus aureus subsp. aureus Mu50
caauuuuaucugaaucugcua

SEQ ID NO: 3958954 - RNA, 18 nt, Staphylococcus aureus subsp. aureus Mu50
caauuuucgauauuuguu

SEQ ID NO: 3958955 - RNA, 16 nt, Staphylococcus aureus subsp. aureus Mu50
caauuuugacuacuaa

SEQ ID NO: 3958956 - RNA, 14 nt, Staphylococcus aureus subsp. aureus Mu50
caauuuuuaacaaa

SEQ ID NO: 3958957 - RNA, 18 nt, Staphylococcus aureus subsp. aureus Mu50
caauuuuuacuaaaucau

SEQ ID NO: 3958958 - RNA, 12 nt, Staphylococcus aureus subsp. aureus Mu50
cacaaaugaaug

SEQ ID NO: 3958959 - RNA, 14 nt, Staphylococcus aureus subsp. aureus Mu50
cacaacacauaaau

SEQ ID NO: 3958960 - RNA, 16 nt, Staphylococcus aureus subsp. aureus Mu50
cacaaccagucagaaa

SEQ ID NO: 3958961 - RNA, 21 nt, Staphylococcus aureus subsp. aureus Mu50
cacaacgauagauaucauuuu

SEQ ID NO: 3958962 - RNA, 22 nt, Staphylococcus aureus subsp. aureus Mu50
cacaagcaucuacaauauucaa

SEQ ID NO: 3958963 - RNA, 22 nt, Staphylococcus aureus subsp. aureus Mu50
cacaaguuuacagguugaauaa

SEQ ID NO: 3958964 - RNA, 16 nt, Staphylococcus aureus subsp. aureus Mu50
cacaauacgaaaucaa

SEQ ID NO: 3958965 - RNA, 20 nt, Staphylococcus aureus subsp. aureus Mu50
cacaauccuuucaucugcaa

SEQ ID NO: 3958966 - RNA, 20 nt, Staphylococcus aureus subsp. aureus Mu50
cacaaugcccuuaaagcaca

SEQ ID NO: 3958967 - RNA, 15 nt, Staphylococcus aureus subsp. aureus Mu50
cacaauuguauaaug

SEQ ID NO: 3958968 - RNA, 18 nt, Staphylococcus aureus subsp. aureus Mu50
cacacacaguuuauaaua

SEQ ID NO: 3958969 - RNA, 15 nt, Staphylococcus aureus subsp. aureus Mu50
cacacaugauaauuu

SEQ ID NO: 3958970 - RNA, 11 nt, Staphylococcus aureus subsp. aureus Mu50
cacaccccaac

SEQ ID NO: 3958971 - RNA, 18 nt, Staphylococcus aureus subsp. aureus Mu50
cacaccccaacucgcauu

SEQ ID NO: 3958972 - RNA, 18 nt, Staphylococcus aureus subsp. aureus Mu50
cacacuaaauguucugga

SEQ ID NO: 3958973 - RNA, 15 nt, Staphylococcus aureus subsp. aureus Mu50
cacacuuuaaacaag

SEQ ID NO: 3958974 - RNA, 23 nt, Staphylococcus aureus subsp. aureus Mu50
cacagacuuuuuacuaacugaau

SEQ ID NO: 3958975 - RNA, 18 nt, Staphylococcus aureus subsp. aureus Mu50
cacagcgauuaaaugaug

SEQ ID NO: 3958976 - RNA, 19 nt, Staphylococcus aureus subsp. aureus Mu50
cacaguggauuacagauga

SEQ ID NO: 3958977 - RNA, 16 nt, Staphylococcus aureus subsp. aureus Mu50
cacauacaccuucaga

SEQ ID NO: 3958978 - RNA, 14 nt, Staphylococcus aureus subsp. aureus Mu50
cacauacauaucuu

SEQ ID NO: 3958979 - RNA, 13 nt, Staphylococcus aureus subsp. aureus Mu50
cacauacauuuug

SEQ ID NO: 3958980 - RNA, 15 nt, Staphylococcus aureus subsp. aureus Mu50
cacaucgcauaauau

SEQ ID NO: 3958981 - RNA, 13 nt, Staphylococcus aureus subsp. aureus Mu50
cacaugaauuuua

SEQ ID NO: 3958982 - RNA, 17 nt, Staphylococcus aureus subsp. aureus Mu50
cacaugaggaucaacug

SEQ ID NO: 3958983 - RNA, 21 nt, Staphylococcus aureus subsp. aureus Mu50
cacauguacguuuuuuuaaau

SEQ ID NO: 3958984 - RNA, 23 nt, Staphylococcus aureus subsp. aureus Mu50
cacauguacguuuuuuuaaauac

SEQ ID NO: 3958985 - RNA, 14 nt, Staphylococcus aureus subsp. aureus Mu50
cacauuaacaaggc

SEQ ID NO: 3958986 - RNA, 14 nt, Staphylococcus aureus subsp. aureus Mu50
cacuauaauuucuu

SEQ ID NO: 3958987 - RNA, 17 nt, Staphylococcus aureus subsp. aureus Mu50
cacuauacaaucauaaa

SEQ ID NO: 3958988 - RNA, 19 nt, Staphylococcus aureus subsp. aureus Mu50
cacuaucauuaucaaauaa

SEQ ID NO: 3958989 - RNA, 15 nt, Staphylococcus aureus subsp. aureus Mu50
cacuaucuuuugcuu

SEQ ID NO: 3958990 - RNA, 15 nt, Staphylococcus aureus subsp. aureus Mu50
cacucacuucaacgu

SEQ ID NO: 3958991 - RNA, 20 nt, Staphylococcus aureus subsp. aureus Mu50
cacucacuucaacgucaucu

SEQ ID NO: 3958992 - RNA, 18 nt, Staphylococcus aureus subsp. aureus Mu50
cacucauaaccgcuucuu

SEQ ID NO: 3958993 - RNA, 19 nt, Staphylococcus aureus subsp. aureus Mu50
cacucauaaccgcuucuuu

SEQ ID NO: 3958994 - RNA, 19 nt, Staphylococcus aureus subsp. aureus Mu50
cacucauaaucaagucugc

SEQ ID NO: 3958995 - RNA, 20 nt, Staphylococcus aureus subsp. aureus Mu50
cacucauaaucaagucugca

SEQ ID NO: 3958996 - RNA, 16 nt, Staphylococcus aureus subsp. aureus Mu50
cacucauauuacuuug

SEQ ID NO: 3958997 - RNA, 15 nt, Staphylococcus aureus subsp. aureus Mu50
cacucauucaauuua

SEQ ID NO: 3958998 - RNA, 14 nt, Staphylococcus aureus subsp. aureus Mu50
cacuccucuauuuu

SEQ ID NO: 3958999 - RNA, 18 nt, Staphylococcus aureus subsp. aureus Mu50
cacuccuuaaacaaauaa

SEQ ID NO: 3959000 - RNA, 20 nt, Staphylococcus aureus subsp. aureus Mu50
cacuccuuaaacaaauaaau

SEQ ID NO: 3959001 - RNA, 17 nt, Staphylococcus aureus subsp. aureus Mu50
cacucuguaauaaagaa

SEQ ID NO: 3959002 - RNA, 17 nt, Staphylococcus aureus subsp. aureus Mu50
cacugagcaacaaaaga

SEQ ID NO: 3959003 - RNA, 18 nt, Staphylococcus aureus subsp. aureus Mu50
cacugcacaucauaauaa

SEQ ID NO: 3959004 - RNA, 22 nt, Staphylococcus aureus subsp. aureus Mu50
cacuguaacgaguccauuuucu

SEQ ID NO: 3959005 - RNA, 16 nt, Staphylococcus aureus subsp. aureus Mu50
cacuguuaaagucugu

SEQ ID NO: 3959006 - RNA, 22 nt, Staphylococcus aureus subsp. aureus Mu50
cacuguuaaagucuguugguuu

SEQ ID NO: 3959007 - RNA, 18 nt, Staphylococcus aureus subsp. aureus Mu50
cacuguuuuauaaaugaa

SEQ ID NO: 3959008 - RNA, 16 nt, Staphylococcus aureus subsp. aureus Mu50
cacuguuuuauuauga

SEQ ID NO: 3959009 - RNA, 14 nt, Staphylococcus aureus subsp. aureus Mu50
cacuuaacucaaag

SEQ ID NO: 3959010 - RNA, 16 nt, Staphylococcus aureus subsp. aureus Mu50
cacuuaagcuuuaauc

SEQ ID NO: 3959011 - RNA, 17 nt, Staphylococcus aureus subsp. aureus Mu50
cacuuaauaaauaauuu

SEQ ID NO: 3959012 - RNA, 21 nt, Staphylococcus aureus subsp. aureus Mu50
cacuuaaucguucccauucuu

SEQ ID NO: 3959013 - RNA, 22 nt, Staphylococcus aureus subsp. aureus Mu50
cacuuaaucguucccauucuuu

SEQ ID NO: 3959014 - RNA, 23 nt, Staphylococcus aureus subsp. aureus Mu50
cacuuaaucguucccauucuuug

SEQ ID NO: 3959015 - RNA, 13 nt, Staphylococcus aureus subsp. aureus Mu50
cacuuacaaauau

SEQ ID NO: 3959016 - RNA, 16 nt, Staphylococcus aureus subsp. aureus Mu50
cacuuacugugaaaau

SEQ ID NO: 3959017 - RNA, 14 nt, Staphylococcus aureus subsp. aureus Mu50
cacuuauaaacaaa

SEQ ID NO: 3959018 - RNA, 18 nt, Staphylococcus aureus subsp. aureus Mu50
cacuuauaaacaaaagau

SEQ ID NO: 3959019 - RNA, 16 nt, Staphylococcus aureus subsp. aureus Mu50
cacuuaugauacugau

SEQ ID NO: 3959020 - RNA, 18 nt, Staphylococcus aureus subsp. aureus Mu50
cacuuaugauacugauau

SEQ ID NO: 3959021 - RNA, 15 nt, Staphylococcus aureus subsp. aureus Mu50
cacuuauuauuuugu

SEQ ID NO: 3959022 - RNA, 13 nt, Staphylococcus aureus subsp. aureus Mu50
cacuucaaacaaa

SEQ ID NO: 3959023 - RNA, 17 nt, Staphylococcus aureus subsp. aureus Mu50
cacuucaaacaaagggg

SEQ ID NO: 3959024 - RNA, 19 nt, Staphylococcus aureus subsp. aureus Mu50
cacuucaaacaaaggggua

SEQ ID NO: 3959025 - RNA, 20 nt, Staphylococcus aureus subsp. aureus Mu50
cacuucaacauauaaaucau

SEQ ID NO: 3959026 - RNA, 13 nt, Staphylococcus aureus subsp. aureus Mu50
cacuucaaguuau

SEQ ID NO: 3959027 - RNA, 16 nt, Staphylococcus aureus subsp. aureus Mu50
cacuucaguuaaaccu

SEQ ID NO: 3959028 - RNA, 18 nt, Staphylococcus aureus subsp. aureus Mu50
cacuucaucuaaaugaug

SEQ ID NO: 3959029 - RNA, 17 nt, Staphylococcus aureus subsp. aureus Mu50
cacuuccaucaauccaa

SEQ ID NO: 3959030 - RNA, 19 nt, Staphylococcus aureus subsp. aureus Mu50
cacuucgccaagccaucuu

SEQ ID NO: 3959031 - RNA, 20 nt, Staphylococcus aureus subsp. aureus Mu50
cacuucgccaagccaucuuu

SEQ ID NO: 3959032 - RNA, 12 nt, Staphylococcus aureus subsp. aureus Mu50
cacuucguauug

SEQ ID NO: 3959033 - RNA, 23 nt, Staphylococcus aureus subsp. aureus Mu50
cacuucucucuuauuaaaaaaga

SEQ ID NO: 3959034 - RNA, 12 nt, Staphylococcus aureus subsp. aureus Mu50
cacuucuucacc

SEQ ID NO: 3959035 - RNA, 20 nt, Staphylococcus aureus subsp. aureus Mu50
cacuugaauacuuuuuaacu

SEQ ID NO: 3959036 - RNA, 17 nt, Staphylococcus aureus subsp. aureus Mu50
cacuugaccacuuuugu

SEQ ID NO: 3959037 - RNA, 17 nt, Staphylococcus aureus subsp. aureus Mu50
cacuuggauucaaauga

SEQ ID NO: 3959038 - RNA, 18 nt, Staphylococcus aureus subsp. aureus Mu50
cacuuggauucaaaugac

SEQ ID NO: 3959039 - RNA, 18 nt, Staphylococcus aureus subsp. aureus Mu50
cacuuggcuuaggaugaa

SEQ ID NO: 3959040 - RNA, 23 nt, Staphylococcus aureus subsp. aureus Mu50
cacuuggcuuaggaugaaaauau

SEQ ID NO: 3959041 - RNA, 22 nt, Staphylococcus aureus subsp. aureus Mu50
cacuugguacaccuacaaauau

SEQ ID NO: 3959042 - RNA, 16 nt, Staphylococcus aureus subsp. aureus Mu50
cacuuguaauauuaua

SEQ ID NO: 3959043 - RNA, 19 nt, Staphylococcus aureus subsp. aureus Mu50
cacuuuaaacaagcaucau

SEQ ID NO: 3959044 - RNA, 18 nt, Staphylococcus aureus subsp. aureus Mu50
cacuuucaaugacaucua

SEQ ID NO: 3959045 - RNA, 14 nt, Staphylococcus aureus subsp. aureus Mu50
cacuuucaguaauu

SEQ ID NO: 3959046 - RNA, 21 nt, Staphylococcus aureus subsp. aureus Mu50
cacuuucaguaauuguuacua

SEQ ID NO: 3959047 - RNA, 12 nt, Staphylococcus aureus subsp. aureus Mu50
cacuuucuacuc

SEQ ID NO: 3959048 - RNA, 16 nt, Staphylococcus aureus subsp. aureus Mu50
cacuuuuguuaaaaaa

SEQ ID NO: 3959049 - RNA, 17 nt, Staphylococcus aureus subsp. aureus Mu50
cacuuuuguuaaaaaau

SEQ ID NO: 3959050 - RNA, 13 nt, Staphylococcus aureus subsp. aureus Mu50
cacuuuuuaaacg

SEQ ID NO: 3959051 - RNA, 20 nt, Staphylococcus aureus subsp. aureus Mu50
cacuuuuugacauauuuuuu

SEQ ID NO: 3959052 - RNA, 21 nt, Staphylococcus aureus subsp. aureus Mu50
cacuuuuugacauauuuuuua

SEQ ID NO: 3959053 - RNA, 21 nt, Staphylococcus aureus subsp. aureus Mu50
cacuuuuuucauuucuuuguu

SEQ ID NO: 3959054 - RNA, 18 nt, Staphylococcus aureus subsp. aureus Mu50
cacuuuuuuguucaauca

SEQ ID NO: 3959055 - RNA, 19 nt, Staphylococcus aureus subsp. aureus Mu50
cacuuuuuuuaauuugauu

SEQ ID NO: 3959056 - RNA, 17 nt, Staphylococcus aureus subsp. aureus Mu50
cagaaaagggcaaaaaa

SEQ ID NO: 3959057 - RNA, 12 nt, Staphylococcus aureus subsp. aureus Mu50
cagaaaguugca

SEQ ID NO: 3959058 - RNA, 14 nt, Staphylococcus aureus subsp. aureus Mu50
cagaaauaccacga

SEQ ID NO: 3959059 - RNA, 12 nt, Staphylococcus aureus subsp. aureus Mu50
cagaaaugacau

SEQ ID NO: 3959060 - RNA, 14 nt, Staphylococcus aureus subsp. aureus Mu50
cagaaauuuaauau

SEQ ID NO: 3959061 - RNA, 21 nt, Staphylococcus aureus subsp. aureus Mu50
cagaaauuuaauauuguuaau

SEQ ID NO: 3959062 - RNA, 17 nt, Staphylococcus aureus subsp. aureus Mu50
cagaacaauucaaugua

SEQ ID NO: 3959063 - RNA, 13 nt, Staphylococcus aureus subsp. aureus Mu50
cagaacuaaugua

SEQ ID NO: 3959064 - RNA, 14 nt, Staphylococcus aureus subsp. aureus Mu50
cagaacuaugaaua

SEQ ID NO: 3959065 - RNA, 23 nt, Staphylococcus aureus subsp. aureus Mu50
cagacgaaacacacuaaaagcug

SEQ ID NO: 3959066 - RNA, 14 nt, Staphylococcus aureus subsp. aureus Mu50
cagacgaaucaaag

SEQ ID NO: 3959067 - RNA, 16 nt, Staphylococcus aureus subsp. aureus Mu50
cagacguaucaucaaa

SEQ ID NO: 3959068 - RNA, 15 nt, Staphylococcus aureus subsp. aureus Mu50
cagagaaauucgaaa

SEQ ID NO: 3959069 - RNA, 20 nt, Staphylococcus aureus subsp. aureus Mu50
cagagaaauucgaaaagaaa

SEQ ID NO: 3959070 - RNA, 23 nt, Staphylococcus aureus subsp. aureus Mu50
cagagaaauucgaaaagaaauuc

SEQ ID NO: 3959071 - RNA, 19 nt, Staphylococcus aureus subsp. aureus Mu50
cagagaauuucgaaaagaa

SEQ ID NO: 3959072 - RNA, 20 nt, Staphylococcus aureus subsp. aureus Mu50
cagagaauuucgaaaagaaa

SEQ ID NO: 3959073 - RNA, 23 nt, Staphylococcus aureus subsp. aureus Mu50
cagagaauuucgaaaagaaauuc

SEQ ID NO: 3959074 - RNA, 22 nt, Staphylococcus aureus subsp. aureus Mu50
caguacgauuauuuggauaauu

SEQ ID NO: 3959075 - RNA, 22 nt, Staphylococcus aureus subsp. aureus Mu50
caguacgguuauuuaauaaugc

SEQ ID NO: 3959076 - RNA, 14 nt, Staphylococcus aureus subsp. aureus Mu50
caguaggaauuguu

SEQ ID NO: 3959077 - RNA, 16 nt, Staphylococcus aureus subsp. aureus Mu50
caguaggacauauaaa

SEQ ID NO: 3959078 - RNA, 15 nt, Staphylococcus aureus subsp. aureus Mu50
caguaggauaauuuc

SEQ ID NO: 3959079 - RNA, 17 nt, Staphylococcus aureus subsp. aureus Mu50
caguaguuaauugaaug

SEQ ID NO: 3959080 - RNA, 21 nt, Staphylococcus aureus subsp. aureus Mu50
caguaguuaauugaaugaaaa

SEQ ID NO: 3959081 - RNA, 20 nt, Staphylococcus aureus subsp. aureus Mu50
caguaguugacugaacgaaa

SEQ ID NO: 3959082 - RNA, 21 nt, Staphylococcus aureus subsp. aureus Mu50
caguaguugacugaacgaaaa

SEQ ID NO: 3959083 - RNA, 16 nt, Staphylococcus aureus subsp. aureus Mu50
caguaguuuuaaaagu

SEQ ID NO: 3959084 - RNA, 20 nt, Staphylococcus aureus subsp. aureus Mu50
caguauacgaguuauaucuu

SEQ ID NO: 3959085 - RNA, 15 nt, Staphylococcus aureus subsp. aureus Mu50
caguauauaucaaau

SEQ ID NO: 3959086 - RNA, 17 nt, Staphylococcus aureus subsp. aureus Mu50
caguauauaucaaauac

SEQ ID NO: 3959087 - RNA, 18 nt, Staphylococcus aureus subsp. aureus Mu50
caguauauaucaaauaca

SEQ ID NO: 3959088 - RNA, 18 nt, Staphylococcus aureus subsp. aureus Mu50
caguaucauguucuuaua

SEQ ID NO: 3959089 - RNA, 15 nt, Staphylococcus aureus subsp. aureus Mu50
caguaucgauuuaac

SEQ ID NO: 3959090 - RNA, 12 nt, Staphylococcus aureus subsp. aureus Mu50
caguaucuaaau

SEQ ID NO: 3959091 - RNA, 20 nt, Staphylococcus aureus subsp. aureus Mu50
caguaucuaaauauuaaauu

SEQ ID NO: 3959092 - RNA, 17 nt, Staphylococcus aureus subsp. aureus Mu50
caguaucucuuuucuau

SEQ ID NO: 3959093 - RNA, 17 nt, Staphylococcus aureus subsp. aureus Mu50
caguauguggauacaaa

SEQ ID NO: 3959094 - RNA, 18 nt, Staphylococcus aureus subsp. aureus Mu50
caguauguggauacaaac

SEQ ID NO: 3959095 - RNA, 14 nt, Staphylococcus aureus subsp. aureus Mu50
caguauuuacuuuu

SEQ ID NO: 3959096 - RNA, 18 nt, Staphylococcus aureus subsp. aureus Mu50
caguauuugccuuuugaa

SEQ ID NO: 3959097 - RNA, 14 nt, Staphylococcus aureus subsp. aureus Mu50
cagucaacugcugc

SEQ ID NO: 3959098 - RNA, 15 nt, Staphylococcus aureus subsp. aureus Mu50
cagucaacugcugcu

SEQ ID NO: 3959099 - RNA, 22 nt, Staphylococcus aureus subsp. aureus Mu50
cagucaacugcugcuaaaauaa

SEQ ID NO: 3959100 - RNA, 18 nt, Staphylococcus aureus subsp. aureus Mu50
cagucaauuuuuucaucu

SEQ ID NO: 3959101 - RNA, 15 nt, Staphylococcus aureus subsp. aureus Mu50
cagucaguaaaaaua

SEQ ID NO: 3959102 - RNA, 18 nt, Staphylococcus aureus subsp. aureus Mu50
cagucauuugauuuaaaa

SEQ ID NO: 3959103 - RNA, 20 nt, Staphylococcus aureus subsp. aureus Mu50
cagucucuaaaacuuuuuca

SEQ ID NO: 3959104 - RNA, 17 nt, Staphylococcus aureus subsp. aureus Mu50
cagucucuuugaagggg

SEQ ID NO: 3959105 - RNA, 12 nt, Staphylococcus aureus subsp. aureus Mu50
cagugaccucag

SEQ ID NO: 3959106 - RNA, 19 nt, Staphylococcus aureus subsp. aureus Mu50
cagugaccucagguuguua

SEQ ID NO: 3959107 - RNA, 19 nt, Staphylococcus aureus subsp. aureus Mu50
cagugaucuuuuuuauauu

SEQ ID NO: 3959108 - RNA, 11 nt, Staphylococcus aureus subsp. aureus Mu50
cagugcaauga

SEQ ID NO: 3959109 - RNA, 19 nt, Staphylococcus aureus subsp. aureus Mu50
caguggauuacagaugaug

SEQ ID NO: 3959110 - RNA, 13 nt, Staphylococcus aureus subsp. aureus Mu50
caguguaugauga

SEQ ID NO: 3959111 - RNA, 19 nt, Staphylococcus aureus subsp. aureus Mu50
caguguuauaauggcgggc

SEQ ID NO: 3959112 - RNA, 20 nt, Staphylococcus aureus subsp. aureus Mu50
caguguugggggccagccaa

SEQ ID NO: 3959113 - RNA, 15 nt, Staphylococcus aureus subsp. aureus Mu50
caguuaaaucacugc

SEQ ID NO: 3959114 - RNA, 16 nt, Staphylococcus aureus subsp. aureus Mu50
caguuaaaucuuuaac

SEQ ID NO: 3959115 - RNA, 11 nt, Staphylococcus aureus subsp. aureus Mu50
caguuaauaau

SEQ ID NO: 3959116 - RNA, 13 nt, Staphylococcus aureus subsp. aureus Mu50
caguuaauaugaa

SEQ ID NO: 3959117 - RNA, 15 nt, Staphylococcus aureus subsp. aureus Mu50
caguuacuucaguuu

SEQ ID NO: 3959118 - RNA, 21 nt, Staphylococcus aureus subsp. aureus Mu50
caguuacuuucgcuugcaaag

SEQ ID NO: 3959119 - RNA, 17 nt, Staphylococcus aureus subsp. aureus Mu50
caguuaugccugaagcg

SEQ ID NO: 3959120 - RNA, 23 nt, Staphylococcus aureus subsp. aureus Mu50
caguuauuuggguaacauuagca

SEQ ID NO: 3959121 - RNA, 22 nt, Staphylococcus aureus subsp. aureus Mu50
caguucuauagguuuauaaaaa

SEQ ID NO: 3959122 - RNA, 21 nt, Staphylococcus aureus subsp. aureus Mu50
caguugcacaaauugcaaugg

SEQ ID NO: 3959123 - RNA, 15 nt, Staphylococcus aureus subsp. aureus Mu50
caguuguuauuuuug

SEQ ID NO: 3959124 - RNA, 18 nt, Staphylococcus aureus subsp. aureus Mu50
caguuguuauuuuugcua

SEQ ID NO: 3959125 - RNA, 18 nt, Staphylococcus aureus subsp. aureus Mu50
caguuguuuuuuugucag

SEQ ID NO: 3959126 - RNA, 15 nt, Staphylococcus aureus subsp. aureus Mu50
caguuuauugaggau

SEQ ID NO: 3959127 - RNA, 15 nt, Staphylococcus aureus subsp. aureus Mu50
caguuucaagugcuu

SEQ ID NO: 3959128 - RNA, 21 nt, Staphylococcus aureus subsp. aureus Mu50
caguuucaaucgcauuuuguu

SEQ ID NO: 3959129 - RNA, 18 nt, Staphylococcus aureus subsp. aureus Mu50
caguuuuacuauaaugau

SEQ ID NO: 3959130 - RNA, 12 nt, Staphylococcus aureus subsp. aureus Mu50
cauaaaaaaacg

SEQ ID NO: 3959131 - RNA, 14 nt, Staphylococcus aureus subsp. aureus Mu50
cauaaaaaaagaac

SEQ ID NO: 3959132 - RNA, 20 nt, Staphylococcus aureus subsp. aureus Mu50
cauaaaaaucauaaauaaca

SEQ ID NO: 3959133 - RNA, 17 nt, Staphylococcus aureus subsp. aureus Mu50
cauaaaaaugcucaagu

SEQ ID NO: 3959134 - RNA, 19 nt, Staphylococcus aureus subsp. aureus Mu50
cauaaaacuuacauuacau

SEQ ID NO: 3959135 - RNA, 20 nt, Staphylococcus aureus subsp. aureus Mu50
cauaaaagacagaaauuacu

SEQ ID NO: 3959136 - RNA, 11 nt, Staphylococcus aureus subsp. aureus Mu50
cauaaaaugag

SEQ ID NO: 3959137 - RNA, 19 nt, Staphylococcus aureus subsp. aureus Mu50
cauaaaauuaacuuaaaau

SEQ ID NO: 3959138 - RNA, 22 nt, Staphylococcus aureus subsp. aureus Mu50
cauaaaauuaacuuaaaauuua

SEQ ID NO: 3959139 - RNA, 16 nt, Staphylococcus aureus subsp. aureus Mu50
cauaaaauuucugcuu

SEQ ID NO: 3959140 - RNA, 20 nt, Staphylococcus aureus subsp. aureus Mu50
cauaaacaauaacuguucuu

SEQ ID NO: 3959141 - RNA, 16 nt, Staphylococcus aureus subsp. aureus Mu50
cauaaagcuguuuauu

SEQ ID NO: 3959142 - RNA, 17 nt, Staphylococcus aureus subsp. aureus Mu50
cauaaagugcguuuuuc

SEQ ID NO: 3959143 - RNA, 14 nt, Staphylococcus aureus subsp. aureus Mu50
cauaaaguuuauuu

SEQ ID NO: 3959144 - RNA, 16 nt, Staphylococcus aureus subsp. aureus Mu50
cauaaaguuuauuuau

SEQ ID NO: 3959145 - RNA, 18 nt, Staphylococcus aureus subsp. aureus Mu50
cauaaaguuuauuuaugu

SEQ ID NO: 3959146 - RNA, 23 nt, Staphylococcus aureus subsp. aureus Mu50
cauaaauaacacgauuugguuga

SEQ ID NO: 3959147 - RNA, 23 nt, Staphylococcus aureus subsp. aureus Mu50
cauaaauaagcguaaaaucaugu

SEQ ID NO: 3959148 - RNA, 15 nt, Staphylococcus aureus subsp. aureus Mu50
cauaaauacaaaaau

SEQ ID NO: 3959149 - RNA, 16 nt, Staphylococcus aureus subsp. aureus Mu50
cauaaauauaaaauau

SEQ ID NO: 3959150 - RNA, 19 nt, Staphylococcus aureus subsp. aureus Mu50
cauaaauauuggaauacuc

SEQ ID NO: 3959151 - RNA, 14 nt, Staphylococcus aureus subsp. aureus Mu50
cauaaauauuuucu

SEQ ID NO: 3959152 - RNA, 12 nt, Staphylococcus aureus subsp. aureus Mu50
cauaaaucaaug

SEQ ID NO: 3959153 - RNA, 14 nt, Staphylococcus aureus subsp. aureus Mu50
cauaaaucaaugua

SEQ ID NO: 3959154 - RNA, 14 nt, Staphylococcus aureus subsp. aureus Mu50
cauaaaugacugaa

SEQ ID NO: 3959155 - RNA, 17 nt, Staphylococcus aureus subsp. aureus Mu50
cauaaaugcuaaaagua

SEQ ID NO: 3959156 - RNA, 20 nt, Staphylococcus aureus subsp. aureus Mu50
cauaaaugcuaaaaguauaa

SEQ ID NO: 3959157 - RNA, 21 nt, Staphylococcus aureus subsp. aureus Mu50
cauaaaugcuaaaaguauaaa

SEQ ID NO: 3959158 - RNA, 18 nt, Staphylococcus aureus subsp. aureus Mu50
cauaaauuaauauaguag

SEQ ID NO: 3959159 - RNA, 18 nt, Staphylococcus aureus subsp. aureus Mu50
cauaacaaaaacaucuac

SEQ ID NO: 3959160 - RNA, 13 nt, Staphylococcus aureus subsp. aureus Mu50
cauaacaccuacu

SEQ ID NO: 3959161 - RNA, 21 nt, Staphylococcus aureus subsp. aureus Mu50
cauaaccuugcuuugcauaca

SEQ ID NO: 3959162 - RNA, 20 nt, Staphylococcus aureus subsp. aureus Mu50
cauaguauacauaauucaau

SEQ ID NO: 3959163 - RNA, 20 nt, Staphylococcus aureus subsp. aureus Mu50
cauagucacuuuuaacgaca

SEQ ID NO: 3959164 - RNA, 16 nt, Staphylococcus aureus subsp. aureus Mu50
cauagugguguuuaua

SEQ ID NO: 3959165 - RNA, 17 nt, Staphylococcus aureus subsp. aureus Mu50
cauauaaaaaauuauua

SEQ ID NO: 3959166 - RNA, 12 nt, Staphylococcus aureus subsp. aureus Mu50
cauauaaaaacc

SEQ ID NO: 3959167 - RNA, 19 nt, Staphylococcus aureus subsp. aureus Mu50
cauauaaagcugcgauaua

SEQ ID NO: 3959168 - RNA, 17 nt, Staphylococcus aureus subsp. aureus Mu50
cauauaaagucguauca

SEQ ID NO: 3959169 - RNA, 20 nt, Staphylococcus aureus subsp. aureus Mu50
cauauaaagucguaucauau

SEQ ID NO: 3959170 - RNA, 14 nt, Staphylococcus aureus subsp. aureus Mu50
cauauaaauauuuu

SEQ ID NO: 3959171 - RNA, 21 nt, Staphylococcus aureus subsp. aureus Mu50
cauauaaauauuuuuaauuau

SEQ ID NO: 3959172 - RNA, 21 nt, Staphylococcus aureus subsp. aureus Mu50
cauauaagccccaccaugauu

SEQ ID NO: 3959173 - RNA, 18 nt, Staphylococcus aureus subsp. aureus Mu50
cauauaaugccaaauaua

SEQ ID NO: 3959174 - RNA, 23 nt, Staphylococcus aureus subsp. aureus Mu50
cauauaaugcugauaauuuuucu

SEQ ID NO: 3959175 - RNA, 20 nt, Staphylococcus aureus subsp. aureus Mu50
cauauaauuugggucguuag

SEQ ID NO: 3959176 - RNA, 16 nt, Staphylococcus aureus subsp. aureus Mu50
cauauacgacauuuuu

SEQ ID NO: 3959177 - RNA, 17 nt, Staphylococcus aureus subsp. aureus Mu50
cauauacgacauuuuua

SEQ ID NO: 3959178 - RNA, 14 nt, Staphylococcus aureus subsp. aureus Mu50
cauauacuauaugu

SEQ ID NO: 3959179 - RNA, 17 nt, Staphylococcus aureus subsp. aureus Mu50
cauauacucuaaaaaag

SEQ ID NO: 3959180 - RNA, 15 nt, Staphylococcus aureus subsp. aureus Mu50
cauauauauauagau

SEQ ID NO: 3959181 - RNA, 14 nt, Staphylococcus aureus subsp. aureus Mu50
cauauaucaacaug

SEQ ID NO: 3959182 - RNA, 21 nt, Staphylococcus aureus subsp. aureus Mu50
cauauaucaacauguuccgcu

SEQ ID NO: 3959183 - RNA, 18 nt, Staphylococcus aureus subsp. aureus Mu50
cauauaugauaaauauug

SEQ ID NO: 3959184 - RNA, 13 nt, Staphylococcus aureus subsp. aureus Mu50
cauauauuuuguu

SEQ ID NO: 3959185 - RNA, 17 nt, Staphylococcus aureus subsp. aureus Mu50
cauauauuuuguuaaua

SEQ ID NO: 3959186 - RNA, 20 nt, Staphylococcus aureus subsp. aureus Mu50
cauauauuuuguuaauaagc

SEQ ID NO: 3959187 - RNA, 17 nt, Staphylococcus aureus subsp. aureus Mu50
cauaucagcuuuuucau

SEQ ID NO: 3959188 - RNA, 14 nt, Staphylococcus aureus subsp. aureus Mu50
cauaucaugaaugu

SEQ ID NO: 3959189 - RNA, 21 nt, Staphylococcus aureus subsp. aureus Mu50
cauaucaugaaugucagucgu

SEQ ID NO: 3959190 - RNA, 15 nt, Staphylococcus aureus subsp. aureus Mu50
cauaucgauaaaugu

SEQ ID NO: 3959191 - RNA, 14 nt, Staphylococcus aureus subsp. aureus Mu50
cauaucgauuaaua

SEQ ID NO: 3959192 - RNA, 21 nt, Staphylococcus aureus subsp. aureus Mu50
cauaucggcccauaauagcua

SEQ ID NO: 3959193 - RNA, 13 nt, Staphylococcus aureus subsp. aureus Mu50
cauaucuauuuuu

SEQ ID NO: 3959194 - RNA, 15 nt, Staphylococcus aureus subsp. aureus Mu50
cauaucuuuaucauu

SEQ ID NO: 3959195 - RNA, 16 nt, Staphylococcus aureus subsp. aureus Mu50
cauaucuuuaucauua

SEQ ID NO: 3959196 - RNA, 15 nt, Staphylococcus aureus subsp. aureus Mu50
cauaucuuuugcugu

SEQ ID NO: 3959197 - RNA, 18 nt, Staphylococcus aureus subsp. aureus Mu50
cauaugauaguguauguu

SEQ ID NO: 3959198 - RNA, 17 nt, Staphylococcus aureus subsp. aureus Mu50
cauaugcuauauuuagu

SEQ ID NO: 3959199 - RNA, 15 nt, Staphylococcus aureus subsp. aureus Mu50
cauauguaauacaaa

SEQ ID NO: 3959200 - RNA, 16 nt, Staphylococcus aureus subsp. aureus Mu50
cauauguaauacaaaa

SEQ ID NO: 3959201 - RNA, 18 nt, Staphylococcus aureus subsp. aureus Mu50
cauauguaauacaaaaga

SEQ ID NO: 3959202 - RNA, 15 nt, Staphylococcus aureus subsp. aureus Mu50
cauauguacuauuau

SEQ ID NO: 3959203 - RNA, 18 nt, Staphylococcus aureus subsp. aureus Mu50
cauaugucuguuccucaa

SEQ ID NO: 3959204 - RNA, 21 nt, Staphylococcus aureus subsp. aureus Mu50
cauaugugguggcuauauaau

SEQ ID NO: 3959205 - RNA, 19 nt, Staphylococcus aureus subsp. aureus Mu50
cauauguguaugauagaau

SEQ ID NO: 3959206 - RNA, 17 nt, Staphylococcus aureus subsp. aureus Mu50
cauauguguuucuagcu

SEQ ID NO: 3959207 - RNA, 17 nt, Staphylococcus aureus subsp. aureus Mu50
cauauguuguuucuaau

SEQ ID NO: 3959208 - RNA, 22 nt, Staphylococcus aureus subsp. aureus Mu50
cauauguuguuucuaaugcuca

SEQ ID NO: 3959209 - RNA, 22 nt, Staphylococcus aureus subsp. aureus Mu50
cauauuacuucucaucgaauuc

SEQ ID NO: 3959210 - RNA, 15 nt, Staphylococcus aureus subsp. aureus Mu50
cauauucaaaauaac

SEQ ID NO: 3959211 - RNA, 11 nt, Staphylococcus aureus subsp. aureus Mu50
cauauucacau

SEQ ID NO: 3959212 - RNA, 15 nt, Staphylococcus aureus subsp. aureus Mu50
cauauucacgauaua

SEQ ID NO: 3959213 - RNA, 15 nt, Staphylococcus aureus subsp. aureus Mu50
cauauucaguauaug

SEQ ID NO: 3959214 - RNA, 17 nt, Staphylococcus aureus subsp. aureus Mu50
cauauugugccgcuucu

SEQ ID NO: 3959215 - RNA, 20 nt, Staphylococcus aureus subsp. aureus Mu50
cauauugugccgcuucuaca

SEQ ID NO: 3959216 - RNA, 11 nt, Staphylococcus aureus subsp. aureus Mu50
cauauuuauau

SEQ ID NO: 3959217 - RNA, 17 nt, Staphylococcus aureus subsp. aureus Mu50
cauauuuauauuuacac

SEQ ID NO: 3959218 - RNA, 13 nt, Staphylococcus aureus subsp. aureus Mu50
cauauuucuaaau

SEQ ID NO: 3959219 - RNA, 15 nt, Staphylococcus aureus subsp. aureus Mu50
cauauuuuaacuaug

SEQ ID NO: 3959220 - RNA, 11 nt, Staphylococcus aureus subsp. aureus Mu50
cauauuuugau

SEQ ID NO: 3959221 - RNA, 13 nt, Staphylococcus aureus subsp. aureus Mu50
cauauuuuuuaaa

SEQ ID NO: 3959222 - RNA, 21 nt, Staphylococcus aureus subsp. aureus Mu50
cauauuuuuuaguaauaacau

SEQ ID NO: 3959223 - RNA, 14 nt, Staphylococcus aureus subsp. aureus Mu50
caucaaaaauaaaa

SEQ ID NO: 3959224 - RNA, 19 nt, Staphylococcus aureus subsp. aureus Mu50
caucaaaacguuugaagaa

SEQ ID NO: 3959225 - RNA, 17 nt, Staphylococcus aureus subsp. aureus Mu50
caucaaacaacaucacu

SEQ ID NO: 3959226 - RNA, 20 nt, Staphylococcus aureus subsp. aureus Mu50
caucaaacaacaucacuuua

SEQ ID NO: 3959227 - RNA, 19 nt, Staphylococcus aureus subsp. aureus Mu50
caucaacgccauauuuauu

SEQ ID NO: 3959228 - RNA, 20 nt, Staphylococcus aureus subsp. aureus Mu50
caucaaguauaaauguuauu

SEQ ID NO: 3959229 - RNA, 19 nt, Staphylococcus aureus subsp. aureus Mu50
caucaaguugauaaugucu

SEQ ID NO: 3959230 - RNA, 17 nt, Staphylococcus aureus subsp. aureus Mu50
caucaauaaauauugau

SEQ ID NO: 3959231 - RNA, 18 nt, Staphylococcus aureus subsp. aureus Mu50
caucaauaaauauugauu

SEQ ID NO: 3959232 - RNA, 23 nt, Staphylococcus aureus subsp. aureus Mu50
caucaaucccuuuuagcauaauu

SEQ ID NO: 3959233 - RNA, 22 nt, Staphylococcus aureus subsp. aureus Mu50
caucaaucgcuuuagcaauuga

SEQ ID NO: 3959234 - RNA, 22 nt, Staphylococcus aureus subsp. aureus Mu50
caucaaugagcaagucuucuaa

SEQ ID NO: 3959235 - RNA, 21 nt, Staphylococcus aureus subsp. aureus Mu50
caucaccugaugaauagauaa

SEQ ID NO: 3959236 - RNA, 23 nt, Staphylococcus aureus subsp. aureus Mu50
caucacgugauaaugacucaagu

SEQ ID NO: 3959237 - RNA, 17 nt, Staphylococcus aureus subsp. aureus Mu50
caucacuaaaguaaaua

SEQ ID NO: 3959238 - RNA, 14 nt, Staphylococcus aureus subsp. aureus Mu50
caucacugcauaua

SEQ ID NO: 3959239 - RNA, 19 nt, Staphylococcus aureus subsp. aureus Mu50
caucacuguagauucaaau

SEQ ID NO: 3959240 - RNA, 11 nt, Staphylococcus aureus subsp. aureus Mu50
caucacuugcu

SEQ ID NO: 3959241 - RNA, 20 nt, Staphylococcus aureus subsp. aureus Mu50
caucacuugcuguugcaaua

SEQ ID NO: 3959242 - RNA, 13 nt, Staphylococcus aureus subsp. aureus Mu50
caucacuuuuuaa

SEQ ID NO: 3959243 - RNA, 18 nt, Staphylococcus aureus subsp. aureus Mu50
caucagauuauugguuga

SEQ ID NO: 3959244 - RNA, 22 nt, Staphylococcus aureus subsp. aureus Mu50
caucagauuauugguugaaauu

SEQ ID NO: 3959245 - RNA, 14 nt, Staphylococcus aureus subsp. aureus Mu50
caucaggucgcccu

SEQ ID NO: 3959246 - RNA, 14 nt, Staphylococcus aureus subsp. aureus Mu50
caucaguuaauaau

SEQ ID NO: 3959247 - RNA, 17 nt, Staphylococcus aureus subsp. aureus Mu50
caucaguuguguaauaa

SEQ ID NO: 3959248 - RNA, 20 nt, Staphylococcus aureus subsp. aureus Mu50
caucauaaucaagaauauaa

SEQ ID NO: 3959249 - RNA, 12 nt, Staphylococcus aureus subsp. aureus Mu50
caucauauacau

SEQ ID NO: 3959250 - RNA, 23 nt, Staphylococcus aureus subsp. aureus Mu50
caucauaucauaccaaaaaguau

SEQ ID NO: 3959251 - RNA, 14 nt, Staphylococcus aureus subsp. aureus Mu50
caucaucaaguuca

SEQ ID NO: 3959252 - RNA, 16 nt, Staphylococcus aureus subsp. aureus Mu50
caucaucaaguucacc

SEQ ID NO: 3959253 - RNA, 17 nt, Staphylococcus aureus subsp. aureus Mu50
caucaucaccauacuaa

SEQ ID NO: 3959254 - RNA, 19 nt, Staphylococcus aureus subsp. aureus Mu50
caucaucacuguagauuca

SEQ ID NO: 3959255 - RNA, 22 nt, Staphylococcus aureus subsp. aureus Mu50
caucaucacuguagauucaaau

SEQ ID NO: 3959256 - RNA, 13 nt, Staphylococcus aureus subsp. aureus Mu50
caucaucuuuaau

SEQ ID NO: 3959257 - RNA, 22 nt, Staphylococcus aureus subsp. aureus Mu50
caucaugaacuuuuauugccau

SEQ ID NO: 3959258 - RNA, 24 nt, Staphylococcus aureus subsp. aureus Mu50
caucaugaacuuuuauugccauaa

SEQ ID NO: 3959259 - RNA, 15 nt, Staphylococcus aureus subsp. aureus Mu50
caucaugacuauuuc

SEQ ID NO: 3959260 - RNA, 20 nt, Staphylococcus aureus subsp. aureus Mu50
caucaugacuauuucgcuuu

SEQ ID NO: 3959261 - RNA, 13 nt, Staphylococcus aureus subsp. aureus Mu50
caucaugcauaau

SEQ ID NO: 3959262 - RNA, 18 nt, Staphylococcus aureus subsp. aureus Mu50
caucauguacaguuacuu

SEQ ID NO: 3959263 - RNA, 13 nt, Staphylococcus aureus subsp. aureus Mu50
caucaugugcuuu

SEQ ID NO: 3959264 - RNA, 14 nt, Staphylococcus aureus subsp. aureus Mu50
caucaugugcuuug

SEQ ID NO: 3959265 - RNA, 18 nt, Staphylococcus aureus subsp. aureus Mu50
caucaugugcuuuguuua

SEQ ID NO: 3959266 - RNA, 14 nt, Staphylococcus aureus subsp. aureus Mu50
caucauguuuaucu

SEQ ID NO: 3959267 - RNA, 13 nt, Staphylococcus aureus subsp. aureus Mu50
caucauuaaaauc

SEQ ID NO: 3959268 - RNA, 16 nt, Staphylococcus aureus subsp. aureus Mu50
caucauucaaacuccu

SEQ ID NO: 3959269 - RNA, 21 nt, Staphylococcus aureus subsp. aureus Mu50
caucauucauauggaauacua

SEQ ID NO: 3959270 - RNA, 13 nt, Staphylococcus aureus subsp. aureus Mu50
caucauucucaaa

SEQ ID NO: 3959271 - RNA, 13 nt, Staphylococcus aureus subsp. aureus Mu50
caucauuguaaaa

SEQ ID NO: 3959272 - RNA, 16 nt, Staphylococcus aureus subsp. aureus Mu50
caucauuguaaaacaa

SEQ ID NO: 3959273 - RNA, 21 nt, Staphylococcus aureus subsp. aureus Mu50
caucauuuaauugaugucaca

SEQ ID NO: 3959274 - RNA, 22 nt, Staphylococcus aureus subsp. aureus Mu50
caucauuuauaugauguucaau

SEQ ID NO: 3959275 - RNA, 18 nt, Staphylococcus aureus subsp. aureus Mu50
caucauuucugaaguuau

SEQ ID NO: 3959276 - RNA, 21 nt, Staphylococcus aureus subsp. aureus Mu50
caucauuuguguaaaugaauu

SEQ ID NO: 3959277 - RNA, 17 nt, Staphylococcus aureus subsp. aureus Mu50
caucauuuguguuuuua

SEQ ID NO: 3959278 - RNA, 17 nt, Staphylococcus aureus subsp. aureus Mu50
caucauuuucaauacuu

SEQ ID NO: 3959279 - RNA, 14 nt, Staphylococcus aureus subsp. aureus Mu50
cauccaauuauguu

SEQ ID NO: 3959280 - RNA, 12 nt, Staphylococcus aureus subsp. aureus Mu50
cauccauaaaaa

SEQ ID NO: 3959281 - RNA, 19 nt, Staphylococcus aureus subsp. aureus Mu50
cauccauaaaaauacgaca

SEQ ID NO: 3959282 - RNA, 21 nt, Staphylococcus aureus subsp. aureus Mu50
cauccauauaugccgauugcu

SEQ ID NO: 3959283 - RNA, 14 nt, Staphylococcus aureus subsp. aureus Mu50
cauccccagccauu

SEQ ID NO: 3959284 - RNA, 14 nt, Staphylococcus aureus subsp. aureus Mu50
cauccucauaauua

SEQ ID NO: 3959285 - RNA, 15 nt, Staphylococcus aureus subsp. aureus Mu50
cauccucauuaauaa

SEQ ID NO: 3959286 - RNA, 18 nt, Staphylococcus aureus subsp. aureus Mu50
cauccucauuaauaaauu

SEQ ID NO: 3959287 - RNA, 16 nt, Staphylococcus aureus subsp. aureus Mu50
caucgaacaugaauga

SEQ ID NO: 3959288 - RNA, 16 nt, Staphylococcus aureus subsp. aureus Mu50
caucgauaucuaaguc

SEQ ID NO: 3959289 - RNA, 20 nt, Staphylococcus aureus subsp. aureus Mu50
caucgauuuaucauuauuug

SEQ ID NO: 3959290 - RNA, 17 nt, Staphylococcus aureus subsp. aureus Mu50
caucgcaacugauaauu

SEQ ID NO: 3959291 - RNA, 23 nt, Staphylococcus aureus subsp. aureus Mu50
caucguaaaaaacaaaaaaaccg

SEQ ID NO: 3959292 - RNA, 17 nt, Staphylococcus aureus subsp. aureus Mu50
caucguaaagaucauuu

SEQ ID NO: 3959293 - RNA, 14 nt, Staphylococcus aureus subsp. aureus Mu50
caucguauagaugu

SEQ ID NO: 3959294 - RNA, 19 nt, Staphylococcus aureus subsp. aureus Mu50
caucguauagaugugucuu

SEQ ID NO: 3959295 - RNA, 14 nt, Staphylococcus aureus subsp. aureus Mu50
caucguauucuuuu

SEQ ID NO: 3959296 - RNA, 19 nt, Staphylococcus aureus subsp. aureus Mu50
caucguauucuuuuaauag

SEQ ID NO: 3959297 - RNA, 21 nt, Staphylococcus aureus subsp. aureus Mu50
caucgucaucacuuuuuaaac

SEQ ID NO: 3959298 - RNA, 22 nt, Staphylococcus aureus subsp. aureus Mu50
caucgucaucacuuuuuaaacg

SEQ ID NO: 3959299 - RNA, 13 nt, Staphylococcus aureus subsp. aureus Mu50
caucuaaaaugag

SEQ ID NO: 3959300 - RNA, 16 nt, Staphylococcus aureus subsp. aureus Mu50
caucuaaauaguuuuu

SEQ ID NO: 3959301 - RNA, 14 nt, Staphylococcus aureus subsp. aureus Mu50
caucuauauuuaau

SEQ ID NO: 3959302 - RNA, 20 nt, Staphylococcus aureus subsp. aureus Mu50
caucuauauuuaauuuugau

SEQ ID NO: 3959303 - RNA, 19 nt, Staphylococcus aureus subsp. aureus Mu50
caucuauccgauuuaaguu

SEQ ID NO: 3959304 - RNA, 22 nt, Staphylococcus aureus subsp. aureus Mu50
caucuauccgauuuaaguugau

SEQ ID NO: 3959305 - RNA, 18 nt, Staphylococcus aureus subsp. aureus Mu50
caucuauuuaauaaugua

SEQ ID NO: 3959306 - RNA, 14 nt, Staphylococcus aureus subsp. aureus Mu50
caucuauuucuugu

SEQ ID NO: 3959307 - RNA, 17 nt, Staphylococcus aureus subsp. aureus Mu50
caucucagcaauacuaa

SEQ ID NO: 3959308 - RNA, 18 nt, Staphylococcus aureus subsp. aureus Mu50
caucuccaccauuaauag

SEQ ID NO: 3959309 - RNA, 13 nt, Staphylococcus aureus subsp. aureus Mu50
caucucuauuuuu

SEQ ID NO: 3959310 - RNA, 17 nt, Staphylococcus aureus subsp. aureus Mu50
caucucugcuuuaauau

SEQ ID NO: 3959311 - RNA, 21 nt, Staphylococcus aureus subsp. aureus Mu50
caucucugcuuuaauauaauu

SEQ ID NO: 3959312 - RNA, 16 nt, Staphylococcus aureus subsp. aureus Mu50
caucugaaaaaauuaa

SEQ ID NO: 3959313 - RNA, 19 nt, Staphylococcus aureus subsp. aureus Mu50
caucugaaaaaauuaauaa

SEQ ID NO: 3959314 - RNA, 13 nt, Staphylococcus aureus subsp. aureus Mu50
caucugacugauu

SEQ ID NO: 3959315 - RNA, 21 nt, Staphylococcus aureus subsp. aureus Mu50
caucugaugaggcaauauuaa

SEQ ID NO: 3959316 - RNA, 23 nt, Staphylococcus aureus subsp. aureus Mu50
caucugaugaggcaauauuaaaa

SEQ ID NO: 3959317 - RNA, 15 nt, Staphylococcus aureus subsp. aureus Mu50
caucugcaagggauc

SEQ ID NO: 3959318 - RNA, 15 nt, Staphylococcus aureus subsp. aureus Mu50
caucugcaagugcuu

SEQ ID NO: 3959319 - RNA, 14 nt, Staphylococcus aureus subsp. aureus Mu50
caucugcauuuaau

SEQ ID NO: 3959320 - RNA, 18 nt, Staphylococcus aureus subsp. aureus Mu50
caucuguaacuaauauga

SEQ ID NO: 3959321 - RNA, 21 nt, Staphylococcus aureus subsp. aureus Mu50
caucuguuuuagguuuguugc

SEQ ID NO: 3959322 - RNA, 15 nt, Staphylococcus aureus subsp. aureus Mu50
caucuuaucaagaau

SEQ ID NO: 3959323 - RNA, 21 nt, Staphylococcus aureus subsp. aureus Mu50
caucuuaugacugcuuuuuau

SEQ ID NO: 3959324 - RNA, 22 nt, Staphylococcus aureus subsp. aureus Mu50
caucuucaagacgcauuguugu

SEQ ID NO: 3959325 - RNA, 23 nt, Staphylococcus aureus subsp. aureus Mu50
caucuucaagacgcauuguugua

SEQ ID NO: 3959326 - RNA, 19 nt, Staphylococcus aureus subsp. aureus Mu50
caucuucaauauuuaaauu

SEQ ID NO: 3959327 - RNA, 15 nt, Staphylococcus aureus subsp. aureus Mu50
caucuucuucaaaac

SEQ ID NO: 3959328 - RNA, 18 nt, Staphylococcus aureus subsp. aureus Mu50
caucuugagauuuucaac

SEQ ID NO: 3959329 - RNA, 19 nt, Staphylococcus aureus subsp. aureus Mu50
caucuugcgccuuguucaa

SEQ ID NO: 3959330 - RNA, 21 nt, Staphylococcus aureus subsp. aureus Mu50
caucuugucuaguucgauuuu

SEQ ID NO: 3959331 - RNA, 12 nt, Staphylococcus aureus subsp. aureus Mu50
caucuuuaaaga

SEQ ID NO: 3959332 - RNA, 14 nt, Staphylococcus aureus subsp. aureus Mu50
caucuuuaaagaaa

SEQ ID NO: 3959333 - RNA, 14 nt, Staphylococcus aureus subsp. aureus Mu50
caucuuuauuuaca

SEQ ID NO: 3959334 - RNA, 17 nt, Staphylococcus aureus subsp. aureus Mu50
caucuuuauuuacaaug

SEQ ID NO: 3959335 - RNA, 12 nt, Staphylococcus aureus subsp. aureus Mu50
caucuuucaaau

SEQ ID NO: 3959336 - RNA, 17 nt, Staphylococcus aureus subsp. aureus Mu50
caucuuucaaaugcuua

SEQ ID NO: 3959337 - RNA, 19 nt, Staphylococcus aureus subsp. aureus Mu50
caucuuucacaauuguaua

SEQ ID NO: 3959338 - RNA, 20 nt, Staphylococcus aureus subsp. aureus Mu50
cauuaaucuauauaaaaacu

SEQ ID NO: 3959339 - RNA, 17 nt, Staphylococcus aureus subsp. aureus Mu50
cauuaauguucaauuua

SEQ ID NO: 3959340 - RNA, 20 nt, Staphylococcus aureus subsp. aureus Mu50
cauuaauuggauuuuuacaa

SEQ ID NO: 3959341 - RNA, 14 nt, Staphylococcus aureus subsp. aureus Mu50
cauuaauuucaugu

SEQ ID NO: 3959342 - RNA, 19 nt, Staphylococcus aureus subsp. aureus Mu50
cauuaauuugucauuucuu

SEQ ID NO: 3959343 - RNA, 17 nt, Staphylococcus aureus subsp. aureus Mu50
cauuacaaaucaugaca

SEQ ID NO: 3959344 - RNA, 22 nt, Staphylococcus aureus subsp. aureus Mu50
cauuacaaaucaugacauaaaa

SEQ ID NO: 3959345 - RNA, 14 nt, Staphylococcus aureus subsp. aureus Mu50
cauuacagauaauu

SEQ ID NO: 3959346 - RNA, 16 nt, Staphylococcus aureus subsp. aureus Mu50
cauuacagauaauuau

SEQ ID NO: 3959347 - RNA, 19 nt, Staphylococcus aureus subsp. aureus Mu50
cauuacauauaucaacaug

SEQ ID NO: 3959348 - RNA, 22 nt, Staphylococcus aureus subsp. aureus Mu50
cauuacauuuggcguaaugaua

SEQ ID NO: 3959349 - RNA, 14 nt, Staphylococcus aureus subsp. aureus Mu50
cauuaccagcaauu

SEQ ID NO: 3959350 - RNA, 14 nt, Staphylococcus aureus subsp. aureus Mu50
cauuacccuuuaaa

SEQ ID NO: 3959351 - RNA, 17 nt, Staphylococcus aureus subsp. aureus Mu50
cauuacccuuuaaacuc

SEQ ID NO: 3959352 - RNA, 19 nt, Staphylococcus aureus subsp. aureus Mu50
cauuacgcucaucaccuuu

SEQ ID NO: 3959353 - RNA, 14 nt, Staphylococcus aureus subsp. aureus Mu50
cauuacuacuuuau

SEQ ID NO: 3959354 - RNA, 20 nt, Staphylococcus aureus subsp. aureus Mu50
cauuacuacuuuauaaauau

SEQ ID NO: 3959355 - RNA, 21 nt, Staphylococcus aureus subsp. aureus Mu50
cauuacuacuuuauaaauauc

SEQ ID NO: 3959356 - RNA, 19 nt, Staphylococcus aureus subsp. aureus Mu50
cauuacuaucuucaucaua

SEQ ID NO: 3959357 - RNA, 15 nt, Staphylococcus aureus subsp. aureus Mu50
cauuagcaaauauua

SEQ ID NO: 3959358 - RNA, 18 nt, Staphylococcus aureus subsp. aureus Mu50
cauuagcaaauauuauua

SEQ ID NO: 3959359 - RNA, 20 nt, Staphylococcus aureus subsp. aureus Mu50
cauuagcaaauauuauuaaa

SEQ ID NO: 3959360 - RNA, 15 nt, Staphylococcus aureus subsp. aureus Mu50
cauuagcaauuucau

SEQ ID NO: 3959361 - RNA, 17 nt, Staphylococcus aureus subsp. aureus Mu50
cauuagcaugauaaagu

SEQ ID NO: 3959362 - RNA, 15 nt, Staphylococcus aureus subsp. aureus Mu50
cauuagcauuaaauu

SEQ ID NO: 3959363 - RNA, 17 nt, Staphylococcus aureus subsp. aureus Mu50
cauuagcauuauuauuu

SEQ ID NO: 3959364 - RNA, 17 nt, Staphylococcus aureus subsp. aureus Mu50
cauuaggauguucagcu

SEQ ID NO: 3959365 - RNA, 21 nt, Staphylococcus aureus subsp. aureus Mu50
cauuaggucuacgaucaaaau

SEQ ID NO: 3959366 - RNA, 15 nt, Staphylococcus aureus subsp. aureus Mu50
cauuaguucuguuga

SEQ ID NO: 3959367 - RNA, 17 nt, Staphylococcus aureus subsp. aureus Mu50
cauuaguuuuuaaaauu

SEQ ID NO: 3959368 - RNA, 17 nt, Staphylococcus aureus subsp. aureus Mu50
cauuauaaugauuuuua

SEQ ID NO: 3959369 - RNA, 20 nt, Staphylococcus aureus subsp. aureus Mu50
cauuauaauggacuaauuua

SEQ ID NO: 3959370 - RNA, 21 nt, Staphylococcus aureus subsp. aureus Mu50
cauuauaauggacuaauuuau

SEQ ID NO: 3959371 - RNA, 17 nt, Staphylococcus aureus subsp. aureus Mu50
cauuauauaauucuuca

SEQ ID NO: 3959372 - RNA, 18 nt, Staphylococcus aureus subsp. aureus Mu50
cauuauauaauucuucaa

SEQ ID NO: 3959373 - RNA, 20 nt, Staphylococcus aureus subsp. aureus Mu50
cauuauaugguucguccauu

SEQ ID NO: 3959374 - RNA, 20 nt, Staphylococcus aureus subsp. aureus Mu50
cauuaucaagaacuuuaaaa

SEQ ID NO: 3959375 - RNA, 21 nt, Staphylococcus aureus subsp. aureus Mu50
cauuaucaagaacuuuaaaaa

SEQ ID NO: 3959376 - RNA, 18 nt, Staphylococcus aureus subsp. aureus Mu50
cauuaucaccuucaaacu

SEQ ID NO: 3959377 - RNA, 13 nt, Staphylococcus aureus subsp. aureus Mu50
cauuaucauuaag

SEQ ID NO: 3959378 - RNA, 21 nt, Staphylococcus aureus subsp. aureus Mu50
cauuauccaaggauguuauaa

SEQ ID NO: 3959379 - RNA, 18 nt, Staphylococcus aureus subsp. aureus Mu50
cauuauccauucuuuguu

SEQ ID NO: 3959380 - RNA, 15 nt, Staphylococcus aureus subsp. aureus Mu50
cauuauguucuucac

SEQ ID NO: 3959381 - RNA, 13 nt, Staphylococcus aureus subsp. aureus Mu50
cauuauuaaauag

SEQ ID NO: 3959382 - RNA, 21 nt, Staphylococcus aureus subsp. aureus Mu50
cauuauuaaauagaugagaaa

SEQ ID NO: 3959383 - RNA, 17 nt, Staphylococcus aureus subsp. aureus Mu50
cauuauuaagugaguuu

SEQ ID NO: 3959384 - RNA, 20 nt, Staphylococcus aureus subsp. aureus Mu50
cauuauuacugauuguuaac

SEQ ID NO: 3959385 - RNA, 14 nt, Staphylococcus aureus subsp. aureus Mu50
cauuauuauuaaau

SEQ ID NO: 3959386 - RNA, 15 nt, Staphylococcus aureus subsp. aureus Mu50
cauuauuuagaauuc

SEQ ID NO: 3959387 - RNA, 17 nt, Staphylococcus aureus subsp. aureus Mu50
cauuauuuauauuuaga

SEQ ID NO: 3959388 - RNA, 18 nt, Staphylococcus aureus subsp. aureus Mu50
cauuauuugauaaauaaa

SEQ ID NO: 3959389 - RNA, 20 nt, Staphylococcus aureus subsp. aureus Mu50
cauuauuugcugcuaauuga

SEQ ID NO: 3959390 - RNA, 14 nt, Staphylococcus aureus subsp. aureus Mu50
cauucaauguuuaa

SEQ ID NO: 3959391 - RNA, 23 nt, Staphylococcus aureus subsp. aureus Mu50
cauucaauguuuaauuuucuaaa

SEQ ID NO: 3959392 - RNA, 24 nt, Staphylococcus aureus subsp. aureus Mu50
cauucaauguuuaauuuucuaaau

SEQ ID NO: 3959393 - RNA, 14 nt, Staphylococcus aureus subsp. aureus Mu50
cauucacuacuuuu

SEQ ID NO: 3959394 - RNA, 13 nt, Staphylococcus aureus subsp. aureus Mu50
cauucacuucaag

SEQ ID NO: 3959395 - RNA, 19 nt, Staphylococcus aureus subsp. aureus Mu50
cauucauaauuuguugaua

SEQ ID NO: 3959396 - RNA, 18 nt, Staphylococcus aureus subsp. aureus Mu50
cauucauauggaauacua

SEQ ID NO: 3959397 - RNA, 14 nt, Staphylococcus aureus subsp. aureus Mu50
cauucaucgucuca

SEQ ID NO: 3959398 - RNA, 14 nt, Staphylococcus aureus subsp. aureus Mu50
cauucauuugcaaa

SEQ ID NO: 3959399 - RNA, 12 nt, Staphylococcus aureus subsp. aureus Mu50
cauuccaaaaau

SEQ ID NO: 3959400 - RNA, 15 nt, Staphylococcus aureus subsp. aureus Mu50
cauuccaaaaauugu

SEQ ID NO: 3959401 - RNA, 22 nt, Staphylococcus aureus subsp. aureus Mu50
cauuccaaacacacuguugaaa

SEQ ID NO: 3959402 - RNA, 22 nt, Staphylococcus aureus subsp. aureus Mu50
cauuccaaaguaccaucucuau

SEQ ID NO: 3959403 - RNA, 23 nt, Staphylococcus aureus subsp. aureus Mu50
cauucgaugcuaaaaauauugaa

SEQ ID NO: 3959404 - RNA, 12 nt, Staphylococcus aureus subsp. aureus Mu50
cauucguuuaau

SEQ ID NO: 3959405 - RNA, 18 nt, Staphylococcus aureus subsp. aureus Mu50
cauucuaacgguaaauaa

SEQ ID NO: 3959406 - RNA, 20 nt, Staphylococcus aureus subsp. aureus Mu50
cauucuaccaguugauuuaa

SEQ ID NO: 3959407 - RNA, 16 nt, Staphylococcus aureus subsp. aureus Mu50
cauucuguguaaauau

SEQ ID NO: 3959408 - RNA, 18 nt, Staphylococcus aureus subsp. aureus Mu50
cauucuguguaaauauaa

SEQ ID NO: 3959409 - RNA, 13 nt, Staphylococcus aureus subsp. aureus Mu50
cauucuuauuuga

SEQ ID NO: 3959410 - RNA, 14 nt, Staphylococcus aureus subsp. aureus Mu50
cauucuucaaaaaa

SEQ ID NO: 3959411 - RNA, 13 nt, Staphylococcus aureus subsp. aureus Mu50
cauucuuccaaca

SEQ ID NO: 3959412 - RNA, 19 nt, Staphylococcus aureus subsp. aureus Mu50
cauucuugaauaaauuuua

SEQ ID NO: 3959413 - RNA, 14 nt, Staphylococcus aureus subsp. aureus Mu50
cauucuugguuuuu

SEQ ID NO: 3959414 - RNA, 20 nt, Staphylococcus aureus subsp. aureus Mu50
cauucuuuaauauaaauuuu

SEQ ID NO: 3959415 - RNA, 19 nt, Staphylococcus aureus subsp. aureus Mu50
cauucuuuuucucaaugug

SEQ ID NO: 3959416 - RNA, 21 nt, Staphylococcus aureus subsp. aureus Mu50
cauucuuuuucucaaugugag

SEQ ID NO: 3959417 - RNA, 19 nt, Staphylococcus aureus subsp. aureus Mu50
cauugaaaggaacauuuca

SEQ ID NO: 3959418 - RNA, 21 nt, Staphylococcus aureus subsp. aureus Mu50
cauugaaaggaacauuucaau

SEQ ID NO: 3959419 - RNA, 21 nt, Staphylococcus aureus subsp. aureus Mu50
cauugaaaucgucuuacugcu

SEQ ID NO: 3959420 - RNA, 21 nt, Staphylococcus aureus subsp. aureus Mu50
cauugagauaucuuauaacaa

SEQ ID NO: 3959421 - RNA, 17 nt, Staphylococcus aureus subsp. aureus Mu50
cauugagauuaucuuua

SEQ ID NO: 3959422 - RNA, 13 nt, Staphylococcus aureus subsp. aureus Mu50
cauugauaaaaua

SEQ ID NO: 3959423 - RNA, 18 nt, Staphylococcus aureus subsp. aureus Mu50
cauugauaaauuuuuagu

SEQ ID NO: 3959424 - RNA, 21 nt, Staphylococcus aureus subsp. aureus Mu50
cauugauaaauuuuuaguuaa

SEQ ID NO: 3959425 - RNA, 20 nt, Staphylococcus aureus subsp. aureus Mu50
ccaccaccugcaauuuguaa

SEQ ID NO: 3959426 - RNA, 16 nt, Staphylococcus aureus subsp. aureus Mu50
ccaccagucguaauga

SEQ ID NO: 3959427 - RNA, 11 nt, Staphylococcus aureus subsp. aureus Mu50
ccaccugauaa

SEQ ID NO: 3959428 - RNA, 14 nt, Staphylococcus aureus subsp. aureus Mu50
ccaccuuguuuaag

SEQ ID NO: 3959429 - RNA, 20 nt, Staphylococcus aureus subsp. aureus Mu50
ccaccuuguuuaaguuuuuc

SEQ ID NO: 3959430 - RNA, 21 nt, Staphylococcus aureus subsp. aureus Mu50
ccaccuuguuuaaguuuuuca

SEQ ID NO: 3959431 - RNA, 18 nt, Staphylococcus aureus subsp. aureus Mu50
ccacggcauuuaagccug

SEQ ID NO: 3959432 - RNA, 12 nt, Staphylococcus aureus subsp. aureus Mu50
ccacucaauucu

SEQ ID NO: 3959433 - RNA, 19 nt, Staphylococcus aureus subsp. aureus Mu50
ccacucauaaucaagucug

SEQ ID NO: 3959434 - RNA, 17 nt, Staphylococcus aureus subsp. aureus Mu50
ccacuggccuuuaauga

SEQ ID NO: 3959435 - RNA, 14 nt, Staphylococcus aureus subsp. aureus Mu50
ccacuuaaucguuc

SEQ ID NO: 3959436 - RNA, 15 nt, Staphylococcus aureus subsp. aureus Mu50
ccacuucaucuaaau

SEQ ID NO: 3959437 - RNA, 14 nt, Staphylococcus aureus subsp. aureus Mu50
ccacuucuucaccu

SEQ ID NO: 3959438 - RNA, 11 nt, Staphylococcus aureus subsp. aureus Mu50
ccagaauaaau

SEQ ID NO: 3959439 - RNA, 13 nt, Staphylococcus aureus subsp. aureus Mu50
ccagaauaaaucc

SEQ ID NO: 3959440 - RNA, 22 nt, Staphylococcus aureus subsp. aureus Mu50
ccagaauguguuggcuuuuuga

SEQ ID NO: 3959441 - RNA, 15 nt, Staphylococcus aureus subsp. aureus Mu50
ccagauaucauaaua

SEQ ID NO: 3959442 - RNA, 20 nt, Staphylococcus aureus subsp. aureus Mu50
ccagauucauaucuuucaau

SEQ ID NO: 3959443 - RNA, 22 nt, Staphylococcus aureus subsp. aureus Mu50
ccagcaugaaucgcauuuaaau

SEQ ID NO: 3959444 - RNA, 15 nt, Staphylococcus aureus subsp. aureus Mu50
ccagccauuaaaccu

SEQ ID NO: 3959445 - RNA, 22 nt, Staphylococcus aureus subsp. aureus Mu50
ccagccccaauuagccccagua

SEQ ID NO: 3959446 - RNA, 15 nt, Staphylococcus aureus subsp. aureus Mu50
ccagccucuguguug

SEQ ID NO: 3959447 - RNA, 16 nt, Staphylococcus aureus subsp. aureus Mu50
ccagcuaaaccaucug

SEQ ID NO: 3959448 - RNA, 15 nt, Staphylococcus aureus subsp. aureus Mu50
ccagcuuacugcuuu

SEQ ID NO: 3959449 - RNA, 20 nt, Staphylococcus aureus subsp. aureus Mu50
ccaggccagucaauuuuuuc

SEQ ID NO: 3959450 - RNA, 12 nt, Staphylococcus aureus subsp. aureus Mu50
ccagguccuggg

SEQ ID NO: 3959451 - RNA, 13 nt, Staphylococcus aureus subsp. aureus Mu50
ccaguauaauuuu

SEQ ID NO: 3959452 - RNA, 23 nt, Staphylococcus aureus subsp. aureus Mu50
ccaguauacgaguuauaucuuuu

SEQ ID NO: 3959453 - RNA, 15 nt, Staphylococcus aureus subsp. aureus Mu50
ccagucaauuuuuuc

SEQ ID NO: 3959454 - RNA, 18 nt, Staphylococcus aureus subsp. aureus Mu50
ccagucauuguauaaaaa

SEQ ID NO: 3959455 - RNA, 13 nt, Staphylococcus aureus subsp. aureus Mu50
ccaguuucaagug

SEQ ID NO: 3959456 - RNA, 15 nt, Staphylococcus aureus subsp. aureus Mu50
ccaguuuucaauuua

SEQ ID NO: 3959457 - RNA, 19 nt, Staphylococcus aureus subsp. aureus Mu50
ccauaaacauggucaauca

SEQ ID NO: 3959458 - RNA, 21 nt, Staphylococcus aureus subsp. aureus Mu50
ccauaaauaaaaugcuacaau

SEQ ID NO: 3959459 - RNA, 15 nt, Staphylococcus aureus subsp. aureus Mu50
ccauaaauauuaaau

SEQ ID NO: 3959460 - RNA, 12 nt, Staphylococcus aureus subsp. aureus Mu50
ccauaacaauca

SEQ ID NO: 3959461 - RNA, 13 nt, Staphylococcus aureus subsp. aureus Mu50
ccauaacaauuuu

SEQ ID NO: 3959462 - RNA, 22 nt, Staphylococcus aureus subsp. aureus Mu50
ccauaaggauuuuuaauuuuau

SEQ ID NO: 3959463 - RNA, 19 nt, Staphylococcus aureus subsp. aureus Mu50
ccauaaguaaaacugcaau

SEQ ID NO: 3959464 - RNA, 17 nt, Staphylococcus aureus subsp. aureus Mu50
ccauaaucuuuauuaau

SEQ ID NO: 3959465 - RNA, 21 nt, Staphylococcus aureus subsp. aureus Mu50
ccauaaucuuuauuaauaaau

SEQ ID NO: 3959466 - RNA, 16 nt, Staphylococcus aureus subsp. aureus Mu50
ccauaaugacuauaac

SEQ ID NO: 3959467 - RNA, 20 nt, Staphylococcus aureus subsp. aureus Mu50
ccauaauuaaauaacuuuuu

SEQ ID NO: 3959468 - RNA, 16 nt, Staphylococcus aureus subsp. aureus Mu50
ccauacccauauuaaa

SEQ ID NO: 3959469 - RNA, 19 nt, Staphylococcus aureus subsp. aureus Mu50
ccauacuaaaacaugauac

SEQ ID NO: 3959470 - RNA, 20 nt, Staphylococcus aureus subsp. aureus Mu50
ccauacuucuauuuuauaau

SEQ ID NO: 3959471 - RNA, 17 nt, Staphylococcus aureus subsp. aureus Mu50
ccauaguaauaaaauga

SEQ ID NO: 3959472 - RNA, 19 nt, Staphylococcus aureus subsp. aureus Mu50
ccauaguaauaaaaugaug

SEQ ID NO: 3959473 - RNA, 17 nt, Staphylococcus aureus subsp. aureus Mu50
ccauauagauauuagcu

SEQ ID NO: 3959474 - RNA, 20 nt, Staphylococcus aureus subsp. aureus Mu50
ccaucaauaccauaauuaaa

SEQ ID NO: 3959475 - RNA, 19 nt, Staphylococcus aureus subsp. aureus Mu50
ccaucaauauugauaucga

SEQ ID NO: 3959476 - RNA, 20 nt, Staphylococcus aureus subsp. aureus Mu50
ccaucaauauuuauauuaaa

SEQ ID NO: 3959477 - RNA, 14 nt, Staphylococcus aureus subsp. aureus Mu50
ccaucauaaauguu

SEQ ID NO: 3959478 - RNA, 21 nt, Staphylococcus aureus subsp. aureus Mu50
ccaucauguacaguuacuuuc

SEQ ID NO: 3959479 - RNA, 20 nt, Staphylococcus aureus subsp. aureus Mu50
ccaucguagcgcuuagauaa

SEQ ID NO: 3959480 - RNA, 20 nt, Staphylococcus aureus subsp. aureus Mu50
ccaucucgugaaaauaauac

SEQ ID NO: 3959481 - RNA, 11 nt, Staphylococcus aureus subsp. aureus Mu50
ccaucuuuaau

SEQ ID NO: 3959482 - RNA, 22 nt, Staphylococcus aureus subsp. aureus Mu50
ccaucuuuguaaccuaaaaaca

SEQ ID NO: 3959483 - RNA, 23 nt, Staphylococcus aureus subsp. aureus Mu50
ccaucuuuguaaccuaaaaacaa

SEQ ID NO: 3959484 - RNA, 17 nt, Staphylococcus aureus subsp. aureus Mu50
ccaugauuagcgcacca

SEQ ID NO: 3959485 - RNA, 19 nt, Staphylococcus aureus subsp. aureus Mu50
ccaugauuagcgcaccaau

SEQ ID NO: 3959486 - RNA, 16 nt, Staphylococcus aureus subsp. aureus Mu50
ccaugcccgauaaaac

SEQ ID NO: 3959487 - RNA, 15 nt, Staphylococcus aureus subsp. aureus Mu50
ccauuaguacuaaac

SEQ ID NO: 3959488 - RNA, 23 nt, Staphylococcus aureus subsp. aureus Mu50
ccauuaucaagaacuuuaaaaau

SEQ ID NO: 3959489 - RNA, 16 nt, Staphylococcus aureus subsp. aureus Mu50
ccauuauuauuuuuuu

SEQ ID NO: 3959490 - RNA, 18 nt, Staphylococcus aureus subsp. aureus Mu50
ccauucaaaguauauacu

SEQ ID NO: 3959491 - RNA, 21 nt, Staphylococcus aureus subsp. aureus Mu50
ccauucaauguuuaauuuucu

SEQ ID NO: 3959492 - RNA, 19 nt, Staphylococcus aureus subsp. aureus Mu50
ccauucaucgucucacuua

SEQ ID NO: 3959493 - RNA, 12 nt, Staphylococcus aureus subsp. aureus Mu50
ccauucauuaag

SEQ ID NO: 3959494 - RNA, 23 nt, Staphylococcus aureus subsp. aureus Mu50
ccauucgaaagccaauuaauaaa

SEQ ID NO: 3959495 - RNA, 17 nt, Staphylococcus aureus subsp. aureus Mu50
ccauucuuuuucucaau

SEQ ID NO: 3959496 - RNA, 18 nt, Staphylococcus aureus subsp. aureus Mu50
ccauugaucuuuuauaau

SEQ ID NO: 3959497 - RNA, 14 nt, Staphylococcus aureus subsp. aureus Mu50
ccauugauguaugu

SEQ ID NO: 3959498 - RNA, 14 nt, Staphylococcus aureus subsp. aureus Mu50
ccauugcacuaugc

SEQ ID NO: 3959499 - RNA, 17 nt, Staphylococcus aureus subsp. aureus Mu50
ccauugcacuaugcaua

SEQ ID NO: 3959500 - RNA, 23 nt, Staphylococcus aureus subsp. aureus Mu50
ccauugcuucuuggcauuuuuuc

SEQ ID NO: 3959501 - RNA, 13 nt, Staphylococcus aureus subsp. aureus Mu50
ccauugucaugcc

SEQ ID NO: 3959502 - RNA, 22 nt, Staphylococcus aureus subsp. aureus Mu50
ccauuguccaacugcuuuuuau

SEQ ID NO: 3959503 - RNA, 21 nt, Staphylococcus aureus subsp. aureus Mu50
ccauuguuauccaaaacauuu

SEQ ID NO: 3959504 - RNA, 19 nt, Staphylococcus aureus subsp. aureus Mu50
ccauuuacuucauaaguca

SEQ ID NO: 3959505 - RNA, 16 nt, Staphylococcus aureus subsp. aureus Mu50
ccauuugcaacaauau

SEQ ID NO: 3959506 - RNA, 17 nt, Staphylococcus aureus subsp. aureus Mu50
ccauuuuuuuccaagca

SEQ ID NO: 3959507 - RNA, 18 nt, Staphylococcus aureus subsp. aureus Mu50
ccauuuuuuuccaagcau

SEQ ID NO: 3959508 - RNA, 22 nt, Staphylococcus aureus subsp. aureus Mu50
cccaaauugaugacuuacuaau

SEQ ID NO: 3959509 - RNA, 13 nt, Staphylococcus aureus subsp. aureus Mu50
cccaacaaagaag

SEQ ID NO: 3959510 - RNA, 12 nt, Staphylococcus aureus subsp. aureus Mu50
cccaacacagaa

SEQ ID NO: 3959511 - RNA, 12 nt, Staphylococcus aureus subsp. aureus Mu50
cccaacacagag

SEQ ID NO: 3959512 - RNA, 15 nt, Staphylococcus aureus subsp. aureus Mu50
cccaacacagagaaa

SEQ ID NO: 3959513 - RNA, 21 nt, Staphylococcus aureus subsp. aureus Mu50
ccuaaagguaacuuuuuaacu

SEQ ID NO: 3959514 - RNA, 12 nt, Staphylococcus aureus subsp. aureus Mu50
ccuaaaucuccu

SEQ ID NO: 3959515 - RNA, 12 nt, Staphylococcus aureus subsp. aureus Mu50
ccuaaccuguuu

SEQ ID NO: 3959516 - RNA, 19 nt, Staphylococcus aureus subsp. aureus Mu50
ccuaaccuguuugagauau

SEQ ID NO: 3959517 - RNA, 20 nt, Staphylococcus aureus subsp. aureus Mu50
ccuaagcaagauaauagcaa

SEQ ID NO: 3959518 - RNA, 21 nt, Staphylococcus aureus subsp. aureus Mu50
ccuaagcaagauaauagcaau

SEQ ID NO: 3959519 - RNA, 17 nt, Staphylococcus aureus subsp. aureus Mu50
ccuaagcugauuaaaau

SEQ ID NO: 3959520 - RNA, 17 nt, Staphylococcus aureus subsp. aureus Mu50
ccuaaguuaugacuaac

SEQ ID NO: 3959521 - RNA, 14 nt, Staphylococcus aureus subsp. aureus Mu50
ccuaauaauaaaau

SEQ ID NO: 3959522 - RNA, 18 nt, Staphylococcus aureus subsp. aureus Mu50
ccuaauacacuugauaaa

SEQ ID NO: 3959523 - RNA, 20 nt, Staphylococcus aureus subsp. aureus Mu50
ccuaauacacuugauaaaac

SEQ ID NO: 3959524 - RNA, 14 nt, Staphylococcus aureus subsp. aureus Mu50
ccuaauauuuuaaa

SEQ ID NO: 3959525 - RNA, 17 nt, Staphylococcus aureus subsp. aureus Mu50
ccuaaucuaccauguuu

SEQ ID NO: 3959526 - RNA, 22 nt, Staphylococcus aureus subsp. aureus Mu50
ccuaaucugcaacgauuuuaaa

SEQ ID NO: 3959527 - RNA, 22 nt, Staphylococcus aureus subsp. aureus Mu50
ccuaauguguggauuuaauuuu

SEQ ID NO: 3959528 - RNA, 16 nt, Staphylococcus aureus subsp. aureus Mu50
ccuaauuauauuaaug

SEQ ID NO: 3959529 - RNA, 17 nt, Staphylococcus aureus subsp. aureus Mu50
ccuaauucgccaucuuu

SEQ ID NO: 3959530 - RNA, 13 nt, Staphylococcus aureus subsp. aureus Mu50
ccuaauuuuguga

SEQ ID NO: 3959531 - RNA, 18 nt, Staphylococcus aureus subsp. aureus Mu50
ccuacaaauauuucuaaa

SEQ ID NO: 3959532 - RNA, 14 nt, Staphylococcus aureus subsp. aureus Mu50
ccuacaacaccaau

SEQ ID NO: 3959533 - RNA, 20 nt, Staphylococcus aureus subsp. aureus Mu50
ccuacaacaccaauugaaau

SEQ ID NO: 3959534 - RNA, 16 nt, Staphylococcus aureus subsp. aureus Mu50
ccuacaguguuauaau

SEQ ID NO: 3959535 - RNA, 21 nt, Staphylococcus aureus subsp. aureus Mu50
ccuaccgcuaaaauucuuuca

SEQ ID NO: 3959536 - RNA, 16 nt, Staphylococcus aureus subsp. aureus Mu50
ccuacgcccaucauca

SEQ ID NO: 3959537 - RNA, 16 nt, Staphylococcus aureus subsp. aureus Mu50
ccuacguguguaguag

SEQ ID NO: 3959538 - RNA, 10 nt, Staphylococcus aureus subsp. aureus Mu50
ccuacuacau

SEQ ID NO: 3959539 - RNA, 17 nt, Staphylococcus aureus subsp. aureus Mu50
ccuagauaccaaacugc

SEQ ID NO: 3959540 - RNA, 21 nt, Staphylococcus aureus subsp. aureus Mu50
ccuagcaaaaauacuuuuuga

SEQ ID NO: 3959541 - RNA, 21 nt, Staphylococcus aureus subsp. aureus Mu50
ccuaggaaauaaaaaauaacc

SEQ ID NO: 3959542 - RNA, 16 nt, Staphylococcus aureus subsp. aureus Mu50
ccuagguuuauauauc

SEQ ID NO: 3959543 - RNA, 18 nt, Staphylococcus aureus subsp. aureus Mu50
ccuagguuuauauaucac

SEQ ID NO: 3959544 - RNA, 20 nt, Staphylococcus aureus subsp. aureus Mu50
ccuagguuuauauaucacau

SEQ ID NO: 3959545 - RNA, 14 nt, Staphylococcus aureus subsp. aureus Mu50
ccuauaagucucuu

SEQ ID NO: 3959546 - RNA, 11 nt, Staphylococcus aureus subsp. aureus Mu50
ccuauaauagc

SEQ ID NO: 3959547 - RNA, 17 nt, Staphylococcus aureus subsp. aureus Mu50
ccuauacauaacccuaa

SEQ ID NO: 3959548 - RNA, 19 nt, Staphylococcus aureus subsp. aureus Mu50
ccuaucaucaaucguuaau

SEQ ID NO: 3959549 - RNA, 14 nt, Staphylococcus aureus subsp. aureus Mu50
ccuaugaauuuagc

SEQ ID NO: 3959550 - RNA, 20 nt, Staphylococcus aureus subsp. aureus Mu50
ccuauggcgcaauuuuuaac

SEQ ID NO: 3959551 - RNA, 19 nt, Staphylococcus aureus subsp. aureus Mu50
ccuauuaaaucugcuugug

SEQ ID NO: 3959552 - RNA, 11 nt, Staphylococcus aureus subsp. aureus Mu50
ccuauucccaa

SEQ ID NO: 3959553 - RNA, 17 nt, Staphylococcus aureus subsp. aureus Mu50
ccuauucccaaaaugau

SEQ ID NO: 3959554 - RNA, 16 nt, Staphylococcus aureus subsp. aureus Mu50
ccuauuccuaauaaau

SEQ ID NO: 3959555 - RNA, 22 nt, Staphylococcus aureus subsp. aureus Mu50
ccuauuccuaauaaauaucuua

SEQ ID NO: 3959556 - RNA, 19 nt, Staphylococcus aureus subsp. aureus Mu50
ccuauuccuauuacuacau

SEQ ID NO: 3959557 - RNA, 20 nt, Staphylococcus aureus subsp. aureus Mu50
ccuauuuguggaaauaaaac

SEQ ID NO: 3959558 - RNA, 11 nt, Staphylococcus aureus subsp. aureus Mu50
ccuauuuuuua

SEQ ID NO: 3959559 - RNA, 21 nt, Staphylococcus aureus subsp. aureus Mu50
ccuauuuuuugagcacuuaau

SEQ ID NO: 3959560 - RNA, 18 nt, Staphylococcus aureus subsp. aureus Mu50
ccucaacauuaaaaugug

SEQ ID NO: 3959561 - RNA, 16 nt, Staphylococcus aureus subsp. aureus Mu50
ccucacaaauuugaau

SEQ ID NO: 3959562 - RNA, 19 nt, Staphylococcus aureus subsp. aureus Mu50
ccucacuagauaguuuaua

SEQ ID NO: 3959563 - RNA, 14 nt, Staphylococcus aureus subsp. aureus Mu50
ccucauaauuauca

SEQ ID NO: 3959564 - RNA, 13 nt, Staphylococcus aureus subsp. aureus Mu50
ccucaucgaguuu

SEQ ID NO: 3959565 - RNA, 14 nt, Staphylococcus aureus subsp. aureus Mu50
ccucauuaauaaau

SEQ ID NO: 3959566 - RNA, 18 nt, Staphylococcus aureus subsp. aureus Mu50
ccuccuggugcugcacca

SEQ ID NO: 3959567 - RNA, 19 nt, Staphylococcus aureus subsp. aureus Mu50
ccucguaggcauaggcuua

SEQ ID NO: 3959568 - RNA, 14 nt, Staphylococcus aureus subsp. aureus Mu50
ccucuaaauaaaau

SEQ ID NO: 3959569 - RNA, 21 nt, Staphylococcus aureus subsp. aureus Mu50
ccucuaacguuaacaauauuc

SEQ ID NO: 3959570 - RNA, 23 nt, Staphylococcus aureus subsp. aureus Mu50
ccucuaaugauuaaaaaucaaag

SEQ ID NO: 3959571 - RNA, 14 nt, Staphylococcus aureus subsp. aureus Mu50
ccucuccuucggcu

SEQ ID NO: 3959572 - RNA, 18 nt, Staphylococcus aureus subsp. aureus Mu50
ccucucguaaauuguugu

SEQ ID NO: 3959573 - RNA, 15 nt, Staphylococcus aureus subsp. aureus Mu50
ccucugauaaaugaa

SEQ ID NO: 3959574 - RNA, 22 nt, Staphylococcus aureus subsp. aureus Mu50
ccucugauacuucaccaucuuu

SEQ ID NO: 3959575 - RNA, 21 nt, Staphylococcus aureus subsp. aureus Mu50
ccucuguuuuguugguguuua

SEQ ID NO: 3959576 - RNA, 19 nt, Staphylococcus aureus subsp. aureus Mu50
ccucuuagcacuuggauuu

SEQ ID NO: 3959577 - RNA, 20 nt, Staphylococcus aureus subsp. aureus Mu50
ccucuugauaaaauaaauaa

SEQ ID NO: 3959578 - RNA, 12 nt, Staphylococcus aureus subsp. aureus Mu50
ccucuugccuug

SEQ ID NO: 3959579 - RNA, 17 nt, Staphylococcus aureus subsp. aureus Mu50
ccucuuuuguuuaguau

SEQ ID NO: 3959580 - RNA, 21 nt, Staphylococcus aureus subsp. aureus Mu50
ccugaaauuaacgucaacagc

SEQ ID NO: 3959581 - RNA, 19 nt, Staphylococcus aureus subsp. aureus Mu50
ccugaagcgcuuggauuuu

SEQ ID NO: 3959582 - RNA, 15 nt, Staphylococcus aureus subsp. aureus Mu50
ccugauaaugcaugu

SEQ ID NO: 3959583 - RNA, 21 nt, Staphylococcus aureus subsp. aureus Mu50
ccugauacaaugauuacuuua

SEQ ID NO: 3959584 - RNA, 23 nt, Staphylococcus aureus subsp. aureus Mu50
ccugaugaauagauaaucgccau

SEQ ID NO: 3959585 - RNA, 22 nt, Staphylococcus aureus subsp. aureus Mu50
ccugauuccacuacaaucauac

SEQ ID NO: 3959586 - RNA, 13 nt, Staphylococcus aureus subsp. aureus Mu50
ccugauuuaaugu

SEQ ID NO: 3959587 - RNA, 20 nt, Staphylococcus aureus subsp. aureus Mu50
ccugcaaaauguuacacaaa

SEQ ID NO: 3959588 - RNA, 19 nt, Staphylococcus aureus subsp. aureus Mu50
ccugcaauuuguaauacaa

SEQ ID NO: 3959589 - RNA, 18 nt, Staphylococcus aureus subsp. aureus Mu50
ccugcauauucacgauau

SEQ ID NO: 3959590 - RNA, 17 nt, Staphylococcus aureus subsp. aureus Mu50
ccugcuacaacuucuuc

SEQ ID NO: 3959591 - RNA, 13 nt, Staphylococcus aureus subsp. aureus Mu50
ccuggaaaaugau

SEQ ID NO: 3959592 - RNA, 16 nt, Staphylococcus aureus subsp. aureus Mu50
ccuggaauauuaacac

SEQ ID NO: 3959593 - RNA, 23 nt, Staphylococcus aureus subsp. aureus Mu50
ccuggaaucgaaaauaucaauuu

SEQ ID NO: 3959594 - RNA, 19 nt, Staphylococcus aureus subsp. aureus Mu50
ccuguaaaaccauagauaa

SEQ ID NO: 3959595 - RNA, 23 nt, Staphylococcus aureus subsp. aureus Mu50
ccuguauagcgguguuuugagag

SEQ ID NO: 3959596 - RNA, 12 nt, Staphylococcus aureus subsp. aureus Mu50
ccugugauaaaa

SEQ ID NO: 3959597 - RNA, 13 nt, Staphylococcus aureus subsp. aureus Mu50
ccugugauaaaaa

SEQ ID NO: 3959598 - RNA, 19 nt, Staphylococcus aureus subsp. aureus Mu50
ccuguuauugcaauaaaau

SEQ ID NO: 3959599 - RNA, 22 nt, Staphylococcus aureus subsp. aureus Mu50
ccuguuauugcaauaaaauuag

SEQ ID NO: 3959600 - RNA, 18 nt, Staphylococcus aureus subsp. aureus Mu50
cgaauuaagaaaaguuac

SEQ ID NO: 3959601 - RNA, 20 nt, Staphylococcus aureus subsp. aureus Mu50
cgaauucaccuucccaguca

SEQ ID NO: 3959602 - RNA, 17 nt, Staphylococcus aureus subsp. aureus Mu50
cgaauucuccguuaauu

SEQ ID NO: 3959603 - RNA, 18 nt, Staphylococcus aureus subsp. aureus Mu50
cgaauucuccguuaauuu

SEQ ID NO: 3959604 - RNA, 18 nt, Staphylococcus aureus subsp. aureus Mu50
cgacaaauuaaaaaacaa

SEQ ID NO: 3959605 - RNA, 19 nt, Staphylococcus aureus subsp. aureus Mu50
cgacaaauuaaaaaacaau

SEQ ID NO: 3959606 - RNA, 22 nt, Staphylococcus aureus subsp. aureus Mu50
cgacaauuauaauaaaacuugu

SEQ ID NO: 3959607 - RNA, 15 nt, Staphylococcus aureus subsp. aureus Mu50
cgacaauuccauaag

SEQ ID NO: 3959608 - RNA, 15 nt, Staphylococcus aureus subsp. aureus Mu50
cgacaggggcuuaac

SEQ ID NO: 3959609 - RNA, 20 nt, Staphylococcus aureus subsp. aureus Mu50
cgacaucuagaugaaauugu

SEQ ID NO: 3959610 - RNA, 21 nt, Staphylococcus aureus subsp. aureus Mu50
cgaccagucgcauauuuugau

SEQ ID NO: 3959611 - RNA, 19 nt, Staphylococcus aureus subsp. aureus Mu50
cgaccuuuauaugaagcgu

SEQ ID NO: 3959612 - RNA, 20 nt, Staphylococcus aureus subsp. aureus Mu50
cgacgcuaaacaaaggggau

SEQ ID NO: 3959613 - RNA, 23 nt, Staphylococcus aureus subsp. aureus Mu50
cgacgguauaaaaaaauuaacua

SEQ ID NO: 3959614 - RNA, 19 nt, Staphylococcus aureus subsp. aureus Mu50
cgacuaaccacauuauaau

SEQ ID NO: 3959615 - RNA, 15 nt, Staphylococcus aureus subsp. aureus Mu50
cgacuucgauaucaa

SEQ ID NO: 3959616 - RNA, 21 nt, Staphylococcus aureus subsp. aureus Mu50
cgacuuuuagauuaucuuuca

SEQ ID NO: 3959617 - RNA, 18 nt, Staphylococcus aureus subsp. aureus Mu50
cgagaaauuagaaccauc

SEQ ID NO: 3959618 - RNA, 11 nt, Staphylococcus aureus subsp. aureus Mu50
cgagaaucucc

SEQ ID NO: 3959619 - RNA, 14 nt, Staphylococcus aureus subsp. aureus Mu50
cgagacaucaucua

SEQ ID NO: 3959620 - RNA, 20 nt, Staphylococcus aureus subsp. aureus Mu50
cgagauguguccuaauaagu

SEQ ID NO: 3959621 - RNA, 18 nt, Staphylococcus aureus subsp. aureus Mu50
cgagcaguauauaucaaa

SEQ ID NO: 3959622 - RNA, 16 nt, Staphylococcus aureus subsp. aureus Mu50
cgagcguaauggauua

SEQ ID NO: 3959623 - RNA, 15 nt, Staphylococcus aureus subsp. aureus Mu50
cgagcguugguaacg

SEQ ID NO: 3959624 - RNA, 20 nt, Staphylococcus aureus subsp. aureus Mu50
cgagcguugguaacguuaau

SEQ ID NO: 3959625 - RNA, 23 nt, Staphylococcus aureus subsp. aureus Mu50
cgagcuuagggcuuuguuuucug

SEQ ID NO: 3959626 - RNA, 19 nt, Staphylococcus aureus subsp. aureus Mu50
cgaggaaauccuuaaaugg

SEQ ID NO: 3959627 - RNA, 21 nt, Staphylococcus aureus subsp. aureus Mu50
cgaggggucuuuuuuuaaugu

SEQ ID NO: 3959628 - RNA, 20 nt, Staphylococcus aureus subsp. aureus Mu50
cgaguguuuuaaucuuauuc

SEQ ID NO: 3959629 - RNA, 19 nt, Staphylococcus aureus subsp. aureus Mu50
cgaguuuguuucuaaauuc

SEQ ID NO: 3959630 - RNA, 12 nt, Staphylococcus aureus subsp. aureus Mu50
cgauaaaagaac

SEQ ID NO: 3959631 - RNA, 22 nt, Staphylococcus aureus subsp. aureus Mu50
cgauaaaaguuguauucugaaa

SEQ ID NO: 3959632 - RNA, 12 nt, Staphylococcus aureus subsp. aureus Mu50
cgauaaaauguu

SEQ ID NO: 3959633 - RNA, 23 nt, Staphylococcus aureus subsp. aureus Mu50
cgauaaauaacuuuaccaccauu

SEQ ID NO: 3959634 - RNA, 11 nt, Staphylococcus aureus subsp. aureus Mu50
cgauaaauaau

SEQ ID NO: 3959635 - RNA, 11 nt, Staphylococcus aureus subsp. aureus Mu50
cgauaaaugua

SEQ ID NO: 3959636 - RNA, 17 nt, Staphylococcus aureus subsp. aureus Mu50
cgauaaauguauuaaac

SEQ ID NO: 3959637 - RNA, 14 nt, Staphylococcus aureus subsp. aureus Mu50
cgauaaauuaacuu

SEQ ID NO: 3959638 - RNA, 17 nt, Staphylococcus aureus subsp. aureus Mu50
cgauaacaauuuauuaa

SEQ ID NO: 3959639 - RNA, 18 nt, Staphylococcus aureus subsp. aureus Mu50
cgauaacaauuuauuaaa

SEQ ID NO: 3959640 - RNA, 14 nt, Staphylococcus aureus subsp. aureus Mu50
cgauaaguucaucg

SEQ ID NO: 3959641 - RNA, 13 nt, Staphylococcus aureus subsp. aureus Mu50
cgauaauaacuag

SEQ ID NO: 3959642 - RNA, 14 nt, Staphylococcus aureus subsp. aureus Mu50
cgauaauaauaaga

SEQ ID NO: 3959643 - RNA, 20 nt, Staphylococcus aureus subsp. aureus Mu50
cgauaauuugagaaaugaaa

SEQ ID NO: 3959644 - RNA, 17 nt, Staphylococcus aureus subsp. aureus Mu50
cgauacaaaggauuauu

SEQ ID NO: 3959645 - RNA, 22 nt, Staphylococcus aureus subsp. aureus Mu50
cgauacaaaggauuauuaacuu

SEQ ID NO: 3959646 - RNA, 17 nt, Staphylococcus aureus subsp. aureus Mu50
cgauaccaaauauauuu

SEQ ID NO: 3959647 - RNA, 16 nt, Staphylococcus aureus subsp. aureus Mu50
cgauaccuuuaauaau

SEQ ID NO: 3959648 - RNA, 17 nt, Staphylococcus aureus subsp. aureus Mu50
cgauacgacuugaaauc

SEQ ID NO: 3959649 - RNA, 20 nt, Staphylococcus aureus subsp. aureus Mu50
cgauacgacuugaaaucuuu

SEQ ID NO: 3959650 - RNA, 21 nt, Staphylococcus aureus subsp. aureus Mu50
cgauagacauugagauaucuu

SEQ ID NO: 3959651 - RNA, 21 nt, Staphylococcus aureus subsp. aureus Mu50
cgauagauuuaucaccuuuag

SEQ ID NO: 3959652 - RNA, 22 nt, Staphylococcus aureus subsp. aureus Mu50
cgauaguucuauauaauuuauu

SEQ ID NO: 3959653 - RNA, 14 nt, Staphylococcus aureus subsp. aureus Mu50
cgauaguuuauuaa

SEQ ID NO: 3959654 - RNA, 19 nt, Staphylococcus aureus subsp. aureus Mu50
cgauauagaccguugaaau

SEQ ID NO: 3959655 - RNA, 16 nt, Staphylococcus aureus subsp. aureus Mu50
cgauauagugcuuguu

SEQ ID NO: 3959656 - RNA, 23 nt, Staphylococcus aureus subsp. aureus Mu50
cgauauagugcuuguuuauuaca

SEQ ID NO: 3959657 - RNA, 20 nt, Staphylococcus aureus subsp. aureus Mu50
cgauaucaauguauuguaau

SEQ ID NO: 3959658 - RNA, 16 nt, Staphylococcus aureus subsp. aureus Mu50
cgauaucuaagucgau

SEQ ID NO: 3959659 - RNA, 22 nt, Staphylococcus aureus subsp. aureus Mu50
cgaucagucucuaaaacuuuuu

SEQ ID NO: 3959660 - RNA, 15 nt, Staphylococcus aureus subsp. aureus Mu50
cgaucaugccuucau

SEQ ID NO: 3959661 - RNA, 18 nt, Staphylococcus aureus subsp. aureus Mu50
cgaucauuagcaauuuca

SEQ ID NO: 3959662 - RNA, 16 nt, Staphylococcus aureus subsp. aureus Mu50
cgaucuaaauauauua

SEQ ID NO: 3959663 - RNA, 16 nt, Staphylococcus aureus subsp. aureus Mu50
cgaucuaacaauugca

SEQ ID NO: 3959664 - RNA, 18 nt, Staphylococcus aureus subsp. aureus Mu50
cgaucuaacaauugcaga

SEQ ID NO: 3959665 - RNA, 22 nt, Staphylococcus aureus subsp. aureus Mu50
cgaucuucaugaacagcaucuu

SEQ ID NO: 3959666 - RNA, 19 nt, Staphylococcus aureus subsp. aureus Mu50
cgaucuuuuuuauuuaauu

SEQ ID NO: 3959667 - RNA, 17 nt, Staphylococcus aureus subsp. aureus Mu50
cgaugaaucccauaaca

SEQ ID NO: 3959668 - RNA, 23 nt, Staphylococcus aureus subsp. aureus Mu50
cgaugaaucccauaacaaucauu

SEQ ID NO: 3959669 - RNA, 21 nt, Staphylococcus aureus subsp. aureus Mu50
cgaugaugauuuauaaaaacu

SEQ ID NO: 3959670 - RNA, 15 nt, Staphylococcus aureus subsp. aureus Mu50
cgaugcuaaaaauau

SEQ ID NO: 3959671 - RNA, 14 nt, Staphylococcus aureus subsp. aureus Mu50
cgaugucagacgaa

SEQ ID NO: 3959672 - RNA, 12 nt, Staphylococcus aureus subsp. aureus Mu50
cgauguccuuua

SEQ ID NO: 3959673 - RNA, 14 nt, Staphylococcus aureus subsp. aureus Mu50
cgauuaaaugaugc

SEQ ID NO: 3959674 - RNA, 19 nt, Staphylococcus aureus subsp. aureus Mu50
cgauuaagaaugcaccaac

SEQ ID NO: 3959675 - RNA, 14 nt, Staphylococcus aureus subsp. aureus Mu50
cgauuaauugaaug

SEQ ID NO: 3959676 - RNA, 14 nt, Staphylococcus aureus subsp. aureus Mu50
cgauuaauuuucuu

SEQ ID NO: 3959677 - RNA, 21 nt, Staphylococcus aureus subsp. aureus Mu50
cgauuaauuuucuuuuuuaau

SEQ ID NO: 3959678 - RNA, 14 nt, Staphylococcus aureus subsp. aureus Mu50
cgauuauucuuaau

SEQ ID NO: 3959679 - RNA, 21 nt, Staphylococcus aureus subsp. aureus Mu50
cgauucauuuaaaaaucaaag

SEQ ID NO: 3959680 - RNA, 15 nt, Staphylococcus aureus subsp. aureus Mu50
cgauucucauuuacu

SEQ ID NO: 3959681 - RNA, 16 nt, Staphylococcus aureus subsp. aureus Mu50
cgauuuaauuaaaaca

SEQ ID NO: 3959682 - RNA, 22 nt, Staphylococcus aureus subsp. aureus Mu50
cgauuucuuuaugauaauaaga

SEQ ID NO: 3959683 - RNA, 20 nt, Staphylococcus aureus subsp. aureus Mu50
cgauuuuaaaagauaaauaa

SEQ ID NO: 3959684 - RNA, 20 nt, Staphylococcus aureus subsp. aureus Mu50
cgauuuuuuuacguaaucua

SEQ ID NO: 3959685 - RNA, 22 nt, Staphylococcus aureus subsp. aureus Mu50
cgcaacaggaccacucaauucu

SEQ ID NO: 3959686 - RNA, 13 nt, Staphylococcus aureus subsp. aureus Mu50
cgcaagagauaag

SEQ ID NO: 3959687 - RNA, 22 nt, Staphylococcus aureus subsp. aureus Mu50
cguaagguauuucauugauaag

SEQ ID NO: 3959688 - RNA, 21 nt, Staphylococcus aureus subsp. aureus Mu50
cguaauguguuaauacuucau

SEQ ID NO: 3959689 - RNA, 23 nt, Staphylococcus aureus subsp. aureus Mu50
cguaauuaauagguuauuugaua

SEQ ID NO: 3959690 - RNA, 17 nt, Staphylococcus aureus subsp. aureus Mu50
cguaauuuaugauuguu

SEQ ID NO: 3959691 - RNA, 18 nt, Staphylococcus aureus subsp. aureus Mu50
cguacaaagguaauagaa

SEQ ID NO: 3959692 - RNA, 18 nt, Staphylococcus aureus subsp. aureus Mu50
cguacgguagucucccau

SEQ ID NO: 3959693 - RNA, 20 nt, Staphylococcus aureus subsp. aureus Mu50
cguacguugauguguugcau

SEQ ID NO: 3959694 - RNA, 20 nt, Staphylococcus aureus subsp. aureus Mu50
cguacuguguaauaccaauu

SEQ ID NO: 3959695 - RNA, 16 nt, Staphylococcus aureus subsp. aureus Mu50
cguagcuuuucauuua

SEQ ID NO: 3959696 - RNA, 14 nt, Staphylococcus aureus subsp. aureus Mu50
cguauaguacuaaa

SEQ ID NO: 3959697 - RNA, 19 nt, Staphylococcus aureus subsp. aureus Mu50
cguauauauauauuaaaac

SEQ ID NO: 3959698 - RNA, 14 nt, Staphylococcus aureus subsp. aureus Mu50
cguaucaagaaaaa

SEQ ID NO: 3959699 - RNA, 14 nt, Staphylococcus aureus subsp. aureus Mu50
cguaucuguuuaug

SEQ ID NO: 3959700 - RNA, 12 nt, Staphylococcus aureus subsp. aureus Mu50
cguauguuucuu

SEQ ID NO: 3959701 - RNA, 18 nt, Staphylococcus aureus subsp. aureus Mu50
cguauuagccaauaaaau

SEQ ID NO: 3959702 - RNA, 17 nt, Staphylococcus aureus subsp. aureus Mu50
cgucacauauaaauauu

SEQ ID NO: 3959703 - RNA, 14 nt, Staphylococcus aureus subsp. aureus Mu50
cgucacucacuuca

SEQ ID NO: 3959704 - RNA, 13 nt, Staphylococcus aureus subsp. aureus Mu50
cgucgugauggcu

SEQ ID NO: 3959705 - RNA, 21 nt, Staphylococcus aureus subsp. aureus Mu50
cgucuauacuccaguuuauaa

SEQ ID NO: 3959706 - RNA, 16 nt, Staphylococcus aureus subsp. aureus Mu50
cgucucaauaucuucg

SEQ ID NO: 3959707 - RNA, 16 nt, Staphylococcus aureus subsp. aureus Mu50
cgucuuaauucuucug

SEQ ID NO: 3959708 - RNA, 17 nt, Staphylococcus aureus subsp. aureus Mu50
cgucuuaauucuucugu

SEQ ID NO: 3959709 - RNA, 15 nt, Staphylococcus aureus subsp. aureus Mu50
cgugaauuaaaaaau

SEQ ID NO: 3959710 - RNA, 18 nt, Staphylococcus aureus subsp. aureus Mu50
cgugauggcuacuuuuuc

SEQ ID NO: 3959711 - RNA, 14 nt, Staphylococcus aureus subsp. aureus Mu50
cgugcaaauaaaaa

SEQ ID NO: 3959712 - RNA, 18 nt, Staphylococcus aureus subsp. aureus Mu50
cgugcaaauaaaaaaguu

SEQ ID NO: 3959713 - RNA, 18 nt, Staphylococcus aureus subsp. aureus Mu50
cgugcauuguaauaccaa

SEQ ID NO: 3959714 - RNA, 20 nt, Staphylococcus aureus subsp. aureus Mu50
cgugcuuuuaaauguauuuu

SEQ ID NO: 3959715 - RNA, 14 nt, Staphylococcus aureus subsp. aureus Mu50
cgugguaugauuuu

SEQ ID NO: 3959716 - RNA, 20 nt, Staphylococcus aureus subsp. aureus Mu50
cguguauacaacauguguau

SEQ ID NO: 3959717 - RNA, 21 nt, Staphylococcus aureus subsp. aureus Mu50
cguguauuauugaaacuaaua

SEQ ID NO: 3959718 - RNA, 17 nt, Staphylococcus aureus subsp. aureus Mu50
cguguguuuucuuuuca

SEQ ID NO: 3959719 - RNA, 20 nt, Staphylococcus aureus subsp. aureus Mu50
cguguuugaauggcaaauau

SEQ ID NO: 3959720 - RNA, 21 nt, Staphylococcus aureus subsp. aureus Mu50
cguguuugaauguuuuugaua

SEQ ID NO: 3959721 - RNA, 17 nt, Staphylococcus aureus subsp. aureus Mu50
cguuaaaucacauauga

SEQ ID NO: 3959722 - RNA, 20 nt, Staphylococcus aureus subsp. aureus Mu50
cguuaacaaucaguaauaau

SEQ ID NO: 3959723 - RNA, 20 nt, Staphylococcus aureus subsp. aureus Mu50
cguuaauaaaccuacaauau

SEQ ID NO: 3959724 - RNA, 19 nt, Staphylococcus aureus subsp. aureus Mu50
cguuaauauaauuaauuuu

SEQ ID NO: 3959725 - RNA, 22 nt, Staphylococcus aureus subsp. aureus Mu50
cguuacuuuggucaacuuuuuc

SEQ ID NO: 3959726 - RNA, 22 nt, Staphylococcus aureus subsp. aureus Mu50
cguuaguauaaacguccaaaca

SEQ ID NO: 3959727 - RNA, 15 nt, Staphylococcus aureus subsp. aureus Mu50
cguuauagauaagua

SEQ ID NO: 3959728 - RNA, 20 nt, Staphylococcus aureus subsp. aureus Mu50
cguuaucuuuaaguaauuca

SEQ ID NO: 3959729 - RNA, 16 nt, Staphylococcus aureus subsp. aureus Mu50
cguuauuuucaauaaa

SEQ ID NO: 3959730 - RNA, 21 nt, Staphylococcus aureus subsp. aureus Mu50
cguuauuuucaauauuugaua

SEQ ID NO: 3959731 - RNA, 22 nt, Staphylococcus aureus subsp. aureus Mu50
cguuauuuuuuuguccaauaaa

SEQ ID NO: 3959732 - RNA, 16 nt, Staphylococcus aureus subsp. aureus Mu50
cguucaaauguugaau

SEQ ID NO: 3959733 - RNA, 17 nt, Staphylococcus aureus subsp. aureus Mu50
cguucaauguuauuaaa

SEQ ID NO: 3959734 - RNA, 19 nt, Staphylococcus aureus subsp. aureus Mu50
cguucauauaugauaaaua

SEQ ID NO: 3959735 - RNA, 15 nt, Staphylococcus aureus subsp. aureus Mu50
cguucccauucuuug

SEQ ID NO: 3959736 - RNA, 19 nt, Staphylococcus aureus subsp. aureus Mu50
cguucgaaguagcuuguuu

SEQ ID NO: 3959737 - RNA, 19 nt, Staphylococcus aureus subsp. aureus Mu50
cguucgugauagaaguuuu

SEQ ID NO: 3959738 - RNA, 14 nt, Staphylococcus aureus subsp. aureus Mu50
cguucucuuaaaua

SEQ ID NO: 3959739 - RNA, 15 nt, Staphylococcus aureus subsp. aureus Mu50
cguucucuuaaauau

SEQ ID NO: 3959740 - RNA, 15 nt, Staphylococcus aureus subsp. aureus Mu50
cguugaccuuguucu

SEQ ID NO: 3959741 - RNA, 18 nt, Staphylococcus aureus subsp. aureus Mu50
cguugcaccuauuuuuug

SEQ ID NO: 3959742 - RNA, 17 nt, Staphylococcus aureus subsp. aureus Mu50
cguugguauucaucuuc

SEQ ID NO: 3959743 - RNA, 19 nt, Staphylococcus aureus subsp. aureus Mu50
cguuuaagaaaucaacaac

SEQ ID NO: 3959744 - RNA, 11 nt, Staphylococcus aureus subsp. aureus Mu50
cguuuaauuua

SEQ ID NO: 3959745 - RNA, 16 nt, Staphylococcus aureus subsp. aureus Mu50
cguuucagaaguuguu

SEQ ID NO: 3959746 - RNA, 19 nt, Staphylococcus aureus subsp. aureus Mu50
cguuucuuuguauaccuau

SEQ ID NO: 3959747 - RNA, 13 nt, Staphylococcus aureus subsp. aureus Mu50
cguuugauuucac

SEQ ID NO: 3959748 - RNA, 12 nt, Staphylococcus aureus subsp. aureus Mu50
cguuuguacucu

SEQ ID NO: 3959749 - RNA, 16 nt, Staphylococcus aureus subsp. aureus Mu50
cguuuguacuucacua

SEQ ID NO: 3959750 - RNA, 12 nt, Staphylococcus aureus subsp. aureus Mu50
cguuuguguguu

SEQ ID NO: 3959751 - RNA, 17 nt, Staphylococcus aureus subsp. aureus Mu50
cguuuguguguuuuaaa

SEQ ID NO: 3959752 - RNA, 18 nt, Staphylococcus aureus subsp. aureus Mu50
cguuuguguguuuuaaaa

SEQ ID NO: 3959753 - RNA, 16 nt, Staphylococcus aureus subsp. aureus Mu50
cguuuuaaauaaauga

SEQ ID NO: 3959754 - RNA, 15 nt, Staphylococcus aureus subsp. aureus Mu50
cguuuuagacauaaa

SEQ ID NO: 3959755 - RNA, 12 nt, Staphylococcus aureus subsp. aureus Mu50
cguuuucaucaa

SEQ ID NO: 3959756 - RNA, 16 nt, Staphylococcus aureus subsp. aureus Mu50
cguuuuccaugaguuu

SEQ ID NO: 3959757 - RNA, 22 nt, Staphylococcus aureus subsp. aureus Mu50
cguuuuucgaacuuuuguucua

SEQ ID NO: 3959758 - RNA, 17 nt, Staphylococcus aureus subsp. aureus Mu50
cguuuuuuuaaauacau

SEQ ID NO: 3959759 - RNA, 13 nt, Staphylococcus aureus subsp. aureus Mu50
cuaaaaaaauuaa

SEQ ID NO: 3959760 - RNA, 12 nt, Staphylococcus aureus subsp. aureus Mu50
cuaaaaaacuaa

SEQ ID NO: 3959761 - RNA, 22 nt, Staphylococcus aureus subsp. aureus Mu50
cuaaaaaaggaagaacagcaca

SEQ ID NO: 3959762 - RNA, 20 nt, Staphylococcus aureus subsp. aureus Mu50
cuaaaaacagcaguaagaca

SEQ ID NO: 3959763 - RNA, 20 nt, Staphylococcus aureus subsp. aureus Mu50
cuaaaaacggacaaguugca

SEQ ID NO: 3959764 - RNA, 14 nt, Staphylococcus aureus subsp. aureus Mu50
cuaaaaauaaaauc

SEQ ID NO: 3959765 - RNA, 19 nt, Staphylococcus aureus subsp. aureus Mu50
cuaaaaaugucguauaugu

SEQ ID NO: 3959766 - RNA, 22 nt, Staphylococcus aureus subsp. aureus Mu50
cuaaaaauucuggauuaaaccc

SEQ ID NO: 3959767 - RNA, 21 nt, Staphylococcus aureus subsp. aureus Mu50
cuaaaacaaauucauauuaac

SEQ ID NO: 3959768 - RNA, 17 nt, Staphylococcus aureus subsp. aureus Mu50
cuaaaacaucacuugcu

SEQ ID NO: 3959769 - RNA, 20 nt, Staphylococcus aureus subsp. aureus Mu50
cuaaaacaugauacgugguu

SEQ ID NO: 3959770 - RNA, 18 nt, Staphylococcus aureus subsp. aureus Mu50
cuaaaacauguugauaaa

SEQ ID NO: 3959771 - RNA, 16 nt, Staphylococcus aureus subsp. aureus Mu50
cuaaaacgauaauaau

SEQ ID NO: 3959772 - RNA, 15 nt, Staphylococcus aureus subsp. aureus Mu50
cuaaaacuuuuucaa

SEQ ID NO: 3959773 - RNA, 18 nt, Staphylococcus aureus subsp. aureus Mu50
cuaaaaguaugaguuauu

SEQ ID NO: 3959774 - RNA, 18 nt, Staphylococcus aureus subsp. aureus Mu50
cuaaaaguguuaugaauu

SEQ ID NO: 3959775 - RNA, 21 nt, Staphylococcus aureus subsp. aureus Mu50
cuaauaugucuagacuuauuu

SEQ ID NO: 3959776 - RNA, 24 nt, Staphylococcus aureus subsp. aureus Mu50
cuaauauuagauaucuuaaucuaa

SEQ ID NO: 3959777 - RNA, 15 nt, Staphylococcus aureus subsp. aureus Mu50
cuaauauuucuuaga

SEQ ID NO: 3959778 - RNA, 15 nt, Staphylococcus aureus subsp. aureus Mu50
cuaauauuuuaaacg

SEQ ID NO: 3959779 - RNA, 16 nt, Staphylococcus aureus subsp. aureus Mu50
cuaauauuuuaaacgu

SEQ ID NO: 3959780 - RNA, 21 nt, Staphylococcus aureus subsp. aureus Mu50
cuaaucaaauuagucauccaa

SEQ ID NO: 3959781 - RNA, 21 nt, Staphylococcus aureus subsp. aureus Mu50
cuaaucacuuggcguaaaauc

SEQ ID NO: 3959782 - RNA, 19 nt, Staphylococcus aureus subsp. aureus Mu50
cuaaucaugaaguugguuu

SEQ ID NO: 3959783 - RNA, 17 nt, Staphylococcus aureus subsp. aureus Mu50
cuaaucguguauuauug

SEQ ID NO: 3959784 - RNA, 22 nt, Staphylococcus aureus subsp. aureus Mu50
cuaaucguguauuauugaaacu

SEQ ID NO: 3959785 - RNA, 21 nt, Staphylococcus aureus subsp. aureus Mu50
cuaaucguuaauaaaccuaca

SEQ ID NO: 3959786 - RNA, 22 nt, Staphylococcus aureus subsp. aureus Mu50
cuaaucguuccaacaacuaaga

SEQ ID NO: 3959787 - RNA, 16 nt, Staphylococcus aureus subsp. aureus Mu50
cuaaucuauuuagcuu

SEQ ID NO: 3959788 - RNA, 19 nt, Staphylococcus aureus subsp. aureus Mu50
cuaaucugcaacgauuuua

SEQ ID NO: 3959789 - RNA, 16 nt, Staphylococcus aureus subsp. aureus Mu50
cuaaucuuaauugucu

SEQ ID NO: 3959790 - RNA, 18 nt, Staphylococcus aureus subsp. aureus Mu50
cuaaucuuaguuaaaauu

SEQ ID NO: 3959791 - RNA, 19 nt, Staphylococcus aureus subsp. aureus Mu50
cuaaucuuaguuaaaauuc

SEQ ID NO: 3959792 - RNA, 17 nt, Staphylococcus aureus subsp. aureus Mu50
cuaaucuuuuuuuaauu

SEQ ID NO: 3959793 - RNA, 18 nt, Staphylococcus aureus subsp. aureus Mu50
cuaaucuuuuuuuaauua

SEQ ID NO: 3959794 - RNA, 22 nt, Staphylococcus aureus subsp. aureus Mu50
cuaaugauuaaaaaucaaagag

SEQ ID NO: 3959795 - RNA, 14 nt, Staphylococcus aureus subsp. aureus Mu50
cuaaugauuuauua

SEQ ID NO: 3959796 - RNA, 15 nt, Staphylococcus aureus subsp. aureus Mu50
cuaaugcuaauuuaa

SEQ ID NO: 3959797 - RNA, 14 nt, Staphylococcus aureus subsp. aureus Mu50
cuaaugcuauauua

SEQ ID NO: 3959798 - RNA, 16 nt, Staphylococcus aureus subsp. aureus Mu50
cuaauggcacuuaaua

SEQ ID NO: 3959799 - RNA, 18 nt, Staphylococcus aureus subsp. aureus Mu50
cuaaugguuucauaaacu

SEQ ID NO: 3959800 - RNA, 20 nt, Staphylococcus aureus subsp. aureus Mu50
cuaauguguacuuaaaaaua

SEQ ID NO: 3959801 - RNA, 21 nt, Staphylococcus aureus subsp. aureus Mu50
cuaauguguacuuaaaaauag

SEQ ID NO: 3959802 - RNA, 14 nt, Staphylococcus aureus subsp. aureus Mu50
cuaauguuaaaaua

SEQ ID NO: 3959803 - RNA, 20 nt, Staphylococcus aureus subsp. aureus Mu50
cuaauguuaaaauaacugcu

SEQ ID NO: 3959804 - RNA, 21 nt, Staphylococcus aureus subsp. aureus Mu50
cuaauuaagaaugccauaccu

SEQ ID NO: 3959805 - RNA, 20 nt, Staphylococcus aureus subsp. aureus Mu50
cuaauuaguugguaucgauu

SEQ ID NO: 3959806 - RNA, 13 nt, Staphylococcus aureus subsp. aureus Mu50
cuaauuauauuaa

SEQ ID NO: 3959807 - RNA, 15 nt, Staphylococcus aureus subsp. aureus Mu50
cuaauucaagaacag

SEQ ID NO: 3959808 - RNA, 15 nt, Staphylococcus aureus subsp. aureus Mu50
cuaauucaauaccua

SEQ ID NO: 3959809 - RNA, 20 nt, Staphylococcus aureus subsp. aureus Mu50
cuaauucuguuucaaagcug

SEQ ID NO: 3959810 - RNA, 23 nt, Staphylococcus aureus subsp. aureus Mu50
cuaauugaaggccauuuuuauuu

SEQ ID NO: 3959811 - RNA, 16 nt, Staphylococcus aureus subsp. aureus Mu50
cuaauugagagaaguu

SEQ ID NO: 3959812 - RNA, 18 nt, Staphylococcus aureus subsp. aureus Mu50
cuaauuuacguacuucau

SEQ ID NO: 3959813 - RNA, 20 nt, Staphylococcus aureus subsp. aureus Mu50
cuaauuuaguaucuauacaa

SEQ ID NO: 3959814 - RNA, 22 nt, Staphylococcus aureus subsp. aureus Mu50
cuaauuuaguaucuauacaauu

SEQ ID NO: 3959815 - RNA, 18 nt, Staphylococcus aureus subsp. aureus Mu50
cuaauuucuauagaaaaa

SEQ ID NO: 3959816 - RNA, 16 nt, Staphylococcus aureus subsp. aureus Mu50
cuaauuugcaaaauca

SEQ ID NO: 3959817 - RNA, 12 nt, Staphylococcus aureus subsp. aureus Mu50
cuaauuuuaauu

SEQ ID NO: 3959818 - RNA, 17 nt, Staphylococcus aureus subsp. aureus Mu50
cuaauuuuaauuuucag

SEQ ID NO: 3959819 - RNA, 18 nt, Staphylococcus aureus subsp. aureus Mu50
cuaauuuuaauuuucaga

SEQ ID NO: 3959820 - RNA, 20 nt, Staphylococcus aureus subsp. aureus Mu50
cuaauuuugugaauuuauuu

SEQ ID NO: 3959821 - RNA, 23 nt, Staphylococcus aureus subsp. aureus Mu50
cuacaacgaagaauccuaugcca

SEQ ID NO: 3959822 - RNA, 23 nt, Staphylococcus aureus subsp. aureus Mu50
cuacaacuucuucuccguauuua

SEQ ID NO: 3959823 - RNA, 19 nt, Staphylococcus aureus subsp. aureus Mu50
cuacaauauuaaaauuaaa

SEQ ID NO: 3959824 - RNA, 20 nt, Staphylococcus aureus subsp. aureus Mu50
cuacaauauucaauaauuca

SEQ ID NO: 3959825 - RNA, 19 nt, Staphylococcus aureus subsp. aureus Mu50
cuacaaucauaccggcaaa

SEQ ID NO: 3959826 - RNA, 13 nt, Staphylococcus aureus subsp. aureus Mu50
cuacaauccuaug

SEQ ID NO: 3959827 - RNA, 15 nt, Staphylococcus aureus subsp. aureus Mu50
cuacaauuaaaguga

SEQ ID NO: 3959828 - RNA, 21 nt, Staphylococcus aureus subsp. aureus Mu50
cuacaauuauaaaugauuaaa

SEQ ID NO: 3959829 - RNA, 14 nt, Staphylococcus aureus subsp. aureus Mu50
cuacaauuauaugu

SEQ ID NO: 3959830 - RNA, 16 nt, Staphylococcus aureus subsp. aureus Mu50
cuacaauuuucucauu

SEQ ID NO: 3959831 - RNA, 12 nt, Staphylococcus aureus subsp. aureus Mu50
cuacacccauuu

SEQ ID NO: 3959832 - RNA, 19 nt, Staphylococcus aureus subsp. aureus Mu50
cuacacgaguauuaucaca

SEQ ID NO: 3959833 - RNA, 15 nt, Staphylococcus aureus subsp. aureus Mu50
cuacacggucccaag

SEQ ID NO: 3959834 - RNA, 18 nt, Staphylococcus aureus subsp. aureus Mu50
cuacacucaaacaagauu

SEQ ID NO: 3959835 - RNA, 17 nt, Staphylococcus aureus subsp. aureus Mu50
cuacacuccccuuauca

SEQ ID NO: 3959836 - RNA, 14 nt, Staphylococcus aureus subsp. aureus Mu50
cuacacuguuuuau

SEQ ID NO: 3959837 - RNA, 14 nt, Staphylococcus aureus subsp. aureus Mu50
cuacacuuaauaua

SEQ ID NO: 3959838 - RNA, 22 nt, Staphylococcus aureus subsp. aureus Mu50
cuacacuuggcuuaggaugaaa

SEQ ID NO: 3959839 - RNA, 23 nt, Staphylococcus aureus subsp. aureus Mu50
cuacagaauggauaccuaaagcu

SEQ ID NO: 3959840 - RNA, 20 nt, Staphylococcus aureus subsp. aureus Mu50
cuacagauuuuaaaaauuca

SEQ ID NO: 3959841 - RNA, 17 nt, Staphylococcus aureus subsp. aureus Mu50
cuacagguaaugcaagu

SEQ ID NO: 3959842 - RNA, 13 nt, Staphylococcus aureus subsp. aureus Mu50
cuacaguaaauug

SEQ ID NO: 3959843 - RNA, 19 nt, Staphylococcus aureus subsp. aureus Mu50
cuacaguaaauugauucuu

SEQ ID NO: 3959844 - RNA, 21 nt, Staphylococcus aureus subsp. aureus Mu50
cuacaguaaauugauucuuug

SEQ ID NO: 3959845 - RNA, 20 nt, Staphylococcus aureus subsp. aureus Mu50
cuacaguuuuaugaauauca

SEQ ID NO: 3959846 - RNA, 19 nt, Staphylococcus aureus subsp. aureus Mu50
cuacauaauuuaucaauuu

SEQ ID NO: 3959847 - RNA, 23 nt, Staphylococcus aureus subsp. aureus Mu50
cuacauaauuuaucaauuucuau

SEQ ID NO: 3959848 - RNA, 15 nt, Staphylococcus aureus subsp. aureus Mu50
cuacauauuggcuug

SEQ ID NO: 3959849 - RNA, 16 nt, Staphylococcus aureus subsp. aureus Mu50
cuacaugaaucaacaa

SEQ ID NO: 3959850 - RNA, 16 nt, Staphylococcus aureus subsp. aureus Mu50
cuacauuaaagaaaau

SEQ ID NO: 3959851 - RNA, 22 nt, Staphylococcus aureus subsp. aureus Mu50
cuacauuauauugagacaacau

SEQ ID NO: 3959852 - RNA, 23 nt, Staphylococcus aureus subsp. aureus Mu50
cuaccaauacguuuccaaucuau

SEQ ID NO: 3959853 - RNA, 13 nt, Staphylococcus aureus subsp. aureus Mu50
cuacccuauuuua

SEQ ID NO: 3959854 - RNA, 14 nt, Staphylococcus aureus subsp. aureus Mu50
cuacccuauuuuac

SEQ ID NO: 3959855 - RNA, 18 nt, Staphylococcus aureus subsp. aureus Mu50
cuacccuugcaaauauau

SEQ ID NO: 3959856 - RNA, 18 nt, Staphylococcus aureus subsp. aureus Mu50
cuaccgauuguuaauuua

SEQ ID NO: 3959857 - RNA, 15 nt, Staphylococcus aureus subsp. aureus Mu50
cuaccuguuggcuuu

SEQ ID NO: 3959858 - RNA, 15 nt, Staphylococcus aureus subsp. aureus Mu50
cuacgaucaaaauca

SEQ ID NO: 3959859 - RNA, 12 nt, Staphylococcus aureus subsp. aureus Mu50
cuacgcauuuua

SEQ ID NO: 3959860 - RNA, 15 nt, Staphylococcus aureus subsp. aureus Mu50
cuacgcccaucauca

SEQ ID NO: 3959861 - RNA, 17 nt, Staphylococcus aureus subsp. aureus Mu50
cuacgcugaugaaugau

SEQ ID NO: 3959862 - RNA, 19 nt, Staphylococcus aureus subsp. aureus Mu50
cuauauaugaauugaguau

SEQ ID NO: 3959863 - RNA, 20 nt, Staphylococcus aureus subsp. aureus Mu50
cuauauaugaauugaguauu

SEQ ID NO: 3959864 - RNA, 11 nt, Staphylococcus aureus subsp. aureus Mu50
cuauaugcaua

SEQ ID NO: 3959865 - RNA, 17 nt, Staphylococcus aureus subsp. aureus Mu50
cuauauugugcuaaguu

SEQ ID NO: 3959866 - RNA, 15 nt, Staphylococcus aureus subsp. aureus Mu50
cuauauuuguuuguu

SEQ ID NO: 3959867 - RNA, 18 nt, Staphylococcus aureus subsp. aureus Mu50
cuauauuuuuguauuuau

SEQ ID NO: 3959868 - RNA, 17 nt, Staphylococcus aureus subsp. aureus Mu50
cuauauuuuuuuacuuu

SEQ ID NO: 3959869 - RNA, 12 nt, Staphylococcus aureus subsp. aureus Mu50
cuaucaaauaau

SEQ ID NO: 3959870 - RNA, 14 nt, Staphylococcus aureus subsp. aureus Mu50
cuaucaacgauuga

SEQ ID NO: 3959871 - RNA, 18 nt, Staphylococcus aureus subsp. aureus Mu50
cuaucaauauaauuuggu

SEQ ID NO: 3959872 - RNA, 14 nt, Staphylococcus aureus subsp. aureus Mu50
cuaucaaugacauc

SEQ ID NO: 3959873 - RNA, 17 nt, Staphylococcus aureus subsp. aureus Mu50
cuaucaaugacauccau

SEQ ID NO: 3959874 - RNA, 17 nt, Staphylococcus aureus subsp. aureus Mu50
cuauccauguauuuuuc

SEQ ID NO: 3959875 - RNA, 17 nt, Staphylococcus aureus subsp. aureus Mu50
cuaucccuguaaaacca

SEQ ID NO: 3959876 - RNA, 19 nt, Staphylococcus aureus subsp. aureus Mu50
cuauccuaagcauaauuca

SEQ ID NO: 3959877 - RNA, 15 nt, Staphylococcus aureus subsp. aureus Mu50
cuaucgauacuaaac

SEQ ID NO: 3959878 - RNA, 16 nt, Staphylococcus aureus subsp. aureus Mu50
cuaucgccuaaaaaua

SEQ ID NO: 3959879 - RNA, 17 nt, Staphylococcus aureus subsp. aureus Mu50
cuaucgccuaaaaauaa

SEQ ID NO: 3959880 - RNA, 18 nt, Staphylococcus aureus subsp. aureus Mu50
cuaucgccuaaaaauaaa

SEQ ID NO: 3959881 - RNA, 21 nt, Staphylococcus aureus subsp. aureus Mu50
cuaucgccuaaaaauaaaauc

SEQ ID NO: 3959882 - RNA, 22 nt, Staphylococcus aureus subsp. aureus Mu50
cuaucgccuaaaaauaaaauca

SEQ ID NO: 3959883 - RNA, 16 nt, Staphylococcus aureus subsp. aureus Mu50
cuaucguaaacaacau

SEQ ID NO: 3959884 - RNA, 21 nt, Staphylococcus aureus subsp. aureus Mu50
cuaucguuuauugauagucac

SEQ ID NO: 3959885 - RNA, 18 nt, Staphylococcus aureus subsp. aureus Mu50
cuaucuacucaaauauaa

SEQ ID NO: 3959886 - RNA, 22 nt, Staphylococcus aureus subsp. aureus Mu50
cuaucuccgcuacaauuauaug

SEQ ID NO: 3959887 - RNA, 24 nt, Staphylococcus aureus subsp. aureus Mu50
cuaucuccgcuacaauuauaugua

SEQ ID NO: 3959888 - RNA, 14 nt, Staphylococcus aureus subsp. aureus Mu50
cuaucucuuuaguu

SEQ ID NO: 3959889 - RNA, 21 nt, Staphylococcus aureus subsp. aureus Mu50
cuaucuguaccguauuuuaau

SEQ ID NO: 3959890 - RNA, 14 nt, Staphylococcus aureus subsp. aureus Mu50
cuaucuucagauuc

SEQ ID NO: 3959891 - RNA, 15 nt, Staphylococcus aureus subsp. aureus Mu50
cuaugaaauuuuuua

SEQ ID NO: 3959892 - RNA, 19 nt, Staphylococcus aureus subsp. aureus Mu50
cuaugaauuuagcaucaaa

SEQ ID NO: 3959893 - RNA, 11 nt, Staphylococcus aureus subsp. aureus Mu50
cuaugauauau

SEQ ID NO: 3959894 - RNA, 21 nt, Staphylococcus aureus subsp. aureus Mu50
cuaugauauauguaacauaaa

SEQ ID NO: 3959895 - RNA, 16 nt, Staphylococcus aureus subsp. aureus Mu50
cuaugcauaauaccaa

SEQ ID NO: 3959896 - RNA, 23 nt, Staphylococcus aureus subsp. aureus Mu50
cuaugcuuagcgaacgcuagcau

SEQ ID NO: 3959897 - RNA, 16 nt, Staphylococcus aureus subsp. aureus Mu50
cuauggcacaaaugaa

SEQ ID NO: 3959898 - RNA, 13 nt, Staphylococcus aureus subsp. aureus Mu50
cuauggucaucaa

SEQ ID NO: 3959899 - RNA, 13 nt, Staphylococcus aureus subsp. aureus Mu50
cuauguaaaauua

SEQ ID NO: 3959900 - RNA, 13 nt, Staphylococcus aureus subsp. aureus Mu50
cuauguaacuuua

SEQ ID NO: 3959901 - RNA, 20 nt, Staphylococcus aureus subsp. aureus Mu50
cuauguauuuuucuuaauua

SEQ ID NO: 3959902 - RNA, 12 nt, Staphylococcus aureus subsp. aureus Mu50
cuauguggcuac

SEQ ID NO: 3959903 - RNA, 13 nt, Staphylococcus aureus subsp. aureus Mu50
cuauuaaaaaaaa

SEQ ID NO: 3959904 - RNA, 13 nt, Staphylococcus aureus subsp. aureus Mu50
cuauuaaaggaaa

SEQ ID NO: 3959905 - RNA, 18 nt, Staphylococcus aureus subsp. aureus Mu50
cuauuaaaggaaaucaau

SEQ ID NO: 3959906 - RNA, 21 nt, Staphylococcus aureus subsp. aureus Mu50
cuauuaaaggaaaucaaucca

SEQ ID NO: 3959907 - RNA, 20 nt, Staphylococcus aureus subsp. aureus Mu50
cuauuaacugaccuaacaau

SEQ ID NO: 3959908 - RNA, 17 nt, Staphylococcus aureus subsp. aureus Mu50
cuauuaagaaauacuca

SEQ ID NO: 3959909 - RNA, 20 nt, Staphylococcus aureus subsp. aureus Mu50
cuauuaauaucauaguuguc

SEQ ID NO: 3959910 - RNA, 14 nt, Staphylococcus aureus subsp. aureus Mu50
cuauuaaugcucua

SEQ ID NO: 3959911 - RNA, 14 nt, Staphylococcus aureus subsp. aureus Mu50
cuauuaauuuacuc

SEQ ID NO: 3959912 - RNA, 11 nt, Staphylococcus aureus subsp. aureus Mu50
cuauuaauuug

SEQ ID NO: 3959913 - RNA, 22 nt, Staphylococcus aureus subsp. aureus Mu50
cuauuacuacauaauuuaucaa

SEQ ID NO: 3959914 - RNA, 15 nt, Staphylococcus aureus subsp. aureus Mu50
cuauuacuauaaaaa

SEQ ID NO: 3959915 - RNA, 20 nt, Staphylococcus aureus subsp. aureus Mu50
cuauuagauacauauaagaa

SEQ ID NO: 3959916 - RNA, 13 nt, Staphylococcus aureus subsp. aureus Mu50
cuauuauauugaa

SEQ ID NO: 3959917 - RNA, 11 nt, Staphylococcus aureus subsp. aureus Mu50
cuauucaacug

SEQ ID NO: 3959918 - RNA, 15 nt, Staphylococcus aureus subsp. aureus Mu50
cuauucaauugcuau

SEQ ID NO: 3959919 - RNA, 22 nt, Staphylococcus aureus subsp. aureus Mu50
cuauucccaaaaugauugccac

SEQ ID NO: 3959920 - RNA, 14 nt, Staphylococcus aureus subsp. aureus Mu50
cuauuccuaauaaa

SEQ ID NO: 3959921 - RNA, 21 nt, Staphylococcus aureus subsp. aureus Mu50
cuauugauauucuaaaaaauu

SEQ ID NO: 3959922 - RNA, 23 nt, Staphylococcus aureus subsp. aureus Mu50
cuauugauauucuaaaaaauuaa

SEQ ID NO: 3959923 - RNA, 20 nt, Staphylococcus aureus subsp. aureus Mu50
cuauugcagaagaaaacuau

SEQ ID NO: 3959924 - RNA, 14 nt, Staphylococcus aureus subsp. aureus Mu50
cuauuguaagcuga

SEQ ID NO: 3959925 - RNA, 19 nt, Staphylococcus aureus subsp. aureus Mu50
cuauugugauauaugaaau

SEQ ID NO: 3959926 - RNA, 16 nt, Staphylococcus aureus subsp. aureus Mu50
cuauuuaaaagacaau

SEQ ID NO: 3959927 - RNA, 12 nt, Staphylococcus aureus subsp. aureus Mu50
cuauuuaauaau

SEQ ID NO: 3959928 - RNA, 20 nt, Staphylococcus aureus subsp. aureus Mu50
cuauuuagcuugcuuacaau

SEQ ID NO: 3959929 - RNA, 22 nt, Staphylococcus aureus subsp. aureus Mu50
cuauuucaacaaacauaaauaa

SEQ ID NO: 3959930 - RNA, 12 nt, Staphylococcus aureus subsp. aureus Mu50
cuauuugauaag

SEQ ID NO: 3959931 - RNA, 17 nt, Staphylococcus aureus subsp. aureus Mu50
cuauuuguggaaauaaa

SEQ ID NO: 3959932 - RNA, 21 nt, Staphylococcus aureus subsp. aureus Mu50
cuauuuguggaaauaaaacaa

SEQ ID NO: 3959933 - RNA, 13 nt, Staphylococcus aureus subsp. aureus Mu50
cuauuuuaaauua

SEQ ID NO: 3959934 - RNA, 16 nt, Staphylococcus aureus subsp. aureus Mu50
cuauuuuugauuuaau

SEQ ID NO: 3959935 - RNA, 17 nt, Staphylococcus aureus subsp. aureus Mu50
cuauuuuuugagcacuu

SEQ ID NO: 3959936 - RNA, 16 nt, Staphylococcus aureus subsp. aureus Mu50
cucaaaaagccaacac

SEQ ID NO: 3959937 - RNA, 15 nt, Staphylococcus aureus subsp. aureus Mu50
cucaaaacaauuuaa

SEQ ID NO: 3959938 - RNA, 14 nt, Staphylococcus aureus subsp. aureus Mu50
cucaaaauguuuaa

SEQ ID NO: 3959939 - RNA, 18 nt, Staphylococcus aureus subsp. aureus Mu50
cucaaagguuuacuauua

SEQ ID NO: 3959940 - RNA, 19 nt, Staphylococcus aureus subsp. aureus Mu50
cucaaagguuuacuauuaa

SEQ ID NO: 3959941 - RNA, 12 nt, Staphylococcus aureus subsp. aureus Mu50
cucaacauuuug

SEQ ID NO: 3959942 - RNA, 18 nt, Staphylococcus aureus subsp. aureus Mu50
cucaacgggaacaucaua

SEQ ID NO: 3959943 - RNA, 15 nt, Staphylococcus aureus subsp. aureus Mu50
cucaacuuaaauauc

SEQ ID NO: 3959944 - RNA, 15 nt, Staphylococcus aureus subsp. aureus Mu50
cucaagauauccauu

SEQ ID NO: 3959945 - RNA, 17 nt, Staphylococcus aureus subsp. aureus Mu50
cucaagugaaucuaacu

SEQ ID NO: 3959946 - RNA, 23 nt, Staphylococcus aureus subsp. aureus Mu50
cucaauccugauuccacuacaau

SEQ ID NO: 3959947 - RNA, 15 nt, Staphylococcus aureus subsp. aureus Mu50
cucaaugaauuuacu

SEQ ID NO: 3959948 - RNA, 16 nt, Staphylococcus aureus subsp. aureus Mu50
cucaaugcauuuaauu

SEQ ID NO: 3959949 - RNA, 22 nt, Staphylococcus aureus subsp. aureus Mu50
cucaauuaauuuagucauuaca

SEQ ID NO: 3959950 - RNA, 21 nt, Staphylococcus aureus subsp. aureus Mu50
cucuucaaaguagauauugaa

SEQ ID NO: 3959951 - RNA, 11 nt, Staphylococcus aureus subsp. aureus Mu50
cucuucaaucu

SEQ ID NO: 3959952 - RNA, 14 nt, Staphylococcus aureus subsp. aureus Mu50
cucuucguuuuaau

SEQ ID NO: 3959953 - RNA, 17 nt, Staphylococcus aureus subsp. aureus Mu50
cucuucguuuuaauaaa

SEQ ID NO: 3959954 - RNA, 19 nt, Staphylococcus aureus subsp. aureus Mu50
cucuucuuaucuuuuuacu

SEQ ID NO: 3959955 - RNA, 14 nt, Staphylococcus aureus subsp. aureus Mu50
cucuugcaauagca

SEQ ID NO: 3959956 - RNA, 15 nt, Staphylococcus aureus subsp. aureus Mu50
cucuugucauuucaa

SEQ ID NO: 3959957 - RNA, 12 nt, Staphylococcus aureus subsp. aureus Mu50
cucuuuaaacuc

SEQ ID NO: 3959958 - RNA, 14 nt, Staphylococcus aureus subsp. aureus Mu50
cucuuucaagaccu

SEQ ID NO: 3959959 - RNA, 19 nt, Staphylococcus aureus subsp. aureus Mu50
cucuuuccacugcaacauu

SEQ ID NO: 3959960 - RNA, 23 nt, Staphylococcus aureus subsp. aureus Mu50
cucuuugaagggguuuuuucuua

SEQ ID NO: 3959961 - RNA, 23 nt, Staphylococcus aureus subsp. aureus Mu50
cucuuuguuggggcccacacccc

SEQ ID NO: 3959962 - RNA, 16 nt, Staphylococcus aureus subsp. aureus Mu50
cucuuuuugauuauau

SEQ ID NO: 3959963 - RNA, 18 nt, Staphylococcus aureus subsp. aureus Mu50
cucuuuuuguuuaucuga

SEQ ID NO: 3959964 - RNA, 20 nt, Staphylococcus aureus subsp. aureus Mu50
cucuuuuuuauguacuacau

SEQ ID NO: 3959965 - RNA, 16 nt, Staphylococcus aureus subsp. aureus Mu50
cugaaaagccuacuuu

SEQ ID NO: 3959966 - RNA, 16 nt, Staphylococcus aureus subsp. aureus Mu50
cugaaaaucaucauua

SEQ ID NO: 3959967 - RNA, 15 nt, Staphylococcus aureus subsp. aureus Mu50
cugaaacaaauuagu

SEQ ID NO: 3959968 - RNA, 19 nt, Staphylococcus aureus subsp. aureus Mu50
cugaaacgccucaacacuu

SEQ ID NO: 3959969 - RNA, 20 nt, Staphylococcus aureus subsp. aureus Mu50
cugaaacgccucaacacuuu

SEQ ID NO: 3959970 - RNA, 15 nt, Staphylococcus aureus subsp. aureus Mu50
cugaaacuaaauuaa

SEQ ID NO: 3959971 - RNA, 13 nt, Staphylococcus aureus subsp. aureus Mu50
cugaaacuuuaau

SEQ ID NO: 3959972 - RNA, 16 nt, Staphylococcus aureus subsp. aureus Mu50
cugaaacuuuaauacu

SEQ ID NO: 3959973 - RNA, 17 nt, Staphylococcus aureus subsp. aureus Mu50
cugaaacuuuaauacua

SEQ ID NO: 3959974 - RNA, 18 nt, Staphylococcus aureus subsp. aureus Mu50
cugaaaucaguuuuugaa

SEQ ID NO: 3959975 - RNA, 16 nt, Staphylococcus aureus subsp. aureus Mu50
cugaaaucuagaccuu

SEQ ID NO: 3959976 - RNA, 17 nt, Staphylococcus aureus subsp. aureus Mu50
cugaaaugauacauuau

SEQ ID NO: 3959977 - RNA, 19 nt, Staphylococcus aureus subsp. aureus Mu50
cugaaauuucauaaaguuu

SEQ ID NO: 3959978 - RNA, 14 nt, Staphylococcus aureus subsp. aureus Mu50
cugaaauuuuuccg

SEQ ID NO: 3959979 - RNA, 15 nt, Staphylococcus aureus subsp. aureus Mu50
cugaaauuuuuuagu

SEQ ID NO: 3959980 - RNA, 21 nt, Staphylococcus aureus subsp. aureus Mu50
cugaacgaaaauucgcuugua

SEQ ID NO: 3959981 - RNA, 22 nt, Staphylococcus aureus subsp. aureus Mu50
cugaagggaucggucuugaaaa

SEQ ID NO: 3959982 - RNA, 21 nt, Staphylococcus aureus subsp. aureus Mu50
cugaagguaauuuaacauuuu

SEQ ID NO: 3959983 - RNA, 22 nt, Staphylococcus aureus subsp. aureus Mu50
cugaaguuaucggcuaaaguua

SEQ ID NO: 3959984 - RNA, 21 nt, Staphylococcus aureus subsp. aureus Mu50
cugaauaaauaacuucguuuu

SEQ ID NO: 3959985 - RNA, 18 nt, Staphylococcus aureus subsp. aureus Mu50
cugaaucugcuaauuuau

SEQ ID NO: 3959986 - RNA, 17 nt, Staphylococcus aureus subsp. aureus Mu50
cugaaugcuaauacuaa

SEQ ID NO: 3959987 - RNA, 23 nt, Staphylococcus aureus subsp. aureus Mu50
cugaauuaaagcaucgaacaauc

SEQ ID NO: 3959988 - RNA, 11 nt, Staphylococcus aureus subsp. aureus Mu50
cugaauuuagg

SEQ ID NO: 3959989 - RNA, 12 nt, Staphylococcus aureus subsp. aureus Mu50
cugaauuuuacu

SEQ ID NO: 3959990 - RNA, 21 nt, Staphylococcus aureus subsp. aureus Mu50
cugacauuguugcuaaucuca

SEQ ID NO: 3959991 - RNA, 17 nt, Staphylococcus aureus subsp. aureus Mu50
cugacauuuuuggcuua

SEQ ID NO: 3959992 - RNA, 18 nt, Staphylococcus aureus subsp. aureus Mu50
cugaccuaacaauuugag

SEQ ID NO: 3959993 - RNA, 22 nt, Staphylococcus aureus subsp. aureus Mu50
cugacucguugaccuuguucuu

SEQ ID NO: 3959994 - RNA, 12 nt, Staphylococcus aureus subsp. aureus Mu50
cugacuuuccac

SEQ ID NO: 3959995 - RNA, 13 nt, Staphylococcus aureus subsp. aureus Mu50
cugagauugagaa

SEQ ID NO: 3959996 - RNA, 18 nt, Staphylococcus aureus subsp. aureus Mu50
cugagauugagaauucag

SEQ ID NO: 3959997 - RNA, 15 nt, Staphylococcus aureus subsp. aureus Mu50
cugagcuuuaauuuu

SEQ ID NO: 3959998 - RNA, 18 nt, Staphylococcus aureus subsp. aureus Mu50
cugaguucaauuaaauua

SEQ ID NO: 3959999 - RNA, 14 nt, Staphylococcus aureus subsp. aureus Mu50
cugauaaaugaauu

SEQ ID NO: 3960000 - RNA, 19 nt, Staphylococcus aureus subsp. aureus Mu50
cugauaaaugaauugucuu

SEQ ID NO: 3960001 - RNA, 18 nt, Staphylococcus aureus subsp. aureus Mu50
cugauaauacuguuuaaa

SEQ ID NO: 3960002 - RNA, 22 nt, Staphylococcus aureus subsp. aureus Mu50
cugauaauacuguuuaaauaaa

SEQ ID NO: 3960003 - RNA, 14 nt, Staphylococcus aureus subsp. aureus Mu50
cugauaaugcaugu

SEQ ID NO: 3960004 - RNA, 22 nt, Staphylococcus aureus subsp. aureus Mu50
cugauaauuuuucuucuuuuuu

SEQ ID NO: 3960005 - RNA, 17 nt, Staphylococcus aureus subsp. aureus Mu50
cugauacagaaccaaca

SEQ ID NO: 3960006 - RNA, 22 nt, Staphylococcus aureus subsp. aureus Mu50
cugauacagaaccaacaauaaa

SEQ ID NO: 3960007 - RNA, 22 nt, Staphylococcus aureus subsp. aureus Mu50
cugauauugaucugauuucacu

SEQ ID NO: 3960008 - RNA, 21 nt, Staphylococcus aureus subsp. aureus Mu50
cugaucauuuucauuuaaucc

SEQ ID NO: 3960009 - RNA, 15 nt, Staphylococcus aureus subsp. aureus Mu50
cugaucguaacauua

SEQ ID NO: 3960010 - RNA, 16 nt, Staphylococcus aureus subsp. aureus Mu50
cugaugaacauaccug

SEQ ID NO: 3960011 - RNA, 21 nt, Staphylococcus aureus subsp. aureus Mu50
cugaugaggcaauauuaaaau

SEQ ID NO: 3960012 - RNA, 23 nt, Staphylococcus aureus subsp. aureus Mu50
cugaugcuagcuuucuuuuucau

SEQ ID NO: 3960013 - RNA, 22 nt, Staphylococcus aureus subsp. aureus Mu50
cugaugcuucgaauuuaacauc

SEQ ID NO: 3960014 - RNA, 21 nt, Staphylococcus aureus subsp. aureus Mu50
cugauguguuauguuagauga

SEQ ID NO: 3960015 - RNA, 16 nt, Staphylococcus aureus subsp. aureus Mu50
cugauuaauuauugag

SEQ ID NO: 3960016 - RNA, 13 nt, Staphylococcus aureus subsp. aureus Mu50
cugauucauuaaa

SEQ ID NO: 3960017 - RNA, 19 nt, Staphylococcus aureus subsp. aureus Mu50
cugauucuucacuaaaaau

SEQ ID NO: 3960018 - RNA, 23 nt, Staphylococcus aureus subsp. aureus Mu50
cugauugaauguuugguaacacu

SEQ ID NO: 3960019 - RNA, 23 nt, Staphylococcus aureus subsp. aureus Mu50
cugauugcugcuguacaauuucg

SEQ ID NO: 3960020 - RNA, 19 nt, Staphylococcus aureus subsp. aureus Mu50
cugauugggcugauaauaa

SEQ ID NO: 3960021 - RNA, 16 nt, Staphylococcus aureus subsp. aureus Mu50
cugauuuaauagcuaa

SEQ ID NO: 3960022 - RNA, 13 nt, Staphylococcus aureus subsp. aureus Mu50
cugauuucacuuc

SEQ ID NO: 3960023 - RNA, 20 nt, Staphylococcus aureus subsp. aureus Mu50
cugauuuuauaaaguuugua

SEQ ID NO: 3960024 - RNA, 15 nt, Staphylococcus aureus subsp. aureus Mu50
cugauuuuguuucaa

SEQ ID NO: 3960025 - RNA, 19 nt, Staphylococcus aureus subsp. aureus Mu50
cugcaaaauguuacacaaa

SEQ ID NO: 3960026 - RNA, 16 nt, Staphylococcus aureus subsp. aureus Mu50
cugcaaacacaguaca

SEQ ID NO: 3960027 - RNA, 21 nt, Staphylococcus aureus subsp. aureus Mu50
cugcaaacacaguacaaauaa

SEQ ID NO: 3960028 - RNA, 23 nt, Staphylococcus aureus subsp. aureus Mu50
cugcaaacacaguacaaauaaca

SEQ ID NO: 3960029 - RNA, 21 nt, Staphylococcus aureus subsp. aureus Mu50
cugcaaacuugauucaauaua

SEQ ID NO: 3960030 - RNA, 20 nt, Staphylococcus aureus subsp. aureus Mu50
cugcaacauuugauaaccaa

SEQ ID NO: 3960031 - RNA, 23 nt, Staphylococcus aureus subsp. aureus Mu50
cugcaagucguucucuuaaauau

SEQ ID NO: 3960032 - RNA, 21 nt, Staphylococcus aureus subsp. aureus Mu50
cugcaagugcuuccacuucau

SEQ ID NO: 3960033 - RNA, 15 nt, Staphylococcus aureus subsp. aureus Mu50
cugcaccgauaucau

SEQ ID NO: 3960034 - RNA, 22 nt, Staphylococcus aureus subsp. aureus Mu50
cugcaccuaaggcuaaugauaa

SEQ ID NO: 3960035 - RNA, 22 nt, Staphylococcus aureus subsp. aureus Mu50
cugcagaguaaccuuucgcagc

SEQ ID NO: 3960036 - RNA, 17 nt, Staphylococcus aureus subsp. aureus Mu50
cugcagcaauuacaccu

SEQ ID NO: 3960037 - RNA, 16 nt, Staphylococcus aureus subsp. aureus Mu50
cugugauauuaauuga

SEQ ID NO: 3960038 - RNA, 20 nt, Staphylococcus aureus subsp. aureus Mu50
cugugauauuaauugaaaaa

SEQ ID NO: 3960039 - RNA, 17 nt, Staphylococcus aureus subsp. aureus Mu50
cugugauucauucguac

SEQ ID NO: 3960040 - RNA, 22 nt, Staphylococcus aureus subsp. aureus Mu50
cugugcaugacgauaaugaaau

SEQ ID NO: 3960041 - RNA, 23 nt, Staphylococcus aureus subsp. aureus Mu50
cuguggcucgaaaauaaaacaaa

SEQ ID NO: 3960042 - RNA, 17 nt, Staphylococcus aureus subsp. aureus Mu50
cuguguaaaauaaauca

SEQ ID NO: 3960043 - RNA, 18 nt, Staphylococcus aureus subsp. aureus Mu50
cuguguaaaauaaaucau

SEQ ID NO: 3960044 - RNA, 21 nt, Staphylococcus aureus subsp. aureus Mu50
cuguguaaauauaaauaugaa

SEQ ID NO: 3960045 - RNA, 19 nt, Staphylococcus aureus subsp. aureus Mu50
cuguguaauaccaauuguu

SEQ ID NO: 3960046 - RNA, 16 nt, Staphylococcus aureus subsp. aureus Mu50
cuguguacguuucaau

SEQ ID NO: 3960047 - RNA, 15 nt, Staphylococcus aureus subsp. aureus Mu50
cugugucagcauuca

SEQ ID NO: 3960048 - RNA, 16 nt, Staphylococcus aureus subsp. aureus Mu50
cuguguuggggcccac

SEQ ID NO: 3960049 - RNA, 21 nt, Staphylococcus aureus subsp. aureus Mu50
cuguguuggggcccacacccc

SEQ ID NO: 3960050 - RNA, 22 nt, Staphylococcus aureus subsp. aureus Mu50
cuguguuggggcccacacccca

SEQ ID NO: 3960051 - RNA, 22 nt, Staphylococcus aureus subsp. aureus Mu50
cuguuaaacgcugauuuuauaa

SEQ ID NO: 3960052 - RNA, 14 nt, Staphylococcus aureus subsp. aureus Mu50
cuguuaaacucaua

SEQ ID NO: 3960053 - RNA, 22 nt, Staphylococcus aureus subsp. aureus Mu50
cuguuaaacucauacaaauuuu

SEQ ID NO: 3960054 - RNA, 15 nt, Staphylococcus aureus subsp. aureus Mu50
cuguuaauguuccaa

SEQ ID NO: 3960055 - RNA, 15 nt, Staphylococcus aureus subsp. aureus Mu50
cuguuacgagugcac

SEQ ID NO: 3960056 - RNA, 15 nt, Staphylococcus aureus subsp. aureus Mu50
cuguuccaaauucau

SEQ ID NO: 3960057 - RNA, 21 nt, Staphylococcus aureus subsp. aureus Mu50
cuguucuuucgucuuguaaac

SEQ ID NO: 3960058 - RNA, 16 nt, Staphylococcus aureus subsp. aureus Mu50
cuguugcauuaagugc

SEQ ID NO: 3960059 - RNA, 16 nt, Staphylococcus aureus subsp. aureus Mu50
cuguuggcaaaacaau

SEQ ID NO: 3960060 - RNA, 20 nt, Staphylococcus aureus subsp. aureus Mu50
cuguuuaaauuuaaaagaaa

SEQ ID NO: 3960061 - RNA, 19 nt, Staphylococcus aureus subsp. aureus Mu50
cuguuuaauuaaaauacaa

SEQ ID NO: 3960062 - RNA, 13 nt, Staphylococcus aureus subsp. aureus Mu50
cuguuugcuuuau

SEQ ID NO: 3960063 - RNA, 17 nt, Staphylococcus aureus subsp. aureus Mu50
cuguuuuuagguuauau

SEQ ID NO: 3960064 - RNA, 13 nt, Staphylococcus aureus subsp. aureus Mu50
cuguuuuuuuaug

SEQ ID NO: 3960065 - RNA, 11 nt, Staphylococcus aureus subsp. aureus Mu50
cuuaaaaacaa

SEQ ID NO: 3960066 - RNA, 19 nt, Staphylococcus aureus subsp. aureus Mu50
cuuaaaaauaggaauacau

SEQ ID NO: 3960067 - RNA, 17 nt, Staphylococcus aureus subsp. aureus Mu50
cuuaaaagacauccaca

SEQ ID NO: 3960068 - RNA, 20 nt, Staphylococcus aureus subsp. aureus Mu50
cuuaaaagacauccacagaa

SEQ ID NO: 3960069 - RNA, 21 nt, Staphylococcus aureus subsp. aureus Mu50
cuuaaaauaugauuuaaaaua

SEQ ID NO: 3960070 - RNA, 18 nt, Staphylococcus aureus subsp. aureus Mu50
cuuaaaaugauuguuuua

SEQ ID NO: 3960071 - RNA, 15 nt, Staphylococcus aureus subsp. aureus Mu50
cuuaaaauuuaaaua

SEQ ID NO: 3960072 - RNA, 21 nt, Staphylococcus aureus subsp. aureus Mu50
cuuaaaauuuaaauauugaag

SEQ ID NO: 3960073 - RNA, 16 nt, Staphylococcus aureus subsp. aureus Mu50
cuuaaagaauuaagua

SEQ ID NO: 3960074 - RNA, 21 nt, Staphylococcus aureus subsp. aureus Mu50
cuuaaagauuuacccauuaca

SEQ ID NO: 3960075 - RNA, 13 nt, Staphylococcus aureus subsp. aureus Mu50
cuuaaauacaauu

SEQ ID NO: 3960076 - RNA, 16 nt, Staphylococcus aureus subsp. aureus Mu50
cuuaaauacaauuucu

SEQ ID NO: 3960077 - RNA, 22 nt, Staphylococcus aureus subsp. aureus Mu50
cuuaaauacaauuucuucauuu

SEQ ID NO: 3960078 - RNA, 23 nt, Staphylococcus aureus subsp. aureus Mu50
cuuaaauacaauuucuucauuuu

SEQ ID NO: 3960079 - RNA, 16 nt, Staphylococcus aureus subsp. aureus Mu50
cuuaaauagugcuuuu

SEQ ID NO: 3960080 - RNA, 18 nt, Staphylococcus aureus subsp. aureus Mu50
cuuaaauagugcuuuuuc

SEQ ID NO: 3960081 - RNA, 11 nt, Staphylococcus aureus subsp. aureus Mu50
cuuaaauauuc

SEQ ID NO: 3960082 - RNA, 23 nt, Staphylococcus aureus subsp. aureus Mu50
cuuaaauggagauucucgguuuu

SEQ ID NO: 3960083 - RNA, 13 nt, Staphylococcus aureus subsp. aureus Mu50
cuuaaauuaagaa

SEQ ID NO: 3960084 - RNA, 16 nt, Staphylococcus aureus subsp. aureus Mu50
cuuaacaaauuaaaaa

SEQ ID NO: 3960085 - RNA, 18 nt, Staphylococcus aureus subsp. aureus Mu50
cuuaacaacuuuaauuuu

SEQ ID NO: 3960086 - RNA, 16 nt, Staphylococcus aureus subsp. aureus Mu50
cuuaaccauuuaaaaa

SEQ ID NO: 3960087 - RNA, 22 nt, Staphylococcus aureus subsp. aureus Mu50
cuuaaccauuuaaaaauugaag

SEQ ID NO: 3960088 - RNA, 18 nt, Staphylococcus aureus subsp. aureus Mu50
cuuaacgagugcuuucac

SEQ ID NO: 3960089 - RNA, 16 nt, Staphylococcus aureus subsp. aureus Mu50
cuuaacguugcagaga

SEQ ID NO: 3960090 - RNA, 15 nt, Staphylococcus aureus subsp. aureus Mu50
cuuaacucaaagaaa

SEQ ID NO: 3960091 - RNA, 14 nt, Staphylococcus aureus subsp. aureus Mu50
cuuaacuuccuuuu

SEQ ID NO: 3960092 - RNA, 17 nt, Staphylococcus aureus subsp. aureus Mu50
cuuaaguacauaaaugc

SEQ ID NO: 3960093 - RNA, 21 nt, Staphylococcus aureus subsp. aureus Mu50
cuuaauaaccauguaaaauua

SEQ ID NO: 3960094 - RNA, 16 nt, Staphylococcus aureus subsp. aureus Mu50
cuuaauaagcugaaau

SEQ ID NO: 3960095 - RNA, 17 nt, Staphylococcus aureus subsp. aureus Mu50
cuuaauaagcugaaaua

SEQ ID NO: 3960096 - RNA, 15 nt, Staphylococcus aureus subsp. aureus Mu50
cuuaauaagucagcu

SEQ ID NO: 3960097 - RNA, 20 nt, Staphylococcus aureus subsp. aureus Mu50
cuuaauacgauaauaacuag

SEQ ID NO: 3960098 - RNA, 14 nt, Staphylococcus aureus subsp. aureus Mu50
cuuaauagaaagag

SEQ ID NO: 3960099 - RNA, 21 nt, Staphylococcus aureus subsp. aureus Mu50
cuuaauaggauaugcuaaaca

SEQ ID NO: 3960100 - RNA, 18 nt, Staphylococcus aureus subsp. aureus Mu50
cuuaauauauucggcaaa

SEQ ID NO: 3960101 - RNA, 21 nt, Staphylococcus aureus subsp. aureus Mu50
cuuaaugacuucuuuauauuu

SEQ ID NO: 3960102 - RNA, 14 nt, Staphylococcus aureus subsp. aureus Mu50
cuuaaugcuucaaa

SEQ ID NO: 3960103 - RNA, 13 nt, Staphylococcus aureus subsp. aureus Mu50
cuuaauuaauaau

SEQ ID NO: 3960104 - RNA, 14 nt, Staphylococcus aureus subsp. aureus Mu50
cuuaauuaauaauu

SEQ ID NO: 3960105 - RNA, 18 nt, Staphylococcus aureus subsp. aureus Mu50
cuuaauucuucaucaaua

SEQ ID NO: 3960106 - RNA, 13 nt, Staphylococcus aureus subsp. aureus Mu50
cuuaauuuaaauc

SEQ ID NO: 3960107 - RNA, 14 nt, Staphylococcus aureus subsp. aureus Mu50
cuuaauuuaaaucu

SEQ ID NO: 3960108 - RNA, 17 nt, Staphylococcus aureus subsp. aureus Mu50
cuuaauuuguuuuaaau

SEQ ID NO: 3960109 - RNA, 18 nt, Staphylococcus aureus subsp. aureus Mu50
cuuaauuuguuuuaaaua

SEQ ID NO: 3960110 - RNA, 19 nt, Staphylococcus aureus subsp. aureus Mu50
cuuaauuuugcaacauuaa

SEQ ID NO: 3960111 - RNA, 23 nt, Staphylococcus aureus subsp. aureus Mu50
cuuaauuuugcaacauuaaauua

SEQ ID NO: 3960112 - RNA, 14 nt, Staphylococcus aureus subsp. aureus Mu50
cuuacaauaaagac

SEQ ID NO: 3960113 - RNA, 23 nt, Staphylococcus aureus subsp. aureus Mu50
cuuacaauagugugcaaguuggc

SEQ ID NO: 3960114 - RNA, 16 nt, Staphylococcus aureus subsp. aureus Mu50
cuuacagacaaacauu

SEQ ID NO: 3960115 - RNA, 16 nt, Staphylococcus aureus subsp. aureus Mu50
cuuacauuacauauau

SEQ ID NO: 3960116 - RNA, 18 nt, Staphylococcus aureus subsp. aureus Mu50
cuuacauugauaaaauaa

SEQ ID NO: 3960117 - RNA, 18 nt, Staphylococcus aureus subsp. aureus Mu50
cuuacccaaaaaauugua

SEQ ID NO: 3960118 - RNA, 21 nt, Staphylococcus aureus subsp. aureus Mu50
cuuaccuuuauguucaaaugu

SEQ ID NO: 3960119 - RNA, 20 nt, Staphylococcus aureus subsp. aureus Mu50
cuuacuaaguaaccaagucu

SEQ ID NO: 3960120 - RNA, 14 nt, Staphylococcus aureus subsp. aureus Mu50
cuuacuacuuaauu

SEQ ID NO: 3960121 - RNA, 16 nt, Staphylococcus aureus subsp. aureus Mu50
cuuacuacuuaauuaa

SEQ ID NO: 3960122 - RNA, 17 nt, Staphylococcus aureus subsp. aureus Mu50
cuuacugaaacuaaauu

SEQ ID NO: 3960123 - RNA, 18 nt, Staphylococcus aureus subsp. aureus Mu50
cuuacugaaacuaaauua

SEQ ID NO: 3960124 - RNA, 22 nt, Staphylococcus aureus subsp. aureus Mu50
cuucacuaaaaauauauuucaa

SEQ ID NO: 3960125 - RNA, 17 nt, Staphylococcus aureus subsp. aureus Mu50
cuucacugcuguuuuua

SEQ ID NO: 3960126 - RNA, 22 nt, Staphylococcus aureus subsp. aureus Mu50
cuucacuguuuuauuaugaauu

SEQ ID NO: 3960127 - RNA, 19 nt, Staphylococcus aureus subsp. aureus Mu50
cuucaggaauaucuuucaa

SEQ ID NO: 3960128 - RNA, 23 nt, Staphylococcus aureus subsp. aureus Mu50
cuucaggaauaucuuucaaauua

SEQ ID NO: 3960129 - RNA, 20 nt, Staphylococcus aureus subsp. aureus Mu50
cuucaguacgguuauuuaau

SEQ ID NO: 3960130 - RNA, 21 nt, Staphylococcus aureus subsp. aureus Mu50
cuucauagucacuuuuaacga

SEQ ID NO: 3960131 - RNA, 22 nt, Staphylococcus aureus subsp. aureus Mu50
cuucauaguucaaauugaacuu

SEQ ID NO: 3960132 - RNA, 13 nt, Staphylococcus aureus subsp. aureus Mu50
cuucaucaauaac

SEQ ID NO: 3960133 - RNA, 20 nt, Staphylococcus aureus subsp. aureus Mu50
cuucaucauuguaaaacaaa

SEQ ID NO: 3960134 - RNA, 16 nt, Staphylococcus aureus subsp. aureus Mu50
cuucaucuguaucaau

SEQ ID NO: 3960135 - RNA, 21 nt, Staphylococcus aureus subsp. aureus Mu50
cuucauguucuaaugauauuu

SEQ ID NO: 3960136 - RNA, 22 nt, Staphylococcus aureus subsp. aureus Mu50
cuucauuaguugccccuagcaa

SEQ ID NO: 3960137 - RNA, 23 nt, Staphylococcus aureus subsp. aureus Mu50
cuucauuauauaauucuucaaau

SEQ ID NO: 3960138 - RNA, 20 nt, Staphylococcus aureus subsp. aureus Mu50
cuucauuaucaauagaugaa

SEQ ID NO: 3960139 - RNA, 19 nt, Staphylococcus aureus subsp. aureus Mu50
cuuccaauaaccccuguca

SEQ ID NO: 3960140 - RNA, 21 nt, Staphylococcus aureus subsp. aureus Mu50
cuuccaauaaccccugucacu

SEQ ID NO: 3960141 - RNA, 17 nt, Staphylococcus aureus subsp. aureus Mu50
cuuccaauaauaaauca

SEQ ID NO: 3960142 - RNA, 18 nt, Staphylococcus aureus subsp. aureus Mu50
cuuccaaucaacuucaua

SEQ ID NO: 3960143 - RNA, 21 nt, Staphylococcus aureus subsp. aureus Mu50
cuuccaaucaacuucauauaa

SEQ ID NO: 3960144 - RNA, 14 nt, Staphylococcus aureus subsp. aureus Mu50
cuuccaauuuaaaa

SEQ ID NO: 3960145 - RNA, 20 nt, Staphylococcus aureus subsp. aureus Mu50
cuuccaauuuaaaaugauuc

SEQ ID NO: 3960146 - RNA, 14 nt, Staphylococcus aureus subsp. aureus Mu50
cuuccacuucaucu

SEQ ID NO: 3960147 - RNA, 16 nt, Staphylococcus aureus subsp. aureus Mu50
cuuccaucacaucaua

SEQ ID NO: 3960148 - RNA, 21 nt, Staphylococcus aureus subsp. aureus Mu50
cuuccauuaaggauaguucuu

SEQ ID NO: 3960149 - RNA, 19 nt, Staphylococcus aureus subsp. aureus Mu50
cuuccauucggauaaauaa

SEQ ID NO: 3960150 - RNA, 16 nt, Staphylococcus aureus subsp. aureus Mu50
cuucccaaucgaugcg

SEQ ID NO: 3960151 - RNA, 19 nt, Staphylococcus aureus subsp. aureus Mu50
cuucccagucaugucccau

SEQ ID NO: 3960152 - RNA, 22 nt, Staphylococcus aureus subsp. aureus Mu50
cuucccaucuuuuagguaauaa

SEQ ID NO: 3960153 - RNA, 14 nt, Staphylococcus aureus subsp. aureus Mu50
cuuccgcacugccu

SEQ ID NO: 3960154 - RNA, 21 nt, Staphylococcus aureus subsp. aureus Mu50
cuuccuccgccaucaauauuu

SEQ ID NO: 3960155 - RNA, 19 nt, Staphylococcus aureus subsp. aureus Mu50
cuuccucucguaaauuguu

SEQ ID NO: 3960156 - RNA, 22 nt, Staphylococcus aureus subsp. aureus Mu50
cuuccuuacagacaaacauuac

SEQ ID NO: 3960157 - RNA, 12 nt, Staphylococcus aureus subsp. aureus Mu50
cuuccuuccauu

SEQ ID NO: 3960158 - RNA, 18 nt, Staphylococcus aureus subsp. aureus Mu50
cuuccuuuuuauuuuuug

SEQ ID NO: 3960159 - RNA, 23 nt, Staphylococcus aureus subsp. aureus Mu50
cuucgaagucauaugcauacacu

SEQ ID NO: 3960160 - RNA, 20 nt, Staphylococcus aureus subsp. aureus Mu50
cuucgauaguuuauuaauau

SEQ ID NO: 3960161 - RNA, 14 nt, Staphylococcus aureus subsp. aureus Mu50
cuucgauaucaaug

SEQ ID NO: 3960162 - RNA, 17 nt, Staphylococcus aureus subsp. aureus Mu50
cuucgauaucaauguau

SEQ ID NO: 3960163 - RNA, 16 nt, Staphylococcus aureus subsp. aureus Mu50
cuucgauucauaaaau

SEQ ID NO: 3960164 - RNA, 18 nt, Staphylococcus aureus subsp. aureus Mu50
cuucgccaagccaucuuu

SEQ ID NO: 3960165 - RNA, 21 nt, Staphylococcus aureus subsp. aureus Mu50
cuucgccaagccaucuuucuu

SEQ ID NO: 3960166 - RNA, 18 nt, Staphylococcus aureus subsp. aureus Mu50
cuucgcuaauaucaucuu

SEQ ID NO: 3960167 - RNA, 20 nt, Staphylococcus aureus subsp. aureus Mu50
cuucguacaucguugccauu

SEQ ID NO: 3960168 - RNA, 19 nt, Staphylococcus aureus subsp. aureus Mu50
cuucgucaaugacuaagau

SEQ ID NO: 3960169 - RNA, 17 nt, Staphylococcus aureus subsp. aureus Mu50
cuucuaaaacaucacuu

SEQ ID NO: 3960170 - RNA, 17 nt, Staphylococcus aureus subsp. aureus Mu50
cuucuaaccacuucuuc

SEQ ID NO: 3960171 - RNA, 15 nt, Staphylococcus aureus subsp. aureus Mu50
cuucuaaguaauaua

SEQ ID NO: 3960172 - RNA, 17 nt, Staphylococcus aureus subsp. aureus Mu50
cuucuaaguaauauaau

SEQ ID NO: 3960173 - RNA, 17 nt, Staphylococcus aureus subsp. aureus Mu50
cuucuaaucguuaauaa

SEQ ID NO: 3960174 - RNA, 21 nt, Staphylococcus aureus subsp. aureus Mu50
cuucuaauuugcaaaaucaac

SEQ ID NO: 3960175 - RNA, 20 nt, Staphylococcus aureus subsp. aureus Mu50
cuucuacccuugcaaauaua

SEQ ID NO: 3960176 - RNA, 17 nt, Staphylococcus aureus subsp. aureus Mu50
cuucuauagcaccauua

SEQ ID NO: 3960177 - RNA, 18 nt, Staphylococcus aureus subsp. aureus Mu50
cuucuauagcaccauuau

SEQ ID NO: 3960178 - RNA, 23 nt, Staphylococcus aureus subsp. aureus Mu50
cuucuauagcaccauuauuaaau

SEQ ID NO: 3960179 - RNA, 13 nt, Staphylococcus aureus subsp. aureus Mu50
cuucuauauuaau

SEQ ID NO: 3960180 - RNA, 14 nt, Staphylococcus aureus subsp. aureus Mu50
cuucuaucucuuua

SEQ ID NO: 3960181 - RNA, 19 nt, Staphylococcus aureus subsp. aureus Mu50
cuucuaucuucacacuuuu

SEQ ID NO: 3960182 - RNA, 14 nt, Staphylococcus aureus subsp. aureus Mu50
cuucuauuaagaaa

SEQ ID NO: 3960183 - RNA, 16 nt, Staphylococcus aureus subsp. aureus Mu50
cuucuauuaauaauuu

SEQ ID NO: 3960184 - RNA, 14 nt, Staphylococcus aureus subsp. aureus Mu50
cuucuauuauauug

SEQ ID NO: 3960185 - RNA, 15 nt, Staphylococcus aureus subsp. aureus Mu50
cuucuauuauauuga

SEQ ID NO: 3960186 - RNA, 16 nt, Staphylococcus aureus subsp. aureus Mu50
cuucuauuuuauaaua

SEQ ID NO: 3960187 - RNA, 17 nt, Staphylococcus aureus subsp. aureus Mu50
cuucuauuuuauaauaa

SEQ ID NO: 3960188 - RNA, 18 nt, Staphylococcus aureus subsp. aureus Mu50
cuucuauuuuauaauaaa

SEQ ID NO: 3960189 - RNA, 20 nt, Staphylococcus aureus subsp. aureus Mu50
cuucuauuuuauaauaaauu

SEQ ID NO: 3960190 - RNA, 22 nt, Staphylococcus aureus subsp. aureus Mu50
cuucucaauuuaguauaaauaa

SEQ ID NO: 3960191 - RNA, 12 nt, Staphylococcus aureus subsp. aureus Mu50
cuucucaucauu

SEQ ID NO: 3960192 - RNA, 17 nt, Staphylococcus aureus subsp. aureus Mu50
cuucucaucauuuucaa

SEQ ID NO: 3960193 - RNA, 18 nt, Staphylococcus aureus subsp. aureus Mu50
cuucucaucauuuucaau

SEQ ID NO: 3960194 - RNA, 20 nt, Staphylococcus aureus subsp. aureus Mu50
cuucucaucgaauucauuug

SEQ ID NO: 3960195 - RNA, 16 nt, Staphylococcus aureus subsp. aureus Mu50
cuucuccuucaauguu

SEQ ID NO: 3960196 - RNA, 12 nt, Staphylococcus aureus subsp. aureus Mu50
cuucucuaucag

SEQ ID NO: 3960197 - RNA, 17 nt, Staphylococcus aureus subsp. aureus Mu50
cuucugcuacuuguugu

SEQ ID NO: 3960198 - RNA, 20 nt, Staphylococcus aureus subsp. aureus Mu50
cuucuggagccccuuguucu

SEQ ID NO: 3960199 - RNA, 21 nt, Staphylococcus aureus subsp. aureus Mu50
cuucuggagccccuuguucuc

SEQ ID NO: 3960200 - RNA, 23 nt, Staphylococcus aureus subsp. aureus Mu50
cuucuggauagguaucacuagga

SEQ ID NO: 3960201 - RNA, 19 nt, Staphylococcus aureus subsp. aureus Mu50
cuucuguacguuuuaaaua

SEQ ID NO: 3960202 - RNA, 22 nt, Staphylococcus aureus subsp. aureus Mu50
cuucuuaaaucaacaucaucuu

SEQ ID NO: 3960203 - RNA, 23 nt, Staphylococcus aureus subsp. aureus Mu50
cuucuuaucaacaacaaguucuu

SEQ ID NO: 3960204 - RNA, 22 nt, Staphylococcus aureus subsp. aureus Mu50
cuucuugagguuuugguucuga

SEQ ID NO: 3960205 - RNA, 17 nt, Staphylococcus aureus subsp. aureus Mu50
cuucuuugaaaucaaug

SEQ ID NO: 3960206 - RNA, 19 nt, Staphylococcus aureus subsp. aureus Mu50
cuucuuuguuuuuaauuuu

SEQ ID NO: 3960207 - RNA, 13 nt, Staphylococcus aureus subsp. aureus Mu50
cuucuuuucuuug

SEQ ID NO: 3960208 - RNA, 19 nt, Staphylococcus aureus subsp. aureus Mu50
cuucuuuugcaaaacgcau

SEQ ID NO: 3960209 - RNA, 19 nt, Staphylococcus aureus subsp. aureus Mu50
cuucuuuuguuuuaccauc

SEQ ID NO: 3960210 - RNA, 15 nt, Staphylococcus aureus subsp. aureus Mu50
cuucuuuuugcguuu

SEQ ID NO: 3960211 - RNA, 14 nt, Staphylococcus aureus subsp. aureus Mu50
cuuguuuuaaacuu

SEQ ID NO: 3960212 - RNA, 22 nt, Staphylococcus aureus subsp. aureus Mu50
cuuuaaaacaucauucacaagu

SEQ ID NO: 3960213 - RNA, 23 nt, Staphylococcus aureus subsp. aureus Mu50
cuuuaaaacguuaguacuuugau

SEQ ID NO: 3960214 - RNA, 14 nt, Staphylococcus aureus subsp. aureus Mu50
cuuuaaaauucucu

SEQ ID NO: 3960215 - RNA, 15 nt, Staphylococcus aureus subsp. aureus Mu50
cuuuaaaauucucua

SEQ ID NO: 3960216 - RNA, 12 nt, Staphylococcus aureus subsp. aureus Mu50
cuuuaaaauugu

SEQ ID NO: 3960217 - RNA, 19 nt, Staphylococcus aureus subsp. aureus Mu50
cuuuaaaauuguauagaau

SEQ ID NO: 3960218 - RNA, 13 nt, Staphylococcus aureus subsp. aureus Mu50
cuuuaaacauauu

SEQ ID NO: 3960219 - RNA, 23 nt, Staphylococcus aureus subsp. aureus Mu50
cuuuaaacucauaccaaaaacau

SEQ ID NO: 3960220 - RNA, 11 nt, Staphylococcus aureus subsp. aureus Mu50
cuuuaaacucg

SEQ ID NO: 3960221 - RNA, 17 nt, Staphylococcus aureus subsp. aureus Mu50
cuuuaaacucguaaauu

SEQ ID NO: 3960222 - RNA, 22 nt, Staphylococcus aureus subsp. aureus Mu50
cuuuaaaucuuguucuaauugu

SEQ ID NO: 3960223 - RNA, 20 nt, Staphylococcus aureus subsp. aureus Mu50
cuuuaacaguuguaaucauu

SEQ ID NO: 3960224 - RNA, 14 nt, Staphylococcus aureus subsp. aureus Mu50
cuuuaacauuuauu

SEQ ID NO: 3960225 - RNA, 21 nt, Staphylococcus aureus subsp. aureus Mu50
cuuuaacuguacgauucaauu

SEQ ID NO: 3960226 - RNA, 20 nt, Staphylococcus aureus subsp. aureus Mu50
cuuuaacuucugauucuuca

SEQ ID NO: 3960227 - RNA, 17 nt, Staphylococcus aureus subsp. aureus Mu50
cuuuaacuucuuuuguu

SEQ ID NO: 3960228 - RNA, 14 nt, Staphylococcus aureus subsp. aureus Mu50
cuuuaagcuuaaau

SEQ ID NO: 3960229 - RNA, 18 nt, Staphylococcus aureus subsp. aureus Mu50
cuuuaaguaauucauuug

SEQ ID NO: 3960230 - RNA, 15 nt, Staphylococcus aureus subsp. aureus Mu50
cuuuaauaaccuuua

SEQ ID NO: 3960231 - RNA, 22 nt, Staphylococcus aureus subsp. aureus Mu50
cuuuaauaaccuuuaaaacauc

SEQ ID NO: 3960232 - RNA, 14 nt, Staphylococcus aureus subsp. aureus Mu50
cuuuaauauaauua

SEQ ID NO: 3960233 - RNA, 19 nt, Staphylococcus aureus subsp. aureus Mu50
cuuuaauauaauuauuaaa

SEQ ID NO: 3960234 - RNA, 16 nt, Staphylococcus aureus subsp. aureus Mu50
cuuuaaucauagcauu

SEQ ID NO: 3960235 - RNA, 18 nt, Staphylococcus aureus subsp. aureus Mu50
cuuuaaucauagcauuaa

SEQ ID NO: 3960236 - RNA, 15 nt, Staphylococcus aureus subsp. aureus Mu50
cuuuaauuaaaguua

SEQ ID NO: 3960237 - RNA, 16 nt, Staphylococcus aureus subsp. aureus Mu50
cuuuaauuuagugaaa

SEQ ID NO: 3960238 - RNA, 13 nt, Staphylococcus aureus subsp. aureus Mu50
cuuuaauuuucuu

SEQ ID NO: 3960239 - RNA, 20 nt, Staphylococcus aureus subsp. aureus Mu50
cuuuacauucuuuguauuua

SEQ ID NO: 3960240 - RNA, 14 nt, Staphylococcus aureus subsp. aureus Mu50
cuuuacgauaaaua

SEQ ID NO: 3960241 - RNA, 23 nt, Staphylococcus aureus subsp. aureus Mu50
cuuuacuaaaccucaacauuaaa

SEQ ID NO: 3960242 - RNA, 15 nt, Staphylococcus aureus subsp. aureus Mu50
cuuuacuaaagauag

SEQ ID NO: 3960243 - RNA, 18 nt, Staphylococcus aureus subsp. aureus Mu50
cuuuacucuacacucaaa

SEQ ID NO: 3960244 - RNA, 19 nt, Staphylococcus aureus subsp. aureus Mu50
cuuuacucuacacucaaac

SEQ ID NO: 3960245 - RNA, 23 nt, Staphylococcus aureus subsp. aureus Mu50
cuuuacuugcuuuuucaaauaau

SEQ ID NO: 3960246 - RNA, 14 nt, Staphylococcus aureus subsp. aureus Mu50
cuuuacuuucauua

SEQ ID NO: 3960247 - RNA, 21 nt, Staphylococcus aureus subsp. aureus Mu50
cuuuagaaagugauucccaaa

SEQ ID NO: 3960248 - RNA, 22 nt, Staphylococcus aureus subsp. aureus Mu50
cuuuagcaaaaauauuuaaacu

SEQ ID NO: 3960249 - RNA, 22 nt, Staphylococcus aureus subsp. aureus Mu50
cuuuagcaauugaaucaaauac

SEQ ID NO: 3960250 - RNA, 20 nt, Staphylococcus aureus subsp. aureus Mu50
cuuuagcuauguaaaauuau

SEQ ID NO: 3960251 - RNA, 15 nt, Staphylococcus aureus subsp. aureus Mu50
cuuuagcucuuuuuu

SEQ ID NO: 3960252 - RNA, 17 nt, Staphylococcus aureus subsp. aureus Mu50
cuuuaggguucauugcu

SEQ ID NO: 3960253 - RNA, 19 nt, Staphylococcus aureus subsp. aureus Mu50
cuuuaguaguguauucauu

SEQ ID NO: 3960254 - RNA, 15 nt, Staphylococcus aureus subsp. aureus Mu50
cuuuaguguguuuaa

SEQ ID NO: 3960255 - RNA, 19 nt, Staphylococcus aureus subsp. aureus Mu50
cuuuaguguguuuaaaagg

SEQ ID NO: 3960256 - RNA, 15 nt, Staphylococcus aureus subsp. aureus Mu50
cuuuauaaauaucuu

SEQ ID NO: 3960257 - RNA, 17 nt, Staphylococcus aureus subsp. aureus Mu50
cuuuauaaauaucuuuu

SEQ ID NO: 3960258 - RNA, 14 nt, Staphylococcus aureus subsp. aureus Mu50
cuuuauauauaaag

SEQ ID NO: 3960259 - RNA, 19 nt, Staphylococcus aureus subsp. aureus Mu50
cuuuaucaacauaaaauuu

SEQ ID NO: 3960260 - RNA, 15 nt, Staphylococcus aureus subsp. aureus Mu50
cuuuaucgaauucuu

SEQ ID NO: 3960261 - RNA, 20 nt, Staphylococcus aureus subsp. aureus Mu50
cuuuaucgaauucuucuuua

SEQ ID NO: 3960262 - RNA, 14 nt, Staphylococcus aureus subsp. aureus Mu50
cuuuaugauaauaa

SEQ ID NO: 3960263 - RNA, 17 nt, Staphylococcus aureus subsp. aureus Mu50
cuuuaugauaauuaauu

SEQ ID NO: 3960264 - RNA, 20 nt, Staphylococcus aureus subsp. aureus Mu50
cuuuauggguauccuucuca

SEQ ID NO: 3960265 - RNA, 21 nt, Staphylococcus aureus subsp. aureus Mu50
cuuuaugugcaucauuuauau

SEQ ID NO: 3960266 - RNA, 15 nt, Staphylococcus aureus subsp. aureus Mu50
cuuuauuacuuuaau

SEQ ID NO: 3960267 - RNA, 14 nt, Staphylococcus aureus subsp. aureus Mu50
cuuuauuagaauga

SEQ ID NO: 3960268 - RNA, 22 nt, Staphylococcus aureus subsp. aureus Mu50
cuuuauucuucccaaaaauugu

SEQ ID NO: 3960269 - RNA, 15 nt, Staphylococcus aureus subsp. aureus Mu50
cuuuauuugauucuu

SEQ ID NO: 3960270 - RNA, 16 nt, Staphylococcus aureus subsp. aureus Mu50
cuuuauuuuaaacaug

SEQ ID NO: 3960271 - RNA, 18 nt, Staphylococcus aureus subsp. aureus Mu50
cuuuauuuuaaacaugaa

SEQ ID NO: 3960272 - RNA, 12 nt, Staphylococcus aureus subsp. aureus Mu50
cuuuauuuucuu

SEQ ID NO: 3960273 - RNA, 22 nt, Staphylococcus aureus subsp. aureus Mu50
cuuuauuuucuuguguauuuuu

SEQ ID NO: 3960274 - RNA, 12 nt, Staphylococcus aureus subsp. aureus Mu50
cuuuauuuuuug

SEQ ID NO: 3960275 - RNA, 18 nt, Staphylococcus aureus subsp. aureus Mu50
cuuucaaauauaucuaau

SEQ ID NO: 3960276 - RNA, 13 nt, Staphylococcus aureus subsp. aureus Mu50
cuuucaagaccuu

SEQ ID NO: 3960277 - RNA, 19 nt, Staphylococcus aureus subsp. aureus Mu50
cuuucaagaccuucuucuc

SEQ ID NO: 3960278 - RNA, 13 nt, Staphylococcus aureus subsp. aureus Mu50
cuuucacauacca

SEQ ID NO: 3960279 - RNA, 19 nt, Staphylococcus aureus subsp. aureus Mu50
cuuucaccauuuacuucau

SEQ ID NO: 3960280 - RNA, 22 nt, Staphylococcus aureus subsp. aureus Mu50
cuuucagcaccagaacaauuca

SEQ ID NO: 3960281 - RNA, 19 nt, Staphylococcus aureus subsp. aureus Mu50
cuuucagcuaauucgucua

SEQ ID NO: 3960282 - RNA, 17 nt, Staphylococcus aureus subsp. aureus Mu50
cuuucauaauuaacaca

SEQ ID NO: 3960283 - RNA, 14 nt, Staphylococcus aureus subsp. aureus Mu50
cuuucauuaauuuu

SEQ ID NO: 3960284 - RNA, 15 nt, Staphylococcus aureus subsp. aureus Mu50
cuuucauuaauuuuu

SEQ ID NO: 3960285 - RNA, 15 nt, Staphylococcus aureus subsp. aureus Mu50
cuuucauuguaaauu

SEQ ID NO: 3960286 - RNA, 13 nt, Staphylococcus aureus subsp. aureus Mu50
cuuucauuuuagc

SEQ ID NO: 3960287 - RNA, 16 nt, Staphylococcus aureus subsp. aureus Mu50
cuuuccauuguugaua

SEQ ID NO: 3960288 - RNA, 15 nt, Staphylococcus aureus subsp. aureus Mu50
cuuucgaaaaacugu

SEQ ID NO: 3960289 - RNA, 13 nt, Staphylococcus aureus subsp. aureus Mu50
cuuucgauaaacu

SEQ ID NO: 3960290 - RNA, 16 nt, Staphylococcus aureus subsp. aureus Mu50
cuuucguccaacaugu

SEQ ID NO: 3960291 - RNA, 23 nt, Staphylococcus aureus subsp. aureus Mu50
cuuucguuucuuuuauaucgcuu

SEQ ID NO: 3960292 - RNA, 12 nt, Staphylococcus aureus subsp. aureus Mu50
cuuucuauuaau

SEQ ID NO: 3960293 - RNA, 16 nt, Staphylococcus aureus subsp. aureus Mu50
cuuucucaucuauuua

SEQ ID NO: 3960294 - RNA, 18 nt, Staphylococcus aureus subsp. aureus Mu50
cuuucucaucuauuuaau

SEQ ID NO: 3960295 - RNA, 16 nt, Staphylococcus aureus subsp. aureus Mu50
cuuucucggcgauaaa

SEQ ID NO: 3960296 - RNA, 21 nt, Staphylococcus aureus subsp. aureus Mu50
cuuucucggcgauaaaauguu

SEQ ID NO: 3960297 - RNA, 14 nt, Staphylococcus aureus subsp. aureus Mu50
cuuucucuauuaau

SEQ ID NO: 3960298 - RNA, 17 nt, Staphylococcus aureus subsp. aureus Mu50
cuuucucuauuaauuua

SEQ ID NO: 3960299 - RNA, 21 nt, Staphylococcus aureus subsp. aureus Mu50
cuuuuuaaaaucguuaaggaa

SEQ ID NO: 3960300 - RNA, 22 nt, Staphylococcus aureus subsp. aureus Mu50
cuuuuuaaaggaccacuuagau

SEQ ID NO: 3960301 - RNA, 12 nt, Staphylococcus aureus subsp. aureus Mu50
cuuuuuaaagua

SEQ ID NO: 3960302 - RNA, 14 nt, Staphylococcus aureus subsp. aureus Mu50
cuuuuuaaaugauu

SEQ ID NO: 3960303 - RNA, 21 nt, Staphylococcus aureus subsp. aureus Mu50
cuuuuuaacuauguuacuuau

SEQ ID NO: 3960304 - RNA, 13 nt, Staphylococcus aureus subsp. aureus Mu50
cuuuuuacauuuu

SEQ ID NO: 3960305 - RNA, 17 nt, Staphylococcus aureus subsp. aureus Mu50
cuuuuuacauuuucaaa

SEQ ID NO: 3960306 - RNA, 17 nt, Staphylococcus aureus subsp. aureus Mu50
cuuuuuagccccagcaa

SEQ ID NO: 3960307 - RNA, 15 nt, Staphylococcus aureus subsp. aureus Mu50
cuuuuuaggaaugau

SEQ ID NO: 3960308 - RNA, 21 nt, Staphylococcus aureus subsp. aureus Mu50
cuuuuuaggaaugauagauuu

SEQ ID NO: 3960309 - RNA, 12 nt, Staphylococcus aureus subsp. aureus Mu50
cuuuuuaggaug

SEQ ID NO: 3960310 - RNA, 19 nt, Staphylococcus aureus subsp. aureus Mu50
cuuuuuaucaacaaauuua

SEQ ID NO: 3960311 - RNA, 13 nt, Staphylococcus aureus subsp. aureus Mu50
cuuuuuaucauga

SEQ ID NO: 3960312 - RNA, 17 nt, Staphylococcus aureus subsp. aureus Mu50
cuuuuuauuauacuuua

SEQ ID NO: 3960313 - RNA, 23 nt, Staphylococcus aureus subsp. aureus Mu50
cuuuuuauuuauaacuuuaaaaa

SEQ ID NO: 3960314 - RNA, 17 nt, Staphylococcus aureus subsp. aureus Mu50
cuuuuuauuuuaauauu

SEQ ID NO: 3960315 - RNA, 14 nt, Staphylococcus aureus subsp. aureus Mu50
cuuuuuauuuuguu

SEQ ID NO: 3960316 - RNA, 14 nt, Staphylococcus aureus subsp. aureus Mu50
cuuuuuauuuuuug

SEQ ID NO: 3960317 - RNA, 12 nt, Staphylococcus aureus subsp. aureus Mu50
cuuuuucacauu

SEQ ID NO: 3960318 - RNA, 15 nt, Staphylococcus aureus subsp. aureus Mu50
cuuuuucacauugcc

SEQ ID NO: 3960319 - RNA, 22 nt, Staphylococcus aureus subsp. aureus Mu50
cuuuuucacgauuuuuaaaaug

SEQ ID NO: 3960320 - RNA, 15 nt, Staphylococcus aureus subsp. aureus Mu50
cuuuuucauagaaca

SEQ ID NO: 3960321 - RNA, 21 nt, Staphylococcus aureus subsp. aureus Mu50
cuuuuucauagaacaaaaugu

SEQ ID NO: 3960322 - RNA, 15 nt, Staphylococcus aureus subsp. aureus Mu50
cuuuuucuaaauaaa

SEQ ID NO: 3960323 - RNA, 19 nt, Staphylococcus aureus subsp. aureus Mu50
cuuuuucuaaauaaacgau

SEQ ID NO: 3960324 - RNA, 17 nt, Staphylococcus aureus subsp. aureus Mu50
cuuuuucuaccaauaau

SEQ ID NO: 3960325 - RNA, 17 nt, Staphylococcus aureus subsp. aureus Mu50
cuuuuucuauacaauga

SEQ ID NO: 3960326 - RNA, 13 nt, Staphylococcus aureus subsp. aureus Mu50
cuuuuucuuucau

SEQ ID NO: 3960327 - RNA, 19 nt, Staphylococcus aureus subsp. aureus Mu50
cuuuuugacauauuuuuua

SEQ ID NO: 3960328 - RNA, 22 nt, Staphylococcus aureus subsp. aureus Mu50
cuuuuugacauauuuuuuaaau

SEQ ID NO: 3960329 - RNA, 17 nt, Staphylococcus aureus subsp. aureus Mu50
cuuuuugacucagaauc

SEQ ID NO: 3960330 - RNA, 20 nt, Staphylococcus aureus subsp. aureus Mu50
cuuuuugacucagaaucuua

SEQ ID NO: 3960331 - RNA, 15 nt, Staphylococcus aureus subsp. aureus Mu50
cuuuuugauuauauu

SEQ ID NO: 3960332 - RNA, 22 nt, Staphylococcus aureus subsp. aureus Mu50
cuuuuugccuggcaacguucua

SEQ ID NO: 3960333 - RNA, 19 nt, Staphylococcus aureus subsp. aureus Mu50
cuuuuugcguuuuuaaaua

SEQ ID NO: 3960334 - RNA, 21 nt, Staphylococcus aureus subsp. aureus Mu50
cuuuuugcguuuuuaaauaau

SEQ ID NO: 3960335 - RNA, 20 nt, Staphylococcus aureus subsp. aureus Mu50
cuuuuugucucucaacauuu

SEQ ID NO: 3960336 - RNA, 13 nt, Staphylococcus aureus subsp. aureus Mu50
cuuuuuguuaauu

SEQ ID NO: 3960337 - RNA, 18 nt, Staphylococcus aureus subsp. aureus Mu50
cuuuuuguuaauuuuuua

SEQ ID NO: 3960338 - RNA, 19 nt, Staphylococcus aureus subsp. aureus Mu50
cuuuuuguuauaucuaauu

SEQ ID NO: 3960339 - RNA, 17 nt, Staphylococcus aureus subsp. aureus Mu50
cuuuuuguuuugaaugu

SEQ ID NO: 3960340 - RNA, 14 nt, Staphylococcus aureus subsp. aureus Mu50
cuuuuuuaacuuua

SEQ ID NO: 3960341 - RNA, 17 nt, Staphylococcus aureus subsp. aureus Mu50
cuuuuuuaagcuuauca

SEQ ID NO: 3960342 - RNA, 19 nt, Staphylococcus aureus subsp. aureus Mu50
cuuuuuuaccagcaugaau

SEQ ID NO: 3960343 - RNA, 20 nt, Staphylococcus aureus subsp. aureus Mu50
cuuuuuuauuuuauaagaau

SEQ ID NO: 3960344 - RNA, 15 nt, Staphylococcus aureus subsp. aureus Mu50
cuuuuuucauuucuu

SEQ ID NO: 3960345 - RNA, 20 nt, Staphylococcus aureus subsp. aureus Mu50
cuuuuuucucuucuugaggu

SEQ ID NO: 3960346 - RNA, 17 nt, Staphylococcus aureus subsp. aureus Mu50
cuuuuuuuauaaguauu

SEQ ID NO: 3960347 - RNA, 13 nt, Staphylococcus aureus subsp. aureus Mu50
cuuuuuuuuauaa

SEQ ID NO: 3960348 - RNA, 20 nt, Staphylococcus aureus subsp. aureus Mu50
gaaaaaauggcgaaaaagcu

SEQ ID NO: 3960349 - RNA, 22 nt, Staphylococcus aureus subsp. aureus Mu50
gaaaaaauuaauaauuuuccau

SEQ ID NO: 3960350 - RNA, 12 nt, Staphylococcus aureus subsp. aureus Mu50
gaaaaaccaagu

SEQ ID NO: 3960351 - RNA, 19 nt, Staphylococcus aureus subsp. aureus Mu50
gaaaaaccugggacauuaa

SEQ ID NO: 3960352 - RNA, 17 nt, Staphylococcus aureus subsp. aureus Mu50
gaaaaacuguaaaucau

SEQ ID NO: 3960353 - RNA, 21 nt, Staphylococcus aureus subsp. aureus Mu50
gaaaaacuucuuaacuugaaa

SEQ ID NO: 3960354 - RNA, 22 nt, Staphylococcus aureus subsp. aureus Mu50
gaaaaacuucuuaacuugaaau

SEQ ID NO: 3960355 - RNA, 20 nt, Staphylococcus aureus subsp. aureus Mu50
gaaaaacuuuucauggaguc

SEQ ID NO: 3960356 - RNA, 15 nt, Staphylococcus aureus subsp. aureus Mu50
gaaaaagaugaaaaa

SEQ ID NO: 3960357 - RNA, 17 nt, Staphylococcus aureus subsp. aureus Mu50
gaaaaagcaggcaagcu

SEQ ID NO: 3960358 - RNA, 14 nt, Staphylococcus aureus subsp. aureus Mu50
gaaaaagucuuucu

SEQ ID NO: 3960359 - RNA, 11 nt, Staphylococcus aureus subsp. aureus Mu50
gaaaaauaauu

SEQ ID NO: 3960360 - RNA, 12 nt, Staphylococcus aureus subsp. aureus Mu50
gaaaaauuaaaa

SEQ ID NO: 3960361 - RNA, 16 nt, Staphylococcus aureus subsp. aureus Mu50
gaaaaauuucaaaaau

SEQ ID NO: 3960362 - RNA, 11 nt, Staphylococcus aureus subsp. aureus Mu50
gaaaacaauaa

SEQ ID NO: 3960363 - RNA, 14 nt, Staphylococcus aureus subsp. aureus Mu50
gaaaacagguggaa

SEQ ID NO: 3960364 - RNA, 14 nt, Staphylococcus aureus subsp. aureus Mu50
gaaaacccugaaga

SEQ ID NO: 3960365 - RNA, 16 nt, Staphylococcus aureus subsp. aureus Mu50
gaaaagaaauucuaca

SEQ ID NO: 3960366 - RNA, 17 nt, Staphylococcus aureus subsp. aureus Mu50
gaaaagaaauucuacaa

SEQ ID NO: 3960367 - RNA, 15 nt, Staphylococcus aureus subsp. aureus Mu50
gaaaagagaaacaaa

SEQ ID NO: 3960368 - RNA, 19 nt, Staphylococcus aureus subsp. aureus Mu50
gaaaagcagucgaacaaug

SEQ ID NO: 3960369 - RNA, 14 nt, Staphylococcus aureus subsp. aureus Mu50
gaaaaguauaugaa

SEQ ID NO: 3960370 - RNA, 18 nt, Staphylococcus aureus subsp. aureus Mu50
gaaaagugaaaacuucuc

SEQ ID NO: 3960371 - RNA, 22 nt, Staphylococcus aureus subsp. aureus Mu50
gaaaaguuacuuacgccaauca

SEQ ID NO: 3960372 - RNA, 14 nt, Staphylococcus aureus subsp. aureus Mu50
gaaaauaaaaacca

SEQ ID NO: 3960373 - RNA, 21 nt, Staphylococcus aureus subsp. aureus Mu50
gaaaauaaaacaaauuauuaa

SEQ ID NO: 3960374 - RNA, 19 nt, Staphylococcus aureus subsp. aureus Mu50
gaaaauaagcaucacauau

SEQ ID NO: 3960375 - RNA, 16 nt, Staphylococcus aureus subsp. aureus Mu50
gaaaauaagcuuguaa

SEQ ID NO: 3960376 - RNA, 18 nt, Staphylococcus aureus subsp. aureus Mu50
gaaaauaagcuuguaaca

SEQ ID NO: 3960377 - RNA, 20 nt, Staphylococcus aureus subsp. aureus Mu50
gaaaauaaucgaacagaaaa

SEQ ID NO: 3960378 - RNA, 21 nt, Staphylococcus aureus subsp. aureus Mu50
gaaaauaaucgaacagaaaau

SEQ ID NO: 3960379 - RNA, 17 nt, Staphylococcus aureus subsp. aureus Mu50
gaaaauaccucuacauu

SEQ ID NO: 3960380 - RNA, 19 nt, Staphylococcus aureus subsp. aureus Mu50
gaaaauaccucuacauuau

SEQ ID NO: 3960381 - RNA, 14 nt, Staphylococcus aureus subsp. aureus Mu50
gaaaauagaaagaa

SEQ ID NO: 3960382 - RNA, 18 nt, Staphylococcus aureus subsp. aureus Mu50
gaaaauagccauauucau

SEQ ID NO: 3960383 - RNA, 13 nt, Staphylococcus aureus subsp. aureus Mu50
gaaaauagcuguu

SEQ ID NO: 3960384 - RNA, 20 nt, Staphylococcus aureus subsp. aureus Mu50
gaaaauauaguggugguacu

SEQ ID NO: 3960385 - RNA, 14 nt, Staphylococcus aureus subsp. aureus Mu50
gaaaaucaucauua

SEQ ID NO: 3960386 - RNA, 12 nt, Staphylococcus aureus subsp. aureus Mu50
gaaaauuaacuc

SEQ ID NO: 3960387 - RNA, 21 nt, Staphylococcus aureus subsp. aureus Mu50
gaacaguacgauuauuuggau

SEQ ID NO: 3960388 - RNA, 13 nt, Staphylococcus aureus subsp. aureus Mu50
gaacauaaauaaa

SEQ ID NO: 3960389 - RNA, 17 nt, Staphylococcus aureus subsp. aureus Mu50
gaacauaaauaaacuuu

SEQ ID NO: 3960390 - RNA, 16 nt, Staphylococcus aureus subsp. aureus Mu50
gaacauaccugcauau

SEQ ID NO: 3960391 - RNA, 22 nt, Staphylococcus aureus subsp. aureus Mu50
gaacauaccugcauauguguuu

SEQ ID NO: 3960392 - RNA, 18 nt, Staphylococcus aureus subsp. aureus Mu50
gaacauauucauaauauc

SEQ ID NO: 3960393 - RNA, 13 nt, Staphylococcus aureus subsp. aureus Mu50
gaacaucaucuau

SEQ ID NO: 3960394 - RNA, 14 nt, Staphylococcus aureus subsp. aureus Mu50
gaacaucuaguuau

SEQ ID NO: 3960395 - RNA, 15 nt, Staphylococcus aureus subsp. aureus Mu50
gaacaucugaaaaaa

SEQ ID NO: 3960396 - RNA, 16 nt, Staphylococcus aureus subsp. aureus Mu50
gaacaugaaugauauu

SEQ ID NO: 3960397 - RNA, 21 nt, Staphylococcus aureus subsp. aureus Mu50
gaacaugaaugauauugauuu

SEQ ID NO: 3960398 - RNA, 14 nt, Staphylococcus aureus subsp. aureus Mu50
gaacauuaaaagga

SEQ ID NO: 3960399 - RNA, 15 nt, Staphylococcus aureus subsp. aureus Mu50
gaaccacgcaucaug

SEQ ID NO: 3960400 - RNA, 20 nt, Staphylococcus aureus subsp. aureus Mu50
gaaccacgcaucauguauau

SEQ ID NO: 3960401 - RNA, 14 nt, Staphylococcus aureus subsp. aureus Mu50
gaaccccauucacu

SEQ ID NO: 3960402 - RNA, 17 nt, Staphylococcus aureus subsp. aureus Mu50
gaaccuauauuaagcau

SEQ ID NO: 3960403 - RNA, 16 nt, Staphylococcus aureus subsp. aureus Mu50
gaaccugcugaaguuu

SEQ ID NO: 3960404 - RNA, 20 nt, Staphylococcus aureus subsp. aureus Mu50
gaacgauauuuuaaaaagua

SEQ ID NO: 3960405 - RNA, 21 nt, Staphylococcus aureus subsp. aureus Mu50
gaacgauauuuuaaaaaguaa

SEQ ID NO: 3960406 - RNA, 18 nt, Staphylococcus aureus subsp. aureus Mu50
gaacguaaguuuaguuca

SEQ ID NO: 3960407 - RNA, 19 nt, Staphylococcus aureus subsp. aureus Mu50
gaacguguuugaauggcaa

SEQ ID NO: 3960408 - RNA, 15 nt, Staphylococcus aureus subsp. aureus Mu50
gaacguuauuuucaa

SEQ ID NO: 3960409 - RNA, 15 nt, Staphylococcus aureus subsp. aureus Mu50
gaacuaacauaauuu

SEQ ID NO: 3960410 - RNA, 16 nt, Staphylococcus aureus subsp. aureus Mu50
gaacuaagaugugcau

SEQ ID NO: 3960411 - RNA, 13 nt, Staphylococcus aureus subsp. aureus Mu50
gaacuaauguaaa

SEQ ID NO: 3960412 - RNA, 19 nt, Staphylococcus aureus subsp. aureus Mu50
gaacuacgcauuuuaaaua

SEQ ID NO: 3960413 - RNA, 13 nt, Staphylococcus aureus subsp. aureus Mu50
gaacuacuacauu

SEQ ID NO: 3960414 - RNA, 19 nt, Staphylococcus aureus subsp. aureus Mu50
gaacuaguacgaaaugcaa

SEQ ID NO: 3960415 - RNA, 17 nt, Staphylococcus aureus subsp. aureus Mu50
gaacucugauauugauc

SEQ ID NO: 3960416 - RNA, 16 nt, Staphylococcus aureus subsp. aureus Mu50
gaacuuaaugcuucaa

SEQ ID NO: 3960417 - RNA, 21 nt, Staphylococcus aureus subsp. aureus Mu50
gaacuuacaagucuaguucga

SEQ ID NO: 3960418 - RNA, 23 nt, Staphylococcus aureus subsp. aureus Mu50
gaacuuauaaguccgauuugaua

SEQ ID NO: 3960419 - RNA, 20 nt, Staphylococcus aureus subsp. aureus Mu50
gaacuugcuuuguuaggauc

SEQ ID NO: 3960420 - RNA, 16 nt, Staphylococcus aureus subsp. aureus Mu50
gaacuuuucaaacaau

SEQ ID NO: 3960421 - RNA, 14 nt, Staphylococcus aureus subsp. aureus Mu50
gaacuuuuguucua

SEQ ID NO: 3960422 - RNA, 14 nt, Staphylococcus aureus subsp. aureus Mu50
gaagaaacauuaua

SEQ ID NO: 3960423 - RNA, 16 nt, Staphylococcus aureus subsp. aureus Mu50
gaagaaacuuaaucaa

SEQ ID NO: 3960424 - RNA, 15 nt, Staphylococcus aureus subsp. aureus Mu50
gaagaauaaaaaagu

SEQ ID NO: 3960425 - RNA, 14 nt, Staphylococcus aureus subsp. aureus Mu50
gaagaauacaaaua

SEQ ID NO: 3960426 - RNA, 15 nt, Staphylococcus aureus subsp. aureus Mu50
gaagaauacaaauau

SEQ ID NO: 3960427 - RNA, 21 nt, Staphylococcus aureus subsp. aureus Mu50
gaagaaucaggaccaaauaga

SEQ ID NO: 3960428 - RNA, 22 nt, Staphylococcus aureus subsp. aureus Mu50
gaagaauccuaugccaaauaac

SEQ ID NO: 3960429 - RNA, 22 nt, Staphylococcus aureus subsp. aureus Mu50
gaagaaugccuuuuauuuaucu

SEQ ID NO: 3960430 - RNA, 13 nt, Staphylococcus aureus subsp. aureus Mu50
gaagaccauuuua

SEQ ID NO: 3960431 - RNA, 15 nt, Staphylococcus aureus subsp. aureus Mu50
gaagagaugaaagau

SEQ ID NO: 3960432 - RNA, 13 nt, Staphylococcus aureus subsp. aureus Mu50
gaagaugauuauu

SEQ ID NO: 3960433 - RNA, 14 nt, Staphylococcus aureus subsp. aureus Mu50
gaagcacagaaaau

SEQ ID NO: 3960434 - RNA, 15 nt, Staphylococcus aureus subsp. aureus Mu50
gaagcacagaaaauu

SEQ ID NO: 3960435 - RNA, 20 nt, Staphylococcus aureus subsp. aureus Mu50
gaagcaguuguugguuuugc

SEQ ID NO: 3960436 - RNA, 22 nt, Staphylococcus aureus subsp. aureus Mu50
gaagcgcuuggauuuuuugguu

SEQ ID NO: 3960437 - RNA, 18 nt, Staphylococcus aureus subsp. aureus Mu50
gaagcugucuuacugcug

SEQ ID NO: 3960438 - RNA, 14 nt, Staphylococcus aureus subsp. aureus Mu50
gaaggaaaauaaaa

SEQ ID NO: 3960439 - RNA, 19 nt, Staphylococcus aureus subsp. aureus Mu50
gaaggaauguauucuaaga

SEQ ID NO: 3960440 - RNA, 20 nt, Staphylococcus aureus subsp. aureus Mu50
gaaggacaggaauaaauuuu

SEQ ID NO: 3960441 - RNA, 17 nt, Staphylococcus aureus subsp. aureus Mu50
gaaggagauauuuucuu

SEQ ID NO: 3960442 - RNA, 15 nt, Staphylococcus aureus subsp. aureus Mu50
gaaggauuuuagauu

SEQ ID NO: 3960443 - RNA, 16 nt, Staphylococcus aureus subsp. aureus Mu50
gaagggguuuuuucuu

SEQ ID NO: 3960444 - RNA, 14 nt, Staphylococcus aureus subsp. aureus Mu50
gaaguaauguuaaa

SEQ ID NO: 3960445 - RNA, 14 nt, Staphylococcus aureus subsp. aureus Mu50
gaaguauugccaaa

SEQ ID NO: 3960446 - RNA, 12 nt, Staphylococcus aureus subsp. aureus Mu50
gaaguuguuucu

SEQ ID NO: 3960447 - RNA, 23 nt, Staphylococcus aureus subsp. aureus Mu50
gaauaaagcguccucuugugaaa

SEQ ID NO: 3960448 - RNA, 14 nt, Staphylococcus aureus subsp. aureus Mu50
gaauaaaucgggca

SEQ ID NO: 3960449 - RNA, 21 nt, Staphylococcus aureus subsp. aureus Mu50
gaauaagugguuguucccauu

SEQ ID NO: 3960450 - RNA, 18 nt, Staphylococcus aureus subsp. aureus Mu50
gaauaauguuuucauugg

SEQ ID NO: 3960451 - RNA, 13 nt, Staphylococcus aureus subsp. aureus Mu50
gaauaauuaaaaa

SEQ ID NO: 3960452 - RNA, 23 nt, Staphylococcus aureus subsp. aureus Mu50
gaauaauuagauuuaaaauguca

SEQ ID NO: 3960453 - RNA, 18 nt, Staphylococcus aureus subsp. aureus Mu50
gaauaauugcuaaaauau

SEQ ID NO: 3960454 - RNA, 21 nt, Staphylococcus aureus subsp. aureus Mu50
gaauaauuggcugaugaacuu

SEQ ID NO: 3960455 - RNA, 18 nt, Staphylococcus aureus subsp. aureus Mu50
gaauaauuuuaaaaauaa

SEQ ID NO: 3960456 - RNA, 22 nt, Staphylococcus aureus subsp. aureus Mu50
gaauacacgacgcuaaacaaag

SEQ ID NO: 3960457 - RNA, 18 nt, Staphylococcus aureus subsp. aureus Mu50
gaauacaugaguaaaacu

SEQ ID NO: 3960458 - RNA, 19 nt, Staphylococcus aureus subsp. aureus Mu50
gaauacaugaguaaaacuc

SEQ ID NO: 3960459 - RNA, 18 nt, Staphylococcus aureus subsp. aureus Mu50
gaauaccguuauagcuca

SEQ ID NO: 3960460 - RNA, 15 nt, Staphylococcus aureus subsp. aureus Mu50
gaauacuaaaagugu

SEQ ID NO: 3960461 - RNA, 20 nt, Staphylococcus aureus subsp. aureus Mu50
gaauacucuucaaucuacca

SEQ ID NO: 3960462 - RNA, 17 nt, Staphylococcus aureus subsp. aureus Mu50
gaauacuuuauuugaua

SEQ ID NO: 3960463 - RNA, 13 nt, Staphylococcus aureus subsp. aureus Mu50
gaauacuuuuuaa

SEQ ID NO: 3960464 - RNA, 23 nt, Staphylococcus aureus subsp. aureus Mu50
gaauagugagcguauuauuauug

SEQ ID NO: 3960465 - RNA, 14 nt, Staphylococcus aureus subsp. aureus Mu50
gaauauaauaacaa

SEQ ID NO: 3960466 - RNA, 19 nt, Staphylococcus aureus subsp. aureus Mu50
gaauauaauaacaaucaaa

SEQ ID NO: 3960467 - RNA, 19 nt, Staphylococcus aureus subsp. aureus Mu50
gaauauacuuaauuuaaau

SEQ ID NO: 3960468 - RNA, 17 nt, Staphylococcus aureus subsp. aureus Mu50
gaauauagcugugauuu

SEQ ID NO: 3960469 - RNA, 18 nt, Staphylococcus aureus subsp. aureus Mu50
gaauaucuuaaagaauua

SEQ ID NO: 3960470 - RNA, 23 nt, Staphylococcus aureus subsp. aureus Mu50
gaauaugaauugcuuguuuuaaa

SEQ ID NO: 3960471 - RNA, 16 nt, Staphylococcus aureus subsp. aureus Mu50
gaauaugauauugauu

SEQ ID NO: 3960472 - RNA, 22 nt, Staphylococcus aureus subsp. aureus Mu50
gaauauuaacaccagauaucau

SEQ ID NO: 3960473 - RNA, 23 nt, Staphylococcus aureus subsp. aureus Mu50
gaauauuaacguuaguauaaacg

SEQ ID NO: 3960474 - RNA, 16 nt, Staphylococcus aureus subsp. aureus Mu50
gaauauuauucauaau

SEQ ID NO: 3960475 - RNA, 14 nt, Staphylococcus aureus subsp. aureus Mu50
gacaucuacaacgc

SEQ ID NO: 3960476 - RNA, 13 nt, Staphylococcus aureus subsp. aureus Mu50
gacauguccuguu

SEQ ID NO: 3960477 - RNA, 18 nt, Staphylococcus aureus subsp. aureus Mu50
gacauuacauuuaguaca

SEQ ID NO: 3960478 - RNA, 19 nt, Staphylococcus aureus subsp. aureus Mu50
gacauuuaaauauaaccua

SEQ ID NO: 3960479 - RNA, 15 nt, Staphylococcus aureus subsp. aureus Mu50
gacauuucaucaaua

SEQ ID NO: 3960480 - RNA, 16 nt, Staphylococcus aureus subsp. aureus Mu50
gacauuuguaaauauu

SEQ ID NO: 3960481 - RNA, 15 nt, Staphylococcus aureus subsp. aureus Mu50
gacauuuucaaguuu

SEQ ID NO: 3960482 - RNA, 18 nt, Staphylococcus aureus subsp. aureus Mu50
gaccacucaauucucuaa

SEQ ID NO: 3960483 - RNA, 21 nt, Staphylococcus aureus subsp. aureus Mu50
gaccacucaauucucuaacuu

SEQ ID NO: 3960484 - RNA, 19 nt, Staphylococcus aureus subsp. aureus Mu50
gaccauugucaugccuuca

SEQ ID NO: 3960485 - RNA, 21 nt, Staphylococcus aureus subsp. aureus Mu50
gaccauugucaugccuucauu

SEQ ID NO: 3960486 - RNA, 14 nt, Staphylococcus aureus subsp. aureus Mu50
gacccaaauuauau

SEQ ID NO: 3960487 - RNA, 23 nt, Staphylococcus aureus subsp. aureus Mu50
gacccuugucaguuuuuuuauaa

SEQ ID NO: 3960488 - RNA, 13 nt, Staphylococcus aureus subsp. aureus Mu50
gaccguugaaaug

SEQ ID NO: 3960489 - RNA, 15 nt, Staphylococcus aureus subsp. aureus Mu50
gaccuacuuuuucaa

SEQ ID NO: 3960490 - RNA, 21 nt, Staphylococcus aureus subsp. aureus Mu50
gaccucagguuguuaggggcu

SEQ ID NO: 3960491 - RNA, 23 nt, Staphylococcus aureus subsp. aureus Mu50
gaccuuaucugaccaguauacga

SEQ ID NO: 3960492 - RNA, 20 nt, Staphylococcus aureus subsp. aureus Mu50
gaccuucaauaucuucagcu

SEQ ID NO: 3960493 - RNA, 15 nt, Staphylococcus aureus subsp. aureus Mu50
gaccuucuucucuaa

SEQ ID NO: 3960494 - RNA, 16 nt, Staphylococcus aureus subsp. aureus Mu50
gaccuucuucucuaau

SEQ ID NO: 3960495 - RNA, 21 nt, Staphylococcus aureus subsp. aureus Mu50
gacgauaccuuuaauaauauu

SEQ ID NO: 3960496 - RNA, 16 nt, Staphylococcus aureus subsp. aureus Mu50
gacgauacguauauag

SEQ ID NO: 3960497 - RNA, 13 nt, Staphylococcus aureus subsp. aureus Mu50
gacgaucuauaau

SEQ ID NO: 3960498 - RNA, 18 nt, Staphylococcus aureus subsp. aureus Mu50
gacgaucuuuaaugauaa

SEQ ID NO: 3960499 - RNA, 20 nt, Staphylococcus aureus subsp. aureus Mu50
gacgauuuauuaguuuuuac

SEQ ID NO: 3960500 - RNA, 20 nt, Staphylococcus aureus subsp. aureus Mu50
gacgguauaaaaaaauuaac

SEQ ID NO: 3960501 - RNA, 19 nt, Staphylococcus aureus subsp. aureus Mu50
gacguaaguguaaaugaaa

SEQ ID NO: 3960502 - RNA, 13 nt, Staphylococcus aureus subsp. aureus Mu50
gacguaucaucaa

SEQ ID NO: 3960503 - RNA, 17 nt, Staphylococcus aureus subsp. aureus Mu50
gacguuuugguuguucu

SEQ ID NO: 3960504 - RNA, 16 nt, Staphylococcus aureus subsp. aureus Mu50
gacguuuuuuuauaaa

SEQ ID NO: 3960505 - RNA, 19 nt, Staphylococcus aureus subsp. aureus Mu50
gacuaaaaugaaugaagac

SEQ ID NO: 3960506 - RNA, 13 nt, Staphylococcus aureus subsp. aureus Mu50
gacuaaccacauu

SEQ ID NO: 3960507 - RNA, 14 nt, Staphylococcus aureus subsp. aureus Mu50
gacuaauaauuguc

SEQ ID NO: 3960508 - RNA, 23 nt, Staphylococcus aureus subsp. aureus Mu50
gacuaauuaucuucaucauugua

SEQ ID NO: 3960509 - RNA, 11 nt, Staphylococcus aureus subsp. aureus Mu50
gacuaauuuau

SEQ ID NO: 3960510 - RNA, 16 nt, Staphylococcus aureus subsp. aureus Mu50
gacuacaaguuuauaa

SEQ ID NO: 3960511 - RNA, 20 nt, Staphylococcus aureus subsp. aureus Mu50
gacuacuaaucuuaguuaaa

SEQ ID NO: 3960512 - RNA, 20 nt, Staphylococcus aureus subsp. aureus Mu50
gacuaguguaccuuguuuca

SEQ ID NO: 3960513 - RNA, 20 nt, Staphylococcus aureus subsp. aureus Mu50
gacuauaacaccaauuaaau

SEQ ID NO: 3960514 - RNA, 11 nt, Staphylococcus aureus subsp. aureus Mu50
gacuauuuuug

SEQ ID NO: 3960515 - RNA, 17 nt, Staphylococcus aureus subsp. aureus Mu50
gacucaagugaaucuaa

SEQ ID NO: 3960516 - RNA, 14 nt, Staphylococcus aureus subsp. aureus Mu50
gacucaauuucauu

SEQ ID NO: 3960517 - RNA, 16 nt, Staphylococcus aureus subsp. aureus Mu50
gacucuccaaauauug

SEQ ID NO: 3960518 - RNA, 17 nt, Staphylococcus aureus subsp. aureus Mu50
gacucuuaauuuugcaa

SEQ ID NO: 3960519 - RNA, 11 nt, Staphylococcus aureus subsp. aureus Mu50
gacugaaagaa

SEQ ID NO: 3960520 - RNA, 15 nt, Staphylococcus aureus subsp. aureus Mu50
gacugaacgaaaaug

SEQ ID NO: 3960521 - RNA, 20 nt, Staphylococcus aureus subsp. aureus Mu50
gacugaacgaaaauucgcuu

SEQ ID NO: 3960522 - RNA, 20 nt, Staphylococcus aureus subsp. aureus Mu50
gacugaaugagaaugugcuu

SEQ ID NO: 3960523 - RNA, 21 nt, Staphylococcus aureus subsp. aureus Mu50
gacugaaugagaaugugcuug

SEQ ID NO: 3960524 - RNA, 14 nt, Staphylococcus aureus subsp. aureus Mu50
gacugacuaauaaa

SEQ ID NO: 3960525 - RNA, 23 nt, Staphylococcus aureus subsp. aureus Mu50
gacugagaaaaauauuucuaaua

SEQ ID NO: 3960526 - RNA, 14 nt, Staphylococcus aureus subsp. aureus Mu50
gacuguagaaaaca

SEQ ID NO: 3960527 - RNA, 21 nt, Staphylococcus aureus subsp. aureus Mu50
gacuguuaaacgcugauuuua

SEQ ID NO: 3960528 - RNA, 18 nt, Staphylococcus aureus subsp. aureus Mu50
gacuuacauuuuaauaaa

SEQ ID NO: 3960529 - RNA, 16 nt, Staphylococcus aureus subsp. aureus Mu50
gacuuaucguaagcuu

SEQ ID NO: 3960530 - RNA, 20 nt, Staphylococcus aureus subsp. aureus Mu50
gacuuauucaacguauaagu

SEQ ID NO: 3960531 - RNA, 18 nt, Staphylococcus aureus subsp. aureus Mu50
gacuuauuugaaugcaaa

SEQ ID NO: 3960532 - RNA, 14 nt, Staphylococcus aureus subsp. aureus Mu50
gacuuauuuuucau

SEQ ID NO: 3960533 - RNA, 20 nt, Staphylococcus aureus subsp. aureus Mu50
gacuuauuuuucaucauuua

SEQ ID NO: 3960534 - RNA, 15 nt, Staphylococcus aureus subsp. aureus Mu50
gacuucccaaucgau

SEQ ID NO: 3960535 - RNA, 16 nt, Staphylococcus aureus subsp. aureus Mu50
gacuucgauaucaaug

SEQ ID NO: 3960536 - RNA, 14 nt, Staphylococcus aureus subsp. aureus Mu50
gacuucuuuauauu

SEQ ID NO: 3960537 - RNA, 19 nt, Staphylococcus aureus subsp. aureus Mu50
gacuucuuucaauuaaucg

SEQ ID NO: 3960538 - RNA, 17 nt, Staphylococcus aureus subsp. aureus Mu50
gacuugauaaaaaauga

SEQ ID NO: 3960539 - RNA, 15 nt, Staphylococcus aureus subsp. aureus Mu50
gacuuggugcccaag

SEQ ID NO: 3960540 - RNA, 16 nt, Staphylococcus aureus subsp. aureus Mu50
gacuuggugcccaagu

SEQ ID NO: 3960541 - RNA, 18 nt, Staphylococcus aureus subsp. aureus Mu50
gacuuuaaaucuuguucu

SEQ ID NO: 3960542 - RNA, 23 nt, Staphylococcus aureus subsp. aureus Mu50
gacuuuccaccagccucuguguu

SEQ ID NO: 3960543 - RNA, 16 nt, Staphylococcus aureus subsp. aureus Mu50
gacuuucuugaugaau

SEQ ID NO: 3960544 - RNA, 15 nt, Staphylococcus aureus subsp. aureus Mu50
gacuuugucauacua

SEQ ID NO: 3960545 - RNA, 23 nt, Staphylococcus aureus subsp. aureus Mu50
gacuuuuacagaacguucauaua

SEQ ID NO: 3960546 - RNA, 15 nt, Staphylococcus aureus subsp. aureus Mu50
gacuuuuagauuauc

SEQ ID NO: 3960547 - RNA, 21 nt, Staphylococcus aureus subsp. aureus Mu50
gacuuuuagauuaucuuucaa

SEQ ID NO: 3960548 - RNA, 14 nt, Staphylococcus aureus subsp. aureus Mu50
gagaaacaaaacaa

SEQ ID NO: 3960549 - RNA, 16 nt, Staphylococcus aureus subsp. aureus Mu50
gagaaauacuauucuu

SEQ ID NO: 3960550 - RNA, 13 nt, Staphylococcus aureus subsp. aureus Mu50
gagaaauuagaac

SEQ ID NO: 3960551 - RNA, 23 nt, Staphylococcus aureus subsp. aureus Mu50
gagaaauuuuucacuucaaacaa

SEQ ID NO: 3960552 - RNA, 20 nt, Staphylococcus aureus subsp. aureus Mu50
gagaaccauccauaggauuc

SEQ ID NO: 3960553 - RNA, 14 nt, Staphylococcus aureus subsp. aureus Mu50
gagaagcugucuua

SEQ ID NO: 3960554 - RNA, 22 nt, Staphylococcus aureus subsp. aureus Mu50
gagaaucgaaccaaauuuuaua

SEQ ID NO: 3960555 - RNA, 12 nt, Staphylococcus aureus subsp. aureus Mu50
gagaaucuccau

SEQ ID NO: 3960556 - RNA, 17 nt, Staphylococcus aureus subsp. aureus Mu50
gagaauuucgaaaagaa

SEQ ID NO: 3960557 - RNA, 19 nt, Staphylococcus aureus subsp. aureus Mu50
gagaauuucgaaaagaaau

SEQ ID NO: 3960558 - RNA, 14 nt, Staphylococcus aureus subsp. aureus Mu50
gagaauuuuaauua

SEQ ID NO: 3960559 - RNA, 18 nt, Staphylococcus aureus subsp. aureus Mu50
gagacaaaaauaaaccau

SEQ ID NO: 3960560 - RNA, 14 nt, Staphylococcus aureus subsp. aureus Mu50
gagacaacauuguu

SEQ ID NO: 3960561 - RNA, 15 nt, Staphylococcus aureus subsp. aureus Mu50
gagacaaguauacuu

SEQ ID NO: 3960562 - RNA, 16 nt, Staphylococcus aureus subsp. aureus Mu50
gagacguuuuccauga

SEQ ID NO: 3960563 - RNA, 14 nt, Staphylococcus aureus subsp. aureus Mu50
gauacgcacguaua

SEQ ID NO: 3960564 - RNA, 19 nt, Staphylococcus aureus subsp. aureus Mu50
gauacgcuuuuuaaaaaau

SEQ ID NO: 3960565 - RNA, 21 nt, Staphylococcus aureus subsp. aureus Mu50
gauacgugguuuuauuugauu

SEQ ID NO: 3960566 - RNA, 20 nt, Staphylococcus aureus subsp. aureus Mu50
gauacuaaacgauaaauuaa

SEQ ID NO: 3960567 - RNA, 16 nt, Staphylococcus aureus subsp. aureus Mu50
gauacuaauaucuucu

SEQ ID NO: 3960568 - RNA, 13 nt, Staphylococcus aureus subsp. aureus Mu50
gauacugaaauuu

SEQ ID NO: 3960569 - RNA, 23 nt, Staphylococcus aureus subsp. aureus Mu50
gauacugaaauuucauaaaguuu

SEQ ID NO: 3960570 - RNA, 15 nt, Staphylococcus aureus subsp. aureus Mu50
gauacugaauuuuaa

SEQ ID NO: 3960571 - RNA, 14 nt, Staphylococcus aureus subsp. aureus Mu50
gauacugauauuua

SEQ ID NO: 3960572 - RNA, 18 nt, Staphylococcus aureus subsp. aureus Mu50
gauacugauauuuagaau

SEQ ID NO: 3960573 - RNA, 14 nt, Staphylococcus aureus subsp. aureus Mu50
gauacuuugaaaga

SEQ ID NO: 3960574 - RNA, 21 nt, Staphylococcus aureus subsp. aureus Mu50
gauacuuuggcagacguauca

SEQ ID NO: 3960575 - RNA, 22 nt, Staphylococcus aureus subsp. aureus Mu50
gauacuuuuuguaguccuucuu

SEQ ID NO: 3960576 - RNA, 15 nt, Staphylococcus aureus subsp. aureus Mu50
gauagaaguuuuuug

SEQ ID NO: 3960577 - RNA, 19 nt, Staphylococcus aureus subsp. aureus Mu50
gauagaauacuaaaagugu

SEQ ID NO: 3960578 - RNA, 21 nt, Staphylococcus aureus subsp. aureus Mu50
gauagaauacuaaaaguguua

SEQ ID NO: 3960579 - RNA, 21 nt, Staphylococcus aureus subsp. aureus Mu50
gauagaaugucgauauuucua

SEQ ID NO: 3960580 - RNA, 19 nt, Staphylococcus aureus subsp. aureus Mu50
gauagauucugauacagaa

SEQ ID NO: 3960581 - RNA, 21 nt, Staphylococcus aureus subsp. aureus Mu50
gauagcaccguaacauaugua

SEQ ID NO: 3960582 - RNA, 18 nt, Staphylococcus aureus subsp. aureus Mu50
gauagccguuaacaucag

SEQ ID NO: 3960583 - RNA, 16 nt, Staphylococcus aureus subsp. aureus Mu50
gauaggaaacuuaaau

SEQ ID NO: 3960584 - RNA, 15 nt, Staphylococcus aureus subsp. aureus Mu50
gauaggauauuuuuu

SEQ ID NO: 3960585 - RNA, 13 nt, Staphylococcus aureus subsp. aureus Mu50
gauaggauuuaca

SEQ ID NO: 3960586 - RNA, 22 nt, Staphylococcus aureus subsp. aureus Mu50
gauaggauuuacaccuauaccu

SEQ ID NO: 3960587 - RNA, 22 nt, Staphylococcus aureus subsp. aureus Mu50
gauaggauuugcaccuauaccu

SEQ ID NO: 3960588 - RNA, 15 nt, Staphylococcus aureus subsp. aureus Mu50
gauagguaacuaaaa

SEQ ID NO: 3960589 - RNA, 20 nt, Staphylococcus aureus subsp. aureus Mu50
gauaguacauuuauuuucaa

SEQ ID NO: 3960590 - RNA, 13 nt, Staphylococcus aureus subsp. aureus Mu50
gauagugaauaau

SEQ ID NO: 3960591 - RNA, 14 nt, Staphylococcus aureus subsp. aureus Mu50
gauagugaauaaug

SEQ ID NO: 3960592 - RNA, 16 nt, Staphylococcus aureus subsp. aureus Mu50
gauauaaugaaguuau

SEQ ID NO: 3960593 - RNA, 18 nt, Staphylococcus aureus subsp. aureus Mu50
gauauaaugaaguuauga

SEQ ID NO: 3960594 - RNA, 15 nt, Staphylococcus aureus subsp. aureus Mu50
gauauagaaaaggga

SEQ ID NO: 3960595 - RNA, 18 nt, Staphylococcus aureus subsp. aureus Mu50
gauauagaauucacgcaa

SEQ ID NO: 3960596 - RNA, 20 nt, Staphylococcus aureus subsp. aureus Mu50
gauauagauggcuuuuuuug

SEQ ID NO: 3960597 - RNA, 23 nt, Staphylococcus aureus subsp. aureus Mu50
gauauauaacuauggucaucaau

SEQ ID NO: 3960598 - RNA, 16 nt, Staphylococcus aureus subsp. aureus Mu50
gauaucaauguauugu

SEQ ID NO: 3960599 - RNA, 21 nt, Staphylococcus aureus subsp. aureus Mu50
gauaucagcuaaguuaaauau

SEQ ID NO: 3960600 - RNA, 17 nt, Staphylococcus aureus subsp. aureus Mu50
gauaucuggauuaacug

SEQ ID NO: 3960601 - RNA, 19 nt, Staphylococcus aureus subsp. aureus Mu50
gauaucuuaaucuaaaaau

SEQ ID NO: 3960602 - RNA, 12 nt, Staphylococcus aureus subsp. aureus Mu50
gauaucuuuuaa

SEQ ID NO: 3960603 - RNA, 15 nt, Staphylococcus aureus subsp. aureus Mu50
gauauggaucauaau

SEQ ID NO: 3960604 - RNA, 20 nt, Staphylococcus aureus subsp. aureus Mu50
gauauuaauugaaaaaccaa

SEQ ID NO: 3960605 - RNA, 20 nt, Staphylococcus aureus subsp. aureus Mu50
gauauucauguucuuguaau

SEQ ID NO: 3960606 - RNA, 18 nt, Staphylococcus aureus subsp. aureus Mu50
gauauucgcgaacguuau

SEQ ID NO: 3960607 - RNA, 20 nt, Staphylococcus aureus subsp. aureus Mu50
gauauugaccaccuguaucu

SEQ ID NO: 3960608 - RNA, 13 nt, Staphylococcus aureus subsp. aureus Mu50
gauauuuaacaaa

SEQ ID NO: 3960609 - RNA, 23 nt, Staphylococcus aureus subsp. aureus Mu50
gauauuuaacaaaauuaagaaga

SEQ ID NO: 3960610 - RNA, 22 nt, Staphylococcus aureus subsp. aureus Mu50
gauauuucaacuuuuuaauaau

SEQ ID NO: 3960611 - RNA, 23 nt, Staphylococcus aureus subsp. aureus Mu50
gauauuucaacuuuuuaauaaua

SEQ ID NO: 3960612 - RNA, 15 nt, Staphylococcus aureus subsp. aureus Mu50
gauauuuccaaauug

SEQ ID NO: 3960613 - RNA, 16 nt, Staphylococcus aureus subsp. aureus Mu50
gauauuuuuuaauaau

SEQ ID NO: 3960614 - RNA, 20 nt, Staphylococcus aureus subsp. aureus Mu50
gauauuuuuuaauaaucaaa

SEQ ID NO: 3960615 - RNA, 17 nt, Staphylococcus aureus subsp. aureus Mu50
gaucaaaaauguuaucu

SEQ ID NO: 3960616 - RNA, 12 nt, Staphylococcus aureus subsp. aureus Mu50
gaucaaaaucau

SEQ ID NO: 3960617 - RNA, 15 nt, Staphylococcus aureus subsp. aureus Mu50
gaucaaaaucaugcu

SEQ ID NO: 3960618 - RNA, 14 nt, Staphylococcus aureus subsp. aureus Mu50
gaucaacaaugcca

SEQ ID NO: 3960619 - RNA, 14 nt, Staphylococcus aureus subsp. aureus Mu50
gaucacacgacaug

SEQ ID NO: 3960620 - RNA, 21 nt, Staphylococcus aureus subsp. aureus Mu50
gaucacuuacugugaaaauac

SEQ ID NO: 3960621 - RNA, 18 nt, Staphylococcus aureus subsp. aureus Mu50
gaucauaaauauuuucug

SEQ ID NO: 3960622 - RNA, 17 nt, Staphylococcus aureus subsp. aureus Mu50
gaucaucuauauuuaau

SEQ ID NO: 3960623 - RNA, 13 nt, Staphylococcus aureus subsp. aureus Mu50
gaucaugccuuca

SEQ ID NO: 3960624 - RNA, 14 nt, Staphylococcus aureus subsp. aureus Mu50
gaucauuauuuaga

SEQ ID NO: 3960625 - RNA, 19 nt, Staphylococcus aureus subsp. aureus Mu50
gaucauuuucaacauaaua

SEQ ID NO: 3960626 - RNA, 17 nt, Staphylococcus aureus subsp. aureus Mu50
gaucauuuucauuuaau

SEQ ID NO: 3960627 - RNA, 17 nt, Staphylococcus aureus subsp. aureus Mu50
gauccaaaguacucaag

SEQ ID NO: 3960628 - RNA, 19 nt, Staphylococcus aureus subsp. aureus Mu50
gauccaaaguacucaagua

SEQ ID NO: 3960629 - RNA, 14 nt, Staphylococcus aureus subsp. aureus Mu50
gaucgauacuuuuu

SEQ ID NO: 3960630 - RNA, 20 nt, Staphylococcus aureus subsp. aureus Mu50
gaucgcccauacuaaauaag

SEQ ID NO: 3960631 - RNA, 13 nt, Staphylococcus aureus subsp. aureus Mu50
gaucugauuucac

SEQ ID NO: 3960632 - RNA, 20 nt, Staphylococcus aureus subsp. aureus Mu50
gaucuguccauuuaucuuua

SEQ ID NO: 3960633 - RNA, 22 nt, Staphylococcus aureus subsp. aureus Mu50
gaucuuggccaauuaacuugau

SEQ ID NO: 3960634 - RNA, 12 nt, Staphylococcus aureus subsp. aureus Mu50
gaugaaaaagau

SEQ ID NO: 3960635 - RNA, 14 nt, Staphylococcus aureus subsp. aureus Mu50
gaugaaaauauagu

SEQ ID NO: 3960636 - RNA, 22 nt, Staphylococcus aureus subsp. aureus Mu50
gaugaaagacugacuaauaaaa

SEQ ID NO: 3960637 - RNA, 18 nt, Staphylococcus aureus subsp. aureus Mu50
gaugaaauauucuuuaau

SEQ ID NO: 3960638 - RNA, 23 nt, Staphylococcus aureus subsp. aureus Mu50
gaugaacaaaauaacauguuugu

SEQ ID NO: 3960639 - RNA, 21 nt, Staphylococcus aureus subsp. aureus Mu50
gaugaacuuaaugcuucaaau

SEQ ID NO: 3960640 - RNA, 17 nt, Staphylococcus aureus subsp. aureus Mu50
gaugaaucccauaacaa

SEQ ID NO: 3960641 - RNA, 22 nt, Staphylococcus aureus subsp. aureus Mu50
gaugaaucccauaacaaucauu

SEQ ID NO: 3960642 - RNA, 16 nt, Staphylococcus aureus subsp. aureus Mu50
gaugaaugauugcauu

SEQ ID NO: 3960643 - RNA, 22 nt, Staphylococcus aureus subsp. aureus Mu50
gaugaauggauuuucuucacca

SEQ ID NO: 3960644 - RNA, 14 nt, Staphylococcus aureus subsp. aureus Mu50
gaugaauuaaacug

SEQ ID NO: 3960645 - RNA, 13 nt, Staphylococcus aureus subsp. aureus Mu50
gaugacauggcac

SEQ ID NO: 3960646 - RNA, 21 nt, Staphylococcus aureus subsp. aureus Mu50
gaugacugaaccaauccaaua

SEQ ID NO: 3960647 - RNA, 23 nt, Staphylococcus aureus subsp. aureus Mu50
gaugacuuugucuuuaaugaaag

SEQ ID NO: 3960648 - RNA, 13 nt, Staphylococcus aureus subsp. aureus Mu50
gaugagaaauguu

SEQ ID NO: 3960649 - RNA, 12 nt, Staphylococcus aureus subsp. aureus Mu50
gaugaugcuucg

SEQ ID NO: 3960650 - RNA, 22 nt, Staphylococcus aureus subsp. aureus Mu50
gauuggaaaguuucuccaccug

SEQ ID NO: 3960651 - RNA, 19 nt, Staphylococcus aureus subsp. aureus Mu50
gauuggcagugaucuuuuu

SEQ ID NO: 3960652 - RNA, 19 nt, Staphylococcus aureus subsp. aureus Mu50
gauuggcugugcuauaauc

SEQ ID NO: 3960653 - RNA, 14 nt, Staphylococcus aureus subsp. aureus Mu50
gauugguaaaucua

SEQ ID NO: 3960654 - RNA, 16 nt, Staphylococcus aureus subsp. aureus Mu50
gauuguaagaauuaau

SEQ ID NO: 3960655 - RNA, 13 nt, Staphylococcus aureus subsp. aureus Mu50
gauuguaccagua

SEQ ID NO: 3960656 - RNA, 15 nt, Staphylococcus aureus subsp. aureus Mu50
gauugucuuauaaga

SEQ ID NO: 3960657 - RNA, 21 nt, Staphylococcus aureus subsp. aureus Mu50
gauuguuuauucgguccuuug

SEQ ID NO: 3960658 - RNA, 17 nt, Staphylococcus aureus subsp. aureus Mu50
gauuuaacauaaaaaug

SEQ ID NO: 3960659 - RNA, 18 nt, Staphylococcus aureus subsp. aureus Mu50
gauuuaagauuuaauaaa

SEQ ID NO: 3960660 - RNA, 11 nt, Staphylococcus aureus subsp. aureus Mu50
gauuuaauaaa

SEQ ID NO: 3960661 - RNA, 21 nt, Staphylococcus aureus subsp. aureus Mu50
gauuuaauugaaauagaaacu

SEQ ID NO: 3960662 - RNA, 14 nt, Staphylococcus aureus subsp. aureus Mu50
gauuuacaccuaua

SEQ ID NO: 3960663 - RNA, 21 nt, Staphylococcus aureus subsp. aureus Mu50
gauuuaccucuugauaaaaua

SEQ ID NO: 3960664 - RNA, 16 nt, Staphylococcus aureus subsp. aureus Mu50
gauuuagcauacauua

SEQ ID NO: 3960665 - RNA, 20 nt, Staphylococcus aureus subsp. aureus Mu50
gauuuaguuuuuuuaaaguu

SEQ ID NO: 3960666 - RNA, 21 nt, Staphylococcus aureus subsp. aureus Mu50
gauuuaucaccuuuaggcaaa

SEQ ID NO: 3960667 - RNA, 15 nt, Staphylococcus aureus subsp. aureus Mu50
gauuuauuaaauaua

SEQ ID NO: 3960668 - RNA, 20 nt, Staphylococcus aureus subsp. aureus Mu50
gauuuauuauuaccauaacu

SEQ ID NO: 3960669 - RNA, 13 nt, Staphylococcus aureus subsp. aureus Mu50
gauuuauucuaaa

SEQ ID NO: 3960670 - RNA, 15 nt, Staphylococcus aureus subsp. aureus Mu50
gauuucaguucauca

SEQ ID NO: 3960671 - RNA, 16 nt, Staphylococcus aureus subsp. aureus Mu50
gauuucaguucaucau

SEQ ID NO: 3960672 - RNA, 20 nt, Staphylococcus aureus subsp. aureus Mu50
gauuucccacgugccucauc

SEQ ID NO: 3960673 - RNA, 15 nt, Staphylococcus aureus subsp. aureus Mu50
gauuuccucgguuuu

SEQ ID NO: 3960674 - RNA, 23 nt, Staphylococcus aureus subsp. aureus Mu50
gauuucguuagacucacuucuua

SEQ ID NO: 3960675 - RNA, 12 nt, Staphylococcus aureus subsp. aureus Mu50
gauuucuuauuu

SEQ ID NO: 3960676 - RNA, 21 nt, Staphylococcus aureus subsp. aureus Mu50
gauuucuucauuaucaauaga

SEQ ID NO: 3960677 - RNA, 19 nt, Staphylococcus aureus subsp. aureus Mu50
gauuucuuuaugauaauaa

SEQ ID NO: 3960678 - RNA, 14 nt, Staphylococcus aureus subsp. aureus Mu50
gauuugaaauuuau

SEQ ID NO: 3960679 - RNA, 18 nt, Staphylococcus aureus subsp. aureus Mu50
gauuuggguaauguuuuu

SEQ ID NO: 3960680 - RNA, 18 nt, Staphylococcus aureus subsp. aureus Mu50
gauuuguagcuugaauaa

SEQ ID NO: 3960681 - RNA, 15 nt, Staphylococcus aureus subsp. aureus Mu50
gauuuuaacaagaua

SEQ ID NO: 3960682 - RNA, 19 nt, Staphylococcus aureus subsp. aureus Mu50
gauuuuaagugguuaucac

SEQ ID NO: 3960683 - RNA, 12 nt, Staphylococcus aureus subsp. aureus Mu50
gauuuuaauuau

SEQ ID NO: 3960684 - RNA, 14 nt, Staphylococcus aureus subsp. aureus Mu50
gauuuuacuugaau

SEQ ID NO: 3960685 - RNA, 13 nt, Staphylococcus aureus subsp. aureus Mu50
gauuuuagauuua

SEQ ID NO: 3960686 - RNA, 15 nt, Staphylococcus aureus subsp. aureus Mu50
gauuuuauaaaguuu

SEQ ID NO: 3960687 - RNA, 11 nt, Staphylococcus aureus subsp. aureus Mu50
gauuuuauaau

SEQ ID NO: 3960688 - RNA, 21 nt, Staphylococcus aureus subsp. aureus Mu50
gauuuuauauaaaaagaagau

SEQ ID NO: 3960689 - RNA, 22 nt, Staphylococcus aureus subsp. aureus Mu50
gauuuucgagugugucaacuua

SEQ ID NO: 3960690 - RNA, 14 nt, Staphylococcus aureus subsp. aureus Mu50
gauuuugaauuuua

SEQ ID NO: 3960691 - RNA, 10 nt, Staphylococcus aureus subsp. aureus Mu50
gauuuugcuu

SEQ ID NO: 3960692 - RNA, 20 nt, Staphylococcus aureus subsp. aureus Mu50
gauuuuguuucaaacgugau

SEQ ID NO: 3960693 - RNA, 17 nt, Staphylococcus aureus subsp. aureus Mu50
gauuuuuacaaagugau

SEQ ID NO: 3960694 - RNA, 15 nt, Staphylococcus aureus subsp. aureus Mu50
gauuuuuugguuucu

SEQ ID NO: 3960695 - RNA, 14 nt, Staphylococcus aureus subsp. aureus Mu50
gauuuuuuuguucu

SEQ ID NO: 3960696 - RNA, 18 nt, Staphylococcus aureus subsp. aureus Mu50
gcaaaaauaauaugaauu

SEQ ID NO: 3960697 - RNA, 18 nt, Staphylococcus aureus subsp. aureus Mu50
gcaaaaauauuuaaacua

SEQ ID NO: 3960698 - RNA, 13 nt, Staphylococcus aureus subsp. aureus Mu50
gcaaaacuaauca

SEQ ID NO: 3960699 - RNA, 19 nt, Staphylococcus aureus subsp. aureus Mu50
gcaaaacuugcgcaugcuu

SEQ ID NO: 3960700 - RNA, 20 nt, Staphylococcus aureus subsp. aureus Mu50
gcaaaacuugcgcaugcuuu

SEQ ID NO: 3960701 - RNA, 11 nt, Staphylococcus aureus subsp. aureus Mu50
gcaaaaucaac

SEQ ID NO: 3960702 - RNA, 15 nt, Staphylococcus aureus subsp. aureus Mu50
gcaaaauuauguaaa

SEQ ID NO: 3960703 - RNA, 18 nt, Staphylococcus aureus subsp. aureus Mu50
gcaaaauuauguaaaaaa

SEQ ID NO: 3960704 - RNA, 15 nt, Staphylococcus aureus subsp. aureus Mu50
gcaaacacaguacaa

SEQ ID NO: 3960705 - RNA, 17 nt, Staphylococcus aureus subsp. aureus Mu50
gcaaacgcacuaucaau

SEQ ID NO: 3960706 - RNA, 23 nt, Staphylococcus aureus subsp. aureus Mu50
gcaaacgcacuaucaaugacauc

SEQ ID NO: 3960707 - RNA, 16 nt, Staphylococcus aureus subsp. aureus Mu50
gcaaacuugauucaau

SEQ ID NO: 3960708 - RNA, 18 nt, Staphylococcus aureus subsp. aureus Mu50
gcaaagacucaauuucau

SEQ ID NO: 3960709 - RNA, 20 nt, Staphylococcus aureus subsp. aureus Mu50
gcaaaggcgcaccaugugcc

SEQ ID NO: 3960710 - RNA, 14 nt, Staphylococcus aureus subsp. aureus Mu50
gcaaagucauuaaa

SEQ ID NO: 3960711 - RNA, 12 nt, Staphylococcus aureus subsp. aureus Mu50
gcaaauaaaaaa

SEQ ID NO: 3960712 - RNA, 13 nt, Staphylococcus aureus subsp. aureus Mu50
gcaaauauaucau

SEQ ID NO: 3960713 - RNA, 16 nt, Staphylococcus aureus subsp. aureus Mu50
gcaaauauuaaauuau

SEQ ID NO: 3960714 - RNA, 15 nt, Staphylococcus aureus subsp. aureus Mu50
gcaaauauuauuaaa

SEQ ID NO: 3960715 - RNA, 13 nt, Staphylococcus aureus subsp. aureus Mu50
gcaaauauuucug

SEQ ID NO: 3960716 - RNA, 17 nt, Staphylococcus aureus subsp. aureus Mu50
gcaaaucucgucacaua

SEQ ID NO: 3960717 - RNA, 19 nt, Staphylococcus aureus subsp. aureus Mu50
gcaaaugaaauucuuuugu

SEQ ID NO: 3960718 - RNA, 18 nt, Staphylococcus aureus subsp. aureus Mu50
gcaaauuaguaugacuua

SEQ ID NO: 3960719 - RNA, 15 nt, Staphylococcus aureus subsp. aureus Mu50
gcaaauuauauagaa

SEQ ID NO: 3960720 - RNA, 19 nt, Staphylococcus aureus subsp. aureus Mu50
gcaaauuauauagaaaacu

SEQ ID NO: 3960721 - RNA, 16 nt, Staphylococcus aureus subsp. aureus Mu50
gcaaauuaucauuaaa

SEQ ID NO: 3960722 - RNA, 20 nt, Staphylococcus aureus subsp. aureus Mu50
gcaaauucaacuuuaaucaa

SEQ ID NO: 3960723 - RNA, 17 nt, Staphylococcus aureus subsp. aureus Mu50
gcaaauugauuaaauaa

SEQ ID NO: 3960724 - RNA, 18 nt, Staphylococcus aureus subsp. aureus Mu50
gcaaauugauuaaauaaa

SEQ ID NO: 3960725 - RNA, 16 nt, Staphylococcus aureus subsp. aureus Mu50
gcaacaaaagauguug

SEQ ID NO: 3960726 - RNA, 20 nt, Staphylococcus aureus subsp. aureus Mu50
gcaacauauuuucacaauca

SEQ ID NO: 3960727 - RNA, 11 nt, Staphylococcus aureus subsp. aureus Mu50
gcaacauuuga

SEQ ID NO: 3960728 - RNA, 12 nt, Staphylococcus aureus subsp. aureus Mu50
gcaacuaagaug

SEQ ID NO: 3960729 - RNA, 18 nt, Staphylococcus aureus subsp. aureus Mu50
gcaacuaagaugacugaa

SEQ ID NO: 3960730 - RNA, 18 nt, Staphylococcus aureus subsp. aureus Mu50
gcaacugaucauuuucau

SEQ ID NO: 3960731 - RNA, 17 nt, Staphylococcus aureus subsp. aureus Mu50
gcaacuugggauuuuuu

SEQ ID NO: 3960732 - RNA, 22 nt, Staphylococcus aureus subsp. aureus Mu50
gcaacuuguccguuuuuaguau

SEQ ID NO: 3960733 - RNA, 14 nt, Staphylococcus aureus subsp. aureus Mu50
gcaagccaucaaua

SEQ ID NO: 3960734 - RNA, 18 nt, Staphylococcus aureus subsp. aureus Mu50
gcaagccuucuauauagu

SEQ ID NO: 3960735 - RNA, 20 nt, Staphylococcus aureus subsp. aureus Mu50
gcaagucguucucuuaaaua

SEQ ID NO: 3960736 - RNA, 19 nt, Staphylococcus aureus subsp. aureus Mu50
gcaagugaguaacauuugc

SEQ ID NO: 3960737 - RNA, 14 nt, Staphylococcus aureus subsp. aureus Mu50
gcaaguuggcgggg

SEQ ID NO: 3960738 - RNA, 18 nt, Staphylococcus aureus subsp. aureus Mu50
gcaucuccaaaggccaug

SEQ ID NO: 3960739 - RNA, 16 nt, Staphylococcus aureus subsp. aureus Mu50
gcaucuuuuacugcuu

SEQ ID NO: 3960740 - RNA, 21 nt, Staphylococcus aureus subsp. aureus Mu50
gcaucuuuuacugcuucgaca

SEQ ID NO: 3960741 - RNA, 23 nt, Staphylococcus aureus subsp. aureus Mu50
gcaucuuuuacugcuucgacauu

SEQ ID NO: 3960742 - RNA, 19 nt, Staphylococcus aureus subsp. aureus Mu50
gcaugaaucgcauuuaaau

SEQ ID NO: 3960743 - RNA, 14 nt, Staphylococcus aureus subsp. aureus Mu50
gcaugacagcaaau

SEQ ID NO: 3960744 - RNA, 17 nt, Staphylococcus aureus subsp. aureus Mu50
gcaugacagcaaauuuu

SEQ ID NO: 3960745 - RNA, 14 nt, Staphylococcus aureus subsp. aureus Mu50
gcaugacuguaagu

SEQ ID NO: 3960746 - RNA, 13 nt, Staphylococcus aureus subsp. aureus Mu50
gcaugcgcaaaag

SEQ ID NO: 3960747 - RNA, 19 nt, Staphylococcus aureus subsp. aureus Mu50
gcaugcgcaaaagcgcagg

SEQ ID NO: 3960748 - RNA, 14 nt, Staphylococcus aureus subsp. aureus Mu50
gcauguaagcuauc

SEQ ID NO: 3960749 - RNA, 22 nt, Staphylococcus aureus subsp. aureus Mu50
gcauguuuaaauaucaugcaaa

SEQ ID NO: 3960750 - RNA, 17 nt, Staphylococcus aureus subsp. aureus Mu50
gcauuaauguucaauuu

SEQ ID NO: 3960751 - RNA, 23 nt, Staphylococcus aureus subsp. aureus Mu50
gcauuauuaaggggguaauacua

SEQ ID NO: 3960752 - RNA, 14 nt, Staphylococcus aureus subsp. aureus Mu50
gcauuauuauaaua

SEQ ID NO: 3960753 - RNA, 18 nt, Staphylococcus aureus subsp. aureus Mu50
gcauuauuauuaaauuau

SEQ ID NO: 3960754 - RNA, 20 nt, Staphylococcus aureus subsp. aureus Mu50
gcauuauuauuucauuagaa

SEQ ID NO: 3960755 - RNA, 21 nt, Staphylococcus aureus subsp. aureus Mu50
gcauuauuauuucauuagaaa

SEQ ID NO: 3960756 - RNA, 15 nt, Staphylococcus aureus subsp. aureus Mu50
gcauucuuccaacac

SEQ ID NO: 3960757 - RNA, 14 nt, Staphylococcus aureus subsp. aureus Mu50
gcauugaccaccuu

SEQ ID NO: 3960758 - RNA, 15 nt, Staphylococcus aureus subsp. aureus Mu50
gcauugagauggucu

SEQ ID NO: 3960759 - RNA, 12 nt, Staphylococcus aureus subsp. aureus Mu50
gcauuuaaauau

SEQ ID NO: 3960760 - RNA, 16 nt, Staphylococcus aureus subsp. aureus Mu50
gcauuuacgaaguuua

SEQ ID NO: 3960761 - RNA, 14 nt, Staphylococcus aureus subsp. aureus Mu50
gcauuuuaaauaaa

SEQ ID NO: 3960762 - RNA, 13 nt, Staphylococcus aureus subsp. aureus Mu50
gcauuuuguuuca

SEQ ID NO: 3960763 - RNA, 19 nt, Staphylococcus aureus subsp. aureus Mu50
gcauuuuuauguuaaaucg

SEQ ID NO: 3960764 - RNA, 18 nt, Staphylococcus aureus subsp. aureus Mu50
gcauuuuuucauuauuaa

SEQ ID NO: 3960765 - RNA, 21 nt, Staphylococcus aureus subsp. aureus Mu50
gccaaacaaccugugauaaaa

SEQ ID NO: 3960766 - RNA, 18 nt, Staphylococcus aureus subsp. aureus Mu50
gccaaaggcaaaauguau

SEQ ID NO: 3960767 - RNA, 17 nt, Staphylococcus aureus subsp. aureus Mu50
gccaaauaucaguaaua

SEQ ID NO: 3960768 - RNA, 19 nt, Staphylococcus aureus subsp. aureus Mu50
gccaaauaucaguaauaau

SEQ ID NO: 3960769 - RNA, 20 nt, Staphylococcus aureus subsp. aureus Mu50
gccaaauaucaguaauaaua

SEQ ID NO: 3960770 - RNA, 22 nt, Staphylococcus aureus subsp. aureus Mu50
gccaaauuucucuuucaagacc

SEQ ID NO: 3960771 - RNA, 14 nt, Staphylococcus aureus subsp. aureus Mu50
gccaagugguucag

SEQ ID NO: 3960772 - RNA, 14 nt, Staphylococcus aureus subsp. aureus Mu50
gccaauaaaauguc

SEQ ID NO: 3960773 - RNA, 17 nt, Staphylococcus aureus subsp. aureus Mu50
gccaaugcuuccaucac

SEQ ID NO: 3960774 - RNA, 13 nt, Staphylococcus aureus subsp. aureus Mu50
gccaauuaaaauu

SEQ ID NO: 3960775 - RNA, 17 nt, Staphylococcus aureus subsp. aureus Mu50
gccacaacauguuugga

SEQ ID NO: 3960776 - RNA, 14 nt, Staphylococcus aureus subsp. aureus Mu50
gccaccaguuucaa

SEQ ID NO: 3960777 - RNA, 22 nt, Staphylococcus aureus subsp. aureus Mu50
gccacugucauguguucaaaua

SEQ ID NO: 3960778 - RNA, 14 nt, Staphylococcus aureus subsp. aureus Mu50
gccaguccauuauu

SEQ ID NO: 3960779 - RNA, 21 nt, Staphylococcus aureus subsp. aureus Mu50
gccauaaucuucauuaauuac

SEQ ID NO: 3960780 - RNA, 22 nt, Staphylococcus aureus subsp. aureus Mu50
gccauagaaaugugcugugucu

SEQ ID NO: 3960781 - RNA, 23 nt, Staphylococcus aureus subsp. aureus Mu50
gccauauguuuuagaauaguuac

SEQ ID NO: 3960782 - RNA, 12 nt, Staphylococcus aureus subsp. aureus Mu50
gccauauuuauu

SEQ ID NO: 3960783 - RNA, 12 nt, Staphylococcus aureus subsp. aureus Mu50
gccaucaauauu

SEQ ID NO: 3960784 - RNA, 16 nt, Staphylococcus aureus subsp. aureus Mu50
gccaucaauuucugua

SEQ ID NO: 3960785 - RNA, 15 nt, Staphylococcus aureus subsp. aureus Mu50
gccaucuuaccuuua

SEQ ID NO: 3960786 - RNA, 19 nt, Staphylococcus aureus subsp. aureus Mu50
gccauguuggcaauuguuu

SEQ ID NO: 3960787 - RNA, 19 nt, Staphylococcus aureus subsp. aureus Mu50
gccauuaaaccuaaucuac

SEQ ID NO: 3960788 - RNA, 12 nt, Staphylococcus aureus subsp. aureus Mu50
gccauucuuuuu

SEQ ID NO: 3960789 - RNA, 18 nt, Staphylococcus aureus subsp. aureus Mu50
gccauuguuauccaaaac

SEQ ID NO: 3960790 - RNA, 20 nt, Staphylococcus aureus subsp. aureus Mu50
gccauuuuuauuuaacacuu

SEQ ID NO: 3960791 - RNA, 12 nt, Staphylococcus aureus subsp. aureus Mu50
gcccacacccca

SEQ ID NO: 3960792 - RNA, 14 nt, Staphylococcus aureus subsp. aureus Mu50
gcccacaccccaac

SEQ ID NO: 3960793 - RNA, 13 nt, Staphylococcus aureus subsp. aureus Mu50
gcccauaccacca

SEQ ID NO: 3960794 - RNA, 18 nt, Staphylococcus aureus subsp. aureus Mu50
gcccauacuaaauaagua

SEQ ID NO: 3960795 - RNA, 15 nt, Staphylococcus aureus subsp. aureus Mu50
gcccaucaucacugu

SEQ ID NO: 3960796 - RNA, 15 nt, Staphylococcus aureus subsp. aureus Mu50
gccccaacaaagaag

SEQ ID NO: 3960797 - RNA, 15 nt, Staphylococcus aureus subsp. aureus Mu50
gccccaacaaagaga

SEQ ID NO: 3960798 - RNA, 12 nt, Staphylococcus aureus subsp. aureus Mu50
gccccaacacag

SEQ ID NO: 3960799 - RNA, 13 nt, Staphylococcus aureus subsp. aureus Mu50
gccccaacacaga

SEQ ID NO: 3960800 - RNA, 14 nt, Staphylococcus aureus subsp. aureus Mu50
gccccaacacagaa

SEQ ID NO: 3960801 - RNA, 15 nt, Staphylococcus aureus subsp. aureus Mu50
gccccaacacagaag

SEQ ID NO: 3960802 - RNA, 14 nt, Staphylococcus aureus subsp. aureus Mu50
gccccaacacagag

SEQ ID NO: 3960803 - RNA, 17 nt, Staphylococcus aureus subsp. aureus Mu50
gccccaacacagagaau

SEQ ID NO: 3960804 - RNA, 17 nt, Staphylococcus aureus subsp. aureus Mu50
gccccaucuauuagaaa

SEQ ID NO: 3960805 - RNA, 20 nt, Staphylococcus aureus subsp. aureus Mu50
gccccuagcaaaaauacuuu

SEQ ID NO: 3960806 - RNA, 23 nt, Staphylococcus aureus subsp. aureus Mu50
gccccuuguucuccgaucaugcc

SEQ ID NO: 3960807 - RNA, 15 nt, Staphylococcus aureus subsp. aureus Mu50
gcccgacaucauaaa

SEQ ID NO: 3960808 - RNA, 22 nt, Staphylococcus aureus subsp. aureus Mu50
gccgauaauuugagaaaugaaa

SEQ ID NO: 3960809 - RNA, 13 nt, Staphylococcus aureus subsp. aureus Mu50
gccuaauaauaaa

SEQ ID NO: 3960810 - RNA, 19 nt, Staphylococcus aureus subsp. aureus Mu50
gccuaauaauaaaauagcu

SEQ ID NO: 3960811 - RNA, 23 nt, Staphylococcus aureus subsp. aureus Mu50
gccuaauacacuugauaaaacua

SEQ ID NO: 3960812 - RNA, 18 nt, Staphylococcus aureus subsp. aureus Mu50
gccuacuguuucacguaa

SEQ ID NO: 3960813 - RNA, 20 nt, Staphylococcus aureus subsp. aureus Mu50
gccuacuguuucacguaaug

SEQ ID NO: 3960814 - RNA, 16 nt, Staphylococcus aureus subsp. aureus Mu50
gccuauccauucaaau

SEQ ID NO: 3960815 - RNA, 21 nt, Staphylococcus aureus subsp. aureus Mu50
gccuaugugaugguaaaucau

SEQ ID NO: 3960816 - RNA, 13 nt, Staphylococcus aureus subsp. aureus Mu50
gccuauuuaaaag

SEQ ID NO: 3960817 - RNA, 15 nt, Staphylococcus aureus subsp. aureus Mu50
gccuauuugacacau

SEQ ID NO: 3960818 - RNA, 12 nt, Staphylococcus aureus subsp. aureus Mu50
gccucguccauu

SEQ ID NO: 3960819 - RNA, 23 nt, Staphylococcus aureus subsp. aureus Mu50
gccucuaaugauuaaaaaucaaa

SEQ ID NO: 3960820 - RNA, 17 nt, Staphylococcus aureus subsp. aureus Mu50
gccugcaagucguucuc

SEQ ID NO: 3960821 - RNA, 23 nt, Staphylococcus aureus subsp. aureus Mu50
gccugcaucaccugaugaauaga

SEQ ID NO: 3960822 - RNA, 21 nt, Staphylococcus aureus subsp. aureus Mu50
gccugcccuuuagucauguuu

SEQ ID NO: 3960823 - RNA, 15 nt, Staphylococcus aureus subsp. aureus Mu50
gccugcuaaaaaguu

SEQ ID NO: 3960824 - RNA, 11 nt, Staphylococcus aureus subsp. aureus Mu50
gccuggcaacg

SEQ ID NO: 3960825 - RNA, 16 nt, Staphylococcus aureus subsp. aureus Mu50
gccuguagaauuucuu

SEQ ID NO: 3960826 - RNA, 14 nt, Staphylococcus aureus subsp. aureus Mu50
gcuauuugauacaa

SEQ ID NO: 3960827 - RNA, 18 nt, Staphylococcus aureus subsp. aureus Mu50
gcuauuuuggauaauaug

SEQ ID NO: 3960828 - RNA, 22 nt, Staphylococcus aureus subsp. aureus Mu50
gcucaaguugauuauucuauau

SEQ ID NO: 3960829 - RNA, 16 nt, Staphylococcus aureus subsp. aureus Mu50
gcucauaugucuguuc

SEQ ID NO: 3960830 - RNA, 15 nt, Staphylococcus aureus subsp. aureus Mu50
gcucauccucauuaa

SEQ ID NO: 3960831 - RNA, 20 nt, Staphylococcus aureus subsp. aureus Mu50
gcucauuaaugguauugauu

SEQ ID NO: 3960832 - RNA, 16 nt, Staphylococcus aureus subsp. aureus Mu50
gcucauuacaaagucu

SEQ ID NO: 3960833 - RNA, 15 nt, Staphylococcus aureus subsp. aureus Mu50
gcucauugugcuuga

SEQ ID NO: 3960834 - RNA, 20 nt, Staphylococcus aureus subsp. aureus Mu50
gcucauuuuuuuaauuauuu

SEQ ID NO: 3960835 - RNA, 13 nt, Staphylococcus aureus subsp. aureus Mu50
gcucguuaaauca

SEQ ID NO: 3960836 - RNA, 23 nt, Staphylococcus aureus subsp. aureus Mu50
gcucguuuuuuuagcuauagaaa

SEQ ID NO: 3960837 - RNA, 15 nt, Staphylococcus aureus subsp. aureus Mu50
gcucuggauuuuucu

SEQ ID NO: 3960838 - RNA, 22 nt, Staphylococcus aureus subsp. aureus Mu50
gcucuggauuuuucuuauaaaa

SEQ ID NO: 3960839 - RNA, 18 nt, Staphylococcus aureus subsp. aureus Mu50
gcucuuaaaucacuagcu

SEQ ID NO: 3960840 - RNA, 20 nt, Staphylococcus aureus subsp. aureus Mu50
gcucuuaauguacuuuucug

SEQ ID NO: 3960841 - RNA, 13 nt, Staphylococcus aureus subsp. aureus Mu50
gcucuucuuaucu

SEQ ID NO: 3960842 - RNA, 13 nt, Staphylococcus aureus subsp. aureus Mu50
gcucuugcuaaag

SEQ ID NO: 3960843 - RNA, 12 nt, Staphylococcus aureus subsp. aureus Mu50
gcucuuuauaua

SEQ ID NO: 3960844 - RNA, 19 nt, Staphylococcus aureus subsp. aureus Mu50
gcucuuuuuugauuuggaa

SEQ ID NO: 3960845 - RNA, 23 nt, Staphylococcus aureus subsp. aureus Mu50
gcugaacguaaguuuaguucaaa

SEQ ID NO: 3960846 - RNA, 21 nt, Staphylococcus aureus subsp. aureus Mu50
gcugaaguuugaacaacaucu

SEQ ID NO: 3960847 - RNA, 22 nt, Staphylococcus aureus subsp. aureus Mu50
gcugaaucgaguuugaaauaau

SEQ ID NO: 3960848 - RNA, 16 nt, Staphylococcus aureus subsp. aureus Mu50
gcugacauuuuuggcu

SEQ ID NO: 3960849 - RNA, 22 nt, Staphylococcus aureus subsp. aureus Mu50
gcugaguugaagaaauuugaug

SEQ ID NO: 3960850 - RNA, 13 nt, Staphylococcus aureus subsp. aureus Mu50
gcugauaauaaaa

SEQ ID NO: 3960851 - RNA, 14 nt, Staphylococcus aureus subsp. aureus Mu50
gcugauaauuuuuc

SEQ ID NO: 3960852 - RNA, 15 nt, Staphylococcus aureus subsp. aureus Mu50
gcugauaauuuuucu

SEQ ID NO: 3960853 - RNA, 22 nt, Staphylococcus aureus subsp. aureus Mu50
gcugauaauuuuucuucuuuuu

SEQ ID NO: 3960854 - RNA, 16 nt, Staphylococcus aureus subsp. aureus Mu50
gcugauacauaaaaug

SEQ ID NO: 3960855 - RNA, 21 nt, Staphylococcus aureus subsp. aureus Mu50
gcugauuuaauagcuaaagcu

SEQ ID NO: 3960856 - RNA, 22 nt, Staphylococcus aureus subsp. aureus Mu50
gcugauuucuaucaaauaauga

SEQ ID NO: 3960857 - RNA, 14 nt, Staphylococcus aureus subsp. aureus Mu50
gcugauuuuauaaa

SEQ ID NO: 3960858 - RNA, 20 nt, Staphylococcus aureus subsp. aureus Mu50
gcugccuaaucgcacucugc

SEQ ID NO: 3960859 - RNA, 23 nt, Staphylococcus aureus subsp. aureus Mu50
gcugcuauccuugcuaucaaacu

SEQ ID NO: 3960860 - RNA, 17 nt, Staphylococcus aureus subsp. aureus Mu50
gcugcuguacaauuucg

SEQ ID NO: 3960861 - RNA, 14 nt, Staphylococcus aureus subsp. aureus Mu50
gcugcuuucauaga

SEQ ID NO: 3960862 - RNA, 21 nt, Staphylococcus aureus subsp. aureus Mu50
gcuggacaaucuuaucauaau

SEQ ID NO: 3960863 - RNA, 18 nt, Staphylococcus aureus subsp. aureus Mu50
gcuggacagcuacaauuu

SEQ ID NO: 3960864 - RNA, 18 nt, Staphylococcus aureus subsp. aureus Mu50
gcuggguaauaaauugua

SEQ ID NO: 3960865 - RNA, 18 nt, Staphylococcus aureus subsp. aureus Mu50
gcugguaauauuuuuguu

SEQ ID NO: 3960866 - RNA, 22 nt, Staphylococcus aureus subsp. aureus Mu50
gcuguaccuucugauacuucau

SEQ ID NO: 3960867 - RNA, 23 nt, Staphylococcus aureus subsp. aureus Mu50
gcuguauauauauguaaaugaaa

SEQ ID NO: 3960868 - RNA, 16 nt, Staphylococcus aureus subsp. aureus Mu50
gcuguauuuaauaaac

SEQ ID NO: 3960869 - RNA, 17 nt, Staphylococcus aureus subsp. aureus Mu50
gcugucauuuucugcuu

SEQ ID NO: 3960870 - RNA, 21 nt, Staphylococcus aureus subsp. aureus Mu50
gcuguguacguuucaauguau

SEQ ID NO: 3960871 - RNA, 13 nt, Staphylococcus aureus subsp. aureus Mu50
gcuguguaucauc

SEQ ID NO: 3960872 - RNA, 16 nt, Staphylococcus aureus subsp. aureus Mu50
gcuguguaucaucaua

SEQ ID NO: 3960873 - RNA, 18 nt, Staphylococcus aureus subsp. aureus Mu50
gcuguguaucaucauaau

SEQ ID NO: 3960874 - RNA, 20 nt, Staphylococcus aureus subsp. aureus Mu50
gcuguuaauaaaucauuagu

SEQ ID NO: 3960875 - RNA, 17 nt, Staphylococcus aureus subsp. aureus Mu50
gcuguuacacuuuucuu

SEQ ID NO: 3960876 - RNA, 21 nt, Staphylococcus aureus subsp. aureus Mu50
gcuguuggcaaaacaauauac

SEQ ID NO: 3960877 - RNA, 23 nt, Staphylococcus aureus subsp. aureus Mu50
gcuguuuuuauuauaauagagaa

SEQ ID NO: 3960878 - RNA, 15 nt, Staphylococcus aureus subsp. aureus Mu50
gcuuaaauauaauga

SEQ ID NO: 3960879 - RNA, 16 nt, Staphylococcus aureus subsp. aureus Mu50
gcuuaagaaauuuuuu

SEQ ID NO: 3960880 - RNA, 18 nt, Staphylococcus aureus subsp. aureus Mu50
gcuuaagaaauuuuuucu

SEQ ID NO: 3960881 - RNA, 22 nt, Staphylococcus aureus subsp. aureus Mu50
gcuuaaguaagauuuaaacauc

SEQ ID NO: 3960882 - RNA, 22 nt, Staphylococcus aureus subsp. aureus Mu50
gcuuaaucucuuuuugauuaua

SEQ ID NO: 3960883 - RNA, 14 nt, Staphylococcus aureus subsp. aureus Mu50
gcuuaauucuucau

SEQ ID NO: 3960884 - RNA, 13 nt, Staphylococcus aureus subsp. aureus Mu50
gcuuaauuuaugu

SEQ ID NO: 3960885 - RNA, 16 nt, Staphylococcus aureus subsp. aureus Mu50
gcuuaauuuuauuauu

SEQ ID NO: 3960886 - RNA, 24 nt, Staphylococcus aureus subsp. aureus Mu50
gcuuagucaauguauauuuaacau

SEQ ID NO: 3960887 - RNA, 18 nt, Staphylococcus aureus subsp. aureus Mu50
gcuuaugggggauuuuuu

SEQ ID NO: 3960888 - RNA, 13 nt, Staphylococcus aureus subsp. aureus Mu50
gcuuauugaaaag

SEQ ID NO: 3960889 - RNA, 18 nt, Staphylococcus aureus subsp. aureus Mu50
gcuucauagucacuuuua

SEQ ID NO: 3960890 - RNA, 22 nt, Staphylococcus aureus subsp. aureus Mu50
gcuucaucaguuguguaauaaa

SEQ ID NO: 3960891 - RNA, 18 nt, Staphylococcus aureus subsp. aureus Mu50
gcuuccaauuuaaaauga

SEQ ID NO: 3960892 - RNA, 17 nt, Staphylococcus aureus subsp. aureus Mu50
gcuuccacuucaucuaa

SEQ ID NO: 3960893 - RNA, 18 nt, Staphylococcus aureus subsp. aureus Mu50
gcuuccacuucaucuaaa

SEQ ID NO: 3960894 - RNA, 20 nt, Staphylococcus aureus subsp. aureus Mu50
gcuuccucucguaaauuguu

SEQ ID NO: 3960895 - RNA, 19 nt, Staphylococcus aureus subsp. aureus Mu50
gcuucgucacguaaaauau

SEQ ID NO: 3960896 - RNA, 13 nt, Staphylococcus aureus subsp. aureus Mu50
gcuucgucuuuau

SEQ ID NO: 3960897 - RNA, 22 nt, Staphylococcus aureus subsp. aureus Mu50
gcuucuaacugaauuaaagcau

SEQ ID NO: 3960898 - RNA, 15 nt, Staphylococcus aureus subsp. aureus Mu50
gcuucuaauuuuuca

SEQ ID NO: 3960899 - RNA, 21 nt, Staphylococcus aureus subsp. aureus Mu50
gcuucucacaacugcauauaa

SEQ ID NO: 3960900 - RNA, 23 nt, Staphylococcus aureus subsp. aureus Mu50
gcuucuguguuggggcccacacc

SEQ ID NO: 3960901 - RNA, 13 nt, Staphylococcus aureus subsp. aureus Mu50
gcuucuuaaauca

SEQ ID NO: 3960902 - RNA, 19 nt, Staphylococcus aureus subsp. aureus Mu50
gcuucuuaucaacaacaag

SEQ ID NO: 3960903 - RNA, 14 nt, Staphylococcus aureus subsp. aureus Mu50
gcuucuucuucaga

SEQ ID NO: 3960904 - RNA, 17 nt, Staphylococcus aureus subsp. aureus Mu50
gcuucuuggcauuuuuu

SEQ ID NO: 3960905 - RNA, 21 nt, Staphylococcus aureus subsp. aureus Mu50
gcuugaaauuauuauuuaaau

SEQ ID NO: 3960906 - RNA, 16 nt, Staphylococcus aureus subsp. aureus Mu50
gcuugaaguuguuucu

SEQ ID NO: 3960907 - RNA, 20 nt, Staphylococcus aureus subsp. aureus Mu50
gcuugaccuucaguuucuac

SEQ ID NO: 3960908 - RNA, 17 nt, Staphylococcus aureus subsp. aureus Mu50
gcuugcggauacauauu

SEQ ID NO: 3960909 - RNA, 16 nt, Staphylococcus aureus subsp. aureus Mu50
gcuugcuuacaauaau

SEQ ID NO: 3960910 - RNA, 15 nt, Staphylococcus aureus subsp. aureus Mu50
gcuugcuucuuuccu

SEQ ID NO: 3960911 - RNA, 14 nt, Staphylococcus aureus subsp. aureus Mu50
gcuuggacauauac

SEQ ID NO: 3960912 - RNA, 14 nt, Staphylococcus aureus subsp. aureus Mu50
gcuuguaaaauuuu

SEQ ID NO: 3960913 - RNA, 20 nt, Staphylococcus aureus subsp. aureus Mu50
ggauuuccucgguuuuauuu

SEQ ID NO: 3960914 - RNA, 16 nt, Staphylococcus aureus subsp. aureus Mu50
ggauuuuagauuuagu

SEQ ID NO: 3960915 - RNA, 23 nt, Staphylococcus aureus subsp. aureus Mu50
ggcaaaaaaggaugaugugaaug

SEQ ID NO: 3960916 - RNA, 21 nt, Staphylococcus aureus subsp. aureus Mu50
ggcaaagcuucauuucccuua

SEQ ID NO: 3960917 - RNA, 16 nt, Staphylococcus aureus subsp. aureus Mu50
ggcaauagcaccauac

SEQ ID NO: 3960918 - RNA, 18 nt, Staphylococcus aureus subsp. aureus Mu50
ggcaauuaaaacuauaau

SEQ ID NO: 3960919 - RNA, 12 nt, Staphylococcus aureus subsp. aureus Mu50
ggcaauugauug

SEQ ID NO: 3960920 - RNA, 21 nt, Staphylococcus aureus subsp. aureus Mu50
ggcagacguaucaucaaaguu

SEQ ID NO: 3960921 - RNA, 22 nt, Staphylococcus aureus subsp. aureus Mu50
ggcagcuaaaaaguauacuaaa

SEQ ID NO: 3960922 - RNA, 14 nt, Staphylococcus aureus subsp. aureus Mu50
ggcauccauaucca

SEQ ID NO: 3960923 - RNA, 21 nt, Staphylococcus aureus subsp. aureus Mu50
ggcauuauauuuaguccucuu

SEQ ID NO: 3960924 - RNA, 13 nt, Staphylococcus aureus subsp. aureus Mu50
ggcauuguaaaau

SEQ ID NO: 3960925 - RNA, 22 nt, Staphylococcus aureus subsp. aureus Mu50
ggcauuuugacgccagaauaaa

SEQ ID NO: 3960926 - RNA, 18 nt, Staphylococcus aureus subsp. aureus Mu50
ggccaaauguugauaaua

SEQ ID NO: 3960927 - RNA, 18 nt, Staphylococcus aureus subsp. aureus Mu50
ggccccgacuauuuuuga

SEQ ID NO: 3960928 - RNA, 20 nt, Staphylococcus aureus subsp. aureus Mu50
ggccgugguaugauuuuuga

SEQ ID NO: 3960929 - RNA, 14 nt, Staphylococcus aureus subsp. aureus Mu50
ggccuuuaaugauu

SEQ ID NO: 3960930 - RNA, 13 nt, Staphylococcus aureus subsp. aureus Mu50
ggcgacauuugua

SEQ ID NO: 3960931 - RNA, 12 nt, Staphylococcus aureus subsp. aureus Mu50
ggcguaaugaua

SEQ ID NO: 3960932 - RNA, 23 nt, Staphylococcus aureus subsp. aureus Mu50
ggcguuucagaaguuguuuagaa

SEQ ID NO: 3960933 - RNA, 14 nt, Staphylococcus aureus subsp. aureus Mu50
ggcuuaauagaggu

SEQ ID NO: 3960934 - RNA, 19 nt, Staphylococcus aureus subsp. aureus Mu50
ggcuuaauuaauaaaaaaa

SEQ ID NO: 3960935 - RNA, 14 nt, Staphylococcus aureus subsp. aureus Mu50
ggcuuuguuuuuca

SEQ ID NO: 3960936 - RNA, 14 nt, Staphylococcus aureus subsp. aureus Mu50
ggcuuuuucuuuug

SEQ ID NO: 3960937 - RNA, 19 nt, Staphylococcus aureus subsp. aureus Mu50
ggcuuuuuguuuugaaugu

SEQ ID NO: 3960938 - RNA, 21 nt, Staphylococcus aureus subsp. aureus Mu50
ggcuuuuuuauuuuauaagaa

SEQ ID NO: 3960939 - RNA, 19 nt, Staphylococcus aureus subsp. aureus Mu50
ggcuuuuuuuauggugugg

SEQ ID NO: 3960940 - RNA, 21 nt, Staphylococcus aureus subsp. aureus Mu50
gggaauacagcuagcaagaau

SEQ ID NO: 3960941 - RNA, 22 nt, Staphylococcus aureus subsp. aureus Mu50
gggaugggccccaacaaagaga

SEQ ID NO: 3960942 - RNA, 24 nt, Staphylococcus aureus subsp. aureus Mu50
gggaugggccccaacacagagaau

SEQ ID NO: 3960943 - RNA, 15 nt, Staphylococcus aureus subsp. aureus Mu50
gggccagccaacuug

SEQ ID NO: 3960944 - RNA, 11 nt, Staphylococcus aureus subsp. aureus Mu50
gggcccacacc

SEQ ID NO: 3960945 - RNA, 16 nt, Staphylococcus aureus subsp. aureus Mu50
gggcccacaccccaac

SEQ ID NO: 3960946 - RNA, 13 nt, Staphylococcus aureus subsp. aureus Mu50
gggccccaacaca

SEQ ID NO: 3960947 - RNA, 17 nt, Staphylococcus aureus subsp. aureus Mu50
gggccccaacacagaga

SEQ ID NO: 3960948 - RNA, 13 nt, Staphylococcus aureus subsp. aureus Mu50
gggcccccaacac

SEQ ID NO: 3960949 - RNA, 14 nt, Staphylococcus aureus subsp. aureus Mu50
gggcccccaacaca

SEQ ID NO: 3960950 - RNA, 15 nt, Staphylococcus aureus subsp. aureus Mu50
gggcgauaaaaguug

SEQ ID NO: 3960951 - RNA, 12 nt, Staphylococcus aureus subsp. aureus Mu50
gggcuucugcua

SEQ ID NO: 3960952 - RNA, 17 nt, Staphylococcus aureus subsp. aureus Mu50
ggggacuuaaccauuua

SEQ ID NO: 3960953 - RNA, 15 nt, Staphylococcus aureus subsp. aureus Mu50
ggggaugggccccaa

SEQ ID NO: 3960954 - RNA, 23 nt, Staphylococcus aureus subsp. aureus Mu50
ggggauuuuuuuauguuugggau

SEQ ID NO: 3960955 - RNA, 15 nt, Staphylococcus aureus subsp. aureus Mu50
ggggccccaacacag

SEQ ID NO: 3960956 - RNA, 18 nt, Staphylococcus aureus subsp. aureus Mu50
ggggccccaacacagaga

SEQ ID NO: 3960957 - RNA, 16 nt, Staphylococcus aureus subsp. aureus Mu50
ggggugagggccccaa

SEQ ID NO: 3960958 - RNA, 18 nt, Staphylococcus aureus subsp. aureus Mu50
ggggugggacgacgaaau

SEQ ID NO: 3960959 - RNA, 23 nt, Staphylococcus aureus subsp. aureus Mu50
gggucacacccauacucugggca

SEQ ID NO: 3960960 - RNA, 20 nt, Staphylococcus aureus subsp. aureus Mu50
gguaaaacaucguaaagauc

SEQ ID NO: 3960961 - RNA, 17 nt, Staphylococcus aureus subsp. aureus Mu50
gguaaauuuaucauuuu

SEQ ID NO: 3960962 - RNA, 13 nt, Staphylococcus aureus subsp. aureus Mu50
gguaacuuuuuaa

SEQ ID NO: 3960963 - RNA, 20 nt, Staphylococcus aureus subsp. aureus Mu50
gguaacuuuuuacauuuuca

SEQ ID NO: 3960964 - RNA, 10 nt, Staphylococcus aureus subsp. aureus Mu50
gguaauaauu

SEQ ID NO: 3960965 - RNA, 17 nt, Staphylococcus aureus subsp. aureus Mu50
gguacaacuaaauaugc

SEQ ID NO: 3960966 - RNA, 23 nt, Staphylococcus aureus subsp. aureus Mu50
gguacacauguacguuuuuuuaa

SEQ ID NO: 3960967 - RNA, 21 nt, Staphylococcus aureus subsp. aureus Mu50
gguacaccuacaaauauuucu

SEQ ID NO: 3960968 - RNA, 19 nt, Staphylococcus aureus subsp. aureus Mu50
gguacacuucaacauauaa

SEQ ID NO: 3960969 - RNA, 13 nt, Staphylococcus aureus subsp. aureus Mu50
gguacuuuuuuga

SEQ ID NO: 3960970 - RNA, 15 nt, Staphylococcus aureus subsp. aureus Mu50
gguauaaaaaaauua

SEQ ID NO: 3960971 - RNA, 14 nt, Staphylococcus aureus subsp. aureus Mu50
gguauauuaaaaau

SEQ ID NO: 3960972 - RNA, 18 nt, Staphylococcus aureus subsp. aureus Mu50
gguauauuaaaaauuuca

SEQ ID NO: 3960973 - RNA, 17 nt, Staphylococcus aureus subsp. aureus Mu50
gguaucuuuaauuucau

SEQ ID NO: 3960974 - RNA, 18 nt, Staphylococcus aureus subsp. aureus Mu50
gguaugauuuuugaacca

SEQ ID NO: 3960975 - RNA, 18 nt, Staphylococcus aureus subsp. aureus Mu50
gguauucuauuuuucaau

SEQ ID NO: 3960976 - RNA, 15 nt, Staphylococcus aureus subsp. aureus Mu50
gguauuuaauguuuu

SEQ ID NO: 3960977 - RNA, 15 nt, Staphylococcus aureus subsp. aureus Mu50
gguauuuauagauuu

SEQ ID NO: 3960978 - RNA, 15 nt, Staphylococcus aureus subsp. aureus Mu50
ggucaauuuuaccau

SEQ ID NO: 3960979 - RNA, 21 nt, Staphylococcus aureus subsp. aureus Mu50
ggucacacccauacucugggc

SEQ ID NO: 3960980 - RNA, 18 nt, Staphylococcus aureus subsp. aureus Mu50
ggucaucaauuggcaacg

SEQ ID NO: 3960981 - RNA, 21 nt, Staphylococcus aureus subsp. aureus Mu50
gguccaaaucgugauaucuug

SEQ ID NO: 3960982 - RNA, 19 nt, Staphylococcus aureus subsp. aureus Mu50
ggucguacuuucaaauaau

SEQ ID NO: 3960983 - RNA, 20 nt, Staphylococcus aureus subsp. aureus Mu50
ggucgugagccccucccaag

SEQ ID NO: 3960984 - RNA, 19 nt, Staphylococcus aureus subsp. aureus Mu50
ggucuaucgccuaaaaaua

SEQ ID NO: 3960985 - RNA, 13 nt, Staphylococcus aureus subsp. aureus Mu50
ggucugcuguauc

SEQ ID NO: 3960986 - RNA, 18 nt, Staphylococcus aureus subsp. aureus Mu50
ggucuuuuaauuaaaagu

SEQ ID NO: 3960987 - RNA, 19 nt, Staphylococcus aureus subsp. aureus Mu50
ggugaaaguacuuggaaaa

SEQ ID NO: 3960988 - RNA, 20 nt, Staphylococcus aureus subsp. aureus Mu50
ggugagggccccaacacaga

SEQ ID NO: 3960989 - RNA, 17 nt, Staphylococcus aureus subsp. aureus Mu50
ggugaguguuucauaau

SEQ ID NO: 3960990 - RNA, 17 nt, Staphylococcus aureus subsp. aureus Mu50
ggugauugaacaauaau

SEQ ID NO: 3960991 - RNA, 21 nt, Staphylococcus aureus subsp. aureus Mu50
ggugcaauaauaaauaggaug

SEQ ID NO: 3960992 - RNA, 23 nt, Staphylococcus aureus subsp. aureus Mu50
gguggagaaccguuuuucaucaa

SEQ ID NO: 3960993 - RNA, 22 nt, Staphylococcus aureus subsp. aureus Mu50
gguggagauuguaaaaauacau

SEQ ID NO: 3960994 - RNA, 20 nt, Staphylococcus aureus subsp. aureus Mu50
ggugggacgacgaaauaaau

SEQ ID NO: 3960995 - RNA, 14 nt, Staphylococcus aureus subsp. aureus Mu50
gguggguauauaau

SEQ ID NO: 3960996 - RNA, 17 nt, Staphylococcus aureus subsp. aureus Mu50
gguguuaaguuuucaau

SEQ ID NO: 3960997 - RNA, 15 nt, Staphylococcus aureus subsp. aureus Mu50
gguguuuaacuaaac

SEQ ID NO: 3960998 - RNA, 14 nt, Staphylococcus aureus subsp. aureus Mu50
gguguuuagucuuu

SEQ ID NO: 3960999 - RNA, 12 nt, Staphylococcus aureus subsp. aureus Mu50
gguuaacacguu

SEQ ID NO: 3961000 - RNA, 20 nt, Staphylococcus aureus subsp. aureus Mu50
gguuaaugacuaugcaaaug

SEQ ID NO: 3961001 - RNA, 20 nt, Staphylococcus aureus subsp. aureus Mu50
guaaguuuaguucaaagcga

SEQ ID NO: 3961002 - RNA, 16 nt, Staphylococcus aureus subsp. aureus Mu50
guaaguuugguuucuu

SEQ ID NO: 3961003 - RNA, 23 nt, Staphylococcus aureus subsp. aureus Mu50
guaauaaaagucgauaaauauga

SEQ ID NO: 3961004 - RNA, 15 nt, Staphylococcus aureus subsp. aureus Mu50
guaauaaaaugauga

SEQ ID NO: 3961005 - RNA, 14 nt, Staphylococcus aureus subsp. aureus Mu50
guaauaaagaaggg

SEQ ID NO: 3961006 - RNA, 22 nt, Staphylococcus aureus subsp. aureus Mu50
guaauaaccaugccagcuucua

SEQ ID NO: 3961007 - RNA, 16 nt, Staphylococcus aureus subsp. aureus Mu50
guaauaaguaauaauu

SEQ ID NO: 3961008 - RNA, 16 nt, Staphylococcus aureus subsp. aureus Mu50
guaauaauauaaauaa

SEQ ID NO: 3961009 - RNA, 15 nt, Staphylococcus aureus subsp. aureus Mu50
guaauaauaucaccu

SEQ ID NO: 3961010 - RNA, 21 nt, Staphylococcus aureus subsp. aureus Mu50
guaauagaacgaaauaguuca

SEQ ID NO: 3961011 - RNA, 15 nt, Staphylococcus aureus subsp. aureus Mu50
guaauauauaaaagu

SEQ ID NO: 3961012 - RNA, 19 nt, Staphylococcus aureus subsp. aureus Mu50
guaauauguugcuuaucaa

SEQ ID NO: 3961013 - RNA, 19 nt, Staphylococcus aureus subsp. aureus Mu50
guaauauuuuuguugcaau

SEQ ID NO: 3961014 - RNA, 20 nt, Staphylococcus aureus subsp. aureus Mu50
guaauauuuuuguugcaauu

SEQ ID NO: 3961015 - RNA, 22 nt, Staphylococcus aureus subsp. aureus Mu50
guaaucacuaucuguuguuaua

SEQ ID NO: 3961016 - RNA, 23 nt, Staphylococcus aureus subsp. aureus Mu50
guaaucagcuuuuucacauugcc

SEQ ID NO: 3961017 - RNA, 16 nt, Staphylococcus aureus subsp. aureus Mu50
guaaucauaccagcaa

SEQ ID NO: 3961018 - RNA, 18 nt, Staphylococcus aureus subsp. aureus Mu50
guaaucauagcaacaucg

SEQ ID NO: 3961019 - RNA, 21 nt, Staphylococcus aureus subsp. aureus Mu50
guaaucauugguuucaucaua

SEQ ID NO: 3961020 - RNA, 15 nt, Staphylococcus aureus subsp. aureus Mu50
guaaucccauuuuaa

SEQ ID NO: 3961021 - RNA, 20 nt, Staphylococcus aureus subsp. aureus Mu50
guaaucuaauacauacggca

SEQ ID NO: 3961022 - RNA, 11 nt, Staphylococcus aureus subsp. aureus Mu50
guaaucuauuu

SEQ ID NO: 3961023 - RNA, 14 nt, Staphylococcus aureus subsp. aureus Mu50
guaaucuauuuucu

SEQ ID NO: 3961024 - RNA, 14 nt, Staphylococcus aureus subsp. aureus Mu50
guaaucucaucuaa

SEQ ID NO: 3961025 - RNA, 12 nt, Staphylococcus aureus subsp. aureus Mu50
guaaucuuuuaa

SEQ ID NO: 3961026 - RNA, 22 nt, Staphylococcus aureus subsp. aureus Mu50
guaaugaccggcauauaaucca

SEQ ID NO: 3961027 - RNA, 13 nt, Staphylococcus aureus subsp. aureus Mu50
guaaugauacgca

SEQ ID NO: 3961028 - RNA, 23 nt, Staphylococcus aureus subsp. aureus Mu50
guaaugaucguuagcuaaucguu

SEQ ID NO: 3961029 - RNA, 17 nt, Staphylococcus aureus subsp. aureus Mu50
guaaugccauuaauggu

SEQ ID NO: 3961030 - RNA, 16 nt, Staphylococcus aureus subsp. aureus Mu50
guaaugcuguacuaua

SEQ ID NO: 3961031 - RNA, 16 nt, Staphylococcus aureus subsp. aureus Mu50
guaaugcuuaaaaaca

SEQ ID NO: 3961032 - RNA, 16 nt, Staphylococcus aureus subsp. aureus Mu50
guaauggauugauaau

SEQ ID NO: 3961033 - RNA, 17 nt, Staphylococcus aureus subsp. aureus Mu50
guaaugucauaucuuua

SEQ ID NO: 3961034 - RNA, 17 nt, Staphylococcus aureus subsp. aureus Mu50
guaauguuccauauaac

SEQ ID NO: 3961035 - RNA, 20 nt, Staphylococcus aureus subsp. aureus Mu50
guaauguuccccugaaaaga

SEQ ID NO: 3961036 - RNA, 13 nt, Staphylococcus aureus subsp. aureus Mu50
guaauuaaauacu

SEQ ID NO: 3961037 - RNA, 22 nt, Staphylococcus aureus subsp. aureus Mu50
guaauucuucaucuucuucaaa

SEQ ID NO: 3961038 - RNA, 17 nt, Staphylococcus aureus subsp. aureus Mu50
guaauuguaaucuauuu

SEQ ID NO: 3961039 - RNA, 18 nt, Staphylococcus aureus subsp. aureus Mu50
guaauugucuuuauaaaa

SEQ ID NO: 3961040 - RNA, 13 nt, Staphylococcus aureus subsp. aureus Mu50
guaauuuaaaaua

SEQ ID NO: 3961041 - RNA, 14 nt, Staphylococcus aureus subsp. aureus Mu50
guaauuuaaaauag

SEQ ID NO: 3961042 - RNA, 16 nt, Staphylococcus aureus subsp. aureus Mu50
guaauuuaaaauaguu

SEQ ID NO: 3961043 - RNA, 17 nt, Staphylococcus aureus subsp. aureus Mu50
guaauuuaauugguucu

SEQ ID NO: 3961044 - RNA, 13 nt, Staphylococcus aureus subsp. aureus Mu50
guaauuucuccaa

SEQ ID NO: 3961045 - RNA, 12 nt, Staphylococcus aureus subsp. aureus Mu50
guaauuuuaaug

SEQ ID NO: 3961046 - RNA, 23 nt, Staphylococcus aureus subsp. aureus Mu50
guaauuuuuaaaucuacaauauu

SEQ ID NO: 3961047 - RNA, 18 nt, Staphylococcus aureus subsp. aureus Mu50
guacaaauaacaaacauu

SEQ ID NO: 3961048 - RNA, 12 nt, Staphylococcus aureus subsp. aureus Mu50
guacaaauaaua

SEQ ID NO: 3961049 - RNA, 14 nt, Staphylococcus aureus subsp. aureus Mu50
guacaaauaauaca

SEQ ID NO: 3961050 - RNA, 21 nt, Staphylococcus aureus subsp. aureus Mu50
guacaauaauaccuucaauug

SEQ ID NO: 3961051 - RNA, 15 nt, Staphylococcus aureus subsp. aureus Mu50
guacaccuacaaaua

SEQ ID NO: 3961052 - RNA, 19 nt, Staphylococcus aureus subsp. aureus Mu50
guacaccucuaaguucacc

SEQ ID NO: 3961053 - RNA, 17 nt, Staphylococcus aureus subsp. aureus Mu50
guacacgaauucauuaa

SEQ ID NO: 3961054 - RNA, 17 nt, Staphylococcus aureus subsp. aureus Mu50
guacacuuuugauuguu

SEQ ID NO: 3961055 - RNA, 15 nt, Staphylococcus aureus subsp. aureus Mu50
guacauaaauaccug

SEQ ID NO: 3961056 - RNA, 11 nt, Staphylococcus aureus subsp. aureus Mu50
guacauaauag

SEQ ID NO: 3961057 - RNA, 14 nt, Staphylococcus aureus subsp. aureus Mu50
guacauauaauaug

SEQ ID NO: 3961058 - RNA, 18 nt, Staphylococcus aureus subsp. aureus Mu50
guacauauguguaugaua

SEQ ID NO: 3961059 - RNA, 16 nt, Staphylococcus aureus subsp. aureus Mu50
guacauuuauuuucaa

SEQ ID NO: 3961060 - RNA, 13 nt, Staphylococcus aureus subsp. aureus Mu50
guaccaaauaaau

SEQ ID NO: 3961061 - RNA, 13 nt, Staphylococcus aureus subsp. aureus Mu50
guaccaagcuuca

SEQ ID NO: 3961062 - RNA, 14 nt, Staphylococcus aureus subsp. aureus Mu50
guaccaauuagcau

SEQ ID NO: 3961063 - RNA, 15 nt, Staphylococcus aureus subsp. aureus Mu50
guaccaauuagcaug

SEQ ID NO: 3961064 - RNA, 13 nt, Staphylococcus aureus subsp. aureus Mu50
guaccaccccaac

SEQ ID NO: 3961065 - RNA, 21 nt, Staphylococcus aureus subsp. aureus Mu50
guaccacucauaaucaagucu

SEQ ID NO: 3961066 - RNA, 12 nt, Staphylococcus aureus subsp. aureus Mu50
guaccguauuuu

SEQ ID NO: 3961067 - RNA, 13 nt, Staphylococcus aureus subsp. aureus Mu50
guaccguauuuua

SEQ ID NO: 3961068 - RNA, 16 nt, Staphylococcus aureus subsp. aureus Mu50
guacgacgguauaaaa

SEQ ID NO: 3961069 - RNA, 22 nt, Staphylococcus aureus subsp. aureus Mu50
guacgcaauuuaauauuauaag

SEQ ID NO: 3961070 - RNA, 20 nt, Staphylococcus aureus subsp. aureus Mu50
guacggcugcuuuaacugua

SEQ ID NO: 3961071 - RNA, 16 nt, Staphylococcus aureus subsp. aureus Mu50
guacguuaaucaguga

SEQ ID NO: 3961072 - RNA, 17 nt, Staphylococcus aureus subsp. aureus Mu50
guacuaacccaacgaug

SEQ ID NO: 3961073 - RNA, 19 nt, Staphylococcus aureus subsp. aureus Mu50
guacuauuaucuauccauu

SEQ ID NO: 3961074 - RNA, 17 nt, Staphylococcus aureus subsp. aureus Mu50
guacucuucguuuuaau

SEQ ID NO: 3961075 - RNA, 16 nt, Staphylococcus aureus subsp. aureus Mu50
guacuuaaaaauagga

SEQ ID NO: 3961076 - RNA, 12 nt, Staphylococcus aureus subsp. aureus Mu50
guacuuaauuua

SEQ ID NO: 3961077 - RNA, 14 nt, Staphylococcus aureus subsp. aureus Mu50
guacuuacaaauau

SEQ ID NO: 3961078 - RNA, 12 nt, Staphylococcus aureus subsp. aureus Mu50
guacuucuaauu

SEQ ID NO: 3961079 - RNA, 15 nt, Staphylococcus aureus subsp. aureus Mu50
guacuuucaaauaau

SEQ ID NO: 3961080 - RNA, 23 nt, Staphylococcus aureus subsp. aureus Mu50
guacuuugauaucuacagagaau

SEQ ID NO: 3961081 - RNA, 22 nt, Staphylococcus aureus subsp. aureus Mu50
guacuuuuauguuguuauaaag

SEQ ID NO: 3961082 - RNA, 23 nt, Staphylococcus aureus subsp. aureus Mu50
guagaaaauagcuguuugauauu

SEQ ID NO: 3961083 - RNA, 18 nt, Staphylococcus aureus subsp. aureus Mu50
guagaaacacaaggaaua

SEQ ID NO: 3961084 - RNA, 20 nt, Staphylococcus aureus subsp. aureus Mu50
guagaaucuacgauuuucaa

SEQ ID NO: 3961085 - RNA, 16 nt, Staphylococcus aureus subsp. aureus Mu50
guagauauugaaugga

SEQ ID NO: 3961086 - RNA, 20 nt, Staphylococcus aureus subsp. aureus Mu50
guagauucaaauugguuuuc

SEQ ID NO: 3961087 - RNA, 18 nt, Staphylococcus aureus subsp. aureus Mu50
guagauuuauuaaauaua

SEQ ID NO: 3961088 - RNA, 20 nt, Staphylococcus aureus subsp. aureus Mu50
guagcaacauuauuuuuguc

SEQ ID NO: 3961089 - RNA, 14 nt, Staphylococcus aureus subsp. aureus Mu50
guauuuuauuuauu

SEQ ID NO: 3961090 - RNA, 22 nt, Staphylococcus aureus subsp. aureus Mu50
guauuuuuauuguuuuggcuuu

SEQ ID NO: 3961091 - RNA, 15 nt, Staphylococcus aureus subsp. aureus Mu50
guauuuuuauuuaua

SEQ ID NO: 3961092 - RNA, 15 nt, Staphylococcus aureus subsp. aureus Mu50
guauuuuucaaauaa

SEQ ID NO: 3961093 - RNA, 19 nt, Staphylococcus aureus subsp. aureus Mu50
guauuuuugcguuaauaau

SEQ ID NO: 3961094 - RNA, 20 nt, Staphylococcus aureus subsp. aureus Mu50
gucaaaaaaucgaacaaaug

SEQ ID NO: 3961095 - RNA, 23 nt, Staphylococcus aureus subsp. aureus Mu50
gucaaacaacaaucaaauuacaa

SEQ ID NO: 3961096 - RNA, 18 nt, Staphylococcus aureus subsp. aureus Mu50
gucaaauuggacuuaugg

SEQ ID NO: 3961097 - RNA, 16 nt, Staphylococcus aureus subsp. aureus Mu50
gucaacagcauaaaua

SEQ ID NO: 3961098 - RNA, 20 nt, Staphylococcus aureus subsp. aureus Mu50
gucaacaucaugaacuuuua

SEQ ID NO: 3961099 - RNA, 12 nt, Staphylococcus aureus subsp. aureus Mu50
gucaacugcugc

SEQ ID NO: 3961100 - RNA, 23 nt, Staphylococcus aureus subsp. aureus Mu50
gucaacuuagcuuagucaaugua

SEQ ID NO: 3961101 - RNA, 16 nt, Staphylococcus aureus subsp. aureus Mu50
gucaauauuguaggga

SEQ ID NO: 3961102 - RNA, 21 nt, Staphylococcus aureus subsp. aureus Mu50
gucaaucacuccucuauuuua

SEQ ID NO: 3961103 - RNA, 21 nt, Staphylococcus aureus subsp. aureus Mu50
gucaaugacugagaaaaauau

SEQ ID NO: 3961104 - RNA, 16 nt, Staphylococcus aureus subsp. aureus Mu50
gucacauuuauaacau

SEQ ID NO: 3961105 - RNA, 14 nt, Staphylococcus aureus subsp. aureus Mu50
gucacuuuauuaaa

SEQ ID NO: 3961106 - RNA, 12 nt, Staphylococcus aureus subsp. aureus Mu50
gucagauucaaa

SEQ ID NO: 3961107 - RNA, 20 nt, Staphylococcus aureus subsp. aureus Mu50
gucagcauucauagcugcuu

SEQ ID NO: 3961108 - RNA, 20 nt, Staphylococcus aureus subsp. aureus Mu50
gucaggggccccaacacaga

SEQ ID NO: 3961109 - RNA, 23 nt, Staphylococcus aureus subsp. aureus Mu50
gucaggggccccaacacagagaa

SEQ ID NO: 3961110 - RNA, 14 nt, Staphylococcus aureus subsp. aureus Mu50
gucaguaaaaauac

SEQ ID NO: 3961111 - RNA, 18 nt, Staphylococcus aureus subsp. aureus Mu50
gucauaauagauaaugca

SEQ ID NO: 3961112 - RNA, 14 nt, Staphylococcus aureus subsp. aureus Mu50
gucauaauuuaaaa

SEQ ID NO: 3961113 - RNA, 22 nt, Staphylococcus aureus subsp. aureus Mu50
gucauaauuuaaaagauuagau

SEQ ID NO: 3961114 - RNA, 14 nt, Staphylococcus aureus subsp. aureus Mu50
gucauaccuuuuaa

SEQ ID NO: 3961115 - RNA, 21 nt, Staphylococcus aureus subsp. aureus Mu50
gucauacgcaaugauuauaaa

SEQ ID NO: 3961116 - RNA, 15 nt, Staphylococcus aureus subsp. aureus Mu50
gucauacuaacuaua

SEQ ID NO: 3961117 - RNA, 19 nt, Staphylococcus aureus subsp. aureus Mu50
gucauacuaucuacaauaa

SEQ ID NO: 3961118 - RNA, 15 nt, Staphylococcus aureus subsp. aureus Mu50
gucauagaaauuuua

SEQ ID NO: 3961119 - RNA, 20 nt, Staphylococcus aureus subsp. aureus Mu50
gucauaguauacauaauuca

SEQ ID NO: 3961120 - RNA, 12 nt, Staphylococcus aureus subsp. aureus Mu50
gucauauaaaca

SEQ ID NO: 3961121 - RNA, 20 nt, Staphylococcus aureus subsp. aureus Mu50
gucauauacuauaugucuua

SEQ ID NO: 3961122 - RNA, 19 nt, Staphylococcus aureus subsp. aureus Mu50
gucauaucuuuauuugauu

SEQ ID NO: 3961123 - RNA, 18 nt, Staphylococcus aureus subsp. aureus Mu50
gucauauguuuuauaaua

SEQ ID NO: 3961124 - RNA, 11 nt, Staphylococcus aureus subsp. aureus Mu50
gucaucaacac

SEQ ID NO: 3961125 - RNA, 18 nt, Staphylococcus aureus subsp. aureus Mu50
gucaucaccuuguuaaaa

SEQ ID NO: 3961126 - RNA, 21 nt, Staphylococcus aureus subsp. aureus Mu50
gucaucaccuuguuaaaauaa

SEQ ID NO: 3961127 - RNA, 16 nt, Staphylococcus aureus subsp. aureus Mu50
gucaucuguuaauuca

SEQ ID NO: 3961128 - RNA, 19 nt, Staphylococcus aureus subsp. aureus Mu50
gucaucuugagauuuucaa

SEQ ID NO: 3961129 - RNA, 16 nt, Staphylococcus aureus subsp. aureus Mu50
gucaucuuucaacgca

SEQ ID NO: 3961130 - RNA, 16 nt, Staphylococcus aureus subsp. aureus Mu50
gucaugaaaauaagca

SEQ ID NO: 3961131 - RNA, 17 nt, Staphylococcus aureus subsp. aureus Mu50
gucaugucuagauuuua

SEQ ID NO: 3961132 - RNA, 20 nt, Staphylococcus aureus subsp. aureus Mu50
gucauguguucaaauaacgc

SEQ ID NO: 3961133 - RNA, 13 nt, Staphylococcus aureus subsp. aureus Mu50
gucauuacaaauc

SEQ ID NO: 3961134 - RNA, 14 nt, Staphylococcus aureus subsp. aureus Mu50
gucauuacaaauca

SEQ ID NO: 3961135 - RNA, 20 nt, Staphylococcus aureus subsp. aureus Mu50
gucauuacaaaucaugacau

SEQ ID NO: 3961136 - RNA, 19 nt, Staphylococcus aureus subsp. aureus Mu50
gucauuaugugacauacca

SEQ ID NO: 3961137 - RNA, 21 nt, Staphylococcus aureus subsp. aureus Mu50
gucauugguggagauuguaaa

SEQ ID NO: 3961138 - RNA, 16 nt, Staphylococcus aureus subsp. aureus Mu50
gucauuucuucuuuuu

SEQ ID NO: 3961139 - RNA, 15 nt, Staphylococcus aureus subsp. aureus Mu50
gucauuugaauccaa

SEQ ID NO: 3961140 - RNA, 14 nt, Staphylococcus aureus subsp. aureus Mu50
gucauuuugauuaa

SEQ ID NO: 3961141 - RNA, 15 nt, Staphylococcus aureus subsp. aureus Mu50
guccaaaaugaacaa

SEQ ID NO: 3961142 - RNA, 18 nt, Staphylococcus aureus subsp. aureus Mu50
guccaauuccaauaaaca

SEQ ID NO: 3961143 - RNA, 14 nt, Staphylococcus aureus subsp. aureus Mu50
guccagcuaauaac

SEQ ID NO: 3961144 - RNA, 23 nt, Staphylococcus aureus subsp. aureus Mu50
guccagcuaauaacgcugcaccu

SEQ ID NO: 3961145 - RNA, 18 nt, Staphylococcus aureus subsp. aureus Mu50
guccauaaucuuuauuaa

SEQ ID NO: 3961146 - RNA, 20 nt, Staphylococcus aureus subsp. aureus Mu50
guccauaaucuuuauuaaua

SEQ ID NO: 3961147 - RNA, 20 nt, Staphylococcus aureus subsp. aureus Mu50
guccaucauuuguguuuuua

SEQ ID NO: 3961148 - RNA, 18 nt, Staphylococcus aureus subsp. aureus Mu50
guccaucgucaucacuuu

SEQ ID NO: 3961149 - RNA, 15 nt, Staphylococcus aureus subsp. aureus Mu50
guccauuuucuuuuu

SEQ ID NO: 3961150 - RNA, 23 nt, Staphylococcus aureus subsp. aureus Mu50
gucccacucccauuggcauuuac

SEQ ID NO: 3961151 - RNA, 19 nt, Staphylococcus aureus subsp. aureus Mu50
gucccauaaggaaccuguc

SEQ ID NO: 3961152 - RNA, 14 nt, Staphylococcus aureus subsp. aureus Mu50
guccggggccccaa

SEQ ID NO: 3961153 - RNA, 20 nt, Staphylococcus aureus subsp. aureus Mu50
guccuauuuguggaaauaaa

SEQ ID NO: 3961154 - RNA, 15 nt, Staphylococcus aureus subsp. aureus Mu50
guccucuugugaaau

SEQ ID NO: 3961155 - RNA, 22 nt, Staphylococcus aureus subsp. aureus Mu50
guccuguacauccacuuuauaa

SEQ ID NO: 3961156 - RNA, 11 nt, Staphylococcus aureus subsp. aureus Mu50
guccuucccac

SEQ ID NO: 3961157 - RNA, 19 nt, Staphylococcus aureus subsp. aureus Mu50
guccuuuaguguguuuaaa

SEQ ID NO: 3961158 - RNA, 20 nt, Staphylococcus aureus subsp. aureus Mu50
gucgaaaauagcuauuaaaa

SEQ ID NO: 3961159 - RNA, 19 nt, Staphylococcus aureus subsp. aureus Mu50
gucgaagaagauuaugaaa

SEQ ID NO: 3961160 - RNA, 13 nt, Staphylococcus aureus subsp. aureus Mu50
gucgaauauaauu

SEQ ID NO: 3961161 - RNA, 15 nt, Staphylococcus aureus subsp. aureus Mu50
gucgaauguuucuuc

SEQ ID NO: 3961162 - RNA, 22 nt, Staphylococcus aureus subsp. aureus Mu50
gucgcacuauaaaauucaccaa

SEQ ID NO: 3961163 - RNA, 13 nt, Staphylococcus aureus subsp. aureus Mu50
gucgcuaauaaac

SEQ ID NO: 3961164 - RNA, 18 nt, Staphylococcus aureus subsp. aureus Mu50
gucgcuucuucuucagaa

SEQ ID NO: 3961165 - RNA, 14 nt, Staphylococcus aureus subsp. aureus Mu50
gucgguucaucuaa

SEQ ID NO: 3961166 - RNA, 15 nt, Staphylococcus aureus subsp. aureus Mu50
gucguacuuucaaau

SEQ ID NO: 3961167 - RNA, 15 nt, Staphylococcus aureus subsp. aureus Mu50
gucgucucaauaucu

SEQ ID NO: 3961168 - RNA, 15 nt, Staphylococcus aureus subsp. aureus Mu50
gucguucaagaacaa

SEQ ID NO: 3961169 - RNA, 12 nt, Staphylococcus aureus subsp. aureus Mu50
gucuaaaaaugu

SEQ ID NO: 3961170 - RNA, 16 nt, Staphylococcus aureus subsp. aureus Mu50
gucuaauguuggaaaa

SEQ ID NO: 3961171 - RNA, 14 nt, Staphylococcus aureus subsp. aureus Mu50
gucuacgaucaaaa

SEQ ID NO: 3961172 - RNA, 21 nt, Staphylococcus aureus subsp. aureus Mu50
gucuaucuccgcuacaauuau

SEQ ID NO: 3961173 - RNA, 10 nt, Staphylococcus aureus subsp. aureus Mu50
gucuaugaau

SEQ ID NO: 3961174 - RNA, 18 nt, Staphylococcus aureus subsp. aureus Mu50
gucuaugucaaauugaac

SEQ ID NO: 3961175 - RNA, 18 nt, Staphylococcus aureus subsp. aureus Mu50
gucucacuuaauaaauaa

SEQ ID NO: 3961176 - RNA, 20 nt, Staphylococcus aureus subsp. aureus Mu50
gucucauaucuauuuuucga

SEQ ID NO: 3961177 - RNA, 14 nt, Staphylococcus aureus subsp. aureus Mu50
guguccuaauaagu

SEQ ID NO: 3961178 - RNA, 16 nt, Staphylococcus aureus subsp. aureus Mu50
gugugccggcuuuuuc

SEQ ID NO: 3961179 - RNA, 22 nt, Staphylococcus aureus subsp. aureus Mu50
gugugccggcuuuuucuuuugu

SEQ ID NO: 3961180 - RNA, 21 nt, Staphylococcus aureus subsp. aureus Mu50
guguuaaaccaacuuucucaa

SEQ ID NO: 3961181 - RNA, 20 nt, Staphylococcus aureus subsp. aureus Mu50
guguuaaucaacguauauaa

SEQ ID NO: 3961182 - RNA, 14 nt, Staphylococcus aureus subsp. aureus Mu50
guguuauaaauaga

SEQ ID NO: 3961183 - RNA, 17 nt, Staphylococcus aureus subsp. aureus Mu50
guguuauauuguauuuu

SEQ ID NO: 3961184 - RNA, 24 nt, Staphylococcus aureus subsp. aureus Mu50
guguucaaauaacgcaaugucuug

SEQ ID NO: 3961185 - RNA, 23 nt, Staphylococcus aureus subsp. aureus Mu50
guguugaaaaguaauuaaauacu

SEQ ID NO: 3961186 - RNA, 17 nt, Staphylococcus aureus subsp. aureus Mu50
guguuggggcccacacc

SEQ ID NO: 3961187 - RNA, 14 nt, Staphylococcus aureus subsp. aureus Mu50
guguuuaacuaaac

SEQ ID NO: 3961188 - RNA, 20 nt, Staphylococcus aureus subsp. aureus Mu50
guguuuuuaauguuugcuuu

SEQ ID NO: 3961189 - RNA, 23 nt, Staphylococcus aureus subsp. aureus Mu50
guuaaaauuugaauugacuuaca

SEQ ID NO: 3961190 - RNA, 19 nt, Staphylococcus aureus subsp. aureus Mu50
guuaaaguacuuacaaaua

SEQ ID NO: 3961191 - RNA, 22 nt, Staphylococcus aureus subsp. aureus Mu50
guuaaagucauaggcuugccaa

SEQ ID NO: 3961192 - RNA, 15 nt, Staphylococcus aureus subsp. aureus Mu50
guuaaaguuuuguuc

SEQ ID NO: 3961193 - RNA, 21 nt, Staphylococcus aureus subsp. aureus Mu50
guuaaaucuuuaacuucugau

SEQ ID NO: 3961194 - RNA, 13 nt, Staphylococcus aureus subsp. aureus Mu50
guuaaauucaucu

SEQ ID NO: 3961195 - RNA, 14 nt, Staphylococcus aureus subsp. aureus Mu50
guuaaauucuaaaa

SEQ ID NO: 3961196 - RNA, 22 nt, Staphylococcus aureus subsp. aureus Mu50
guuaacaauauucguaaauccu

SEQ ID NO: 3961197 - RNA, 14 nt, Staphylococcus aureus subsp. aureus Mu50
guuaacaucuucau

SEQ ID NO: 3961198 - RNA, 13 nt, Staphylococcus aureus subsp. aureus Mu50
guuaaccauacau

SEQ ID NO: 3961199 - RNA, 15 nt, Staphylococcus aureus subsp. aureus Mu50
guuaagacauaugca

SEQ ID NO: 3961200 - RNA, 22 nt, Staphylococcus aureus subsp. aureus Mu50
guuaauaaugacugacacuuua

SEQ ID NO: 3961201 - RNA, 13 nt, Staphylococcus aureus subsp. aureus Mu50
guuaauauaauua

SEQ ID NO: 3961202 - RNA, 18 nt, Staphylococcus aureus subsp. aureus Mu50
guuaauauaauuaaacau

SEQ ID NO: 3961203 - RNA, 14 nt, Staphylococcus aureus subsp. aureus Mu50
guuaaucaacguau

SEQ ID NO: 3961204 - RNA, 23 nt, Staphylococcus aureus subsp. aureus Mu50
guuaauccgauuuugauauaaaa

SEQ ID NO: 3961205 - RNA, 16 nt, Staphylococcus aureus subsp. aureus Mu50
guuaauccucauuaug

SEQ ID NO: 3961206 - RNA, 14 nt, Staphylococcus aureus subsp. aureus Mu50
guuaauguauaaaa

SEQ ID NO: 3961207 - RNA, 22 nt, Staphylococcus aureus subsp. aureus Mu50
guuaauuauuuagauucuuuuc

SEQ ID NO: 3961208 - RNA, 23 nt, Staphylococcus aureus subsp. aureus Mu50
guuaauuuaauaauuaaauauaa

SEQ ID NO: 3961209 - RNA, 12 nt, Staphylococcus aureus subsp. aureus Mu50
guuaauuuaucg

SEQ ID NO: 3961210 - RNA, 15 nt, Staphylococcus aureus subsp. aureus Mu50
guuaauuucaacauu

SEQ ID NO: 3961211 - RNA, 23 nt, Staphylococcus aureus subsp. aureus Mu50
guuaauuuuauuuuagcagcagu

SEQ ID NO: 3961212 - RNA, 18 nt, Staphylococcus aureus subsp. aureus Mu50
guuaccaaacaauacaua

SEQ ID NO: 3961213 - RNA, 21 nt, Staphylococcus aureus subsp. aureus Mu50
guuaccuacuacauucuaugu

SEQ ID NO: 3961214 - RNA, 20 nt, Staphylococcus aureus subsp. aureus Mu50
guuaccugcgccuucuuuuu

SEQ ID NO: 3961215 - RNA, 20 nt, Staphylococcus aureus subsp. aureus Mu50
guuacuaaacuuuucuucaa

SEQ ID NO: 3961216 - RNA, 23 nt, Staphylococcus aureus subsp. aureus Mu50
guuacuauacaugguacugcuuc

SEQ ID NO: 3961217 - RNA, 20 nt, Staphylococcus aureus subsp. aureus Mu50
guuagacucacuucuuaaaa

SEQ ID NO: 3961218 - RNA, 16 nt, Staphylococcus aureus subsp. aureus Mu50
guuagcuauauuuuuu

SEQ ID NO: 3961219 - RNA, 19 nt, Staphylococcus aureus subsp. aureus Mu50
guuaggcgacuuaacuuaa

SEQ ID NO: 3961220 - RNA, 15 nt, Staphylococcus aureus subsp. aureus Mu50
guuagggaaauguag

SEQ ID NO: 3961221 - RNA, 16 nt, Staphylococcus aureus subsp. aureus Mu50
guuauaaauucuaucu

SEQ ID NO: 3961222 - RNA, 23 nt, Staphylococcus aureus subsp. aureus Mu50
guuauaauggcgggcccccaaca

SEQ ID NO: 3961223 - RNA, 14 nt, Staphylococcus aureus subsp. aureus Mu50
guuauaccauauuu

SEQ ID NO: 3961224 - RNA, 21 nt, Staphylococcus aureus subsp. aureus Mu50
guuauaccauauuuauggugu

SEQ ID NO: 3961225 - RNA, 15 nt, Staphylococcus aureus subsp. aureus Mu50
guuauauaaauaggc

SEQ ID NO: 3961226 - RNA, 14 nt, Staphylococcus aureus subsp. aureus Mu50
guuauauuaagguc

SEQ ID NO: 3961227 - RNA, 23 nt, Staphylococcus aureus subsp. aureus Mu50
guuauauuaaggucauuuuuaau

SEQ ID NO: 3961228 - RNA, 22 nt, Staphylococcus aureus subsp. aureus Mu50
guuauauuguauuuuauuuauu

SEQ ID NO: 3961229 - RNA, 13 nt, Staphylococcus aureus subsp. aureus Mu50
guuaugguguguu

SEQ ID NO: 3961230 - RNA, 14 nt, Staphylococcus aureus subsp. aureus Mu50
guuaugguguguug

SEQ ID NO: 3961231 - RNA, 17 nt, Staphylococcus aureus subsp. aureus Mu50
guuaugguguguuggug

SEQ ID NO: 3961232 - RNA, 18 nt, Staphylococcus aureus subsp. aureus Mu50
guuauguaaauaacaguu

SEQ ID NO: 3961233 - RNA, 17 nt, Staphylococcus aureus subsp. aureus Mu50
guuaugugcuaaucuau

SEQ ID NO: 3961234 - RNA, 17 nt, Staphylococcus aureus subsp. aureus Mu50
guuauguuagucuuuuu

SEQ ID NO: 3961235 - RNA, 17 nt, Staphylococcus aureus subsp. aureus Mu50
guuauuaaaauuaaaua

SEQ ID NO: 3961236 - RNA, 12 nt, Staphylococcus aureus subsp. aureus Mu50
guuauuaaccau

SEQ ID NO: 3961237 - RNA, 16 nt, Staphylococcus aureus subsp. aureus Mu50
guuauuaaccaucaug

SEQ ID NO: 3961238 - RNA, 23 nt, Staphylococcus aureus subsp. aureus Mu50
guuauuagauacuucuuuugcaa

SEQ ID NO: 3961239 - RNA, 16 nt, Staphylococcus aureus subsp. aureus Mu50
guuauuauaaaauaaa

SEQ ID NO: 3961240 - RNA, 17 nt, Staphylococcus aureus subsp. aureus Mu50
guuauuguuccaaucuu

SEQ ID NO: 3961241 - RNA, 18 nt, Staphylococcus aureus subsp. aureus Mu50
guuauuuauacagugaau

SEQ ID NO: 3961242 - RNA, 15 nt, Staphylococcus aureus subsp. aureus Mu50
guuauuuuugcuauu

SEQ ID NO: 3961243 - RNA, 14 nt, Staphylococcus aureus subsp. aureus Mu50
guucaaaaaucaua

SEQ ID NO: 3961244 - RNA, 12 nt, Staphylococcus aureus subsp. aureus Mu50
guucaaguauau

SEQ ID NO: 3961245 - RNA, 23 nt, Staphylococcus aureus subsp. aureus Mu50
guucaauauuuaucaauaaauca

SEQ ID NO: 3961246 - RNA, 14 nt, Staphylococcus aureus subsp. aureus Mu50
guucaaucacuaua

SEQ ID NO: 3961247 - RNA, 19 nt, Staphylococcus aureus subsp. aureus Mu50
guucaaucacuauauuuca

SEQ ID NO: 3961248 - RNA, 18 nt, Staphylococcus aureus subsp. aureus Mu50
guucacaacaaaguguaa

SEQ ID NO: 3961249 - RNA, 18 nt, Staphylococcus aureus subsp. aureus Mu50
guucagauuuguauuuug

SEQ ID NO: 3961250 - RNA, 14 nt, Staphylococcus aureus subsp. aureus Mu50
guucagcaaguuuu

SEQ ID NO: 3961251 - RNA, 12 nt, Staphylococcus aureus subsp. aureus Mu50
guucaguuguuu

SEQ ID NO: 3961252 - RNA, 13 nt, Staphylococcus aureus subsp. aureus Mu50
guucauaaugauc

SEQ ID NO: 3961253 - RNA, 22 nt, Staphylococcus aureus subsp. aureus Mu50
guucauaaugaucaaguaguua

SEQ ID NO: 3961254 - RNA, 19 nt, Staphylococcus aureus subsp. aureus Mu50
guucauagugguguuuaua

SEQ ID NO: 3961255 - RNA, 17 nt, Staphylococcus aureus subsp. aureus Mu50
guucauauaugauaaau

SEQ ID NO: 3961256 - RNA, 13 nt, Staphylococcus aureus subsp. aureus Mu50
guucaucaaacaa

SEQ ID NO: 3961257 - RNA, 15 nt, Staphylococcus aureus subsp. aureus Mu50
guucaucuaaaauga

SEQ ID NO: 3961258 - RNA, 17 nt, Staphylococcus aureus subsp. aureus Mu50
guucauuggcaauauac

SEQ ID NO: 3961259 - RNA, 22 nt, Staphylococcus aureus subsp. aureus Mu50
guucauuggcaauauacuuuuu

SEQ ID NO: 3961260 - RNA, 18 nt, Staphylococcus aureus subsp. aureus Mu50
guuccaacaacuaagaua

SEQ ID NO: 3961261 - RNA, 14 nt, Staphylococcus aureus subsp. aureus Mu50
guucccauucuuug

SEQ ID NO: 3961262 - RNA, 19 nt, Staphylococcus aureus subsp. aureus Mu50
guucccauuuuuaaaauua

SEQ ID NO: 3961263 - RNA, 19 nt, Staphylococcus aureus subsp. aureus Mu50
guucgauuguaauaaccau

SEQ ID NO: 3961264 - RNA, 14 nt, Staphylococcus aureus subsp. aureus Mu50
guuuaucaauuucu

SEQ ID NO: 3961265 - RNA, 13 nt, Staphylococcus aureus subsp. aureus Mu50
guuuaucagcuuu

SEQ ID NO: 3961266 - RNA, 18 nt, Staphylococcus aureus subsp. aureus Mu50
guuuauccauauaugaug

SEQ ID NO: 3961267 - RNA, 23 nt, Staphylococcus aureus subsp. aureus Mu50
guuuaucgaucgguauuuucauu

SEQ ID NO: 3961268 - RNA, 18 nt, Staphylococcus aureus subsp. aureus Mu50
guuuaucuccuaaaggua

SEQ ID NO: 3961269 - RNA, 19 nt, Staphylococcus aureus subsp. aureus Mu50
guuuaucuguaucaaaauc

SEQ ID NO: 3961270 - RNA, 20 nt, Staphylococcus aureus subsp. aureus Mu50
guuuaucuguugucaucaug

SEQ ID NO: 3961271 - RNA, 19 nt, Staphylococcus aureus subsp. aureus Mu50
guuuauugaggauaauuau

SEQ ID NO: 3961272 - RNA, 22 nt, Staphylococcus aureus subsp. aureus Mu50
guuuauugccgguuaaauuauu

SEQ ID NO: 3961273 - RNA, 16 nt, Staphylococcus aureus subsp. aureus Mu50
guuuauuuaauaacga

SEQ ID NO: 3961274 - RNA, 22 nt, Staphylococcus aureus subsp. aureus Mu50
guuucaaacaaagcucaauaaa

SEQ ID NO: 3961275 - RNA, 21 nt, Staphylococcus aureus subsp. aureus Mu50
guuucaagcguuucuugaucu

SEQ ID NO: 3961276 - RNA, 22 nt, Staphylococcus aureus subsp. aureus Mu50
guuucaagcguuucuugaucua

SEQ ID NO: 3961277 - RNA, 20 nt, Staphylococcus aureus subsp. aureus Mu50
guuucaaucgcauuuuguuu

SEQ ID NO: 3961278 - RNA, 15 nt, Staphylococcus aureus subsp. aureus Mu50
guuucacguaaugaa

SEQ ID NO: 3961279 - RNA, 19 nt, Staphylococcus aureus subsp. aureus Mu50
guuucauaugcaucaacag

SEQ ID NO: 3961280 - RNA, 19 nt, Staphylococcus aureus subsp. aureus Mu50
guuucauauggugaacugu

SEQ ID NO: 3961281 - RNA, 19 nt, Staphylococcus aureus subsp. aureus Mu50
guuucgaacgcuugaaaaa

SEQ ID NO: 3961282 - RNA, 21 nt, Staphylococcus aureus subsp. aureus Mu50
guuucggaaaaagaugaaaaa

SEQ ID NO: 3961283 - RNA, 13 nt, Staphylococcus aureus subsp. aureus Mu50
guuucgucagauu

SEQ ID NO: 3961284 - RNA, 14 nt, Staphylococcus aureus subsp. aureus Mu50
guuucuaaauucuu

SEQ ID NO: 3961285 - RNA, 17 nt, Staphylococcus aureus subsp. aureus Mu50
guuucuaaauucuuuuu

SEQ ID NO: 3961286 - RNA, 20 nt, Staphylococcus aureus subsp. aureus Mu50
guuucuauaaagaaugauuu

SEQ ID NO: 3961287 - RNA, 19 nt, Staphylococcus aureus subsp. aureus Mu50
guuucugacuuuuaaaaaa

SEQ ID NO: 3961288 - RNA, 14 nt, Staphylococcus aureus subsp. aureus Mu50
guuucuuaacauaa

SEQ ID NO: 3961289 - RNA, 18 nt, Staphylococcus aureus subsp. aureus Mu50
guuucuuccgcacugccu

SEQ ID NO: 3961290 - RNA, 17 nt, Staphylococcus aureus subsp. aureus Mu50
guuucuuuacuucuuuc

SEQ ID NO: 3961291 - RNA, 17 nt, Staphylococcus aureus subsp. aureus Mu50
guuucuuuuauuuucau

SEQ ID NO: 3961292 - RNA, 19 nt, Staphylococcus aureus subsp. aureus Mu50
guuugaacaacaucuuuug

SEQ ID NO: 3961293 - RNA, 20 nt, Staphylococcus aureus subsp. aureus Mu50
guuugaacaacaucuuuugu

SEQ ID NO: 3961294 - RNA, 20 nt, Staphylococcus aureus subsp. aureus Mu50
guuugaaggagauauuuucu

SEQ ID NO: 3961295 - RNA, 20 nt, Staphylococcus aureus subsp. aureus Mu50
guuugaaggugauaauguac

SEQ ID NO: 3961296 - RNA, 19 nt, Staphylococcus aureus subsp. aureus Mu50
guuugaagugauuugccaa

SEQ ID NO: 3961297 - RNA, 14 nt, Staphylococcus aureus subsp. aureus Mu50
guuugaauguuuuu

SEQ ID NO: 3961298 - RNA, 13 nt, Staphylococcus aureus subsp. aureus Mu50
guuugaucauaau

SEQ ID NO: 3961299 - RNA, 14 nt, Staphylococcus aureus subsp. aureus Mu50
guuugauuaaaauc

SEQ ID NO: 3961300 - RNA, 13 nt, Staphylococcus aureus subsp. aureus Mu50
guuugcuuuaaaa

SEQ ID NO: 3961301 - RNA, 18 nt, Staphylococcus aureus subsp. aureus Mu50
guuuggauaaaaugauau

SEQ ID NO: 3961302 - RNA, 22 nt, Staphylococcus aureus subsp. aureus Mu50
guuuggaugaacaaaauaacau

SEQ ID NO: 3961303 - RNA, 22 nt, Staphylococcus aureus subsp. aureus Mu50
guuuggucaccuacagauaaag

SEQ ID NO: 3961304 - RNA, 21 nt, Staphylococcus aureus subsp. aureus Mu50
guuugguuucuuaacauaaaa

SEQ ID NO: 3961305 - RNA, 21 nt, Staphylococcus aureus subsp. aureus Mu50
guuuguaagacaacaaaucga

SEQ ID NO: 3961306 - RNA, 21 nt, Staphylococcus aureus subsp. aureus Mu50
guuugugguaaugauuuugcu

SEQ ID NO: 3961307 - RNA, 14 nt, Staphylococcus aureus subsp. aureus Mu50
guuuguuuauugag

SEQ ID NO: 3961308 - RNA, 17 nt, Staphylococcus aureus subsp. aureus Mu50
guuuguuuauugagaau

SEQ ID NO: 3961309 - RNA, 16 nt, Staphylococcus aureus subsp. aureus Mu50
guuuguuucuaaauuc

SEQ ID NO: 3961310 - RNA, 17 nt, Staphylococcus aureus subsp. aureus Mu50
guuuuaaauaaaugacu

SEQ ID NO: 3961311 - RNA, 17 nt, Staphylococcus aureus subsp. aureus Mu50
guuuuaaauugaaaugu

SEQ ID NO: 3961312 - RNA, 20 nt, Staphylococcus aureus subsp. aureus Mu50
guuuuaauuucacuuuaacu

SEQ ID NO: 3961313 - RNA, 17 nt, Staphylococcus aureus subsp. aureus Mu50
guuuuaccauaaauuga

SEQ ID NO: 3961314 - RNA, 22 nt, Staphylococcus aureus subsp. aureus Mu50
guuuuaccccuguugaauauac

SEQ ID NO: 3961315 - RNA, 19 nt, Staphylococcus aureus subsp. aureus Mu50
guuuuacuauaaugaugua

SEQ ID NO: 3961316 - RNA, 15 nt, Staphylococcus aureus subsp. aureus Mu50
guuuuauagcauuuc

SEQ ID NO: 3961317 - RNA, 23 nt, Staphylococcus aureus subsp. aureus Mu50
guuuuauauuuauuuuauaauaa

SEQ ID NO: 3961318 - RNA, 17 nt, Staphylococcus aureus subsp. aureus Mu50
guuuuaucuacaguuuu

SEQ ID NO: 3961319 - RNA, 16 nt, Staphylococcus aureus subsp. aureus Mu50
guuuuauguauuuauu

SEQ ID NO: 3961320 - RNA, 15 nt, Staphylococcus aureus subsp. aureus Mu50
guuuuauuaucuuug

SEQ ID NO: 3961321 - RNA, 12 nt, Staphylococcus aureus subsp. aureus Mu50
guuuuauucaau

SEQ ID NO: 3961322 - RNA, 17 nt, Staphylococcus aureus subsp. aureus Mu50
guuuuauucaauugauu

SEQ ID NO: 3961323 - RNA, 18 nt, Staphylococcus aureus subsp. aureus Mu50
guuuuauucgauaauaua

SEQ ID NO: 3961324 - RNA, 19 nt, Staphylococcus aureus subsp. aureus Mu50
guuuuauucgauaauauaa

SEQ ID NO: 3961325 - RNA, 16 nt, Staphylococcus aureus subsp. aureus Mu50
guuuuauuuucuuuuu

SEQ ID NO: 3961326 - RNA, 20 nt, Staphylococcus aureus subsp. aureus Mu50
guuuuauuuuuaucaucaug

SEQ ID NO: 3961327 - RNA, 17 nt, Staphylococcus aureus subsp. aureus Mu50
guuuucacuguuuuauc

SEQ ID NO: 3961328 - RNA, 22 nt, Staphylococcus aureus subsp. aureus Mu50
guuuucacuucgccaagccauc

SEQ ID NO: 3961329 - RNA, 15 nt, Staphylococcus aureus subsp. aureus Mu50
guuuucaguaacuga

SEQ ID NO: 3961330 - RNA, 17 nt, Staphylococcus aureus subsp. aureus Mu50
guuuucaugaaaaguug

SEQ ID NO: 3961331 - RNA, 16 nt, Staphylococcus aureus subsp. aureus Mu50
guuuucauuuuuucaa

SEQ ID NO: 3961332 - RNA, 15 nt, Staphylococcus aureus subsp. aureus Mu50
guuuuccaugaguuu

SEQ ID NO: 3961333 - RNA, 16 nt, Staphylococcus aureus subsp. aureus Mu50
guuuucuaauuguuuu

SEQ ID NO: 3961334 - RNA, 10 nt, Staphylococcus aureus subsp. aureus Mu50
guuuucuagu

SEQ ID NO: 3961335 - RNA, 15 nt, Staphylococcus aureus subsp. aureus Mu50
guuuucuuaaaagag

SEQ ID NO: 3961336 - RNA, 12 nt, Staphylococcus aureus subsp. aureus Mu50
guuuucuuuuca

SEQ ID NO: 3961337 - RNA, 14 nt, Staphylococcus aureus subsp. aureus Mu50
guuuugaaccuaaa

SEQ ID NO: 3961338 - RNA, 20 nt, Staphylococcus aureus subsp. aureus Mu50
guuuugagagauuauuuaaa

SEQ ID NO: 3961339 - RNA, 14 nt, Staphylococcus aureus subsp. aureus Mu50
guuuugcaacauuu

SEQ ID NO: 3961340 - RNA, 19 nt, Staphylococcus aureus subsp. aureus Mu50
guuuugcaacauuuugagu

SEQ ID NO: 3961341 - RNA, 18 nt, Staphylococcus aureus subsp. aureus Mu50
guuuugcuaaccaucaua

SEQ ID NO: 3961342 - RNA, 17 nt, Staphylococcus aureus subsp. aureus Mu50
guuuuggucaaguaaau

SEQ ID NO: 3961343 - RNA, 15 nt, Staphylococcus aureus subsp. aureus Mu50
guuuugguucugaca

SEQ ID NO: 3961344 - RNA, 18 nt, Staphylococcus aureus subsp. aureus Mu50
guuuugguuguucuuuuu

SEQ ID NO: 3961345 - RNA, 22 nt, Staphylococcus aureus subsp. aureus Mu50
guuuugguuguucuuuuuguug

SEQ ID NO: 3961346 - RNA, 14 nt, Staphylococcus aureus subsp. aureus Mu50
guuuuguagauaua

SEQ ID NO: 3961347 - RNA, 21 nt, Staphylococcus aureus subsp. aureus Mu50
guuuuuagguuauauuuaaau

SEQ ID NO: 3961348 - RNA, 12 nt, Staphylococcus aureus subsp. aureus Mu50
guuuuuauuaug

SEQ ID NO: 3961349 - RNA, 12 nt, Staphylococcus aureus subsp. aureus Mu50
guuuuuauuauu

SEQ ID NO: 3961350 - RNA, 20 nt, Staphylococcus aureus subsp. aureus Mu50
guuuuucaucauuaaaauca

SEQ ID NO: 3961351 - RNA, 13 nt, Staphylococcus aureus subsp. aureus Mu50
uaaaacuuacauu

SEQ ID NO: 3961352 - RNA, 23 nt, Staphylococcus aureus subsp. aureus Mu50
uaaaacuuacauuacauauauca

SEQ ID NO: 3961353 - RNA, 20 nt, Staphylococcus aureus subsp. aureus Mu50
uaaaacuuauaacugauaau

SEQ ID NO: 3961354 - RNA, 19 nt, Staphylococcus aureus subsp. aureus Mu50
uaaaacuuguaaauuuauu

SEQ ID NO: 3961355 - RNA, 13 nt, Staphylococcus aureus subsp. aureus Mu50
uaaaacuuuuuca

SEQ ID NO: 3961356 - RNA, 13 nt, Staphylococcus aureus subsp. aureus Mu50
uaaaagaaaaauu

SEQ ID NO: 3961357 - RNA, 15 nt, Staphylococcus aureus subsp. aureus Mu50
uaaaagaauuauuca

SEQ ID NO: 3961358 - RNA, 14 nt, Staphylococcus aureus subsp. aureus Mu50
uaaaagacagaaau

SEQ ID NO: 3961359 - RNA, 19 nt, Staphylococcus aureus subsp. aureus Mu50
uaaaagacauccacagaau

SEQ ID NO: 3961360 - RNA, 22 nt, Staphylococcus aureus subsp. aureus Mu50
uaaaagagaauuuuaauuaauu

SEQ ID NO: 3961361 - RNA, 22 nt, Staphylococcus aureus subsp. aureus Mu50
uaaaagauauaaacauuuauau

SEQ ID NO: 3961362 - RNA, 14 nt, Staphylococcus aureus subsp. aureus Mu50
uaaaagcaaaggcg

SEQ ID NO: 3961363 - RNA, 19 nt, Staphylococcus aureus subsp. aureus Mu50
uaaaagcaugauacucaau

SEQ ID NO: 3961364 - RNA, 15 nt, Staphylococcus aureus subsp. aureus Mu50
uaaaagcugauguga

SEQ ID NO: 3961365 - RNA, 22 nt, Staphylococcus aureus subsp. aureus Mu50
uaaaaggaaggauuuuagauuu

SEQ ID NO: 3961366 - RNA, 19 nt, Staphylococcus aureus subsp. aureus Mu50
uaaaaggaagucgcaauca

SEQ ID NO: 3961367 - RNA, 20 nt, Staphylococcus aureus subsp. aureus Mu50
uaaaaggaugugacaaauac

SEQ ID NO: 3961368 - RNA, 17 nt, Staphylococcus aureus subsp. aureus Mu50
uaaaaggcgaaacauua

SEQ ID NO: 3961369 - RNA, 20 nt, Staphylococcus aureus subsp. aureus Mu50
uaaaaggcgaaacauuaaaa

SEQ ID NO: 3961370 - RNA, 17 nt, Staphylococcus aureus subsp. aureus Mu50
uaaaaggcuuuguuaaa

SEQ ID NO: 3961371 - RNA, 19 nt, Staphylococcus aureus subsp. aureus Mu50
uaaaaggggaaaucauuug

SEQ ID NO: 3961372 - RNA, 21 nt, Staphylococcus aureus subsp. aureus Mu50
uaaaaguacuaacccaacgau

SEQ ID NO: 3961373 - RNA, 17 nt, Staphylococcus aureus subsp. aureus Mu50
uaaaaguacuuuaaaau

SEQ ID NO: 3961374 - RNA, 16 nt, Staphylococcus aureus subsp. aureus Mu50
uaaaaguauagauaga

SEQ ID NO: 3961375 - RNA, 20 nt, Staphylococcus aureus subsp. aureus Mu50
uaaaaguuguaauuuaaaau

SEQ ID NO: 3961376 - RNA, 22 nt, Staphylococcus aureus subsp. aureus Mu50
uaaaaguuguaauuuaaaauag

SEQ ID NO: 3961377 - RNA, 23 nt, Staphylococcus aureus subsp. aureus Mu50
uaaaaguuguaauuuaaaauagu

SEQ ID NO: 3961378 - RNA, 18 nt, Staphylococcus aureus subsp. aureus Mu50
uaaaaguuucccaagcau

SEQ ID NO: 3961379 - RNA, 12 nt, Staphylococcus aureus subsp. aureus Mu50
uaaaauaaaaaa

SEQ ID NO: 3961380 - RNA, 17 nt, Staphylococcus aureus subsp. aureus Mu50
uaaaauaaaaaaaugau

SEQ ID NO: 3961381 - RNA, 15 nt, Staphylococcus aureus subsp. aureus Mu50
uaaaauaaaaaaugc

SEQ ID NO: 3961382 - RNA, 16 nt, Staphylococcus aureus subsp. aureus Mu50
uaaaauaaaaaaugca

SEQ ID NO: 3961383 - RNA, 18 nt, Staphylococcus aureus subsp. aureus Mu50
uaaaauaaaaaaugcacu

SEQ ID NO: 3961384 - RNA, 12 nt, Staphylococcus aureus subsp. aureus Mu50
uaaaauaaaaug

SEQ ID NO: 3961385 - RNA, 13 nt, Staphylococcus aureus subsp. aureus Mu50
uaaaauaaaauua

SEQ ID NO: 3961386 - RNA, 13 nt, Staphylococcus aureus subsp. aureus Mu50
uaaaauaaaucau

SEQ ID NO: 3961387 - RNA, 12 nt, Staphylococcus aureus subsp. aureus Mu50
uaaaauaaaucu

SEQ ID NO: 3961388 - RNA, 23 nt, Staphylococcus aureus subsp. aureus Mu50
uaaaauaacugcuaauuuuuuca

SEQ ID NO: 3961389 - RNA, 18 nt, Staphylococcus aureus subsp. aureus Mu50
uaaaauaagauauauaau

SEQ ID NO: 3961390 - RNA, 16 nt, Staphylococcus aureus subsp. aureus Mu50
uaaaauaaucgguaau

SEQ ID NO: 3961391 - RNA, 11 nt, Staphylococcus aureus subsp. aureus Mu50
uaaaauaauga

SEQ ID NO: 3961392 - RNA, 13 nt, Staphylococcus aureus subsp. aureus Mu50
uaaaauaauuaaa

SEQ ID NO: 3961393 - RNA, 15 nt, Staphylococcus aureus subsp. aureus Mu50
uaaaauaauuaaaua

SEQ ID NO: 3961394 - RNA, 16 nt, Staphylococcus aureus subsp. aureus Mu50
uaaaauaauuaaauaa

SEQ ID NO: 3961395 - RNA, 17 nt, Staphylococcus aureus subsp. aureus Mu50
uaaaauaauuaaauaaa

SEQ ID NO: 3961396 - RNA, 20 nt, Staphylococcus aureus subsp. aureus Mu50
uaaaauaauuaaauaaaaau

SEQ ID NO: 3961397 - RNA, 20 nt, Staphylococcus aureus subsp. aureus Mu50
uaaaauacccauuuuuuucc

SEQ ID NO: 3961398 - RNA, 21 nt, Staphylococcus aureus subsp. aureus Mu50
uaaaauacgguacagauagga

SEQ ID NO: 3961399 - RNA, 13 nt, Staphylococcus aureus subsp. aureus Mu50
uaaaauagaaaaa

SEQ ID NO: 3961400 - RNA, 17 nt, Staphylococcus aureus subsp. aureus Mu50
uaaaauagaaaaauuuc

SEQ ID NO: 3961401 - RNA, 17 nt, Staphylococcus aureus subsp. aureus Mu50
uaaaauagaguagacgu

SEQ ID NO: 3961402 - RNA, 20 nt, Staphylococcus aureus subsp. aureus Mu50
uaaaauaguucuuuaaauua

SEQ ID NO: 3961403 - RNA, 21 nt, Staphylococcus aureus subsp. aureus Mu50
uaaaauaguucuuuaaauuau

SEQ ID NO: 3961404 - RNA, 22 nt, Staphylococcus aureus subsp. aureus Mu50
uaaaauaguucuuuaaauuaua

SEQ ID NO: 3961405 - RNA, 23 nt, Staphylococcus aureus subsp. aureus Mu50
uaaaauauaaauuucuucauagu

SEQ ID NO: 3961406 - RNA, 14 nt, Staphylococcus aureus subsp. aureus Mu50
uaaaauauaucuua

SEQ ID NO: 3961407 - RNA, 14 nt, Staphylococcus aureus subsp. aureus Mu50
uaaaauauaugaau

SEQ ID NO: 3961408 - RNA, 15 nt, Staphylococcus aureus subsp. aureus Mu50
uaaaauaucaaaaua

SEQ ID NO: 3961409 - RNA, 15 nt, Staphylococcus aureus subsp. aureus Mu50
uaaaauaugauuuaa

SEQ ID NO: 3961410 - RNA, 14 nt, Staphylococcus aureus subsp. aureus Mu50
uaaaauauuauuuu

SEQ ID NO: 3961411 - RNA, 15 nt, Staphylococcus aureus subsp. aureus Mu50
uaaaauauuuaacuu

SEQ ID NO: 3961412 - RNA, 16 nt, Staphylococcus aureus subsp. aureus Mu50
uaaaauauuuaacuuu

SEQ ID NO: 3961413 - RNA, 15 nt, Staphylococcus aureus subsp. aureus Mu50
uaaaaucaacaccaa

SEQ ID NO: 3961414 - RNA, 15 nt, Staphylococcus aureus subsp. aureus Mu50
uaaaaucaacuuuuc

SEQ ID NO: 3961415 - RNA, 16 nt, Staphylococcus aureus subsp. aureus Mu50
uaaaaucaucguauuu

SEQ ID NO: 3961416 - RNA, 14 nt, Staphylococcus aureus subsp. aureus Mu50
uaaaaucaucuuaa

SEQ ID NO: 3961417 - RNA, 23 nt, Staphylococcus aureus subsp. aureus Mu50
uaaaaucauuaauaauuaaacaa

SEQ ID NO: 3961418 - RNA, 19 nt, Staphylococcus aureus subsp. aureus Mu50
uaaaauccaagugcuaaga

SEQ ID NO: 3961419 - RNA, 20 nt, Staphylococcus aureus subsp. aureus Mu50
uaaaauccaagugcuaagag

SEQ ID NO: 3961420 - RNA, 23 nt, Staphylococcus aureus subsp. aureus Mu50
uaaaauccuaagcaucguaaaaa

SEQ ID NO: 3961421 - RNA, 15 nt, Staphylococcus aureus subsp. aureus Mu50
uaaaaucgcagcaau

SEQ ID NO: 3961422 - RNA, 16 nt, Staphylococcus aureus subsp. aureus Mu50
uaaaaucuauaccauu

SEQ ID NO: 3961423 - RNA, 18 nt, Staphylococcus aureus subsp. aureus Mu50
uaaaaucucauaauaauu

SEQ ID NO: 3961424 - RNA, 15 nt, Staphylococcus aureus subsp. aureus Mu50
uaaaaugaauaguag

SEQ ID NO: 3961425 - RNA, 16 nt, Staphylococcus aureus subsp. aureus Mu50
uaaaaugaaugaagac

SEQ ID NO: 3961426 - RNA, 21 nt, Staphylococcus aureus subsp. aureus Mu50
uaaaaugaguugaagcuaauu

SEQ ID NO: 3961427 - RNA, 15 nt, Staphylococcus aureus subsp. aureus Mu50
uaaaaugauaucuau

SEQ ID NO: 3961428 - RNA, 22 nt, Staphylococcus aureus subsp. aureus Mu50
uaaaaugauaucugacauuuca

SEQ ID NO: 3961429 - RNA, 17 nt, Staphylococcus aureus subsp. aureus Mu50
uaaaaugcaauuuuuca

SEQ ID NO: 3961430 - RNA, 13 nt, Staphylococcus aureus subsp. aureus Mu50
uaaaaugcauagc

SEQ ID NO: 3961431 - RNA, 18 nt, Staphylococcus aureus subsp. aureus Mu50
uaaaaugcuacaauuucc

SEQ ID NO: 3961432 - RNA, 17 nt, Staphylococcus aureus subsp. aureus Mu50
uaaaaugcucccuucaa

SEQ ID NO: 3961433 - RNA, 20 nt, Staphylococcus aureus subsp. aureus Mu50
uaaaaugcucccuucaaagu

SEQ ID NO: 3961434 - RNA, 22 nt, Staphylococcus aureus subsp. aureus Mu50
uaaaaugcuuuuuugaaauggu

SEQ ID NO: 3961435 - RNA, 18 nt, Staphylococcus aureus subsp. aureus Mu50
uaaaauggcaucuggcaa

SEQ ID NO: 3961436 - RNA, 20 nt, Staphylococcus aureus subsp. aureus Mu50
uaaaauggugcgaauaauaa

SEQ ID NO: 3961437 - RNA, 19 nt, Staphylococcus aureus subsp. aureus Mu50
uaaaaugucuuugaaaaac

SEQ ID NO: 3961438 - RNA, 21 nt, Staphylococcus aureus subsp. aureus Mu50
uaaaaugucuuugaaaaacug

SEQ ID NO: 3961439 - RNA, 19 nt, Staphylococcus aureus subsp. aureus Mu50
uaaagaaugauuuauaaaa

SEQ ID NO: 3961440 - RNA, 21 nt, Staphylococcus aureus subsp. aureus Mu50
uaaagaaugauuuauaaaaaa

SEQ ID NO: 3961441 - RNA, 13 nt, Staphylococcus aureus subsp. aureus Mu50
uaaagaauuaagu

SEQ ID NO: 3961442 - RNA, 15 nt, Staphylococcus aureus subsp. aureus Mu50
uaaagaauuaaguag

SEQ ID NO: 3961443 - RNA, 16 nt, Staphylococcus aureus subsp. aureus Mu50
uaaagaauuaaguagu

SEQ ID NO: 3961444 - RNA, 15 nt, Staphylococcus aureus subsp. aureus Mu50
uaaagacaccuucaa

SEQ ID NO: 3961445 - RNA, 21 nt, Staphylococcus aureus subsp. aureus Mu50
uaaagacaccuucaauaucug

SEQ ID NO: 3961446 - RNA, 15 nt, Staphylococcus aureus subsp. aureus Mu50
uaaagagcaauuaaa

SEQ ID NO: 3961447 - RNA, 16 nt, Staphylococcus aureus subsp. aureus Mu50
uaaagagcaauuaaag

SEQ ID NO: 3961448 - RNA, 16 nt, Staphylococcus aureus subsp. aureus Mu50
uaaagauaagaugguu

SEQ ID NO: 3961449 - RNA, 17 nt, Staphylococcus aureus subsp. aureus Mu50
uaaagauagaaugaaua

SEQ ID NO: 3961450 - RNA, 13 nt, Staphylococcus aureus subsp. aureus Mu50
uaaagaucauuuu

SEQ ID NO: 3961451 - RNA, 18 nt, Staphylococcus aureus subsp. aureus Mu50
uaaagauuaaaauaugac

SEQ ID NO: 3961452 - RNA, 20 nt, Staphylococcus aureus subsp. aureus Mu50
uaaagauuauaucuuuauau

SEQ ID NO: 3961453 - RNA, 22 nt, Staphylococcus aureus subsp. aureus Mu50
uaaagauuauuauuacaaugaa

SEQ ID NO: 3961454 - RNA, 13 nt, Staphylococcus aureus subsp. aureus Mu50
uaaagcaaauuau

SEQ ID NO: 3961455 - RNA, 16 nt, Staphylococcus aureus subsp. aureus Mu50
uaaagcaauguugcau

SEQ ID NO: 3961456 - RNA, 20 nt, Staphylococcus aureus subsp. aureus Mu50
uaaagcauaucucaagauau

SEQ ID NO: 3961457 - RNA, 16 nt, Staphylococcus aureus subsp. aureus Mu50
uaaagcgauuuccauc

SEQ ID NO: 3961458 - RNA, 18 nt, Staphylococcus aureus subsp. aureus Mu50
uaaagcugcgauauaacu

SEQ ID NO: 3961459 - RNA, 16 nt, Staphylococcus aureus subsp. aureus Mu50
uaaagcuuauuaaauc

SEQ ID NO: 3961460 - RNA, 21 nt, Staphylococcus aureus subsp. aureus Mu50
uaaagcuucgucaaugacuaa

SEQ ID NO: 3961461 - RNA, 17 nt, Staphylococcus aureus subsp. aureus Mu50
uaaagcuugcuguucaa

SEQ ID NO: 3961462 - RNA, 20 nt, Staphylococcus aureus subsp. aureus Mu50
uaaagcuugcuguucaacau

SEQ ID NO: 3961463 - RNA, 16 nt, Staphylococcus aureus subsp. aureus Mu50
uaaaggaaaucaaucc

SEQ ID NO: 3961464 - RNA, 15 nt, Staphylococcus aureus subsp. aureus Mu50
uaaaggcaacaaaua

SEQ ID NO: 3961465 - RNA, 19 nt, Staphylococcus aureus subsp. aureus Mu50
uaaagggcuauuugauaca

SEQ ID NO: 3961466 - RNA, 19 nt, Staphylococcus aureus subsp. aureus Mu50
uaaaggguguuuagauagc

SEQ ID NO: 3961467 - RNA, 15 nt, Staphylococcus aureus subsp. aureus Mu50
uaaagguaccacugu

SEQ ID NO: 3961468 - RNA, 18 nt, Staphylococcus aureus subsp. aureus Mu50
uaaagguuaaauauuuaa

SEQ ID NO: 3961469 - RNA, 15 nt, Staphylococcus aureus subsp. aureus Mu50
uaaaguaaaauauac

SEQ ID NO: 3961470 - RNA, 16 nt, Staphylococcus aureus subsp. aureus Mu50
uaaaguacuuacaaau

SEQ ID NO: 3961471 - RNA, 17 nt, Staphylococcus aureus subsp. aureus Mu50
uaaaguacuuacaaaua

SEQ ID NO: 3961472 - RNA, 18 nt, Staphylococcus aureus subsp. aureus Mu50
uaaaguacuuacaaauau

SEQ ID NO: 3961473 - RNA, 21 nt, Staphylococcus aureus subsp. aureus Mu50
uaaaguauaagguugaagaag

SEQ ID NO: 3961474 - RNA, 17 nt, Staphylococcus aureus subsp. aureus Mu50
uaaaguauguugucaua

SEQ ID NO: 3961475 - RNA, 16 nt, Staphylococcus aureus subsp. aureus Mu50
uaaagucaauuuaaau

SEQ ID NO: 3961476 - RNA, 21 nt, Staphylococcus aureus subsp. aureus Mu50
uaaagucuguauauggcgaua

SEQ ID NO: 3961477 - RNA, 15 nt, Staphylococcus aureus subsp. aureus Mu50
uaaagugaaauaaag

SEQ ID NO: 3961478 - RNA, 16 nt, Staphylococcus aureus subsp. aureus Mu50
uaaaguguuucaacau

SEQ ID NO: 3961479 - RNA, 14 nt, Staphylococcus aureus subsp. aureus Mu50
uaaaguuaaagacu

SEQ ID NO: 3961480 - RNA, 13 nt, Staphylococcus aureus subsp. aureus Mu50
uaaaguuauaaau

SEQ ID NO: 3961481 - RNA, 20 nt, Staphylococcus aureus subsp. aureus Mu50
uaaaguuauaaauuauauuu

SEQ ID NO: 3961482 - RNA, 13 nt, Staphylococcus aureus subsp. aureus Mu50
uaaaguuccaagu

SEQ ID NO: 3961483 - RNA, 19 nt, Staphylococcus aureus subsp. aureus Mu50
uaaaguuccaaguuaaugc

SEQ ID NO: 3961484 - RNA, 15 nt, Staphylococcus aureus subsp. aureus Mu50
uaaaguuuaaauauu

SEQ ID NO: 3961485 - RNA, 15 nt, Staphylococcus aureus subsp. aureus Mu50
uaaaguuuauuuaug

SEQ ID NO: 3961486 - RNA, 21 nt, Staphylococcus aureus subsp. aureus Mu50
uaaaguuuugaaccuaaauuc

SEQ ID NO: 3961487 - RNA, 15 nt, Staphylococcus aureus subsp. aureus Mu50
uaaauaaaaguucaa

SEQ ID NO: 3961488 - RNA, 14 nt, Staphylococcus aureus subsp. aureus Mu50
uaaauaaaaugcau

SEQ ID NO: 3961489 - RNA, 13 nt, Staphylococcus aureus subsp. aureus Mu50
uaaauaaaaugcu

SEQ ID NO: 3961490 - RNA, 14 nt, Staphylococcus aureus subsp. aureus Mu50
uaaauaaaaugcua

SEQ ID NO: 3961491 - RNA, 14 nt, Staphylococcus aureus subsp. aureus Mu50
uaaauaaaauuaaa

SEQ ID NO: 3961492 - RNA, 15 nt, Staphylococcus aureus subsp. aureus Mu50
uaaauaaaauuaaaa

SEQ ID NO: 3961493 - RNA, 14 nt, Staphylococcus aureus subsp. aureus Mu50
uaaauaaaauuguu

SEQ ID NO: 3961494 - RNA, 22 nt, Staphylococcus aureus subsp. aureus Mu50
uaaauaaaauuuuuuucauaau

SEQ ID NO: 3961495 - RNA, 23 nt, Staphylococcus aureus subsp. aureus Mu50
uaaauaaacucaccaaguucacu

SEQ ID NO: 3961496 - RNA, 13 nt, Staphylococcus aureus subsp. aureus Mu50
uaaauaaaugacu

SEQ ID NO: 3961497 - RNA, 16 nt, Staphylococcus aureus subsp. aureus Mu50
uaaauaaauucucuaa

SEQ ID NO: 3961498 - RNA, 15 nt, Staphylococcus aureus subsp. aureus Mu50
uaaauaacaaguagu

SEQ ID NO: 3961499 - RNA, 20 nt, Staphylococcus aureus subsp. aureus Mu50
uaaauaaccgucacaaacca

SEQ ID NO: 3961500 - RNA, 18 nt, Staphylococcus aureus subsp. aureus Mu50
uaaauaacuuuaccacca

SEQ ID NO: 3961501 - RNA, 17 nt, Staphylococcus aureus subsp. aureus Mu50
uaaauaagaugaaauau

SEQ ID NO: 3961502 - RNA, 22 nt, Staphylococcus aureus subsp. aureus Mu50
uaaauaagcaaucauaauacuu

SEQ ID NO: 3961503 - RNA, 12 nt, Staphylococcus aureus subsp. aureus Mu50
uaaauaaguagu

SEQ ID NO: 3961504 - RNA, 17 nt, Staphylococcus aureus subsp. aureus Mu50
uaaauaagugauaaaua

SEQ ID NO: 3961505 - RNA, 19 nt, Staphylococcus aureus subsp. aureus Mu50
uaaauaagugauaaauaau

SEQ ID NO: 3961506 - RNA, 15 nt, Staphylococcus aureus subsp. aureus Mu50
uaaauaauaaguuga

SEQ ID NO: 3961507 - RNA, 20 nt, Staphylococcus aureus subsp. aureus Mu50
uaaauaaugauaaauuaaag

SEQ ID NO: 3961508 - RNA, 18 nt, Staphylococcus aureus subsp. aureus Mu50
uaaauaaugcauggaaaa

SEQ ID NO: 3961509 - RNA, 14 nt, Staphylococcus aureus subsp. aureus Mu50
uaaauacaaaaaua

SEQ ID NO: 3961510 - RNA, 19 nt, Staphylococcus aureus subsp. aureus Mu50
uaaauacaaaaauauagcu

SEQ ID NO: 3961511 - RNA, 19 nt, Staphylococcus aureus subsp. aureus Mu50
uaaauacaauuucuucauu

SEQ ID NO: 3961512 - RNA, 19 nt, Staphylococcus aureus subsp. aureus Mu50
uaaauacgccaaauaucag

SEQ ID NO: 3961513 - RNA, 21 nt, Staphylococcus aureus subsp. aureus Mu50
uaaauacuugcucuaauucaa

SEQ ID NO: 3961514 - RNA, 21 nt, Staphylococcus aureus subsp. aureus Mu50
uaaauagacugccaauaaaau

SEQ ID NO: 3961515 - RNA, 19 nt, Staphylococcus aureus subsp. aureus Mu50
uaaauagagaacagcagua

SEQ ID NO: 3961516 - RNA, 18 nt, Staphylococcus aureus subsp. aureus Mu50
uaaauagauaauauauag

SEQ ID NO: 3961517 - RNA, 19 nt, Staphylococcus aureus subsp. aureus Mu50
uaaauagcuucuuaaauca

SEQ ID NO: 3961518 - RNA, 19 nt, Staphylococcus aureus subsp. aureus Mu50
uaaauaggaugaaaaagau

SEQ ID NO: 3961519 - RNA, 19 nt, Staphylococcus aureus subsp. aureus Mu50
uaaauaggugauuauauau

SEQ ID NO: 3961520 - RNA, 16 nt, Staphylococcus aureus subsp. aureus Mu50
uaaauaguuuuucaua

SEQ ID NO: 3961521 - RNA, 18 nt, Staphylococcus aureus subsp. aureus Mu50
uaaauaguuuuucauauu

SEQ ID NO: 3961522 - RNA, 20 nt, Staphylococcus aureus subsp. aureus Mu50
uaaauaguuuuucauauuca

SEQ ID NO: 3961523 - RNA, 22 nt, Staphylococcus aureus subsp. aureus Mu50
uaaauauaauagaaauaaucac

SEQ ID NO: 3961524 - RNA, 15 nt, Staphylococcus aureus subsp. aureus Mu50
uaaauauaguaauaa

SEQ ID NO: 3961525 - RNA, 22 nt, Staphylococcus aureus subsp. aureus Mu50
uaaauauauaaggcgcucucuu

SEQ ID NO: 3961526 - RNA, 13 nt, Staphylococcus aureus subsp. aureus Mu50
uaaauauauuagu

SEQ ID NO: 3961527 - RNA, 19 nt, Staphylococcus aureus subsp. aureus Mu50
uaaauguuuauaucuuuua

SEQ ID NO: 3961528 - RNA, 15 nt, Staphylococcus aureus subsp. aureus Mu50
uaaauguuuuaugua

SEQ ID NO: 3961529 - RNA, 17 nt, Staphylococcus aureus subsp. aureus Mu50
uaaauguuuuauguauu

SEQ ID NO: 3961530 - RNA, 18 nt, Staphylococcus aureus subsp. aureus Mu50
uaaauguuuuauguauuu

SEQ ID NO: 3961531 - RNA, 22 nt, Staphylococcus aureus subsp. aureus Mu50
uaaauguuuuauguauuuauuu

SEQ ID NO: 3961532 - RNA, 18 nt, Staphylococcus aureus subsp. aureus Mu50
uaaauuaaaucgauauuu

SEQ ID NO: 3961533 - RNA, 13 nt, Staphylococcus aureus subsp. aureus Mu50
uaaauuaaaugca

SEQ ID NO: 3961534 - RNA, 19 nt, Staphylococcus aureus subsp. aureus Mu50
uaaauuaauagagaaagaa

SEQ ID NO: 3961535 - RNA, 14 nt, Staphylococcus aureus subsp. aureus Mu50
uaaauuaauauagu

SEQ ID NO: 3961536 - RNA, 19 nt, Staphylococcus aureus subsp. aureus Mu50
uaaauuacaaaaguaugau

SEQ ID NO: 3961537 - RNA, 13 nt, Staphylococcus aureus subsp. aureus Mu50
uaaauuacuauau

SEQ ID NO: 3961538 - RNA, 18 nt, Staphylococcus aureus subsp. aureus Mu50
uaaauuagaugaaaugga

SEQ ID NO: 3961539 - RNA, 20 nt, Staphylococcus aureus subsp. aureus Mu50
uaaauuagaugaaauggaaa

SEQ ID NO: 3961540 - RNA, 23 nt, Staphylococcus aureus subsp. aureus Mu50
uaaauuagugguuagcuauauuu

SEQ ID NO: 3961541 - RNA, 15 nt, Staphylococcus aureus subsp. aureus Mu50
uaaauuauaaauagu

SEQ ID NO: 3961542 - RNA, 22 nt, Staphylococcus aureus subsp. aureus Mu50
uaaauuauauacccaccacauu

SEQ ID NO: 3961543 - RNA, 16 nt, Staphylococcus aureus subsp. aureus Mu50
uaaauuauuguuuuaa

SEQ ID NO: 3961544 - RNA, 18 nt, Staphylococcus aureus subsp. aureus Mu50
uaaauuauuguuuuaaug

SEQ ID NO: 3961545 - RNA, 14 nt, Staphylococcus aureus subsp. aureus Mu50
uaaauuauuuaauu

SEQ ID NO: 3961546 - RNA, 15 nt, Staphylococcus aureus subsp. aureus Mu50
uaaauuauuuauuca

SEQ ID NO: 3961547 - RNA, 16 nt, Staphylococcus aureus subsp. aureus Mu50
uaaauucaauaaucuu

SEQ ID NO: 3961548 - RNA, 22 nt, Staphylococcus aureus subsp. aureus Mu50
uaaauuccaagagaauuaauaa

SEQ ID NO: 3961549 - RNA, 19 nt, Staphylococcus aureus subsp. aureus Mu50
uaaauucccauguauucuu

SEQ ID NO: 3961550 - RNA, 20 nt, Staphylococcus aureus subsp. aureus Mu50
uaaauucccauguauucuua

SEQ ID NO: 3961551 - RNA, 22 nt, Staphylococcus aureus subsp. aureus Mu50
uaaauucccauguauucuuaga

SEQ ID NO: 3961552 - RNA, 14 nt, Staphylococcus aureus subsp. aureus Mu50
uaaauucuaucuau

SEQ ID NO: 3961553 - RNA, 20 nt, Staphylococcus aureus subsp. aureus Mu50
uaaauucuaucuauaaacgu

SEQ ID NO: 3961554 - RNA, 19 nt, Staphylococcus aureus subsp. aureus Mu50
uaaauucuuauaaaauaaa

SEQ ID NO: 3961555 - RNA, 18 nt, Staphylococcus aureus subsp. aureus Mu50
uaaauugaaguacauuaa

SEQ ID NO: 3961556 - RNA, 21 nt, Staphylococcus aureus subsp. aureus Mu50
uaaauugaaguacauuaaaac

SEQ ID NO: 3961557 - RNA, 23 nt, Staphylococcus aureus subsp. aureus Mu50
uaaauugacucaaagauauacuu

SEQ ID NO: 3961558 - RNA, 20 nt, Staphylococcus aureus subsp. aureus Mu50
uaaauugacuuuaauugcuc

SEQ ID NO: 3961559 - RNA, 22 nt, Staphylococcus aureus subsp. aureus Mu50
uaaauugaguuuuuuaaaauaa

SEQ ID NO: 3961560 - RNA, 18 nt, Staphylococcus aureus subsp. aureus Mu50
uaaauugcuugaaauuau

SEQ ID NO: 3961561 - RNA, 20 nt, Staphylococcus aureus subsp. aureus Mu50
uaaauugcuugaaauuauua

SEQ ID NO: 3961562 - RNA, 19 nt, Staphylococcus aureus subsp. aureus Mu50
uaaauuguaugaauaauau

SEQ ID NO: 3961563 - RNA, 20 nt, Staphylococcus aureus subsp. aureus Mu50
uaaauuguauuucuuaacau

SEQ ID NO: 3961564 - RNA, 23 nt, Staphylococcus aureus subsp. aureus Mu50
uaaauugucacaaucuguucaua

SEQ ID NO: 3961565 - RNA, 19 nt, Staphylococcus aureus subsp. aureus Mu50
uaaauuguuuacuauacuu

SEQ ID NO: 3961566 - RNA, 14 nt, Staphylococcus aureus subsp. aureus Mu50
uaaauuuaaaagaa

SEQ ID NO: 3961567 - RNA, 15 nt, Staphylococcus aureus subsp. aureus Mu50
uaaauuuaaaagaaa

SEQ ID NO: 3961568 - RNA, 17 nt, Staphylococcus aureus subsp. aureus Mu50
uaaauuuaaaauaauag

SEQ ID NO: 3961569 - RNA, 13 nt, Staphylococcus aureus subsp. aureus Mu50
uaaauuuaaaugu

SEQ ID NO: 3961570 - RNA, 18 nt, Staphylococcus aureus subsp. aureus Mu50
uaaauuuaacguuauuca

SEQ ID NO: 3961571 - RNA, 16 nt, Staphylococcus aureus subsp. aureus Mu50
uaaauuuauuuuuaau

SEQ ID NO: 3961572 - RNA, 17 nt, Staphylococcus aureus subsp. aureus Mu50
uaaauuuauuuuuaauu

SEQ ID NO: 3961573 - RNA, 22 nt, Staphylococcus aureus subsp. aureus Mu50
uaaauuucgauuaauugaaugc

SEQ ID NO: 3961574 - RNA, 14 nt, Staphylococcus aureus subsp. aureus Mu50
uaaauuucuucaua

SEQ ID NO: 3961575 - RNA, 22 nt, Staphylococcus aureus subsp. aureus Mu50
uaaauuucuucauaguucaaau

SEQ ID NO: 3961576 - RNA, 14 nt, Staphylococcus aureus subsp. aureus Mu50
uaaauuugaaagua

SEQ ID NO: 3961577 - RNA, 19 nt, Staphylococcus aureus subsp. aureus Mu50
uaaauuuguaccaaauaaa

SEQ ID NO: 3961578 - RNA, 14 nt, Staphylococcus aureus subsp. aureus Mu50
uaaauuuucaucau

SEQ ID NO: 3961579 - RNA, 21 nt, Staphylococcus aureus subsp. aureus Mu50
uaaauuuucuguuuaauuaaa

SEQ ID NO: 3961580 - RNA, 22 nt, Staphylococcus aureus subsp. aureus Mu50
uaaauuuucuguuuaauuaaaa

SEQ ID NO: 3961581 - RNA, 17 nt, Staphylococcus aureus subsp. aureus Mu50
uaaauuuugaauuacag

SEQ ID NO: 3961582 - RNA, 21 nt, Staphylococcus aureus subsp. aureus Mu50
uaaauuuugcgaaaauaucau

SEQ ID NO: 3961583 - RNA, 23 nt, Staphylococcus aureus subsp. aureus Mu50
uaaauuuugcgaaaauaucauuu

SEQ ID NO: 3961584 - RNA, 15 nt, Staphylococcus aureus subsp. aureus Mu50
uaaauuuuguuagga

SEQ ID NO: 3961585 - RNA, 14 nt, Staphylococcus aureus subsp. aureus Mu50
uaaauuuuuaagaa

SEQ ID NO: 3961586 - RNA, 18 nt, Staphylococcus aureus subsp. aureus Mu50
uaaauuuuuaguuaaagu

SEQ ID NO: 3961587 - RNA, 16 nt, Staphylococcus aureus subsp. aureus Mu50
uaacaaaauuaagaag

SEQ ID NO: 3961588 - RNA, 21 nt, Staphylococcus aureus subsp. aureus Mu50
uaacaaaauuaagaagaaaua

SEQ ID NO: 3961589 - RNA, 13 nt, Staphylococcus aureus subsp. aureus Mu50
uaacaaacauuaa

SEQ ID NO: 3961590 - RNA, 17 nt, Staphylococcus aureus subsp. aureus Mu50
uaacaaacauuaaucua

SEQ ID NO: 3961591 - RNA, 23 nt, Staphylococcus aureus subsp. aureus Mu50
uaacaaacauuaaucuauauaaa

SEQ ID NO: 3961592 - RNA, 14 nt, Staphylococcus aureus subsp. aureus Mu50
uaacaaauaguuca

SEQ ID NO: 3961593 - RNA, 17 nt, Staphylococcus aureus subsp. aureus Mu50
uaacaacuuuaauuuuu

SEQ ID NO: 3961594 - RNA, 13 nt, Staphylococcus aureus subsp. aureus Mu50
uaacaagaaaaac

SEQ ID NO: 3961595 - RNA, 20 nt, Staphylococcus aureus subsp. aureus Mu50
uaacaagaaguaauguuaaa

SEQ ID NO: 3961596 - RNA, 12 nt, Staphylococcus aureus subsp. aureus Mu50
uaacaagcauuu

SEQ ID NO: 3961597 - RNA, 13 nt, Staphylococcus aureus subsp. aureus Mu50
uaacaagcuuuuc

SEQ ID NO: 3961598 - RNA, 17 nt, Staphylococcus aureus subsp. aureus Mu50
uaacaaguacaauaaua

SEQ ID NO: 3961599 - RNA, 21 nt, Staphylococcus aureus subsp. aureus Mu50
uaacaauacuacuuaaugacu

SEQ ID NO: 3961600 - RNA, 20 nt, Staphylococcus aureus subsp. aureus Mu50
uaacaauagugacuuuuaua

SEQ ID NO: 3961601 - RNA, 19 nt, Staphylococcus aureus subsp. aureus Mu50
uaacaauaguuuucuucac

SEQ ID NO: 3961602 - RNA, 15 nt, Staphylococcus aureus subsp. aureus Mu50
uaacaauauuaaauu

SEQ ID NO: 3961603 - RNA, 20 nt, Staphylococcus aureus subsp. aureus Mu50
uaacaauauucguaaauccu

SEQ ID NO: 3961604 - RNA, 12 nt, Staphylococcus aureus subsp. aureus Mu50
uaacaaucaaag

SEQ ID NO: 3961605 - RNA, 18 nt, Staphylococcus aureus subsp. aureus Mu50
uaacaaucaguaauaaug

SEQ ID NO: 3961606 - RNA, 17 nt, Staphylococcus aureus subsp. aureus Mu50
uaacaaucguuuuaaug

SEQ ID NO: 3961607 - RNA, 16 nt, Staphylococcus aureus subsp. aureus Mu50
uaacaauguugcuugu

SEQ ID NO: 3961608 - RNA, 21 nt, Staphylococcus aureus subsp. aureus Mu50
uaacaauuacgacaagaauua

SEQ ID NO: 3961609 - RNA, 12 nt, Staphylococcus aureus subsp. aureus Mu50
uaacaauugauu

SEQ ID NO: 3961610 - RNA, 22 nt, Staphylococcus aureus subsp. aureus Mu50
uaacaauuuagcaaauauuucu

SEQ ID NO: 3961611 - RNA, 15 nt, Staphylococcus aureus subsp. aureus Mu50
uaacaauuuauuaaa

SEQ ID NO: 3961612 - RNA, 17 nt, Staphylococcus aureus subsp. aureus Mu50
uaacaauuuauuaaaac

SEQ ID NO: 3961613 - RNA, 16 nt, Staphylococcus aureus subsp. aureus Mu50
uaacaccaauugaaua

SEQ ID NO: 3961614 - RNA, 16 nt, Staphylococcus aureus subsp. aureus Mu50
uaacuagaaugauuaa

SEQ ID NO: 3961615 - RNA, 17 nt, Staphylococcus aureus subsp. aureus Mu50
uaacuagaaugauuaaa

SEQ ID NO: 3961616 - RNA, 17 nt, Staphylococcus aureus subsp. aureus Mu50
uaacuagcaaaugcacu

SEQ ID NO: 3961617 - RNA, 17 nt, Staphylococcus aureus subsp. aureus Mu50
uaacuagugccucuuuu

SEQ ID NO: 3961618 - RNA, 17 nt, Staphylococcus aureus subsp. aureus Mu50
uaacuaguguaaugucu

SEQ ID NO: 3961619 - RNA, 22 nt, Staphylococcus aureus subsp. aureus Mu50
uaacuauaacaauaguuuucuu

SEQ ID NO: 3961620 - RNA, 18 nt, Staphylococcus aureus subsp. aureus Mu50
uaacuauguuacuuauau

SEQ ID NO: 3961621 - RNA, 16 nt, Staphylococcus aureus subsp. aureus Mu50
uaacuauugaaaauag

SEQ ID NO: 3961622 - RNA, 17 nt, Staphylococcus aureus subsp. aureus Mu50
uaacucaaagaaacuau

SEQ ID NO: 3961623 - RNA, 14 nt, Staphylococcus aureus subsp. aureus Mu50
uaacucaagugauu

SEQ ID NO: 3961624 - RNA, 14 nt, Staphylococcus aureus subsp. aureus Mu50
uaacuccuccaaag

SEQ ID NO: 3961625 - RNA, 16 nt, Staphylococcus aureus subsp. aureus Mu50
uaacucguaaucauag

SEQ ID NO: 3961626 - RNA, 20 nt, Staphylococcus aureus subsp. aureus Mu50
uaacucuaaauauaauagaa

SEQ ID NO: 3961627 - RNA, 14 nt, Staphylococcus aureus subsp. aureus Mu50
uaacucuucaguac

SEQ ID NO: 3961628 - RNA, 15 nt, Staphylococcus aureus subsp. aureus Mu50
uaacucuuuaauuuu

SEQ ID NO: 3961629 - RNA, 17 nt, Staphylococcus aureus subsp. aureus Mu50
uaacugaauuaaagcau

SEQ ID NO: 3961630 - RNA, 15 nt, Staphylococcus aureus subsp. aureus Mu50
uaacugaccuaacaa

SEQ ID NO: 3961631 - RNA, 20 nt, Staphylococcus aureus subsp. aureus Mu50
uaacugaccuaacaauuuga

SEQ ID NO: 3961632 - RNA, 13 nt, Staphylococcus aureus subsp. aureus Mu50
uaacugauaaaag

SEQ ID NO: 3961633 - RNA, 12 nt, Staphylococcus aureus subsp. aureus Mu50
uaacugauuuug

SEQ ID NO: 3961634 - RNA, 22 nt, Staphylococcus aureus subsp. aureus Mu50
uaacugauuuuguuucaaacgu

SEQ ID NO: 3961635 - RNA, 16 nt, Staphylococcus aureus subsp. aureus Mu50
uaacugcaaacuugau

SEQ ID NO: 3961636 - RNA, 19 nt, Staphylococcus aureus subsp. aureus Mu50
uaacugcaaacuugauuca

SEQ ID NO: 3961637 - RNA, 19 nt, Staphylococcus aureus subsp. aureus Mu50
uaacugcuaauuuuuucau

SEQ ID NO: 3961638 - RNA, 20 nt, Staphylococcus aureus subsp. aureus Mu50
uaacuggcaaaucaaacaau

SEQ ID NO: 3961639 - RNA, 14 nt, Staphylococcus aureus subsp. aureus Mu50
uaacugggauauag

SEQ ID NO: 3961640 - RNA, 22 nt, Staphylococcus aureus subsp. aureus Mu50
uaacugugauauuaauugaaaa

SEQ ID NO: 3961641 - RNA, 16 nt, Staphylococcus aureus subsp. aureus Mu50
uaacuguucuaaccau

SEQ ID NO: 3961642 - RNA, 13 nt, Staphylococcus aureus subsp. aureus Mu50
uaacuguucuuuc

SEQ ID NO: 3961643 - RNA, 16 nt, Staphylococcus aureus subsp. aureus Mu50
uaacuguucuuucguc

SEQ ID NO: 3961644 - RNA, 21 nt, Staphylococcus aureus subsp. aureus Mu50
uaacuguucuuucgucuugua

SEQ ID NO: 3961645 - RNA, 15 nt, Staphylococcus aureus subsp. aureus Mu50
uaacuguuuaucaug

SEQ ID NO: 3961646 - RNA, 18 nt, Staphylococcus aureus subsp. aureus Mu50
uaacuuaaaauuuaaaua

SEQ ID NO: 3961647 - RNA, 21 nt, Staphylococcus aureus subsp. aureus Mu50
uaacuuaaaauuuaaauauug

SEQ ID NO: 3961648 - RNA, 19 nt, Staphylococcus aureus subsp. aureus Mu50
uaacuuaagcucauuucaa

SEQ ID NO: 3961649 - RNA, 14 nt, Staphylococcus aureus subsp. aureus Mu50
uaacuuaauuaaaa

SEQ ID NO: 3961650 - RNA, 23 nt, Staphylococcus aureus subsp. aureus Mu50
uaacuuaauuaaaaaaagauuag

SEQ ID NO: 3961651 - RNA, 21 nt, Staphylococcus aureus subsp. aureus Mu50
uaacuuauauacguugauuaa

SEQ ID NO: 3961652 - RNA, 20 nt, Staphylococcus aureus subsp. aureus Mu50
uaacuucauaauauauccug

SEQ ID NO: 3961653 - RNA, 15 nt, Staphylococcus aureus subsp. aureus Mu50
uaacuuccuaaaauu

SEQ ID NO: 3961654 - RNA, 19 nt, Staphylococcus aureus subsp. aureus Mu50
uaacuuccuaaaauuuaca

SEQ ID NO: 3961655 - RNA, 21 nt, Staphylococcus aureus subsp. aureus Mu50
uaacuucuauuaagaaauacu

SEQ ID NO: 3961656 - RNA, 17 nt, Staphylococcus aureus subsp. aureus Mu50
uaacuucugauucuuca

SEQ ID NO: 3961657 - RNA, 21 nt, Staphylococcus aureus subsp. aureus Mu50
uaacuucugauucuucacuaa

SEQ ID NO: 3961658 - RNA, 16 nt, Staphylococcus aureus subsp. aureus Mu50
uaacuugauaucaucu

SEQ ID NO: 3961659 - RNA, 17 nt, Staphylococcus aureus subsp. aureus Mu50
uaacuuguaauauaaca

SEQ ID NO: 3961660 - RNA, 13 nt, Staphylococcus aureus subsp. aureus Mu50
uaacuuuaaaaau

SEQ ID NO: 3961661 - RNA, 18 nt, Staphylococcus aureus subsp. aureus Mu50
uaacuuucagcaccagaa

SEQ ID NO: 3961662 - RNA, 13 nt, Staphylococcus aureus subsp. aureus Mu50
uaacuuucccuac

SEQ ID NO: 3961663 - RNA, 18 nt, Staphylococcus aureus subsp. aureus Mu50
uaacuuucccuacugcuu

SEQ ID NO: 3961664 - RNA, 22 nt, Staphylococcus aureus subsp. aureus Mu50
uaacuuuccgccuucaauccaa

SEQ ID NO: 3961665 - RNA, 13 nt, Staphylococcus aureus subsp. aureus Mu50
uaacuuucuuuug

SEQ ID NO: 3961666 - RNA, 20 nt, Staphylococcus aureus subsp. aureus Mu50
uaacuuucuuuuguuuuuau

SEQ ID NO: 3961667 - RNA, 14 nt, Staphylococcus aureus subsp. aureus Mu50
uaacuuuuuaaagg

SEQ ID NO: 3961668 - RNA, 16 nt, Staphylococcus aureus subsp. aureus Mu50
uaacuuuuuaaaggac

SEQ ID NO: 3961669 - RNA, 13 nt, Staphylococcus aureus subsp. aureus Mu50
uaacuuuuuaaua

SEQ ID NO: 3961670 - RNA, 17 nt, Staphylococcus aureus subsp. aureus Mu50
uaacuuuuuacauuuuc

SEQ ID NO: 3961671 - RNA, 15 nt, Staphylococcus aureus subsp. aureus Mu50
uaagaaaauacuaac

SEQ ID NO: 3961672 - RNA, 17 nt, Staphylococcus aureus subsp. aureus Mu50
uaagaaaaucauucauu

SEQ ID NO: 3961673 - RNA, 23 nt, Staphylococcus aureus subsp. aureus Mu50
uaagaaauuuuuucuauggcaca

SEQ ID NO: 3961674 - RNA, 21 nt, Staphylococcus aureus subsp. aureus Mu50
uaagaacaugauacugaaauu

SEQ ID NO: 3961675 - RNA, 15 nt, Staphylococcus aureus subsp. aureus Mu50
uaagaacgagaauuu

SEQ ID NO: 3961676 - RNA, 14 nt, Staphylococcus aureus subsp. aureus Mu50
uaagaagaaauacu

SEQ ID NO: 3961677 - RNA, 15 nt, Staphylococcus aureus subsp. aureus Mu50
uaagaagaaauacuu

SEQ ID NO: 3961678 - RNA, 22 nt, Staphylococcus aureus subsp. aureus Mu50
uaagaauauuuaaguuuccuau

SEQ ID NO: 3961679 - RNA, 20 nt, Staphylococcus aureus subsp. aureus Mu50
uaagaaugcaccaacaauag

SEQ ID NO: 3961680 - RNA, 20 nt, Staphylococcus aureus subsp. aureus Mu50
uaagaauguacaauuuuuua

SEQ ID NO: 3961681 - RNA, 22 nt, Staphylococcus aureus subsp. aureus Mu50
uaagaaugugagauacguuauu

SEQ ID NO: 3961682 - RNA, 16 nt, Staphylococcus aureus subsp. aureus Mu50
uaagaauguguuaauc

SEQ ID NO: 3961683 - RNA, 15 nt, Staphylococcus aureus subsp. aureus Mu50
uaagaauuaacaaca

SEQ ID NO: 3961684 - RNA, 22 nt, Staphylococcus aureus subsp. aureus Mu50
uaagaauuguugaucaugagac

SEQ ID NO: 3961685 - RNA, 12 nt, Staphylococcus aureus subsp. aureus Mu50
uaagaauuuaaa

SEQ ID NO: 3961686 - RNA, 15 nt, Staphylococcus aureus subsp. aureus Mu50
uaagaauuuaaaaga

SEQ ID NO: 3961687 - RNA, 22 nt, Staphylococcus aureus subsp. aureus Mu50
uaagacagcuucucauugaaau

SEQ ID NO: 3961688 - RNA, 14 nt, Staphylococcus aureus subsp. aureus Mu50
uaagacauaugcag

SEQ ID NO: 3961689 - RNA, 13 nt, Staphylococcus aureus subsp. aureus Mu50
uaagacgauuuca

SEQ ID NO: 3961690 - RNA, 16 nt, Staphylococcus aureus subsp. aureus Mu50
uaagacugauuaauua

SEQ ID NO: 3961691 - RNA, 24 nt, Staphylococcus aureus subsp. aureus Mu50
uaagacugccauucuuuuucucaa

SEQ ID NO: 3961692 - RNA, 18 nt, Staphylococcus aureus subsp. aureus Mu50
uaagauaauuuucaauua

SEQ ID NO: 3961693 - RNA, 21 nt, Staphylococcus aureus subsp. aureus Mu50
uaagauaauuuucaauuagaa

SEQ ID NO: 3961694 - RNA, 15 nt, Staphylococcus aureus subsp. aureus Mu50
uaagauagauaaauc

SEQ ID NO: 3961695 - RNA, 16 nt, Staphylococcus aureus subsp. aureus Mu50
uaagauagauaaauca

SEQ ID NO: 3961696 - RNA, 18 nt, Staphylococcus aureus subsp. aureus Mu50
uaagauagauaaaucaag

SEQ ID NO: 3961697 - RNA, 20 nt, Staphylococcus aureus subsp. aureus Mu50
uaagauauuuccaaauugaa

SEQ ID NO: 3961698 - RNA, 14 nt, Staphylococcus aureus subsp. aureus Mu50
uaagaucaauauca

SEQ ID NO: 3961699 - RNA, 15 nt, Staphylococcus aureus subsp. aureus Mu50
uaagaucaauaucac

SEQ ID NO: 3961700 - RNA, 14 nt, Staphylococcus aureus subsp. aureus Mu50
uaagaugacuacaa

SEQ ID NO: 3961701 - RNA, 16 nt, Staphylococcus aureus subsp. aureus Mu50
uaagaugacugaacca

SEQ ID NO: 3961702 - RNA, 22 nt, Staphylococcus aureus subsp. aureus Mu50
uaaguuucgcugcuacaccacc

SEQ ID NO: 3961703 - RNA, 21 nt, Staphylococcus aureus subsp. aureus Mu50
uaaguuugaaggagauauuuu

SEQ ID NO: 3961704 - RNA, 14 nt, Staphylococcus aureus subsp. aureus Mu50
uaaguuugaaucau

SEQ ID NO: 3961705 - RNA, 16 nt, Staphylococcus aureus subsp. aureus Mu50
uaaguuugaaucauuu

SEQ ID NO: 3961706 - RNA, 17 nt, Staphylococcus aureus subsp. aureus Mu50
uaaguuugguuucuuaa

SEQ ID NO: 3961707 - RNA, 14 nt, Staphylococcus aureus subsp. aureus Mu50
uaaguuuucaauuc

SEQ ID NO: 3961708 - RNA, 16 nt, Staphylococcus aureus subsp. aureus Mu50
uaauaaaacuugugau

SEQ ID NO: 3961709 - RNA, 20 nt, Staphylococcus aureus subsp. aureus Mu50
uaauaaaagucgauaaauau

SEQ ID NO: 3961710 - RNA, 13 nt, Staphylococcus aureus subsp. aureus Mu50
uaauaaaaucauc

SEQ ID NO: 3961711 - RNA, 21 nt, Staphylococcus aureus subsp. aureus Mu50
uaauaaacgacgcaagugacu

SEQ ID NO: 3961712 - RNA, 23 nt, Staphylococcus aureus subsp. aureus Mu50
uaauaaaucgaauugauggaaaa

SEQ ID NO: 3961713 - RNA, 22 nt, Staphylococcus aureus subsp. aureus Mu50
uaauaaaucuaucuacucaaau

SEQ ID NO: 3961714 - RNA, 11 nt, Staphylococcus aureus subsp. aureus Mu50
uaauaaauugu

SEQ ID NO: 3961715 - RNA, 13 nt, Staphylococcus aureus subsp. aureus Mu50
uaauaaauuuaac

SEQ ID NO: 3961716 - RNA, 15 nt, Staphylococcus aureus subsp. aureus Mu50
uaauaaauuuaacgu

SEQ ID NO: 3961717 - RNA, 14 nt, Staphylococcus aureus subsp. aureus Mu50
uaauaaauuuccaa

SEQ ID NO: 3961718 - RNA, 14 nt, Staphylococcus aureus subsp. aureus Mu50
uaauaacaaauagu

SEQ ID NO: 3961719 - RNA, 20 nt, Staphylococcus aureus subsp. aureus Mu50
uaauaacauccccaaaaaua

SEQ ID NO: 3961720 - RNA, 15 nt, Staphylococcus aureus subsp. aureus Mu50
uaauaaccauguaaa

SEQ ID NO: 3961721 - RNA, 19 nt, Staphylococcus aureus subsp. aureus Mu50
uaauaaccauguaaaauua

SEQ ID NO: 3961722 - RNA, 17 nt, Staphylococcus aureus subsp. aureus Mu50
uaauaacccauuuucaa

SEQ ID NO: 3961723 - RNA, 18 nt, Staphylococcus aureus subsp. aureus Mu50
uaauaaccgaaauauugu

SEQ ID NO: 3961724 - RNA, 18 nt, Staphylococcus aureus subsp. aureus Mu50
uaauaaccuuuaaaacau

SEQ ID NO: 3961725 - RNA, 15 nt, Staphylococcus aureus subsp. aureus Mu50
uaauaacgauaagca

SEQ ID NO: 3961726 - RNA, 12 nt, Staphylococcus aureus subsp. aureus Mu50
uaauaacgcaua

SEQ ID NO: 3961727 - RNA, 19 nt, Staphylococcus aureus subsp. aureus Mu50
uaauaacgcugcaccuaag

SEQ ID NO: 3961728 - RNA, 22 nt, Staphylococcus aureus subsp. aureus Mu50
uaauaagagaacuuuucaaaca

SEQ ID NO: 3961729 - RNA, 15 nt, Staphylococcus aureus subsp. aureus Mu50
uaauaagagguauag

SEQ ID NO: 3961730 - RNA, 12 nt, Staphylococcus aureus subsp. aureus Mu50
uaauaaggcauc

SEQ ID NO: 3961731 - RNA, 14 nt, Staphylococcus aureus subsp. aureus Mu50
uaauaaguaauaau

SEQ ID NO: 3961732 - RNA, 15 nt, Staphylococcus aureus subsp. aureus Mu50
uaauaaguugaauau

SEQ ID NO: 3961733 - RNA, 17 nt, Staphylococcus aureus subsp. aureus Mu50
uaauaaguugaauauaa

SEQ ID NO: 3961734 - RNA, 19 nt, Staphylococcus aureus subsp. aureus Mu50
uaauaaguugaauauaaaa

SEQ ID NO: 3961735 - RNA, 21 nt, Staphylococcus aureus subsp. aureus Mu50
uaauaaguugaauauaaaaaa

SEQ ID NO: 3961736 - RNA, 15 nt, Staphylococcus aureus subsp. aureus Mu50
uaauaauacuucuaa

SEQ ID NO: 3961737 - RNA, 18 nt, Staphylococcus aureus subsp. aureus Mu50
uaauaauauugaauggua

SEQ ID NO: 3961738 - RNA, 14 nt, Staphylococcus aureus subsp. aureus Mu50
uaauaaucguaaac

SEQ ID NO: 3961739 - RNA, 16 nt, Staphylococcus aureus subsp. aureus Mu50
uaauaaucuuuaacau

SEQ ID NO: 3961740 - RNA, 18 nt, Staphylococcus aureus subsp. aureus Mu50
uaauaaucuuuaacauuu

SEQ ID NO: 3961741 - RNA, 12 nt, Staphylococcus aureus subsp. aureus Mu50
uaauaaugaauu

SEQ ID NO: 3961742 - RNA, 16 nt, Staphylococcus aureus subsp. aureus Mu50
uaauaaugaauucuau

SEQ ID NO: 3961743 - RNA, 15 nt, Staphylococcus aureus subsp. aureus Mu50
uaauaaugacgagaa

SEQ ID NO: 3961744 - RNA, 20 nt, Staphylococcus aureus subsp. aureus Mu50
uaauaaugacgagaauuaaa

SEQ ID NO: 3961745 - RNA, 13 nt, Staphylococcus aureus subsp. aureus Mu50
uaauaaugacuga

SEQ ID NO: 3961746 - RNA, 20 nt, Staphylococcus aureus subsp. aureus Mu50
uaauaauggcaauuaaaacu

SEQ ID NO: 3961747 - RNA, 18 nt, Staphylococcus aureus subsp. aureus Mu50
uaauaaugggaauuguau

SEQ ID NO: 3961748 - RNA, 14 nt, Staphylococcus aureus subsp. aureus Mu50
uaauaauguaucau

SEQ ID NO: 3961749 - RNA, 13 nt, Staphylococcus aureus subsp. aureus Mu50
uaauaauuaauaa

SEQ ID NO: 3961750 - RNA, 18 nt, Staphylococcus aureus subsp. aureus Mu50
uaauaauucauaaaugcu

SEQ ID NO: 3961751 - RNA, 16 nt, Staphylococcus aureus subsp. aureus Mu50
uaauaauuggaaucau

SEQ ID NO: 3961752 - RNA, 19 nt, Staphylococcus aureus subsp. aureus Mu50
uaauaauuggaaucaucuu

SEQ ID NO: 3961753 - RNA, 12 nt, Staphylococcus aureus subsp. aureus Mu50
uaauaauuuaac

SEQ ID NO: 3961754 - RNA, 19 nt, Staphylococcus aureus subsp. aureus Mu50
uaauaauuuaacuaaucaa

SEQ ID NO: 3961755 - RNA, 12 nt, Staphylococcus aureus subsp. aureus Mu50
uaauaauuuaca

SEQ ID NO: 3961756 - RNA, 21 nt, Staphylococcus aureus subsp. aureus Mu50
uaauaauuugguuaacauccu

SEQ ID NO: 3961757 - RNA, 13 nt, Staphylococcus aureus subsp. aureus Mu50
uaauaauuuuuuu

SEQ ID NO: 3961758 - RNA, 14 nt, Staphylococcus aureus subsp. aureus Mu50
uaauacaagcaaua

SEQ ID NO: 3961759 - RNA, 19 nt, Staphylococcus aureus subsp. aureus Mu50
uaauacaagucuuuacucu

SEQ ID NO: 3961760 - RNA, 15 nt, Staphylococcus aureus subsp. aureus Mu50
uaauacauacugauu

SEQ ID NO: 3961761 - RNA, 14 nt, Staphylococcus aureus subsp. aureus Mu50
uaauacaucaucaa

SEQ ID NO: 3961762 - RNA, 21 nt, Staphylococcus aureus subsp. aureus Mu50
uaauacaucaucaaguucacc

SEQ ID NO: 3961763 - RNA, 13 nt, Staphylococcus aureus subsp. aureus Mu50
uaauacaucuaau

SEQ ID NO: 3961764 - RNA, 18 nt, Staphylococcus aureus subsp. aureus Mu50
uaauacaugacauucauu

SEQ ID NO: 3961765 - RNA, 13 nt, Staphylococcus aureus subsp. aureus Mu50
uaauacauuaugu

SEQ ID NO: 3961766 - RNA, 16 nt, Staphylococcus aureus subsp. aureus Mu50
uaauaccaauuguuuc

SEQ ID NO: 3961767 - RNA, 19 nt, Staphylococcus aureus subsp. aureus Mu50
uaauaccaauuuuuagcau

SEQ ID NO: 3961768 - RNA, 17 nt, Staphylococcus aureus subsp. aureus Mu50
uaauaccagcauccauu

SEQ ID NO: 3961769 - RNA, 23 nt, Staphylococcus aureus subsp. aureus Mu50
uaauaccuucaauugacauuaau

SEQ ID NO: 3961770 - RNA, 17 nt, Staphylococcus aureus subsp. aureus Mu50
uaauaccuuuacuuuca

SEQ ID NO: 3961771 - RNA, 20 nt, Staphylococcus aureus subsp. aureus Mu50
uaauaccuuuacuuucauua

SEQ ID NO: 3961772 - RNA, 17 nt, Staphylococcus aureus subsp. aureus Mu50
uaauacgaauuucauag

SEQ ID NO: 3961773 - RNA, 16 nt, Staphylococcus aureus subsp. aureus Mu50
uaauacgauaauaacu

SEQ ID NO: 3961774 - RNA, 18 nt, Staphylococcus aureus subsp. aureus Mu50
uaauacguguguuuucuu

SEQ ID NO: 3961775 - RNA, 22 nt, Staphylococcus aureus subsp. aureus Mu50
uaauacguguguuuucuuuuca

SEQ ID NO: 3961776 - RNA, 17 nt, Staphylococcus aureus subsp. aureus Mu50
uaauacguuuaauaaug

SEQ ID NO: 3961777 - RNA, 22 nt, Staphylococcus aureus subsp. aureus Mu50
uaauacguuuugcuaauucaag

SEQ ID NO: 3961778 - RNA, 20 nt, Staphylococcus aureus subsp. aureus Mu50
uaauacuaccguuuuuauau

SEQ ID NO: 3961779 - RNA, 16 nt, Staphylococcus aureus subsp. aureus Mu50
uaauacuguuuaaaua

SEQ ID NO: 3961780 - RNA, 17 nt, Staphylococcus aureus subsp. aureus Mu50
uaauacuguuuaaauaa

SEQ ID NO: 3961781 - RNA, 21 nt, Staphylococcus aureus subsp. aureus Mu50
uaauacuguuuaaauaaaauu

SEQ ID NO: 3961782 - RNA, 22 nt, Staphylococcus aureus subsp. aureus Mu50
uaauacuucauauccuucauua

SEQ ID NO: 3961783 - RNA, 13 nt, Staphylococcus aureus subsp. aureus Mu50
uaauacuucucaa

SEQ ID NO: 3961784 - RNA, 15 nt, Staphylococcus aureus subsp. aureus Mu50
uaauacuucucaauu

SEQ ID NO: 3961785 - RNA, 17 nt, Staphylococcus aureus subsp. aureus Mu50
uaauacuuucaaacaaa

SEQ ID NO: 3961786 - RNA, 14 nt, Staphylococcus aureus subsp. aureus Mu50
uaauacuuucacuu

SEQ ID NO: 3961787 - RNA, 20 nt, Staphylococcus aureus subsp. aureus Mu50
uaauacuuucacuuuuuaua

SEQ ID NO: 3961788 - RNA, 17 nt, Staphylococcus aureus subsp. aureus Mu50
uaauacuuuucucgauu

SEQ ID NO: 3961789 - RNA, 17 nt, Staphylococcus aureus subsp. aureus Mu50
uaauacuuuuugaguau

SEQ ID NO: 3961790 - RNA, 14 nt, Staphylococcus aureus subsp. aureus Mu50
uaaucccuucaaaa

SEQ ID NO: 3961791 - RNA, 21 nt, Staphylococcus aureus subsp. aureus Mu50
uaaucccuucaaaauuuugac

SEQ ID NO: 3961792 - RNA, 23 nt, Staphylococcus aureus subsp. aureus Mu50
uaauccgagucauacucaucaga

SEQ ID NO: 3961793 - RNA, 17 nt, Staphylococcus aureus subsp. aureus Mu50
uaauccuuguucuauuu

SEQ ID NO: 3961794 - RNA, 15 nt, Staphylococcus aureus subsp. aureus Mu50
uaaucgaacagaaaa

SEQ ID NO: 3961795 - RNA, 23 nt, Staphylococcus aureus subsp. aureus Mu50
uaaucgauugguaaaucuacuac

SEQ ID NO: 3961796 - RNA, 15 nt, Staphylococcus aureus subsp. aureus Mu50
uaaucgcauucuugg

SEQ ID NO: 3961797 - RNA, 17 nt, Staphylococcus aureus subsp. aureus Mu50
uaaucgcauuguuaaag

SEQ ID NO: 3961798 - RNA, 17 nt, Staphylococcus aureus subsp. aureus Mu50
uaaucggaucauuauuu

SEQ ID NO: 3961799 - RNA, 12 nt, Staphylococcus aureus subsp. aureus Mu50
uaaucguaacau

SEQ ID NO: 3961800 - RNA, 19 nt, Staphylococcus aureus subsp. aureus Mu50
uaaucguauucauaucauu

SEQ ID NO: 3961801 - RNA, 18 nt, Staphylococcus aureus subsp. aureus Mu50
uaaucguguauuauugaa

SEQ ID NO: 3961802 - RNA, 22 nt, Staphylococcus aureus subsp. aureus Mu50
uaaucguuccaacaacuaagau

SEQ ID NO: 3961803 - RNA, 16 nt, Staphylococcus aureus subsp. aureus Mu50
uaaucuaaauucaguu

SEQ ID NO: 3961804 - RNA, 18 nt, Staphylococcus aureus subsp. aureus Mu50
uaaucuauauaaaaacug

SEQ ID NO: 3961805 - RNA, 23 nt, Staphylococcus aureus subsp. aureus Mu50
uaaucuauggaaaauguuaucaa

SEQ ID NO: 3961806 - RNA, 14 nt, Staphylococcus aureus subsp. aureus Mu50
uaaucucauucuuu

SEQ ID NO: 3961807 - RNA, 16 nt, Staphylococcus aureus subsp. aureus Mu50
uaaucucauucuuuaa

SEQ ID NO: 3961808 - RNA, 20 nt, Staphylococcus aureus subsp. aureus Mu50
uaaucucucgcuaaauuuau

SEQ ID NO: 3961809 - RNA, 19 nt, Staphylococcus aureus subsp. aureus Mu50
uaaucucuucaauuuauuu

SEQ ID NO: 3961810 - RNA, 23 nt, Staphylococcus aureus subsp. aureus Mu50
uaaucucuucaauuuauuuuuau

SEQ ID NO: 3961811 - RNA, 17 nt, Staphylococcus aureus subsp. aureus Mu50
uaaucucuuuacaccau

SEQ ID NO: 3961812 - RNA, 16 nt, Staphylococcus aureus subsp. aureus Mu50
uaaucucuuuuugauu

SEQ ID NO: 3961813 - RNA, 22 nt, Staphylococcus aureus subsp. aureus Mu50
uaaucucuuuuugauuauauuu

SEQ ID NO: 3961814 - RNA, 14 nt, Staphylococcus aureus subsp. aureus Mu50
uaaucugcaacgau

SEQ ID NO: 3961815 - RNA, 19 nt, Staphylococcus aureus subsp. aureus Mu50
uaaucuuaauauugauuaa

SEQ ID NO: 3961816 - RNA, 16 nt, Staphylococcus aureus subsp. aureus Mu50
uaaucuuaguuaaaau

SEQ ID NO: 3961817 - RNA, 12 nt, Staphylococcus aureus subsp. aureus Mu50
uaaucuuauucg

SEQ ID NO: 3961818 - RNA, 13 nt, Staphylococcus aureus subsp. aureus Mu50
uaaucuugauuau

SEQ ID NO: 3961819 - RNA, 14 nt, Staphylococcus aureus subsp. aureus Mu50
uaaucuuguuuuca

SEQ ID NO: 3961820 - RNA, 13 nt, Staphylococcus aureus subsp. aureus Mu50
uaaucuuuaacau

SEQ ID NO: 3961821 - RNA, 18 nt, Staphylococcus aureus subsp. aureus Mu50
uaaucuuuaacauuuauu

SEQ ID NO: 3961822 - RNA, 20 nt, Staphylococcus aureus subsp. aureus Mu50
uaaucuuuaacauuuauucu

SEQ ID NO: 3961823 - RNA, 18 nt, Staphylococcus aureus subsp. aureus Mu50
uaaucuuuuuuacuaaaa

SEQ ID NO: 3961824 - RNA, 16 nt, Staphylococcus aureus subsp. aureus Mu50
uaaugaacaacaaauu

SEQ ID NO: 3961825 - RNA, 19 nt, Staphylococcus aureus subsp. aureus Mu50
uaaugaagauuuuguugaa

SEQ ID NO: 3961826 - RNA, 17 nt, Staphylococcus aureus subsp. aureus Mu50
uaaugaauaauuaaaaa

SEQ ID NO: 3961827 - RNA, 18 nt, Staphylococcus aureus subsp. aureus Mu50
uaaugaauucauucaaua

SEQ ID NO: 3961828 - RNA, 13 nt, Staphylococcus aureus subsp. aureus Mu50
uaaugacaaauua

SEQ ID NO: 3961829 - RNA, 20 nt, Staphylococcus aureus subsp. aureus Mu50
uaaugaccggcauauaaucc

SEQ ID NO: 3961830 - RNA, 23 nt, Staphylococcus aureus subsp. aureus Mu50
uaaugacgagaauuaaagucugu

SEQ ID NO: 3961831 - RNA, 16 nt, Staphylococcus aureus subsp. aureus Mu50
uaaugacugacacuuu

SEQ ID NO: 3961832 - RNA, 22 nt, Staphylococcus aureus subsp. aureus Mu50
uaaugacuucuuuauauuuauc

SEQ ID NO: 3961833 - RNA, 12 nt, Staphylococcus aureus subsp. aureus Mu50
uaaugagaguaa

SEQ ID NO: 3961834 - RNA, 16 nt, Staphylococcus aureus subsp. aureus Mu50
uaaugagaguaauguu

SEQ ID NO: 3961835 - RNA, 15 nt, Staphylococcus aureus subsp. aureus Mu50
uaaugauagcaauga

SEQ ID NO: 3961836 - RNA, 19 nt, Staphylococcus aureus subsp. aureus Mu50
uaaugauaguacauuuauu

SEQ ID NO: 3961837 - RNA, 15 nt, Staphylococcus aureus subsp. aureus Mu50
uaaugaucaaguagu

SEQ ID NO: 3961838 - RNA, 21 nt, Staphylococcus aureus subsp. aureus Mu50
uaaugaucguuagcuaaucgu

SEQ ID NO: 3961839 - RNA, 14 nt, Staphylococcus aureus subsp. aureus Mu50
uaaugaugacauca

SEQ ID NO: 3961840 - RNA, 18 nt, Staphylococcus aureus subsp. aureus Mu50
uaaugaugacaucaauau

SEQ ID NO: 3961841 - RNA, 14 nt, Staphylococcus aureus subsp. aureus Mu50
uaaugauugucuua

SEQ ID NO: 3961842 - RNA, 16 nt, Staphylococcus aureus subsp. aureus Mu50
uaaugauugucuuaua

SEQ ID NO: 3961843 - RNA, 13 nt, Staphylococcus aureus subsp. aureus Mu50
uaaugauuuugcu

SEQ ID NO: 3961844 - RNA, 18 nt, Staphylococcus aureus subsp. aureus Mu50
uaaugcaccugugauaac

SEQ ID NO: 3961845 - RNA, 15 nt, Staphylococcus aureus subsp. aureus Mu50
uaaugccaaauauag

SEQ ID NO: 3961846 - RNA, 23 nt, Staphylococcus aureus subsp. aureus Mu50
uaaugccaaauauaguaauuguu

SEQ ID NO: 3961847 - RNA, 21 nt, Staphylococcus aureus subsp. aureus Mu50
uaaugccaccguggaauuuac

SEQ ID NO: 3961848 - RNA, 21 nt, Staphylococcus aureus subsp. aureus Mu50
uaaugccugcccuuuagucau

SEQ ID NO: 3961849 - RNA, 14 nt, Staphylococcus aureus subsp. aureus Mu50
uaaugcuaauuuaa

SEQ ID NO: 3961850 - RNA, 17 nt, Staphylococcus aureus subsp. aureus Mu50
uaaugcuaauuuaacug

SEQ ID NO: 3961851 - RNA, 17 nt, Staphylococcus aureus subsp. aureus Mu50
uaaugcucuauauaucc

SEQ ID NO: 3961852 - RNA, 13 nt, Staphylococcus aureus subsp. aureus Mu50
uaaugcuucaaau

SEQ ID NO: 3961853 - RNA, 23 nt, Staphylococcus aureus subsp. aureus Mu50
uaaugcuucaaauguaacauuaa

SEQ ID NO: 3961854 - RNA, 16 nt, Staphylococcus aureus subsp. aureus Mu50
uaauggacuaauuuau

SEQ ID NO: 3961855 - RNA, 18 nt, Staphylococcus aureus subsp. aureus Mu50
uaauggagcacuaucuuu

SEQ ID NO: 3961856 - RNA, 14 nt, Staphylococcus aureus subsp. aureus Mu50
uaauggauuauuau

SEQ ID NO: 3961857 - RNA, 23 nt, Staphylococcus aureus subsp. aureus Mu50
uaaugggaauuguauuagcaauu

SEQ ID NO: 3961858 - RNA, 17 nt, Staphylococcus aureus subsp. aureus Mu50
uaaugggcgauaaaagu

SEQ ID NO: 3961859 - RNA, 17 nt, Staphylococcus aureus subsp. aureus Mu50
uaaugguaaugucauau

SEQ ID NO: 3961860 - RNA, 14 nt, Staphylococcus aureus subsp. aureus Mu50
uaaugguucauagu

SEQ ID NO: 3961861 - RNA, 23 nt, Staphylococcus aureus subsp. aureus Mu50
uaaugguucucugucaaauugga

SEQ ID NO: 3961862 - RNA, 14 nt, Staphylococcus aureus subsp. aureus Mu50
uaaugguuucauaa

SEQ ID NO: 3961863 - RNA, 19 nt, Staphylococcus aureus subsp. aureus Mu50
uaauguaaaguugauaaug

SEQ ID NO: 3961864 - RNA, 13 nt, Staphylococcus aureus subsp. aureus Mu50
uaauguaaucauu

SEQ ID NO: 3961865 - RNA, 16 nt, Staphylococcus aureus subsp. aureus Mu50
uaauguacauguauaa

SEQ ID NO: 3961866 - RNA, 13 nt, Staphylococcus aureus subsp. aureus Mu50
uaauguacuucaa

SEQ ID NO: 3961867 - RNA, 15 nt, Staphylococcus aureus subsp. aureus Mu50
uaauguauaaaaagu

SEQ ID NO: 3961868 - RNA, 21 nt, Staphylococcus aureus subsp. aureus Mu50
uaauguauaaaaagugcauau

SEQ ID NO: 3961869 - RNA, 15 nt, Staphylococcus aureus subsp. aureus Mu50
uaauguauaaaacag

SEQ ID NO: 3961870 - RNA, 22 nt, Staphylococcus aureus subsp. aureus Mu50
uaauguauaaaacagaauuuca

SEQ ID NO: 3961871 - RNA, 21 nt, Staphylococcus aureus subsp. aureus Mu50
uaauguaucauuucagaaaua

SEQ ID NO: 3961872 - RNA, 15 nt, Staphylococcus aureus subsp. aureus Mu50
uaaugucauaucuuu

SEQ ID NO: 3961873 - RNA, 17 nt, Staphylococcus aureus subsp. aureus Mu50
uaaugucccguuuaccu

SEQ ID NO: 3961874 - RNA, 22 nt, Staphylococcus aureus subsp. aureus Mu50
uaaugucgcacuauaaaauuca

SEQ ID NO: 3961875 - RNA, 13 nt, Staphylococcus aureus subsp. aureus Mu50
uaaugucuucaua

SEQ ID NO: 3961876 - RNA, 23 nt, Staphylococcus aureus subsp. aureus Mu50
uaaugucuucauaaucguauuca

SEQ ID NO: 3961877 - RNA, 18 nt, Staphylococcus aureus subsp. aureus Mu50
uaaugugcaaguugggga

SEQ ID NO: 3961878 - RNA, 13 nt, Staphylococcus aureus subsp. aureus Mu50
uaauugaugauua

SEQ ID NO: 3961879 - RNA, 15 nt, Staphylococcus aureus subsp. aureus Mu50
uaauugaugucacau

SEQ ID NO: 3961880 - RNA, 19 nt, Staphylococcus aureus subsp. aureus Mu50
uaauugcauagcuaaauaa

SEQ ID NO: 3961881 - RNA, 22 nt, Staphylococcus aureus subsp. aureus Mu50
uaauugcauagcuaaauaaauu

SEQ ID NO: 3961882 - RNA, 12 nt, Staphylococcus aureus subsp. aureus Mu50
uaauugcauuac

SEQ ID NO: 3961883 - RNA, 17 nt, Staphylococcus aureus subsp. aureus Mu50
uaauugcuaaaauauca

SEQ ID NO: 3961884 - RNA, 21 nt, Staphylococcus aureus subsp. aureus Mu50
uaauuggaaucaucuuuuuga

SEQ ID NO: 3961885 - RNA, 13 nt, Staphylococcus aureus subsp. aureus Mu50
uaauuggcagaua

SEQ ID NO: 3961886 - RNA, 17 nt, Staphylococcus aureus subsp. aureus Mu50
uaauuggguuuaauaac

SEQ ID NO: 3961887 - RNA, 16 nt, Staphylococcus aureus subsp. aureus Mu50
uaauuguaaucuauuu

SEQ ID NO: 3961888 - RNA, 17 nt, Staphylococcus aureus subsp. aureus Mu50
uaauuguaaucuauuuu

SEQ ID NO: 3961889 - RNA, 19 nt, Staphylococcus aureus subsp. aureus Mu50
uaauuguaaucuauuuucu

SEQ ID NO: 3961890 - RNA, 15 nt, Staphylococcus aureus subsp. aureus Mu50
uaauugucuuuauaa

SEQ ID NO: 3961891 - RNA, 14 nt, Staphylococcus aureus subsp. aureus Mu50
uaauuguuaaauca

SEQ ID NO: 3961892 - RNA, 18 nt, Staphylococcus aureus subsp. aureus Mu50
uaauuguuaaaucaccaa

SEQ ID NO: 3961893 - RNA, 23 nt, Staphylococcus aureus subsp. aureus Mu50
uaauuguuauaaguaaauaauag

SEQ ID NO: 3961894 - RNA, 13 nt, Staphylococcus aureus subsp. aureus Mu50
uaauuguucuuca

SEQ ID NO: 3961895 - RNA, 14 nt, Staphylococcus aureus subsp. aureus Mu50
uaauuguuuaauaa

SEQ ID NO: 3961896 - RNA, 16 nt, Staphylococcus aureus subsp. aureus Mu50
uaauuguuuugagaua

SEQ ID NO: 3961897 - RNA, 23 nt, Staphylococcus aureus subsp. aureus Mu50
uaauuuaaagaacuauuuuaaau

SEQ ID NO: 3961898 - RNA, 14 nt, Staphylococcus aureus subsp. aureus Mu50
uaauuuaaagcauc

SEQ ID NO: 3961899 - RNA, 23 nt, Staphylococcus aureus subsp. aureus Mu50
uaauuuaaaggcauaauaaccau

SEQ ID NO: 3961900 - RNA, 14 nt, Staphylococcus aureus subsp. aureus Mu50
uaauuuaaaucugu

SEQ ID NO: 3961901 - RNA, 13 nt, Staphylococcus aureus subsp. aureus Mu50
uaauuuaaaugcu

SEQ ID NO: 3961902 - RNA, 15 nt, Staphylococcus aureus subsp. aureus Mu50
uaauuuaauaauuaa

SEQ ID NO: 3961903 - RNA, 17 nt, Staphylococcus aureus subsp. aureus Mu50
uaauuuaauauuuagau

SEQ ID NO: 3961904 - RNA, 14 nt, Staphylococcus aureus subsp. aureus Mu50
uaauuuaauuuuag

SEQ ID NO: 3961905 - RNA, 16 nt, Staphylococcus aureus subsp. aureus Mu50
uaauuuacauuaauuu

SEQ ID NO: 3961906 - RNA, 17 nt, Staphylococcus aureus subsp. aureus Mu50
uaauuuacucaaaccau

SEQ ID NO: 3961907 - RNA, 16 nt, Staphylococcus aureus subsp. aureus Mu50
uaauuuagacaucauu

SEQ ID NO: 3961908 - RNA, 17 nt, Staphylococcus aureus subsp. aureus Mu50
uaauuuagucauuacaa

SEQ ID NO: 3961909 - RNA, 19 nt, Staphylococcus aureus subsp. aureus Mu50
uaauuuagucauuacaaau

SEQ ID NO: 3961910 - RNA, 17 nt, Staphylococcus aureus subsp. aureus Mu50
uaauuuauaaacaauua

SEQ ID NO: 3961911 - RNA, 16 nt, Staphylococcus aureus subsp. aureus Mu50
uaauuuauugauaagc

SEQ ID NO: 3961912 - RNA, 12 nt, Staphylococcus aureus subsp. aureus Mu50
uaauuucaauuu

SEQ ID NO: 3961913 - RNA, 22 nt, Staphylococcus aureus subsp. aureus Mu50
uaauuucaauuuggaaauaucu

SEQ ID NO: 3961914 - RNA, 19 nt, Staphylococcus aureus subsp. aureus Mu50
uaauuucaguucuuagauu

SEQ ID NO: 3961915 - RNA, 16 nt, Staphylococcus aureus subsp. aureus Mu50
uaauuuccaauaucuu

SEQ ID NO: 3961916 - RNA, 17 nt, Staphylococcus aureus subsp. aureus Mu50
uaauuuccaauaucuuc

SEQ ID NO: 3961917 - RNA, 10 nt, Staphylococcus aureus subsp. aureus Mu50
uaauuucuau

SEQ ID NO: 3961918 - RNA, 13 nt, Staphylococcus aureus subsp. aureus Mu50
uaauuucuucuuc

SEQ ID NO: 3961919 - RNA, 17 nt, Staphylococcus aureus subsp. aureus Mu50
uaauuucuucuucugua

SEQ ID NO: 3961920 - RNA, 19 nt, Staphylococcus aureus subsp. aureus Mu50
uaauuugaauuaguugaug

SEQ ID NO: 3961921 - RNA, 23 nt, Staphylococcus aureus subsp. aureus Mu50
uaauuugauguucuugaaaacaa

SEQ ID NO: 3961922 - RNA, 11 nt, Staphylococcus aureus subsp. aureus Mu50
uaauuugauua

SEQ ID NO: 3961923 - RNA, 20 nt, Staphylococcus aureus subsp. aureus Mu50
uaauuuggucauagaaauuu

SEQ ID NO: 3961924 - RNA, 16 nt, Staphylococcus aureus subsp. aureus Mu50
uaauuuguaauuccuc

SEQ ID NO: 3961925 - RNA, 19 nt, Staphylococcus aureus subsp. aureus Mu50
uaauuugucauuucuucuu

SEQ ID NO: 3961926 - RNA, 17 nt, Staphylococcus aureus subsp. aureus Mu50
uaauuuguuaguuuaag

SEQ ID NO: 3961927 - RNA, 16 nt, Staphylococcus aureus subsp. aureus Mu50
uaauuuguuuuaaaua

SEQ ID NO: 3961928 - RNA, 20 nt, Staphylococcus aureus subsp. aureus Mu50
uaauuuguuuuaaauacuug

SEQ ID NO: 3961929 - RNA, 10 nt, Staphylococcus aureus subsp. aureus Mu50
uaauuuuaau

SEQ ID NO: 3961930 - RNA, 18 nt, Staphylococcus aureus subsp. aureus Mu50
uaauuuuaccuguuucuu

SEQ ID NO: 3961931 - RNA, 13 nt, Staphylococcus aureus subsp. aureus Mu50
uaauuuuacucug

SEQ ID NO: 3961932 - RNA, 16 nt, Staphylococcus aureus subsp. aureus Mu50
uaauuuuacucuguau

SEQ ID NO: 3961933 - RNA, 15 nt, Staphylococcus aureus subsp. aureus Mu50
uaauuuuauuauuaa

SEQ ID NO: 3961934 - RNA, 15 nt, Staphylococcus aureus subsp. aureus Mu50
uaauuuuauuuaauu

SEQ ID NO: 3961935 - RNA, 21 nt, Staphylococcus aureus subsp. aureus Mu50
uaauuuucacuuucaaugaca

SEQ ID NO: 3961936 - RNA, 16 nt, Staphylococcus aureus subsp. aureus Mu50
uaauuuucuaaauaua

SEQ ID NO: 3961937 - RNA, 23 nt, Staphylococcus aureus subsp. aureus Mu50
uaauuuucuugccaucaauuucu

SEQ ID NO: 3961938 - RNA, 16 nt, Staphylococcus aureus subsp. aureus Mu50
uaauuuugacauaaaa

SEQ ID NO: 3961939 - RNA, 20 nt, Staphylococcus aureus subsp. aureus Mu50
uaauuuuggauuuuuuugua

SEQ ID NO: 3961940 - RNA, 19 nt, Staphylococcus aureus subsp. aureus Mu50
uaauuuugugaauuuauuu

SEQ ID NO: 3961941 - RNA, 21 nt, Staphylococcus aureus subsp. aureus Mu50
uaauuuuguuuugcuucuuua

SEQ ID NO: 3961942 - RNA, 13 nt, Staphylococcus aureus subsp. aureus Mu50
uaauuuuuaaauc

SEQ ID NO: 3961943 - RNA, 15 nt, Staphylococcus aureus subsp. aureus Mu50
uaauuuuuaacagcg

SEQ ID NO: 3961944 - RNA, 24 nt, Staphylococcus aureus subsp. aureus Mu50
uaauuuuuaacagcgugaauauaa

SEQ ID NO: 3961945 - RNA, 14 nt, Staphylococcus aureus subsp. aureus Mu50
uaauuuuuaaucuu

SEQ ID NO: 3961946 - RNA, 15 nt, Staphylococcus aureus subsp. aureus Mu50
uaauuuuuaauguau

SEQ ID NO: 3961947 - RNA, 18 nt, Staphylococcus aureus subsp. aureus Mu50
uaauuuuuauucuguaac

SEQ ID NO: 3961948 - RNA, 12 nt, Staphylococcus aureus subsp. aureus Mu50
uaauuuuucauu

SEQ ID NO: 3961949 - RNA, 14 nt, Staphylococcus aureus subsp. aureus Mu50
uaauuuuucauuaa

SEQ ID NO: 3961950 - RNA, 17 nt, Staphylococcus aureus subsp. aureus Mu50
uaauuuuucuaaaugau

SEQ ID NO: 3961951 - RNA, 14 nt, Staphylococcus aureus subsp. aureus Mu50
uaauuuuuuauuaa

SEQ ID NO: 3961952 - RNA, 15 nt, Staphylococcus aureus subsp. aureus Mu50
uaauuuuuugugccu

SEQ ID NO: 3961953 - RNA, 22 nt, Staphylococcus aureus subsp. aureus Mu50
uaauuuuuuuccuuucuuuuuc

SEQ ID NO: 3961954 - RNA, 21 nt, Staphylococcus aureus subsp. aureus Mu50
uacaaaacaccucgauauuau

SEQ ID NO: 3961955 - RNA, 19 nt, Staphylococcus aureus subsp. aureus Mu50
uacaaacccuuuaaacaua

SEQ ID NO: 3961956 - RNA, 17 nt, Staphylococcus aureus subsp. aureus Mu50
uacaaagccuuaauauc

SEQ ID NO: 3961957 - RNA, 22 nt, Staphylococcus aureus subsp. aureus Mu50
uacaaagccuuaauaucaugca

SEQ ID NO: 3961958 - RNA, 19 nt, Staphylococcus aureus subsp. aureus Mu50
uacaaagugauuuaaaaaa

SEQ ID NO: 3961959 - RNA, 19 nt, Staphylococcus aureus subsp. aureus Mu50
uacaaauaacaaacauuaa

SEQ ID NO: 3961960 - RNA, 23 nt, Staphylococcus aureus subsp. aureus Mu50
uacaaauaacaaacauuaaucua

SEQ ID NO: 3961961 - RNA, 13 nt, Staphylococcus aureus subsp. aureus Mu50
uacaaauauacuu

SEQ ID NO: 3961962 - RNA, 17 nt, Staphylococcus aureus subsp. aureus Mu50
uacaaauauguaaucag

SEQ ID NO: 3961963 - RNA, 20 nt, Staphylococcus aureus subsp. aureus Mu50
uacaaaucaugacauaaaac

SEQ ID NO: 3961964 - RNA, 21 nt, Staphylococcus aureus subsp. aureus Mu50
uacaaaucaugacauaaaacu

SEQ ID NO: 3961965 - RNA, 14 nt, Staphylococcus aureus subsp. aureus Mu50
uacaaaucgauauu

SEQ ID NO: 3961966 - RNA, 12 nt, Staphylococcus aureus subsp. aureus Mu50
uacaguaauauu

SEQ ID NO: 3961967 - RNA, 17 nt, Staphylococcus aureus subsp. aureus Mu50
uacaguaauauucaacu

SEQ ID NO: 3961968 - RNA, 15 nt, Staphylococcus aureus subsp. aureus Mu50
uacagucaacugcug

SEQ ID NO: 3961969 - RNA, 19 nt, Staphylococcus aureus subsp. aureus Mu50
uacagucaacugcugcuaa

SEQ ID NO: 3961970 - RNA, 20 nt, Staphylococcus aureus subsp. aureus Mu50
uacagucaauacaaagaauu

SEQ ID NO: 3961971 - RNA, 19 nt, Staphylococcus aureus subsp. aureus Mu50
uacagucaucuugagauuu

SEQ ID NO: 3961972 - RNA, 23 nt, Staphylococcus aureus subsp. aureus Mu50
uacaguucuauagguuuauaaaa

SEQ ID NO: 3961973 - RNA, 14 nt, Staphylococcus aureus subsp. aureus Mu50
uacaguuuuacuau

SEQ ID NO: 3961974 - RNA, 18 nt, Staphylococcus aureus subsp. aureus Mu50
uacauaaaauggcaucug

SEQ ID NO: 3961975 - RNA, 12 nt, Staphylococcus aureus subsp. aureus Mu50
uacauaaauacc

SEQ ID NO: 3961976 - RNA, 11 nt, Staphylococcus aureus subsp. aureus Mu50
uacauaaaucu

SEQ ID NO: 3961977 - RNA, 12 nt, Staphylococcus aureus subsp. aureus Mu50
uacauaaaucua

SEQ ID NO: 3961978 - RNA, 15 nt, Staphylococcus aureus subsp. aureus Mu50
uacauaaaucuaaua

SEQ ID NO: 3961979 - RNA, 17 nt, Staphylococcus aureus subsp. aureus Mu50
uacauaaaucuaauacu

SEQ ID NO: 3961980 - RNA, 22 nt, Staphylococcus aureus subsp. aureus Mu50
uacauaaaugcuaaaaguauaa

SEQ ID NO: 3961981 - RNA, 23 nt, Staphylococcus aureus subsp. aureus Mu50
uacauaaauuaggucauuuuuau

SEQ ID NO: 3961982 - RNA, 17 nt, Staphylococcus aureus subsp. aureus Mu50
uacauaacccuaaaaug

SEQ ID NO: 3961983 - RNA, 18 nt, Staphylococcus aureus subsp. aureus Mu50
uacauaacccuaaaauga

SEQ ID NO: 3961984 - RNA, 21 nt, Staphylococcus aureus subsp. aureus Mu50
uacauaacccuaaaaugaaua

SEQ ID NO: 3961985 - RNA, 21 nt, Staphylococcus aureus subsp. aureus Mu50
uacauaauuaacuuucuuuug

SEQ ID NO: 3961986 - RNA, 20 nt, Staphylococcus aureus subsp. aureus Mu50
uacauaauuuaucaauuucu

SEQ ID NO: 3961987 - RNA, 22 nt, Staphylococcus aureus subsp. aureus Mu50
uacauaauuuaucugcaaaaug

SEQ ID NO: 3961988 - RNA, 15 nt, Staphylococcus aureus subsp. aureus Mu50
uacauaauuugaauu

SEQ ID NO: 3961989 - RNA, 16 nt, Staphylococcus aureus subsp. aureus Mu50
uacauacaacucguuu

SEQ ID NO: 3961990 - RNA, 22 nt, Staphylococcus aureus subsp. aureus Mu50
uacauaccacacuuuaaacaag

SEQ ID NO: 3961991 - RNA, 22 nt, Staphylococcus aureus subsp. aureus Mu50
uacauaccgauuuucaaccauc

SEQ ID NO: 3961992 - RNA, 16 nt, Staphylococcus aureus subsp. aureus Mu50
uacauaggauaucuac

SEQ ID NO: 3961993 - RNA, 13 nt, Staphylococcus aureus subsp. aureus Mu50
uacauauaagaau

SEQ ID NO: 3961994 - RNA, 14 nt, Staphylococcus aureus subsp. aureus Mu50
uacauauaauaugu

SEQ ID NO: 3961995 - RNA, 17 nt, Staphylococcus aureus subsp. aureus Mu50
uacauauacgacauuuu

SEQ ID NO: 3961996 - RNA, 16 nt, Staphylococcus aureus subsp. aureus Mu50
uacauaucuuuugcaa

SEQ ID NO: 3961997 - RNA, 16 nt, Staphylococcus aureus subsp. aureus Mu50
uacauaugcuauauuu

SEQ ID NO: 3961998 - RNA, 14 nt, Staphylococcus aureus subsp. aureus Mu50
uacauauguguaug

SEQ ID NO: 3961999 - RNA, 16 nt, Staphylococcus aureus subsp. aureus Mu50
uacauauguguaugau

SEQ ID NO: 3962000 - RNA, 17 nt, Staphylococcus aureus subsp. aureus Mu50
uacauauucucugcuuc

SEQ ID NO: 3962001 - RNA, 14 nt, Staphylococcus aureus subsp. aureus Mu50
uacauauuggcuug

SEQ ID NO: 3962002 - RNA, 15 nt, Staphylococcus aureus subsp. aureus Mu50
uacaucauuaaauau

SEQ ID NO: 3962003 - RNA, 16 nt, Staphylococcus aureus subsp. aureus Mu50
uacaucauuaaauauu

SEQ ID NO: 3962004 - RNA, 21 nt, Staphylococcus aureus subsp. aureus Mu50
uacaucauuaaauauuuagau

SEQ ID NO: 3962005 - RNA, 14 nt, Staphylococcus aureus subsp. aureus Mu50
uacaucguguugcu

SEQ ID NO: 3962006 - RNA, 16 nt, Staphylococcus aureus subsp. aureus Mu50
uacaucuaauaaauau

SEQ ID NO: 3962007 - RNA, 20 nt, Staphylococcus aureus subsp. aureus Mu50
uacaugaacaaauaauuuac

SEQ ID NO: 3962008 - RNA, 15 nt, Staphylococcus aureus subsp. aureus Mu50
uacaugaaucaacaa

SEQ ID NO: 3962009 - RNA, 19 nt, Staphylococcus aureus subsp. aureus Mu50
uacaugacauucauuuagu

SEQ ID NO: 3962010 - RNA, 18 nt, Staphylococcus aureus subsp. aureus Mu50
uacaugcaccuuuacaac

SEQ ID NO: 3962011 - RNA, 14 nt, Staphylococcus aureus subsp. aureus Mu50
uacauguauaaaag

SEQ ID NO: 3962012 - RNA, 16 nt, Staphylococcus aureus subsp. aureus Mu50
uacauguauaaaagau

SEQ ID NO: 3962013 - RNA, 16 nt, Staphylococcus aureus subsp. aureus Mu50
uacaugugggauaucu

SEQ ID NO: 3962014 - RNA, 16 nt, Staphylococcus aureus subsp. aureus Mu50
uacauuaaaacaauaa

SEQ ID NO: 3962015 - RNA, 17 nt, Staphylococcus aureus subsp. aureus Mu50
uacauuaauauaaauau

SEQ ID NO: 3962016 - RNA, 19 nt, Staphylococcus aureus subsp. aureus Mu50
uacauuaauauaaauauca

SEQ ID NO: 3962017 - RNA, 17 nt, Staphylococcus aureus subsp. aureus Mu50
uacauuacauauaucaa

SEQ ID NO: 3962018 - RNA, 18 nt, Staphylococcus aureus subsp. aureus Mu50
uacauuacgcucaucacc

SEQ ID NO: 3962019 - RNA, 17 nt, Staphylococcus aureus subsp. aureus Mu50
uacauuauuaaauagau

SEQ ID NO: 3962020 - RNA, 15 nt, Staphylococcus aureus subsp. aureus Mu50
uacauugauaaaaua

SEQ ID NO: 3962021 - RNA, 14 nt, Staphylococcus aureus subsp. aureus Mu50
uacauugauaaauu

SEQ ID NO: 3962022 - RNA, 16 nt, Staphylococcus aureus subsp. aureus Mu50
uacauuguaaauauag

SEQ ID NO: 3962023 - RNA, 17 nt, Staphylococcus aureus subsp. aureus Mu50
uacauuguaaauauagu

SEQ ID NO: 3962024 - RNA, 23 nt, Staphylococcus aureus subsp. aureus Mu50
uacauuuaauggucuaauaucaa

SEQ ID NO: 3962025 - RNA, 16 nt, Staphylococcus aureus subsp. aureus Mu50
uacauuuaguacauau

SEQ ID NO: 3962026 - RNA, 20 nt, Staphylococcus aureus subsp. aureus Mu50
uacauuuauuuucaauaaau

SEQ ID NO: 3962027 - RNA, 21 nt, Staphylococcus aureus subsp. aureus Mu50
uacauuuauuuucaauaaaua

SEQ ID NO: 3962028 - RNA, 14 nt, Staphylococcus aureus subsp. aureus Mu50
uacauuuguagaga

SEQ ID NO: 3962029 - RNA, 17 nt, Staphylococcus aureus subsp. aureus Mu50
uacauuuugcucuaaac

SEQ ID NO: 3962030 - RNA, 15 nt, Staphylococcus aureus subsp. aureus Mu50
uacauuuuuauacaa

SEQ ID NO: 3962031 - RNA, 16 nt, Staphylococcus aureus subsp. aureus Mu50
uaccaaaaacauuaac

SEQ ID NO: 3962032 - RNA, 14 nt, Staphylococcus aureus subsp. aureus Mu50
uaccaaaaaguauu

SEQ ID NO: 3962033 - RNA, 17 nt, Staphylococcus aureus subsp. aureus Mu50
uaccaaaaaguauugcc

SEQ ID NO: 3962034 - RNA, 14 nt, Staphylococcus aureus subsp. aureus Mu50
uaccaaacaauaca

SEQ ID NO: 3962035 - RNA, 21 nt, Staphylococcus aureus subsp. aureus Mu50
uaccaaacaauacauaauggu

SEQ ID NO: 3962036 - RNA, 16 nt, Staphylococcus aureus subsp. aureus Mu50
uaccaaauaaauuaaa

SEQ ID NO: 3962037 - RNA, 14 nt, Staphylococcus aureus subsp. aureus Mu50
uaccaaauauauuu

SEQ ID NO: 3962038 - RNA, 22 nt, Staphylococcus aureus subsp. aureus Mu50
uaccaaauauauuuuuauuaau

SEQ ID NO: 3962039 - RNA, 19 nt, Staphylococcus aureus subsp. aureus Mu50
uaccaacaagguucuaaau

SEQ ID NO: 3962040 - RNA, 22 nt, Staphylococcus aureus subsp. aureus Mu50
uaccaacaagguucuaaaucuu

SEQ ID NO: 3962041 - RNA, 18 nt, Staphylococcus aureus subsp. aureus Mu50
uaccaauacguuuccaau

SEQ ID NO: 3962042 - RNA, 22 nt, Staphylococcus aureus subsp. aureus Mu50
uaccaauaucaugcaaaauaau

SEQ ID NO: 3962043 - RNA, 15 nt, Staphylococcus aureus subsp. aureus Mu50
uaccaaugaauaaau

SEQ ID NO: 3962044 - RNA, 22 nt, Staphylococcus aureus subsp. aureus Mu50
uaccaaugaauaaauugauauu

SEQ ID NO: 3962045 - RNA, 15 nt, Staphylococcus aureus subsp. aureus Mu50
uaccaauuagcauga

SEQ ID NO: 3962046 - RNA, 13 nt, Staphylococcus aureus subsp. aureus Mu50
uaccaauugauuu

SEQ ID NO: 3962047 - RNA, 17 nt, Staphylococcus aureus subsp. aureus Mu50
uaccaauugauuuugcu

SEQ ID NO: 3962048 - RNA, 17 nt, Staphylococcus aureus subsp. aureus Mu50
uaccaauugcuucuucg

SEQ ID NO: 3962049 - RNA, 20 nt, Staphylococcus aureus subsp. aureus Mu50
uaccacacuuuaaacaagca

SEQ ID NO: 3962050 - RNA, 20 nt, Staphylococcus aureus subsp. aureus Mu50
uaccacaucgcauaauaucu

SEQ ID NO: 3962051 - RNA, 17 nt, Staphylococcus aureus subsp. aureus Mu50
uaccacauuuuccuugu

SEQ ID NO: 3962052 - RNA, 16 nt, Staphylococcus aureus subsp. aureus Mu50
uaccaccagccccaau

SEQ ID NO: 3962053 - RNA, 20 nt, Staphylococcus aureus subsp. aureus Mu50
uaccaccauuuuuagaaaua

SEQ ID NO: 3962054 - RNA, 17 nt, Staphylococcus aureus subsp. aureus Mu50
uacguuuuaaauaaaug

SEQ ID NO: 3962055 - RNA, 15 nt, Staphylococcus aureus subsp. aureus Mu50
uacguuuuuuuaaau

SEQ ID NO: 3962056 - RNA, 11 nt, Staphylococcus aureus subsp. aureus Mu50
uacuaaaacau

SEQ ID NO: 3962057 - RNA, 18 nt, Staphylococcus aureus subsp. aureus Mu50
uacuaaaaguguuaugaa

SEQ ID NO: 3962058 - RNA, 13 nt, Staphylococcus aureus subsp. aureus Mu50
uacuaaaccgauu

SEQ ID NO: 3962059 - RNA, 14 nt, Staphylococcus aureus subsp. aureus Mu50
uacuaaauugagaa

SEQ ID NO: 3962060 - RNA, 15 nt, Staphylococcus aureus subsp. aureus Mu50
uacuaaauugagaag

SEQ ID NO: 3962061 - RNA, 21 nt, Staphylococcus aureus subsp. aureus Mu50
uacuaaccuauuaaaaaaaac

SEQ ID NO: 3962062 - RNA, 21 nt, Staphylococcus aureus subsp. aureus Mu50
uacuaacguaaaggugauauu

SEQ ID NO: 3962063 - RNA, 15 nt, Staphylococcus aureus subsp. aureus Mu50
uacuaacugaagaca

SEQ ID NO: 3962064 - RNA, 16 nt, Staphylococcus aureus subsp. aureus Mu50
uacuaacugaagacac

SEQ ID NO: 3962065 - RNA, 22 nt, Staphylococcus aureus subsp. aureus Mu50
uacuaagcgcucauaaacgauu

SEQ ID NO: 3962066 - RNA, 18 nt, Staphylococcus aureus subsp. aureus Mu50
uacuaagcuuucauuaau

SEQ ID NO: 3962067 - RNA, 15 nt, Staphylococcus aureus subsp. aureus Mu50
uacuaauauauuaau

SEQ ID NO: 3962068 - RNA, 13 nt, Staphylococcus aureus subsp. aureus Mu50
uacuaauaucuuc

SEQ ID NO: 3962069 - RNA, 23 nt, Staphylococcus aureus subsp. aureus Mu50
uacuaaucguuguggcuuuuuau

SEQ ID NO: 3962070 - RNA, 21 nt, Staphylococcus aureus subsp. aureus Mu50
uacuacacuccccuuaucaaa

SEQ ID NO: 3962071 - RNA, 13 nt, Staphylococcus aureus subsp. aureus Mu50
uacuacauuauua

SEQ ID NO: 3962072 - RNA, 16 nt, Staphylococcus aureus subsp. aureus Mu50
uacuacauucuaugua

SEQ ID NO: 3962073 - RNA, 22 nt, Staphylococcus aureus subsp. aureus Mu50
uacuaccguuuuuauauacuug

SEQ ID NO: 3962074 - RNA, 12 nt, Staphylococcus aureus subsp. aureus Mu50
uacuacgcauua

SEQ ID NO: 3962075 - RNA, 23 nt, Staphylococcus aureus subsp. aureus Mu50
uacuacugucucaucuucuaaau

SEQ ID NO: 3962076 - RNA, 18 nt, Staphylococcus aureus subsp. aureus Mu50
uacuaggaauauaaaacu

SEQ ID NO: 3962077 - RNA, 23 nt, Staphylococcus aureus subsp. aureus Mu50
uacuaguuuguaauaauuaacuu

SEQ ID NO: 3962078 - RNA, 20 nt, Staphylococcus aureus subsp. aureus Mu50
uacuauaaaaauuuauucaa

SEQ ID NO: 3962079 - RNA, 20 nt, Staphylococcus aureus subsp. aureus Mu50
uacuauaaaaucaucguauu

SEQ ID NO: 3962080 - RNA, 14 nt, Staphylococcus aureus subsp. aureus Mu50
uacuauaaauccua

SEQ ID NO: 3962081 - RNA, 15 nt, Staphylococcus aureus subsp. aureus Mu50
uacuauaauaauuaa

SEQ ID NO: 3962082 - RNA, 13 nt, Staphylococcus aureus subsp. aureus Mu50
uacuauauuuauu

SEQ ID NO: 3962083 - RNA, 19 nt, Staphylococcus aureus subsp. aureus Mu50
uacuaucuacaauaaccau

SEQ ID NO: 3962084 - RNA, 14 nt, Staphylococcus aureus subsp. aureus Mu50
uacuaucuucauca

SEQ ID NO: 3962085 - RNA, 16 nt, Staphylococcus aureus subsp. aureus Mu50
uacuaucuucaucaua

SEQ ID NO: 3962086 - RNA, 15 nt, Staphylococcus aureus subsp. aureus Mu50
uacuauggcauuauu

SEQ ID NO: 3962087 - RNA, 16 nt, Staphylococcus aureus subsp. aureus Mu50
uacuauggcauuauug

SEQ ID NO: 3962088 - RNA, 23 nt, Staphylococcus aureus subsp. aureus Mu50
uacuauuaaaggaaaucaaucca

SEQ ID NO: 3962089 - RNA, 13 nt, Staphylococcus aureus subsp. aureus Mu50
uacuauuaaauaa

SEQ ID NO: 3962090 - RNA, 14 nt, Staphylococcus aureus subsp. aureus Mu50
uacuauuuaaucuu

SEQ ID NO: 3962091 - RNA, 23 nt, Staphylococcus aureus subsp. aureus Mu50
uacuauuuuugacuguuaaacaa

SEQ ID NO: 3962092 - RNA, 15 nt, Staphylococcus aureus subsp. aureus Mu50
uacucaaaccaucuu

SEQ ID NO: 3962093 - RNA, 13 nt, Staphylococcus aureus subsp. aureus Mu50
uacucaaguaauc

SEQ ID NO: 3962094 - RNA, 13 nt, Staphylococcus aureus subsp. aureus Mu50
uacucacaaaaaa

SEQ ID NO: 3962095 - RNA, 19 nt, Staphylococcus aureus subsp. aureus Mu50
uacucacugcacuuaugau

SEQ ID NO: 3962096 - RNA, 20 nt, Staphylococcus aureus subsp. aureus Mu50
uacucacugcacuuaugaua

SEQ ID NO: 3962097 - RNA, 22 nt, Staphylococcus aureus subsp. aureus Mu50
uacucacugcacuuaugauacu

SEQ ID NO: 3962098 - RNA, 18 nt, Staphylococcus aureus subsp. aureus Mu50
uacucauuuagcucuacu

SEQ ID NO: 3962099 - RNA, 14 nt, Staphylococcus aureus subsp. aureus Mu50
uacuccaaaguaac

SEQ ID NO: 3962100 - RNA, 21 nt, Staphylococcus aureus subsp. aureus Mu50
uacucuaaaaaaggaagaaca

SEQ ID NO: 3962101 - RNA, 14 nt, Staphylococcus aureus subsp. aureus Mu50
uacucuaacuuacc

SEQ ID NO: 3962102 - RNA, 16 nt, Staphylococcus aureus subsp. aureus Mu50
uacucuaacuuaccau

SEQ ID NO: 3962103 - RNA, 14 nt, Staphylococcus aureus subsp. aureus Mu50
uacucuagcggaac

SEQ ID NO: 3962104 - RNA, 17 nt, Staphylococcus aureus subsp. aureus Mu50
uacucugauuacauaua

SEQ ID NO: 3962105 - RNA, 14 nt, Staphylococcus aureus subsp. aureus Mu50
uacucugggcauuu

SEQ ID NO: 3962106 - RNA, 17 nt, Staphylococcus aureus subsp. aureus Mu50
uacucugggcauuuuga

SEQ ID NO: 3962107 - RNA, 19 nt, Staphylococcus aureus subsp. aureus Mu50
uacucugggcauuuugacg

SEQ ID NO: 3962108 - RNA, 18 nt, Staphylococcus aureus subsp. aureus Mu50
uacugaaacuaaauuaaa

SEQ ID NO: 3962109 - RNA, 16 nt, Staphylococcus aureus subsp. aureus Mu50
uacugaauuuuaacua

SEQ ID NO: 3962110 - RNA, 15 nt, Staphylococcus aureus subsp. aureus Mu50
uacugcaauuauuuu

SEQ ID NO: 3962111 - RNA, 17 nt, Staphylococcus aureus subsp. aureus Mu50
uacugcaauuauuuuuc

SEQ ID NO: 3962112 - RNA, 23 nt, Staphylococcus aureus subsp. aureus Mu50
uacugcaccgauaucauauaaug

SEQ ID NO: 3962113 - RNA, 21 nt, Staphylococcus aureus subsp. aureus Mu50
uacugcuuuuuuauucuaaua

SEQ ID NO: 3962114 - RNA, 22 nt, Staphylococcus aureus subsp. aureus Mu50
uacuggguuuuaccauaaauug

SEQ ID NO: 3962115 - RNA, 23 nt, Staphylococcus aureus subsp. aureus Mu50
uacuggguuuuaccauaaauuga

SEQ ID NO: 3962116 - RNA, 15 nt, Staphylococcus aureus subsp. aureus Mu50
uacuguauaagugcu

SEQ ID NO: 3962117 - RNA, 22 nt, Staphylococcus aureus subsp. aureus Mu50
uacuguauuuuaacgucauuuu

SEQ ID NO: 3962118 - RNA, 21 nt, Staphylococcus aureus subsp. aureus Mu50
uacugucuuuccauaauaaug

SEQ ID NO: 3962119 - RNA, 15 nt, Staphylococcus aureus subsp. aureus Mu50
uacugugaaaauacc

SEQ ID NO: 3962120 - RNA, 16 nt, Staphylococcus aureus subsp. aureus Mu50
uacugugaaaauacca

SEQ ID NO: 3962121 - RNA, 15 nt, Staphylococcus aureus subsp. aureus Mu50
uacuguguuuaggua

SEQ ID NO: 3962122 - RNA, 13 nt, Staphylococcus aureus subsp. aureus Mu50
uacuguuuaaaua

SEQ ID NO: 3962123 - RNA, 16 nt, Staphylococcus aureus subsp. aureus Mu50
uacuguuuaaauaaaa

SEQ ID NO: 3962124 - RNA, 21 nt, Staphylococcus aureus subsp. aureus Mu50
uacuguuuaaauaaaauuguu

SEQ ID NO: 3962125 - RNA, 13 nt, Staphylococcus aureus subsp. aureus Mu50
uacuguuugcuuu

SEQ ID NO: 3962126 - RNA, 18 nt, Staphylococcus aureus subsp. aureus Mu50
uacuuaaagcuaguaaug

SEQ ID NO: 3962127 - RNA, 12 nt, Staphylococcus aureus subsp. aureus Mu50
uacuuaauauag

SEQ ID NO: 3962128 - RNA, 14 nt, Staphylococcus aureus subsp. aureus Mu50
uacuuaauuuaaau

SEQ ID NO: 3962129 - RNA, 20 nt, Staphylococcus aureus subsp. aureus Mu50
uacuuaauuuaaauugucac

SEQ ID NO: 3962130 - RNA, 20 nt, Staphylococcus aureus subsp. aureus Mu50
uacuuaccuuucaaauauau

SEQ ID NO: 3962131 - RNA, 17 nt, Staphylococcus aureus subsp. aureus Mu50
uacuuacgccaaucaca

SEQ ID NO: 3962132 - RNA, 21 nt, Staphylococcus aureus subsp. aureus Mu50
uacuuacuccguugaauucaa

SEQ ID NO: 3962133 - RNA, 14 nt, Staphylococcus aureus subsp. aureus Mu50
uacuuacugaaacu

SEQ ID NO: 3962134 - RNA, 22 nt, Staphylococcus aureus subsp. aureus Mu50
uacuuacugaaacuaaauuaaa

SEQ ID NO: 3962135 - RNA, 19 nt, Staphylococcus aureus subsp. aureus Mu50
uacuuagcguacgauauag

SEQ ID NO: 3962136 - RNA, 23 nt, Staphylococcus aureus subsp. aureus Mu50
uacuuauauauucaauaauuauu

SEQ ID NO: 3962137 - RNA, 13 nt, Staphylococcus aureus subsp. aureus Mu50
uacuuauuucuuu

SEQ ID NO: 3962138 - RNA, 18 nt, Staphylococcus aureus subsp. aureus Mu50
uacuuauuucuuuucauu

SEQ ID NO: 3962139 - RNA, 14 nt, Staphylococcus aureus subsp. aureus Mu50
uacuucaauaacaa

SEQ ID NO: 3962140 - RNA, 13 nt, Staphylococcus aureus subsp. aureus Mu50
uacuucaccacau

SEQ ID NO: 3962141 - RNA, 20 nt, Staphylococcus aureus subsp. aureus Mu50
uacuucaccacauaaaaaua

SEQ ID NO: 3962142 - RNA, 21 nt, Staphylococcus aureus subsp. aureus Mu50
uagauagacuuucuugaugaa

SEQ ID NO: 3962143 - RNA, 13 nt, Staphylococcus aureus subsp. aureus Mu50
uagauagcggauu

SEQ ID NO: 3962144 - RNA, 15 nt, Staphylococcus aureus subsp. aureus Mu50
uagauauauuugaaa

SEQ ID NO: 3962145 - RNA, 13 nt, Staphylococcus aureus subsp. aureus Mu50
uagauaucauuuu

SEQ ID NO: 3962146 - RNA, 22 nt, Staphylococcus aureus subsp. aureus Mu50
uagauaucuuaaucuaaaaaua

SEQ ID NO: 3962147 - RNA, 13 nt, Staphylococcus aureus subsp. aureus Mu50
uagauauuauaaa

SEQ ID NO: 3962148 - RNA, 14 nt, Staphylococcus aureus subsp. aureus Mu50
uagauauuauaaaa

SEQ ID NO: 3962149 - RNA, 15 nt, Staphylococcus aureus subsp. aureus Mu50
uagaugaaaauuuaa

SEQ ID NO: 3962150 - RNA, 11 nt, Staphylococcus aureus subsp. aureus Mu50
uagaugaaaug

SEQ ID NO: 3962151 - RNA, 18 nt, Staphylococcus aureus subsp. aureus Mu50
uagaugaaugccuaauuu

SEQ ID NO: 3962152 - RNA, 21 nt, Staphylococcus aureus subsp. aureus Mu50
uagaugaaugccuaauuuugu

SEQ ID NO: 3962153 - RNA, 14 nt, Staphylococcus aureus subsp. aureus Mu50
uagaugauacauuc

SEQ ID NO: 3962154 - RNA, 12 nt, Staphylococcus aureus subsp. aureus Mu50
uagaugauauuu

SEQ ID NO: 3962155 - RNA, 14 nt, Staphylococcus aureus subsp. aureus Mu50
uagaugauauuuaa

SEQ ID NO: 3962156 - RNA, 23 nt, Staphylococcus aureus subsp. aureus Mu50
uagaugauuagugucacaaagaa

SEQ ID NO: 3962157 - RNA, 19 nt, Staphylococcus aureus subsp. aureus Mu50
uagaugcauaaaaaaagaa

SEQ ID NO: 3962158 - RNA, 19 nt, Staphylococcus aureus subsp. aureus Mu50
uagaugcuaauguaaucug

SEQ ID NO: 3962159 - RNA, 23 nt, Staphylococcus aureus subsp. aureus Mu50
uagaugcuggcuuaguaguugua

SEQ ID NO: 3962160 - RNA, 20 nt, Staphylococcus aureus subsp. aureus Mu50
uagauggacaguuuuuauau

SEQ ID NO: 3962161 - RNA, 20 nt, Staphylococcus aureus subsp. aureus Mu50
uagauguugaugaaguaguu

SEQ ID NO: 3962162 - RNA, 20 nt, Staphylococcus aureus subsp. aureus Mu50
uagauucacuguauaaauaa

SEQ ID NO: 3962163 - RNA, 20 nt, Staphylococcus aureus subsp. aureus Mu50
uagauucugauacagaacca

SEQ ID NO: 3962164 - RNA, 12 nt, Staphylococcus aureus subsp. aureus Mu50
uagauucuuuuc

SEQ ID NO: 3962165 - RNA, 13 nt, Staphylococcus aureus subsp. aureus Mu50
uagauugaaaaaa

SEQ ID NO: 3962166 - RNA, 15 nt, Staphylococcus aureus subsp. aureus Mu50
uagauugaucagcuc

SEQ ID NO: 3962167 - RNA, 16 nt, Staphylococcus aureus subsp. aureus Mu50
uagauugauuguauuu

SEQ ID NO: 3962168 - RNA, 17 nt, Staphylococcus aureus subsp. aureus Mu50
uagauuguauuuaauaa

SEQ ID NO: 3962169 - RNA, 18 nt, Staphylococcus aureus subsp. aureus Mu50
uagauuguauuuaauaag

SEQ ID NO: 3962170 - RNA, 13 nt, Staphylococcus aureus subsp. aureus Mu50
uagauuuaaaaug

SEQ ID NO: 3962171 - RNA, 12 nt, Staphylococcus aureus subsp. aureus Mu50
uagauuuaaaga

SEQ ID NO: 3962172 - RNA, 13 nt, Staphylococcus aureus subsp. aureus Mu50
uagauuuaggaga

SEQ ID NO: 3962173 - RNA, 14 nt, Staphylococcus aureus subsp. aureus Mu50
uagauuuauaacga

SEQ ID NO: 3962174 - RNA, 17 nt, Staphylococcus aureus subsp. aureus Mu50
uagauuuaucaccuuua

SEQ ID NO: 3962175 - RNA, 19 nt, Staphylococcus aureus subsp. aureus Mu50
uagauuuaucaccuuuagg

SEQ ID NO: 3962176 - RNA, 19 nt, Staphylococcus aureus subsp. aureus Mu50
uagauuucaugauguuaag

SEQ ID NO: 3962177 - RNA, 14 nt, Staphylococcus aureus subsp. aureus Mu50
uagauuuguguguc

SEQ ID NO: 3962178 - RNA, 14 nt, Staphylococcus aureus subsp. aureus Mu50
uagauuuuaaauca

SEQ ID NO: 3962179 - RNA, 14 nt, Staphylococcus aureus subsp. aureus Mu50
uagauuuuauauaa

SEQ ID NO: 3962180 - RNA, 19 nt, Staphylococcus aureus subsp. aureus Mu50
uagauuuuauauaaaaaga

SEQ ID NO: 3962181 - RNA, 18 nt, Staphylococcus aureus subsp. aureus Mu50
uagauuuuaugcuuuacu

SEQ ID NO: 3962182 - RNA, 14 nt, Staphylococcus aureus subsp. aureus Mu50
uagauuuucacuaa

SEQ ID NO: 3962183 - RNA, 19 nt, Staphylococcus aureus subsp. aureus Mu50
uagauuuuguauuagcauc

SEQ ID NO: 3962184 - RNA, 22 nt, Staphylococcus aureus subsp. aureus Mu50
uagauuuuguauuagcaucuga

SEQ ID NO: 3962185 - RNA, 14 nt, Staphylococcus aureus subsp. aureus Mu50
uagcaaaaauacuu

SEQ ID NO: 3962186 - RNA, 21 nt, Staphylococcus aureus subsp. aureus Mu50
uagcaaaauuauguaaaaaau

SEQ ID NO: 3962187 - RNA, 22 nt, Staphylococcus aureus subsp. aureus Mu50
uagcaaauauuauuaaaucaaa

SEQ ID NO: 3962188 - RNA, 17 nt, Staphylococcus aureus subsp. aureus Mu50
uagcaaauauuucuggc

SEQ ID NO: 3962189 - RNA, 11 nt, Staphylococcus aureus subsp. aureus Mu50
uagcaaauuga

SEQ ID NO: 3962190 - RNA, 20 nt, Staphylococcus aureus subsp. aureus Mu50
uagcaaccauauuuuuagaa

SEQ ID NO: 3962191 - RNA, 21 nt, Staphylococcus aureus subsp. aureus Mu50
uagcaaccauauuuuuagaaa

SEQ ID NO: 3962192 - RNA, 20 nt, Staphylococcus aureus subsp. aureus Mu50
uagcaacgagcuuagcaguu

SEQ ID NO: 3962193 - RNA, 20 nt, Staphylococcus aureus subsp. aureus Mu50
uagcaacugaucauuuucau

SEQ ID NO: 3962194 - RNA, 16 nt, Staphylococcus aureus subsp. aureus Mu50
uagcaaugaauuaaua

SEQ ID NO: 3962195 - RNA, 18 nt, Staphylococcus aureus subsp. aureus Mu50
uagcaaugaauuaauagc

SEQ ID NO: 3962196 - RNA, 22 nt, Staphylococcus aureus subsp. aureus Mu50
uagcaauuuucgauauuuguuu

SEQ ID NO: 3962197 - RNA, 16 nt, Staphylococcus aureus subsp. aureus Mu50
uagcaccauuauuaaa

SEQ ID NO: 3962198 - RNA, 19 nt, Staphylococcus aureus subsp. aureus Mu50
uagcaccggcaucuugaac

SEQ ID NO: 3962199 - RNA, 18 nt, Staphylococcus aureus subsp. aureus Mu50
uagcacuuggauuuuaau

SEQ ID NO: 3962200 - RNA, 22 nt, Staphylococcus aureus subsp. aureus Mu50
uagcacuuggauuuuaauuauu

SEQ ID NO: 3962201 - RNA, 18 nt, Staphylococcus aureus subsp. aureus Mu50
uagcagucaaacauagau

SEQ ID NO: 3962202 - RNA, 13 nt, Staphylococcus aureus subsp. aureus Mu50
uagcaguuucuga

SEQ ID NO: 3962203 - RNA, 19 nt, Staphylococcus aureus subsp. aureus Mu50
uagcaguuucugagaagaa

SEQ ID NO: 3962204 - RNA, 12 nt, Staphylococcus aureus subsp. aureus Mu50
uagcauaaaauu

SEQ ID NO: 3962205 - RNA, 14 nt, Staphylococcus aureus subsp. aureus Mu50
uagcauacauuaag

SEQ ID NO: 3962206 - RNA, 21 nt, Staphylococcus aureus subsp. aureus Mu50
uagcauagcguucaauagcau

SEQ ID NO: 3962207 - RNA, 18 nt, Staphylococcus aureus subsp. aureus Mu50
uagcauaucuuuaucauu

SEQ ID NO: 3962208 - RNA, 19 nt, Staphylococcus aureus subsp. aureus Mu50
uagcauauucgcuuaaaaa

SEQ ID NO: 3962209 - RNA, 19 nt, Staphylococcus aureus subsp. aureus Mu50
uagcaucaaaaauaaaaau

SEQ ID NO: 3962210 - RNA, 20 nt, Staphylococcus aureus subsp. aureus Mu50
uagcaucuuuaccauauaau

SEQ ID NO: 3962211 - RNA, 18 nt, Staphylococcus aureus subsp. aureus Mu50
uagcaugauaaaguaugu

SEQ ID NO: 3962212 - RNA, 19 nt, Staphylococcus aureus subsp. aureus Mu50
uagcauuacgccaccaguu

SEQ ID NO: 3962213 - RNA, 14 nt, Staphylococcus aureus subsp. aureus Mu50
uagcauuauuugcu

SEQ ID NO: 3962214 - RNA, 18 nt, Staphylococcus aureus subsp. aureus Mu50
uagcauuccuaauuauau

SEQ ID NO: 3962215 - RNA, 19 nt, Staphylococcus aureus subsp. aureus Mu50
uagcauuccuaauuauauu

SEQ ID NO: 3962216 - RNA, 15 nt, Staphylococcus aureus subsp. aureus Mu50
uagcauugccccauc

SEQ ID NO: 3962217 - RNA, 20 nt, Staphylococcus aureus subsp. aureus Mu50
uagcauuucuuuauuagaau

SEQ ID NO: 3962218 - RNA, 20 nt, Staphylococcus aureus subsp. aureus Mu50
uagccaaaggcaaaauguau

SEQ ID NO: 3962219 - RNA, 21 nt, Staphylococcus aureus subsp. aureus Mu50
uagccaaauaaauuuugacgc

SEQ ID NO: 3962220 - RNA, 16 nt, Staphylococcus aureus subsp. aureus Mu50
uagccaauaucauauu

SEQ ID NO: 3962221 - RNA, 13 nt, Staphylococcus aureus subsp. aureus Mu50
uagccacaauuuu

SEQ ID NO: 3962222 - RNA, 16 nt, Staphylococcus aureus subsp. aureus Mu50
uagccauauucauauu

SEQ ID NO: 3962223 - RNA, 17 nt, Staphylococcus aureus subsp. aureus Mu50
uagccccaguauagaag

SEQ ID NO: 3962224 - RNA, 21 nt, Staphylococcus aureus subsp. aureus Mu50
uagccgaaaaacaucauuucu

SEQ ID NO: 3962225 - RNA, 20 nt, Staphylococcus aureus subsp. aureus Mu50
uagccuucaauauuucuugc

SEQ ID NO: 3962226 - RNA, 14 nt, Staphylococcus aureus subsp. aureus Mu50
uagcgaaaacuaaa

SEQ ID NO: 3962227 - RNA, 20 nt, Staphylococcus aureus subsp. aureus Mu50
uagcgaaaguaucuaugaaa

SEQ ID NO: 3962228 - RNA, 15 nt, Staphylococcus aureus subsp. aureus Mu50
uagcgauuuuaaaga

SEQ ID NO: 3962229 - RNA, 15 nt, Staphylococcus aureus subsp. aureus Mu50
uagcguaauuauuau

SEQ ID NO: 3962230 - RNA, 16 nt, Staphylococcus aureus subsp. aureus Mu50
uagucaucuguuaauu

SEQ ID NO: 3962231 - RNA, 20 nt, Staphylococcus aureus subsp. aureus Mu50
uagucauguuuggcauaaua

SEQ ID NO: 3962232 - RNA, 16 nt, Staphylococcus aureus subsp. aureus Mu50
uagucauuacaaauca

SEQ ID NO: 3962233 - RNA, 23 nt, Staphylococcus aureus subsp. aureus Mu50
uagucauuacaaaucaugacaua

SEQ ID NO: 3962234 - RNA, 15 nt, Staphylococcus aureus subsp. aureus Mu50
uagucauuacauuuu

SEQ ID NO: 3962235 - RNA, 17 nt, Staphylococcus aureus subsp. aureus Mu50
uaguccggggccccaac

SEQ ID NO: 3962236 - RNA, 23 nt, Staphylococcus aureus subsp. aureus Mu50
uaguccuucuuuacuaaaccuca

SEQ ID NO: 3962237 - RNA, 21 nt, Staphylococcus aureus subsp. aureus Mu50
uagucgaagaagauuaugaaa

SEQ ID NO: 3962238 - RNA, 17 nt, Staphylococcus aureus subsp. aureus Mu50
uagucggggccccaaca

SEQ ID NO: 3962239 - RNA, 21 nt, Staphylococcus aureus subsp. aureus Mu50
uagucggggccccaacacaga

SEQ ID NO: 3962240 - RNA, 15 nt, Staphylococcus aureus subsp. aureus Mu50
uagucgguguuuucu

SEQ ID NO: 3962241 - RNA, 17 nt, Staphylococcus aureus subsp. aureus Mu50
uagucgucgaaaugccu

SEQ ID NO: 3962242 - RNA, 23 nt, Staphylococcus aureus subsp. aureus Mu50
uagucuaugaauaauguuuucau

SEQ ID NO: 3962243 - RNA, 19 nt, Staphylococcus aureus subsp. aureus Mu50
uagucucccauaacaccua

SEQ ID NO: 3962244 - RNA, 16 nt, Staphylococcus aureus subsp. aureus Mu50
uagucucguaauaaug

SEQ ID NO: 3962245 - RNA, 23 nt, Staphylococcus aureus subsp. aureus Mu50
uagucuuuuuauuuuaauauuuu

SEQ ID NO: 3962246 - RNA, 21 nt, Staphylococcus aureus subsp. aureus Mu50
uagucuuuuuuaagcuuauca

SEQ ID NO: 3962247 - RNA, 11 nt, Staphylococcus aureus subsp. aureus Mu50
uagugaaaaag

SEQ ID NO: 3962248 - RNA, 12 nt, Staphylococcus aureus subsp. aureus Mu50
uagugaaaagaa

SEQ ID NO: 3962249 - RNA, 23 nt, Staphylococcus aureus subsp. aureus Mu50
uagugaaauucgaacuaucaaua

SEQ ID NO: 3962250 - RNA, 12 nt, Staphylococcus aureus subsp. aureus Mu50
uagugaauaaug

SEQ ID NO: 3962251 - RNA, 16 nt, Staphylococcus aureus subsp. aureus Mu50
uagugacucaguuaua

SEQ ID NO: 3962252 - RNA, 23 nt, Staphylococcus aureus subsp. aureus Mu50
uagugauauuuuucgaauuuaac

SEQ ID NO: 3962253 - RNA, 16 nt, Staphylococcus aureus subsp. aureus Mu50
uagugauuuuuuacau

SEQ ID NO: 3962254 - RNA, 17 nt, Staphylococcus aureus subsp. aureus Mu50
uagugccucuuuuauua

SEQ ID NO: 3962255 - RNA, 21 nt, Staphylococcus aureus subsp. aureus Mu50
uagugccucuuuuauuauuua

SEQ ID NO: 3962256 - RNA, 13 nt, Staphylococcus aureus subsp. aureus Mu50
uagugcucuugca

SEQ ID NO: 3962257 - RNA, 16 nt, Staphylococcus aureus subsp. aureus Mu50
uagugcuuguuuauua

SEQ ID NO: 3962258 - RNA, 14 nt, Staphylococcus aureus subsp. aureus Mu50
uagugcuuuuucaa

SEQ ID NO: 3962259 - RNA, 23 nt, Staphylococcus aureus subsp. aureus Mu50
uaguggaagacaaugauuugugg

SEQ ID NO: 3962260 - RNA, 18 nt, Staphylococcus aureus subsp. aureus Mu50
uaguggugguacuuuuuu

SEQ ID NO: 3962261 - RNA, 17 nt, Staphylococcus aureus subsp. aureus Mu50
uaguguuauauuguauu

SEQ ID NO: 3962262 - RNA, 18 nt, Staphylococcus aureus subsp. aureus Mu50
uaguguuuuauucgauaa

SEQ ID NO: 3962263 - RNA, 20 nt, Staphylococcus aureus subsp. aureus Mu50
uaguuaaaguacuuacaaau

SEQ ID NO: 3962264 - RNA, 21 nt, Staphylococcus aureus subsp. aureus Mu50
uaguuaauucuccuaauaauu

SEQ ID NO: 3962265 - RNA, 20 nt, Staphylococcus aureus subsp. aureus Mu50
uaguuagcccuauucaacua

SEQ ID NO: 3962266 - RNA, 18 nt, Staphylococcus aureus subsp. aureus Mu50
uaguuauacuacuauuga

SEQ ID NO: 3962267 - RNA, 17 nt, Staphylococcus aureus subsp. aureus Mu50
uaguuaugugcuaaucu

SEQ ID NO: 3962268 - RNA, 21 nt, Staphylococcus aureus subsp. aureus Mu50
uaguucaaauugaacuucuuu

SEQ ID NO: 3962269 - RNA, 23 nt, Staphylococcus aureus subsp. aureus Mu50
uaguucaaauugaacuucuuuuu

SEQ ID NO: 3962270 - RNA, 20 nt, Staphylococcus aureus subsp. aureus Mu50
uaguucacaugaauuuuaau

SEQ ID NO: 3962271 - RNA, 15 nt, Staphylococcus aureus subsp. aureus Mu50
uaguucagcuucuaa

SEQ ID NO: 3962272 - RNA, 20 nt, Staphylococcus aureus subsp. aureus Mu50
uaguucagcuucuaaguaau

SEQ ID NO: 3962273 - RNA, 16 nt, Staphylococcus aureus subsp. aureus Mu50
uaguucgauucaugaa

SEQ ID NO: 3962274 - RNA, 20 nt, Staphylococcus aureus subsp. aureus Mu50
uaguucggaugagaaauguu

SEQ ID NO: 3962275 - RNA, 22 nt, Staphylococcus aureus subsp. aureus Mu50
uaguucuauugcagaagaaaac

SEQ ID NO: 3962276 - RNA, 19 nt, Staphylococcus aureus subsp. aureus Mu50
uaguucuggcaaagaaucc

SEQ ID NO: 3962277 - RNA, 12 nt, Staphylococcus aureus subsp. aureus Mu50
uaguucuguuga

SEQ ID NO: 3962278 - RNA, 15 nt, Staphylococcus aureus subsp. aureus Mu50
uaguucuuuaaauua

SEQ ID NO: 3962279 - RNA, 16 nt, Staphylococcus aureus subsp. aureus Mu50
uaguucuuuaaauuau

SEQ ID NO: 3962280 - RNA, 14 nt, Staphylococcus aureus subsp. aureus Mu50
uaguucuuugucug

SEQ ID NO: 3962281 - RNA, 16 nt, Staphylococcus aureus subsp. aureus Mu50
uaguugaucaaaaaga

SEQ ID NO: 3962282 - RNA, 21 nt, Staphylococcus aureus subsp. aureus Mu50
uaguugccccuagcaaaaaua

SEQ ID NO: 3962283 - RNA, 16 nt, Staphylococcus aureus subsp. aureus Mu50
uaguuguccauuuuau

SEQ ID NO: 3962284 - RNA, 21 nt, Staphylococcus aureus subsp. aureus Mu50
uaguuguccauuuuaugcacu

SEQ ID NO: 3962285 - RNA, 19 nt, Staphylococcus aureus subsp. aureus Mu50
uaguuuaagucuaacuuua

SEQ ID NO: 3962286 - RNA, 20 nt, Staphylococcus aureus subsp. aureus Mu50
uaguuuaagucuaacuuuag

SEQ ID NO: 3962287 - RNA, 14 nt, Staphylococcus aureus subsp. aureus Mu50
uaguuuagguugau

SEQ ID NO: 3962288 - RNA, 12 nt, Staphylococcus aureus subsp. aureus Mu50
uaguuuauuaau

SEQ ID NO: 3962289 - RNA, 22 nt, Staphylococcus aureus subsp. aureus Mu50
uaguuuauugccgguuaaauua

SEQ ID NO: 3962290 - RNA, 18 nt, Staphylococcus aureus subsp. aureus Mu50
uaguuucugacuuuuaaa

SEQ ID NO: 3962291 - RNA, 21 nt, Staphylococcus aureus subsp. aureus Mu50
uaguuugauaugcucucuuca

SEQ ID NO: 3962292 - RNA, 23 nt, Staphylococcus aureus subsp. aureus Mu50
uaguuugauaugcucucuucaaa

SEQ ID NO: 3962293 - RNA, 15 nt, Staphylococcus aureus subsp. aureus Mu50
uaguuuguaauaauu

SEQ ID NO: 3962294 - RNA, 14 nt, Staphylococcus aureus subsp. aureus Mu50
uaguuuuuaaaauu

SEQ ID NO: 3962295 - RNA, 18 nt, Staphylococcus aureus subsp. aureus Mu50
uaguuuuuacguuuucua

SEQ ID NO: 3962296 - RNA, 14 nt, Staphylococcus aureus subsp. aureus Mu50
uaguuuuuuuuaua

SEQ ID NO: 3962297 - RNA, 15 nt, Staphylococcus aureus subsp. aureus Mu50
uaguuuuuuuuauau

SEQ ID NO: 3962298 - RNA, 21 nt, Staphylococcus aureus subsp. aureus Mu50
uauaaaaaagaucacugccaa

SEQ ID NO: 3962299 - RNA, 13 nt, Staphylococcus aureus subsp. aureus Mu50
uauaaaaacaaaa

SEQ ID NO: 3962300 - RNA, 16 nt, Staphylococcus aureus subsp. aureus Mu50
uauaaaaacagcagug

SEQ ID NO: 3962301 - RNA, 14 nt, Staphylococcus aureus subsp. aureus Mu50
uauaaaaacuguuc

SEQ ID NO: 3962302 - RNA, 14 nt, Staphylococcus aureus subsp. aureus Mu50
uauaaaaagaauau

SEQ ID NO: 3962303 - RNA, 21 nt, Staphylococcus aureus subsp. aureus Mu50
uauaaaaagaauaugauauug

SEQ ID NO: 3962304 - RNA, 23 nt, Staphylococcus aureus subsp. aureus Mu50
uauaaaaagaauaugauauugau

SEQ ID NO: 3962305 - RNA, 19 nt, Staphylococcus aureus subsp. aureus Mu50
uauaaaaagaucauuaaaa

SEQ ID NO: 3962306 - RNA, 21 nt, Staphylococcus aureus subsp. aureus Mu50
uauaaaaagugcauauuuaau

SEQ ID NO: 3962307 - RNA, 22 nt, Staphylococcus aureus subsp. aureus Mu50
uauaaaacagaauuucaucaaa

SEQ ID NO: 3962308 - RNA, 20 nt, Staphylococcus aureus subsp. aureus Mu50
uauaaaacgauaagaauuaa

SEQ ID NO: 3962309 - RNA, 20 nt, Staphylococcus aureus subsp. aureus Mu50
uauaaaaggaagcaucucca

SEQ ID NO: 3962310 - RNA, 14 nt, Staphylococcus aureus subsp. aureus Mu50
uauaaaauaaauau

SEQ ID NO: 3962311 - RNA, 18 nt, Staphylococcus aureus subsp. aureus Mu50
uauaaaaucauuaauaau

SEQ ID NO: 3962312 - RNA, 18 nt, Staphylococcus aureus subsp. aureus Mu50
uauaaaaucuauaccauu

SEQ ID NO: 3962313 - RNA, 15 nt, Staphylococcus aureus subsp. aureus Mu50
uauaaaaugaauaau

SEQ ID NO: 3962314 - RNA, 12 nt, Staphylococcus aureus subsp. aureus Mu50
uauaaaauucac

SEQ ID NO: 3962315 - RNA, 16 nt, Staphylococcus aureus subsp. aureus Mu50
uauaaaauucaccaac

SEQ ID NO: 3962316 - RNA, 14 nt, Staphylococcus aureus subsp. aureus Mu50
uauaaacaauaaaa

SEQ ID NO: 3962317 - RNA, 22 nt, Staphylococcus aureus subsp. aureus Mu50
uauaauucgucuguuucauaua

SEQ ID NO: 3962318 - RNA, 19 nt, Staphylococcus aureus subsp. aureus Mu50
uauaauucuuguuugauuu

SEQ ID NO: 3962319 - RNA, 22 nt, Staphylococcus aureus subsp. aureus Mu50
uauaauugcauagcuaaauaaa

SEQ ID NO: 3962320 - RNA, 13 nt, Staphylococcus aureus subsp. aureus Mu50
uauaauuuaaaga

SEQ ID NO: 3962321 - RNA, 15 nt, Staphylococcus aureus subsp. aureus Mu50
uauaauuuauaaaaa

SEQ ID NO: 3962322 - RNA, 17 nt, Staphylococcus aureus subsp. aureus Mu50
uauaauuuauaaaaaga

SEQ ID NO: 3962323 - RNA, 19 nt, Staphylococcus aureus subsp. aureus Mu50
uauaauuuauuuagcaucu

SEQ ID NO: 3962324 - RNA, 13 nt, Staphylococcus aureus subsp. aureus Mu50
uauaauuuccuaa

SEQ ID NO: 3962325 - RNA, 20 nt, Staphylococcus aureus subsp. aureus Mu50
uauaauuuccuaaaaacugu

SEQ ID NO: 3962326 - RNA, 15 nt, Staphylococcus aureus subsp. aureus Mu50
uauaauuuuaauauu

SEQ ID NO: 3962327 - RNA, 17 nt, Staphylococcus aureus subsp. aureus Mu50
uauaauuuuaauauuau

SEQ ID NO: 3962328 - RNA, 20 nt, Staphylococcus aureus subsp. aureus Mu50
uauaauuuucuguccaaaaa

SEQ ID NO: 3962329 - RNA, 12 nt, Staphylococcus aureus subsp. aureus Mu50
uauacaaauuau

SEQ ID NO: 3962330 - RNA, 15 nt, Staphylococcus aureus subsp. aureus Mu50
uauacaaugacagca

SEQ ID NO: 3962331 - RNA, 17 nt, Staphylococcus aureus subsp. aureus Mu50
uauacacacuaaggaaa

SEQ ID NO: 3962332 - RNA, 21 nt, Staphylococcus aureus subsp. aureus Mu50
uauacacacuaaggaaaauua

SEQ ID NO: 3962333 - RNA, 16 nt, Staphylococcus aureus subsp. aureus Mu50
uauacacuuacaaaua

SEQ ID NO: 3962334 - RNA, 16 nt, Staphylococcus aureus subsp. aureus Mu50
uauacagguuuaauaa

SEQ ID NO: 3962335 - RNA, 22 nt, Staphylococcus aureus subsp. aureus Mu50
uauacauaacccuaaaaugaau

SEQ ID NO: 3962336 - RNA, 23 nt, Staphylococcus aureus subsp. aureus Mu50
uauacauaacccuaaaaugaaua

SEQ ID NO: 3962337 - RNA, 21 nt, Staphylococcus aureus subsp. aureus Mu50
uauacauaccacacuuuaaac

SEQ ID NO: 3962338 - RNA, 20 nt, Staphylococcus aureus subsp. aureus Mu50
uauaccaaggguuucuggcu

SEQ ID NO: 3962339 - RNA, 17 nt, Staphylococcus aureus subsp. aureus Mu50
uauaccauuccaaaaau

SEQ ID NO: 3962340 - RNA, 22 nt, Staphylococcus aureus subsp. aureus Mu50
uauaccuagggaugauauaguu

SEQ ID NO: 3962341 - RNA, 19 nt, Staphylococcus aureus subsp. aureus Mu50
uauacgauugaguugaaaa

SEQ ID NO: 3962342 - RNA, 19 nt, Staphylococcus aureus subsp. aureus Mu50
uauacuaaacuuuuuucaa

SEQ ID NO: 3962343 - RNA, 13 nt, Staphylococcus aureus subsp. aureus Mu50
uauacuaaauuga

SEQ ID NO: 3962344 - RNA, 20 nt, Staphylococcus aureus subsp. aureus Mu50
uauacuaagcgcucauaaac

SEQ ID NO: 3962345 - RNA, 21 nt, Staphylococcus aureus subsp. aureus Mu50
uauacuauaaauacaaauaua

SEQ ID NO: 3962346 - RNA, 22 nt, Staphylococcus aureus subsp. aureus Mu50
uauacuauaaauacaaauauau

SEQ ID NO: 3962347 - RNA, 15 nt, Staphylococcus aureus subsp. aureus Mu50
uauacuugaagaauc

SEQ ID NO: 3962348 - RNA, 19 nt, Staphylococcus aureus subsp. aureus Mu50
uauacuugaugaaacugau

SEQ ID NO: 3962349 - RNA, 15 nt, Staphylococcus aureus subsp. aureus Mu50
uauacuuuuaccauu

SEQ ID NO: 3962350 - RNA, 15 nt, Staphylococcus aureus subsp. aureus Mu50
uauacuuuuauagaa

SEQ ID NO: 3962351 - RNA, 15 nt, Staphylococcus aureus subsp. aureus Mu50
uauacuuuuggucug

SEQ ID NO: 3962352 - RNA, 13 nt, Staphylococcus aureus subsp. aureus Mu50
uauacuuuuuaaa

SEQ ID NO: 3962353 - RNA, 14 nt, Staphylococcus aureus subsp. aureus Mu50
uauacuuuuuaaau

SEQ ID NO: 3962354 - RNA, 20 nt, Staphylococcus aureus subsp. aureus Mu50
uauagaaaaaguauuacuuu

SEQ ID NO: 3962355 - RNA, 21 nt, Staphylococcus aureus subsp. aureus Mu50
uauagaaaaugaguacaacau

SEQ ID NO: 3962356 - RNA, 23 nt, Staphylococcus aureus subsp. aureus Mu50
uauagaaaaugaguacaacauag

SEQ ID NO: 3962357 - RNA, 17 nt, Staphylococcus aureus subsp. aureus Mu50
uauagaaaccaaaaaau

SEQ ID NO: 3962358 - RNA, 17 nt, Staphylococcus aureus subsp. aureus Mu50
uauagaaccuauuuuuu

SEQ ID NO: 3962359 - RNA, 22 nt, Staphylococcus aureus subsp. aureus Mu50
uauagaauucacgcaauaucau

SEQ ID NO: 3962360 - RNA, 16 nt, Staphylococcus aureus subsp. aureus Mu50
uauagaccguugaaau

SEQ ID NO: 3962361 - RNA, 19 nt, Staphylococcus aureus subsp. aureus Mu50
uauagaccguugaaauguu

SEQ ID NO: 3962362 - RNA, 22 nt, Staphylococcus aureus subsp. aureus Mu50
uauagaccguugaaauguucaa

SEQ ID NO: 3962363 - RNA, 16 nt, Staphylococcus aureus subsp. aureus Mu50
uauagagccaugaaaa

SEQ ID NO: 3962364 - RNA, 22 nt, Staphylococcus aureus subsp. aureus Mu50
uauagaggauauuuauucuaag

SEQ ID NO: 3962365 - RNA, 21 nt, Staphylococcus aureus subsp. aureus Mu50
uauagaugacuguagaaaaca

SEQ ID NO: 3962366 - RNA, 23 nt, Staphylococcus aureus subsp. aureus Mu50
uauagaugacuguagaaaacaug

SEQ ID NO: 3962367 - RNA, 15 nt, Staphylococcus aureus subsp. aureus Mu50
uauagaugugucuuu

SEQ ID NO: 3962368 - RNA, 15 nt, Staphylococcus aureus subsp. aureus Mu50
uauagauuaaaccgc

SEQ ID NO: 3962369 - RNA, 21 nt, Staphylococcus aureus subsp. aureus Mu50
uauagauuaaaccgcacuucu

SEQ ID NO: 3962370 - RNA, 14 nt, Staphylococcus aureus subsp. aureus Mu50
uauagauugccauu

SEQ ID NO: 3962371 - RNA, 18 nt, Staphylococcus aureus subsp. aureus Mu50
uauagauugccauucaua

SEQ ID NO: 3962372 - RNA, 14 nt, Staphylococcus aureus subsp. aureus Mu50
uauagauuuaaaga

SEQ ID NO: 3962373 - RNA, 20 nt, Staphylococcus aureus subsp. aureus Mu50
uauagauuuuguauuagcau

SEQ ID NO: 3962374 - RNA, 16 nt, Staphylococcus aureus subsp. aureus Mu50
uauagcaccauuauua

SEQ ID NO: 3962375 - RNA, 20 nt, Staphylococcus aureus subsp. aureus Mu50
uauagcaccauuauuaaaug

SEQ ID NO: 3962376 - RNA, 19 nt, Staphylococcus aureus subsp. aureus Mu50
uauagcaucauaaaguaaa

SEQ ID NO: 3962377 - RNA, 16 nt, Staphylococcus aureus subsp. aureus Mu50
uauagcaucuaugauu

SEQ ID NO: 3962378 - RNA, 19 nt, Staphylococcus aureus subsp. aureus Mu50
uauagcguuuaagaaauca

SEQ ID NO: 3962379 - RNA, 21 nt, Staphylococcus aureus subsp. aureus Mu50
uauaggcccuaacgguagaau

SEQ ID NO: 3962380 - RNA, 19 nt, Staphylococcus aureus subsp. aureus Mu50
uauaggugcaguuaaauua

SEQ ID NO: 3962381 - RNA, 15 nt, Staphylococcus aureus subsp. aureus Mu50
uauagguuuauaaaa

SEQ ID NO: 3962382 - RNA, 18 nt, Staphylococcus aureus subsp. aureus Mu50
uauaguaagaaaagucac

SEQ ID NO: 3962383 - RNA, 18 nt, Staphylococcus aureus subsp. aureus Mu50
uauaguaauagcuauauu

SEQ ID NO: 3962384 - RNA, 23 nt, Staphylococcus aureus subsp. aureus Mu50
uauaguccggggccccaacaaag

SEQ ID NO: 3962385 - RNA, 18 nt, Staphylococcus aureus subsp. aureus Mu50
uauagucuuaaacauaac

SEQ ID NO: 3962386 - RNA, 20 nt, Staphylococcus aureus subsp. aureus Mu50
uauagucuuaaacauaacau

SEQ ID NO: 3962387 - RNA, 14 nt, Staphylococcus aureus subsp. aureus Mu50
uauagugguaaaaa

SEQ ID NO: 3962388 - RNA, 18 nt, Staphylococcus aureus subsp. aureus Mu50
uauagugucgagauuuua

SEQ ID NO: 3962389 - RNA, 20 nt, Staphylococcus aureus subsp. aureus Mu50
uauagugucgagauuuuaua

SEQ ID NO: 3962390 - RNA, 22 nt, Staphylococcus aureus subsp. aureus Mu50
uauaguguucaagcuuuauuuu

SEQ ID NO: 3962391 - RNA, 16 nt, Staphylococcus aureus subsp. aureus Mu50
uauaguuggcaauccu

SEQ ID NO: 3962392 - RNA, 14 nt, Staphylococcus aureus subsp. aureus Mu50
uauauaaaaacugu

SEQ ID NO: 3962393 - RNA, 12 nt, Staphylococcus aureus subsp. aureus Mu50
uauauaaaaaga

SEQ ID NO: 3962394 - RNA, 14 nt, Staphylococcus aureus subsp. aureus Mu50
uauauaaaaucauu

SEQ ID NO: 3962395 - RNA, 16 nt, Staphylococcus aureus subsp. aureus Mu50
uauauaaaaucauuaa

SEQ ID NO: 3962396 - RNA, 20 nt, Staphylococcus aureus subsp. aureus Mu50
uauauaaaaucauuaauaau

SEQ ID NO: 3962397 - RNA, 15 nt, Staphylococcus aureus subsp. aureus Mu50
uauauaaacaaaaau

SEQ ID NO: 3962398 - RNA, 16 nt, Staphylococcus aureus subsp. aureus Mu50
uauauaaagaaauaau

SEQ ID NO: 3962399 - RNA, 20 nt, Staphylococcus aureus subsp. aureus Mu50
uauauaaagcuuugacauau

SEQ ID NO: 3962400 - RNA, 23 nt, Staphylococcus aureus subsp. aureus Mu50
uauauaaaguugacaauacaaau

SEQ ID NO: 3962401 - RNA, 11 nt, Staphylococcus aureus subsp. aureus Mu50
uauauaaauua

SEQ ID NO: 3962402 - RNA, 20 nt, Staphylococcus aureus subsp. aureus Mu50
uauauaacaaguacaauaau

SEQ ID NO: 3962403 - RNA, 13 nt, Staphylococcus aureus subsp. aureus Mu50
uauauaauuuaaa

SEQ ID NO: 3962404 - RNA, 15 nt, Staphylococcus aureus subsp. aureus Mu50
uaucaagaaaaaguu

SEQ ID NO: 3962405 - RNA, 18 nt, Staphylococcus aureus subsp. aureus Mu50
uaucaagaacuuuaaaaa

SEQ ID NO: 3962406 - RNA, 19 nt, Staphylococcus aureus subsp. aureus Mu50
uaucaagaacuuuaaaaau

SEQ ID NO: 3962407 - RNA, 18 nt, Staphylococcus aureus subsp. aureus Mu50
uaucaagaauauaacgaa

SEQ ID NO: 3962408 - RNA, 19 nt, Staphylococcus aureus subsp. aureus Mu50
uaucaagaauauaacgaau

SEQ ID NO: 3962409 - RNA, 12 nt, Staphylococcus aureus subsp. aureus Mu50
uaucaauaaauc

SEQ ID NO: 3962410 - RNA, 15 nt, Staphylococcus aureus subsp. aureus Mu50
uaucaauagaugaaa

SEQ ID NO: 3962411 - RNA, 13 nt, Staphylococcus aureus subsp. aureus Mu50
uaucaauauaauu

SEQ ID NO: 3962412 - RNA, 14 nt, Staphylococcus aureus subsp. aureus Mu50
uaucaaugacaucc

SEQ ID NO: 3962413 - RNA, 15 nt, Staphylococcus aureus subsp. aureus Mu50
uaucaauugaaugaa

SEQ ID NO: 3962414 - RNA, 18 nt, Staphylococcus aureus subsp. aureus Mu50
uaucaauugaaugaagua

SEQ ID NO: 3962415 - RNA, 20 nt, Staphylococcus aureus subsp. aureus Mu50
uaucaauugaaugaaguaau

SEQ ID NO: 3962416 - RNA, 21 nt, Staphylococcus aureus subsp. aureus Mu50
uaucaauuguugcaaaauacg

SEQ ID NO: 3962417 - RNA, 22 nt, Staphylococcus aureus subsp. aureus Mu50
uaucaauuuauuauuaacugua

SEQ ID NO: 3962418 - RNA, 14 nt, Staphylococcus aureus subsp. aureus Mu50
uaucaauuucuauu

SEQ ID NO: 3962419 - RNA, 14 nt, Staphylococcus aureus subsp. aureus Mu50
uaucacaacacaua

SEQ ID NO: 3962420 - RNA, 17 nt, Staphylococcus aureus subsp. aureus Mu50
uaucacauagaguaauu

SEQ ID NO: 3962421 - RNA, 15 nt, Staphylococcus aureus subsp. aureus Mu50
uaucaccuaauugaa

SEQ ID NO: 3962422 - RNA, 13 nt, Staphylococcus aureus subsp. aureus Mu50
uaucacuuauuau

SEQ ID NO: 3962423 - RNA, 13 nt, Staphylococcus aureus subsp. aureus Mu50
uaucagcuuuaau

SEQ ID NO: 3962424 - RNA, 23 nt, Staphylococcus aureus subsp. aureus Mu50
uaucaguccgcuuuuucauagaa

SEQ ID NO: 3962425 - RNA, 14 nt, Staphylococcus aureus subsp. aureus Mu50
uaucagugugauuu

SEQ ID NO: 3962426 - RNA, 18 nt, Staphylococcus aureus subsp. aureus Mu50
uaucaguuuguccuuuaa

SEQ ID NO: 3962427 - RNA, 13 nt, Staphylococcus aureus subsp. aureus Mu50
uaucauaauauug

SEQ ID NO: 3962428 - RNA, 14 nt, Staphylococcus aureus subsp. aureus Mu50
uaucauaauuuugu

SEQ ID NO: 3962429 - RNA, 15 nt, Staphylococcus aureus subsp. aureus Mu50
uaucauaauuuuguu

SEQ ID NO: 3962430 - RNA, 18 nt, Staphylococcus aureus subsp. aureus Mu50
uaucauaccaaaaaguau

SEQ ID NO: 3962431 - RNA, 20 nt, Staphylococcus aureus subsp. aureus Mu50
uaucauaccgacaccuauac

SEQ ID NO: 3962432 - RNA, 22 nt, Staphylococcus aureus subsp. aureus Mu50
uaucauaccgacaccuauacau

SEQ ID NO: 3962433 - RNA, 23 nt, Staphylococcus aureus subsp. aureus Mu50
uaucauaccgacaccuauacaua

SEQ ID NO: 3962434 - RNA, 17 nt, Staphylococcus aureus subsp. aureus Mu50
uaucauauaaaucaaau

SEQ ID NO: 3962435 - RNA, 23 nt, Staphylococcus aureus subsp. aureus Mu50
uaucauauaaaucaaauauacuu

SEQ ID NO: 3962436 - RNA, 14 nt, Staphylococcus aureus subsp. aureus Mu50
uaucauauucaaaa

SEQ ID NO: 3962437 - RNA, 19 nt, Staphylococcus aureus subsp. aureus Mu50
uaucauauucaaaauaacu

SEQ ID NO: 3962438 - RNA, 12 nt, Staphylococcus aureus subsp. aureus Mu50
uaucauauuuga

SEQ ID NO: 3962439 - RNA, 23 nt, Staphylococcus aureus subsp. aureus Mu50
uaucaucaaucguuaauuuccaa

SEQ ID NO: 3962440 - RNA, 19 nt, Staphylococcus aureus subsp. aureus Mu50
uaucaucauacuucaauaa

SEQ ID NO: 3962441 - RNA, 12 nt, Staphylococcus aureus subsp. aureus Mu50
uaucaucaugac

SEQ ID NO: 3962442 - RNA, 21 nt, Staphylococcus aureus subsp. aureus Mu50
uaucaucaugacuauuucgcu

SEQ ID NO: 3962443 - RNA, 16 nt, Staphylococcus aureus subsp. aureus Mu50
uaucaucauuuaaaua

SEQ ID NO: 3962444 - RNA, 18 nt, Staphylococcus aureus subsp. aureus Mu50
uaucaucugcauuuaauu

SEQ ID NO: 3962445 - RNA, 17 nt, Staphylococcus aureus subsp. aureus Mu50
uaucaugaugauaaauu

SEQ ID NO: 3962446 - RNA, 14 nt, Staphylococcus aureus subsp. aureus Mu50
uaucaugauuaauu

SEQ ID NO: 3962447 - RNA, 19 nt, Staphylococcus aureus subsp. aureus Mu50
uaucaugauuaauuaaaga

SEQ ID NO: 3962448 - RNA, 19 nt, Staphylococcus aureus subsp. aureus Mu50
uaucauguucuuauaaaaa

SEQ ID NO: 3962449 - RNA, 20 nt, Staphylococcus aureus subsp. aureus Mu50
uaucauguucuuauaaaaaa

SEQ ID NO: 3962450 - RNA, 18 nt, Staphylococcus aureus subsp. aureus Mu50
uaucauuaaguacuuuua

SEQ ID NO: 3962451 - RNA, 20 nt, Staphylococcus aureus subsp. aureus Mu50
uaucauuacagauaauuauu

SEQ ID NO: 3962452 - RNA, 13 nt, Staphylococcus aureus subsp. aureus Mu50
uaucauuaucaaa

SEQ ID NO: 3962453 - RNA, 18 nt, Staphylococcus aureus subsp. aureus Mu50
uaucauuaucaaauaacc

SEQ ID NO: 3962454 - RNA, 20 nt, Staphylococcus aureus subsp. aureus Mu50
uaucauuaucaaauaaccua

SEQ ID NO: 3962455 - RNA, 12 nt, Staphylococcus aureus subsp. aureus Mu50
uaucauuauuug

SEQ ID NO: 3962456 - RNA, 15 nt, Staphylococcus aureus subsp. aureus Mu50
uaucauucauuacuu

SEQ ID NO: 3962457 - RNA, 21 nt, Staphylococcus aureus subsp. aureus Mu50
uaucauuguguccauaaauau

SEQ ID NO: 3962458 - RNA, 22 nt, Staphylococcus aureus subsp. aureus Mu50
uaucauuguguccauaaauauu

SEQ ID NO: 3962459 - RNA, 17 nt, Staphylococcus aureus subsp. aureus Mu50
uaucauuuaaaauauuu

SEQ ID NO: 3962460 - RNA, 23 nt, Staphylococcus aureus subsp. aureus Mu50
uaucauuuaaaauauuuuuucug

SEQ ID NO: 3962461 - RNA, 16 nt, Staphylococcus aureus subsp. aureus Mu50
uaucauuucaaauaag

SEQ ID NO: 3962462 - RNA, 19 nt, Staphylococcus aureus subsp. aureus Mu50
uaucauuucaaauaagaau

SEQ ID NO: 3962463 - RNA, 20 nt, Staphylococcus aureus subsp. aureus Mu50
uauccaaaauccugaaauua

SEQ ID NO: 3962464 - RNA, 13 nt, Staphylococcus aureus subsp. aureus Mu50
uauccaaagacau

SEQ ID NO: 3962465 - RNA, 21 nt, Staphylococcus aureus subsp. aureus Mu50
uauccaaggauguuauaaaau

SEQ ID NO: 3962466 - RNA, 21 nt, Staphylococcus aureus subsp. aureus Mu50
uauccaauacuaccuuccauu

SEQ ID NO: 3962467 - RNA, 22 nt, Staphylococcus aureus subsp. aureus Mu50
uauccaauacuaccuuccauuu

SEQ ID NO: 3962468 - RNA, 15 nt, Staphylococcus aureus subsp. aureus Mu50
uauccauguauuuuu

SEQ ID NO: 3962469 - RNA, 20 nt, Staphylococcus aureus subsp. aureus Mu50
uauccauguauuuuucuacc

SEQ ID NO: 3962470 - RNA, 20 nt, Staphylococcus aureus subsp. aureus Mu50
uauccauucaauguuuaauu

SEQ ID NO: 3962471 - RNA, 16 nt, Staphylococcus aureus subsp. aureus Mu50
uauccccauuuaugug

SEQ ID NO: 3962472 - RNA, 23 nt, Staphylococcus aureus subsp. aureus Mu50
uauccgaaaauugcuaaaaaaau

SEQ ID NO: 3962473 - RNA, 24 nt, Staphylococcus aureus subsp. aureus Mu50
uauccgcaucuuuugguuuaucug

SEQ ID NO: 3962474 - RNA, 15 nt, Staphylococcus aureus subsp. aureus Mu50
uauccucaaauauau

SEQ ID NO: 3962475 - RNA, 17 nt, Staphylococcus aureus subsp. aureus Mu50
uauccucgguauuuaau

SEQ ID NO: 3962476 - RNA, 13 nt, Staphylococcus aureus subsp. aureus Mu50
uauccugauuuaa

SEQ ID NO: 3962477 - RNA, 14 nt, Staphylococcus aureus subsp. aureus Mu50
uauccugauuuaau

SEQ ID NO: 3962478 - RNA, 16 nt, Staphylococcus aureus subsp. aureus Mu50
uauccuucucaucauu

SEQ ID NO: 3962479 - RNA, 20 nt, Staphylococcus aureus subsp. aureus Mu50
uauccuucucaucauuuuca

SEQ ID NO: 3962480 - RNA, 14 nt, Staphylococcus aureus subsp. aureus Mu50
uauccuuuuugacu

SEQ ID NO: 3962481 - RNA, 22 nt, Staphylococcus aureus subsp. aureus Mu50
uaucgaaagguauaucuucauu

SEQ ID NO: 3962482 - RNA, 21 nt, Staphylococcus aureus subsp. aureus Mu50
uaucgaagaaacauuauauaa

SEQ ID NO: 3962483 - RNA, 23 nt, Staphylococcus aureus subsp. aureus Mu50
uaucgagcguaauggauuauuau

SEQ ID NO: 3962484 - RNA, 14 nt, Staphylococcus aureus subsp. aureus Mu50
uaucgauaguucua

SEQ ID NO: 3962485 - RNA, 17 nt, Staphylococcus aureus subsp. aureus Mu50
uaucgauaguucuauau

SEQ ID NO: 3962486 - RNA, 21 nt, Staphylococcus aureus subsp. aureus Mu50
uaucgauaguucuauauaauu

SEQ ID NO: 3962487 - RNA, 18 nt, Staphylococcus aureus subsp. aureus Mu50
uaucgauucgauuauuua

SEQ ID NO: 3962488 - RNA, 22 nt, Staphylococcus aureus subsp. aureus Mu50
uaucgauucgauuauuuagaua

SEQ ID NO: 3962489 - RNA, 20 nt, Staphylococcus aureus subsp. aureus Mu50
uaucgcccauaccaccaguc

SEQ ID NO: 3962490 - RNA, 16 nt, Staphylococcus aureus subsp. aureus Mu50
uaucgcgcaucaaaaa

SEQ ID NO: 3962491 - RNA, 21 nt, Staphylococcus aureus subsp. aureus Mu50
uaucgcuuuugaaguuggucc

SEQ ID NO: 3962492 - RNA, 16 nt, Staphylococcus aureus subsp. aureus Mu50
uaucguaaacaacauc

SEQ ID NO: 3962493 - RNA, 15 nt, Staphylococcus aureus subsp. aureus Mu50
uaucgucgcuaauaa

SEQ ID NO: 3962494 - RNA, 15 nt, Staphylococcus aureus subsp. aureus Mu50
uaucguuaccuuuua

SEQ ID NO: 3962495 - RNA, 20 nt, Staphylococcus aureus subsp. aureus Mu50
uaucguuguaccaccccaac

SEQ ID NO: 3962496 - RNA, 15 nt, Staphylococcus aureus subsp. aureus Mu50
uaucguuuauugaua

SEQ ID NO: 3962497 - RNA, 22 nt, Staphylococcus aureus subsp. aureus Mu50
uaucuaaagcuauaaaaaaucu

SEQ ID NO: 3962498 - RNA, 23 nt, Staphylococcus aureus subsp. aureus Mu50
uaucuaacaaucguuuuaaugcc

SEQ ID NO: 3962499 - RNA, 11 nt, Staphylococcus aureus subsp. aureus Mu50
uaucuaagucg

SEQ ID NO: 3962500 - RNA, 23 nt, Staphylococcus aureus subsp. aureus Mu50
uaucuaaugaucaucuauauuua

SEQ ID NO: 3962501 - RNA, 18 nt, Staphylococcus aureus subsp. aureus Mu50
uaucuacagagaaucaau

SEQ ID NO: 3962502 - RNA, 18 nt, Staphylococcus aureus subsp. aureus Mu50
uaucuacaugguuuucac

SEQ ID NO: 3962503 - RNA, 16 nt, Staphylococcus aureus subsp. aureus Mu50
uaucuagccugaaaua

SEQ ID NO: 3962504 - RNA, 16 nt, Staphylococcus aureus subsp. aureus Mu50
uaucuaguguucucau

SEQ ID NO: 3962505 - RNA, 17 nt, Staphylococcus aureus subsp. aureus Mu50
uaucuaguguucucauu

SEQ ID NO: 3962506 - RNA, 23 nt, Staphylococcus aureus subsp. aureus Mu50
uaucuaguguucucauuauaaug

SEQ ID NO: 3962507 - RNA, 13 nt, Staphylococcus aureus subsp. aureus Mu50
uaucuauaugcau

SEQ ID NO: 3962508 - RNA, 18 nt, Staphylococcus aureus subsp. aureus Mu50
uaucuauaugcauauauu

SEQ ID NO: 3962509 - RNA, 13 nt, Staphylococcus aureus subsp. aureus Mu50
uaucuaugaaauu

SEQ ID NO: 3962510 - RNA, 18 nt, Staphylococcus aureus subsp. aureus Mu50
uaucucaaagauuccugu

SEQ ID NO: 3962511 - RNA, 23 nt, Staphylococcus aureus subsp. aureus Mu50
uaucuccgcuacaauuauaugua

SEQ ID NO: 3962512 - RNA, 18 nt, Staphylococcus aureus subsp. aureus Mu50
uaucugacauuguugcua

SEQ ID NO: 3962513 - RNA, 14 nt, Staphylococcus aureus subsp. aureus Mu50
uaucugacauuuaa

SEQ ID NO: 3962514 - RNA, 14 nt, Staphylococcus aureus subsp. aureus Mu50
uaucugcuuuucua

SEQ ID NO: 3962515 - RNA, 16 nt, Staphylococcus aureus subsp. aureus Mu50
uaucuggauuaacugu

SEQ ID NO: 3962516 - RNA, 19 nt, Staphylococcus aureus subsp. aureus Mu50
uaucuguaccguauuuuaa

SEQ ID NO: 3962517 - RNA, 13 nt, Staphylococcus aureus subsp. aureus Mu50
uaucuguugucau

SEQ ID NO: 3962518 - RNA, 19 nt, Staphylococcus aureus subsp. aureus Mu50
uaucuuaaagaauuaagua

SEQ ID NO: 3962519 - RNA, 22 nt, Staphylococcus aureus subsp. aureus Mu50
uaucuuaaucagcuauaaaagu

SEQ ID NO: 3962520 - RNA, 19 nt, Staphylococcus aureus subsp. aureus Mu50
uaucuuacuacuuaauuaa

SEQ ID NO: 3962521 - RNA, 17 nt, Staphylococcus aureus subsp. aureus Mu50
uaucuuauaacaaaaau

SEQ ID NO: 3962522 - RNA, 18 nt, Staphylococcus aureus subsp. aureus Mu50
uaucuuauaacaaaaauu

SEQ ID NO: 3962523 - RNA, 14 nt, Staphylococcus aureus subsp. aureus Mu50
uaucuuauauucuu

SEQ ID NO: 3962524 - RNA, 22 nt, Staphylococcus aureus subsp. aureus Mu50
uaucuucagauucccaaauagu

SEQ ID NO: 3962525 - RNA, 17 nt, Staphylococcus aureus subsp. aureus Mu50
uaucuucaguaauuucu

SEQ ID NO: 3962526 - RNA, 14 nt, Staphylococcus aureus subsp. aureus Mu50
uaucuucauuuaaa

SEQ ID NO: 3962527 - RNA, 12 nt, Staphylococcus aureus subsp. aureus Mu50
uaucuucuucua

SEQ ID NO: 3962528 - RNA, 11 nt, Staphylococcus aureus subsp. aureus Mu50
uaucuuuaauu

SEQ ID NO: 3962529 - RNA, 22 nt, Staphylococcus aureus subsp. aureus Mu50
uaucuuuacgauaaacuaaaaa

SEQ ID NO: 3962530 - RNA, 22 nt, Staphylococcus aureus subsp. aureus Mu50
uaucuuuaugauaauuaauuaa

SEQ ID NO: 3962531 - RNA, 17 nt, Staphylococcus aureus subsp. aureus Mu50
uaucuuuauuugauucu

SEQ ID NO: 3962532 - RNA, 14 nt, Staphylococcus aureus subsp. aureus Mu50
uaucuuucaauuaa

SEQ ID NO: 3962533 - RNA, 22 nt, Staphylococcus aureus subsp. aureus Mu50
uaucuuuuguuguuuccuuaga

SEQ ID NO: 3962534 - RNA, 23 nt, Staphylococcus aureus subsp. aureus Mu50
uaucuuuuuacugcacuuuuauu

SEQ ID NO: 3962535 - RNA, 23 nt, Staphylococcus aureus subsp. aureus Mu50
uaugaaaacauuauuaagugagu

SEQ ID NO: 3962536 - RNA, 13 nt, Staphylococcus aureus subsp. aureus Mu50
uaugaaaaguaaa

SEQ ID NO: 3962537 - RNA, 19 nt, Staphylococcus aureus subsp. aureus Mu50
uaugaaauuggaauagaug

SEQ ID NO: 3962538 - RNA, 14 nt, Staphylococcus aureus subsp. aureus Mu50
uaugaaauuucagu

SEQ ID NO: 3962539 - RNA, 15 nt, Staphylococcus aureus subsp. aureus Mu50
uaugaacaauaagug

SEQ ID NO: 3962540 - RNA, 21 nt, Staphylococcus aureus subsp. aureus Mu50
uaugaaguaagcagagccaua

SEQ ID NO: 3962541 - RNA, 14 nt, Staphylococcus aureus subsp. aureus Mu50
uaugaauagaugau

SEQ ID NO: 3962542 - RNA, 13 nt, Staphylococcus aureus subsp. aureus Mu50
uaugaaucauuuu

SEQ ID NO: 3962543 - RNA, 14 nt, Staphylococcus aureus subsp. aureus Mu50
uaugaaucauuuua

SEQ ID NO: 3962544 - RNA, 17 nt, Staphylococcus aureus subsp. aureus Mu50
uaugaaucgauauaaug

SEQ ID NO: 3962545 - RNA, 22 nt, Staphylococcus aureus subsp. aureus Mu50
uaugaauggcaaucuauauaaa

SEQ ID NO: 3962546 - RNA, 17 nt, Staphylococcus aureus subsp. aureus Mu50
uaugaauuauuaauaag

SEQ ID NO: 3962547 - RNA, 13 nt, Staphylococcus aureus subsp. aureus Mu50
uaugaauuuuaua

SEQ ID NO: 3962548 - RNA, 15 nt, Staphylococcus aureus subsp. aureus Mu50
uaugaauuuuauaaa

SEQ ID NO: 3962549 - RNA, 20 nt, Staphylococcus aureus subsp. aureus Mu50
uaugaauuuuauaaauuaaa

SEQ ID NO: 3962550 - RNA, 12 nt, Staphylococcus aureus subsp. aureus Mu50
uaugacaacaua

SEQ ID NO: 3962551 - RNA, 14 nt, Staphylococcus aureus subsp. aureus Mu50
uaugaccuuuaugu

SEQ ID NO: 3962552 - RNA, 19 nt, Staphylococcus aureus subsp. aureus Mu50
uaugacugcaaauacgagu

SEQ ID NO: 3962553 - RNA, 16 nt, Staphylococcus aureus subsp. aureus Mu50
uaugacuuaccuaaua

SEQ ID NO: 3962554 - RNA, 21 nt, Staphylococcus aureus subsp. aureus Mu50
uaugacuuauuuuucaucauu

SEQ ID NO: 3962555 - RNA, 18 nt, Staphylococcus aureus subsp. aureus Mu50
uaugagcuuaauaaauug

SEQ ID NO: 3962556 - RNA, 21 nt, Staphylococcus aureus subsp. aureus Mu50
uaugaguccuuuuuaguaguu

SEQ ID NO: 3962557 - RNA, 22 nt, Staphylococcus aureus subsp. aureus Mu50
uaugaguccuuuuuaguaguuu

SEQ ID NO: 3962558 - RNA, 23 nt, Staphylococcus aureus subsp. aureus Mu50
uaugauaaauauuguguuuagga

SEQ ID NO: 3962559 - RNA, 15 nt, Staphylococcus aureus subsp. aureus Mu50
uaugauaaccaaacc

SEQ ID NO: 3962560 - RNA, 20 nt, Staphylococcus aureus subsp. aureus Mu50
uaugauaauuaauuaaaauu

SEQ ID NO: 3962561 - RNA, 21 nt, Staphylococcus aureus subsp. aureus Mu50
uaugauacgcuuuuuaaaaaa

SEQ ID NO: 3962562 - RNA, 23 nt, Staphylococcus aureus subsp. aureus Mu50
uaugauacgcuuuuuaaaaaauu

SEQ ID NO: 3962563 - RNA, 22 nt, Staphylococcus aureus subsp. aureus Mu50
uaugauagaauacuaaaagugu

SEQ ID NO: 3962564 - RNA, 15 nt, Staphylococcus aureus subsp. aureus Mu50
uaugauccuuuaaug

SEQ ID NO: 3962565 - RNA, 15 nt, Staphylococcus aureus subsp. aureus Mu50
uaugauguuaaaaaa

SEQ ID NO: 3962566 - RNA, 16 nt, Staphylococcus aureus subsp. aureus Mu50
uaugauguuaaaaaau

SEQ ID NO: 3962567 - RNA, 19 nt, Staphylococcus aureus subsp. aureus Mu50
uaugauuaauaaaguaauc

SEQ ID NO: 3962568 - RNA, 12 nt, Staphylococcus aureus subsp. aureus Mu50
uaugauuuaaaa

SEQ ID NO: 3962569 - RNA, 18 nt, Staphylococcus aureus subsp. aureus Mu50
uaugauuugauuugggua

SEQ ID NO: 3962570 - RNA, 21 nt, Staphylococcus aureus subsp. aureus Mu50
uaugauuuguuugauuuauua

SEQ ID NO: 3962571 - RNA, 22 nt, Staphylococcus aureus subsp. aureus Mu50
uaugauuuucuuuaauaacuaa

SEQ ID NO: 3962572 - RNA, 16 nt, Staphylococcus aureus subsp. aureus Mu50
uaugcaaaauuaauga

SEQ ID NO: 3962573 - RNA, 16 nt, Staphylococcus aureus subsp. aureus Mu50
uaugcaaaugaaauuc

SEQ ID NO: 3962574 - RNA, 20 nt, Staphylococcus aureus subsp. aureus Mu50
uaugcaaugcaccuauaaua

SEQ ID NO: 3962575 - RNA, 20 nt, Staphylococcus aureus subsp. aureus Mu50
uaugcauaauaccaauugcu

SEQ ID NO: 3962576 - RNA, 23 nt, Staphylococcus aureus subsp. aureus Mu50
uaugcauccuaaaaaggcaagca

SEQ ID NO: 3962577 - RNA, 19 nt, Staphylococcus aureus subsp. aureus Mu50
uaugcaugccagaugcaau

SEQ ID NO: 3962578 - RNA, 22 nt, Staphylococcus aureus subsp. aureus Mu50
uauuacuacauaauuuaucaau

SEQ ID NO: 3962579 - RNA, 12 nt, Staphylococcus aureus subsp. aureus Mu50
uauuacuauaaa

SEQ ID NO: 3962580 - RNA, 19 nt, Staphylococcus aureus subsp. aureus Mu50
uauuacuauaaaaaacagc

SEQ ID NO: 3962581 - RNA, 19 nt, Staphylococcus aureus subsp. aureus Mu50
uauuacugauuguuaacga

SEQ ID NO: 3962582 - RNA, 15 nt, Staphylococcus aureus subsp. aureus Mu50
uauuacuuauuucuu

SEQ ID NO: 3962583 - RNA, 20 nt, Staphylococcus aureus subsp. aureus Mu50
uauuacuuauuucuuuucau

SEQ ID NO: 3962584 - RNA, 19 nt, Staphylococcus aureus subsp. aureus Mu50
uauuacuuuggaaauuuau

SEQ ID NO: 3962585 - RNA, 23 nt, Staphylococcus aureus subsp. aureus Mu50
uauuacuuuggaaauuuauuaua

SEQ ID NO: 3962586 - RNA, 14 nt, Staphylococcus aureus subsp. aureus Mu50
uauuagauauauuu

SEQ ID NO: 3962587 - RNA, 18 nt, Staphylococcus aureus subsp. aureus Mu50
uauuagccaauaaaaugu

SEQ ID NO: 3962588 - RNA, 16 nt, Staphylococcus aureus subsp. aureus Mu50
uauuaggcuuaaauau

SEQ ID NO: 3962589 - RNA, 21 nt, Staphylococcus aureus subsp. aureus Mu50
uauuaggcuuaaauauaauga

SEQ ID NO: 3962590 - RNA, 17 nt, Staphylococcus aureus subsp. aureus Mu50
uauuaguuuuuacguuu

SEQ ID NO: 3962591 - RNA, 12 nt, Staphylococcus aureus subsp. aureus Mu50
uauuauaaaaua

SEQ ID NO: 3962592 - RNA, 17 nt, Staphylococcus aureus subsp. aureus Mu50
uauuauaauagagaaac

SEQ ID NO: 3962593 - RNA, 15 nt, Staphylococcus aureus subsp. aureus Mu50
uauuauaauuguuca

SEQ ID NO: 3962594 - RNA, 19 nt, Staphylococcus aureus subsp. aureus Mu50
uauuauaauuguucauugg

SEQ ID NO: 3962595 - RNA, 15 nt, Staphylococcus aureus subsp. aureus Mu50
uauuauaauuuuguu

SEQ ID NO: 3962596 - RNA, 19 nt, Staphylococcus aureus subsp. aureus Mu50
uauuauacugcucuuuaua

SEQ ID NO: 3962597 - RNA, 22 nt, Staphylococcus aureus subsp. aureus Mu50
uauuauacugcucuuuauauau

SEQ ID NO: 3962598 - RNA, 11 nt, Staphylococcus aureus subsp. aureus Mu50
uauuauagaac

SEQ ID NO: 3962599 - RNA, 17 nt, Staphylococcus aureus subsp. aureus Mu50
uauuauauaauaagaga

SEQ ID NO: 3962600 - RNA, 15 nt, Staphylococcus aureus subsp. aureus Mu50
uauuauccucaaaua

SEQ ID NO: 3962601 - RNA, 19 nt, Staphylococcus aureus subsp. aureus Mu50
uauuauccucaaauauauu

SEQ ID NO: 3962602 - RNA, 15 nt, Staphylococcus aureus subsp. aureus Mu50
uauuaucuauccauu

SEQ ID NO: 3962603 - RNA, 16 nt, Staphylococcus aureus subsp. aureus Mu50
uauuaugaauuauuaa

SEQ ID NO: 3962604 - RNA, 22 nt, Staphylococcus aureus subsp. aureus Mu50
uauuaugauugcuuauuuauuu

SEQ ID NO: 3962605 - RNA, 18 nt, Staphylococcus aureus subsp. aureus Mu50
uauuaugccauucauuaa

SEQ ID NO: 3962606 - RNA, 16 nt, Staphylococcus aureus subsp. aureus Mu50
uauuaugccuuugauu

SEQ ID NO: 3962607 - RNA, 14 nt, Staphylococcus aureus subsp. aureus Mu50
uauuauuaauuccu

SEQ ID NO: 3962608 - RNA, 17 nt, Staphylococcus aureus subsp. aureus Mu50
uauuauuacaaugaaaa

SEQ ID NO: 3962609 - RNA, 16 nt, Staphylococcus aureus subsp. aureus Mu50
uauuauuacuuaucug

SEQ ID NO: 3962610 - RNA, 14 nt, Staphylococcus aureus subsp. aureus Mu50
uauuauuauaauuu

SEQ ID NO: 3962611 - RNA, 15 nt, Staphylococcus aureus subsp. aureus Mu50
uauuauuauaauuuu

SEQ ID NO: 3962612 - RNA, 14 nt, Staphylococcus aureus subsp. aureus Mu50
uauuauuaugugua

SEQ ID NO: 3962613 - RNA, 15 nt, Staphylococcus aureus subsp. aureus Mu50
uauuauuauguuaua

SEQ ID NO: 3962614 - RNA, 17 nt, Staphylococcus aureus subsp. aureus Mu50
uauuauucauaauauau

SEQ ID NO: 3962615 - RNA, 18 nt, Staphylococcus aureus subsp. aureus Mu50
uauuauucauaauauauu

SEQ ID NO: 3962616 - RNA, 13 nt, Staphylococcus aureus subsp. aureus Mu50
uauuauucucuca

SEQ ID NO: 3962617 - RNA, 15 nt, Staphylococcus aureus subsp. aureus Mu50
uauuauucucucauu

SEQ ID NO: 3962618 - RNA, 14 nt, Staphylococcus aureus subsp. aureus Mu50
uauuauucuuuaua

SEQ ID NO: 3962619 - RNA, 16 nt, Staphylococcus aureus subsp. aureus Mu50
uauuauugucaucaug

SEQ ID NO: 3962620 - RNA, 16 nt, Staphylococcus aureus subsp. aureus Mu50
uauuauugugaaaucu

SEQ ID NO: 3962621 - RNA, 15 nt, Staphylococcus aureus subsp. aureus Mu50
uauuauuuaaauuuu

SEQ ID NO: 3962622 - RNA, 15 nt, Staphylococcus aureus subsp. aureus Mu50
uauuauuuaaucuau

SEQ ID NO: 3962623 - RNA, 19 nt, Staphylococcus aureus subsp. aureus Mu50
uauuauuuuguauuuuuca

SEQ ID NO: 3962624 - RNA, 17 nt, Staphylococcus aureus subsp. aureus Mu50
uauucaaaaaauauuua

SEQ ID NO: 3962625 - RNA, 22 nt, Staphylococcus aureus subsp. aureus Mu50
uauucaaacaguccuuauuaua

SEQ ID NO: 3962626 - RNA, 15 nt, Staphylococcus aureus subsp. aureus Mu50
uauucaacuuauuau

SEQ ID NO: 3962627 - RNA, 16 nt, Staphylococcus aureus subsp. aureus Mu50
uauucaacuuauuauu

SEQ ID NO: 3962628 - RNA, 17 nt, Staphylococcus aureus subsp. aureus Mu50
uauucaauaauuauuaa

SEQ ID NO: 3962629 - RNA, 19 nt, Staphylococcus aureus subsp. aureus Mu50
uauucaauaauuauuaauu

SEQ ID NO: 3962630 - RNA, 19 nt, Staphylococcus aureus subsp. aureus Mu50
uauucaaugauuaguaaug

SEQ ID NO: 3962631 - RNA, 14 nt, Staphylococcus aureus subsp. aureus Mu50
uauucaauucugug

SEQ ID NO: 3962632 - RNA, 18 nt, Staphylococcus aureus subsp. aureus Mu50
uauucacgaacauuacuu

SEQ ID NO: 3962633 - RNA, 23 nt, Staphylococcus aureus subsp. aureus Mu50
uauucacgauauaacauuaaaau

SEQ ID NO: 3962634 - RNA, 19 nt, Staphylococcus aureus subsp. aureus Mu50
uauucacgcguucaaaugu

SEQ ID NO: 3962635 - RNA, 19 nt, Staphylococcus aureus subsp. aureus Mu50
uauucacuuuuuuuaauuu

SEQ ID NO: 3962636 - RNA, 22 nt, Staphylococcus aureus subsp. aureus Mu50
uauucacuuuuuuuaauuugau

SEQ ID NO: 3962637 - RNA, 19 nt, Staphylococcus aureus subsp. aureus Mu50
uauucagucaguaaaaaua

SEQ ID NO: 3962638 - RNA, 21 nt, Staphylococcus aureus subsp. aureus Mu50
uauucagucaguaaaaauaca

SEQ ID NO: 3962639 - RNA, 19 nt, Staphylococcus aureus subsp. aureus Mu50
uauucaucucuuauaaguu

SEQ ID NO: 3962640 - RNA, 18 nt, Staphylococcus aureus subsp. aureus Mu50
uauucauguucuuguaau

SEQ ID NO: 3962641 - RNA, 15 nt, Staphylococcus aureus subsp. aureus Mu50
uauucauuuguguuc

SEQ ID NO: 3962642 - RNA, 13 nt, Staphylococcus aureus subsp. aureus Mu50
uauucauuuuaaa

SEQ ID NO: 3962643 - RNA, 23 nt, Staphylococcus aureus subsp. aureus Mu50
uauuccauugauguaugugagua

SEQ ID NO: 3962644 - RNA, 22 nt, Staphylococcus aureus subsp. aureus Mu50
uauuccauuggaaguucuuuug

SEQ ID NO: 3962645 - RNA, 13 nt, Staphylococcus aureus subsp. aureus Mu50
uauucccaaaaug

SEQ ID NO: 3962646 - RNA, 21 nt, Staphylococcus aureus subsp. aureus Mu50
uauuccgaacauguuucuaga

SEQ ID NO: 3962647 - RNA, 19 nt, Staphylococcus aureus subsp. aureus Mu50
uauucgaacgauauuuuaa

SEQ ID NO: 3962648 - RNA, 17 nt, Staphylococcus aureus subsp. aureus Mu50
uauucgauaauauaacu

SEQ ID NO: 3962649 - RNA, 24 nt, Staphylococcus aureus subsp. aureus Mu50
uauucgauaauauaacugcaugua

SEQ ID NO: 3962650 - RNA, 20 nt, Staphylococcus aureus subsp. aureus Mu50
uauucgauacauaaaacauc

SEQ ID NO: 3962651 - RNA, 14 nt, Staphylococcus aureus subsp. aureus Mu50
uauucgcaccacug

SEQ ID NO: 3962652 - RNA, 12 nt, Staphylococcus aureus subsp. aureus Mu50
uauucggcaaaa

SEQ ID NO: 3962653 - RNA, 15 nt, Staphylococcus aureus subsp. aureus Mu50
uauucgguuaauauu

SEQ ID NO: 3962654 - RNA, 21 nt, Staphylococcus aureus subsp. aureus Mu50
uauucgguuaauauucuuucg

SEQ ID NO: 3962655 - RNA, 16 nt, Staphylococcus aureus subsp. aureus Mu50
uauucuaaaaaauuaa

SEQ ID NO: 3962656 - RNA, 20 nt, Staphylococcus aureus subsp. aureus Mu50
uauucuaaaaaauuaaaaau

SEQ ID NO: 3962657 - RNA, 16 nt, Staphylococcus aureus subsp. aureus Mu50
uauucuaaauauauuu

SEQ ID NO: 3962658 - RNA, 14 nt, Staphylococcus aureus subsp. aureus Mu50
uauucuaauacaaa

SEQ ID NO: 3962659 - RNA, 20 nt, Staphylococcus aureus subsp. aureus Mu50
uauucuagauucauauuuau

SEQ ID NO: 3962660 - RNA, 12 nt, Staphylococcus aureus subsp. aureus Mu50
uauucuauuuuu

SEQ ID NO: 3962661 - RNA, 15 nt, Staphylococcus aureus subsp. aureus Mu50
uauucuauuuuucaa

SEQ ID NO: 3962662 - RNA, 22 nt, Staphylococcus aureus subsp. aureus Mu50
uauucucugcuucuaaaacauc

SEQ ID NO: 3962663 - RNA, 18 nt, Staphylococcus aureus subsp. aureus Mu50
uauucugagauugagaau

SEQ ID NO: 3962664 - RNA, 17 nt, Staphylococcus aureus subsp. aureus Mu50
uauucuguaacguuacu

SEQ ID NO: 3962665 - RNA, 17 nt, Staphylococcus aureus subsp. aureus Mu50
uauucuuaaaagacauc

SEQ ID NO: 3962666 - RNA, 17 nt, Staphylococcus aureus subsp. aureus Mu50
uauuuauacuauaaaua

SEQ ID NO: 3962667 - RNA, 19 nt, Staphylococcus aureus subsp. aureus Mu50
uauuuauacuauaaauaca

SEQ ID NO: 3962668 - RNA, 13 nt, Staphylococcus aureus subsp. aureus Mu50
uauuuauagauuu

SEQ ID NO: 3962669 - RNA, 15 nt, Staphylococcus aureus subsp. aureus Mu50
uauuuauauuaaaua

SEQ ID NO: 3962670 - RNA, 15 nt, Staphylococcus aureus subsp. aureus Mu50
uauuuaucucuuucu

SEQ ID NO: 3962671 - RNA, 18 nt, Staphylococcus aureus subsp. aureus Mu50
uauuuaucucuuucuuca

SEQ ID NO: 3962672 - RNA, 12 nt, Staphylococcus aureus subsp. aureus Mu50
uauuuaucuuua

SEQ ID NO: 3962673 - RNA, 14 nt, Staphylococcus aureus subsp. aureus Mu50
uauuuaucuuuaga

SEQ ID NO: 3962674 - RNA, 10 nt, Staphylococcus aureus subsp. aureus Mu50
uauuuauuca

SEQ ID NO: 3962675 - RNA, 23 nt, Staphylococcus aureus subsp. aureus Mu50
uauuuauucuaaucuaaauucag

SEQ ID NO: 3962676 - RNA, 15 nt, Staphylococcus aureus subsp. aureus Mu50
uauuuauuuuauaau

SEQ ID NO: 3962677 - RNA, 17 nt, Staphylococcus aureus subsp. aureus Mu50
uauuuauuuuauaauaa

SEQ ID NO: 3962678 - RNA, 22 nt, Staphylococcus aureus subsp. aureus Mu50
uauuuauuuugauuaacacaau

SEQ ID NO: 3962679 - RNA, 13 nt, Staphylococcus aureus subsp. aureus Mu50
uauuucaaaugua

SEQ ID NO: 3962680 - RNA, 14 nt, Staphylococcus aureus subsp. aureus Mu50
uauuucaaauguaa

SEQ ID NO: 3962681 - RNA, 16 nt, Staphylococcus aureus subsp. aureus Mu50
uauuucaacaaacaua

SEQ ID NO: 3962682 - RNA, 16 nt, Staphylococcus aureus subsp. aureus Mu50
uauuucaauaauaaug

SEQ ID NO: 3962683 - RNA, 15 nt, Staphylococcus aureus subsp. aureus Mu50
uauuucaauuaucaa

SEQ ID NO: 3962684 - RNA, 21 nt, Staphylococcus aureus subsp. aureus Mu50
uauuucacacagcuucauuaa

SEQ ID NO: 3962685 - RNA, 21 nt, Staphylococcus aureus subsp. aureus Mu50
uauuucacucuacaauccuau

SEQ ID NO: 3962686 - RNA, 14 nt, Staphylococcus aureus subsp. aureus Mu50
uauuucagcuuauu

SEQ ID NO: 3962687 - RNA, 16 nt, Staphylococcus aureus subsp. aureus Mu50
uauuucagcuuauuaa

SEQ ID NO: 3962688 - RNA, 19 nt, Staphylococcus aureus subsp. aureus Mu50
uauuucauagggaaauauu

SEQ ID NO: 3962689 - RNA, 14 nt, Staphylococcus aureus subsp. aureus Mu50
uauuucauauaugu

SEQ ID NO: 3962690 - RNA, 15 nt, Staphylococcus aureus subsp. aureus Mu50
uauuuccaaauugaa

SEQ ID NO: 3962691 - RNA, 21 nt, Staphylococcus aureus subsp. aureus Mu50
uauuucccuaugaaauaacua

SEQ ID NO: 3962692 - RNA, 20 nt, Staphylococcus aureus subsp. aureus Mu50
uauuucgguauuuuaaauuu

SEQ ID NO: 3962693 - RNA, 20 nt, Staphylococcus aureus subsp. aureus Mu50
uauuucgguuagucuuaauc

SEQ ID NO: 3962694 - RNA, 16 nt, Staphylococcus aureus subsp. aureus Mu50
uauuucuaaauuauuu

SEQ ID NO: 3962695 - RNA, 21 nt, Staphylococcus aureus subsp. aureus Mu50
uauuucuaaauuauuuauuca

SEQ ID NO: 3962696 - RNA, 22 nt, Staphylococcus aureus subsp. aureus Mu50
uauuucugaaaugauacauuau

SEQ ID NO: 3962697 - RNA, 15 nt, Staphylococcus aureus subsp. aureus Mu50
uauuucugaauuuuu

SEQ ID NO: 3962698 - RNA, 14 nt, Staphylococcus aureus subsp. aureus Mu50
uauuucugggcuuu

SEQ ID NO: 3962699 - RNA, 16 nt, Staphylococcus aureus subsp. aureus Mu50
uauuucuuaccauuua

SEQ ID NO: 3962700 - RNA, 17 nt, Staphylococcus aureus subsp. aureus Mu50
uauuucuuuucauuauc

SEQ ID NO: 3962701 - RNA, 21 nt, Staphylococcus aureus subsp. aureus Mu50
uauuucuuuuugucauuaauc

SEQ ID NO: 3962702 - RNA, 14 nt, Staphylococcus aureus subsp. aureus Mu50
uauuugaaaauauu

SEQ ID NO: 3962703 - RNA, 16 nt, Staphylococcus aureus subsp. aureus Mu50
uauuugaaaauuucac

SEQ ID NO: 3962704 - RNA, 16 nt, Staphylococcus aureus subsp. aureus Mu50
uauuugaaugcaaauc

SEQ ID NO: 3962705 - RNA, 19 nt, Staphylococcus aureus subsp. aureus Mu50
uauuugacacauuauugaa

SEQ ID NO: 3962706 - RNA, 21 nt, Staphylococcus aureus subsp. aureus Mu50
uauuugacacauuauugaaau

SEQ ID NO: 3962707 - RNA, 16 nt, Staphylococcus aureus subsp. aureus Mu50
uauuugauaaauaaaa

SEQ ID NO: 3962708 - RNA, 15 nt, Staphylococcus aureus subsp. aureus Mu50
uauuugauaauauug

SEQ ID NO: 3962709 - RNA, 15 nt, Staphylococcus aureus subsp. aureus Mu50
uauuugaucguugaa

SEQ ID NO: 3962710 - RNA, 18 nt, Staphylococcus aureus subsp. aureus Mu50
uauuugauuauucuucau

SEQ ID NO: 3962711 - RNA, 14 nt, Staphylococcus aureus subsp. aureus Mu50
uauuugcccgacuu

SEQ ID NO: 3962712 - RNA, 22 nt, Staphylococcus aureus subsp. aureus Mu50
uauuugcuagucauaauuuaaa

SEQ ID NO: 3962713 - RNA, 14 nt, Staphylococcus aureus subsp. aureus Mu50
uauuugcuuuuugu

SEQ ID NO: 3962714 - RNA, 23 nt, Staphylococcus aureus subsp. aureus Mu50
uauuuggguaacauuagcauuaa

SEQ ID NO: 3962715 - RNA, 22 nt, Staphylococcus aureus subsp. aureus Mu50
uauuuguacaugaacaaauaau

SEQ ID NO: 3962716 - RNA, 19 nt, Staphylococcus aureus subsp. aureus Mu50
uauuuguggaaauaaaaca

SEQ ID NO: 3962717 - RNA, 24 nt, Staphylococcus aureus subsp. aureus Mu50
uauuuguuaugguauuuauagauu

SEQ ID NO: 3962718 - RNA, 12 nt, Staphylococcus aureus subsp. aureus Mu50
uauuuuaaaaau

SEQ ID NO: 3962719 - RNA, 12 nt, Staphylococcus aureus subsp. aureus Mu50
uauuuuaaacau

SEQ ID NO: 3962720 - RNA, 22 nt, Staphylococcus aureus subsp. aureus Mu50
uauuuuaaacguaucauuuaaa

SEQ ID NO: 3962721 - RNA, 21 nt, Staphylococcus aureus subsp. aureus Mu50
uauuuuaaauuacaacuuuua

SEQ ID NO: 3962722 - RNA, 19 nt, Staphylococcus aureus subsp. aureus Mu50
uauuuuaaauuuauaauac

SEQ ID NO: 3962723 - RNA, 14 nt, Staphylococcus aureus subsp. aureus Mu50
uauuuuaacuuaau

SEQ ID NO: 3962724 - RNA, 12 nt, Staphylococcus aureus subsp. aureus Mu50
uauuuuaauagc

SEQ ID NO: 3962725 - RNA, 22 nt, Staphylococcus aureus subsp. aureus Mu50
uauuuuaaugggcgauaaaagu

SEQ ID NO: 3962726 - RNA, 13 nt, Staphylococcus aureus subsp. aureus Mu50
uauuuuacaauca

SEQ ID NO: 3962727 - RNA, 14 nt, Staphylococcus aureus subsp. aureus Mu50
uauuuuauaagaau

SEQ ID NO: 3962728 - RNA, 20 nt, Staphylococcus aureus subsp. aureus Mu50
uauuuuauaagaauuuaaaa

SEQ ID NO: 3962729 - RNA, 20 nt, Staphylococcus aureus subsp. aureus Mu50
uauuuuaugacguaauuaau

SEQ ID NO: 3962730 - RNA, 21 nt, Staphylococcus aureus subsp. aureus Mu50
uauuuucaauaaauuuuauau

SEQ ID NO: 3962731 - RNA, 15 nt, Staphylococcus aureus subsp. aureus Mu50
uauuuucaaugauua

SEQ ID NO: 3962732 - RNA, 16 nt, Staphylococcus aureus subsp. aureus Mu50
uauuuucaaugauuaa

SEQ ID NO: 3962733 - RNA, 11 nt, Staphylococcus aureus subsp. aureus Mu50
uauuuucauaa

SEQ ID NO: 3962734 - RNA, 16 nt, Staphylococcus aureus subsp. aureus Mu50
uauuuucauaaacucu

SEQ ID NO: 3962735 - RNA, 21 nt, Staphylococcus aureus subsp. aureus Mu50
uauuuucauagaugcauaaaa

SEQ ID NO: 3962736 - RNA, 13 nt, Staphylococcus aureus subsp. aureus Mu50
uauuuucauuuua

SEQ ID NO: 3962737 - RNA, 13 nt, Staphylococcus aureus subsp. aureus Mu50
uauuuucucuaua

SEQ ID NO: 3962738 - RNA, 17 nt, Staphylococcus aureus subsp. aureus Mu50
uauuuucucuauaauuu

SEQ ID NO: 3962739 - RNA, 18 nt, Staphylococcus aureus subsp. aureus Mu50
uauuuucugccauaaaca

SEQ ID NO: 3962740 - RNA, 19 nt, Staphylococcus aureus subsp. aureus Mu50
uauuuucugccauaaacau

SEQ ID NO: 3962741 - RNA, 12 nt, Staphylococcus aureus subsp. aureus Mu50
uauuuucuuaga

SEQ ID NO: 3962742 - RNA, 21 nt, Staphylococcus aureus subsp. aureus Mu50
uauuuucuuguguauuuuuau

SEQ ID NO: 3962743 - RNA, 21 nt, Staphylococcus aureus subsp. aureus Mu50
uauuuucuuuuucuaaauaaa

SEQ ID NO: 3962744 - RNA, 22 nt, Staphylococcus aureus subsp. aureus Mu50
uauuuucuuuuucuaaauaaac

SEQ ID NO: 3962745 - RNA, 20 nt, Staphylococcus aureus subsp. aureus Mu50
uauuuugaauaugauauuaa

SEQ ID NO: 3962746 - RNA, 13 nt, Staphylococcus aureus subsp. aureus Mu50
uauuuugcaauaa

SEQ ID NO: 3962747 - RNA, 20 nt, Staphylococcus aureus subsp. aureus Mu50
uauuuugcaauugcaaugaa

SEQ ID NO: 3962748 - RNA, 20 nt, Staphylococcus aureus subsp. aureus Mu50
uauuuuggacugguacuacu

SEQ ID NO: 3962749 - RNA, 14 nt, Staphylococcus aureus subsp. aureus Mu50
uauuuuguauuuuu

SEQ ID NO: 3962750 - RNA, 16 nt, Staphylococcus aureus subsp. aureus Mu50
uauuuuguucaguuaa

SEQ ID NO: 3962751 - RNA, 16 nt, Staphylococcus aureus subsp. aureus Mu50
uauuuuguuuuaaaaa

SEQ ID NO: 3962752 - RNA, 16 nt, Staphylococcus aureus subsp. aureus Mu50
uauuuuuaagcugcuc

SEQ ID NO: 3962753 - RNA, 14 nt, Staphylococcus aureus subsp. aureus Mu50
uauuuuuacauauu

SEQ ID NO: 3962754 - RNA, 23 nt, Staphylococcus aureus subsp. aureus Mu50
ucaaauugguuuucaugugucau

SEQ ID NO: 3962755 - RNA, 21 nt, Staphylococcus aureus subsp. aureus Mu50
ucaaauuuaccgucauuauau

SEQ ID NO: 3962756 - RNA, 18 nt, Staphylococcus aureus subsp. aureus Mu50
ucaacaaacauaaauaag

SEQ ID NO: 3962757 - RNA, 18 nt, Staphylococcus aureus subsp. aureus Mu50
ucaacaaagugcaauuau

SEQ ID NO: 3962758 - RNA, 19 nt, Staphylococcus aureus subsp. aureus Mu50
ucaacaaaucuauaaauau

SEQ ID NO: 3962759 - RNA, 21 nt, Staphylococcus aureus subsp. aureus Mu50
ucaacaaaucuauaaauauca

SEQ ID NO: 3962760 - RNA, 18 nt, Staphylococcus aureus subsp. aureus Mu50
ucaacaaauuuaacuuuc

SEQ ID NO: 3962761 - RNA, 17 nt, Staphylococcus aureus subsp. aureus Mu50
ucaacaaucuuuuucau

SEQ ID NO: 3962762 - RNA, 23 nt, Staphylococcus aureus subsp. aureus Mu50
ucaacaccaacaccuaauauuuu

SEQ ID NO: 3962763 - RNA, 15 nt, Staphylococcus aureus subsp. aureus Mu50
ucaacacuuucuacu

SEQ ID NO: 3962764 - RNA, 20 nt, Staphylococcus aureus subsp. aureus Mu50
ucaacacuuucuacucugau

SEQ ID NO: 3962765 - RNA, 15 nt, Staphylococcus aureus subsp. aureus Mu50
ucaacagauacuuca

SEQ ID NO: 3962766 - RNA, 19 nt, Staphylococcus aureus subsp. aureus Mu50
ucaacagauacuucaguac

SEQ ID NO: 3962767 - RNA, 18 nt, Staphylococcus aureus subsp. aureus Mu50
ucaacagggguaaaacuu

SEQ ID NO: 3962768 - RNA, 14 nt, Staphylococcus aureus subsp. aureus Mu50
ucaacaguuucuug

SEQ ID NO: 3962769 - RNA, 16 nt, Staphylococcus aureus subsp. aureus Mu50
ucaacaguuuuaaaga

SEQ ID NO: 3962770 - RNA, 17 nt, Staphylococcus aureus subsp. aureus Mu50
ucaacauaaaauuuaaa

SEQ ID NO: 3962771 - RNA, 20 nt, Staphylococcus aureus subsp. aureus Mu50
ucaacauaacucaaauaucu

SEQ ID NO: 3962772 - RNA, 18 nt, Staphylococcus aureus subsp. aureus Mu50
ucaacauaauauuucuua

SEQ ID NO: 3962773 - RNA, 13 nt, Staphylococcus aureus subsp. aureus Mu50
ucaacaucaucuu

SEQ ID NO: 3962774 - RNA, 11 nt, Staphylococcus aureus subsp. aureus Mu50
ucaacaucaug

SEQ ID NO: 3962775 - RNA, 16 nt, Staphylococcus aureus subsp. aureus Mu50
ucaacaucaugaacuu

SEQ ID NO: 3962776 - RNA, 19 nt, Staphylococcus aureus subsp. aureus Mu50
ucaacauguuccgcuacaa

SEQ ID NO: 3962777 - RNA, 20 nt, Staphylococcus aureus subsp. aureus Mu50
ucaacauguuccgcuacaaa

SEQ ID NO: 3962778 - RNA, 21 nt, Staphylococcus aureus subsp. aureus Mu50
ucaaccuguucuuuauuuaaa

SEQ ID NO: 3962779 - RNA, 23 nt, Staphylococcus aureus subsp. aureus Mu50
ucaaccuguucuuuauuuaaagg

SEQ ID NO: 3962780 - RNA, 19 nt, Staphylococcus aureus subsp. aureus Mu50
ucaaccuuuuaauaguacu

SEQ ID NO: 3962781 - RNA, 14 nt, Staphylococcus aureus subsp. aureus Mu50
ucaacgauugaauu

SEQ ID NO: 3962782 - RNA, 15 nt, Staphylococcus aureus subsp. aureus Mu50
ucaacgccauauuua

SEQ ID NO: 3962783 - RNA, 15 nt, Staphylococcus aureus subsp. aureus Mu50
ucaacgucaucugcu

SEQ ID NO: 3962784 - RNA, 21 nt, Staphylococcus aureus subsp. aureus Mu50
ucaacgucaucugcuuguaau

SEQ ID NO: 3962785 - RNA, 19 nt, Staphylococcus aureus subsp. aureus Mu50
ucaacgucgaauguuucuu

SEQ ID NO: 3962786 - RNA, 14 nt, Staphylococcus aureus subsp. aureus Mu50
ucaacuaauuuaaa

SEQ ID NO: 3962787 - RNA, 21 nt, Staphylococcus aureus subsp. aureus Mu50
ucaacuaauuuaaagcaucau

SEQ ID NO: 3962788 - RNA, 21 nt, Staphylococcus aureus subsp. aureus Mu50
ucaacugaaauuuuuccgauu

SEQ ID NO: 3962789 - RNA, 18 nt, Staphylococcus aureus subsp. aureus Mu50
ucaacugcugcuaaaaua

SEQ ID NO: 3962790 - RNA, 17 nt, Staphylococcus aureus subsp. aureus Mu50
ucaacugcuucacgauu

SEQ ID NO: 3962791 - RNA, 15 nt, Staphylococcus aureus subsp. aureus Mu50
ucaacuguaccauuu

SEQ ID NO: 3962792 - RNA, 22 nt, Staphylococcus aureus subsp. aureus Mu50
ucaacuucgauaugauuaaagc

SEQ ID NO: 3962793 - RNA, 15 nt, Staphylococcus aureus subsp. aureus Mu50
ucaacuuguuuccua

SEQ ID NO: 3962794 - RNA, 13 nt, Staphylococcus aureus subsp. aureus Mu50
ucaacuuuucuau

SEQ ID NO: 3962795 - RNA, 17 nt, Staphylococcus aureus subsp. aureus Mu50
ucaacuuuuuaauaaua

SEQ ID NO: 3962796 - RNA, 14 nt, Staphylococcus aureus subsp. aureus Mu50
ucaacuuuuuuaac

SEQ ID NO: 3962797 - RNA, 16 nt, Staphylococcus aureus subsp. aureus Mu50
ucaacuuuuuuaacuu

SEQ ID NO: 3962798 - RNA, 14 nt, Staphylococcus aureus subsp. aureus Mu50
ucaagaaaaaguuu

SEQ ID NO: 3962799 - RNA, 15 nt, Staphylococcus aureus subsp. aureus Mu50
ucaagaaauguuaaa

SEQ ID NO: 3962800 - RNA, 10 nt, Staphylococcus aureus subsp. aureus Mu50
ucaagaacaa

SEQ ID NO: 3962801 - RNA, 14 nt, Staphylococcus aureus subsp. aureus Mu50
ucaagaacuuuaaa

SEQ ID NO: 3962802 - RNA, 15 nt, Staphylococcus aureus subsp. aureus Mu50
ucaagaacuuuaaaa

SEQ ID NO: 3962803 - RNA, 18 nt, Staphylococcus aureus subsp. aureus Mu50
ucaagaacuuuaaaaauu

SEQ ID NO: 3962804 - RNA, 19 nt, Staphylococcus aureus subsp. aureus Mu50
ucaagaccaaauauuuuau

SEQ ID NO: 3962805 - RNA, 19 nt, Staphylococcus aureus subsp. aureus Mu50
ucaagaccuucuucucuaa

SEQ ID NO: 3962806 - RNA, 12 nt, Staphylococcus aureus subsp. aureus Mu50
ucaagacgcauu

SEQ ID NO: 3962807 - RNA, 16 nt, Staphylococcus aureus subsp. aureus Mu50
ucaagagguaaaucug

SEQ ID NO: 3962808 - RNA, 19 nt, Staphylococcus aureus subsp. aureus Mu50
ucaagauauccauuaugau

SEQ ID NO: 3962809 - RNA, 17 nt, Staphylococcus aureus subsp. aureus Mu50
ucaagcaaugcaugcuu

SEQ ID NO: 3962810 - RNA, 16 nt, Staphylococcus aureus subsp. aureus Mu50
ucaagcuagcaucaug

SEQ ID NO: 3962811 - RNA, 14 nt, Staphylococcus aureus subsp. aureus Mu50
ucaagcuuaauaag

SEQ ID NO: 3962812 - RNA, 18 nt, Staphylococcus aureus subsp. aureus Mu50
ucaagcuuaauaagcuga

SEQ ID NO: 3962813 - RNA, 17 nt, Staphylococcus aureus subsp. aureus Mu50
ucaagcuuugcugcuuu

SEQ ID NO: 3962814 - RNA, 17 nt, Staphylococcus aureus subsp. aureus Mu50
ucaagguauacacaaau

SEQ ID NO: 3962815 - RNA, 20 nt, Staphylococcus aureus subsp. aureus Mu50
ucaaguaauggauugauaau

SEQ ID NO: 3962816 - RNA, 20 nt, Staphylococcus aureus subsp. aureus Mu50
ucaagugccauuuuuaaauu

SEQ ID NO: 3962817 - RNA, 11 nt, Staphylococcus aureus subsp. aureus Mu50
ucaagugcuug

SEQ ID NO: 3962818 - RNA, 19 nt, Staphylococcus aureus subsp. aureus Mu50
ucaaguucaccguaaucuu

SEQ ID NO: 3962819 - RNA, 20 nt, Staphylococcus aureus subsp. aureus Mu50
ucaaguuggugugcaauuaa

SEQ ID NO: 3962820 - RNA, 22 nt, Staphylococcus aureus subsp. aureus Mu50
ucaaguuuacgaucauaaauau

SEQ ID NO: 3962821 - RNA, 12 nt, Staphylococcus aureus subsp. aureus Mu50
ucaauaaaaaug

SEQ ID NO: 3962822 - RNA, 12 nt, Staphylococcus aureus subsp. aureus Mu50
ucaauaaauaaa

SEQ ID NO: 3962823 - RNA, 13 nt, Staphylococcus aureus subsp. aureus Mu50
ucaauaaauauug

SEQ ID NO: 3962824 - RNA, 11 nt, Staphylococcus aureus subsp. aureus Mu50
ucaauaaauug

SEQ ID NO: 3962825 - RNA, 12 nt, Staphylococcus aureus subsp. aureus Mu50
ucaauaaauugu

SEQ ID NO: 3962826 - RNA, 13 nt, Staphylococcus aureus subsp. aureus Mu50
ucaauaaauuguu

SEQ ID NO: 3962827 - RNA, 14 nt, Staphylococcus aureus subsp. aureus Mu50
ucaauaacaccuuu

SEQ ID NO: 3962828 - RNA, 18 nt, Staphylococcus aureus subsp. aureus Mu50
ucaauaacaccuuucauu

SEQ ID NO: 3962829 - RNA, 19 nt, Staphylococcus aureus subsp. aureus Mu50
ucaauaacaccuuucauuu

SEQ ID NO: 3962830 - RNA, 16 nt, Staphylococcus aureus subsp. aureus Mu50
ucaauaacuauaauca

SEQ ID NO: 3962831 - RNA, 19 nt, Staphylococcus aureus subsp. aureus Mu50
ucaauaaugcguuggcggu

SEQ ID NO: 3962832 - RNA, 13 nt, Staphylococcus aureus subsp. aureus Mu50
ucaauaauuauua

SEQ ID NO: 3962833 - RNA, 19 nt, Staphylococcus aureus subsp. aureus Mu50
ucaauaauuauuaauuuaa

SEQ ID NO: 3962834 - RNA, 14 nt, Staphylococcus aureus subsp. aureus Mu50
ucaauaauuucuug

SEQ ID NO: 3962835 - RNA, 20 nt, Staphylococcus aureus subsp. aureus Mu50
ucaauaccauaauuaaauaa

SEQ ID NO: 3962836 - RNA, 21 nt, Staphylococcus aureus subsp. aureus Mu50
ucaauaccauaauuaaauaac

SEQ ID NO: 3962837 - RNA, 16 nt, Staphylococcus aureus subsp. aureus Mu50
ucaauacuugaaagau

SEQ ID NO: 3962838 - RNA, 15 nt, Staphylococcus aureus subsp. aureus Mu50
ucaauagaugaaaau

SEQ ID NO: 3962839 - RNA, 20 nt, Staphylococcus aureus subsp. aureus Mu50
ucaauagcgguuuaaaaaug

SEQ ID NO: 3962840 - RNA, 23 nt, Staphylococcus aureus subsp. aureus Mu50
ucaauagcgguuuaaaaaugcug

SEQ ID NO: 3962841 - RNA, 22 nt, Staphylococcus aureus subsp. aureus Mu50
ucaauaggaauaccacuuaauc

SEQ ID NO: 3962842 - RNA, 22 nt, Staphylococcus aureus subsp. aureus Mu50
ucacauguaccacauuuuccuu

SEQ ID NO: 3962843 - RNA, 15 nt, Staphylococcus aureus subsp. aureus Mu50
ucacaugugaaauaa

SEQ ID NO: 3962844 - RNA, 18 nt, Staphylococcus aureus subsp. aureus Mu50
ucacaugugaaauaaucc

SEQ ID NO: 3962845 - RNA, 18 nt, Staphylococcus aureus subsp. aureus Mu50
ucacauuaaguuaaacgu

SEQ ID NO: 3962846 - RNA, 15 nt, Staphylococcus aureus subsp. aureus Mu50
ucacauucaauauuu

SEQ ID NO: 3962847 - RNA, 13 nt, Staphylococcus aureus subsp. aureus Mu50
ucacauuuauaac

SEQ ID NO: 3962848 - RNA, 17 nt, Staphylococcus aureus subsp. aureus Mu50
ucaccaacuuuuuuaac

SEQ ID NO: 3962849 - RNA, 15 nt, Staphylococcus aureus subsp. aureus Mu50
ucaccaauuagguuu

SEQ ID NO: 3962850 - RNA, 15 nt, Staphylococcus aureus subsp. aureus Mu50
ucaccacauaaaaau

SEQ ID NO: 3962851 - RNA, 16 nt, Staphylococcus aureus subsp. aureus Mu50
ucaccacauaaaaaua

SEQ ID NO: 3962852 - RNA, 20 nt, Staphylococcus aureus subsp. aureus Mu50
ucaccagguuuuuuauuuuc

SEQ ID NO: 3962853 - RNA, 17 nt, Staphylococcus aureus subsp. aureus Mu50
ucaccauacuaaaacau

SEQ ID NO: 3962854 - RNA, 14 nt, Staphylococcus aureus subsp. aureus Mu50
ucaccauauuuaac

SEQ ID NO: 3962855 - RNA, 20 nt, Staphylococcus aureus subsp. aureus Mu50
ucaccauauuuaacauuuug

SEQ ID NO: 3962856 - RNA, 17 nt, Staphylococcus aureus subsp. aureus Mu50
ucaccauuuacuucaua

SEQ ID NO: 3962857 - RNA, 19 nt, Staphylococcus aureus subsp. aureus Mu50
ucaccguaaucuuuuaacu

SEQ ID NO: 3962858 - RNA, 20 nt, Staphylococcus aureus subsp. aureus Mu50
ucaccuaaaugauuaauaac

SEQ ID NO: 3962859 - RNA, 15 nt, Staphylococcus aureus subsp. aureus Mu50
ucaccuacaacacca

SEQ ID NO: 3962860 - RNA, 22 nt, Staphylococcus aureus subsp. aureus Mu50
ucaccugaugucgcuuucauac

SEQ ID NO: 3962861 - RNA, 22 nt, Staphylococcus aureus subsp. aureus Mu50
ucaccugcagcauccuuaccuu

SEQ ID NO: 3962862 - RNA, 13 nt, Staphylococcus aureus subsp. aureus Mu50
ucaccuucccagu

SEQ ID NO: 3962863 - RNA, 14 nt, Staphylococcus aureus subsp. aureus Mu50
ucaccuucccaguc

SEQ ID NO: 3962864 - RNA, 22 nt, Staphylococcus aureus subsp. aureus Mu50
ucaccuuuagacaauauuuuua

SEQ ID NO: 3962865 - RNA, 14 nt, Staphylococcus aureus subsp. aureus Mu50
ucaccuuuaggcaa

SEQ ID NO: 3962866 - RNA, 21 nt, Staphylococcus aureus subsp. aureus Mu50
ucaccuuugaauauaguccuu

SEQ ID NO: 3962867 - RNA, 16 nt, Staphylococcus aureus subsp. aureus Mu50
ucaccuuuuuuaacuu

SEQ ID NO: 3962868 - RNA, 14 nt, Staphylococcus aureus subsp. aureus Mu50
ucacgaauaucuua

SEQ ID NO: 3962869 - RNA, 19 nt, Staphylococcus aureus subsp. aureus Mu50
ucacgauauaacauuaaaa

SEQ ID NO: 3962870 - RNA, 13 nt, Staphylococcus aureus subsp. aureus Mu50
ucacgaucuuuaa

SEQ ID NO: 3962871 - RNA, 18 nt, Staphylococcus aureus subsp. aureus Mu50
ucacgauuaauaaaauuc

SEQ ID NO: 3962872 - RNA, 21 nt, Staphylococcus aureus subsp. aureus Mu50
ucacgauuacgcucauauguc

SEQ ID NO: 3962873 - RNA, 15 nt, Staphylococcus aureus subsp. aureus Mu50
ucacgauuuuuaaaa

SEQ ID NO: 3962874 - RNA, 16 nt, Staphylococcus aureus subsp. aureus Mu50
ucacgauuuuuaaaau

SEQ ID NO: 3962875 - RNA, 18 nt, Staphylococcus aureus subsp. aureus Mu50
ucacgauuuuuaaaaugc

SEQ ID NO: 3962876 - RNA, 19 nt, Staphylococcus aureus subsp. aureus Mu50
ucacgauuuuuaaaaugcu

SEQ ID NO: 3962877 - RNA, 13 nt, Staphylococcus aureus subsp. aureus Mu50
ucacgccauaauc

SEQ ID NO: 3962878 - RNA, 12 nt, Staphylococcus aureus subsp. aureus Mu50
ucacgcuaacau

SEQ ID NO: 3962879 - RNA, 16 nt, Staphylococcus aureus subsp. aureus Mu50
ucacgcuuauucgaac

SEQ ID NO: 3962880 - RNA, 22 nt, Staphylococcus aureus subsp. aureus Mu50
ucacgguuuacccacuuauaaa

SEQ ID NO: 3962881 - RNA, 14 nt, Staphylococcus aureus subsp. aureus Mu50
ucacguaaugaauc

SEQ ID NO: 3962882 - RNA, 23 nt, Staphylococcus aureus subsp. aureus Mu50
ucacgugcuucguuuuuaguguu

SEQ ID NO: 3962883 - RNA, 18 nt, Staphylococcus aureus subsp. aureus Mu50
ucacguugugcaauaccu

SEQ ID NO: 3962884 - RNA, 20 nt, Staphylococcus aureus subsp. aureus Mu50
ucacuaaaaauauauuucaa

SEQ ID NO: 3962885 - RNA, 17 nt, Staphylococcus aureus subsp. aureus Mu50
ucacuaaaguaaauaac

SEQ ID NO: 3962886 - RNA, 18 nt, Staphylococcus aureus subsp. aureus Mu50
ucacuaaucucgguacau

SEQ ID NO: 3962887 - RNA, 15 nt, Staphylococcus aureus subsp. aureus Mu50
ucacuacuuuuucaa

SEQ ID NO: 3962888 - RNA, 18 nt, Staphylococcus aureus subsp. aureus Mu50
ucacuagauaguuuauac

SEQ ID NO: 3962889 - RNA, 18 nt, Staphylococcus aureus subsp. aureus Mu50
ucacuaggauguucauca

SEQ ID NO: 3962890 - RNA, 13 nt, Staphylococcus aureus subsp. aureus Mu50
ucacuaucagcuu

SEQ ID NO: 3962891 - RNA, 14 nt, Staphylococcus aureus subsp. aureus Mu50
ucacucacuucaac

SEQ ID NO: 3962892 - RNA, 23 nt, Staphylococcus aureus subsp. aureus Mu50
ucacucacuucaacgucaucugc

SEQ ID NO: 3962893 - RNA, 18 nt, Staphylococcus aureus subsp. aureus Mu50
ucacucauaacaguccca

SEQ ID NO: 3962894 - RNA, 19 nt, Staphylococcus aureus subsp. aureus Mu50
ucacuccucuauuuuauga

SEQ ID NO: 3962895 - RNA, 18 nt, Staphylococcus aureus subsp. aureus Mu50
ucacucggcagauguuca

SEQ ID NO: 3962896 - RNA, 19 nt, Staphylococcus aureus subsp. aureus Mu50
ucacucuguaauaaagaau

SEQ ID NO: 3962897 - RNA, 14 nt, Staphylococcus aureus subsp. aureus Mu50
ucacugaaugcuaa

SEQ ID NO: 3962898 - RNA, 23 nt, Staphylococcus aureus subsp. aureus Mu50
ucacugaaugcuaauacuaauca

SEQ ID NO: 3962899 - RNA, 22 nt, Staphylococcus aureus subsp. aureus Mu50
ucacugcaaacacaguacaaau

SEQ ID NO: 3962900 - RNA, 15 nt, Staphylococcus aureus subsp. aureus Mu50
ucacugcuguucuuu

SEQ ID NO: 3962901 - RNA, 22 nt, Staphylococcus aureus subsp. aureus Mu50
ucacugcuguucuuuuuauuua

SEQ ID NO: 3962902 - RNA, 22 nt, Staphylococcus aureus subsp. aureus Mu50
ucacugcuguuuuuauuauaau

SEQ ID NO: 3962903 - RNA, 17 nt, Staphylococcus aureus subsp. aureus Mu50
ucacugcuuucaaguaa

SEQ ID NO: 3962904 - RNA, 16 nt, Staphylococcus aureus subsp. aureus Mu50
ucacuguagauucaaa

SEQ ID NO: 3962905 - RNA, 21 nt, Staphylococcus aureus subsp. aureus Mu50
ucacuguauggucuggaauaa

SEQ ID NO: 3962906 - RNA, 23 nt, Staphylococcus aureus subsp. aureus Mu50
ucacuguauggucuggaauaaau

SEQ ID NO: 3962907 - RNA, 12 nt, Staphylococcus aureus subsp. aureus Mu50
ucacuuaauaaa

SEQ ID NO: 3962908 - RNA, 20 nt, Staphylococcus aureus subsp. aureus Mu50
ucacuuacugugaaaauacc

SEQ ID NO: 3962909 - RNA, 16 nt, Staphylococcus aureus subsp. aureus Mu50
ucacuuauuauuuugu

SEQ ID NO: 3962910 - RNA, 15 nt, Staphylococcus aureus subsp. aureus Mu50
ucacuucaaacaaag

SEQ ID NO: 3962911 - RNA, 16 nt, Staphylococcus aureus subsp. aureus Mu50
ucacuucaaacaaagg

SEQ ID NO: 3962912 - RNA, 21 nt, Staphylococcus aureus subsp. aureus Mu50
ucacuucuaaaacuaaaggua

SEQ ID NO: 3962913 - RNA, 20 nt, Staphylococcus aureus subsp. aureus Mu50
ucacuucucucuuauuaaaa

SEQ ID NO: 3962914 - RNA, 22 nt, Staphylococcus aureus subsp. aureus Mu50
ucacuucucucuuauuaaaaaa

SEQ ID NO: 3962915 - RNA, 15 nt, Staphylococcus aureus subsp. aureus Mu50
ucacuugguacaccu

SEQ ID NO: 3962916 - RNA, 18 nt, Staphylococcus aureus subsp. aureus Mu50
ucacuuuaacuucuuuug

SEQ ID NO: 3962917 - RNA, 18 nt, Staphylococcus aureus subsp. aureus Mu50
ucacuuuaggguucauug

SEQ ID NO: 3962918 - RNA, 17 nt, Staphylococcus aureus subsp. aureus Mu50
ucacuuuauuaaauaac

SEQ ID NO: 3962919 - RNA, 17 nt, Staphylococcus aureus subsp. aureus Mu50
ucacuuuuaacgacauc

SEQ ID NO: 3962920 - RNA, 21 nt, Staphylococcus aureus subsp. aureus Mu50
ucacuuuuuaaacguacauuu

SEQ ID NO: 3962921 - RNA, 22 nt, Staphylococcus aureus subsp. aureus Mu50
ucacuuuuuuuaauuugauuaa

SEQ ID NO: 3962922 - RNA, 14 nt, Staphylococcus aureus subsp. aureus Mu50
ucagaaauuuaaua

SEQ ID NO: 3962923 - RNA, 15 nt, Staphylococcus aureus subsp. aureus Mu50
ucagaacuaugaaua

SEQ ID NO: 3962924 - RNA, 20 nt, Staphylococcus aureus subsp. aureus Mu50
ucagaaguuguuuagaaaag

SEQ ID NO: 3962925 - RNA, 19 nt, Staphylococcus aureus subsp. aureus Mu50
ucagaaugaacuucucuua

SEQ ID NO: 3962926 - RNA, 12 nt, Staphylococcus aureus subsp. aureus Mu50
ucagaguagaaa

SEQ ID NO: 3962927 - RNA, 14 nt, Staphylococcus aureus subsp. aureus Mu50
ucagaguagaaagu

SEQ ID NO: 3962928 - RNA, 17 nt, Staphylococcus aureus subsp. aureus Mu50
ucagaugaauaauguuu

SEQ ID NO: 3962929 - RNA, 16 nt, Staphylococcus aureus subsp. aureus Mu50
ucauuagcaauuucau

SEQ ID NO: 3962930 - RNA, 18 nt, Staphylococcus aureus subsp. aureus Mu50
ucauuagcgcaagagaua

SEQ ID NO: 3962931 - RNA, 15 nt, Staphylococcus aureus subsp. aureus Mu50
ucauuaguguagaaa

SEQ ID NO: 3962932 - RNA, 18 nt, Staphylococcus aureus subsp. aureus Mu50
ucauuaguguagaaaaua

SEQ ID NO: 3962933 - RNA, 22 nt, Staphylococcus aureus subsp. aureus Mu50
ucauuaguugccccuagcaaaa

SEQ ID NO: 3962934 - RNA, 15 nt, Staphylococcus aureus subsp. aureus Mu50
ucauuaguuguauca

SEQ ID NO: 3962935 - RNA, 14 nt, Staphylococcus aureus subsp. aureus Mu50
ucauuauaaaaugg

SEQ ID NO: 3962936 - RNA, 19 nt, Staphylococcus aureus subsp. aureus Mu50
ucauuauauaauucuucaa

SEQ ID NO: 3962937 - RNA, 16 nt, Staphylococcus aureus subsp. aureus Mu50
ucauuaucaaauaacc

SEQ ID NO: 3962938 - RNA, 11 nt, Staphylococcus aureus subsp. aureus Mu50
ucauuaucauu

SEQ ID NO: 3962939 - RNA, 20 nt, Staphylococcus aureus subsp. aureus Mu50
ucauuauuuagaauucuaaa

SEQ ID NO: 3962940 - RNA, 21 nt, Staphylococcus aureus subsp. aureus Mu50
ucauuauuugauaaauaaaau

SEQ ID NO: 3962941 - RNA, 18 nt, Staphylococcus aureus subsp. aureus Mu50
ucauucguacuuccaaua

SEQ ID NO: 3962942 - RNA, 21 nt, Staphylococcus aureus subsp. aureus Mu50
ucauucuaguagcuagaacag

SEQ ID NO: 3962943 - RNA, 21 nt, Staphylococcus aureus subsp. aureus Mu50
ucauucucgauaacuuacuau

SEQ ID NO: 3962944 - RNA, 16 nt, Staphylococcus aureus subsp. aureus Mu50
ucauucuuuaauauaa

SEQ ID NO: 3962945 - RNA, 20 nt, Staphylococcus aureus subsp. aureus Mu50
ucauucuuuaauauaaauuu

SEQ ID NO: 3962946 - RNA, 15 nt, Staphylococcus aureus subsp. aureus Mu50
ucauucuuuauagaa

SEQ ID NO: 3962947 - RNA, 22 nt, Staphylococcus aureus subsp. aureus Mu50
ucauugaucgauuguuuauuag

SEQ ID NO: 3962948 - RNA, 13 nt, Staphylococcus aureus subsp. aureus Mu50
ucauugaugaugu

SEQ ID NO: 3962949 - RNA, 18 nt, Staphylococcus aureus subsp. aureus Mu50
ucauugcuugguuugauu

SEQ ID NO: 3962950 - RNA, 20 nt, Staphylococcus aureus subsp. aureus Mu50
ucauuggauagguaacuaaa

SEQ ID NO: 3962951 - RNA, 14 nt, Staphylococcus aureus subsp. aureus Mu50
ucauuguaacucaa

SEQ ID NO: 3962952 - RNA, 13 nt, Staphylococcus aureus subsp. aureus Mu50
ucauuguaauaau

SEQ ID NO: 3962953 - RNA, 12 nt, Staphylococcus aureus subsp. aureus Mu50
ucauuguauaaa

SEQ ID NO: 3962954 - RNA, 14 nt, Staphylococcus aureus subsp. aureus Mu50
ucauuguauaaaaa

SEQ ID NO: 3962955 - RNA, 15 nt, Staphylococcus aureus subsp. aureus Mu50
ucauuguauaaaaag

SEQ ID NO: 3962956 - RNA, 20 nt, Staphylococcus aureus subsp. aureus Mu50
ucauuguguauuguuuuacu

SEQ ID NO: 3962957 - RNA, 19 nt, Staphylococcus aureus subsp. aureus Mu50
ucauuguguccauaaauau

SEQ ID NO: 3962958 - RNA, 22 nt, Staphylococcus aureus subsp. aureus Mu50
ucauuguguccauaaauauuaa

SEQ ID NO: 3962959 - RNA, 15 nt, Staphylococcus aureus subsp. aureus Mu50
ucauuuaaaaaucaa

SEQ ID NO: 3962960 - RNA, 12 nt, Staphylococcus aureus subsp. aureus Mu50
ucauuuaaaaua

SEQ ID NO: 3962961 - RNA, 15 nt, Staphylococcus aureus subsp. aureus Mu50
ucauuuaaaauauuu

SEQ ID NO: 3962962 - RNA, 13 nt, Staphylococcus aureus subsp. aureus Mu50
ucauuuaaauauu

SEQ ID NO: 3962963 - RNA, 18 nt, Staphylococcus aureus subsp. aureus Mu50
ucauuuaguuaaauacaa

SEQ ID NO: 3962964 - RNA, 17 nt, Staphylococcus aureus subsp. aureus Mu50
ucauuucaauauuaaaa

SEQ ID NO: 3962965 - RNA, 18 nt, Staphylococcus aureus subsp. aureus Mu50
ucauuucaauauuaaaau

SEQ ID NO: 3962966 - RNA, 22 nt, Staphylococcus aureus subsp. aureus Mu50
ucauuucaauauuaaaauacgg

SEQ ID NO: 3962967 - RNA, 12 nt, Staphylococcus aureus subsp. aureus Mu50
ucauuucaauca

SEQ ID NO: 3962968 - RNA, 16 nt, Staphylococcus aureus subsp. aureus Mu50
ucauuucgauuaauuu

SEQ ID NO: 3962969 - RNA, 19 nt, Staphylococcus aureus subsp. aureus Mu50
ucauuucgauuaauuuaau

SEQ ID NO: 3962970 - RNA, 12 nt, Staphylococcus aureus subsp. aureus Mu50
ucauuucugaag

SEQ ID NO: 3962971 - RNA, 17 nt, Staphylococcus aureus subsp. aureus Mu50
ucauuucugaaguuauc

SEQ ID NO: 3962972 - RNA, 13 nt, Staphylococcus aureus subsp. aureus Mu50
ucauuucuuuguu

SEQ ID NO: 3962973 - RNA, 15 nt, Staphylococcus aureus subsp. aureus Mu50
ucauuucuuuguuuc

SEQ ID NO: 3962974 - RNA, 16 nt, Staphylococcus aureus subsp. aureus Mu50
ucauuucuuuguuucg

SEQ ID NO: 3962975 - RNA, 20 nt, Staphylococcus aureus subsp. aureus Mu50
ucauuugaacaucauuuaau

SEQ ID NO: 3962976 - RNA, 19 nt, Staphylococcus aureus subsp. aureus Mu50
ucauuugacauaucaugaa

SEQ ID NO: 3962977 - RNA, 18 nt, Staphylococcus aureus subsp. aureus Mu50
ucauuugauuuaaaaagu

SEQ ID NO: 3962978 - RNA, 16 nt, Staphylococcus aureus subsp. aureus Mu50
ucauuuggcguucaac

SEQ ID NO: 3962979 - RNA, 14 nt, Staphylococcus aureus subsp. aureus Mu50
ucauuuguauagau

SEQ ID NO: 3962980 - RNA, 15 nt, Staphylococcus aureus subsp. aureus Mu50
ucauuuguguaaaug

SEQ ID NO: 3962981 - RNA, 18 nt, Staphylococcus aureus subsp. aureus Mu50
ucauuuguguaaaugaau

SEQ ID NO: 3962982 - RNA, 18 nt, Staphylococcus aureus subsp. aureus Mu50
ucauuuguguauaaaugu

SEQ ID NO: 3962983 - RNA, 18 nt, Staphylococcus aureus subsp. aureus Mu50
ucauuuguguuuuuaaug

SEQ ID NO: 3962984 - RNA, 15 nt, Staphylococcus aureus subsp. aureus Mu50
ucauuuuauaaauca

SEQ ID NO: 3962985 - RNA, 22 nt, Staphylococcus aureus subsp. aureus Mu50
ucauuuuauccaaaccaauuuu

SEQ ID NO: 3962986 - RNA, 18 nt, Staphylococcus aureus subsp. aureus Mu50
ucauuuucaaauaacuga

SEQ ID NO: 3962987 - RNA, 14 nt, Staphylococcus aureus subsp. aureus Mu50
ucauuuucaacaua

SEQ ID NO: 3962988 - RNA, 16 nt, Staphylococcus aureus subsp. aureus Mu50
ucauuuucaacauaau

SEQ ID NO: 3962989 - RNA, 20 nt, Staphylococcus aureus subsp. aureus Mu50
ucauuuucaacauaauauuu

SEQ ID NO: 3962990 - RNA, 12 nt, Staphylococcus aureus subsp. aureus Mu50
ucauuuucaaua

SEQ ID NO: 3962991 - RNA, 16 nt, Staphylococcus aureus subsp. aureus Mu50
ucauuuucaauacuug

SEQ ID NO: 3962992 - RNA, 14 nt, Staphylococcus aureus subsp. aureus Mu50
ucauuuucauugua

SEQ ID NO: 3962993 - RNA, 13 nt, Staphylococcus aureus subsp. aureus Mu50
ucauuuugauuaa

SEQ ID NO: 3962994 - RNA, 11 nt, Staphylococcus aureus subsp. aureus Mu50
ucauuuuuaau

SEQ ID NO: 3962995 - RNA, 23 nt, Staphylococcus aureus subsp. aureus Mu50
ucauuuuuaauugaaugaaaaag

SEQ ID NO: 3962996 - RNA, 17 nt, Staphylococcus aureus subsp. aureus Mu50
ucauuuuucguuguuca

SEQ ID NO: 3962997 - RNA, 20 nt, Staphylococcus aureus subsp. aureus Mu50
ucauuuuucguuguucauaa

SEQ ID NO: 3962998 - RNA, 12 nt, Staphylococcus aureus subsp. aureus Mu50
ucauuuuuucaa

SEQ ID NO: 3962999 - RNA, 22 nt, Staphylococcus aureus subsp. aureus Mu50
ucauuuuuucgagaugauauua

SEQ ID NO: 3963000 - RNA, 12 nt, Staphylococcus aureus subsp. aureus Mu50
uccaaaaagguu

SEQ ID NO: 3963001 - RNA, 19 nt, Staphylococcus aureus subsp. aureus Mu50
uccaaaaauuguaaaaccu

SEQ ID NO: 3963002 - RNA, 17 nt, Staphylococcus aureus subsp. aureus Mu50
uccaaaacaaaaauaau

SEQ ID NO: 3963003 - RNA, 14 nt, Staphylococcus aureus subsp. aureus Mu50
uccaaaacauuuug

SEQ ID NO: 3963004 - RNA, 16 nt, Staphylococcus aureus subsp. aureus Mu50
uccaaaauccugaaau

SEQ ID NO: 3963005 - RNA, 19 nt, Staphylococcus aureus subsp. aureus Mu50
uccaaacacaaauaaaggc

SEQ ID NO: 3963006 - RNA, 15 nt, Staphylococcus aureus subsp. aureus Mu50
uccaaagaaacggaa

SEQ ID NO: 3963007 - RNA, 21 nt, Staphylococcus aureus subsp. aureus Mu50
uccaaagcuugauuuaacaac

SEQ ID NO: 3963008 - RNA, 17 nt, Staphylococcus aureus subsp. aureus Mu50
uccaaaggccaugagcu

SEQ ID NO: 3963009 - RNA, 15 nt, Staphylococcus aureus subsp. aureus Mu50
uccaaaguaauauga

SEQ ID NO: 3963010 - RNA, 18 nt, Staphylococcus aureus subsp. aureus Mu50
uccaaaucgugauaucuu

SEQ ID NO: 3963011 - RNA, 17 nt, Staphylococcus aureus subsp. aureus Mu50
uccaacacccauauaau

SEQ ID NO: 3963012 - RNA, 18 nt, Staphylococcus aureus subsp. aureus Mu50
uccaacacccauauaauu

SEQ ID NO: 3963013 - RNA, 21 nt, Staphylococcus aureus subsp. aureus Mu50
uccaacacccauauaauuugg

SEQ ID NO: 3963014 - RNA, 17 nt, Staphylococcus aureus subsp. aureus Mu50
uccaacauauaaaaaau

SEQ ID NO: 3963015 - RNA, 18 nt, Staphylococcus aureus subsp. aureus Mu50
uccaacauguaacaaaau

SEQ ID NO: 3963016 - RNA, 16 nt, Staphylococcus aureus subsp. aureus Mu50
uccaagaaucucuauc

SEQ ID NO: 3963017 - RNA, 12 nt, Staphylococcus aureus subsp. aureus Mu50
ucccuuaauaau

SEQ ID NO: 3963018 - RNA, 17 nt, Staphylococcus aureus subsp. aureus Mu50
ucccuuaauaauaagua

SEQ ID NO: 3963019 - RNA, 19 nt, Staphylococcus aureus subsp. aureus Mu50
ucccuucaaaguuuucauu

SEQ ID NO: 3963020 - RNA, 12 nt, Staphylococcus aureus subsp. aureus Mu50
uccgacuuuuga

SEQ ID NO: 3963021 - RNA, 15 nt, Staphylococcus aureus subsp. aureus Mu50
uccgauaucuuuuaa

SEQ ID NO: 3963022 - RNA, 19 nt, Staphylococcus aureus subsp. aureus Mu50
uccgauaucuuuuaauucu

SEQ ID NO: 3963023 - RNA, 14 nt, Staphylococcus aureus subsp. aureus Mu50
uccgauuuuuuuac

SEQ ID NO: 3963024 - RNA, 16 nt, Staphylococcus aureus subsp. aureus Mu50
uccgcacugccuuuuu

SEQ ID NO: 3963025 - RNA, 16 nt, Staphylococcus aureus subsp. aureus Mu50
uccgcaucuuuugguu

SEQ ID NO: 3963026 - RNA, 15 nt, Staphylococcus aureus subsp. aureus Mu50
uccgccaauuaaaau

SEQ ID NO: 3963027 - RNA, 16 nt, Staphylococcus aureus subsp. aureus Mu50
uccgcuuguucaacua

SEQ ID NO: 3963028 - RNA, 12 nt, Staphylococcus aureus subsp. aureus Mu50
uccggaacaaua

SEQ ID NO: 3963029 - RNA, 14 nt, Staphylococcus aureus subsp. aureus Mu50
uccggggccccaac

SEQ ID NO: 3963030 - RNA, 23 nt, Staphylococcus aureus subsp. aureus Mu50
uccgucgaauauaauuuuuugac

SEQ ID NO: 3963031 - RNA, 18 nt, Staphylococcus aureus subsp. aureus Mu50
uccguuaaaauuuuaauu

SEQ ID NO: 3963032 - RNA, 20 nt, Staphylococcus aureus subsp. aureus Mu50
uccguuaaaauuuuaauuaa

SEQ ID NO: 3963033 - RNA, 14 nt, Staphylococcus aureus subsp. aureus Mu50
uccguuaauuuaac

SEQ ID NO: 3963034 - RNA, 23 nt, Staphylococcus aureus subsp. aureus Mu50
uccguugaauuaacaauauuaaa

SEQ ID NO: 3963035 - RNA, 15 nt, Staphylococcus aureus subsp. aureus Mu50
uccguuuuauauuua

SEQ ID NO: 3963036 - RNA, 16 nt, Staphylococcus aureus subsp. aureus Mu50
uccuaaauuauaaaua

SEQ ID NO: 3963037 - RNA, 15 nt, Staphylococcus aureus subsp. aureus Mu50
uccuaagcuaguguu

SEQ ID NO: 3963038 - RNA, 14 nt, Staphylococcus aureus subsp. aureus Mu50
uccuacaacuauuc

SEQ ID NO: 3963039 - RNA, 13 nt, Staphylococcus aureus subsp. aureus Mu50
uccuacugcuguc

SEQ ID NO: 3963040 - RNA, 23 nt, Staphylococcus aureus subsp. aureus Mu50
uccuagacgaucuuuaaugauaa

SEQ ID NO: 3963041 - RNA, 21 nt, Staphylococcus aureus subsp. aureus Mu50
uccuauggcgcaauuuuuaac

SEQ ID NO: 3963042 - RNA, 16 nt, Staphylococcus aureus subsp. aureus Mu50
uccuauuacuacauaa

SEQ ID NO: 3963043 - RNA, 14 nt, Staphylococcus aureus subsp. aureus Mu50
uccucaaauauauu

SEQ ID NO: 3963044 - RNA, 16 nt, Staphylococcus aureus subsp. aureus Mu50
uccucaacgggaacau

SEQ ID NO: 3963045 - RNA, 14 nt, Staphylococcus aureus subsp. aureus Mu50
uccucauaauuauc

SEQ ID NO: 3963046 - RNA, 17 nt, Staphylococcus aureus subsp. aureus Mu50
uccucauaauuaucaua

SEQ ID NO: 3963047 - RNA, 15 nt, Staphylococcus aureus subsp. aureus Mu50
uccucauuaauaaau

SEQ ID NO: 3963048 - RNA, 13 nt, Staphylococcus aureus subsp. aureus Mu50
uccuccaaagcua

SEQ ID NO: 3963049 - RNA, 22 nt, Staphylococcus aureus subsp. aureus Mu50
uccuccgccaucaauauuuaua

SEQ ID NO: 3963050 - RNA, 19 nt, Staphylococcus aureus subsp. aureus Mu50
uccuccuaccgcuaaaauu

SEQ ID NO: 3963051 - RNA, 21 nt, Staphylococcus aureus subsp. aureus Mu50
uccucgguauuuaauguuuua

SEQ ID NO: 3963052 - RNA, 14 nt, Staphylococcus aureus subsp. aureus Mu50
uccucuauuguauc

SEQ ID NO: 3963053 - RNA, 20 nt, Staphylococcus aureus subsp. aureus Mu50
uccucuauuuuaugauuuga

SEQ ID NO: 3963054 - RNA, 19 nt, Staphylococcus aureus subsp. aureus Mu50
uccucuguccgauuuuuaa

SEQ ID NO: 3963055 - RNA, 20 nt, Staphylococcus aureus subsp. aureus Mu50
uccugcuacaacuucuucuc

SEQ ID NO: 3963056 - RNA, 14 nt, Staphylococcus aureus subsp. aureus Mu50
uccugcuuauuaau

SEQ ID NO: 3963057 - RNA, 22 nt, Staphylococcus aureus subsp. aureus Mu50
uccuggaaucgaaaauaucaau

SEQ ID NO: 3963058 - RNA, 16 nt, Staphylococcus aureus subsp. aureus Mu50
uccugguauaauggac

SEQ ID NO: 3963059 - RNA, 17 nt, Staphylococcus aureus subsp. aureus Mu50
uccuguguaaaauaaau

SEQ ID NO: 3963060 - RNA, 17 nt, Staphylococcus aureus subsp. aureus Mu50
uccuuaaacaaauaaau

SEQ ID NO: 3963061 - RNA, 22 nt, Staphylococcus aureus subsp. aureus Mu50
uccuuaaaccguauagucauua

SEQ ID NO: 3963062 - RNA, 16 nt, Staphylococcus aureus subsp. aureus Mu50
uccuuaauugcucuuc

SEQ ID NO: 3963063 - RNA, 13 nt, Staphylococcus aureus subsp. aureus Mu50
uccuuaccuuuua

SEQ ID NO: 3963064 - RNA, 16 nt, Staphylococcus aureus subsp. aureus Mu50
uccuuagacaaacgac

SEQ ID NO: 3963065 - RNA, 13 nt, Staphylococcus aureus subsp. aureus Mu50
uccuuauuuuucg

SEQ ID NO: 3963066 - RNA, 20 nt, Staphylococcus aureus subsp. aureus Mu50
uccuucaauguucaauucac

SEQ ID NO: 3963067 - RNA, 14 nt, Staphylococcus aureus subsp. aureus Mu50
uccuucaucaauaa

SEQ ID NO: 3963068 - RNA, 20 nt, Staphylococcus aureus subsp. aureus Mu50
uccuucgauaguuuauuaau

SEQ ID NO: 3963069 - RNA, 22 nt, Staphylococcus aureus subsp. aureus Mu50
uccuucgauaguuuauuaauau

SEQ ID NO: 3963070 - RNA, 15 nt, Staphylococcus aureus subsp. aureus Mu50
uccuugauucuuaua

SEQ ID NO: 3963071 - RNA, 22 nt, Staphylococcus aureus subsp. aureus Mu50
uccuugcucaugagcacaaacu

SEQ ID NO: 3963072 - RNA, 20 nt, Staphylococcus aureus subsp. aureus Mu50
uccuuggaaacgauauagac

SEQ ID NO: 3963073 - RNA, 18 nt, Staphylococcus aureus subsp. aureus Mu50
uccuuggugucgaaauug

SEQ ID NO: 3963074 - RNA, 16 nt, Staphylococcus aureus subsp. aureus Mu50
uccuuguucuauuuga

SEQ ID NO: 3963075 - RNA, 17 nt, Staphylococcus aureus subsp. aureus Mu50
uccuuguucuauuugau

SEQ ID NO: 3963076 - RNA, 15 nt, Staphylococcus aureus subsp. aureus Mu50
uccuuuauauucuaa

SEQ ID NO: 3963077 - RNA, 21 nt, Staphylococcus aureus subsp. aureus Mu50
uccuuuauauucuaauauucc

SEQ ID NO: 3963078 - RNA, 12 nt, Staphylococcus aureus subsp. aureus Mu50
uccuuucuuuuu

SEQ ID NO: 3963079 - RNA, 14 nt, Staphylococcus aureus subsp. aureus Mu50
uccuuugauguuca

SEQ ID NO: 3963080 - RNA, 23 nt, Staphylococcus aureus subsp. aureus Mu50
uccuuugauguucacuaaaugug

SEQ ID NO: 3963081 - RNA, 16 nt, Staphylococcus aureus subsp. aureus Mu50
uccuuugauguuuucu

SEQ ID NO: 3963082 - RNA, 13 nt, Staphylococcus aureus subsp. aureus Mu50
uccuuuguuugua

SEQ ID NO: 3963083 - RNA, 14 nt, Staphylococcus aureus subsp. aureus Mu50
uccuuuuacuuaau

SEQ ID NO: 3963084 - RNA, 22 nt, Staphylococcus aureus subsp. aureus Mu50
uccuuuuuaguaguuuauauca

SEQ ID NO: 3963085 - RNA, 13 nt, Staphylococcus aureus subsp. aureus Mu50
uccuuuuugacuc

SEQ ID NO: 3963086 - RNA, 13 nt, Staphylococcus aureus subsp. aureus Mu50
uccuuuuuuuaag

SEQ ID NO: 3963087 - RNA, 19 nt, Staphylococcus aureus subsp. aureus Mu50
ucgaaaaacuguaaaucau

SEQ ID NO: 3963088 - RNA, 20 nt, Staphylococcus aureus subsp. aureus Mu50
ucgaaaaacuguaaaucauc

SEQ ID NO: 3963089 - RNA, 13 nt, Staphylococcus aureus subsp. aureus Mu50
ucgaaaagaaauu

SEQ ID NO: 3963090 - RNA, 17 nt, Staphylococcus aureus subsp. aureus Mu50
ucgaaaauaaaacaaau

SEQ ID NO: 3963091 - RNA, 19 nt, Staphylococcus aureus subsp. aureus Mu50
ucgaaaauagcuauuaaaa

SEQ ID NO: 3963092 - RNA, 15 nt, Staphylococcus aureus subsp. aureus Mu50
ucgaaaauuauacaa

SEQ ID NO: 3963093 - RNA, 23 nt, Staphylococcus aureus subsp. aureus Mu50
ucgaaaauuauacaaauuauaaa

SEQ ID NO: 3963094 - RNA, 15 nt, Staphylococcus aureus subsp. aureus Mu50
ucgaaagccaauuaa

SEQ ID NO: 3963095 - RNA, 22 nt, Staphylococcus aureus subsp. aureus Mu50
ucgaaauauuuauucgcuuguu

SEQ ID NO: 3963096 - RNA, 16 nt, Staphylococcus aureus subsp. aureus Mu50
ucgaaauucucuuugu

SEQ ID NO: 3963097 - RNA, 22 nt, Staphylococcus aureus subsp. aureus Mu50
ucgaaauucucuuuguuggggc

SEQ ID NO: 3963098 - RNA, 16 nt, Staphylococcus aureus subsp. aureus Mu50
ucgaaauuguucuaau

SEQ ID NO: 3963099 - RNA, 12 nt, Staphylococcus aureus subsp. aureus Mu50
ucgaacagaaaa

SEQ ID NO: 3963100 - RNA, 19 nt, Staphylococcus aureus subsp. aureus Mu50
ucgaacaugaaugauauug

SEQ ID NO: 3963101 - RNA, 21 nt, Staphylococcus aureus subsp. aureus Mu50
ucgaacaugaaugauauugau

SEQ ID NO: 3963102 - RNA, 16 nt, Staphylococcus aureus subsp. aureus Mu50
ucgaaccaaauuuuau

SEQ ID NO: 3963103 - RNA, 17 nt, Staphylococcus aureus subsp. aureus Mu50
ucgaacgauauuuuaaa

SEQ ID NO: 3963104 - RNA, 15 nt, Staphylococcus aureus subsp. aureus Mu50
ucgaacuaucaauau

SEQ ID NO: 3963105 - RNA, 18 nt, Staphylococcus aureus subsp. aureus Mu50
ucgguauuuaauguuuua

SEQ ID NO: 3963106 - RNA, 18 nt, Staphylococcus aureus subsp. aureus Mu50
ucgguauuuuaaauuuau

SEQ ID NO: 3963107 - RNA, 15 nt, Staphylococcus aureus subsp. aureus Mu50
ucgguuuauuuaaua

SEQ ID NO: 3963108 - RNA, 15 nt, Staphylococcus aureus subsp. aureus Mu50
ucgguuugauuaaaa

SEQ ID NO: 3963109 - RNA, 15 nt, Staphylococcus aureus subsp. aureus Mu50
ucguaacauuuaaaa

SEQ ID NO: 3963110 - RNA, 16 nt, Staphylococcus aureus subsp. aureus Mu50
ucguaacauuuaaaaa

SEQ ID NO: 3963111 - RNA, 14 nt, Staphylococcus aureus subsp. aureus Mu50
ucguaaugaugaca

SEQ ID NO: 3963112 - RNA, 22 nt, Staphylococcus aureus subsp. aureus Mu50
ucguaaugaugacaucaauauc

SEQ ID NO: 3963113 - RNA, 16 nt, Staphylococcus aureus subsp. aureus Mu50
ucguaauguguuaaua

SEQ ID NO: 3963114 - RNA, 22 nt, Staphylococcus aureus subsp. aureus Mu50
ucguaauugucuuuauaaaaaa

SEQ ID NO: 3963115 - RNA, 18 nt, Staphylococcus aureus subsp. aureus Mu50
ucguacaccauaaaugua

SEQ ID NO: 3963116 - RNA, 18 nt, Staphylococcus aureus subsp. aureus Mu50
ucguaccaacucgcuaua

SEQ ID NO: 3963117 - RNA, 14 nt, Staphylococcus aureus subsp. aureus Mu50
ucguacuuucaaau

SEQ ID NO: 3963118 - RNA, 21 nt, Staphylococcus aureus subsp. aureus Mu50
ucguauauguaaucagaguag

SEQ ID NO: 3963119 - RNA, 16 nt, Staphylococcus aureus subsp. aureus Mu50
ucguauucaaaguuuu

SEQ ID NO: 3963120 - RNA, 15 nt, Staphylococcus aureus subsp. aureus Mu50
ucguauucuuuuaau

SEQ ID NO: 3963121 - RNA, 13 nt, Staphylococcus aureus subsp. aureus Mu50
ucguauuuuuaag

SEQ ID NO: 3963122 - RNA, 13 nt, Staphylococcus aureus subsp. aureus Mu50
ucgucaaaaacag

SEQ ID NO: 3963123 - RNA, 13 nt, Staphylococcus aureus subsp. aureus Mu50
ucgucaaauucaa

SEQ ID NO: 3963124 - RNA, 20 nt, Staphylococcus aureus subsp. aureus Mu50
ucgucacauauaaauauuuu

SEQ ID NO: 3963125 - RNA, 15 nt, Staphylococcus aureus subsp. aureus Mu50
ucgucacguaaaaua

SEQ ID NO: 3963126 - RNA, 14 nt, Staphylococcus aureus subsp. aureus Mu50
ucgucgaaaugccu

SEQ ID NO: 3963127 - RNA, 18 nt, Staphylococcus aureus subsp. aureus Mu50
ucgucucacuuaauaaau

SEQ ID NO: 3963128 - RNA, 23 nt, Staphylococcus aureus subsp. aureus Mu50
ucgucuucuuuuuguccccagcc

SEQ ID NO: 3963129 - RNA, 21 nt, Staphylococcus aureus subsp. aureus Mu50
ucgucuuguaaacuucuuuuc

SEQ ID NO: 3963130 - RNA, 22 nt, Staphylococcus aureus subsp. aureus Mu50
ucgucuuuaucaacauaaaauu

SEQ ID NO: 3963131 - RNA, 16 nt, Staphylococcus aureus subsp. aureus Mu50
ucgugauagaaguuuu

SEQ ID NO: 3963132 - RNA, 23 nt, Staphylococcus aureus subsp. aureus Mu50
ucguguuaauaaccgaaauauug

SEQ ID NO: 3963133 - RNA, 15 nt, Staphylococcus aureus subsp. aureus Mu50
ucguguuccaauuuu

SEQ ID NO: 3963134 - RNA, 17 nt, Staphylococcus aureus subsp. aureus Mu50
ucguguuugaauguuuu

SEQ ID NO: 3963135 - RNA, 22 nt, Staphylococcus aureus subsp. aureus Mu50
ucguuaacaaucaguaauaaug

SEQ ID NO: 3963136 - RNA, 17 nt, Staphylococcus aureus subsp. aureus Mu50
ucguuaauguauaaaaa

SEQ ID NO: 3963137 - RNA, 19 nt, Staphylococcus aureus subsp. aureus Mu50
ucguuaauguauaaaaagu

SEQ ID NO: 3963138 - RNA, 20 nt, Staphylococcus aureus subsp. aureus Mu50
ucguuaauguauaaaaagug

SEQ ID NO: 3963139 - RNA, 16 nt, Staphylococcus aureus subsp. aureus Mu50
ucguuaauuuuauuuu

SEQ ID NO: 3963140 - RNA, 14 nt, Staphylococcus aureus subsp. aureus Mu50
ucguuaccuuuuaa

SEQ ID NO: 3963141 - RNA, 23 nt, Staphylococcus aureus subsp. aureus Mu50
ucguuaccuuuuaaggcagcuaa

SEQ ID NO: 3963142 - RNA, 17 nt, Staphylococcus aureus subsp. aureus Mu50
ucguuagaugaaugccu

SEQ ID NO: 3963143 - RNA, 22 nt, Staphylococcus aureus subsp. aureus Mu50
ucguuauaaguacaaauaauac

SEQ ID NO: 3963144 - RNA, 15 nt, Staphylococcus aureus subsp. aureus Mu50
ucguucaagaacaau

SEQ ID NO: 3963145 - RNA, 24 nt, Staphylococcus aureus subsp. aureus Mu50
ucguucaagaacaaucaauacaga

SEQ ID NO: 3963146 - RNA, 18 nt, Staphylococcus aureus subsp. aureus Mu50
ucguucaauuguugauuu

SEQ ID NO: 3963147 - RNA, 17 nt, Staphylococcus aureus subsp. aureus Mu50
ucguucauauauuuugu

SEQ ID NO: 3963148 - RNA, 21 nt, Staphylococcus aureus subsp. aureus Mu50
ucguucauauauuuuguuaau

SEQ ID NO: 3963149 - RNA, 14 nt, Staphylococcus aureus subsp. aureus Mu50
ucguucucuuaaau

SEQ ID NO: 3963150 - RNA, 22 nt, Staphylococcus aureus subsp. aureus Mu50
ucguuguaaaacuaaguuauuu

SEQ ID NO: 3963151 - RNA, 19 nt, Staphylococcus aureus subsp. aureus Mu50
ucguuguacaguaauauuc

SEQ ID NO: 3963152 - RNA, 19 nt, Staphylococcus aureus subsp. aureus Mu50
ucguuguaccaccccaacu

SEQ ID NO: 3963153 - RNA, 17 nt, Staphylococcus aureus subsp. aureus Mu50
ucguugucacuauugca

SEQ ID NO: 3963154 - RNA, 15 nt, Staphylococcus aureus subsp. aureus Mu50
ucguuguugaaauua

SEQ ID NO: 3963155 - RNA, 15 nt, Staphylococcus aureus subsp. aureus Mu50
ucguuucgucagauu

SEQ ID NO: 3963156 - RNA, 15 nt, Staphylococcus aureus subsp. aureus Mu50
ucguuucuuuuauau

SEQ ID NO: 3963157 - RNA, 13 nt, Staphylococcus aureus subsp. aureus Mu50
ucguuuuacuacu

SEQ ID NO: 3963158 - RNA, 17 nt, Staphylococcus aureus subsp. aureus Mu50
ucguuuucaucaacgau

SEQ ID NO: 3963159 - RNA, 17 nt, Staphylococcus aureus subsp. aureus Mu50
ucguuuugcuaaccauc

SEQ ID NO: 3963160 - RNA, 18 nt, Staphylococcus aureus subsp. aureus Mu50
ucguuuugcuaaccauca

SEQ ID NO: 3963161 - RNA, 13 nt, Staphylococcus aureus subsp. aureus Mu50
ucguuuuuccaug

SEQ ID NO: 3963162 - RNA, 13 nt, Staphylococcus aureus subsp. aureus Mu50
ucuaaaaaauuaa

SEQ ID NO: 3963163 - RNA, 18 nt, Staphylococcus aureus subsp. aureus Mu50
ucuaaaaaauuaaaaauu

SEQ ID NO: 3963164 - RNA, 16 nt, Staphylococcus aureus subsp. aureus Mu50
ucuaaaaacauaaaaa

SEQ ID NO: 3963165 - RNA, 17 nt, Staphylococcus aureus subsp. aureus Mu50
ucuaaaaacauaaaaau

SEQ ID NO: 3963166 - RNA, 18 nt, Staphylococcus aureus subsp. aureus Mu50
ucuaaaaacauaaaaauc

SEQ ID NO: 3963167 - RNA, 11 nt, Staphylococcus aureus subsp. aureus Mu50
ucuaaaaaugu

SEQ ID NO: 3963168 - RNA, 13 nt, Staphylococcus aureus subsp. aureus Mu50
ucuaaaacauguu

SEQ ID NO: 3963169 - RNA, 16 nt, Staphylococcus aureus subsp. aureus Mu50
ucuaaaacggaaauaa

SEQ ID NO: 3963170 - RNA, 16 nt, Staphylococcus aureus subsp. aureus Mu50
ucuaaaacuuuuucaa

SEQ ID NO: 3963171 - RNA, 13 nt, Staphylococcus aureus subsp. aureus Mu50
ucuaaaaguugua

SEQ ID NO: 3963172 - RNA, 21 nt, Staphylococcus aureus subsp. aureus Mu50
ucuaaaaguuguaauuuaaaa

SEQ ID NO: 3963173 - RNA, 23 nt, Staphylococcus aureus subsp. aureus Mu50
ucuaaaauaaaacgugcaaauaa

SEQ ID NO: 3963174 - RNA, 13 nt, Staphylococcus aureus subsp. aureus Mu50
ucuaaacaauucc

SEQ ID NO: 3963175 - RNA, 18 nt, Staphylococcus aureus subsp. aureus Mu50
ucuaaacuauaauaauug

SEQ ID NO: 3963176 - RNA, 17 nt, Staphylococcus aureus subsp. aureus Mu50
ucuaaacuucuauuaau

SEQ ID NO: 3963177 - RNA, 20 nt, Staphylococcus aureus subsp. aureus Mu50
ucuaaacuucuauuaauaau

SEQ ID NO: 3963178 - RNA, 14 nt, Staphylococcus aureus subsp. aureus Mu50
ucuaaagauuucag

SEQ ID NO: 3963179 - RNA, 15 nt, Staphylococcus aureus subsp. aureus Mu50
ucuaaagcuauaaaa

SEQ ID NO: 3963180 - RNA, 16 nt, Staphylococcus aureus subsp. aureus Mu50
ucuaaagcuuauuaaa

SEQ ID NO: 3963181 - RNA, 19 nt, Staphylococcus aureus subsp. aureus Mu50
ucuaaagguaccacuguau

SEQ ID NO: 3963182 - RNA, 15 nt, Staphylococcus aureus subsp. aureus Mu50
ucuaaauaaaauuaa

SEQ ID NO: 3963183 - RNA, 17 nt, Staphylococcus aureus subsp. aureus Mu50
ucuaaauaguuuuucau

SEQ ID NO: 3963184 - RNA, 20 nt, Staphylococcus aureus subsp. aureus Mu50
ucuaaauauaauagaaauaa

SEQ ID NO: 3963185 - RNA, 11 nt, Staphylococcus aureus subsp. aureus Mu50
ucuaaaucuug

SEQ ID NO: 3963186 - RNA, 22 nt, Staphylococcus aureus subsp. aureus Mu50
ucuaaaugcacgagcaacaucu

SEQ ID NO: 3963187 - RNA, 16 nt, Staphylococcus aureus subsp. aureus Mu50
ucuaacaauauauaau

SEQ ID NO: 3963188 - RNA, 23 nt, Staphylococcus aureus subsp. aureus Mu50
ucuaacaccugauugacaaugua

SEQ ID NO: 3963189 - RNA, 16 nt, Staphylococcus aureus subsp. aureus Mu50
ucuaacagcuuaauuu

SEQ ID NO: 3963190 - RNA, 14 nt, Staphylococcus aureus subsp. aureus Mu50
ucuaacaguuaaua

SEQ ID NO: 3963191 - RNA, 14 nt, Staphylococcus aureus subsp. aureus Mu50
ucuaaccacuucuu

SEQ ID NO: 3963192 - RNA, 16 nt, Staphylococcus aureus subsp. aureus Mu50
ucuaacguuaacaaua

SEQ ID NO: 3963193 - RNA, 16 nt, Staphylococcus aureus subsp. aureus Mu50
ucuaugaauaauguuu

SEQ ID NO: 3963194 - RNA, 15 nt, Staphylococcus aureus subsp. aureus Mu50
ucuauguacaauaau

SEQ ID NO: 3963195 - RNA, 18 nt, Staphylococcus aureus subsp. aureus Mu50
ucuauguacaauaauuag

SEQ ID NO: 3963196 - RNA, 23 nt, Staphylococcus aureus subsp. aureus Mu50
ucuauuaaacauuuuugaauuua

SEQ ID NO: 3963197 - RNA, 21 nt, Staphylococcus aureus subsp. aureus Mu50
ucuauuaacugaccuaacaau

SEQ ID NO: 3963198 - RNA, 23 nt, Staphylococcus aureus subsp. aureus Mu50
ucuauuaaugcucuauauaucca

SEQ ID NO: 3963199 - RNA, 23 nt, Staphylococcus aureus subsp. aureus Mu50
ucuauuauauugaauugaaaaau

SEQ ID NO: 3963200 - RNA, 15 nt, Staphylococcus aureus subsp. aureus Mu50
ucuauucaaaaaggu

SEQ ID NO: 3963201 - RNA, 13 nt, Staphylococcus aureus subsp. aureus Mu50
ucuauuuaauaau

SEQ ID NO: 3963202 - RNA, 17 nt, Staphylococcus aureus subsp. aureus Mu50
ucuauuuuauaauaaau

SEQ ID NO: 3963203 - RNA, 20 nt, Staphylococcus aureus subsp. aureus Mu50
ucuauuuuaugauuugauuu

SEQ ID NO: 3963204 - RNA, 21 nt, Staphylococcus aureus subsp. aureus Mu50
ucuauuuucugccauaaacau

SEQ ID NO: 3963205 - RNA, 16 nt, Staphylococcus aureus subsp. aureus Mu50
ucuauuuuuaacuaau

SEQ ID NO: 3963206 - RNA, 14 nt, Staphylococcus aureus subsp. aureus Mu50
ucuauuuuugauuu

SEQ ID NO: 3963207 - RNA, 20 nt, Staphylococcus aureus subsp. aureus Mu50
ucuauuuuugauuuaauaau

SEQ ID NO: 3963208 - RNA, 22 nt, Staphylococcus aureus subsp. aureus Mu50
ucucaaagguuuacuauuaaag

SEQ ID NO: 3963209 - RNA, 21 nt, Staphylococcus aureus subsp. aureus Mu50
ucucaacaaaucuauaaauau

SEQ ID NO: 3963210 - RNA, 17 nt, Staphylococcus aureus subsp. aureus Mu50
ucucaaugcauuuaauu

SEQ ID NO: 3963211 - RNA, 16 nt, Staphylococcus aureus subsp. aureus Mu50
ucucacuuaauaaaua

SEQ ID NO: 3963212 - RNA, 14 nt, Staphylococcus aureus subsp. aureus Mu50
ucucagcaauacua

SEQ ID NO: 3963213 - RNA, 16 nt, Staphylococcus aureus subsp. aureus Mu50
ucucauacuauaagca

SEQ ID NO: 3963214 - RNA, 19 nt, Staphylococcus aureus subsp. aureus Mu50
ucucauaucuauuuuucga

SEQ ID NO: 3963215 - RNA, 19 nt, Staphylococcus aureus subsp. aureus Mu50
ucucaucauuuucaauacu

SEQ ID NO: 3963216 - RNA, 19 nt, Staphylococcus aureus subsp. aureus Mu50
ucucaucuacuauuuaauc

SEQ ID NO: 3963217 - RNA, 14 nt, Staphylococcus aureus subsp. aureus Mu50
ucucaucuucuaaa

SEQ ID NO: 3963218 - RNA, 16 nt, Staphylococcus aureus subsp. aureus Mu50
ucucaucuucuaaauc

SEQ ID NO: 3963219 - RNA, 21 nt, Staphylococcus aureus subsp. aureus Mu50
ucucauuauaaugauuuuuau

SEQ ID NO: 3963220 - RNA, 23 nt, Staphylococcus aureus subsp. aureus Mu50
ucuccaguuuucaauuuauuaac

SEQ ID NO: 3963221 - RNA, 19 nt, Staphylococcus aureus subsp. aureus Mu50
ucuccauuagaacuaagau

SEQ ID NO: 3963222 - RNA, 16 nt, Staphylococcus aureus subsp. aureus Mu50
ucuccguauuuaccuu

SEQ ID NO: 3963223 - RNA, 22 nt, Staphylococcus aureus subsp. aureus Mu50
ucuccuaaagguaacuuuuuaa

SEQ ID NO: 3963224 - RNA, 20 nt, Staphylococcus aureus subsp. aureus Mu50
ucuccuacaacuauucccac

SEQ ID NO: 3963225 - RNA, 21 nt, Staphylococcus aureus subsp. aureus Mu50
ucuccuacaacuauucccacu

SEQ ID NO: 3963226 - RNA, 20 nt, Staphylococcus aureus subsp. aureus Mu50
ucucgauuaauuuucuuuuu

SEQ ID NO: 3963227 - RNA, 19 nt, Staphylococcus aureus subsp. aureus Mu50
ucucgcauacugucaucuu

SEQ ID NO: 3963228 - RNA, 20 nt, Staphylococcus aureus subsp. aureus Mu50
ucucgcuaaauuuauauagu

SEQ ID NO: 3963229 - RNA, 15 nt, Staphylococcus aureus subsp. aureus Mu50
ucucgcuuacucauu

SEQ ID NO: 3963230 - RNA, 16 nt, Staphylococcus aureus subsp. aureus Mu50
ucucggcauuuuuaua

SEQ ID NO: 3963231 - RNA, 18 nt, Staphylococcus aureus subsp. aureus Mu50
ucucguguaaaaugcaau

SEQ ID NO: 3963232 - RNA, 15 nt, Staphylococcus aureus subsp. aureus Mu50
ucucguguauacaac

SEQ ID NO: 3963233 - RNA, 17 nt, Staphylococcus aureus subsp. aureus Mu50
ucucguugcacaacagu

SEQ ID NO: 3963234 - RNA, 19 nt, Staphylococcus aureus subsp. aureus Mu50
ucucguuuguacucuucgu

SEQ ID NO: 3963235 - RNA, 13 nt, Staphylococcus aureus subsp. aureus Mu50
ucucuaauuucac

SEQ ID NO: 3963236 - RNA, 14 nt, Staphylococcus aureus subsp. aureus Mu50
ucucuaguaucuga

SEQ ID NO: 3963237 - RNA, 18 nt, Staphylococcus aureus subsp. aureus Mu50
ucucuaguaucugauacc

SEQ ID NO: 3963238 - RNA, 22 nt, Staphylococcus aureus subsp. aureus Mu50
ucucuaucaguccgcuuuuuca

SEQ ID NO: 3963239 - RNA, 23 nt, Staphylococcus aureus subsp. aureus Mu50
ucucuaucaguccgcuuuuucau

SEQ ID NO: 3963240 - RNA, 18 nt, Staphylococcus aureus subsp. aureus Mu50
ucucucaaugcauuuaau

SEQ ID NO: 3963241 - RNA, 17 nt, Staphylococcus aureus subsp. aureus Mu50
ucucucgcuaaauuuau

SEQ ID NO: 3963242 - RNA, 17 nt, Staphylococcus aureus subsp. aureus Mu50
ucucugaaaaacuucuu

SEQ ID NO: 3963243 - RNA, 16 nt, Staphylococcus aureus subsp. aureus Mu50
ucucugcugcuuucau

SEQ ID NO: 3963244 - RNA, 19 nt, Staphylococcus aureus subsp. aureus Mu50
ucucuuaaauaugaauaau

SEQ ID NO: 3963245 - RNA, 16 nt, Staphylococcus aureus subsp. aureus Mu50
ucucuucaaaguagau

SEQ ID NO: 3963246 - RNA, 16 nt, Staphylococcus aureus subsp. aureus Mu50
ucucuucugucuaaaa

SEQ ID NO: 3963247 - RNA, 15 nt, Staphylococcus aureus subsp. aureus Mu50
ucucuuucuuauuca

SEQ ID NO: 3963248 - RNA, 22 nt, Staphylococcus aureus subsp. aureus Mu50
ucucuuuuaaauucuuauaaaa

SEQ ID NO: 3963249 - RNA, 14 nt, Staphylococcus aureus subsp. aureus Mu50
ucucuuuucacgaa

SEQ ID NO: 3963250 - RNA, 20 nt, Staphylococcus aureus subsp. aureus Mu50
ucucuuuuugauuauauuua

SEQ ID NO: 3963251 - RNA, 22 nt, Staphylococcus aureus subsp. aureus Mu50
ucucuuuuugauuauauuuauu

SEQ ID NO: 3963252 - RNA, 19 nt, Staphylococcus aureus subsp. aureus Mu50
ucugaaaaaauuaauaauu

SEQ ID NO: 3963253 - RNA, 22 nt, Staphylococcus aureus subsp. aureus Mu50
ucugaaaauaucacugaaugcu

SEQ ID NO: 3963254 - RNA, 19 nt, Staphylococcus aureus subsp. aureus Mu50
ucugaaacuuuaauacuac

SEQ ID NO: 3963255 - RNA, 13 nt, Staphylococcus aureus subsp. aureus Mu50
ucugaauuuaaua

SEQ ID NO: 3963256 - RNA, 19 nt, Staphylococcus aureus subsp. aureus Mu50
ucugacaacuuaauagaaa

SEQ ID NO: 3963257 - RNA, 14 nt, Staphylococcus aureus subsp. aureus Mu50
ucugacauuguugc

SEQ ID NO: 3963258 - RNA, 17 nt, Staphylococcus aureus subsp. aureus Mu50
ucugacuuuuaaaaaac

SEQ ID NO: 3963259 - RNA, 22 nt, Staphylococcus aureus subsp. aureus Mu50
ucugauacagaaccaacaauaa

SEQ ID NO: 3963260 - RNA, 22 nt, Staphylococcus aureus subsp. aureus Mu50
ucugauacuucaccaucuuuaa

SEQ ID NO: 3963261 - RNA, 20 nt, Staphylococcus aureus subsp. aureus Mu50
ucugaugaggcaauauuaaa

SEQ ID NO: 3963262 - RNA, 13 nt, Staphylococcus aureus subsp. aureus Mu50
ucugauucucuaa

SEQ ID NO: 3963263 - RNA, 23 nt, Staphylococcus aureus subsp. aureus Mu50
ucugauucucuaacgauuucuag

SEQ ID NO: 3963264 - RNA, 20 nt, Staphylococcus aureus subsp. aureus Mu50
ucugauucuucacuaaaaau

SEQ ID NO: 3963265 - RNA, 18 nt, Staphylococcus aureus subsp. aureus Mu50
ucugauuucacuucuaaa

SEQ ID NO: 3963266 - RNA, 13 nt, Staphylococcus aureus subsp. aureus Mu50
ucugcaaaaugca

SEQ ID NO: 3963267 - RNA, 23 nt, Staphylococcus aureus subsp. aureus Mu50
ucugcaugguuugcugguugcuu

SEQ ID NO: 3963268 - RNA, 15 nt, Staphylococcus aureus subsp. aureus Mu50
ucugcccugcaaugc

SEQ ID NO: 3963269 - RNA, 16 nt, Staphylococcus aureus subsp. aureus Mu50
ucugcgauuucuaaag

SEQ ID NO: 3963270 - RNA, 16 nt, Staphylococcus aureus subsp. aureus Mu50
ucugcugcuuucauag

SEQ ID NO: 3963271 - RNA, 11 nt, Staphylococcus aureus subsp. aureus Mu50
ucugcuuuauu

SEQ ID NO: 3963272 - RNA, 16 nt, Staphylococcus aureus subsp. aureus Mu50
ucugcuuuauuuuauc

SEQ ID NO: 3963273 - RNA, 13 nt, Staphylococcus aureus subsp. aureus Mu50
ucugcuuucgcuu

SEQ ID NO: 3963274 - RNA, 20 nt, Staphylococcus aureus subsp. aureus Mu50
ucuggaauaccuaaccauaa

SEQ ID NO: 3963275 - RNA, 15 nt, Staphylococcus aureus subsp. aureus Mu50
ucuggcaaauugccu

SEQ ID NO: 3963276 - RNA, 14 nt, Staphylococcus aureus subsp. aureus Mu50
ucugguaaaaaaau

SEQ ID NO: 3963277 - RNA, 17 nt, Staphylococcus aureus subsp. aureus Mu50
ucugguaaaaaaauaac

SEQ ID NO: 3963278 - RNA, 17 nt, Staphylococcus aureus subsp. aureus Mu50
ucugguucuuuacuaaa

SEQ ID NO: 3963279 - RNA, 22 nt, Staphylococcus aureus subsp. aureus Mu50
ucuguaaauuaucuaaagaaau

SEQ ID NO: 3963280 - RNA, 23 nt, Staphylococcus aureus subsp. aureus Mu50
ucuucaucaugacuauuuuccau

SEQ ID NO: 3963281 - RNA, 20 nt, Staphylococcus aureus subsp. aureus Mu50
ucuucaucauuguaaaacaa

SEQ ID NO: 3963282 - RNA, 12 nt, Staphylococcus aureus subsp. aureus Mu50
ucuucaucuucu

SEQ ID NO: 3963283 - RNA, 17 nt, Staphylococcus aureus subsp. aureus Mu50
ucuucaucuucuucaaa

SEQ ID NO: 3963284 - RNA, 12 nt, Staphylococcus aureus subsp. aureus Mu50
ucuucaucuuuu

SEQ ID NO: 3963285 - RNA, 14 nt, Staphylococcus aureus subsp. aureus Mu50
ucuucaugaacagc

SEQ ID NO: 3963286 - RNA, 17 nt, Staphylococcus aureus subsp. aureus Mu50
ucuucauuaucaauaga

SEQ ID NO: 3963287 - RNA, 14 nt, Staphylococcus aureus subsp. aureus Mu50
ucuucauuuaaaag

SEQ ID NO: 3963288 - RNA, 14 nt, Staphylococcus aureus subsp. aureus Mu50
ucuucauuuucauu

SEQ ID NO: 3963289 - RNA, 13 nt, Staphylococcus aureus subsp. aureus Mu50
ucuuccaaucaac

SEQ ID NO: 3963290 - RNA, 15 nt, Staphylococcus aureus subsp. aureus Mu50
ucuuccaaucaacuu

SEQ ID NO: 3963291 - RNA, 22 nt, Staphylococcus aureus subsp. aureus Mu50
ucuuccaaucaacuucauauaa

SEQ ID NO: 3963292 - RNA, 20 nt, Staphylococcus aureus subsp. aureus Mu50
ucuucccaaaaauuguucaa

SEQ ID NO: 3963293 - RNA, 23 nt, Staphylococcus aureus subsp. aureus Mu50
ucuuccuccgccaucaauauuua

SEQ ID NO: 3963294 - RNA, 21 nt, Staphylococcus aureus subsp. aureus Mu50
ucuucgcgaccguguuguuga

SEQ ID NO: 3963295 - RNA, 21 nt, Staphylococcus aureus subsp. aureus Mu50
ucuucggcuuuguaaaauugu

SEQ ID NO: 3963296 - RNA, 13 nt, Staphylococcus aureus subsp. aureus Mu50
ucuucuaauucug

SEQ ID NO: 3963297 - RNA, 20 nt, Staphylococcus aureus subsp. aureus Mu50
ucuucuaguaauucuucauc

SEQ ID NO: 3963298 - RNA, 20 nt, Staphylococcus aureus subsp. aureus Mu50
ucuucuauuaaacauuuuug

SEQ ID NO: 3963299 - RNA, 23 nt, Staphylococcus aureus subsp. aureus Mu50
ucuucuauuaaacauuuuugaau

SEQ ID NO: 3963300 - RNA, 23 nt, Staphylococcus aureus subsp. aureus Mu50
ucuucucaacaaaucuauaaaua

SEQ ID NO: 3963301 - RNA, 17 nt, Staphylococcus aureus subsp. aureus Mu50
ucuucugcauagcgcuc

SEQ ID NO: 3963302 - RNA, 13 nt, Staphylococcus aureus subsp. aureus Mu50
ucuucuucagaaa

SEQ ID NO: 3963303 - RNA, 13 nt, Staphylococcus aureus subsp. aureus Mu50
ucuucuuuuaaua

SEQ ID NO: 3963304 - RNA, 14 nt, Staphylococcus aureus subsp. aureus Mu50
ucuucuuuuuuuaa

SEQ ID NO: 3963305 - RNA, 21 nt, Staphylococcus aureus subsp. aureus Mu50
ucuucuuuuuuucuccuuugu

SEQ ID NO: 3963306 - RNA, 23 nt, Staphylococcus aureus subsp. aureus Mu50
ucuugaaaaguuuggcuuuuuau

SEQ ID NO: 3963307 - RNA, 19 nt, Staphylococcus aureus subsp. aureus Mu50
ucuugaaccccauucacua

SEQ ID NO: 3963308 - RNA, 22 nt, Staphylococcus aureus subsp. aureus Mu50
ucuugagcaucacucaacauau

SEQ ID NO: 3963309 - RNA, 23 nt, Staphylococcus aureus subsp. aureus Mu50
ucuugagcaucacucaacauauu

SEQ ID NO: 3963310 - RNA, 20 nt, Staphylococcus aureus subsp. aureus Mu50
ucuugagcuguuacacuuuu

SEQ ID NO: 3963311 - RNA, 14 nt, Staphylococcus aureus subsp. aureus Mu50
ucuugauaaaauaa

SEQ ID NO: 3963312 - RNA, 16 nt, Staphylococcus aureus subsp. aureus Mu50
ucuugauaaaauaaau

SEQ ID NO: 3963313 - RNA, 13 nt, Staphylococcus aureus subsp. aureus Mu50
ucuugauauucau

SEQ ID NO: 3963314 - RNA, 19 nt, Staphylococcus aureus subsp. aureus Mu50
ucuugcaagccaucaauau

SEQ ID NO: 3963315 - RNA, 15 nt, Staphylococcus aureus subsp. aureus Mu50
ucuugcaaguauuuu

SEQ ID NO: 3963316 - RNA, 16 nt, Staphylococcus aureus subsp. aureus Mu50
ucuugcaauagcaaca

SEQ ID NO: 3963317 - RNA, 22 nt, Staphylococcus aureus subsp. aureus Mu50
ucuugcauacgaauuaaaauaa

SEQ ID NO: 3963318 - RNA, 16 nt, Staphylococcus aureus subsp. aureus Mu50
ucuuggacuaauaauu

SEQ ID NO: 3963319 - RNA, 21 nt, Staphylococcus aureus subsp. aureus Mu50
ucuuggacuaauaauugucca

SEQ ID NO: 3963320 - RNA, 17 nt, Staphylococcus aureus subsp. aureus Mu50
ucuuggauguuuucguu

SEQ ID NO: 3963321 - RNA, 18 nt, Staphylococcus aureus subsp. aureus Mu50
ucuuggcguauuuuuugu

SEQ ID NO: 3963322 - RNA, 15 nt, Staphylococcus aureus subsp. aureus Mu50
ucuugguauuuuuua

SEQ ID NO: 3963323 - RNA, 23 nt, Staphylococcus aureus subsp. aureus Mu50
ucuugguauuuuuuaaaugcgua

SEQ ID NO: 3963324 - RNA, 14 nt, Staphylococcus aureus subsp. aureus Mu50
ucuuggugauaguc

SEQ ID NO: 3963325 - RNA, 20 nt, Staphylococcus aureus subsp. aureus Mu50
ucuugucauuucaaucauuu

SEQ ID NO: 3963326 - RNA, 13 nt, Staphylococcus aureus subsp. aureus Mu50
ucuugugaaauua

SEQ ID NO: 3963327 - RNA, 18 nt, Staphylococcus aureus subsp. aureus Mu50
ucuugugauaauucuuca

SEQ ID NO: 3963328 - RNA, 20 nt, Staphylococcus aureus subsp. aureus Mu50
ucuugugcgguaaccauuuu

SEQ ID NO: 3963329 - RNA, 16 nt, Staphylococcus aureus subsp. aureus Mu50
ucuuguucuaauuguu

SEQ ID NO: 3963330 - RNA, 16 nt, Staphylococcus aureus subsp. aureus Mu50
ucuuguuggauuuuaa

SEQ ID NO: 3963331 - RNA, 19 nt, Staphylococcus aureus subsp. aureus Mu50
ucuuguuucaaacaaagcu

SEQ ID NO: 3963332 - RNA, 17 nt, Staphylococcus aureus subsp. aureus Mu50
ucuuguuuucauuuaaa

SEQ ID NO: 3963333 - RNA, 20 nt, Staphylococcus aureus subsp. aureus Mu50
ucuuuaaacucguaaauuuu

SEQ ID NO: 3963334 - RNA, 17 nt, Staphylococcus aureus subsp. aureus Mu50
ucuuuaaagucuuuaau

SEQ ID NO: 3963335 - RNA, 23 nt, Staphylococcus aureus subsp. aureus Mu50
ucuuuaacccaaauugaugacuu

SEQ ID NO: 3963336 - RNA, 22 nt, Staphylococcus aureus subsp. aureus Mu50
ucuuuaagcccuuccccuacaa

SEQ ID NO: 3963337 - RNA, 16 nt, Staphylococcus aureus subsp. aureus Mu50
ucuuuaagcuuaaaua

SEQ ID NO: 3963338 - RNA, 17 nt, Staphylococcus aureus subsp. aureus Mu50
ucuuuaagcuuaaauag

SEQ ID NO: 3963339 - RNA, 18 nt, Staphylococcus aureus subsp. aureus Mu50
ucuuuaagcuuaaauagu

SEQ ID NO: 3963340 - RNA, 19 nt, Staphylococcus aureus subsp. aureus Mu50
ucuuuaagugacacaccac

SEQ ID NO: 3963341 - RNA, 14 nt, Staphylococcus aureus subsp. aureus Mu50
ucuuuaauauaaau

SEQ ID NO: 3963342 - RNA, 14 nt, Staphylococcus aureus subsp. aureus Mu50
ucuuuaaugaaagc

SEQ ID NO: 3963343 - RNA, 15 nt, Staphylococcus aureus subsp. aureus Mu50
ucuuuaaugaaagca

SEQ ID NO: 3963344 - RNA, 17 nt, Staphylococcus aureus subsp. aureus Mu50
ucuuuaauguaauuauu

SEQ ID NO: 3963345 - RNA, 16 nt, Staphylococcus aureus subsp. aureus Mu50
ucuuuaccauauaauu

SEQ ID NO: 3963346 - RNA, 15 nt, Staphylococcus aureus subsp. aureus Mu50
ucuuuacuaaagaua

SEQ ID NO: 3963347 - RNA, 20 nt, Staphylococcus aureus subsp. aureus Mu50
ucuuuacuuguaauuaauac

SEQ ID NO: 3963348 - RNA, 17 nt, Staphylococcus aureus subsp. aureus Mu50
ucuuuagauugaucagc

SEQ ID NO: 3963349 - RNA, 18 nt, Staphylococcus aureus subsp. aureus Mu50
ucuuuagcuauguaaaau

SEQ ID NO: 3963350 - RNA, 20 nt, Staphylococcus aureus subsp. aureus Mu50
ucuuuagcuauguaaaauua

SEQ ID NO: 3963351 - RNA, 15 nt, Staphylococcus aureus subsp. aureus Mu50
ucuuuagguaaaaga

SEQ ID NO: 3963352 - RNA, 13 nt, Staphylococcus aureus subsp. aureus Mu50
ucuuuauaacuuu

SEQ ID NO: 3963353 - RNA, 15 nt, Staphylococcus aureus subsp. aureus Mu50
ucuuuauuaauaaau

SEQ ID NO: 3963354 - RNA, 23 nt, Staphylococcus aureus subsp. aureus Mu50
ucuuuauugggagcaaucaauac

SEQ ID NO: 3963355 - RNA, 21 nt, Staphylococcus aureus subsp. aureus Mu50
ucuuuauuuuuuaucauuuuu

SEQ ID NO: 3963356 - RNA, 18 nt, Staphylococcus aureus subsp. aureus Mu50
ucuuucaaauacacagau

SEQ ID NO: 3963357 - RNA, 15 nt, Staphylococcus aureus subsp. aureus Mu50
ucuuucaaaugcuua

SEQ ID NO: 3963358 - RNA, 19 nt, Staphylococcus aureus subsp. aureus Mu50
ucuuucaacgcauauucua

SEQ ID NO: 3963359 - RNA, 21 nt, Staphylococcus aureus subsp. aureus Mu50
ucuuucaacgcauauucuauu

SEQ ID NO: 3963360 - RNA, 14 nt, Staphylococcus aureus subsp. aureus Mu50
ucuuucaauuaauc

SEQ ID NO: 3963361 - RNA, 15 nt, Staphylococcus aureus subsp. aureus Mu50
ucuuucaauuaauuu

SEQ ID NO: 3963362 - RNA, 18 nt, Staphylococcus aureus subsp. aureus Mu50
ucuuucaauuaauuuaaa

SEQ ID NO: 3963363 - RNA, 22 nt, Staphylococcus aureus subsp. aureus Mu50
ucuuucgacuucgauaucaaug

SEQ ID NO: 3963364 - RNA, 19 nt, Staphylococcus aureus subsp. aureus Mu50
ucuuucgagguaauuucac

SEQ ID NO: 3963365 - RNA, 14 nt, Staphylococcus aureus subsp. aureus Mu50
ucuuucgucuugua

SEQ ID NO: 3963366 - RNA, 16 nt, Staphylococcus aureus subsp. aureus Mu50
ucuuucuaaguuugaa

SEQ ID NO: 3963367 - RNA, 22 nt, Staphylococcus aureus subsp. aureus Mu50
ugaaaauaccucuacauuauau

SEQ ID NO: 3963368 - RNA, 22 nt, Staphylococcus aureus subsp. aureus Mu50
ugaaaauagaaagaaauuguuc

SEQ ID NO: 3963369 - RNA, 16 nt, Staphylococcus aureus subsp. aureus Mu50
ugaaaauagccauauu

SEQ ID NO: 3963370 - RNA, 18 nt, Staphylococcus aureus subsp. aureus Mu50
ugaaacaucuugauauuc

SEQ ID NO: 3963371 - RNA, 20 nt, Staphylococcus aureus subsp. aureus Mu50
ugaaacuaauaauuuguaau

SEQ ID NO: 3963372 - RNA, 18 nt, Staphylococcus aureus subsp. aureus Mu50
ugaaacugaguucaauua

SEQ ID NO: 3963373 - RNA, 22 nt, Staphylococcus aureus subsp. aureus Mu50
ugaaacugauugggcugauaau

SEQ ID NO: 3963374 - RNA, 19 nt, Staphylococcus aureus subsp. aureus Mu50
ugaaagaaaagugaaaacu

SEQ ID NO: 3963375 - RNA, 16 nt, Staphylococcus aureus subsp. aureus Mu50
ugaaagauuuguagcu

SEQ ID NO: 3963376 - RNA, 23 nt, Staphylococcus aureus subsp. aureus Mu50
ugaaaggaguauuuuugcguuaa

SEQ ID NO: 3963377 - RNA, 23 nt, Staphylococcus aureus subsp. aureus Mu50
ugaaaguaccgguuuuucguaua

SEQ ID NO: 3963378 - RNA, 17 nt, Staphylococcus aureus subsp. aureus Mu50
ugaaaguaccuaaaaua

SEQ ID NO: 3963379 - RNA, 19 nt, Staphylococcus aureus subsp. aureus Mu50
ugaaaguaccuaaaauaga

SEQ ID NO: 3963380 - RNA, 20 nt, Staphylococcus aureus subsp. aureus Mu50
ugaaaguaccuaaaauagaa

SEQ ID NO: 3963381 - RNA, 22 nt, Staphylococcus aureus subsp. aureus Mu50
ugaaaguaccuaaaauagaaaa

SEQ ID NO: 3963382 - RNA, 13 nt, Staphylococcus aureus subsp. aureus Mu50
ugaaaguauuaga

SEQ ID NO: 3963383 - RNA, 20 nt, Staphylococcus aureus subsp. aureus Mu50
ugaaaguauuagauauauuu

SEQ ID NO: 3963384 - RNA, 22 nt, Staphylococcus aureus subsp. aureus Mu50
ugaaagucguuguugaaauuaa

SEQ ID NO: 3963385 - RNA, 19 nt, Staphylococcus aureus subsp. aureus Mu50
ugaaaguuuuugucuuaau

SEQ ID NO: 3963386 - RNA, 14 nt, Staphylococcus aureus subsp. aureus Mu50
ugaaauaauauaaa

SEQ ID NO: 3963387 - RNA, 21 nt, Staphylococcus aureus subsp. aureus Mu50
ugaaauaauauaaaaacaaaa

SEQ ID NO: 3963388 - RNA, 22 nt, Staphylococcus aureus subsp. aureus Mu50
ugaaauaccuccugauugcugc

SEQ ID NO: 3963389 - RNA, 14 nt, Staphylococcus aureus subsp. aureus Mu50
ugaaauagaaacua

SEQ ID NO: 3963390 - RNA, 15 nt, Staphylococcus aureus subsp. aureus Mu50
ugaaauaguuaaagu

SEQ ID NO: 3963391 - RNA, 16 nt, Staphylococcus aureus subsp. aureus Mu50
ugaaauauaccaacca

SEQ ID NO: 3963392 - RNA, 14 nt, Staphylococcus aureus subsp. aureus Mu50
ugaaauaucaagau

SEQ ID NO: 3963393 - RNA, 16 nt, Staphylococcus aureus subsp. aureus Mu50
ugaaauaucgagaggg

SEQ ID NO: 3963394 - RNA, 18 nt, Staphylococcus aureus subsp. aureus Mu50
ugaaauauucuuuaauau

SEQ ID NO: 3963395 - RNA, 15 nt, Staphylococcus aureus subsp. aureus Mu50
ugaaauauuuaucuu

SEQ ID NO: 3963396 - RNA, 16 nt, Staphylococcus aureus subsp. aureus Mu50
ugaaauauuuaucuuu

SEQ ID NO: 3963397 - RNA, 21 nt, Staphylococcus aureus subsp. aureus Mu50
ugaaaucaguuuuugaauauu

SEQ ID NO: 3963398 - RNA, 22 nt, Staphylococcus aureus subsp. aureus Mu50
ugaaaucaguuuuugaauauuu

SEQ ID NO: 3963399 - RNA, 14 nt, Staphylococcus aureus subsp. aureus Mu50
ugaaaucauuuaaa

SEQ ID NO: 3963400 - RNA, 19 nt, Staphylococcus aureus subsp. aureus Mu50
ugaaaucuauugugauaua

SEQ ID NO: 3963401 - RNA, 15 nt, Staphylococcus aureus subsp. aureus Mu50
ugaaaugagcuuaag

SEQ ID NO: 3963402 - RNA, 20 nt, Staphylococcus aureus subsp. aureus Mu50
ugaaaugauacauuauuaaa

SEQ ID NO: 3963403 - RNA, 17 nt, Staphylococcus aureus subsp. aureus Mu50
ugaaauggaaaguaaua

SEQ ID NO: 3963404 - RNA, 15 nt, Staphylococcus aureus subsp. aureus Mu50
ugaaaugguaucuaa

SEQ ID NO: 3963405 - RNA, 17 nt, Staphylococcus aureus subsp. aureus Mu50
ugaaauguuuaucaauu

SEQ ID NO: 3963406 - RNA, 17 nt, Staphylococcus aureus subsp. aureus Mu50
ugaaauuaaauucaaau

SEQ ID NO: 3963407 - RNA, 21 nt, Staphylococcus aureus subsp. aureus Mu50
ugaaauuaacgucaacagcau

SEQ ID NO: 3963408 - RNA, 23 nt, Staphylococcus aureus subsp. aureus Mu50
ugaaauuaacgucaacagcauaa

SEQ ID NO: 3963409 - RNA, 16 nt, Staphylococcus aureus subsp. aureus Mu50
ugaaauuaauuaucuu

SEQ ID NO: 3963410 - RNA, 19 nt, Staphylococcus aureus subsp. aureus Mu50
ugaaauuagauuuuaugcu

SEQ ID NO: 3963411 - RNA, 13 nt, Staphylococcus aureus subsp. aureus Mu50
ugaaauuauuauu

SEQ ID NO: 3963412 - RNA, 20 nt, Staphylococcus aureus subsp. aureus Mu50
ugaaauuauuauuuaaauuu

SEQ ID NO: 3963413 - RNA, 22 nt, Staphylococcus aureus subsp. aureus Mu50
ugaaauucuuuuguaauugaaa

SEQ ID NO: 3963414 - RNA, 20 nt, Staphylococcus aureus subsp. aureus Mu50
ugaaauugacaguuuccaua

SEQ ID NO: 3963415 - RNA, 14 nt, Staphylococcus aureus subsp. aureus Mu50
ugaaauuuauuaua

SEQ ID NO: 3963416 - RNA, 18 nt, Staphylococcus aureus subsp. aureus Mu50
ugaaauuucuguaaccaa

SEQ ID NO: 3963417 - RNA, 14 nt, Staphylococcus aureus subsp. aureus Mu50
ugaaauuuuuaaua

SEQ ID NO: 3963418 - RNA, 14 nt, Staphylococcus aureus subsp. aureus Mu50
ugaaauuuuuccga

SEQ ID NO: 3963419 - RNA, 22 nt, Staphylococcus aureus subsp. aureus Mu50
ugaacaaaaaauaaaaacuucu

SEQ ID NO: 3963420 - RNA, 23 nt, Staphylococcus aureus subsp. aureus Mu50
ugaacaaaaaauaaaaacuucua

SEQ ID NO: 3963421 - RNA, 14 nt, Staphylococcus aureus subsp. aureus Mu50
ugaacaacaucuuu

SEQ ID NO: 3963422 - RNA, 20 nt, Staphylococcus aureus subsp. aureus Mu50
ugaacaacaucuuuuguugu

SEQ ID NO: 3963423 - RNA, 22 nt, Staphylococcus aureus subsp. aureus Mu50
ugaacaacauugagauuaucuu

SEQ ID NO: 3963424 - RNA, 13 nt, Staphylococcus aureus subsp. aureus Mu50
ugaacaauaauau

SEQ ID NO: 3963425 - RNA, 22 nt, Staphylococcus aureus subsp. aureus Mu50
ugaacaauaauaugccauagua

SEQ ID NO: 3963426 - RNA, 21 nt, Staphylococcus aureus subsp. aureus Mu50
ugaacaauaccgcgauaaaua

SEQ ID NO: 3963427 - RNA, 13 nt, Staphylococcus aureus subsp. aureus Mu50
ugaacauaaaaaa

SEQ ID NO: 3963428 - RNA, 16 nt, Staphylococcus aureus subsp. aureus Mu50
ugaacauauuauaaaa

SEQ ID NO: 3963429 - RNA, 17 nt, Staphylococcus aureus subsp. aureus Mu50
ugaacaucauuuaauug

SEQ ID NO: 3963430 - RNA, 13 nt, Staphylococcus aureus subsp. aureus Mu50
ugaacaucuaguu

SEQ ID NO: 3963431 - RNA, 22 nt, Staphylococcus aureus subsp. aureus Mu50
ugaacaucuaguuauuucauag

SEQ ID NO: 3963432 - RNA, 18 nt, Staphylococcus aureus subsp. aureus Mu50
ugaaccaauccaauauac

SEQ ID NO: 3963433 - RNA, 23 nt, Staphylococcus aureus subsp. aureus Mu50
ugaacgaaaauucgcuuguaaca

SEQ ID NO: 3963434 - RNA, 16 nt, Staphylococcus aureus subsp. aureus Mu50
ugaacgauauucuaca

SEQ ID NO: 3963435 - RNA, 14 nt, Staphylococcus aureus subsp. aureus Mu50
ugaacgguagaaua

SEQ ID NO: 3963436 - RNA, 16 nt, Staphylococcus aureus subsp. aureus Mu50
ugaacgguuguauuuc

SEQ ID NO: 3963437 - RNA, 22 nt, Staphylococcus aureus subsp. aureus Mu50
ugaacgguuguauuucaucaug

SEQ ID NO: 3963438 - RNA, 12 nt, Staphylococcus aureus subsp. aureus Mu50
ugaacguuuauu

SEQ ID NO: 3963439 - RNA, 22 nt, Staphylococcus aureus subsp. aureus Mu50
ugaacuaaaacgauaauaauaa

SEQ ID NO: 3963440 - RNA, 20 nt, Staphylococcus aureus subsp. aureus Mu50
ugaacuacucccgcaaauau

SEQ ID NO: 3963441 - RNA, 23 nt, Staphylococcus aureus subsp. aureus Mu50
ugaacuguuucuguaaaaguaua

SEQ ID NO: 3963442 - RNA, 12 nt, Staphylococcus aureus subsp. aureus Mu50
ugaacuucuuuu

SEQ ID NO: 3963443 - RNA, 13 nt, Staphylococcus aureus subsp. aureus Mu50
ugaacuuuuauuu

SEQ ID NO: 3963444 - RNA, 13 nt, Staphylococcus aureus subsp. aureus Mu50
ugaagaaaucuau

SEQ ID NO: 3963445 - RNA, 12 nt, Staphylococcus aureus subsp. aureus Mu50
ugaagaaauuug

SEQ ID NO: 3963446 - RNA, 15 nt, Staphylococcus aureus subsp. aureus Mu50
ugaagaauacaaaua

SEQ ID NO: 3963447 - RNA, 19 nt, Staphylococcus aureus subsp. aureus Mu50
ugaagaauacaaauauuaa

SEQ ID NO: 3963448 - RNA, 23 nt, Staphylococcus aureus subsp. aureus Mu50
ugaagaaucaggaccaaauagag

SEQ ID NO: 3963449 - RNA, 21 nt, Staphylococcus aureus subsp. aureus Mu50
ugaagaauguuucauaugcau

SEQ ID NO: 3963450 - RNA, 13 nt, Staphylococcus aureus subsp. aureus Mu50
ugaagauguauuu

SEQ ID NO: 3963451 - RNA, 20 nt, Staphylococcus aureus subsp. aureus Mu50
ugaagcgcuuggauuuuuug

SEQ ID NO: 3963452 - RNA, 22 nt, Staphylococcus aureus subsp. aureus Mu50
ugaagcguuuuuauuacaaaca

SEQ ID NO: 3963453 - RNA, 14 nt, Staphylococcus aureus subsp. aureus Mu50
ugaagcuaauucau

SEQ ID NO: 3963454 - RNA, 14 nt, Staphylococcus aureus subsp. aureus Mu50
ugaauuuagcauca

SEQ ID NO: 3963455 - RNA, 14 nt, Staphylococcus aureus subsp. aureus Mu50
ugaauuuauuuugu

SEQ ID NO: 3963456 - RNA, 23 nt, Staphylococcus aureus subsp. aureus Mu50
ugaauuuuaacuaagauuaguag

SEQ ID NO: 3963457 - RNA, 16 nt, Staphylococcus aureus subsp. aureus Mu50
ugaauuuuaauauauu

SEQ ID NO: 3963458 - RNA, 15 nt, Staphylococcus aureus subsp. aureus Mu50
ugaauuuuauaaauu

SEQ ID NO: 3963459 - RNA, 21 nt, Staphylococcus aureus subsp. aureus Mu50
ugaauuuuauaaauuaaaugc

SEQ ID NO: 3963460 - RNA, 21 nt, Staphylococcus aureus subsp. aureus Mu50
ugaauuuuauaaguauauaau

SEQ ID NO: 3963461 - RNA, 13 nt, Staphylococcus aureus subsp. aureus Mu50
ugaauuuuuauuu

SEQ ID NO: 3963462 - RNA, 17 nt, Staphylococcus aureus subsp. aureus Mu50
ugaauuuuuauuuuuag

SEQ ID NO: 3963463 - RNA, 14 nt, Staphylococcus aureus subsp. aureus Mu50
ugacaaauuaucac

SEQ ID NO: 3963464 - RNA, 14 nt, Staphylococcus aureus subsp. aureus Mu50
ugacaacauaacaa

SEQ ID NO: 3963465 - RNA, 13 nt, Staphylococcus aureus subsp. aureus Mu50
ugacaacauuauu

SEQ ID NO: 3963466 - RNA, 19 nt, Staphylococcus aureus subsp. aureus Mu50
ugacaacuuaauagaaaga

SEQ ID NO: 3963467 - RNA, 19 nt, Staphylococcus aureus subsp. aureus Mu50
ugacaaguaugucaucuuc

SEQ ID NO: 3963468 - RNA, 17 nt, Staphylococcus aureus subsp. aureus Mu50
ugacaauguacauaaau

SEQ ID NO: 3963469 - RNA, 17 nt, Staphylococcus aureus subsp. aureus Mu50
ugacacacccaaauuua

SEQ ID NO: 3963470 - RNA, 15 nt, Staphylococcus aureus subsp. aureus Mu50
ugacacauuauugaa

SEQ ID NO: 3963471 - RNA, 12 nt, Staphylococcus aureus subsp. aureus Mu50
ugacaccuaaua

SEQ ID NO: 3963472 - RNA, 19 nt, Staphylococcus aureus subsp. aureus Mu50
ugacacucauucaauuuag

SEQ ID NO: 3963473 - RNA, 20 nt, Staphylococcus aureus subsp. aureus Mu50
ugacaguuuccauaaauaaa

SEQ ID NO: 3963474 - RNA, 23 nt, Staphylococcus aureus subsp. aureus Mu50
ugacaguuuccauaaauaaaaug

SEQ ID NO: 3963475 - RNA, 14 nt, Staphylococcus aureus subsp. aureus Mu50
ugacauaaaaaaua

SEQ ID NO: 3963476 - RNA, 22 nt, Staphylococcus aureus subsp. aureus Mu50
ugacauaaaacuuacauuacau

SEQ ID NO: 3963477 - RNA, 15 nt, Staphylococcus aureus subsp. aureus Mu50
ugacauaggcgcuuu

SEQ ID NO: 3963478 - RNA, 16 nt, Staphylococcus aureus subsp. aureus Mu50
ugacauaucgauauuc

SEQ ID NO: 3963479 - RNA, 19 nt, Staphylococcus aureus subsp. aureus Mu50
ugacauaucgauauucucc

SEQ ID NO: 3963480 - RNA, 15 nt, Staphylococcus aureus subsp. aureus Mu50
ugacauauuuuuuaa

SEQ ID NO: 3963481 - RNA, 17 nt, Staphylococcus aureus subsp. aureus Mu50
ugacauauuuuuuaaau

SEQ ID NO: 3963482 - RNA, 21 nt, Staphylococcus aureus subsp. aureus Mu50
ugacauauuuuuuaaauuuaa

SEQ ID NO: 3963483 - RNA, 17 nt, Staphylococcus aureus subsp. aureus Mu50
ugacaucaucuauaaua

SEQ ID NO: 3963484 - RNA, 15 nt, Staphylococcus aureus subsp. aureus Mu50
ugacauccauacaaa

SEQ ID NO: 3963485 - RNA, 19 nt, Staphylococcus aureus subsp. aureus Mu50
ugacauguguuaaaccaac

SEQ ID NO: 3963486 - RNA, 22 nt, Staphylococcus aureus subsp. aureus Mu50
ugacauucauuuaguuaaauac

SEQ ID NO: 3963487 - RNA, 20 nt, Staphylococcus aureus subsp. aureus Mu50
ugacauuucaucaauaauuu

SEQ ID NO: 3963488 - RNA, 21 nt, Staphylococcus aureus subsp. aureus Mu50
ugacauuucaucaauaauuuc

SEQ ID NO: 3963489 - RNA, 12 nt, Staphylococcus aureus subsp. aureus Mu50
ugacauuucuga

SEQ ID NO: 3963490 - RNA, 18 nt, Staphylococcus aureus subsp. aureus Mu50
ugaccaauagaauucauu

SEQ ID NO: 3963491 - RNA, 17 nt, Staphylococcus aureus subsp. aureus Mu50
ugaccauuaucaagaac

SEQ ID NO: 3963492 - RNA, 14 nt, Staphylococcus aureus subsp. aureus Mu50
ugaccuaauauauu

SEQ ID NO: 3963493 - RNA, 14 nt, Staphylococcus aureus subsp. aureus Mu50
ugaccuacuuuuuc

SEQ ID NO: 3963494 - RNA, 17 nt, Staphylococcus aureus subsp. aureus Mu50
ugaccuacuuuuucaau

SEQ ID NO: 3963495 - RNA, 12 nt, Staphylococcus aureus subsp. aureus Mu50
ugaccucagguu

SEQ ID NO: 3963496 - RNA, 17 nt, Staphylococcus aureus subsp. aureus Mu50
ugaccuuaauauaacga

SEQ ID NO: 3963497 - RNA, 16 nt, Staphylococcus aureus subsp. aureus Mu50
ugaccuucaguuucua

SEQ ID NO: 3963498 - RNA, 23 nt, Staphylococcus aureus subsp. aureus Mu50
ugacgaaaugaaugagugcuuau

SEQ ID NO: 3963499 - RNA, 21 nt, Staphylococcus aureus subsp. aureus Mu50
ugacgaacgauagauucugau

SEQ ID NO: 3963500 - RNA, 18 nt, Staphylococcus aureus subsp. aureus Mu50
ugacgcgugaauuaaaaa

SEQ ID NO: 3963501 - RNA, 20 nt, Staphylococcus aureus subsp. aureus Mu50
ugacgcugguaauauuuuug

SEQ ID NO: 3963502 - RNA, 16 nt, Staphylococcus aureus subsp. aureus Mu50
ugacgugcuuuuaaau

SEQ ID NO: 3963503 - RNA, 19 nt, Staphylococcus aureus subsp. aureus Mu50
ugacgugcuuuuaaaugua

SEQ ID NO: 3963504 - RNA, 14 nt, Staphylococcus aureus subsp. aureus Mu50
ugacguugugucau

SEQ ID NO: 3963505 - RNA, 18 nt, Staphylococcus aureus subsp. aureus Mu50
ugacguugugucaugcug

SEQ ID NO: 3963506 - RNA, 16 nt, Staphylococcus aureus subsp. aureus Mu50
ugacuagggguuuuua

SEQ ID NO: 3963507 - RNA, 22 nt, Staphylococcus aureus subsp. aureus Mu50
ugacuagggguuuuuaauauau

SEQ ID NO: 3963508 - RNA, 22 nt, Staphylococcus aureus subsp. aureus Mu50
ugacuauuucgcuuuuuuuauu

SEQ ID NO: 3963509 - RNA, 12 nt, Staphylococcus aureus subsp. aureus Mu50
ugacuauuuucc

SEQ ID NO: 3963510 - RNA, 18 nt, Staphylococcus aureus subsp. aureus Mu50
ugacucaaagauauacuu

SEQ ID NO: 3963511 - RNA, 20 nt, Staphylococcus aureus subsp. aureus Mu50
ugacucagaaucuuacauug

SEQ ID NO: 3963512 - RNA, 18 nt, Staphylococcus aureus subsp. aureus Mu50
ugacugaaugagaaugug

SEQ ID NO: 3963513 - RNA, 16 nt, Staphylococcus aureus subsp. aureus Mu50
ugacugaauuaauauc

SEQ ID NO: 3963514 - RNA, 12 nt, Staphylococcus aureus subsp. aureus Mu50
ugacugagaaaa

SEQ ID NO: 3963515 - RNA, 14 nt, Staphylococcus aureus subsp. aureus Mu50
ugacuguaaaacaa

SEQ ID NO: 3963516 - RNA, 16 nt, Staphylococcus aureus subsp. aureus Mu50
ugacuguagaaaacau

SEQ ID NO: 3963517 - RNA, 17 nt, Staphylococcus aureus subsp. aureus Mu50
ugacugugaagcugugc

SEQ ID NO: 3963518 - RNA, 14 nt, Staphylococcus aureus subsp. aureus Mu50
ugacuguuaaacaa

SEQ ID NO: 3963519 - RNA, 22 nt, Staphylococcus aureus subsp. aureus Mu50
ugacuuaauaucauauucaaaa

SEQ ID NO: 3963520 - RNA, 14 nt, Staphylococcus aureus subsp. aureus Mu50
ugacuuacauuuua

SEQ ID NO: 3963521 - RNA, 14 nt, Staphylococcus aureus subsp. aureus Mu50
ugacuuauuuuuca

SEQ ID NO: 3963522 - RNA, 15 nt, Staphylococcus aureus subsp. aureus Mu50
ugacuuccuuaguca

SEQ ID NO: 3963523 - RNA, 16 nt, Staphylococcus aureus subsp. aureus Mu50
ugacuucuuuauauuu

SEQ ID NO: 3963524 - RNA, 14 nt, Staphylococcus aureus subsp. aureus Mu50
ugacuuuaaaucuu

SEQ ID NO: 3963525 - RNA, 20 nt, Staphylococcus aureus subsp. aureus Mu50
ugacuuuaaaucuuguucua

SEQ ID NO: 3963526 - RNA, 16 nt, Staphylococcus aureus subsp. aureus Mu50
ugacuuuaauugcucu

SEQ ID NO: 3963527 - RNA, 16 nt, Staphylococcus aureus subsp. aureus Mu50
ugacuuugucauacua

SEQ ID NO: 3963528 - RNA, 21 nt, Staphylococcus aureus subsp. aureus Mu50
ugacuuuuaaaaaacauaccu

SEQ ID NO: 3963529 - RNA, 14 nt, Staphylococcus aureus subsp. aureus Mu50
ugacuuuuauaauu

SEQ ID NO: 3963530 - RNA, 16 nt, Staphylococcus aureus subsp. aureus Mu50
ugacuuuuauaauucu

SEQ ID NO: 3963531 - RNA, 20 nt, Staphylococcus aureus subsp. aureus Mu50
ugagaaaaauauuucuaaua

SEQ ID NO: 3963532 - RNA, 16 nt, Staphylococcus aureus subsp. aureus Mu50
ugagaaaguaaaaguu

SEQ ID NO: 3963533 - RNA, 16 nt, Staphylococcus aureus subsp. aureus Mu50
ugagaaaucuuaaaga

SEQ ID NO: 3963534 - RNA, 15 nt, Staphylococcus aureus subsp. aureus Mu50
ugagaagaaauauau

SEQ ID NO: 3963535 - RNA, 19 nt, Staphylococcus aureus subsp. aureus Mu50
ugagaauauuuauuguuuu

SEQ ID NO: 3963536 - RNA, 15 nt, Staphylococcus aureus subsp. aureus Mu50
ugagaaucuuggaag

SEQ ID NO: 3963537 - RNA, 23 nt, Staphylococcus aureus subsp. aureus Mu50
ugagacccaccguuaaaauauau

SEQ ID NO: 3963538 - RNA, 17 nt, Staphylococcus aureus subsp. aureus Mu50
ugagacguuuuccauga

SEQ ID NO: 3963539 - RNA, 13 nt, Staphylococcus aureus subsp. aureus Mu50
ugagauaaaauca

SEQ ID NO: 3963540 - RNA, 16 nt, Staphylococcus aureus subsp. aureus Mu50
ugagauaaaaucauau

SEQ ID NO: 3963541 - RNA, 23 nt, Staphylococcus aureus subsp. aureus Mu50
ugagauaaaaucauaugucuuaa

SEQ ID NO: 3963542 - RNA, 19 nt, Staphylococcus aureus subsp. aureus Mu50
ugauauaaccgcauacaga

SEQ ID NO: 3963543 - RNA, 17 nt, Staphylococcus aureus subsp. aureus Mu50
ugauauaagauucauau

SEQ ID NO: 3963544 - RNA, 23 nt, Staphylococcus aureus subsp. aureus Mu50
ugauauauaacaaguacaauaau

SEQ ID NO: 3963545 - RNA, 17 nt, Staphylococcus aureus subsp. aureus Mu50
ugauauauaaccauagu

SEQ ID NO: 3963546 - RNA, 22 nt, Staphylococcus aureus subsp. aureus Mu50
ugauaucacuauacaaucauaa

SEQ ID NO: 3963547 - RNA, 18 nt, Staphylococcus aureus subsp. aureus Mu50
ugauaucugacauuucau

SEQ ID NO: 3963548 - RNA, 14 nt, Staphylococcus aureus subsp. aureus Mu50
ugauaucuugcuug

SEQ ID NO: 3963549 - RNA, 17 nt, Staphylococcus aureus subsp. aureus Mu50
ugauaugcucucuucaa

SEQ ID NO: 3963550 - RNA, 18 nt, Staphylococcus aureus subsp. aureus Mu50
ugauaugcucucuucaaa

SEQ ID NO: 3963551 - RNA, 20 nt, Staphylococcus aureus subsp. aureus Mu50
ugauaugcucucuucaaagu

SEQ ID NO: 3963552 - RNA, 16 nt, Staphylococcus aureus subsp. aureus Mu50
ugauauguuuccucuu

SEQ ID NO: 3963553 - RNA, 18 nt, Staphylococcus aureus subsp. aureus Mu50
ugauauguuuccucuuua

SEQ ID NO: 3963554 - RNA, 19 nt, Staphylococcus aureus subsp. aureus Mu50
ugauauuaggcuuaaauau

SEQ ID NO: 3963555 - RNA, 21 nt, Staphylococcus aureus subsp. aureus Mu50
ugauauucgcgaacguuauuu

SEQ ID NO: 3963556 - RNA, 19 nt, Staphylococcus aureus subsp. aureus Mu50
ugauauugaucugauuuca

SEQ ID NO: 3963557 - RNA, 14 nt, Staphylococcus aureus subsp. aureus Mu50
ugauauuuaacaaa

SEQ ID NO: 3963558 - RNA, 15 nt, Staphylococcus aureus subsp. aureus Mu50
ugauauuuaacaaaa

SEQ ID NO: 3963559 - RNA, 18 nt, Staphylococcus aureus subsp. aureus Mu50
ugauauuuaacaaaauua

SEQ ID NO: 3963560 - RNA, 23 nt, Staphylococcus aureus subsp. aureus Mu50
ugauauuugcuagucauaauuua

SEQ ID NO: 3963561 - RNA, 22 nt, Staphylococcus aureus subsp. aureus Mu50
ugaucaaaaauguuaucuagua

SEQ ID NO: 3963562 - RNA, 16 nt, Staphylococcus aureus subsp. aureus Mu50
ugaucagcauuuaagc

SEQ ID NO: 3963563 - RNA, 16 nt, Staphylococcus aureus subsp. aureus Mu50
ugauccgccuugauuu

SEQ ID NO: 3963564 - RNA, 21 nt, Staphylococcus aureus subsp. aureus Mu50
ugauccgccuugauuuuuuga

SEQ ID NO: 3963565 - RNA, 23 nt, Staphylococcus aureus subsp. aureus Mu50
ugauccuggaaucgaaaauauca

SEQ ID NO: 3963566 - RNA, 18 nt, Staphylococcus aureus subsp. aureus Mu50
ugaucgauuguuuauuag

SEQ ID NO: 3963567 - RNA, 12 nt, Staphylococcus aureus subsp. aureus Mu50
ugaucuuuuuua

SEQ ID NO: 3963568 - RNA, 20 nt, Staphylococcus aureus subsp. aureus Mu50
ugaucuuuuuuauauucaac

SEQ ID NO: 3963569 - RNA, 14 nt, Staphylococcus aureus subsp. aureus Mu50
ugaugaaacugauu

SEQ ID NO: 3963570 - RNA, 14 nt, Staphylococcus aureus subsp. aureus Mu50
ugaugaaagacuga

SEQ ID NO: 3963571 - RNA, 14 nt, Staphylococcus aureus subsp. aureus Mu50
ugaugaacuuaaug

SEQ ID NO: 3963572 - RNA, 19 nt, Staphylococcus aureus subsp. aureus Mu50
ugaugaagcaguuguuggu

SEQ ID NO: 3963573 - RNA, 20 nt, Staphylococcus aureus subsp. aureus Mu50
ugaugaaguaguuucauugc

SEQ ID NO: 3963574 - RNA, 14 nt, Staphylococcus aureus subsp. aureus Mu50
ugaugaaugauugc

SEQ ID NO: 3963575 - RNA, 16 nt, Staphylococcus aureus subsp. aureus Mu50
ugaugaauuaaacuga

SEQ ID NO: 3963576 - RNA, 18 nt, Staphylococcus aureus subsp. aureus Mu50
ugaugaauuguuguacau

SEQ ID NO: 3963577 - RNA, 12 nt, Staphylococcus aureus subsp. aureus Mu50
ugaugacaucaa

SEQ ID NO: 3963578 - RNA, 15 nt, Staphylococcus aureus subsp. aureus Mu50
ugaugagauaaaauc

SEQ ID NO: 3963579 - RNA, 18 nt, Staphylococcus aureus subsp. aureus Mu50
ugaugagauaaaaucaua

SEQ ID NO: 3963580 - RNA, 22 nt, Staphylococcus aureus subsp. aureus Mu50
ugaugagaugaggcgauaaaag

SEQ ID NO: 3963581 - RNA, 22 nt, Staphylococcus aureus subsp. aureus Mu50
ugaugauaaaaauaaaaccgag

SEQ ID NO: 3963582 - RNA, 14 nt, Staphylococcus aureus subsp. aureus Mu50
ugaugauaaauuga

SEQ ID NO: 3963583 - RNA, 14 nt, Staphylococcus aureus subsp. aureus Mu50
ugaugaugugcuuu

SEQ ID NO: 3963584 - RNA, 19 nt, Staphylococcus aureus subsp. aureus Mu50
ugaugcauaagauuuugaa

SEQ ID NO: 3963585 - RNA, 16 nt, Staphylococcus aureus subsp. aureus Mu50
ugaugcgaaaccuuuc

SEQ ID NO: 3963586 - RNA, 16 nt, Staphylococcus aureus subsp. aureus Mu50
ugaugcgcuucuaacu

SEQ ID NO: 3963587 - RNA, 19 nt, Staphylococcus aureus subsp. aureus Mu50
ugaugcgcuucuaacucac

SEQ ID NO: 3963588 - RNA, 23 nt, Staphylococcus aureus subsp. aureus Mu50
ugaugcuagcuuucuuuuucauc

SEQ ID NO: 3963589 - RNA, 19 nt, Staphylococcus aureus subsp. aureus Mu50
ugaugcuucgaauuuaaca

SEQ ID NO: 3963590 - RNA, 15 nt, Staphylococcus aureus subsp. aureus Mu50
ugaugcuugaauguu

SEQ ID NO: 3963591 - RNA, 19 nt, Staphylococcus aureus subsp. aureus Mu50
ugauggaaaaguuuuuuac

SEQ ID NO: 3963592 - RNA, 15 nt, Staphylococcus aureus subsp. aureus Mu50
ugauggaaaauuauu

SEQ ID NO: 3963593 - RNA, 16 nt, Staphylococcus aureus subsp. aureus Mu50
ugauggaaaauuauuu

SEQ ID NO: 3963594 - RNA, 23 nt, Staphylococcus aureus subsp. aureus Mu50
ugauggaaaauuauuugauauuu

SEQ ID NO: 3963595 - RNA, 15 nt, Staphylococcus aureus subsp. aureus Mu50
ugauggauauucaau

SEQ ID NO: 3963596 - RNA, 23 nt, Staphylococcus aureus subsp. aureus Mu50
ugaugggaaaucaguaauaucaa

SEQ ID NO: 3963597 - RNA, 16 nt, Staphylococcus aureus subsp. aureus Mu50
ugaugguacuaaaguu

SEQ ID NO: 3963598 - RNA, 17 nt, Staphylococcus aureus subsp. aureus Mu50
ugauguaacguuucuuu

SEQ ID NO: 3963599 - RNA, 12 nt, Staphylococcus aureus subsp. aureus Mu50
ugauguaauucu

SEQ ID NO: 3963600 - RNA, 15 nt, Staphylococcus aureus subsp. aureus Mu50
ugaugucauaugcac

SEQ ID NO: 3963601 - RNA, 16 nt, Staphylococcus aureus subsp. aureus Mu50
ugaugucauguauugu

SEQ ID NO: 3963602 - RNA, 14 nt, Staphylococcus aureus subsp. aureus Mu50
ugaugugaauguuu

SEQ ID NO: 3963603 - RNA, 17 nt, Staphylococcus aureus subsp. aureus Mu50
ugaugugaauguuuugu

SEQ ID NO: 3963604 - RNA, 18 nt, Staphylococcus aureus subsp. aureus Mu50
ugauguguuguuuuaauu

SEQ ID NO: 3963605 - RNA, 19 nt, Staphylococcus aureus subsp. aureus Mu50
ugauguguuguuuuaauug

SEQ ID NO: 3963606 - RNA, 13 nt, Staphylococcus aureus subsp. aureus Mu50
ugauguuaaaaaa

SEQ ID NO: 3963607 - RNA, 14 nt, Staphylococcus aureus subsp. aureus Mu50
ugauguuaaaaaau

SEQ ID NO: 3963608 - RNA, 20 nt, Staphylococcus aureus subsp. aureus Mu50
ugauguuuucuauaauauuu

SEQ ID NO: 3963609 - RNA, 22 nt, Staphylococcus aureus subsp. aureus Mu50
ugauguuuucuauaauauuuaa

SEQ ID NO: 3963610 - RNA, 19 nt, Staphylococcus aureus subsp. aureus Mu50
ugauuaaaaacgucucuau

SEQ ID NO: 3963611 - RNA, 15 nt, Staphylococcus aureus subsp. aureus Mu50
ugauuaaaaaucaaa

SEQ ID NO: 3963612 - RNA, 12 nt, Staphylococcus aureus subsp. aureus Mu50
ugauuaaaagug

SEQ ID NO: 3963613 - RNA, 23 nt, Staphylococcus aureus subsp. aureus Mu50
ugauuaaaaguguugacuuuauc

SEQ ID NO: 3963614 - RNA, 22 nt, Staphylococcus aureus subsp. aureus Mu50
ugauuaaaguguuucaacauau

SEQ ID NO: 3963615 - RNA, 23 nt, Staphylococcus aureus subsp. aureus Mu50
ugauuaaaguguuucaacauauu

SEQ ID NO: 3963616 - RNA, 12 nt, Staphylococcus aureus subsp. aureus Mu50
ugauuaacacaa

SEQ ID NO: 3963617 - RNA, 22 nt, Staphylococcus aureus subsp. aureus Mu50
ugauuaacauuuugaaucauac

SEQ ID NO: 3963618 - RNA, 21 nt, Staphylococcus aureus subsp. aureus Mu50
ugauuaacuuucuaauuguuu

SEQ ID NO: 3963619 - RNA, 12 nt, Staphylococcus aureus subsp. aureus Mu50
ugauuaaucuau

SEQ ID NO: 3963620 - RNA, 18 nt, Staphylococcus aureus subsp. aureus Mu50
ugauuaauuaaagauuaa

SEQ ID NO: 3963621 - RNA, 17 nt, Staphylococcus aureus subsp. aureus Mu50
ugauuaauuauugagaa

SEQ ID NO: 3963622 - RNA, 23 nt, Staphylococcus aureus subsp. aureus Mu50
ugauuaauuauugagaauauuua

SEQ ID NO: 3963623 - RNA, 11 nt, Staphylococcus aureus subsp. aureus Mu50
ugauuaauuuc

SEQ ID NO: 3963624 - RNA, 16 nt, Staphylococcus aureus subsp. aureus Mu50
ugauuaauuuuaucuu

SEQ ID NO: 3963625 - RNA, 13 nt, Staphylococcus aureus subsp. aureus Mu50
ugauuacaacuua

SEQ ID NO: 3963626 - RNA, 16 nt, Staphylococcus aureus subsp. aureus Mu50
ugauuacaacuuauuc

SEQ ID NO: 3963627 - RNA, 18 nt, Staphylococcus aureus subsp. aureus Mu50
ugauuacaacuuauucuu

SEQ ID NO: 3963628 - RNA, 14 nt, Staphylococcus aureus subsp. aureus Mu50
ugauuacauauacg

SEQ ID NO: 3963629 - RNA, 21 nt, Staphylococcus aureus subsp. aureus Mu50
ugcaacagaaccgaaaauaau

SEQ ID NO: 3963630 - RNA, 22 nt, Staphylococcus aureus subsp. aureus Mu50
ugcaacagaaccgaaaauaauc

SEQ ID NO: 3963631 - RNA, 12 nt, Staphylococcus aureus subsp. aureus Mu50
ugcaacauuaaa

SEQ ID NO: 3963632 - RNA, 16 nt, Staphylococcus aureus subsp. aureus Mu50
ugcaacauuaaauuau

SEQ ID NO: 3963633 - RNA, 14 nt, Staphylococcus aureus subsp. aureus Mu50
ugcaacauuuugag

SEQ ID NO: 3963634 - RNA, 20 nt, Staphylococcus aureus subsp. aureus Mu50
ugcaacgaugcuacuuaaag

SEQ ID NO: 3963635 - RNA, 21 nt, Staphylococcus aureus subsp. aureus Mu50
ugcaacgcaucacaaaauugu

SEQ ID NO: 3963636 - RNA, 16 nt, Staphylococcus aureus subsp. aureus Mu50
ugcaacuacgauaccg

SEQ ID NO: 3963637 - RNA, 15 nt, Staphylococcus aureus subsp. aureus Mu50
ugcaacuuauaauau

SEQ ID NO: 3963638 - RNA, 16 nt, Staphylococcus aureus subsp. aureus Mu50
ugcaacuuauaauauu

SEQ ID NO: 3963639 - RNA, 19 nt, Staphylococcus aureus subsp. aureus Mu50
ugcaacuuauaauauuaaa

SEQ ID NO: 3963640 - RNA, 17 nt, Staphylococcus aureus subsp. aureus Mu50
ugcaacuugaucauuau

SEQ ID NO: 3963641 - RNA, 17 nt, Staphylococcus aureus subsp. aureus Mu50
ugcaaguaauuuaauug

SEQ ID NO: 3963642 - RNA, 19 nt, Staphylococcus aureus subsp. aureus Mu50
ugcaaguaauuuaauuggu

SEQ ID NO: 3963643 - RNA, 17 nt, Staphylococcus aureus subsp. aureus Mu50
ugcaagucguucucuua

SEQ ID NO: 3963644 - RNA, 23 nt, Staphylococcus aureus subsp. aureus Mu50
ugcaauaacaccaauugaauauu

SEQ ID NO: 3963645 - RNA, 22 nt, Staphylococcus aureus subsp. aureus Mu50
ugcaauaauaaauaggaugaaa

SEQ ID NO: 3963646 - RNA, 18 nt, Staphylococcus aureus subsp. aureus Mu50
ugcaauaauuacuaaccu

SEQ ID NO: 3963647 - RNA, 22 nt, Staphylococcus aureus subsp. aureus Mu50
ugcaauacauuaauauaaauau

SEQ ID NO: 3963648 - RNA, 16 nt, Staphylococcus aureus subsp. aureus Mu50
ugcaauagcuauaacu

SEQ ID NO: 3963649 - RNA, 19 nt, Staphylococcus aureus subsp. aureus Mu50
ugcaauaggaugaaacuuu

SEQ ID NO: 3963650 - RNA, 15 nt, Staphylococcus aureus subsp. aureus Mu50
ugcaaucguauguaa

SEQ ID NO: 3963651 - RNA, 20 nt, Staphylococcus aureus subsp. aureus Mu50
ugcaaucguauguaacaauu

SEQ ID NO: 3963652 - RNA, 11 nt, Staphylococcus aureus subsp. aureus Mu50
ugcaaugcaaa

SEQ ID NO: 3963653 - RNA, 19 nt, Staphylococcus aureus subsp. aureus Mu50
ugcaauuaauguaaugaua

SEQ ID NO: 3963654 - RNA, 21 nt, Staphylococcus aureus subsp. aureus Mu50
ugcaauuauuucaauuaucaa

SEQ ID NO: 3963655 - RNA, 23 nt, Staphylococcus aureus subsp. aureus Mu50
ugcaauuauuuuucaaauauauc

SEQ ID NO: 3963656 - RNA, 11 nt, Staphylococcus aureus subsp. aureus Mu50
ugcaauuugua

SEQ ID NO: 3963657 - RNA, 14 nt, Staphylococcus aureus subsp. aureus Mu50
ugcaauuuguaaua

SEQ ID NO: 3963658 - RNA, 21 nt, Staphylococcus aureus subsp. aureus Mu50
ugcaauuuuucacuuauaaca

SEQ ID NO: 3963659 - RNA, 13 nt, Staphylococcus aureus subsp. aureus Mu50
ugcacaaacaaaa

SEQ ID NO: 3963660 - RNA, 22 nt, Staphylococcus aureus subsp. aureus Mu50
ugcacaccagccucuauaagua

SEQ ID NO: 3963661 - RNA, 17 nt, Staphylococcus aureus subsp. aureus Mu50
ugcacaguuucaucuuc

SEQ ID NO: 3963662 - RNA, 14 nt, Staphylococcus aureus subsp. aureus Mu50
ugcacauaaaaaau

SEQ ID NO: 3963663 - RNA, 15 nt, Staphylococcus aureus subsp. aureus Mu50
ugcaccuauaauagc

SEQ ID NO: 3963664 - RNA, 14 nt, Staphylococcus aureus subsp. aureus Mu50
ugcaccuauaccuc

SEQ ID NO: 3963665 - RNA, 20 nt, Staphylococcus aureus subsp. aureus Mu50
ugcaccuggucguacuuuca

SEQ ID NO: 3963666 - RNA, 21 nt, Staphylococcus aureus subsp. aureus Mu50
ugcaccuggucguacuuucaa

SEQ ID NO: 3963667 - RNA, 14 nt, Staphylococcus aureus subsp. aureus Mu50
ugcacgugagaaac

SEQ ID NO: 3963668 - RNA, 16 nt, Staphylococcus aureus subsp. aureus Mu50
ugcacugcuaauauua

SEQ ID NO: 3963669 - RNA, 18 nt, Staphylococcus aureus subsp. aureus Mu50
ugcacugcuaauauuaga

SEQ ID NO: 3963670 - RNA, 19 nt, Staphylococcus aureus subsp. aureus Mu50
ugcacuuaugauacugaua

SEQ ID NO: 3963671 - RNA, 18 nt, Staphylococcus aureus subsp. aureus Mu50
ugcacuucaaaagaaauu

SEQ ID NO: 3963672 - RNA, 23 nt, Staphylococcus aureus subsp. aureus Mu50
ugcacuugguucauaaugaucaa

SEQ ID NO: 3963673 - RNA, 16 nt, Staphylococcus aureus subsp. aureus Mu50
ugcacuuguaauauua

SEQ ID NO: 3963674 - RNA, 17 nt, Staphylococcus aureus subsp. aureus Mu50
ugcacuuguaauauuau

SEQ ID NO: 3963675 - RNA, 22 nt, Staphylococcus aureus subsp. aureus Mu50
ugcacuuguaauauuauaacca

SEQ ID NO: 3963676 - RNA, 20 nt, Staphylococcus aureus subsp. aureus Mu50
ugcacuuuuuucauuucuuu

SEQ ID NO: 3963677 - RNA, 21 nt, Staphylococcus aureus subsp. aureus Mu50
ugcacuuuuuucauuucuuug

SEQ ID NO: 3963678 - RNA, 15 nt, Staphylococcus aureus subsp. aureus Mu50
ugcagaacguucuaa

SEQ ID NO: 3963679 - RNA, 23 nt, Staphylococcus aureus subsp. aureus Mu50
ugcagaagaaaacuauuuuaaaa

SEQ ID NO: 3963680 - RNA, 14 nt, Staphylococcus aureus subsp. aureus Mu50
ugcagauaauugaa

SEQ ID NO: 3963681 - RNA, 18 nt, Staphylococcus aureus subsp. aureus Mu50
ugcagauaauugaaaauc

SEQ ID NO: 3963682 - RNA, 19 nt, Staphylococcus aureus subsp. aureus Mu50
ugcagauuuugcaaucuuu

SEQ ID NO: 3963683 - RNA, 23 nt, Staphylococcus aureus subsp. aureus Mu50
ugcagcaacugcauuacgcuguc

SEQ ID NO: 3963684 - RNA, 16 nt, Staphylococcus aureus subsp. aureus Mu50
ugcagcuguauaacca

SEQ ID NO: 3963685 - RNA, 14 nt, Staphylococcus aureus subsp. aureus Mu50
ugcagcuguauuua

SEQ ID NO: 3963686 - RNA, 22 nt, Staphylococcus aureus subsp. aureus Mu50
ugcagcuguauuuaauaaacca

SEQ ID NO: 3963687 - RNA, 20 nt, Staphylococcus aureus subsp. aureus Mu50
ugcagcuugaucuaaaugau

SEQ ID NO: 3963688 - RNA, 22 nt, Staphylococcus aureus subsp. aureus Mu50
ugcaguuucaaucgcauuuugu

SEQ ID NO: 3963689 - RNA, 13 nt, Staphylococcus aureus subsp. aureus Mu50
ugcauaaaaaaag

SEQ ID NO: 3963690 - RNA, 16 nt, Staphylococcus aureus subsp. aureus Mu50
ugcauaagaaauacua

SEQ ID NO: 3963691 - RNA, 14 nt, Staphylococcus aureus subsp. aureus Mu50
ugcauaaucaauuu

SEQ ID NO: 3963692 - RNA, 21 nt, Staphylococcus aureus subsp. aureus Mu50
ugcauaauuaggauuaacaua

SEQ ID NO: 3963693 - RNA, 17 nt, Staphylococcus aureus subsp. aureus Mu50
ugcauaccuauaaacau

SEQ ID NO: 3963694 - RNA, 19 nt, Staphylococcus aureus subsp. aureus Mu50
ugcauacgaauuaaaauaa

SEQ ID NO: 3963695 - RNA, 16 nt, Staphylococcus aureus subsp. aureus Mu50
ugcauagcuaaauaaa

SEQ ID NO: 3963696 - RNA, 21 nt, Staphylococcus aureus subsp. aureus Mu50
ugcauagguaaccuuaaauau

SEQ ID NO: 3963697 - RNA, 16 nt, Staphylococcus aureus subsp. aureus Mu50
ugcauauaaagucaua

SEQ ID NO: 3963698 - RNA, 14 nt, Staphylococcus aureus subsp. aureus Mu50
ugcauauauauaua

SEQ ID NO: 3963699 - RNA, 12 nt, Staphylococcus aureus subsp. aureus Mu50
ugcauauucacg

SEQ ID NO: 3963700 - RNA, 17 nt, Staphylococcus aureus subsp. aureus Mu50
ugcaucaguuaauaauu

SEQ ID NO: 3963701 - RNA, 15 nt, Staphylococcus aureus subsp. aureus Mu50
ugcaucccgaaaguu

SEQ ID NO: 3963702 - RNA, 22 nt, Staphylococcus aureus subsp. aureus Mu50
ugcaucccgaaaguuagacuaa

SEQ ID NO: 3963703 - RNA, 19 nt, Staphylococcus aureus subsp. aureus Mu50
ugcaugacucacuaaucuc

SEQ ID NO: 3963704 - RNA, 16 nt, Staphylococcus aureus subsp. aureus Mu50
ugcaugcgcaaaagcg

SEQ ID NO: 3963705 - RNA, 19 nt, Staphylococcus aureus subsp. aureus Mu50
ugcaugcgcaaaagcgcag

SEQ ID NO: 3963706 - RNA, 17 nt, Staphylococcus aureus subsp. aureus Mu50
ugcaugcuucucaauuu

SEQ ID NO: 3963707 - RNA, 24 nt, Staphylococcus aureus subsp. aureus Mu50
ugcauguccugaauguucgaagau

SEQ ID NO: 3963708 - RNA, 15 nt, Staphylococcus aureus subsp. aureus Mu50
ugcauguuuaaauau

SEQ ID NO: 3963709 - RNA, 17 nt, Staphylococcus aureus subsp. aureus Mu50
ugcauguuuaaauauca

SEQ ID NO: 3963710 - RNA, 20 nt, Staphylococcus aureus subsp. aureus Mu50
ugcauuaauuucaugugcaa

SEQ ID NO: 3963711 - RNA, 17 nt, Staphylococcus aureus subsp. aureus Mu50
ugcauuacuaucuucau

SEQ ID NO: 3963712 - RNA, 20 nt, Staphylococcus aureus subsp. aureus Mu50
ugcauuacuaucuucaucau

SEQ ID NO: 3963713 - RNA, 12 nt, Staphylococcus aureus subsp. aureus Mu50
ugcauuauuaua

SEQ ID NO: 3963714 - RNA, 22 nt, Staphylococcus aureus subsp. aureus Mu50
ugcauugauuucagcaccgaca

SEQ ID NO: 3963715 - RNA, 23 nt, Staphylococcus aureus subsp. aureus Mu50
ugcauuguaauaccaauuuuuag

SEQ ID NO: 3963716 - RNA, 13 nt, Staphylococcus aureus subsp. aureus Mu50
ugcuguuuuuauu

SEQ ID NO: 3963717 - RNA, 18 nt, Staphylococcus aureus subsp. aureus Mu50
ugcuguuuuuauuauaau

SEQ ID NO: 3963718 - RNA, 18 nt, Staphylococcus aureus subsp. aureus Mu50
ugcuuaaaccuuaauaau

SEQ ID NO: 3963719 - RNA, 12 nt, Staphylococcus aureus subsp. aureus Mu50
ugcuuacaauaa

SEQ ID NO: 3963720 - RNA, 15 nt, Staphylococcus aureus subsp. aureus Mu50
ugcuuacuuuuaaaa

SEQ ID NO: 3963721 - RNA, 18 nt, Staphylococcus aureus subsp. aureus Mu50
ugcuuaguacacguguau

SEQ ID NO: 3963722 - RNA, 19 nt, Staphylococcus aureus subsp. aureus Mu50
ugcuuaguacacguguauu

SEQ ID NO: 3963723 - RNA, 17 nt, Staphylococcus aureus subsp. aureus Mu50
ugcuuauuuguuuauua

SEQ ID NO: 3963724 - RNA, 13 nt, Staphylococcus aureus subsp. aureus Mu50
ugcuucaaagccu

SEQ ID NO: 3963725 - RNA, 16 nt, Staphylococcus aureus subsp. aureus Mu50
ugcuucacuguuuuau

SEQ ID NO: 3963726 - RNA, 18 nt, Staphylococcus aureus subsp. aureus Mu50
ugcuuccacuucaucuaa

SEQ ID NO: 3963727 - RNA, 22 nt, Staphylococcus aureus subsp. aureus Mu50
ugcuuccuuuuuguuauaucua

SEQ ID NO: 3963728 - RNA, 17 nt, Staphylococcus aureus subsp. aureus Mu50
ugcuucgcacaacugca

SEQ ID NO: 3963729 - RNA, 17 nt, Staphylococcus aureus subsp. aureus Mu50
ugcuucgcaucacugca

SEQ ID NO: 3963730 - RNA, 15 nt, Staphylococcus aureus subsp. aureus Mu50
ugcuucgcuaauauc

SEQ ID NO: 3963731 - RNA, 24 nt, Staphylococcus aureus subsp. aureus Mu50
ugcuucuacccuugcaaauauauc

SEQ ID NO: 3963732 - RNA, 17 nt, Staphylococcus aureus subsp. aureus Mu50
ugcuucugguucuucaa

SEQ ID NO: 3963733 - RNA, 12 nt, Staphylococcus aureus subsp. aureus Mu50
ugcuucuuauca

SEQ ID NO: 3963734 - RNA, 14 nt, Staphylococcus aureus subsp. aureus Mu50
ugcuucuuuccucu

SEQ ID NO: 3963735 - RNA, 14 nt, Staphylococcus aureus subsp. aureus Mu50
ugcuugaaauuauu

SEQ ID NO: 3963736 - RNA, 13 nt, Staphylococcus aureus subsp. aureus Mu50
ugcuuggugguuu

SEQ ID NO: 3963737 - RNA, 18 nt, Staphylococcus aureus subsp. aureus Mu50
ugcuugguuugauuuuag

SEQ ID NO: 3963738 - RNA, 13 nt, Staphylococcus aureus subsp. aureus Mu50
ugcuuguaacaag

SEQ ID NO: 3963739 - RNA, 17 nt, Staphylococcus aureus subsp. aureus Mu50
ugcuuguccucuaaaac

SEQ ID NO: 3963740 - RNA, 18 nt, Staphylococcus aureus subsp. aureus Mu50
ugcuuguccucuaaaaca

SEQ ID NO: 3963741 - RNA, 14 nt, Staphylococcus aureus subsp. aureus Mu50
ugcuuguuuuaaau

SEQ ID NO: 3963742 - RNA, 13 nt, Staphylococcus aureus subsp. aureus Mu50
ugcuuuaacugua

SEQ ID NO: 3963743 - RNA, 14 nt, Staphylococcus aureus subsp. aureus Mu50
ugcuuuaacuguac

SEQ ID NO: 3963744 - RNA, 12 nt, Staphylococcus aureus subsp. aureus Mu50
ugcuuuaauaaa

SEQ ID NO: 3963745 - RNA, 13 nt, Staphylococcus aureus subsp. aureus Mu50
ugcuuuaauaaau

SEQ ID NO: 3963746 - RNA, 12 nt, Staphylococcus aureus subsp. aureus Mu50
ugcuuuaauuug

SEQ ID NO: 3963747 - RNA, 23 nt, Staphylococcus aureus subsp. aureus Mu50
ugcuuuaauuugauuaaauucuu

SEQ ID NO: 3963748 - RNA, 20 nt, Staphylococcus aureus subsp. aureus Mu50
ugcuuuagucgguguuuucu

SEQ ID NO: 3963749 - RNA, 15 nt, Staphylococcus aureus subsp. aureus Mu50
ugcuuuauuuuauca

SEQ ID NO: 3963750 - RNA, 19 nt, Staphylococcus aureus subsp. aureus Mu50
ugcuuuauuuuaucaucua

SEQ ID NO: 3963751 - RNA, 20 nt, Staphylococcus aureus subsp. aureus Mu50
ugcuuuauuuucuuguguau

SEQ ID NO: 3963752 - RNA, 20 nt, Staphylococcus aureus subsp. aureus Mu50
ugcuuucacauuguuuacaa

SEQ ID NO: 3963753 - RNA, 12 nt, Staphylococcus aureus subsp. aureus Mu50
ugcuuuccaaau

SEQ ID NO: 3963754 - RNA, 17 nt, Staphylococcus aureus subsp. aureus Mu50
ugcuuuggaguuucuuc

SEQ ID NO: 3963755 - RNA, 20 nt, Staphylococcus aureus subsp. aureus Mu50
ugcuuuguuuaucaauuucu

SEQ ID NO: 3963756 - RNA, 14 nt, Staphylococcus aureus subsp. aureus Mu50
ugcuuuuaaaugua

SEQ ID NO: 3963757 - RNA, 22 nt, Staphylococcus aureus subsp. aureus Mu50
ugcuuuuaaauguauuuuuacu

SEQ ID NO: 3963758 - RNA, 16 nt, Staphylococcus aureus subsp. aureus Mu50
ugcuuuuaauaguguu

SEQ ID NO: 3963759 - RNA, 15 nt, Staphylococcus aureus subsp. aureus Mu50
ugcuuuuaauauuau

SEQ ID NO: 3963760 - RNA, 18 nt, Staphylococcus aureus subsp. aureus Mu50
ugcuuuuaauauuauaaa

SEQ ID NO: 3963761 - RNA, 14 nt, Staphylococcus aureus subsp. aureus Mu50
ugcuuuuccaguau

SEQ ID NO: 3963762 - RNA, 17 nt, Staphylococcus aureus subsp. aureus Mu50
ugcuuuuccauaaauau

SEQ ID NO: 3963763 - RNA, 22 nt, Staphylococcus aureus subsp. aureus Mu50
ugcuuuuccauaaauauuuaaa

SEQ ID NO: 3963764 - RNA, 13 nt, Staphylococcus aureus subsp. aureus Mu50
ugcuuuucuaucc

SEQ ID NO: 3963765 - RNA, 20 nt, Staphylococcus aureus subsp. aureus Mu50
ugcuuuucuauccauaguaa

SEQ ID NO: 3963766 - RNA, 16 nt, Staphylococcus aureus subsp. aureus Mu50
ugcuuuuucaaauaau

SEQ ID NO: 3963767 - RNA, 20 nt, Staphylococcus aureus subsp. aureus Mu50
ugcuuuuuguguaucuguaa

SEQ ID NO: 3963768 - RNA, 18 nt, Staphylococcus aureus subsp. aureus Mu50
ugcuuuuuuauucuaaua

SEQ ID NO: 3963769 - RNA, 22 nt, Staphylococcus aureus subsp. aureus Mu50
ugcuuuuuuauucuaauacaaa

SEQ ID NO: 3963770 - RNA, 19 nt, Staphylococcus aureus subsp. aureus Mu50
ugcuuuuuuuauaaguauu

SEQ ID NO: 3963771 - RNA, 18 nt, Staphylococcus aureus subsp. aureus Mu50
uggaaaaggucaaaaaau

SEQ ID NO: 3963772 - RNA, 20 nt, Staphylococcus aureus subsp. aureus Mu50
uggaaaauuauuugauauuu

SEQ ID NO: 3963773 - RNA, 15 nt, Staphylococcus aureus subsp. aureus Mu50
uggaaagacguuuuu

SEQ ID NO: 3963774 - RNA, 23 nt, Staphylococcus aureus subsp. aureus Mu50
uggaaagacguuuuuuuauaaau

SEQ ID NO: 3963775 - RNA, 23 nt, Staphylococcus aureus subsp. aureus Mu50
uggaaaggaggagauuguuauua

SEQ ID NO: 3963776 - RNA, 16 nt, Staphylococcus aureus subsp. aureus Mu50
uggaaaguaauaagua

SEQ ID NO: 3963777 - RNA, 13 nt, Staphylococcus aureus subsp. aureus Mu50
uggaaagucagcu

SEQ ID NO: 3963778 - RNA, 15 nt, Staphylococcus aureus subsp. aureus Mu50
uggaaauuuauuaua

SEQ ID NO: 3963779 - RNA, 22 nt, Staphylococcus aureus subsp. aureus Mu50
uggaaauuuauuauaaaauaga

SEQ ID NO: 3963780 - RNA, 12 nt, Staphylococcus aureus subsp. aureus Mu50
uggaaguguuuu

SEQ ID NO: 3963781 - RNA, 16 nt, Staphylococcus aureus subsp. aureus Mu50
uggaaguuguugcuuu

SEQ ID NO: 3963782 - RNA, 21 nt, Staphylococcus aureus subsp. aureus Mu50
uggaauaccuaaccauaacaa

SEQ ID NO: 3963783 - RNA, 20 nt, Staphylococcus aureus subsp. aureus Mu50
uggaauaccuaauucaauac

SEQ ID NO: 3963784 - RNA, 16 nt, Staphylococcus aureus subsp. aureus Mu50
uggaauacucuucaau

SEQ ID NO: 3963785 - RNA, 23 nt, Staphylococcus aureus subsp. aureus Mu50
uggaauacucuucaaucuaccaa

SEQ ID NO: 3963786 - RNA, 19 nt, Staphylococcus aureus subsp. aureus Mu50
uggaauacuugucaaaauu

SEQ ID NO: 3963787 - RNA, 23 nt, Staphylococcus aureus subsp. aureus Mu50
uggacagcuacaauuuucucauu

SEQ ID NO: 3963788 - RNA, 21 nt, Staphylococcus aureus subsp. aureus Mu50
uggacauauacucuaaaaaag

SEQ ID NO: 3963789 - RNA, 15 nt, Staphylococcus aureus subsp. aureus Mu50
uggacuaauuuauua

SEQ ID NO: 3963790 - RNA, 16 nt, Staphylococcus aureus subsp. aureus Mu50
uggacuuuaaaguuaa

SEQ ID NO: 3963791 - RNA, 23 nt, Staphylococcus aureus subsp. aureus Mu50
uggacuuugcuguccaucgucau

SEQ ID NO: 3963792 - RNA, 16 nt, Staphylococcus aureus subsp. aureus Mu50
uggagaaccauuuuau

SEQ ID NO: 3963793 - RNA, 15 nt, Staphylococcus aureus subsp. aureus Mu50
uggagaaccuuuaaa

SEQ ID NO: 3963794 - RNA, 22 nt, Staphylococcus aureus subsp. aureus Mu50
uggagaucuaacaauauauaau

SEQ ID NO: 3963795 - RNA, 19 nt, Staphylococcus aureus subsp. aureus Mu50
uggagccccuuguucuccg

SEQ ID NO: 3963796 - RNA, 17 nt, Staphylococcus aureus subsp. aureus Mu50
uggagcggaagauagga

SEQ ID NO: 3963797 - RNA, 18 nt, Staphylococcus aureus subsp. aureus Mu50
uggagguccauaaucuuu

SEQ ID NO: 3963798 - RNA, 17 nt, Staphylococcus aureus subsp. aureus Mu50
uggauaaaaugauaucu

SEQ ID NO: 3963799 - RNA, 16 nt, Staphylococcus aureus subsp. aureus Mu50
uggauaauugcauuac

SEQ ID NO: 3963800 - RNA, 19 nt, Staphylococcus aureus subsp. aureus Mu50
uggauaauuucuucuucug

SEQ ID NO: 3963801 - RNA, 14 nt, Staphylococcus aureus subsp. aureus Mu50
uggauacaaaccua

SEQ ID NO: 3963802 - RNA, 15 nt, Staphylococcus aureus subsp. aureus Mu50
uggauaugauaacca

SEQ ID NO: 3963803 - RNA, 12 nt, Staphylococcus aureus subsp. aureus Mu50
uggaugcuuuuc

SEQ ID NO: 3963804 - RNA, 20 nt, Staphylococcus aureus subsp. aureus Mu50
ugguucagaaaugacaucau

SEQ ID NO: 3963805 - RNA, 20 nt, Staphylococcus aureus subsp. aureus Mu50
ugguucauaaugaucaagua

SEQ ID NO: 3963806 - RNA, 17 nt, Staphylococcus aureus subsp. aureus Mu50
ugguucaucaaacaaca

SEQ ID NO: 3963807 - RNA, 11 nt, Staphylococcus aureus subsp. aureus Mu50
ugguucccaau

SEQ ID NO: 3963808 - RNA, 14 nt, Staphylococcus aureus subsp. aureus Mu50
ugguucuuuacuaa

SEQ ID NO: 3963809 - RNA, 19 nt, Staphylococcus aureus subsp. aureus Mu50
ugguugaacgguuguauuu

SEQ ID NO: 3963810 - RNA, 13 nt, Staphylococcus aureus subsp. aureus Mu50
ugguugcuucuua

SEQ ID NO: 3963811 - RNA, 15 nt, Staphylococcus aureus subsp. aureus Mu50
ugguugcuucuuauc

SEQ ID NO: 3963812 - RNA, 15 nt, Staphylococcus aureus subsp. aureus Mu50
ugguugucuccacac

SEQ ID NO: 3963813 - RNA, 14 nt, Staphylococcus aureus subsp. aureus Mu50
ugguuguucuuuuu

SEQ ID NO: 3963814 - RNA, 13 nt, Staphylococcus aureus subsp. aureus Mu50
ugguuuaacuuua

SEQ ID NO: 3963815 - RNA, 20 nt, Staphylococcus aureus subsp. aureus Mu50
ugguuuaaugagcuuuucua

SEQ ID NO: 3963816 - RNA, 19 nt, Staphylococcus aureus subsp. aureus Mu50
ugguuuaucagcuuuaaua

SEQ ID NO: 3963817 - RNA, 21 nt, Staphylococcus aureus subsp. aureus Mu50
ugguuuaucagcuuuaauaau

SEQ ID NO: 3963818 - RNA, 17 nt, Staphylococcus aureus subsp. aureus Mu50
ugguuuggauaaaauga

SEQ ID NO: 3963819 - RNA, 12 nt, Staphylococcus aureus subsp. aureus Mu50
ugguuuuacugc

SEQ ID NO: 3963820 - RNA, 12 nt, Staphylococcus aureus subsp. aureus Mu50
uguaaaaaauau

SEQ ID NO: 3963821 - RNA, 16 nt, Staphylococcus aureus subsp. aureus Mu50
uguaaaaaauaucuug

SEQ ID NO: 3963822 - RNA, 16 nt, Staphylococcus aureus subsp. aureus Mu50
uguaaaaacguucaau

SEQ ID NO: 3963823 - RNA, 23 nt, Staphylococcus aureus subsp. aureus Mu50
uguaaaacaaugcccguguaaca

SEQ ID NO: 3963824 - RNA, 21 nt, Staphylococcus aureus subsp. aureus Mu50
uguaaaaccuuacccaaaaaa

SEQ ID NO: 3963825 - RNA, 22 nt, Staphylococcus aureus subsp. aureus Mu50
uguaaaaccuuacccaaaaaau

SEQ ID NO: 3963826 - RNA, 18 nt, Staphylococcus aureus subsp. aureus Mu50
uguaaacaguauguagcu

SEQ ID NO: 3963827 - RNA, 21 nt, Staphylococcus aureus subsp. aureus Mu50
uguaaaccagcuaaaccaucu

SEQ ID NO: 3963828 - RNA, 20 nt, Staphylococcus aureus subsp. aureus Mu50
uguaaagcaugaauagcuug

SEQ ID NO: 3963829 - RNA, 21 nt, Staphylococcus aureus subsp. aureus Mu50
uguaaagcuaauuuuuuauuu

SEQ ID NO: 3963830 - RNA, 20 nt, Staphylococcus aureus subsp. aureus Mu50
uguaaagcuuuaguuaaaua

SEQ ID NO: 3963831 - RNA, 22 nt, Staphylococcus aureus subsp. aureus Mu50
uguaaagcuuuaguuaaauagu

SEQ ID NO: 3963832 - RNA, 15 nt, Staphylococcus aureus subsp. aureus Mu50
uguaaaguugauaau

SEQ ID NO: 3963833 - RNA, 14 nt, Staphylococcus aureus subsp. aureus Mu50
uguaaauaaaaauu

SEQ ID NO: 3963834 - RNA, 15 nt, Staphylococcus aureus subsp. aureus Mu50
uguaaauaacaguua

SEQ ID NO: 3963835 - RNA, 15 nt, Staphylococcus aureus subsp. aureus Mu50
uguaaauauaaauau

SEQ ID NO: 3963836 - RNA, 14 nt, Staphylococcus aureus subsp. aureus Mu50
uguaaauauaguaa

SEQ ID NO: 3963837 - RNA, 14 nt, Staphylococcus aureus subsp. aureus Mu50
uguaaauaugaacu

SEQ ID NO: 3963838 - RNA, 17 nt, Staphylococcus aureus subsp. aureus Mu50
uguaaaucacgauuuuc

SEQ ID NO: 3963839 - RNA, 23 nt, Staphylococcus aureus subsp. aureus Mu50
uguaaaucacgauuuucaaguaa

SEQ ID NO: 3963840 - RNA, 18 nt, Staphylococcus aureus subsp. aureus Mu50
uguaaaugaauuuugacg

SEQ ID NO: 3963841 - RNA, 19 nt, Staphylococcus aureus subsp. aureus Mu50
uguaaauguuaaauucuaa

SEQ ID NO: 3963842 - RNA, 14 nt, Staphylococcus aureus subsp. aureus Mu50
uguaaauuacaaaa

SEQ ID NO: 3963843 - RNA, 20 nt, Staphylococcus aureus subsp. aureus Mu50
uguaaauuuauuuuuaauuu

SEQ ID NO: 3963844 - RNA, 17 nt, Staphylococcus aureus subsp. aureus Mu50
uguaaauuuuuaagaag

SEQ ID NO: 3963845 - RNA, 18 nt, Staphylococcus aureus subsp. aureus Mu50
uguaacaagcuuuucauu

SEQ ID NO: 3963846 - RNA, 18 nt, Staphylococcus aureus subsp. aureus Mu50
uguaacacacuuauaauc

SEQ ID NO: 3963847 - RNA, 23 nt, Staphylococcus aureus subsp. aureus Mu50
uguaacacacuuauaaucuauaa

SEQ ID NO: 3963848 - RNA, 15 nt, Staphylococcus aureus subsp. aureus Mu50
uguaacacgcucuuu

SEQ ID NO: 3963849 - RNA, 22 nt, Staphylococcus aureus subsp. aureus Mu50
uguaacauaaagcuguuuauug

SEQ ID NO: 3963850 - RNA, 14 nt, Staphylococcus aureus subsp. aureus Mu50
uguaaccaaaagaa

SEQ ID NO: 3963851 - RNA, 14 nt, Staphylococcus aureus subsp. aureus Mu50
uguaaccaccugau

SEQ ID NO: 3963852 - RNA, 14 nt, Staphylococcus aureus subsp. aureus Mu50
uguaacguacaauu

SEQ ID NO: 3963853 - RNA, 11 nt, Staphylococcus aureus subsp. aureus Mu50
uguaacuguuu

SEQ ID NO: 3963854 - RNA, 22 nt, Staphylococcus aureus subsp. aureus Mu50
uguaacuuggcuuaaucucuuu

SEQ ID NO: 3963855 - RNA, 18 nt, Staphylococcus aureus subsp. aureus Mu50
uguaacuuuaucacugua

SEQ ID NO: 3963856 - RNA, 19 nt, Staphylococcus aureus subsp. aureus Mu50
uguaagcuaucguaaacaa

SEQ ID NO: 3963857 - RNA, 21 nt, Staphylococcus aureus subsp. aureus Mu50
uguaagucgaaaguacccaga

SEQ ID NO: 3963858 - RNA, 20 nt, Staphylococcus aureus subsp. aureus Mu50
uguaagucgcucuagacauu

SEQ ID NO: 3963859 - RNA, 18 nt, Staphylococcus aureus subsp. aureus Mu50
uguaauaauaucaccuuu

SEQ ID NO: 3963860 - RNA, 22 nt, Staphylococcus aureus subsp. aureus Mu50
uguaauaauaucaccuuuuuua

SEQ ID NO: 3963861 - RNA, 15 nt, Staphylococcus aureus subsp. aureus Mu50
uguaauacaucuaau

SEQ ID NO: 3963862 - RNA, 22 nt, Staphylococcus aureus subsp. aureus Mu50
uguaauaccuuuacuuucauua

SEQ ID NO: 3963863 - RNA, 17 nt, Staphylococcus aureus subsp. aureus Mu50
uguaauaucuaaagauu

SEQ ID NO: 3963864 - RNA, 15 nt, Staphylococcus aureus subsp. aureus Mu50
uguaauaugaaggcu

SEQ ID NO: 3963865 - RNA, 16 nt, Staphylococcus aureus subsp. aureus Mu50
uguaauauuauaacca

SEQ ID NO: 3963866 - RNA, 23 nt, Staphylococcus aureus subsp. aureus Mu50
uguaaucacuaucuguuguuaua

SEQ ID NO: 3963867 - RNA, 14 nt, Staphylococcus aureus subsp. aureus Mu50
uguaaucccauuuu

SEQ ID NO: 3963868 - RNA, 19 nt, Staphylococcus aureus subsp. aureus Mu50
uguaauccgcagaccacau

SEQ ID NO: 3963869 - RNA, 19 nt, Staphylococcus aureus subsp. aureus Mu50
uguaaucucguuuuuacau

SEQ ID NO: 3963870 - RNA, 20 nt, Staphylococcus aureus subsp. aureus Mu50
uguaaugcuuaaaaacaaua

SEQ ID NO: 3963871 - RNA, 21 nt, Staphylococcus aureus subsp. aureus Mu50
uguaaugcuuaaaaacaauau

SEQ ID NO: 3963872 - RNA, 16 nt, Staphylococcus aureus subsp. aureus Mu50
uguaauuaauccaucu

SEQ ID NO: 3963873 - RNA, 17 nt, Staphylococcus aureus subsp. aureus Mu50
uguaauuccucuggaac

SEQ ID NO: 3963874 - RNA, 20 nt, Staphylococcus aureus subsp. aureus Mu50
uguaauuguuuuuucuuauu

SEQ ID NO: 3963875 - RNA, 14 nt, Staphylococcus aureus subsp. aureus Mu50
uguaauuuaaaaua

SEQ ID NO: 3963876 - RNA, 22 nt, Staphylococcus aureus subsp. aureus Mu50
uguaauuuaaaauaguucuuua

SEQ ID NO: 3963877 - RNA, 23 nt, Staphylococcus aureus subsp. aureus Mu50
uguaauuuucacuuucaaugaca

SEQ ID NO: 3963878 - RNA, 23 nt, Staphylococcus aureus subsp. aureus Mu50
uguacaaccuuugcuuaaaccuu

SEQ ID NO: 3963879 - RNA, 12 nt, Staphylococcus aureus subsp. aureus Mu50
uguacaauaauu

SEQ ID NO: 3963880 - RNA, 20 nt, Staphylococcus aureus subsp. aureus Mu50
uguacacauccucauaauua

SEQ ID NO: 3963881 - RNA, 21 nt, Staphylococcus aureus subsp. aureus Mu50
uguacacuaucguuuuuauua

SEQ ID NO: 3963882 - RNA, 14 nt, Staphylococcus aureus subsp. aureus Mu50
uguacauaugugua

SEQ ID NO: 3963883 - RNA, 14 nt, Staphylococcus aureus subsp. aureus Mu50
uguacaucauuaaa

SEQ ID NO: 3963884 - RNA, 19 nt, Staphylococcus aureus subsp. aureus Mu50
uguacauccacuuuauaau

SEQ ID NO: 3963885 - RNA, 16 nt, Staphylococcus aureus subsp. aureus Mu50
uguacaugaacaaaua

SEQ ID NO: 3963886 - RNA, 16 nt, Staphylococcus aureus subsp. aureus Mu50
uguacauugguuuuua

SEQ ID NO: 3963887 - RNA, 19 nt, Staphylococcus aureus subsp. aureus Mu50
uguacauugguuuuuacua

SEQ ID NO: 3963888 - RNA, 16 nt, Staphylococcus aureus subsp. aureus Mu50
uguacauuguaaauau

SEQ ID NO: 3963889 - RNA, 17 nt, Staphylococcus aureus subsp. aureus Mu50
uguacauuguaaauaua

SEQ ID NO: 3963890 - RNA, 13 nt, Staphylococcus aureus subsp. aureus Mu50
uguaccaaauuug

SEQ ID NO: 3963891 - RNA, 19 nt, Staphylococcus aureus subsp. aureus Mu50
ugucauuucuucuuuuucc

SEQ ID NO: 3963892 - RNA, 23 nt, Staphylococcus aureus subsp. aureus Mu50
ugucauuucuucuuuuucccaau

SEQ ID NO: 3963893 - RNA, 15 nt, Staphylococcus aureus subsp. aureus Mu50
ugucauuuucugcuu

SEQ ID NO: 3963894 - RNA, 16 nt, Staphylococcus aureus subsp. aureus Mu50
ugucauuuucugcuuu

SEQ ID NO: 3963895 - RNA, 18 nt, Staphylococcus aureus subsp. aureus Mu50
uguccaacugcuuuuuau

SEQ ID NO: 3963896 - RNA, 17 nt, Staphylococcus aureus subsp. aureus Mu50
uguccacuauauccuuu

SEQ ID NO: 3963897 - RNA, 20 nt, Staphylococcus aureus subsp. aureus Mu50
uguccagccauuaaaccuaa

SEQ ID NO: 3963898 - RNA, 20 nt, Staphylococcus aureus subsp. aureus Mu50
uguccaucuuuuauuaaaga

SEQ ID NO: 3963899 - RNA, 19 nt, Staphylococcus aureus subsp. aureus Mu50
ugucccaaugcugaauaaa

SEQ ID NO: 3963900 - RNA, 14 nt, Staphylococcus aureus subsp. aureus Mu50
uguccgauaucuuu

SEQ ID NO: 3963901 - RNA, 16 nt, Staphylococcus aureus subsp. aureus Mu50
uguccgauuuuuuuac

SEQ ID NO: 3963902 - RNA, 22 nt, Staphylococcus aureus subsp. aureus Mu50
uguccuaacgcuaauuuuacuc

SEQ ID NO: 3963903 - RNA, 19 nt, Staphylococcus aureus subsp. aureus Mu50
ugucgaaauuguucuaaua

SEQ ID NO: 3963904 - RNA, 15 nt, Staphylococcus aureus subsp. aureus Mu50
ugucgacuuuuagau

SEQ ID NO: 3963905 - RNA, 14 nt, Staphylococcus aureus subsp. aureus Mu50
ugucgauauuucua

SEQ ID NO: 3963906 - RNA, 18 nt, Staphylococcus aureus subsp. aureus Mu50
ugucggaauugguuuuua

SEQ ID NO: 3963907 - RNA, 15 nt, Staphylococcus aureus subsp. aureus Mu50
ugucgguucaucuaa

SEQ ID NO: 3963908 - RNA, 22 nt, Staphylococcus aureus subsp. aureus Mu50
ugucuaaaaacauaaaaaucca

SEQ ID NO: 3963909 - RNA, 14 nt, Staphylococcus aureus subsp. aureus Mu50
ugucuaaaaauguc

SEQ ID NO: 3963910 - RNA, 17 nt, Staphylococcus aureus subsp. aureus Mu50
ugucuagacuuauuuga

SEQ ID NO: 3963911 - RNA, 20 nt, Staphylococcus aureus subsp. aureus Mu50
ugucuagauuuuaaaucaau

SEQ ID NO: 3963912 - RNA, 19 nt, Staphylococcus aureus subsp. aureus Mu50
ugucuaguucgauuuuuua

SEQ ID NO: 3963913 - RNA, 21 nt, Staphylococcus aureus subsp. aureus Mu50
ugucuaguucgauuuuuuaau

SEQ ID NO: 3963914 - RNA, 14 nt, Staphylococcus aureus subsp. aureus Mu50
ugucuauuguaaaa

SEQ ID NO: 3963915 - RNA, 15 nt, Staphylococcus aureus subsp. aureus Mu50
ugucuuaauaugcaa

SEQ ID NO: 3963916 - RNA, 21 nt, Staphylococcus aureus subsp. aureus Mu50
ugucuuaggcgcuacaauguu

SEQ ID NO: 3963917 - RNA, 20 nt, Staphylococcus aureus subsp. aureus Mu50
ugucuuaucaauuagccaau

SEQ ID NO: 3963918 - RNA, 19 nt, Staphylococcus aureus subsp. aureus Mu50
ugucuuccaaucaacuuca

SEQ ID NO: 3963919 - RNA, 21 nt, Staphylococcus aureus subsp. aureus Mu50
ugucuuccaaucaacuucaua

SEQ ID NO: 3963920 - RNA, 20 nt, Staphylococcus aureus subsp. aureus Mu50
ugucuuuauguuugauuuua

SEQ ID NO: 3963921 - RNA, 19 nt, Staphylococcus aureus subsp. aureus Mu50
ugucuuucaaauacacaga

SEQ ID NO: 3963922 - RNA, 17 nt, Staphylococcus aureus subsp. aureus Mu50
ugucuuuuauuaugaua

SEQ ID NO: 3963923 - RNA, 13 nt, Staphylococcus aureus subsp. aureus Mu50
ugugaaaauacca

SEQ ID NO: 3963924 - RNA, 22 nt, Staphylococcus aureus subsp. aureus Mu50
ugugaaaauaccaagugcuuuu

SEQ ID NO: 3963925 - RNA, 16 nt, Staphylococcus aureus subsp. aureus Mu50
ugugaaaguuuuuguc

SEQ ID NO: 3963926 - RNA, 23 nt, Staphylococcus aureus subsp. aureus Mu50
ugugaaauuagaaaaauaugauu

SEQ ID NO: 3963927 - RNA, 23 nt, Staphylococcus aureus subsp. aureus Mu50
ugugaacaucuaguuauuucaua

SEQ ID NO: 3963928 - RNA, 19 nt, Staphylococcus aureus subsp. aureus Mu50
ugugaauaugcuuuuaaua

SEQ ID NO: 3963929 - RNA, 19 nt, Staphylococcus aureus subsp. aureus Mu50
ugugaauuuauuuuguagu

SEQ ID NO: 3963930 - RNA, 14 nt, Staphylococcus aureus subsp. aureus Mu50
ugugacaaaugccu

SEQ ID NO: 3963931 - RNA, 12 nt, Staphylococcus aureus subsp. aureus Mu50
ugugacauacca

SEQ ID NO: 3963932 - RNA, 14 nt, Staphylococcus aureus subsp. aureus Mu50
ugugacgauauuug

SEQ ID NO: 3963933 - RNA, 23 nt, Staphylococcus aureus subsp. aureus Mu50
ugugacucggggaauuuuuaugc

SEQ ID NO: 3963934 - RNA, 17 nt, Staphylococcus aureus subsp. aureus Mu50
ugugacuuguaucaucg

SEQ ID NO: 3963935 - RNA, 21 nt, Staphylococcus aureus subsp. aureus Mu50
ugugagauacguuauuucaau

SEQ ID NO: 3963936 - RNA, 20 nt, Staphylococcus aureus subsp. aureus Mu50
ugugauaacuuguaauauaa

SEQ ID NO: 3963937 - RNA, 17 nt, Staphylococcus aureus subsp. aureus Mu50
ugugauaauucuucaac

SEQ ID NO: 3963938 - RNA, 18 nt, Staphylococcus aureus subsp. aureus Mu50
ugugauauaugaaauauu

SEQ ID NO: 3963939 - RNA, 17 nt, Staphylococcus aureus subsp. aureus Mu50
ugugauguacuacuuua

SEQ ID NO: 3963940 - RNA, 18 nt, Staphylococcus aureus subsp. aureus Mu50
ugugauuuguuacuucua

SEQ ID NO: 3963941 - RNA, 19 nt, Staphylococcus aureus subsp. aureus Mu50
ugugauuuguuacuucuaa

SEQ ID NO: 3963942 - RNA, 14 nt, Staphylococcus aureus subsp. aureus Mu50
ugugcaaaaguuug

SEQ ID NO: 3963943 - RNA, 13 nt, Staphylococcus aureus subsp. aureus Mu50
ugugcaacuuuaa

SEQ ID NO: 3963944 - RNA, 16 nt, Staphylococcus aureus subsp. aureus Mu50
ugugcaaguuggggau

SEQ ID NO: 3963945 - RNA, 18 nt, Staphylococcus aureus subsp. aureus Mu50
ugugcaauuagaauauau

SEQ ID NO: 3963946 - RNA, 13 nt, Staphylococcus aureus subsp. aureus Mu50
ugugcaucauuua

SEQ ID NO: 3963947 - RNA, 19 nt, Staphylococcus aureus subsp. aureus Mu50
ugugcucauuuuuuuaauu

SEQ ID NO: 3963948 - RNA, 14 nt, Staphylococcus aureus subsp. aureus Mu50
ugugcuguucuauu

SEQ ID NO: 3963949 - RNA, 13 nt, Staphylococcus aureus subsp. aureus Mu50
ugugcuuaagaac

SEQ ID NO: 3963950 - RNA, 22 nt, Staphylococcus aureus subsp. aureus Mu50
uguggcuacuaaucuuuuuuua

SEQ ID NO: 3963951 - RNA, 15 nt, Staphylococcus aureus subsp. aureus Mu50
uguggcuuuuuauca

SEQ ID NO: 3963952 - RNA, 14 nt, Staphylococcus aureus subsp. aureus Mu50
ugugggcuuuauua

SEQ ID NO: 3963953 - RNA, 14 nt, Staphylococcus aureus subsp. aureus Mu50
ugugguaaugauuu

SEQ ID NO: 3963954 - RNA, 14 nt, Staphylococcus aureus subsp. aureus Mu50
uguggucuaaccau

SEQ ID NO: 3963955 - RNA, 13 nt, Staphylococcus aureus subsp. aureus Mu50
ugugguucauuag

SEQ ID NO: 3963956 - RNA, 17 nt, Staphylococcus aureus subsp. aureus Mu50
uguguaaauauaaauau

SEQ ID NO: 3963957 - RNA, 21 nt, Staphylococcus aureus subsp. aureus Mu50
uguguaaauauaaauaugaau

SEQ ID NO: 3963958 - RNA, 22 nt, Staphylococcus aureus subsp. aureus Mu50
uguguacguuucaauguaucaa

SEQ ID NO: 3963959 - RNA, 15 nt, Staphylococcus aureus subsp. aureus Mu50
uguguacuuaaaaau

SEQ ID NO: 3963960 - RNA, 19 nt, Staphylococcus aureus subsp. aureus Mu50
uguguaucaguuauuuuaa

SEQ ID NO: 3963961 - RNA, 16 nt, Staphylococcus aureus subsp. aureus Mu50
uguguaugaucaagcu

SEQ ID NO: 3963962 - RNA, 21 nt, Staphylococcus aureus subsp. aureus Mu50
uguguaugguuuuguacauau

SEQ ID NO: 3963963 - RNA, 22 nt, Staphylococcus aureus subsp. aureus Mu50
uguguauuugaaagacauuuaa

SEQ ID NO: 3963964 - RNA, 16 nt, Staphylococcus aureus subsp. aureus Mu50
uguguauuuuuauugu

SEQ ID NO: 3963965 - RNA, 22 nt, Staphylococcus aureus subsp. aureus Mu50
ugugucauaauccauucuucuu

SEQ ID NO: 3963966 - RNA, 24 nt, Staphylococcus aureus subsp. aureus Mu50
ugugucauaauccauucuucuugu

SEQ ID NO: 3963967 - RNA, 14 nt, Staphylococcus aureus subsp. aureus Mu50
uguguguuuuaaaa

SEQ ID NO: 3963968 - RNA, 17 nt, Staphylococcus aureus subsp. aureus Mu50
uguguuaauacuucaua

SEQ ID NO: 3963969 - RNA, 20 nt, Staphylococcus aureus subsp. aureus Mu50
uguguugaaacugaguucaa

SEQ ID NO: 3963970 - RNA, 11 nt, Staphylococcus aureus subsp. aureus Mu50
uguguuggggc

SEQ ID NO: 3963971 - RNA, 14 nt, Staphylococcus aureus subsp. aureus Mu50
uguguuguuuuaau

SEQ ID NO: 3963972 - RNA, 21 nt, Staphylococcus aureus subsp. aureus Mu50
uguguuuaggaggaauaccca

SEQ ID NO: 3963973 - RNA, 16 nt, Staphylococcus aureus subsp. aureus Mu50
uguguuucuuuuauuu

SEQ ID NO: 3963974 - RNA, 21 nt, Staphylococcus aureus subsp. aureus Mu50
uguguuucuuuuauuuucaua

SEQ ID NO: 3963975 - RNA, 12 nt, Staphylococcus aureus subsp. aureus Mu50
uguguuugcuuu

SEQ ID NO: 3963976 - RNA, 17 nt, Staphylococcus aureus subsp. aureus Mu50
uguguuugcuuuuauuu

SEQ ID NO: 3963977 - RNA, 14 nt, Staphylococcus aureus subsp. aureus Mu50
uguguuuuaaaauu

SEQ ID NO: 3963978 - RNA, 18 nt, Staphylococcus aureus subsp. aureus Mu50
uguugaauaauuaauguu

SEQ ID NO: 3963979 - RNA, 18 nt, Staphylococcus aureus subsp. aureus Mu50
uguugaccaccugauaau

SEQ ID NO: 3963980 - RNA, 18 nt, Staphylococcus aureus subsp. aureus Mu50
uguugacuacucaauccu

SEQ ID NO: 3963981 - RNA, 21 nt, Staphylococcus aureus subsp. aureus Mu50
uguugaggcguuucagaaguu

SEQ ID NO: 3963982 - RNA, 14 nt, Staphylococcus aureus subsp. aureus Mu50
uguugauaaaaagg

SEQ ID NO: 3963983 - RNA, 13 nt, Staphylococcus aureus subsp. aureus Mu50
uguugauaauagc

SEQ ID NO: 3963984 - RNA, 14 nt, Staphylococcus aureus subsp. aureus Mu50
uguugcaauaaaau

SEQ ID NO: 3963985 - RNA, 14 nt, Staphylococcus aureus subsp. aureus Mu50
uguugcaaugauua

SEQ ID NO: 3963986 - RNA, 17 nt, Staphylococcus aureus subsp. aureus Mu50
uguugcuaaucucagau

SEQ ID NO: 3963987 - RNA, 14 nt, Staphylococcus aureus subsp. aureus Mu50
uguugcuuugguaa

SEQ ID NO: 3963988 - RNA, 22 nt, Staphylococcus aureus subsp. aureus Mu50
uguuggaagccuucaauaguuu

SEQ ID NO: 3963989 - RNA, 20 nt, Staphylococcus aureus subsp. aureus Mu50
uguuggaauaccuuuuucua

SEQ ID NO: 3963990 - RNA, 23 nt, Staphylococcus aureus subsp. aureus Mu50
uguuggaucuuucaaaguauauu

SEQ ID NO: 3963991 - RNA, 16 nt, Staphylococcus aureus subsp. aureus Mu50
uguuggcaaacuauua

SEQ ID NO: 3963992 - RNA, 16 nt, Staphylococcus aureus subsp. aureus Mu50
uguuggcuuuuugagu

SEQ ID NO: 3963993 - RNA, 15 nt, Staphylococcus aureus subsp. aureus Mu50
uguuggcuuuuuuaa

SEQ ID NO: 3963994 - RNA, 17 nt, Staphylococcus aureus subsp. aureus Mu50
uguuggggcccacaccc

SEQ ID NO: 3963995 - RNA, 17 nt, Staphylococcus aureus subsp. aureus Mu50
uguugguauuuuuuuau

SEQ ID NO: 3963996 - RNA, 20 nt, Staphylococcus aureus subsp. aureus Mu50
uguugguguuuagucuuuuu

SEQ ID NO: 3963997 - RNA, 22 nt, Staphylococcus aureus subsp. aureus Mu50
uguugguguuuagucuuuuuua

SEQ ID NO: 3963998 - RNA, 20 nt, Staphylococcus aureus subsp. aureus Mu50
uguugguucaucaaacaaca

SEQ ID NO: 3963999 - RNA, 20 nt, Staphylococcus aureus subsp. aureus Mu50
uguuguaagguggacuucua

SEQ ID NO: 3964000 - RNA, 21 nt, Staphylococcus aureus subsp. aureus Mu50
uguugucguuucuagcaacug

SEQ ID NO: 3964001 - RNA, 14 nt, Staphylococcus aureus subsp. aureus Mu50
uguugugaauaaaa

SEQ ID NO: 3964002 - RNA, 14 nt, Staphylococcus aureus subsp. aureus Mu50
uguuguuauauaaa

SEQ ID NO: 3964003 - RNA, 11 nt, Staphylococcus aureus subsp. aureus Mu50
uguuguuuuaa

SEQ ID NO: 3964004 - RNA, 13 nt, Staphylococcus aureus subsp. aureus Mu50
uguuguuuuaauu

SEQ ID NO: 3964005 - RNA, 16 nt, Staphylococcus aureus subsp. aureus Mu50
uguuguuuuaauuguu

SEQ ID NO: 3964006 - RNA, 15 nt, Staphylococcus aureus subsp. aureus Mu50
uguuuaaacauguac

SEQ ID NO: 3964007 - RNA, 12 nt, Staphylococcus aureus subsp. aureus Mu50
uguuuaaauaaa

SEQ ID NO: 3964008 - RNA, 15 nt, Staphylococcus aureus subsp. aureus Mu50
uguuuaaauaaaauu

SEQ ID NO: 3964009 - RNA, 22 nt, Staphylococcus aureus subsp. aureus Mu50
uguuuaagaauguacaauuuuu

SEQ ID NO: 3964010 - RNA, 16 nt, Staphylococcus aureus subsp. aureus Mu50
uguuuaauuaaaauac

SEQ ID NO: 3964011 - RNA, 17 nt, Staphylococcus aureus subsp. aureus Mu50
uguuuaauuaaaauaca

SEQ ID NO: 3964012 - RNA, 19 nt, Staphylococcus aureus subsp. aureus Mu50
uguuuaauuaaaauacaaa

SEQ ID NO: 3964013 - RNA, 12 nt, Staphylococcus aureus subsp. aureus Mu50
uguuuaauuauc

SEQ ID NO: 3964014 - RNA, 14 nt, Staphylococcus aureus subsp. aureus Mu50
uguuuaauuuucua

SEQ ID NO: 3964015 - RNA, 19 nt, Staphylococcus aureus subsp. aureus Mu50
uguuuaauuuucuaaauau

SEQ ID NO: 3964016 - RNA, 13 nt, Staphylococcus aureus subsp. aureus Mu50
uguuuacagaugc

SEQ ID NO: 3964017 - RNA, 12 nt, Staphylococcus aureus subsp. aureus Mu50
uguuuauaucuu

SEQ ID NO: 3964018 - RNA, 17 nt, Staphylococcus aureus subsp. aureus Mu50
uguuuauaucuuuuaua

SEQ ID NO: 3964019 - RNA, 15 nt, Staphylococcus aureus subsp. aureus Mu50
uguuuauauugcaaa

SEQ ID NO: 3964020 - RNA, 21 nt, Staphylococcus aureus subsp. aureus Mu50
uguuuauauugcaaaaauaau

SEQ ID NO: 3964021 - RNA, 17 nt, Staphylococcus aureus subsp. aureus Mu50
uguuuaucaauuucucu

SEQ ID NO: 3964022 - RNA, 21 nt, Staphylococcus aureus subsp. aureus Mu50
uguuuaucaugaugauaaauu

SEQ ID NO: 3964023 - RNA, 23 nt, Staphylococcus aureus subsp. aureus Mu50
uguuuaucaugaugauaaauuga

SEQ ID NO: 3964024 - RNA, 19 nt, Staphylococcus aureus subsp. aureus Mu50
uguuuaucuccuaaaggua

SEQ ID NO: 3964025 - RNA, 19 nt, Staphylococcus aureus subsp. aureus Mu50
uguuuaucugaauuuuacu

SEQ ID NO: 3964026 - RNA, 18 nt, Staphylococcus aureus subsp. aureus Mu50
uguuuaugacaaaguucu

SEQ ID NO: 3964027 - RNA, 24 nt, Staphylococcus aureus subsp. aureus Mu50
uguuuaugagcuuaauaaauugua

SEQ ID NO: 3964028 - RNA, 15 nt, Staphylococcus aureus subsp. aureus Mu50
uguuuauuacauaau

SEQ ID NO: 3964029 - RNA, 18 nt, Staphylococcus aureus subsp. aureus Mu50
uguuuauuacauaauuua

SEQ ID NO: 3964030 - RNA, 20 nt, Staphylococcus aureus subsp. aureus Mu50
uguuuauuacauaauuuauc

SEQ ID NO: 3964031 - RNA, 20 nt, Staphylococcus aureus subsp. aureus Mu50
uguuuauuaggauucaauaa

SEQ ID NO: 3964032 - RNA, 19 nt, Staphylococcus aureus subsp. aureus Mu50
uguuuauuuagaauaaacu

SEQ ID NO: 3964033 - RNA, 15 nt, Staphylococcus aureus subsp. aureus Mu50
uguuucaacauuuca

SEQ ID NO: 3964034 - RNA, 12 nt, Staphylococcus aureus subsp. aureus Mu50
uguuucagcuug

SEQ ID NO: 3964035 - RNA, 21 nt, Staphylococcus aureus subsp. aureus Mu50
uguuucagcuuguccauagua

SEQ ID NO: 3964036 - RNA, 15 nt, Staphylococcus aureus subsp. aureus Mu50
uguuucaggauaaug

SEQ ID NO: 3964037 - RNA, 15 nt, Staphylococcus aureus subsp. aureus Mu50
uguuucauauauauu

SEQ ID NO: 3964038 - RNA, 19 nt, Staphylococcus aureus subsp. aureus Mu50
uguuucauaugcaucaaca

SEQ ID NO: 3964039 - RNA, 14 nt, Staphylococcus aureus subsp. aureus Mu50
uguuuccucuuuaa

SEQ ID NO: 3964040 - RNA, 15 nt, Staphylococcus aureus subsp. aureus Mu50
uguuucuaaauucuu

SEQ ID NO: 3964041 - RNA, 14 nt, Staphylococcus aureus subsp. aureus Mu50
uguuucuaaugcuc

SEQ ID NO: 3964042 - RNA, 23 nt, Staphylococcus aureus subsp. aureus Mu50
uguuucuuagcuagcauguuuug

SEQ ID NO: 3964043 - RNA, 13 nt, Staphylococcus aureus subsp. aureus Mu50
uguuucuuguucu

SEQ ID NO: 3964044 - RNA, 18 nt, Staphylococcus aureus subsp. aureus Mu50
uguuugaauggcaaauau

SEQ ID NO: 3964045 - RNA, 18 nt, Staphylococcus aureus subsp. aureus Mu50
uguuugaauguuuuugau

SEQ ID NO: 3964046 - RNA, 16 nt, Staphylococcus aureus subsp. aureus Mu50
uguuugacucuuuucu

SEQ ID NO: 3964047 - RNA, 14 nt, Staphylococcus aureus subsp. aureus Mu50
uguuugagauauau

SEQ ID NO: 3964048 - RNA, 15 nt, Staphylococcus aureus subsp. aureus Mu50
uguuugagauauauu

SEQ ID NO: 3964049 - RNA, 12 nt, Staphylococcus aureus subsp. aureus Mu50
uguuugauauug

SEQ ID NO: 3964050 - RNA, 17 nt, Staphylococcus aureus subsp. aureus Mu50
uguuugcaacauauuuu

SEQ ID NO: 3964051 - RNA, 20 nt, Staphylococcus aureus subsp. aureus Mu50
uguuugcccugcuguuuuau

SEQ ID NO: 3964052 - RNA, 18 nt, Staphylococcus aureus subsp. aureus Mu50
uguuuggaugcuuuucua

SEQ ID NO: 3964053 - RNA, 18 nt, Staphylococcus aureus subsp. aureus Mu50
uguuugggauauagaaaa

SEQ ID NO: 3964054 - RNA, 19 nt, Staphylococcus aureus subsp. aureus Mu50
uguuuguaaaucaaguguu

SEQ ID NO: 3964055 - RNA, 17 nt, Staphylococcus aureus subsp. aureus Mu50
uguuuguuuuuguggaa

SEQ ID NO: 3964056 - RNA, 12 nt, Staphylococcus aureus subsp. aureus Mu50
uguuuuaaaauu

SEQ ID NO: 3964057 - RNA, 15 nt, Staphylococcus aureus subsp. aureus Mu50
uguuuuaaaauuauu

SEQ ID NO: 3964058 - RNA, 16 nt, Staphylococcus aureus subsp. aureus Mu50
uguuuuaaaauuauuu

SEQ ID NO: 3964059 - RNA, 14 nt, Staphylococcus aureus subsp. aureus Mu50
uguuuuaaauacuu

SEQ ID NO: 3964060 - RNA, 15 nt, Staphylococcus aureus subsp. aureus Mu50
uguuuuaauaauauc

SEQ ID NO: 3964061 - RNA, 21 nt, Staphylococcus aureus subsp. aureus Mu50
uguuuuaauaauaucuuuugc

SEQ ID NO: 3964062 - RNA, 14 nt, Staphylococcus aureus subsp. aureus Mu50
uguuuuaucaauau

SEQ ID NO: 3964063 - RNA, 15 nt, Staphylococcus aureus subsp. aureus Mu50
uguuuuaugauuuuc

SEQ ID NO: 3964064 - RNA, 19 nt, Staphylococcus aureus subsp. aureus Mu50
uguuuuaugauuuucuuua

SEQ ID NO: 3964065 - RNA, 19 nt, Staphylococcus aureus subsp. aureus Mu50
uguuuuauuaugaauuauu

SEQ ID NO: 3964066 - RNA, 20 nt, Staphylococcus aureus subsp. aureus Mu50
uuaaagaugucgaaaaguau

SEQ ID NO: 3964067 - RNA, 15 nt, Staphylococcus aureus subsp. aureus Mu50
uuaaagauuaaaaua

SEQ ID NO: 3964068 - RNA, 22 nt, Staphylococcus aureus subsp. aureus Mu50
uuaaagauuuacccauuacauu

SEQ ID NO: 3964069 - RNA, 21 nt, Staphylococcus aureus subsp. aureus Mu50
uuaaagcaaauuauauagaaa

SEQ ID NO: 3964070 - RNA, 13 nt, Staphylococcus aureus subsp. aureus Mu50
uuaaagcaucaua

SEQ ID NO: 3964071 - RNA, 22 nt, Staphylococcus aureus subsp. aureus Mu50
uuaaagcuaguaaugccauuaa

SEQ ID NO: 3964072 - RNA, 24 nt, Staphylococcus aureus subsp. aureus Mu50
uuaaaggaaaucaauccaucaaua

SEQ ID NO: 3964073 - RNA, 16 nt, Staphylococcus aureus subsp. aureus Mu50
uuaaaggguguuuaga

SEQ ID NO: 3964074 - RNA, 15 nt, Staphylococcus aureus subsp. aureus Mu50
uuaaagguuaaauau

SEQ ID NO: 3964075 - RNA, 20 nt, Staphylococcus aureus subsp. aureus Mu50
uuaaagguuaaauauuuaau

SEQ ID NO: 3964076 - RNA, 22 nt, Staphylococcus aureus subsp. aureus Mu50
uuaaaguaaaauauacuugaag

SEQ ID NO: 3964077 - RNA, 22 nt, Staphylococcus aureus subsp. aureus Mu50
uuaaaguaaccacaacaaugca

SEQ ID NO: 3964078 - RNA, 23 nt, Staphylococcus aureus subsp. aureus Mu50
uuaaagucuguugguuuaucagc

SEQ ID NO: 3964079 - RNA, 11 nt, Staphylococcus aureus subsp. aureus Mu50
uuaaagucuuc

SEQ ID NO: 3964080 - RNA, 19 nt, Staphylococcus aureus subsp. aureus Mu50
uuaaaguuguugaaauuuc

SEQ ID NO: 3964081 - RNA, 17 nt, Staphylococcus aureus subsp. aureus Mu50
uuaaaguuuuguucaau

SEQ ID NO: 3964082 - RNA, 22 nt, Staphylococcus aureus subsp. aureus Mu50
uuaaaguuuuguucaauaugau

SEQ ID NO: 3964083 - RNA, 13 nt, Staphylococcus aureus subsp. aureus Mu50
uuaaauaaaaaua

SEQ ID NO: 3964084 - RNA, 16 nt, Staphylococcus aureus subsp. aureus Mu50
uuaaauaaaaauauug

SEQ ID NO: 3964085 - RNA, 15 nt, Staphylococcus aureus subsp. aureus Mu50
uuaaauaaaugacuu

SEQ ID NO: 3964086 - RNA, 20 nt, Staphylococcus aureus subsp. aureus Mu50
uuaaauaaauucucuaauuu

SEQ ID NO: 3964087 - RNA, 12 nt, Staphylococcus aureus subsp. aureus Mu50
uuaaauaauaau

SEQ ID NO: 3964088 - RNA, 22 nt, Staphylococcus aureus subsp. aureus Mu50
uuaaauaaucgaaaauuucagg

SEQ ID NO: 3964089 - RNA, 14 nt, Staphylococcus aureus subsp. aureus Mu50
uuaaauaaugauaa

SEQ ID NO: 3964090 - RNA, 23 nt, Staphylococcus aureus subsp. aureus Mu50
uuaaauaaugauaaauuaaagcu

SEQ ID NO: 3964091 - RNA, 19 nt, Staphylococcus aureus subsp. aureus Mu50
uuaaauacgccaaauauca

SEQ ID NO: 3964092 - RNA, 14 nt, Staphylococcus aureus subsp. aureus Mu50
uuaaauacuauaua

SEQ ID NO: 3964093 - RNA, 19 nt, Staphylococcus aureus subsp. aureus Mu50
uuaaauacuugcucuaauu

SEQ ID NO: 3964094 - RNA, 23 nt, Staphylococcus aureus subsp. aureus Mu50
uuaaauaggugauuauauauauu

SEQ ID NO: 3964095 - RNA, 11 nt, Staphylococcus aureus subsp. aureus Mu50
uuaaauaucau

SEQ ID NO: 3964096 - RNA, 13 nt, Staphylococcus aureus subsp. aureus Mu50
uuaaauaucauac

SEQ ID NO: 3964097 - RNA, 14 nt, Staphylococcus aureus subsp. aureus Mu50
uuaaauaucaugca

SEQ ID NO: 3964098 - RNA, 20 nt, Staphylococcus aureus subsp. aureus Mu50
uuaaauaucaugcaaaacua

SEQ ID NO: 3964099 - RNA, 22 nt, Staphylococcus aureus subsp. aureus Mu50
uuaaauaucgacaaauuaaaaa

SEQ ID NO: 3964100 - RNA, 18 nt, Staphylococcus aureus subsp. aureus Mu50
uuaaauaugaauaaugca

SEQ ID NO: 3964101 - RNA, 21 nt, Staphylococcus aureus subsp. aureus Mu50
uuaaauaugacgcgugaauua

SEQ ID NO: 3964102 - RNA, 21 nt, Staphylococcus aureus subsp. aureus Mu50
uuaaauauucacgacuugaua

SEQ ID NO: 3964103 - RNA, 19 nt, Staphylococcus aureus subsp. aureus Mu50
uuaaauauugauauaaaaa

SEQ ID NO: 3964104 - RNA, 14 nt, Staphylococcus aureus subsp. aureus Mu50
uuaaaucaacauca

SEQ ID NO: 3964105 - RNA, 19 nt, Staphylococcus aureus subsp. aureus Mu50
uuaaaucaacaucaucuuu

SEQ ID NO: 3964106 - RNA, 13 nt, Staphylococcus aureus subsp. aureus Mu50
uuaaaucacauau

SEQ ID NO: 3964107 - RNA, 20 nt, Staphylococcus aureus subsp. aureus Mu50
uuaaaucaccaacaacuuug

SEQ ID NO: 3964108 - RNA, 20 nt, Staphylococcus aureus subsp. aureus Mu50
uuaaaucacuagcuaaugca

SEQ ID NO: 3964109 - RNA, 19 nt, Staphylococcus aureus subsp. aureus Mu50
uuaaaucacugcuuucaag

SEQ ID NO: 3964110 - RNA, 15 nt, Staphylococcus aureus subsp. aureus Mu50
uuaaaucuaauuauu

SEQ ID NO: 3964111 - RNA, 17 nt, Staphylococcus aureus subsp. aureus Mu50
uuaaaucuaauuauuca

SEQ ID NO: 3964112 - RNA, 12 nt, Staphylococcus aureus subsp. aureus Mu50
uuaaaucuacaa

SEQ ID NO: 3964113 - RNA, 15 nt, Staphylococcus aureus subsp. aureus Mu50
uuaaaucuacuuugu

SEQ ID NO: 3964114 - RNA, 15 nt, Staphylococcus aureus subsp. aureus Mu50
uuaaaucuauauaaa

SEQ ID NO: 3964115 - RNA, 22 nt, Staphylococcus aureus subsp. aureus Mu50
uuaaaucugcuugugugucauu

SEQ ID NO: 3964116 - RNA, 23 nt, Staphylococcus aureus subsp. aureus Mu50
uuaaaucuuuuacuaaaugaauu

SEQ ID NO: 3964117 - RNA, 21 nt, Staphylococcus aureus subsp. aureus Mu50
uuaaaugaugcaguaaaacca

SEQ ID NO: 3964118 - RNA, 20 nt, Staphylococcus aureus subsp. aureus Mu50
uuaaaugauuucacuucaua

SEQ ID NO: 3964119 - RNA, 21 nt, Staphylococcus aureus subsp. aureus Mu50
uuaaaugcccaccauguacau

SEQ ID NO: 3964120 - RNA, 19 nt, Staphylococcus aureus subsp. aureus Mu50
uuaaaugcuggguaauaaa

SEQ ID NO: 3964121 - RNA, 22 nt, Staphylococcus aureus subsp. aureus Mu50
uuaaauguacauuguaaauaua

SEQ ID NO: 3964122 - RNA, 18 nt, Staphylococcus aureus subsp. aureus Mu50
uuaaaugucuuucaaaua

SEQ ID NO: 3964123 - RNA, 18 nt, Staphylococcus aureus subsp. aureus Mu50
uuaaaugugcaauuagaa

SEQ ID NO: 3964124 - RNA, 15 nt, Staphylococcus aureus subsp. aureus Mu50
uuaaauuauauguuu

SEQ ID NO: 3964125 - RNA, 12 nt, Staphylococcus aureus subsp. aureus Mu50
uuaaauuauugu

SEQ ID NO: 3964126 - RNA, 15 nt, Staphylococcus aureus subsp. aureus Mu50
uuaaauuauuuaauu

SEQ ID NO: 3964127 - RNA, 21 nt, Staphylococcus aureus subsp. aureus Mu50
uuaaauuauuuaauuuuucua

SEQ ID NO: 3964128 - RNA, 21 nt, Staphylococcus aureus subsp. aureus Mu50
uuaaauucaucuuaucaagaa

SEQ ID NO: 3964129 - RNA, 14 nt, Staphylococcus aureus subsp. aureus Mu50
uuaaauucaucuug

SEQ ID NO: 3964130 - RNA, 13 nt, Staphylococcus aureus subsp. aureus Mu50
uuaaauucuaaaa

SEQ ID NO: 3964131 - RNA, 21 nt, Staphylococcus aureus subsp. aureus Mu50
uuaaauucuuauaaaauaaaa

SEQ ID NO: 3964132 - RNA, 21 nt, Staphylococcus aureus subsp. aureus Mu50
uuaaauugcuugaaauuauua

SEQ ID NO: 3964133 - RNA, 18 nt, Staphylococcus aureus subsp. aureus Mu50
uuaaauuggaaucccaau

SEQ ID NO: 3964134 - RNA, 15 nt, Staphylococcus aureus subsp. aureus Mu50
uuaaauuuaaaagaa

SEQ ID NO: 3964135 - RNA, 18 nt, Staphylococcus aureus subsp. aureus Mu50
uuaaauuucugaacauaa

SEQ ID NO: 3964136 - RNA, 15 nt, Staphylococcus aureus subsp. aureus Mu50
uuaaauuugaaagua

SEQ ID NO: 3964137 - RNA, 16 nt, Staphylococcus aureus subsp. aureus Mu50
uuaaauuugaaaguaa

SEQ ID NO: 3964138 - RNA, 13 nt, Staphylococcus aureus subsp. aureus Mu50
uuaaauuuucauc

SEQ ID NO: 3964139 - RNA, 20 nt, Staphylococcus aureus subsp. aureus Mu50
uuaacaaaauauacuaaauu

SEQ ID NO: 3964140 - RNA, 20 nt, Staphylococcus aureus subsp. aureus Mu50
uuaacaaaauuaagaagaaa

SEQ ID NO: 3964141 - RNA, 14 nt, Staphylococcus aureus subsp. aureus Mu50
uuaacaacaaauau

SEQ ID NO: 3964142 - RNA, 15 nt, Staphylococcus aureus subsp. aureus Mu50
uuaacaacaaauaua

SEQ ID NO: 3964143 - RNA, 16 nt, Staphylococcus aureus subsp. aureus Mu50
uuaacaacaaauauaa

SEQ ID NO: 3964144 - RNA, 15 nt, Staphylococcus aureus subsp. aureus Mu50
uuaacaacuuuaauu

SEQ ID NO: 3964145 - RNA, 15 nt, Staphylococcus aureus subsp. aureus Mu50
uuaacaacuuuauua

SEQ ID NO: 3964146 - RNA, 16 nt, Staphylococcus aureus subsp. aureus Mu50
uuaacaagauaacuag

SEQ ID NO: 3964147 - RNA, 14 nt, Staphylococcus aureus subsp. aureus Mu50
uuaacaauauuaaa

SEQ ID NO: 3964148 - RNA, 18 nt, Staphylococcus aureus subsp. aureus Mu50
uuaacaauugauugcucu

SEQ ID NO: 3964149 - RNA, 18 nt, Staphylococcus aureus subsp. aureus Mu50
uuaacaauuuuaucugaa

SEQ ID NO: 3964150 - RNA, 13 nt, Staphylococcus aureus subsp. aureus Mu50
uuaacauaaaaau

SEQ ID NO: 3964151 - RNA, 14 nt, Staphylococcus aureus subsp. aureus Mu50
uuaacauaaaauga

SEQ ID NO: 3964152 - RNA, 20 nt, Staphylococcus aureus subsp. aureus Mu50
uuaacauccugcuuauuaau

SEQ ID NO: 3964153 - RNA, 13 nt, Staphylococcus aureus subsp. aureus Mu50
uuaauauaaauuu

SEQ ID NO: 3964154 - RNA, 18 nt, Staphylococcus aureus subsp. aureus Mu50
uuaauauaacgacacuuu

SEQ ID NO: 3964155 - RNA, 13 nt, Staphylococcus aureus subsp. aureus Mu50
uuaauauaaguau

SEQ ID NO: 3964156 - RNA, 14 nt, Staphylococcus aureus subsp. aureus Mu50
uuaauauaauuaau

SEQ ID NO: 3964157 - RNA, 16 nt, Staphylococcus aureus subsp. aureus Mu50
uuaauauaauuaauuu

SEQ ID NO: 3964158 - RNA, 13 nt, Staphylococcus aureus subsp. aureus Mu50
uuaauauauuuau

SEQ ID NO: 3964159 - RNA, 14 nt, Staphylococcus aureus subsp. aureus Mu50
uuaauauauuuauu

SEQ ID NO: 3964160 - RNA, 15 nt, Staphylococcus aureus subsp. aureus Mu50
uuaauauauuuauuu

SEQ ID NO: 3964161 - RNA, 17 nt, Staphylococcus aureus subsp. aureus Mu50
uuaauaucacgaucuuu

SEQ ID NO: 3964162 - RNA, 17 nt, Staphylococcus aureus subsp. aureus Mu50
uuaauaucagguacaaa

SEQ ID NO: 3964163 - RNA, 17 nt, Staphylococcus aureus subsp. aureus Mu50
uuaauaucauauucaaa

SEQ ID NO: 3964164 - RNA, 21 nt, Staphylococcus aureus subsp. aureus Mu50
uuaauaucauauucaaaauaa

SEQ ID NO: 3964165 - RNA, 12 nt, Staphylococcus aureus subsp. aureus Mu50
uuaauauccaaa

SEQ ID NO: 3964166 - RNA, 15 nt, Staphylococcus aureus subsp. aureus Mu50
uuaauauccaaaauc

SEQ ID NO: 3964167 - RNA, 13 nt, Staphylococcus aureus subsp. aureus Mu50
uuaauaugcaaug

SEQ ID NO: 3964168 - RNA, 14 nt, Staphylococcus aureus subsp. aureus Mu50
uuaauauugauuaa

SEQ ID NO: 3964169 - RNA, 12 nt, Staphylococcus aureus subsp. aureus Mu50
uuaaucaauuua

SEQ ID NO: 3964170 - RNA, 14 nt, Staphylococcus aureus subsp. aureus Mu50
uuaaucaauuuaau

SEQ ID NO: 3964171 - RNA, 16 nt, Staphylococcus aureus subsp. aureus Mu50
uuaaucaauuuaauua

SEQ ID NO: 3964172 - RNA, 18 nt, Staphylococcus aureus subsp. aureus Mu50
uuaaucagcuauaaaagu

SEQ ID NO: 3964173 - RNA, 19 nt, Staphylococcus aureus subsp. aureus Mu50
uuaauccgauuuugauaua

SEQ ID NO: 3964174 - RNA, 16 nt, Staphylococcus aureus subsp. aureus Mu50
uuaauccuucuccaaa

SEQ ID NO: 3964175 - RNA, 11 nt, Staphylococcus aureus subsp. aureus Mu50
uuaaucgcauu

SEQ ID NO: 3964176 - RNA, 16 nt, Staphylococcus aureus subsp. aureus Mu50
uuaaucgcucuaaaua

SEQ ID NO: 3964177 - RNA, 18 nt, Staphylococcus aureus subsp. aureus Mu50
uuaaucgcucuaaauagu

SEQ ID NO: 3964178 - RNA, 19 nt, Staphylococcus aureus subsp. aureus Mu50
uuaaucguucccauucuuu

SEQ ID NO: 3964179 - RNA, 17 nt, Staphylococcus aureus subsp. aureus Mu50
uuaaucuauauaaaaac

SEQ ID NO: 3964180 - RNA, 14 nt, Staphylococcus aureus subsp. aureus Mu50
uuaaucuauauaua

SEQ ID NO: 3964181 - RNA, 22 nt, Staphylococcus aureus subsp. aureus Mu50
uuaaucucuuuuugauuauauu

SEQ ID NO: 3964182 - RNA, 14 nt, Staphylococcus aureus subsp. aureus Mu50
uuaaucuuaauauu

SEQ ID NO: 3964183 - RNA, 19 nt, Staphylococcus aureus subsp. aureus Mu50
uuaaucuucgucauaagga

SEQ ID NO: 3964184 - RNA, 23 nt, Staphylococcus aureus subsp. aureus Mu50
uuaaugaaauaccuaccacaaua

SEQ ID NO: 3964185 - RNA, 21 nt, Staphylococcus aureus subsp. aureus Mu50
uuaaugacuaugcaaaugaaa

SEQ ID NO: 3964186 - RNA, 20 nt, Staphylococcus aureus subsp. aureus Mu50
uuaaugacuucuuuauauuu

SEQ ID NO: 3964187 - RNA, 22 nt, Staphylococcus aureus subsp. aureus Mu50
uuaaugacuucuuuauauuuau

SEQ ID NO: 3964188 - RNA, 22 nt, Staphylococcus aureus subsp. aureus Mu50
uuaaugauugacgauuuaauua

SEQ ID NO: 3964189 - RNA, 23 nt, Staphylococcus aureus subsp. aureus Mu50
uuaaugauugacgauuuaauuaa

SEQ ID NO: 3964190 - RNA, 15 nt, Staphylococcus aureus subsp. aureus Mu50
uuaaugauuuuucau

SEQ ID NO: 3964191 - RNA, 22 nt, Staphylococcus aureus subsp. aureus Mu50
uuaauggcagcgaucuuuuuua

SEQ ID NO: 3964192 - RNA, 17 nt, Staphylococcus aureus subsp. aureus Mu50
uuaauggucuaauauca

SEQ ID NO: 3964193 - RNA, 14 nt, Staphylococcus aureus subsp. aureus Mu50
uuaauguaaucauu

SEQ ID NO: 3964194 - RNA, 14 nt, Staphylococcus aureus subsp. aureus Mu50
uuaaugucuucaua

SEQ ID NO: 3964195 - RNA, 13 nt, Staphylococcus aureus subsp. aureus Mu50
uuaaugugcauuu

SEQ ID NO: 3964196 - RNA, 17 nt, Staphylococcus aureus subsp. aureus Mu50
uuaaugugcauuuaucu

SEQ ID NO: 3964197 - RNA, 19 nt, Staphylococcus aureus subsp. aureus Mu50
uuaauguguaaauuuugua

SEQ ID NO: 3964198 - RNA, 13 nt, Staphylococcus aureus subsp. aureus Mu50
uuaauuaaaauac

SEQ ID NO: 3964199 - RNA, 12 nt, Staphylococcus aureus subsp. aureus Mu50
uuaauuaacaaa

SEQ ID NO: 3964200 - RNA, 18 nt, Staphylococcus aureus subsp. aureus Mu50
uuaauuaaguuaaaauaa

SEQ ID NO: 3964201 - RNA, 15 nt, Staphylococcus aureus subsp. aureus Mu50
uuaauuaauaauuua

SEQ ID NO: 3964202 - RNA, 21 nt, Staphylococcus aureus subsp. aureus Mu50
uuaauuaauaauuuaacuaau

SEQ ID NO: 3964203 - RNA, 15 nt, Staphylococcus aureus subsp. aureus Mu50
uuaauuaauguucaa

SEQ ID NO: 3964204 - RNA, 14 nt, Staphylococcus aureus subsp. aureus Mu50
uuaauuaauuauca

SEQ ID NO: 3964205 - RNA, 12 nt, Staphylococcus aureus subsp. aureus Mu50
uuaauuaucauu

SEQ ID NO: 3964206 - RNA, 22 nt, Staphylococcus aureus subsp. aureus Mu50
uuaauuauugagaauauuuauu

SEQ ID NO: 3964207 - RNA, 14 nt, Staphylococcus aureus subsp. aureus Mu50
uuaauuauuucccu

SEQ ID NO: 3964208 - RNA, 15 nt, Staphylococcus aureus subsp. aureus Mu50
uuaauuauuucccug

SEQ ID NO: 3964209 - RNA, 16 nt, Staphylococcus aureus subsp. aureus Mu50
uuaauuauuuuaaaaa

SEQ ID NO: 3964210 - RNA, 22 nt, Staphylococcus aureus subsp. aureus Mu50
uuaauucuauuuuugauuuaau

SEQ ID NO: 3964211 - RNA, 13 nt, Staphylococcus aureus subsp. aureus Mu50
uuaauucuuaauc

SEQ ID NO: 3964212 - RNA, 18 nt, Staphylococcus aureus subsp. aureus Mu50
uuaauugaaaaaccaagu

SEQ ID NO: 3964213 - RNA, 18 nt, Staphylococcus aureus subsp. aureus Mu50
uuaauugaaugaaaauaa

SEQ ID NO: 3964214 - RNA, 18 nt, Staphylococcus aureus subsp. aureus Mu50
uuaauugcuguaaauauu

SEQ ID NO: 3964215 - RNA, 21 nt, Staphylococcus aureus subsp. aureus Mu50
uuaauugcuuucacauuguuu

SEQ ID NO: 3964216 - RNA, 17 nt, Staphylococcus aureus subsp. aureus Mu50
uuaauuggguuuaauaa

SEQ ID NO: 3964217 - RNA, 15 nt, Staphylococcus aureus subsp. aureus Mu50
uuaauuguuaaauca

SEQ ID NO: 3964218 - RNA, 15 nt, Staphylococcus aureus subsp. aureus Mu50
uuaauuguuuaauaa

SEQ ID NO: 3964219 - RNA, 20 nt, Staphylococcus aureus subsp. aureus Mu50
uuaauuuaacggaaauacaa

SEQ ID NO: 3964220 - RNA, 23 nt, Staphylococcus aureus subsp. aureus Mu50
uuaauuuaacggaaauacaauga

SEQ ID NO: 3964221 - RNA, 17 nt, Staphylococcus aureus subsp. aureus Mu50
uuaauuuaauuuuagua

SEQ ID NO: 3964222 - RNA, 17 nt, Staphylococcus aureus subsp. aureus Mu50
uuaauuuaguuauaauu

SEQ ID NO: 3964223 - RNA, 15 nt, Staphylococcus aureus subsp. aureus Mu50
uuaauuucaacauua

SEQ ID NO: 3964224 - RNA, 13 nt, Staphylococcus aureus subsp. aureus Mu50
uuaauuucacuuu

SEQ ID NO: 3964225 - RNA, 14 nt, Staphylococcus aureus subsp. aureus Mu50
uuaauuucacuuua

SEQ ID NO: 3964226 - RNA, 16 nt, Staphylococcus aureus subsp. aureus Mu50
uuaauuucacuuuaac

SEQ ID NO: 3964227 - RNA, 16 nt, Staphylococcus aureus subsp. aureus Mu50
uuaauuucaugugcaa

SEQ ID NO: 3964228 - RNA, 13 nt, Staphylococcus aureus subsp. aureus Mu50
uuaauuucuggua

SEQ ID NO: 3964229 - RNA, 17 nt, Staphylococcus aureus subsp. aureus Mu50
uuaauuucugguaaaaa

SEQ ID NO: 3964230 - RNA, 16 nt, Staphylococcus aureus subsp. aureus Mu50
uuaauuugauuaaaaa

SEQ ID NO: 3964231 - RNA, 12 nt, Staphylococcus aureus subsp. aureus Mu50
uuaauuugucau

SEQ ID NO: 3964232 - RNA, 17 nt, Staphylococcus aureus subsp. aureus Mu50
uuaauuuguuuuaaaua

SEQ ID NO: 3964233 - RNA, 14 nt, Staphylococcus aureus subsp. aureus Mu50
uuaauuuuaaauau

SEQ ID NO: 3964234 - RNA, 14 nt, Staphylococcus aureus subsp. aureus Mu50
uuaauuuuaucuua

SEQ ID NO: 3964235 - RNA, 17 nt, Staphylococcus aureus subsp. aureus Mu50
uuaauuuuaucuuauua

SEQ ID NO: 3964236 - RNA, 14 nt, Staphylococcus aureus subsp. aureus Mu50
uuaauuuuauuuua

SEQ ID NO: 3964237 - RNA, 16 nt, Staphylococcus aureus subsp. aureus Mu50
uuaauuuucuaaauau

SEQ ID NO: 3964238 - RNA, 17 nt, Staphylococcus aureus subsp. aureus Mu50
uuaauuuucuaaauaua

SEQ ID NO: 3964239 - RNA, 14 nt, Staphylococcus aureus subsp. aureus Mu50
uuaauuuucuuuuu

SEQ ID NO: 3964240 - RNA, 16 nt, Staphylococcus aureus subsp. aureus Mu50
uuaauuuucuuuuuua

SEQ ID NO: 3964241 - RNA, 20 nt, Staphylococcus aureus subsp. aureus Mu50
uuaauuuugacauaaaaaau

SEQ ID NO: 3964242 - RNA, 15 nt, Staphylococcus aureus subsp. aureus Mu50
uuacuuuuaaaacua

SEQ ID NO: 3964243 - RNA, 22 nt, Staphylococcus aureus subsp. aureus Mu50
uuacuuuuccuugauucuuaua

SEQ ID NO: 3964244 - RNA, 22 nt, Staphylococcus aureus subsp. aureus Mu50
uuacuuuucuaaacaacuucug

SEQ ID NO: 3964245 - RNA, 21 nt, Staphylococcus aureus subsp. aureus Mu50
uuagaaacaaucguugaagau

SEQ ID NO: 3964246 - RNA, 23 nt, Staphylococcus aureus subsp. aureus Mu50
uuagaaauucucaguguuggggg

SEQ ID NO: 3964247 - RNA, 20 nt, Staphylococcus aureus subsp. aureus Mu50
uuagaacguaauguuacaca

SEQ ID NO: 3964248 - RNA, 18 nt, Staphylococcus aureus subsp. aureus Mu50
uuagaagaugauuauucu

SEQ ID NO: 3964249 - RNA, 20 nt, Staphylococcus aureus subsp. aureus Mu50
uuagaagaugauuauucucu

SEQ ID NO: 3964250 - RNA, 23 nt, Staphylococcus aureus subsp. aureus Mu50
uuagaagaugauuauucucuuua

SEQ ID NO: 3964251 - RNA, 17 nt, Staphylococcus aureus subsp. aureus Mu50
uuagaauaagaaauaaa

SEQ ID NO: 3964252 - RNA, 18 nt, Staphylococcus aureus subsp. aureus Mu50
uuagaauaguuaccaaaa

SEQ ID NO: 3964253 - RNA, 19 nt, Staphylococcus aureus subsp. aureus Mu50
uuagaauuaguacuugaaa

SEQ ID NO: 3964254 - RNA, 13 nt, Staphylococcus aureus subsp. aureus Mu50
uuagacauuaaaa

SEQ ID NO: 3964255 - RNA, 18 nt, Staphylococcus aureus subsp. aureus Mu50
uuagacgcuguuuuaaau

SEQ ID NO: 3964256 - RNA, 18 nt, Staphylococcus aureus subsp. aureus Mu50
uuagacuaaaaaacuaac

SEQ ID NO: 3964257 - RNA, 20 nt, Staphylococcus aureus subsp. aureus Mu50
uuagagaagaauucucuauu

SEQ ID NO: 3964258 - RNA, 22 nt, Staphylococcus aureus subsp. aureus Mu50
uuagagccuacucauauucauu

SEQ ID NO: 3964259 - RNA, 13 nt, Staphylococcus aureus subsp. aureus Mu50
uuagauaaaaauu

SEQ ID NO: 3964260 - RNA, 17 nt, Staphylococcus aureus subsp. aureus Mu50
uuagauaaaaauuacua

SEQ ID NO: 3964261 - RNA, 14 nt, Staphylococcus aureus subsp. aureus Mu50
uuagauaaauuaau

SEQ ID NO: 3964262 - RNA, 21 nt, Staphylococcus aureus subsp. aureus Mu50
uuagauaaauuaauaugaaca

SEQ ID NO: 3964263 - RNA, 15 nt, Staphylococcus aureus subsp. aureus Mu50
uuagauaauaaggaa

SEQ ID NO: 3964264 - RNA, 18 nt, Staphylococcus aureus subsp. aureus Mu50
uuagauagcggauuuauu

SEQ ID NO: 3964265 - RNA, 21 nt, Staphylococcus aureus subsp. aureus Mu50
uuagauauauuugaaagguaa

SEQ ID NO: 3964266 - RNA, 15 nt, Staphylococcus aureus subsp. aureus Mu50
uuagauaucuuaauc

SEQ ID NO: 3964267 - RNA, 13 nt, Staphylococcus aureus subsp. aureus Mu50
uuagaugauauuu

SEQ ID NO: 3964268 - RNA, 16 nt, Staphylococcus aureus subsp. aureus Mu50
uuagaugcauaaaaaa

SEQ ID NO: 3964269 - RNA, 16 nt, Staphylococcus aureus subsp. aureus Mu50
uuagauuaucuuucaa

SEQ ID NO: 3964270 - RNA, 17 nt, Staphylococcus aureus subsp. aureus Mu50
uuagauucacuguauaa

SEQ ID NO: 3964271 - RNA, 21 nt, Staphylococcus aureus subsp. aureus Mu50
uuagauugacuaaguuuguuu

SEQ ID NO: 3964272 - RNA, 12 nt, Staphylococcus aureus subsp. aureus Mu50
uuagauuuaaaa

SEQ ID NO: 3964273 - RNA, 18 nt, Staphylococcus aureus subsp. aureus Mu50
uuagauuuuauauaaaaa

SEQ ID NO: 3964274 - RNA, 21 nt, Staphylococcus aureus subsp. aureus Mu50
uuagauuuuauauaaaaagaa

SEQ ID NO: 3964275 - RNA, 15 nt, Staphylococcus aureus subsp. aureus Mu50
uuagcaaauauuucu

SEQ ID NO: 3964276 - RNA, 13 nt, Staphylococcus aureus subsp. aureus Mu50
uuagcaauuucau

SEQ ID NO: 3964277 - RNA, 14 nt, Staphylococcus aureus subsp. aureus Mu50
uuagcaauuucauc

SEQ ID NO: 3964278 - RNA, 19 nt, Staphylococcus aureus subsp. aureus Mu50
uuagcagcgauacguuuau

SEQ ID NO: 3964279 - RNA, 14 nt, Staphylococcus aureus subsp. aureus Mu50
uuagcauacauuaa

SEQ ID NO: 3964280 - RNA, 13 nt, Staphylococcus aureus subsp. aureus Mu50
uuagcaucaaaaa

SEQ ID NO: 3964281 - RNA, 18 nt, Staphylococcus aureus subsp. aureus Mu50
uuagcaugacuguaagua

SEQ ID NO: 3964282 - RNA, 19 nt, Staphylococcus aureus subsp. aureus Mu50
uuagcauuaaauuccaugu

SEQ ID NO: 3964283 - RNA, 12 nt, Staphylococcus aureus subsp. aureus Mu50
uuagcauuauua

SEQ ID NO: 3964284 - RNA, 13 nt, Staphylococcus aureus subsp. aureus Mu50
uuagcauuauuug

SEQ ID NO: 3964285 - RNA, 17 nt, Staphylococcus aureus subsp. aureus Mu50
uuagccaaaucuuuaau

SEQ ID NO: 3964286 - RNA, 18 nt, Staphylococcus aureus subsp. aureus Mu50
uuagccaauaaaauguca

SEQ ID NO: 3964287 - RNA, 14 nt, Staphylococcus aureus subsp. aureus Mu50
uuagcccuccuaag

SEQ ID NO: 3964288 - RNA, 19 nt, Staphylococcus aureus subsp. aureus Mu50
uuagcgcaccaauuaucaa

SEQ ID NO: 3964289 - RNA, 14 nt, Staphylococcus aureus subsp. aureus Mu50
uuagcuuguuguuu

SEQ ID NO: 3964290 - RNA, 23 nt, Staphylococcus aureus subsp. aureus Mu50
uuagcuuuuguaaagcuuuaguu

SEQ ID NO: 3964291 - RNA, 15 nt, Staphylococcus aureus subsp. aureus Mu50
uuaggaaugauagau

SEQ ID NO: 3964292 - RNA, 18 nt, Staphylococcus aureus subsp. aureus Mu50
uuaggaaugauagauuua

SEQ ID NO: 3964293 - RNA, 13 nt, Staphylococcus aureus subsp. aureus Mu50
uuaggauuaacau

SEQ ID NO: 3964294 - RNA, 15 nt, Staphylococcus aureus subsp. aureus Mu50
uuaggcgacuuaacu

SEQ ID NO: 3964295 - RNA, 17 nt, Staphylococcus aureus subsp. aureus Mu50
uuaggcgcuacaauguu

SEQ ID NO: 3964296 - RNA, 22 nt, Staphylococcus aureus subsp. aureus Mu50
uuagggaaauguagauuacuuu

SEQ ID NO: 3964297 - RNA, 13 nt, Staphylococcus aureus subsp. aureus Mu50
uuaggggcuuuua

SEQ ID NO: 3964298 - RNA, 16 nt, Staphylococcus aureus subsp. aureus Mu50
uuaggggcuuuuaugc

SEQ ID NO: 3964299 - RNA, 15 nt, Staphylococcus aureus subsp. aureus Mu50
uuagguccuuucaca

SEQ ID NO: 3964300 - RNA, 19 nt, Staphylococcus aureus subsp. aureus Mu50
uuaggucuacgaucaaaau

SEQ ID NO: 3964301 - RNA, 14 nt, Staphylococcus aureus subsp. aureus Mu50
uuagguuacuuauu

SEQ ID NO: 3964302 - RNA, 16 nt, Staphylococcus aureus subsp. aureus Mu50
uuagguuauauuuaaa

SEQ ID NO: 3964303 - RNA, 13 nt, Staphylococcus aureus subsp. aureus Mu50
uuaguaaauauag

SEQ ID NO: 3964304 - RNA, 15 nt, Staphylococcus aureus subsp. aureus Mu50
uuaguaaggaauauu

SEQ ID NO: 3964305 - RNA, 19 nt, Staphylococcus aureus subsp. aureus Mu50
uuaguaaggaauauuuccc

SEQ ID NO: 3964306 - RNA, 19 nt, Staphylococcus aureus subsp. aureus Mu50
uuaguaauaacaucuaaau

SEQ ID NO: 3964307 - RNA, 15 nt, Staphylococcus aureus subsp. aureus Mu50
uuaguacaaaauugu

SEQ ID NO: 3964308 - RNA, 21 nt, Staphylococcus aureus subsp. aureus Mu50
uuaguacggcugcuuuaacug

SEQ ID NO: 3964309 - RNA, 19 nt, Staphylococcus aureus subsp. aureus Mu50
uuaguagauuuauuaaaua

SEQ ID NO: 3964310 - RNA, 20 nt, Staphylococcus aureus subsp. aureus Mu50
uuaguagauuuauuaaauau

SEQ ID NO: 3964311 - RNA, 21 nt, Staphylococcus aureus subsp. aureus Mu50
uuaguauaauuuaucuuaauc

SEQ ID NO: 3964312 - RNA, 17 nt, Staphylococcus aureus subsp. aureus Mu50
uuagucuuuuuaaguau

SEQ ID NO: 3964313 - RNA, 23 nt, Staphylococcus aureus subsp. aureus Mu50
uuagugacaaguaugucaucuuc

SEQ ID NO: 3964314 - RNA, 22 nt, Staphylococcus aureus subsp. aureus Mu50
uuagugacucaguuauauuaag

SEQ ID NO: 3964315 - RNA, 21 nt, Staphylococcus aureus subsp. aureus Mu50
uuagugauaccuuuaauuguu

SEQ ID NO: 3964316 - RNA, 13 nt, Staphylococcus aureus subsp. aureus Mu50
uuagugauauuuu

SEQ ID NO: 3964317 - RNA, 15 nt, Staphylococcus aureus subsp. aureus Mu50
uuaguguagaaaaua

SEQ ID NO: 3964318 - RNA, 18 nt, Staphylococcus aureus subsp. aureus Mu50
uuaguuaauuauuuagau

SEQ ID NO: 3964319 - RNA, 15 nt, Staphylococcus aureus subsp. aureus Mu50
uuaguuugacaucua

SEQ ID NO: 3964320 - RNA, 16 nt, Staphylococcus aureus subsp. aureus Mu50
uuaguuugacaucuau

SEQ ID NO: 3964321 - RNA, 14 nt, Staphylococcus aureus subsp. aureus Mu50
uuaguuuucuuaaa

SEQ ID NO: 3964322 - RNA, 17 nt, Staphylococcus aureus subsp. aureus Mu50
uuaguuuucuuaaaaga

SEQ ID NO: 3964323 - RNA, 14 nt, Staphylococcus aureus subsp. aureus Mu50
uuaguuuuuuuaaa

SEQ ID NO: 3964324 - RNA, 12 nt, Staphylococcus aureus subsp. aureus Mu50
uuauaaaaaacg

SEQ ID NO: 3964325 - RNA, 15 nt, Staphylococcus aureus subsp. aureus Mu50
uuauaaaaaaucagu

SEQ ID NO: 3964326 - RNA, 15 nt, Staphylococcus aureus subsp. aureus Mu50
uuauaaaaacagcag

SEQ ID NO: 3964327 - RNA, 14 nt, Staphylococcus aureus subsp. aureus Mu50
uuauaaaaacuuau

SEQ ID NO: 3964328 - RNA, 22 nt, Staphylococcus aureus subsp. aureus Mu50
uuauaaaacaguaaguaauaaa

SEQ ID NO: 3964329 - RNA, 17 nt, Staphylococcus aureus subsp. aureus Mu50
uuauaaaaugaauaauu

SEQ ID NO: 3964330 - RNA, 18 nt, Staphylococcus aureus subsp. aureus Mu50
uuaucgaucgguauuuuc

SEQ ID NO: 3964331 - RNA, 19 nt, Staphylococcus aureus subsp. aureus Mu50
uuaucgaucgguauuuuca

SEQ ID NO: 3964332 - RNA, 16 nt, Staphylococcus aureus subsp. aureus Mu50
uuaucguaaaaaaacg

SEQ ID NO: 3964333 - RNA, 15 nt, Staphylococcus aureus subsp. aureus Mu50
uuaucuaaacauuuu

SEQ ID NO: 3964334 - RNA, 15 nt, Staphylococcus aureus subsp. aureus Mu50
uuaucuaaagcuaua

SEQ ID NO: 3964335 - RNA, 20 nt, Staphylococcus aureus subsp. aureus Mu50
uuaucuaaagcuauaaaaaa

SEQ ID NO: 3964336 - RNA, 21 nt, Staphylococcus aureus subsp. aureus Mu50
uuaucuaacaaucguuuuaau

SEQ ID NO: 3964337 - RNA, 18 nt, Staphylococcus aureus subsp. aureus Mu50
uuaucugacauuguugcu

SEQ ID NO: 3964338 - RNA, 17 nt, Staphylococcus aureus subsp. aureus Mu50
uuaucugaccaguauac

SEQ ID NO: 3964339 - RNA, 20 nt, Staphylococcus aureus subsp. aureus Mu50
uuaucuucaguaauuucucc

SEQ ID NO: 3964340 - RNA, 23 nt, Staphylococcus aureus subsp. aureus Mu50
uuaucuucaguaauuucuccaag

SEQ ID NO: 3964341 - RNA, 21 nt, Staphylococcus aureus subsp. aureus Mu50
uuaucuugcuuauugauauaa

SEQ ID NO: 3964342 - RNA, 13 nt, Staphylococcus aureus subsp. aureus Mu50
uuaucuuuaagua

SEQ ID NO: 3964343 - RNA, 16 nt, Staphylococcus aureus subsp. aureus Mu50
uuaucuuuaauuuaca

SEQ ID NO: 3964344 - RNA, 17 nt, Staphylococcus aureus subsp. aureus Mu50
uuaucuuuagagacuua

SEQ ID NO: 3964345 - RNA, 14 nt, Staphylococcus aureus subsp. aureus Mu50
uuaucuuuuaaaau

SEQ ID NO: 3964346 - RNA, 23 nt, Staphylococcus aureus subsp. aureus Mu50
uuaucuuuuaaaaucguugcaga

SEQ ID NO: 3964347 - RNA, 13 nt, Staphylococcus aureus subsp. aureus Mu50
uuaugaaaaguaa

SEQ ID NO: 3964348 - RNA, 15 nt, Staphylococcus aureus subsp. aureus Mu50
uuaugaaucauuuua

SEQ ID NO: 3964349 - RNA, 15 nt, Staphylococcus aureus subsp. aureus Mu50
uuaugaauugaguau

SEQ ID NO: 3964350 - RNA, 22 nt, Staphylococcus aureus subsp. aureus Mu50
uuaugaauugaguauuaaauuu

SEQ ID NO: 3964351 - RNA, 20 nt, Staphylococcus aureus subsp. aureus Mu50
uuaugacaaaguucugcaau

SEQ ID NO: 3964352 - RNA, 19 nt, Staphylococcus aureus subsp. aureus Mu50
uuaugacuaacauugguac

SEQ ID NO: 3964353 - RNA, 23 nt, Staphylococcus aureus subsp. aureus Mu50
uuaugagacccaccguuaaaaua

SEQ ID NO: 3964354 - RNA, 15 nt, Staphylococcus aureus subsp. aureus Mu50
uuaugagcuuaauaa

SEQ ID NO: 3964355 - RNA, 17 nt, Staphylococcus aureus subsp. aureus Mu50
uuaugagcuucuuuaaa

SEQ ID NO: 3964356 - RNA, 18 nt, Staphylococcus aureus subsp. aureus Mu50
uuaugagcuucuuuaaau

SEQ ID NO: 3964357 - RNA, 14 nt, Staphylococcus aureus subsp. aureus Mu50
uuaugaggcugagu

SEQ ID NO: 3964358 - RNA, 20 nt, Staphylococcus aureus subsp. aureus Mu50
uuaugauacugauauuuaga

SEQ ID NO: 3964359 - RNA, 21 nt, Staphylococcus aureus subsp. aureus Mu50
uuaugauauacgagcuuugcu

SEQ ID NO: 3964360 - RNA, 14 nt, Staphylococcus aureus subsp. aureus Mu50
uuaugauuauauuu

SEQ ID NO: 3964361 - RNA, 16 nt, Staphylococcus aureus subsp. aureus Mu50
uuaugcacuuuuuuua

SEQ ID NO: 3964362 - RNA, 21 nt, Staphylococcus aureus subsp. aureus Mu50
uuaugcauauguaauacaaaa

SEQ ID NO: 3964363 - RNA, 21 nt, Staphylococcus aureus subsp. aureus Mu50
uuaugcaugcgcaaaagcgca

SEQ ID NO: 3964364 - RNA, 18 nt, Staphylococcus aureus subsp. aureus Mu50
uuaugccauucauuaagc

SEQ ID NO: 3964365 - RNA, 16 nt, Staphylococcus aureus subsp. aureus Mu50
uuaugcuagaaaguaa

SEQ ID NO: 3964366 - RNA, 13 nt, Staphylococcus aureus subsp. aureus Mu50
uuaugcuauuuug

SEQ ID NO: 3964367 - RNA, 14 nt, Staphylococcus aureus subsp. aureus Mu50
uuaugcuuuaaauc

SEQ ID NO: 3964368 - RNA, 22 nt, Staphylococcus aureus subsp. aureus Mu50
uuauggcagauccauaaggauu

SEQ ID NO: 3964369 - RNA, 17 nt, Staphylococcus aureus subsp. aureus Mu50
uuaugggguguauuuuu

SEQ ID NO: 3964370 - RNA, 15 nt, Staphylococcus aureus subsp. aureus Mu50
uuaugguuuaauuua

SEQ ID NO: 3964371 - RNA, 14 nt, Staphylococcus aureus subsp. aureus Mu50
uuauguaaaaaaua

SEQ ID NO: 3964372 - RNA, 20 nt, Staphylococcus aureus subsp. aureus Mu50
uuauguaucuauacaacagu

SEQ ID NO: 3964373 - RNA, 19 nt, Staphylococcus aureus subsp. aureus Mu50
uuauguauuuuuauuuaua

SEQ ID NO: 3964374 - RNA, 23 nt, Staphylococcus aureus subsp. aureus Mu50
uuauguauuuuuauuuauacuaa

SEQ ID NO: 3964375 - RNA, 15 nt, Staphylococcus aureus subsp. aureus Mu50
uuaugucccaaugcu

SEQ ID NO: 3964376 - RNA, 23 nt, Staphylococcus aureus subsp. aureus Mu50
uuaugucuuaggcgcuacaaugu

SEQ ID NO: 3964377 - RNA, 12 nt, Staphylococcus aureus subsp. aureus Mu50
uuaugugcauca

SEQ ID NO: 3964378 - RNA, 18 nt, Staphylococcus aureus subsp. aureus Mu50
uuaugugcuaaucuauuu

SEQ ID NO: 3964379 - RNA, 20 nt, Staphylococcus aureus subsp. aureus Mu50
uuauguguuguguaucaguu

SEQ ID NO: 3964380 - RNA, 14 nt, Staphylococcus aureus subsp. aureus Mu50
uuauguuauaaauu

SEQ ID NO: 3964381 - RNA, 20 nt, Staphylococcus aureus subsp. aureus Mu50
uuauguuauaaauucuaucu

SEQ ID NO: 3964382 - RNA, 13 nt, Staphylococcus aureus subsp. aureus Mu50
uuauguuuaauuu

SEQ ID NO: 3964383 - RNA, 23 nt, Staphylococcus aureus subsp. aureus Mu50
uuauguuuaauuugauuaaauuc

SEQ ID NO: 3964384 - RNA, 13 nt, Staphylococcus aureus subsp. aureus Mu50
uuauguuuaucua

SEQ ID NO: 3964385 - RNA, 21 nt, Staphylococcus aureus subsp. aureus Mu50
uuauguuuuuaacagcuuuuu

SEQ ID NO: 3964386 - RNA, 21 nt, Staphylococcus aureus subsp. aureus Mu50
uuauuaaaauuaaauaaugau

SEQ ID NO: 3964387 - RNA, 12 nt, Staphylococcus aureus subsp. aureus Mu50
uuauuaaaucag

SEQ ID NO: 3964388 - RNA, 13 nt, Staphylococcus aureus subsp. aureus Mu50
uuauuaaaucuuu

SEQ ID NO: 3964389 - RNA, 21 nt, Staphylococcus aureus subsp. aureus Mu50
uuauuaagccaucccaacuua

SEQ ID NO: 3964390 - RNA, 23 nt, Staphylococcus aureus subsp. aureus Mu50
uuauuaauaaauucucuuggaua

SEQ ID NO: 3964391 - RNA, 22 nt, Staphylococcus aureus subsp. aureus Mu50
uuauuaauggcaacuaagauga

SEQ ID NO: 3964392 - RNA, 22 nt, Staphylococcus aureus subsp. aureus Mu50
uuauuaauuaaaaaauuccuag

SEQ ID NO: 3964393 - RNA, 22 nt, Staphylococcus aureus subsp. aureus Mu50
uuauuacaaacauuccucuauu

SEQ ID NO: 3964394 - RNA, 21 nt, Staphylococcus aureus subsp. aureus Mu50
uuauuaccauaacuuuauaua

SEQ ID NO: 3964395 - RNA, 15 nt, Staphylococcus aureus subsp. aureus Mu50
uuauuagaaugaaac

SEQ ID NO: 3964396 - RNA, 23 nt, Staphylococcus aureus subsp. aureus Mu50
uuauuaggggagauuagagaaga

SEQ ID NO: 3964397 - RNA, 15 nt, Staphylococcus aureus subsp. aureus Mu50
uuauuaguauucaaa

SEQ ID NO: 3964398 - RNA, 21 nt, Staphylococcus aureus subsp. aureus Mu50
uuauuaguauucaaaaaauau

SEQ ID NO: 3964399 - RNA, 14 nt, Staphylococcus aureus subsp. aureus Mu50
uuauuauaaaauaa

SEQ ID NO: 3964400 - RNA, 14 nt, Staphylococcus aureus subsp. aureus Mu50
uuauuauaauagcu

SEQ ID NO: 3964401 - RNA, 15 nt, Staphylococcus aureus subsp. aureus Mu50
uuauuauaauagcuu

SEQ ID NO: 3964402 - RNA, 12 nt, Staphylococcus aureus subsp. aureus Mu50
uuauuauacaua

SEQ ID NO: 3964403 - RNA, 14 nt, Staphylococcus aureus subsp. aureus Mu50
uuauuauauaauaa

SEQ ID NO: 3964404 - RNA, 23 nt, Staphylococcus aureus subsp. aureus Mu50
uuauuaucaaagaaauguaugau

SEQ ID NO: 3964405 - RNA, 22 nt, Staphylococcus aureus subsp. aureus Mu50
uuauuaucagcccaaucaguuu

SEQ ID NO: 3964406 - RNA, 11 nt, Staphylococcus aureus subsp. aureus Mu50
uuauuaucauu

SEQ ID NO: 3964407 - RNA, 15 nt, Staphylococcus aureus subsp. aureus Mu50
uuauuaucuuuguaa

SEQ ID NO: 3964408 - RNA, 19 nt, Staphylococcus aureus subsp. aureus Mu50
uuauuaucuuuguaaauuu

SEQ ID NO: 3964409 - RNA, 14 nt, Staphylococcus aureus subsp. aureus Mu50
uuauuaugaauuau

SEQ ID NO: 3964410 - RNA, 16 nt, Staphylococcus aureus subsp. aureus Mu50
uuauuaugaauuauua

SEQ ID NO: 3964411 - RNA, 20 nt, Staphylococcus aureus subsp. aureus Mu50
uuauuaugaauuauuaauaa

SEQ ID NO: 3964412 - RNA, 15 nt, Staphylococcus aureus subsp. aureus Mu50
uuauuauuaaauuau

SEQ ID NO: 3964413 - RNA, 20 nt, Staphylococcus aureus subsp. aureus Mu50
uuauuauuacaaugaaaaaa

SEQ ID NO: 3964414 - RNA, 22 nt, Staphylococcus aureus subsp. aureus Mu50
uuauuauugucaucauguucua

SEQ ID NO: 3964415 - RNA, 16 nt, Staphylococcus aureus subsp. aureus Mu50
uuauuauuuuguauuu

SEQ ID NO: 3964416 - RNA, 17 nt, Staphylococcus aureus subsp. aureus Mu50
uuauucaauugauuaca

SEQ ID NO: 3964417 - RNA, 17 nt, Staphylococcus aureus subsp. aureus Mu50
uucaaccaucucuuucu

SEQ ID NO: 3964418 - RNA, 22 nt, Staphylococcus aureus subsp. aureus Mu50
uucaacgcauauucuauuguug

SEQ ID NO: 3964419 - RNA, 15 nt, Staphylococcus aureus subsp. aureus Mu50
uucaacuaauuuaaa

SEQ ID NO: 3964420 - RNA, 15 nt, Staphylococcus aureus subsp. aureus Mu50
uucaacuacuucauc

SEQ ID NO: 3964421 - RNA, 20 nt, Staphylococcus aureus subsp. aureus Mu50
uucaacucaggcuuaauuaa

SEQ ID NO: 3964422 - RNA, 18 nt, Staphylococcus aureus subsp. aureus Mu50
uucaacuuguuuccuaca

SEQ ID NO: 3964423 - RNA, 14 nt, Staphylococcus aureus subsp. aureus Mu50
uucaacuuuaauca

SEQ ID NO: 3964424 - RNA, 19 nt, Staphylococcus aureus subsp. aureus Mu50
uucaacuuuaaucaaaaaa

SEQ ID NO: 3964425 - RNA, 16 nt, Staphylococcus aureus subsp. aureus Mu50
uucaacuuuuuaauaa

SEQ ID NO: 3964426 - RNA, 16 nt, Staphylococcus aureus subsp. aureus Mu50
uucaagagaaccaccu

SEQ ID NO: 3964427 - RNA, 17 nt, Staphylococcus aureus subsp. aureus Mu50
uucaagagguuuuauuu

SEQ ID NO: 3964428 - RNA, 21 nt, Staphylococcus aureus subsp. aureus Mu50
uucaagcguuucuugaucuaa

SEQ ID NO: 3964429 - RNA, 14 nt, Staphylococcus aureus subsp. aureus Mu50
uucaagcuuaauaa

SEQ ID NO: 3964430 - RNA, 21 nt, Staphylococcus aureus subsp. aureus Mu50
uucaaguaauggauugauaau

SEQ ID NO: 3964431 - RNA, 13 nt, Staphylococcus aureus subsp. aureus Mu50
uucaaguuuaaaa

SEQ ID NO: 3964432 - RNA, 14 nt, Staphylococcus aureus subsp. aureus Mu50
uucaaguuuaaaau

SEQ ID NO: 3964433 - RNA, 15 nt, Staphylococcus aureus subsp. aureus Mu50
uucaauaaauaaaca

SEQ ID NO: 3964434 - RNA, 16 nt, Staphylococcus aureus subsp. aureus Mu50
uucaauaaauuuuaua

SEQ ID NO: 3964435 - RNA, 16 nt, Staphylococcus aureus subsp. aureus Mu50
uucaauaacaaugcag

SEQ ID NO: 3964436 - RNA, 16 nt, Staphylococcus aureus subsp. aureus Mu50
uucaauaaucuuaggu

SEQ ID NO: 3964437 - RNA, 17 nt, Staphylococcus aureus subsp. aureus Mu50
uucaauaaucuuaggug

SEQ ID NO: 3964438 - RNA, 23 nt, Staphylococcus aureus subsp. aureus Mu50
uucaauacuucuuguucgauaau

SEQ ID NO: 3964439 - RNA, 16 nt, Staphylococcus aureus subsp. aureus Mu50
uucaauacuugaaaga

SEQ ID NO: 3964440 - RNA, 15 nt, Staphylococcus aureus subsp. aureus Mu50
uucaauauuaaaaua

SEQ ID NO: 3964441 - RNA, 12 nt, Staphylococcus aureus subsp. aureus Mu50
uucaauauuuga

SEQ ID NO: 3964442 - RNA, 12 nt, Staphylococcus aureus subsp. aureus Mu50
uucaaucauuca

SEQ ID NO: 3964443 - RNA, 22 nt, Staphylococcus aureus subsp. aureus Mu50
uucaauccaagcaaucuuagua

SEQ ID NO: 3964444 - RNA, 13 nt, Staphylococcus aureus subsp. aureus Mu50
uucaaucgucaca

SEQ ID NO: 3964445 - RNA, 16 nt, Staphylococcus aureus subsp. aureus Mu50
uucaaucgucacauca

SEQ ID NO: 3964446 - RNA, 16 nt, Staphylococcus aureus subsp. aureus Mu50
uucaaugaauucauuu

SEQ ID NO: 3964447 - RNA, 19 nt, Staphylococcus aureus subsp. aureus Mu50
uucaaugagaagcugucuu

SEQ ID NO: 3964448 - RNA, 15 nt, Staphylococcus aureus subsp. aureus Mu50
uucaaugauuuuaua

SEQ ID NO: 3964449 - RNA, 19 nt, Staphylococcus aureus subsp. aureus Mu50
uucaaugauuuuuaaaaau

SEQ ID NO: 3964450 - RNA, 18 nt, Staphylococcus aureus subsp. aureus Mu50
uucaaugucuacuuugaa

SEQ ID NO: 3964451 - RNA, 16 nt, Staphylococcus aureus subsp. aureus Mu50
uucaauguucaauuca

SEQ ID NO: 3964452 - RNA, 18 nt, Staphylococcus aureus subsp. aureus Mu50
uucaauguuuaauuuucu

SEQ ID NO: 3964453 - RNA, 13 nt, Staphylococcus aureus subsp. aureus Mu50
uucaauuagaaaa

SEQ ID NO: 3964454 - RNA, 19 nt, Staphylococcus aureus subsp. aureus Mu50
uucaauucgcauuaaauaa

SEQ ID NO: 3964455 - RNA, 15 nt, Staphylococcus aureus subsp. aureus Mu50
uucaauucuuacacc

SEQ ID NO: 3964456 - RNA, 23 nt, Staphylococcus aureus subsp. aureus Mu50
uucaauugacauuaaugauagca

SEQ ID NO: 3964457 - RNA, 13 nt, Staphylococcus aureus subsp. aureus Mu50
uucaauugauuac

SEQ ID NO: 3964458 - RNA, 19 nt, Staphylococcus aureus subsp. aureus Mu50
uucaauugucucaauaaug

SEQ ID NO: 3964459 - RNA, 22 nt, Staphylococcus aureus subsp. aureus Mu50
uucaauuuaugguaaaacccag

SEQ ID NO: 3964460 - RNA, 18 nt, Staphylococcus aureus subsp. aureus Mu50
uucacacagcuucauuaa

SEQ ID NO: 3964461 - RNA, 17 nt, Staphylococcus aureus subsp. aureus Mu50
uucacauucuugaauaa

SEQ ID NO: 3964462 - RNA, 13 nt, Staphylococcus aureus subsp. aureus Mu50
uucacauuuaucc

SEQ ID NO: 3964463 - RNA, 18 nt, Staphylococcus aureus subsp. aureus Mu50
uucacauuuauccuuuaa

SEQ ID NO: 3964464 - RNA, 15 nt, Staphylococcus aureus subsp. aureus Mu50
uucaccaacuuuuuu

SEQ ID NO: 3964465 - RNA, 14 nt, Staphylococcus aureus subsp. aureus Mu50
uucaccauuuacuu

SEQ ID NO: 3964466 - RNA, 20 nt, Staphylococcus aureus subsp. aureus Mu50
uucaccauuucguguuccaa

SEQ ID NO: 3964467 - RNA, 14 nt, Staphylococcus aureus subsp. aureus Mu50
uucaccguaaucuu

SEQ ID NO: 3964468 - RNA, 21 nt, Staphylococcus aureus subsp. aureus Mu50
uucacgaauaucuuaaagaau

SEQ ID NO: 3964469 - RNA, 17 nt, Staphylococcus aureus subsp. aureus Mu50
uucacgauauaacauua

SEQ ID NO: 3964470 - RNA, 23 nt, Staphylococcus aureus subsp. aureus Mu50
uucacgauauaacauuaaaauga

SEQ ID NO: 3964471 - RNA, 13 nt, Staphylococcus aureus subsp. aureus Mu50
uucacgauuucuu

SEQ ID NO: 3964472 - RNA, 24 nt, Staphylococcus aureus subsp. aureus Mu50
uucacgauuucuuuaugauaauaa

SEQ ID NO: 3964473 - RNA, 21 nt, Staphylococcus aureus subsp. aureus Mu50
uucacgauuuuuaaaaugcuu

SEQ ID NO: 3964474 - RNA, 16 nt, Staphylococcus aureus subsp. aureus Mu50
uucacgcugaaauuuu

SEQ ID NO: 3964475 - RNA, 14 nt, Staphylococcus aureus subsp. aureus Mu50
uucacguuaucaua

SEQ ID NO: 3964476 - RNA, 16 nt, Staphylococcus aureus subsp. aureus Mu50
uucacuaaaaauauau

SEQ ID NO: 3964477 - RNA, 20 nt, Staphylococcus aureus subsp. aureus Mu50
uucacuaaaaauauauuuca

SEQ ID NO: 3964478 - RNA, 20 nt, Staphylococcus aureus subsp. aureus Mu50
uucacuaaauucaauaaucu

SEQ ID NO: 3964479 - RNA, 23 nt, Staphylococcus aureus subsp. aureus Mu50
uucacuaauauuucuuagauacu

SEQ ID NO: 3964480 - RNA, 19 nt, Staphylococcus aureus subsp. aureus Mu50
uucacuguauaaggaugua

SEQ ID NO: 3964481 - RNA, 12 nt, Staphylococcus aureus subsp. aureus Mu50
uucacuguuuua

SEQ ID NO: 3964482 - RNA, 23 nt, Staphylococcus aureus subsp. aureus Mu50
uucacuucgccaagccaucuuuc

SEQ ID NO: 3964483 - RNA, 14 nt, Staphylococcus aureus subsp. aureus Mu50
uucacuuuaacuuc

SEQ ID NO: 3964484 - RNA, 19 nt, Staphylococcus aureus subsp. aureus Mu50
uucacuuuaacuucuuuug

SEQ ID NO: 3964485 - RNA, 17 nt, Staphylococcus aureus subsp. aureus Mu50
uucagaaacuuuugaaa

SEQ ID NO: 3964486 - RNA, 13 nt, Staphylococcus aureus subsp. aureus Mu50
uucagaaaugaca

SEQ ID NO: 3964487 - RNA, 20 nt, Staphylococcus aureus subsp. aureus Mu50
uucagaaaugacaucaucua

SEQ ID NO: 3964488 - RNA, 19 nt, Staphylococcus aureus subsp. aureus Mu50
uucagaacuaugaauagau

SEQ ID NO: 3964489 - RNA, 14 nt, Staphylococcus aureus subsp. aureus Mu50
uucagaugaauaau

SEQ ID NO: 3964490 - RNA, 19 nt, Staphylococcus aureus subsp. aureus Mu50
uucagcauugggacauaaa

SEQ ID NO: 3964491 - RNA, 15 nt, Staphylococcus aureus subsp. aureus Mu50
uucagcauuugcugu

SEQ ID NO: 3964492 - RNA, 14 nt, Staphylococcus aureus subsp. aureus Mu50
uucagcuaauuguc

SEQ ID NO: 3964493 - RNA, 21 nt, Staphylococcus aureus subsp. aureus Mu50
uucagcugcaauuuuagccaa

SEQ ID NO: 3964494 - RNA, 19 nt, Staphylococcus aureus subsp. aureus Mu50
uucagcuucuaaguaauau

SEQ ID NO: 3964495 - RNA, 19 nt, Staphylococcus aureus subsp. aureus Mu50
uucaggaauuguuaaauga

SEQ ID NO: 3964496 - RNA, 16 nt, Staphylococcus aureus subsp. aureus Mu50
uucagggucaacauca

SEQ ID NO: 3964497 - RNA, 19 nt, Staphylococcus aureus subsp. aureus Mu50
uucagguuuuaugaauuga

SEQ ID NO: 3964498 - RNA, 21 nt, Staphylococcus aureus subsp. aureus Mu50
uucagguuuuaugaauugagu

SEQ ID NO: 3964499 - RNA, 21 nt, Staphylococcus aureus subsp. aureus Mu50
uucaguaacguacuguguaau

SEQ ID NO: 3964500 - RNA, 17 nt, Staphylococcus aureus subsp. aureus Mu50
uucaguacgaacaacua

SEQ ID NO: 3964501 - RNA, 19 nt, Staphylococcus aureus subsp. aureus Mu50
uucaguaggacauauaaau

SEQ ID NO: 3964502 - RNA, 15 nt, Staphylococcus aureus subsp. aureus Mu50
uucaguauacucauc

SEQ ID NO: 3964503 - RNA, 22 nt, Staphylococcus aureus subsp. aureus Mu50
uucaguauagacuauaggucuu

SEQ ID NO: 3964504 - RNA, 14 nt, Staphylococcus aureus subsp. aureus Mu50
uucaguuaaaccuu

SEQ ID NO: 3964505 - RNA, 13 nt, Staphylococcus aureus subsp. aureus Mu50
uucaguuaaauca

SEQ ID NO: 3964506 - RNA, 17 nt, Staphylococcus aureus subsp. aureus Mu50
uucaguucaaacagaaa

SEQ ID NO: 3964507 - RNA, 13 nt, Staphylococcus aureus subsp. aureus Mu50
uucaguuguuuuu

SEQ ID NO: 3964508 - RNA, 14 nt, Staphylococcus aureus subsp. aureus Mu50
uucauaaaauuuaa

SEQ ID NO: 3964509 - RNA, 20 nt, Staphylococcus aureus subsp. aureus Mu50
uucauaaaauuuaaaacaau

SEQ ID NO: 3964510 - RNA, 16 nt, Staphylococcus aureus subsp. aureus Mu50
uucauaaacucuuaca

SEQ ID NO: 3964511 - RNA, 13 nt, Staphylococcus aureus subsp. aureus Mu50
uucauaaacugaa

SEQ ID NO: 3964512 - RNA, 18 nt, Staphylococcus aureus subsp. aureus Mu50
uucauaaaugacugaauu

SEQ ID NO: 3964513 - RNA, 20 nt, Staphylococcus aureus subsp. aureus Mu50
uucauaaaugacugaauuaa

SEQ ID NO: 3964514 - RNA, 22 nt, Staphylococcus aureus subsp. aureus Mu50
uucauaagucuuaacaaauuaa

SEQ ID NO: 3964515 - RNA, 14 nt, Staphylococcus aureus subsp. aureus Mu50
uucauaaucauaau

SEQ ID NO: 3964516 - RNA, 13 nt, Staphylococcus aureus subsp. aureus Mu50
uucauaauuaaca

SEQ ID NO: 3964517 - RNA, 14 nt, Staphylococcus aureus subsp. aureus Mu50
uucauaauuaauaa

SEQ ID NO: 3964518 - RNA, 21 nt, Staphylococcus aureus subsp. aureus Mu50
uucauacacuaucauuaucaa

SEQ ID NO: 3964519 - RNA, 19 nt, Staphylococcus aureus subsp. aureus Mu50
uucauacgcucaaucgcau

SEQ ID NO: 3964520 - RNA, 18 nt, Staphylococcus aureus subsp. aureus Mu50
uucauagaugcauaaaaa

SEQ ID NO: 3964521 - RNA, 17 nt, Staphylococcus aureus subsp. aureus Mu50
uucauagugguguuuau

SEQ ID NO: 3964522 - RNA, 23 nt, Staphylococcus aureus subsp. aureus Mu50
uucauagugguguuuauaucuuu

SEQ ID NO: 3964523 - RNA, 18 nt, Staphylococcus aureus subsp. aureus Mu50
uucauaguguuuguaaug

SEQ ID NO: 3964524 - RNA, 20 nt, Staphylococcus aureus subsp. aureus Mu50
uucauaguuaucgauuuuau

SEQ ID NO: 3964525 - RNA, 14 nt, Staphylococcus aureus subsp. aureus Mu50
uucauaguuuaugu

SEQ ID NO: 3964526 - RNA, 20 nt, Staphylococcus aureus subsp. aureus Mu50
uucauauauuuuguuaauaa

SEQ ID NO: 3964527 - RNA, 16 nt, Staphylococcus aureus subsp. aureus Mu50
uucauauggugaacug

SEQ ID NO: 3964528 - RNA, 22 nt, Staphylococcus aureus subsp. aureus Mu50
uucauauuuagguaauacauca

SEQ ID NO: 3964529 - RNA, 15 nt, Staphylococcus aureus subsp. aureus Mu50
uucaucaaacaacau

SEQ ID NO: 3964530 - RNA, 16 nt, Staphylococcus aureus subsp. aureus Mu50
uucaucaaguugauaa

SEQ ID NO: 3964531 - RNA, 20 nt, Staphylococcus aureus subsp. aureus Mu50
uucaucaauaaauauugauu

SEQ ID NO: 3964532 - RNA, 12 nt, Staphylococcus aureus subsp. aureus Mu50
uucaucaauaac

SEQ ID NO: 3964533 - RNA, 12 nt, Staphylococcus aureus subsp. aureus Mu50
uucaucaauaau

SEQ ID NO: 3964534 - RNA, 19 nt, Staphylococcus aureus subsp. aureus Mu50
uucaucaguaccaaagaaa

SEQ ID NO: 3964535 - RNA, 19 nt, Staphylococcus aureus subsp. aureus Mu50
uucaucauaaucugcugcu

SEQ ID NO: 3964536 - RNA, 14 nt, Staphylococcus aureus subsp. aureus Mu50
uucaucauaauuga

SEQ ID NO: 3964537 - RNA, 14 nt, Staphylococcus aureus subsp. aureus Mu50
uucaucauuaaaau

SEQ ID NO: 3964538 - RNA, 18 nt, Staphylococcus aureus subsp. aureus Mu50
uucaucguucauauauuu

SEQ ID NO: 3964539 - RNA, 15 nt, Staphylococcus aureus subsp. aureus Mu50
uucaucuaaaaugag

SEQ ID NO: 3964540 - RNA, 17 nt, Staphylococcus aureus subsp. aureus Mu50
uucaucugacugauuuu

SEQ ID NO: 3964541 - RNA, 12 nt, Staphylococcus aureus subsp. aureus Mu50
uucaucuucaaa

SEQ ID NO: 3964542 - RNA, 16 nt, Staphylococcus aureus subsp. aureus Mu50
uucaucuucuucaaaa

SEQ ID NO: 3964543 - RNA, 12 nt, Staphylococcus aureus subsp. aureus Mu50
uucaucuuucaa

SEQ ID NO: 3964544 - RNA, 15 nt, Staphylococcus aureus subsp. aureus Mu50
uucaugaaaaguuga

SEQ ID NO: 3964545 - RNA, 14 nt, Staphylococcus aureus subsp. aureus Mu50
uucaugaacagcau

SEQ ID NO: 3964546 - RNA, 21 nt, Staphylococcus aureus subsp. aureus Mu50
uucaugaauaaauacaauguu

SEQ ID NO: 3964547 - RNA, 13 nt, Staphylococcus aureus subsp. aureus Mu50
uucaugaauaauu

SEQ ID NO: 3964548 - RNA, 14 nt, Staphylococcus aureus subsp. aureus Mu50
uucaugaauaauua

SEQ ID NO: 3964549 - RNA, 15 nt, Staphylococcus aureus subsp. aureus Mu50
uucaugauuuacuaa

SEQ ID NO: 3964550 - RNA, 16 nt, Staphylococcus aureus subsp. aureus Mu50
uucauggccaaauguu

SEQ ID NO: 3964551 - RNA, 15 nt, Staphylococcus aureus subsp. aureus Mu50
uucauguaaauaguu

SEQ ID NO: 3964552 - RNA, 16 nt, Staphylococcus aureus subsp. aureus Mu50
uucauguaugaaguaa

SEQ ID NO: 3964553 - RNA, 15 nt, Staphylococcus aureus subsp. aureus Mu50
uucauguccaucuuu

SEQ ID NO: 3964554 - RNA, 17 nt, Staphylococcus aureus subsp. aureus Mu50
uucaugugucacaauga

SEQ ID NO: 3964555 - RNA, 14 nt, Staphylococcus aureus subsp. aureus Mu50
uucauguucauaau

SEQ ID NO: 3964556 - RNA, 15 nt, Staphylococcus aureus subsp. aureus Mu50
uucauguucauaaua

SEQ ID NO: 3964557 - RNA, 15 nt, Staphylococcus aureus subsp. aureus Mu50
uucauuacaaacuug

SEQ ID NO: 3964558 - RNA, 18 nt, Staphylococcus aureus subsp. aureus Mu50
uucauuagccaaaucuuu

SEQ ID NO: 3964559 - RNA, 16 nt, Staphylococcus aureus subsp. aureus Mu50
uucauuauauaauucu

SEQ ID NO: 3964560 - RNA, 21 nt, Staphylococcus aureus subsp. aureus Mu50
uucauuauauaauucuucaaa

SEQ ID NO: 3964561 - RNA, 14 nt, Staphylococcus aureus subsp. aureus Mu50
uucauuauaugguu

SEQ ID NO: 3964562 - RNA, 12 nt, Staphylococcus aureus subsp. aureus Mu50
uucauuaucauu

SEQ ID NO: 3964563 - RNA, 14 nt, Staphylococcus aureus subsp. aureus Mu50
uucauuaucauuaa

SEQ ID NO: 3964564 - RNA, 16 nt, Staphylococcus aureus subsp. aureus Mu50
uucauuauuuaaauaa

SEQ ID NO: 3964565 - RNA, 17 nt, Staphylococcus aureus subsp. aureus Mu50
uucauucguacuuccaa

SEQ ID NO: 3964566 - RNA, 23 nt, Staphylococcus aureus subsp. aureus Mu50
uucauucguacuuccaauacugu

SEQ ID NO: 3964567 - RNA, 13 nt, Staphylococcus aureus subsp. aureus Mu50
uucauugcuuggu

SEQ ID NO: 3964568 - RNA, 20 nt, Staphylococcus aureus subsp. aureus Mu50
uucauuggauagguaacuaa

SEQ ID NO: 3964569 - RNA, 14 nt, Staphylococcus aureus subsp. aureus Mu50
uucauuguaaauuu

SEQ ID NO: 3964570 - RNA, 14 nt, Staphylococcus aureus subsp. aureus Mu50
uucauuguaacuca

SEQ ID NO: 3964571 - RNA, 12 nt, Staphylococcus aureus subsp. aureus Mu50
uucauuuaacau

SEQ ID NO: 3964572 - RNA, 17 nt, Staphylococcus aureus subsp. aureus Mu50
uucauuuaguuaaauac

SEQ ID NO: 3964573 - RNA, 18 nt, Staphylococcus aureus subsp. aureus Mu50
uucauuucccuuaaauca

SEQ ID NO: 3964574 - RNA, 16 nt, Staphylococcus aureus subsp. aureus Mu50
uucauuugaaauaguu

SEQ ID NO: 3964575 - RNA, 19 nt, Staphylococcus aureus subsp. aureus Mu50
uucauuuguauuaauuuga

SEQ ID NO: 3964576 - RNA, 19 nt, Staphylococcus aureus subsp. aureus Mu50
uucauuuuagcaaaagcuu

SEQ ID NO: 3964577 - RNA, 14 nt, Staphylococcus aureus subsp. aureus Mu50
uucauuuuauaaau

SEQ ID NO: 3964578 - RNA, 17 nt, Staphylococcus aureus subsp. aureus Mu50
uucauuuucaaauaacu

SEQ ID NO: 3964579 - RNA, 14 nt, Staphylococcus aureus subsp. aureus Mu50
uucauuuuugauaa

SEQ ID NO: 3964580 - RNA, 16 nt, Staphylococcus aureus subsp. aureus Mu50
uuccaaaaauuguaaa

SEQ ID NO: 3964581 - RNA, 18 nt, Staphylococcus aureus subsp. aureus Mu50
uuccaaagaaagcuaaua

SEQ ID NO: 3964582 - RNA, 18 nt, Staphylococcus aureus subsp. aureus Mu50
uuccaaauugcaaaguaa

SEQ ID NO: 3964583 - RNA, 16 nt, Staphylococcus aureus subsp. aureus Mu50
uuccaacaacuaagau

SEQ ID NO: 3964584 - RNA, 19 nt, Staphylococcus aureus subsp. aureus Mu50
uuccaagagaauuaauaau

SEQ ID NO: 3964585 - RNA, 15 nt, Staphylococcus aureus subsp. aureus Mu50
uuccaagcaucauug

SEQ ID NO: 3964586 - RNA, 19 nt, Staphylococcus aureus subsp. aureus Mu50
uuccaauaauaaaccuaaa

SEQ ID NO: 3964587 - RNA, 23 nt, Staphylococcus aureus subsp. aureus Mu50
uuccaauaauaaaccuaaagaua

SEQ ID NO: 3964588 - RNA, 14 nt, Staphylococcus aureus subsp. aureus Mu50
uuccaauaauaaau

SEQ ID NO: 3964589 - RNA, 13 nt, Staphylococcus aureus subsp. aureus Mu50
uuccaauuuguug

SEQ ID NO: 3964590 - RNA, 23 nt, Staphylococcus aureus subsp. aureus Mu50
uuccacaacaaucacgauuaaug

SEQ ID NO: 3964591 - RNA, 12 nt, Staphylococcus aureus subsp. aureus Mu50
uuccacuucauc

SEQ ID NO: 3964592 - RNA, 19 nt, Staphylococcus aureus subsp. aureus Mu50
uuccacuucaucuaaauga

SEQ ID NO: 3964593 - RNA, 13 nt, Staphylococcus aureus subsp. aureus Mu50
uuccaguaugauu

SEQ ID NO: 3964594 - RNA, 21 nt, Staphylococcus aureus subsp. aureus Mu50
uucuacagcacugaaaucuag

SEQ ID NO: 3964595 - RNA, 19 nt, Staphylococcus aureus subsp. aureus Mu50
uucuacaggcaaugcaagu

SEQ ID NO: 3964596 - RNA, 14 nt, Staphylococcus aureus subsp. aureus Mu50
uucuacagguaaug

SEQ ID NO: 3964597 - RNA, 17 nt, Staphylococcus aureus subsp. aureus Mu50
uucuacagguaaugcaa

SEQ ID NO: 3964598 - RNA, 18 nt, Staphylococcus aureus subsp. aureus Mu50
uucuacagguaaugcaag

SEQ ID NO: 3964599 - RNA, 19 nt, Staphylococcus aureus subsp. aureus Mu50
uucuacagguaaugcaagu

SEQ ID NO: 3964600 - RNA, 20 nt, Staphylococcus aureus subsp. aureus Mu50
uucuacagguaaugcaaguu

SEQ ID NO: 3964601 - RNA, 23 nt, Staphylococcus aureus subsp. aureus Mu50
uucuacaguuggagguccauaau

SEQ ID NO: 3964602 - RNA, 16 nt, Staphylococcus aureus subsp. aureus Mu50
uucuaccaauaauucc

SEQ ID NO: 3964603 - RNA, 17 nt, Staphylococcus aureus subsp. aureus Mu50
uucuaccaguugauuua

SEQ ID NO: 3964604 - RNA, 21 nt, Staphylococcus aureus subsp. aureus Mu50
uucuacccauaauuuaaauga

SEQ ID NO: 3964605 - RNA, 21 nt, Staphylococcus aureus subsp. aureus Mu50
uucuacucuagcggaacguaa

SEQ ID NO: 3964606 - RNA, 16 nt, Staphylococcus aureus subsp. aureus Mu50
uucuagauucauauuu

SEQ ID NO: 3964607 - RNA, 22 nt, Staphylococcus aureus subsp. aureus Mu50
uucuagcaacugaucauuuuca

SEQ ID NO: 3964608 - RNA, 18 nt, Staphylococcus aureus subsp. aureus Mu50
uucuagcaucgauguuau

SEQ ID NO: 3964609 - RNA, 21 nt, Staphylococcus aureus subsp. aureus Mu50
uucuagcaucgauguuaucga

SEQ ID NO: 3964610 - RNA, 12 nt, Staphylococcus aureus subsp. aureus Mu50
uucuagguaaua

SEQ ID NO: 3964611 - RNA, 16 nt, Staphylococcus aureus subsp. aureus Mu50
uucuaguagcuugaau

SEQ ID NO: 3964612 - RNA, 15 nt, Staphylococcus aureus subsp. aureus Mu50
uucuauaauaaaucg

SEQ ID NO: 3964613 - RNA, 18 nt, Staphylococcus aureus subsp. aureus Mu50
uucuauaauauuuaacca

SEQ ID NO: 3964614 - RNA, 23 nt, Staphylococcus aureus subsp. aureus Mu50
uucuauacaaugaauuucuaauu

SEQ ID NO: 3964615 - RNA, 16 nt, Staphylococcus aureus subsp. aureus Mu50
uucuauacauuccaaa

SEQ ID NO: 3964616 - RNA, 13 nt, Staphylococcus aureus subsp. aureus Mu50
uucuauagaaaaa

SEQ ID NO: 3964617 - RNA, 20 nt, Staphylococcus aureus subsp. aureus Mu50
uucuauagcaccauuauuaa

SEQ ID NO: 3964618 - RNA, 17 nt, Staphylococcus aureus subsp. aureus Mu50
uucuauauaguaaaaua

SEQ ID NO: 3964619 - RNA, 16 nt, Staphylococcus aureus subsp. aureus Mu50
uucuaucaaauaauga

SEQ ID NO: 3964620 - RNA, 23 nt, Staphylococcus aureus subsp. aureus Mu50
uucuaucacacgcauacaggaaa

SEQ ID NO: 3964621 - RNA, 15 nt, Staphylococcus aureus subsp. aureus Mu50
uucuaucuauaaacg

SEQ ID NO: 3964622 - RNA, 17 nt, Staphylococcus aureus subsp. aureus Mu50
uucuaugcucuacaaag

SEQ ID NO: 3964623 - RNA, 22 nt, Staphylococcus aureus subsp. aureus Mu50
uucuauguagcaggcaacuuuu

SEQ ID NO: 3964624 - RNA, 12 nt, Staphylococcus aureus subsp. aureus Mu50
uucuauucaaaa

SEQ ID NO: 3964625 - RNA, 13 nt, Staphylococcus aureus subsp. aureus Mu50
uucuauuugauaa

SEQ ID NO: 3964626 - RNA, 16 nt, Staphylococcus aureus subsp. aureus Mu50
uucuauuuucauagau

SEQ ID NO: 3964627 - RNA, 16 nt, Staphylococcus aureus subsp. aureus Mu50
uucucaauuaauuuag

SEQ ID NO: 3964628 - RNA, 17 nt, Staphylococcus aureus subsp. aureus Mu50
uucucaccagcucguuu

SEQ ID NO: 3964629 - RNA, 17 nt, Staphylococcus aureus subsp. aureus Mu50
uucucacugcuguucuu

SEQ ID NO: 3964630 - RNA, 19 nt, Staphylococcus aureus subsp. aureus Mu50
uucucaucuauuuaauaau

SEQ ID NO: 3964631 - RNA, 15 nt, Staphylococcus aureus subsp. aureus Mu50
uucucauuauaauga

SEQ ID NO: 3964632 - RNA, 13 nt, Staphylococcus aureus subsp. aureus Mu50
uucucauugaaau

SEQ ID NO: 3964633 - RNA, 17 nt, Staphylococcus aureus subsp. aureus Mu50
uucuccaacgucauaac

SEQ ID NO: 3964634 - RNA, 22 nt, Staphylococcus aureus subsp. aureus Mu50
uucuccaguuuucaauuuauua

SEQ ID NO: 3964635 - RNA, 13 nt, Staphylococcus aureus subsp. aureus Mu50
uucuccuaauaau

SEQ ID NO: 3964636 - RNA, 12 nt, Staphylococcus aureus subsp. aureus Mu50
uucucguguaaa

SEQ ID NO: 3964637 - RNA, 21 nt, Staphylococcus aureus subsp. aureus Mu50
uucucuaacgauuucuaguuu

SEQ ID NO: 3964638 - RNA, 23 nt, Staphylococcus aureus subsp. aureus Mu50
uucucuauugauuguaccaguaa

SEQ ID NO: 3964639 - RNA, 15 nt, Staphylococcus aureus subsp. aureus Mu50
uucucugcuucuaaa

SEQ ID NO: 3964640 - RNA, 21 nt, Staphylococcus aureus subsp. aureus Mu50
uucucugcuucuaaaacauca

SEQ ID NO: 3964641 - RNA, 19 nt, Staphylococcus aureus subsp. aureus Mu50
uucucuguagauaucaaag

SEQ ID NO: 3964642 - RNA, 20 nt, Staphylococcus aureus subsp. aureus Mu50
uucucuuaaauaugaauaau

SEQ ID NO: 3964643 - RNA, 23 nt, Staphylococcus aureus subsp. aureus Mu50
uucugaaaugauacauuauuaaa

SEQ ID NO: 3964644 - RNA, 12 nt, Staphylococcus aureus subsp. aureus Mu50
uucugacuuuua

SEQ ID NO: 3964645 - RNA, 19 nt, Staphylococcus aureus subsp. aureus Mu50
uucugcaugggcuucugcu

SEQ ID NO: 3964646 - RNA, 10 nt, Staphylococcus aureus subsp. aureus Mu50
uucugcuucu

SEQ ID NO: 3964647 - RNA, 16 nt, Staphylococcus aureus subsp. aureus Mu50
uucugcuuuuucuuua

SEQ ID NO: 3964648 - RNA, 19 nt, Staphylococcus aureus subsp. aureus Mu50
uucuggaauaccuaauuca

SEQ ID NO: 3964649 - RNA, 19 nt, Staphylococcus aureus subsp. aureus Mu50
uucuguacguuuuaaauaa

SEQ ID NO: 3964650 - RNA, 20 nt, Staphylococcus aureus subsp. aureus Mu50
uucuguacguuuuaaauaaa

SEQ ID NO: 3964651 - RNA, 17 nt, Staphylococcus aureus subsp. aureus Mu50
uucuguccaaaaagguu

SEQ ID NO: 3964652 - RNA, 20 nt, Staphylococcus aureus subsp. aureus Mu50
uucugucccacucccuaaua

SEQ ID NO: 3964653 - RNA, 21 nt, Staphylococcus aureus subsp. aureus Mu50
uucugucgcuucuucuucaga

SEQ ID NO: 3964654 - RNA, 23 nt, Staphylococcus aureus subsp. aureus Mu50
uucugucgcuucuucuucagaaa

SEQ ID NO: 3964655 - RNA, 13 nt, Staphylococcus aureus subsp. aureus Mu50
uucugucuguaaa

SEQ ID NO: 3964656 - RNA, 23 nt, Staphylococcus aureus subsp. aureus Mu50
uucuguguuggggcccacacccc

SEQ ID NO: 3964657 - RNA, 11 nt, Staphylococcus aureus subsp. aureus Mu50
uucuuaaaaag

SEQ ID NO: 3964658 - RNA, 17 nt, Staphylococcus aureus subsp. aureus Mu50
uucuuaaaaagcagcag

SEQ ID NO: 3964659 - RNA, 20 nt, Staphylococcus aureus subsp. aureus Mu50
uucuuaaaauaugauuuaaa

SEQ ID NO: 3964660 - RNA, 16 nt, Staphylococcus aureus subsp. aureus Mu50
uucuuaaaucaacauc

SEQ ID NO: 3964661 - RNA, 22 nt, Staphylococcus aureus subsp. aureus Mu50
uucuuaaaucaacaucaucuuu

SEQ ID NO: 3964662 - RNA, 14 nt, Staphylococcus aureus subsp. aureus Mu50
uucuuaacauaaaa

SEQ ID NO: 3964663 - RNA, 18 nt, Staphylococcus aureus subsp. aureus Mu50
uucuuaacauccuuugau

SEQ ID NO: 3964664 - RNA, 20 nt, Staphylococcus aureus subsp. aureus Mu50
uucuuagauuuuauauaaaa

SEQ ID NO: 3964665 - RNA, 19 nt, Staphylococcus aureus subsp. aureus Mu50
uucuuagauuuucacuaau

SEQ ID NO: 3964666 - RNA, 22 nt, Staphylococcus aureus subsp. aureus Mu50
uucuuagauuuucacuaauauu

SEQ ID NO: 3964667 - RNA, 11 nt, Staphylococcus aureus subsp. aureus Mu50
uucuuauaaaa

SEQ ID NO: 3964668 - RNA, 13 nt, Staphylococcus aureus subsp. aureus Mu50
uucuuauaaaaau

SEQ ID NO: 3964669 - RNA, 17 nt, Staphylococcus aureus subsp. aureus Mu50
uucuuaucaacaacaag

SEQ ID NO: 3964670 - RNA, 17 nt, Staphylococcus aureus subsp. aureus Mu50
uucuuaucauuucaaau

SEQ ID NO: 3964671 - RNA, 13 nt, Staphylococcus aureus subsp. aureus Mu50
uucuuauucaaau

SEQ ID NO: 3964672 - RNA, 18 nt, Staphylococcus aureus subsp. aureus Mu50
uucuuauuuauucauaac

SEQ ID NO: 3964673 - RNA, 12 nt, Staphylococcus aureus subsp. aureus Mu50
uucuuauuugaa

SEQ ID NO: 3964674 - RNA, 23 nt, Staphylococcus aureus subsp. aureus Mu50
uucuucaccaguuucugguaaug

SEQ ID NO: 3964675 - RNA, 18 nt, Staphylococcus aureus subsp. aureus Mu50
uucuucacuaaaaauaua

SEQ ID NO: 3964676 - RNA, 18 nt, Staphylococcus aureus subsp. aureus Mu50
uucuucacugcuguuuuu

SEQ ID NO: 3964677 - RNA, 20 nt, Staphylococcus aureus subsp. aureus Mu50
uucuucacugcuguuuuuau

SEQ ID NO: 3964678 - RNA, 16 nt, Staphylococcus aureus subsp. aureus Mu50
uucuucagguguuuua

SEQ ID NO: 3964679 - RNA, 15 nt, Staphylococcus aureus subsp. aureus Mu50
uucuucauaguucaa

SEQ ID NO: 3964680 - RNA, 12 nt, Staphylococcus aureus subsp. aureus Mu50
uucuucaucaug

SEQ ID NO: 3964681 - RNA, 20 nt, Staphylococcus aureus subsp. aureus Mu50
uugaauggcucguuuuuuua

SEQ ID NO: 3964682 - RNA, 17 nt, Staphylococcus aureus subsp. aureus Mu50
uugaaugguauaauucc

SEQ ID NO: 3964683 - RNA, 22 nt, Staphylococcus aureus subsp. aureus Mu50
uugaauuaacaauauuaaauuu

SEQ ID NO: 3964684 - RNA, 21 nt, Staphylococcus aureus subsp. aureus Mu50
uugaauuuaauacuauaguaa

SEQ ID NO: 3964685 - RNA, 20 nt, Staphylococcus aureus subsp. aureus Mu50
uugaauuugaauaagugguu

SEQ ID NO: 3964686 - RNA, 13 nt, Staphylococcus aureus subsp. aureus Mu50
uugaauuuuauua

SEQ ID NO: 3964687 - RNA, 19 nt, Staphylococcus aureus subsp. aureus Mu50
uugacaaguugcugaauaa

SEQ ID NO: 3964688 - RNA, 13 nt, Staphylococcus aureus subsp. aureus Mu50
uugacaauacaaa

SEQ ID NO: 3964689 - RNA, 18 nt, Staphylococcus aureus subsp. aureus Mu50
uugacacauuauugaaau

SEQ ID NO: 3964690 - RNA, 14 nt, Staphylococcus aureus subsp. aureus Mu50
uugacauuugacca

SEQ ID NO: 3964691 - RNA, 15 nt, Staphylococcus aureus subsp. aureus Mu50
uugacauuugaccaa

SEQ ID NO: 3964692 - RNA, 17 nt, Staphylococcus aureus subsp. aureus Mu50
uugacauuugaccaagu

SEQ ID NO: 3964693 - RNA, 16 nt, Staphylococcus aureus subsp. aureus Mu50
uugaccacuuuuguua

SEQ ID NO: 3964694 - RNA, 21 nt, Staphylococcus aureus subsp. aureus Mu50
uugaccgccuaugauauaugu

SEQ ID NO: 3964695 - RNA, 13 nt, Staphylococcus aureus subsp. aureus Mu50
uugaccuucaguu

SEQ ID NO: 3964696 - RNA, 14 nt, Staphylococcus aureus subsp. aureus Mu50
uugacgauuuaauu

SEQ ID NO: 3964697 - RNA, 20 nt, Staphylococcus aureus subsp. aureus Mu50
uugacuaaguuuguuuucuu

SEQ ID NO: 3964698 - RNA, 17 nt, Staphylococcus aureus subsp. aureus Mu50
uugacuuuaauugcucu

SEQ ID NO: 3964699 - RNA, 14 nt, Staphylococcus aureus subsp. aureus Mu50
uugacuuuaucaau

SEQ ID NO: 3964700 - RNA, 14 nt, Staphylococcus aureus subsp. aureus Mu50
uugagaauauuaag

SEQ ID NO: 3964701 - RNA, 22 nt, Staphylococcus aureus subsp. aureus Mu50
uugagaauauuaagauguauau

SEQ ID NO: 3964702 - RNA, 19 nt, Staphylococcus aureus subsp. aureus Mu50
uugagacaaaaauaaacca

SEQ ID NO: 3964703 - RNA, 16 nt, Staphylococcus aureus subsp. aureus Mu50
uugagacguuuuccau

SEQ ID NO: 3964704 - RNA, 22 nt, Staphylococcus aureus subsp. aureus Mu50
uugagauauauuaauguuugau

SEQ ID NO: 3964705 - RNA, 22 nt, Staphylococcus aureus subsp. aureus Mu50
uugagcaauucuugaaaaguuu

SEQ ID NO: 3964706 - RNA, 18 nt, Staphylococcus aureus subsp. aureus Mu50
uugagcaucacucaacau

SEQ ID NO: 3964707 - RNA, 11 nt, Staphylococcus aureus subsp. aureus Mu50
uugaguaauuu

SEQ ID NO: 3964708 - RNA, 13 nt, Staphylococcus aureus subsp. aureus Mu50
uugaguauuaaau

SEQ ID NO: 3964709 - RNA, 14 nt, Staphylococcus aureus subsp. aureus Mu50
uugaguauuaaauu

SEQ ID NO: 3964710 - RNA, 15 nt, Staphylococcus aureus subsp. aureus Mu50
uugagucaauuucuu

SEQ ID NO: 3964711 - RNA, 18 nt, Staphylococcus aureus subsp. aureus Mu50
uugaguugaaaauaaucg

SEQ ID NO: 3964712 - RNA, 19 nt, Staphylococcus aureus subsp. aureus Mu50
uugauaaaaaaugaauguu

SEQ ID NO: 3964713 - RNA, 21 nt, Staphylococcus aureus subsp. aureus Mu50
uugauaaaaaaugaauguuaa

SEQ ID NO: 3964714 - RNA, 13 nt, Staphylococcus aureus subsp. aureus Mu50
uugauaaaacuaa

SEQ ID NO: 3964715 - RNA, 14 nt, Staphylococcus aureus subsp. aureus Mu50
uugauaaaauaaau

SEQ ID NO: 3964716 - RNA, 21 nt, Staphylococcus aureus subsp. aureus Mu50
uugauaaguagaaaauaugac

SEQ ID NO: 3964717 - RNA, 12 nt, Staphylococcus aureus subsp. aureus Mu50
uugauaauagcc

SEQ ID NO: 3964718 - RNA, 23 nt, Staphylococcus aureus subsp. aureus Mu50
uugauaaugcuacuauuaaauaa

SEQ ID NO: 3964719 - RNA, 19 nt, Staphylococcus aureus subsp. aureus Mu50
uugauacguaaacacuuua

SEQ ID NO: 3964720 - RNA, 22 nt, Staphylococcus aureus subsp. aureus Mu50
uugauacguaaacacuuuagua

SEQ ID NO: 3964721 - RNA, 15 nt, Staphylococcus aureus subsp. aureus Mu50
uugauagauagaaau

SEQ ID NO: 3964722 - RNA, 20 nt, Staphylococcus aureus subsp. aureus Mu50
uugauagcaccguaacauau

SEQ ID NO: 3964723 - RNA, 22 nt, Staphylococcus aureus subsp. aureus Mu50
uugauaguaaucucucgcuaaa

SEQ ID NO: 3964724 - RNA, 22 nt, Staphylococcus aureus subsp. aureus Mu50
uugauagugguagccaauauca

SEQ ID NO: 3964725 - RNA, 12 nt, Staphylococcus aureus subsp. aureus Mu50
uugauauaaaaa

SEQ ID NO: 3964726 - RNA, 13 nt, Staphylococcus aureus subsp. aureus Mu50
uugauauaaaaag

SEQ ID NO: 3964727 - RNA, 23 nt, Staphylococcus aureus subsp. aureus Mu50
uugauauaaaaagugaaaguauu

SEQ ID NO: 3964728 - RNA, 21 nt, Staphylococcus aureus subsp. aureus Mu50
uugauauagucaaugaauaau

SEQ ID NO: 3964729 - RNA, 13 nt, Staphylococcus aureus subsp. aureus Mu50
uugauauauauuu

SEQ ID NO: 3964730 - RNA, 18 nt, Staphylococcus aureus subsp. aureus Mu50
uugauauauauuuugcaa

SEQ ID NO: 3964731 - RNA, 13 nt, Staphylococcus aureus subsp. aureus Mu50
uugauaucuacag

SEQ ID NO: 3964732 - RNA, 23 nt, Staphylococcus aureus subsp. aureus Mu50
uugauaucuacagagaaucaauu

SEQ ID NO: 3964733 - RNA, 18 nt, Staphylococcus aureus subsp. aureus Mu50
uugauaugcucucuucaa

SEQ ID NO: 3964734 - RNA, 19 nt, Staphylococcus aureus subsp. aureus Mu50
uugauaugcucucuucaaa

SEQ ID NO: 3964735 - RNA, 19 nt, Staphylococcus aureus subsp. aureus Mu50
uugauaugguuagagaaaa

SEQ ID NO: 3964736 - RNA, 21 nt, Staphylococcus aureus subsp. aureus Mu50
uugauaugguuagagaaaaau

SEQ ID NO: 3964737 - RNA, 11 nt, Staphylococcus aureus subsp. aureus Mu50
uugauauguuu

SEQ ID NO: 3964738 - RNA, 20 nt, Staphylococcus aureus subsp. aureus Mu50
uugauauguuuccucuuuaa

SEQ ID NO: 3964739 - RNA, 17 nt, Staphylococcus aureus subsp. aureus Mu50
uugauauuuuucacgua

SEQ ID NO: 3964740 - RNA, 16 nt, Staphylococcus aureus subsp. aureus Mu50
uugaucaaaaagacag

SEQ ID NO: 3964741 - RNA, 11 nt, Staphylococcus aureus subsp. aureus Mu50
uugaucaaccu

SEQ ID NO: 3964742 - RNA, 17 nt, Staphylococcus aureus subsp. aureus Mu50
uugaucaacuauauaua

SEQ ID NO: 3964743 - RNA, 24 nt, Staphylococcus aureus subsp. aureus Mu50
uugauccaaaguacucaaguaauc

SEQ ID NO: 3964744 - RNA, 21 nt, Staphylococcus aureus subsp. aureus Mu50
uugaucgaauaacuguuuauc

SEQ ID NO: 3964745 - RNA, 13 nt, Staphylococcus aureus subsp. aureus Mu50
uugaucuuuuaua

SEQ ID NO: 3964746 - RNA, 12 nt, Staphylococcus aureus subsp. aureus Mu50
uugaugaauaaa

SEQ ID NO: 3964747 - RNA, 17 nt, Staphylococcus aureus subsp. aureus Mu50
uugaugaauaaauagau

SEQ ID NO: 3964748 - RNA, 15 nt, Staphylococcus aureus subsp. aureus Mu50
uugauggauauucaa

SEQ ID NO: 3964749 - RNA, 16 nt, Staphylococcus aureus subsp. aureus Mu50
uugaugucaauuucac

SEQ ID NO: 3964750 - RNA, 15 nt, Staphylococcus aureus subsp. aureus Mu50
uugaugucacauaug

SEQ ID NO: 3964751 - RNA, 14 nt, Staphylococcus aureus subsp. aureus Mu50
uugauguguugcau

SEQ ID NO: 3964752 - RNA, 14 nt, Staphylococcus aureus subsp. aureus Mu50
uugauuaaaagugu

SEQ ID NO: 3964753 - RNA, 12 nt, Staphylococcus aureus subsp. aureus Mu50
uugauuaaaauc

SEQ ID NO: 3964754 - RNA, 13 nt, Staphylococcus aureus subsp. aureus Mu50
uugauuaaauaaa

SEQ ID NO: 3964755 - RNA, 19 nt, Staphylococcus aureus subsp. aureus Mu50
uugauuaacacaauccuuu

SEQ ID NO: 3964756 - RNA, 14 nt, Staphylococcus aureus subsp. aureus Mu50
uugauuaauuuuau

SEQ ID NO: 3964757 - RNA, 18 nt, Staphylococcus aureus subsp. aureus Mu50
uugauuacaauuguucuc

SEQ ID NO: 3964758 - RNA, 15 nt, Staphylococcus aureus subsp. aureus Mu50
uugauuaguaaauau

SEQ ID NO: 3964759 - RNA, 17 nt, Staphylococcus aureus subsp. aureus Mu50
uugauuauauuucucau

SEQ ID NO: 3964760 - RNA, 22 nt, Staphylococcus aureus subsp. aureus Mu50
uugauuaucauuguucauacgc

SEQ ID NO: 3964761 - RNA, 12 nt, Staphylococcus aureus subsp. aureus Mu50
uugauuauguaa

SEQ ID NO: 3964762 - RNA, 13 nt, Staphylococcus aureus subsp. aureus Mu50
uugauuauucuau

SEQ ID NO: 3964763 - RNA, 13 nt, Staphylococcus aureus subsp. aureus Mu50
uugauucuaaaua

SEQ ID NO: 3964764 - RNA, 18 nt, Staphylococcus aureus subsp. aureus Mu50
uugauucuagugaaauac

SEQ ID NO: 3964765 - RNA, 14 nt, Staphylococcus aureus subsp. aureus Mu50
uugauucuuauaug

SEQ ID NO: 3964766 - RNA, 19 nt, Staphylococcus aureus subsp. aureus Mu50
uugauuguaccaguaacaa

SEQ ID NO: 3964767 - RNA, 16 nt, Staphylococcus aureus subsp. aureus Mu50
uugauuuaacaaccuc

SEQ ID NO: 3964768 - RNA, 18 nt, Staphylococcus aureus subsp. aureus Mu50
uugauuuagcauacauua

SEQ ID NO: 3964769 - RNA, 20 nt, Staphylococcus aureus subsp. aureus Mu50
uuggggccccgacuauuuuu

SEQ ID NO: 3964770 - RNA, 20 nt, Staphylococcus aureus subsp. aureus Mu50
uugguaagcuaauuucuaau

SEQ ID NO: 3964771 - RNA, 20 nt, Staphylococcus aureus subsp. aureus Mu50
uugguauaucgaaagguaac

SEQ ID NO: 3964772 - RNA, 18 nt, Staphylococcus aureus subsp. aureus Mu50
uugguauucaucuucaaa

SEQ ID NO: 3964773 - RNA, 13 nt, Staphylococcus aureus subsp. aureus Mu50
uugguauugguaa

SEQ ID NO: 3964774 - RNA, 20 nt, Staphylococcus aureus subsp. aureus Mu50
uuggucaaguaaauguuuua

SEQ ID NO: 3964775 - RNA, 16 nt, Staphylococcus aureus subsp. aureus Mu50
uuggucaaguuuuggu

SEQ ID NO: 3964776 - RNA, 22 nt, Staphylococcus aureus subsp. aureus Mu50
uuggucaccuacagauaaagcu

SEQ ID NO: 3964777 - RNA, 20 nt, Staphylococcus aureus subsp. aureus Mu50
uugguggagaaccuuuuugu

SEQ ID NO: 3964778 - RNA, 20 nt, Staphylococcus aureus subsp. aureus Mu50
uugguggagauuguaaaaau

SEQ ID NO: 3964779 - RNA, 16 nt, Staphylococcus aureus subsp. aureus Mu50
uugguguuuagucuuu

SEQ ID NO: 3964780 - RNA, 12 nt, Staphylococcus aureus subsp. aureus Mu50
uugguuaaaguu

SEQ ID NO: 3964781 - RNA, 22 nt, Staphylococcus aureus subsp. aureus Mu50
uugguuauuaaaauuaaauaau

SEQ ID NO: 3964782 - RNA, 13 nt, Staphylococcus aureus subsp. aureus Mu50
uugguuuaaaaau

SEQ ID NO: 3964783 - RNA, 18 nt, Staphylococcus aureus subsp. aureus Mu50
uugguuuaucagcuuuaa

SEQ ID NO: 3964784 - RNA, 17 nt, Staphylococcus aureus subsp. aureus Mu50
uugguuucuuaacauaa

SEQ ID NO: 3964785 - RNA, 18 nt, Staphylococcus aureus subsp. aureus Mu50
uugguuuggauaaaauga

SEQ ID NO: 3964786 - RNA, 17 nt, Staphylococcus aureus subsp. aureus Mu50
uuguaaaaauacauaau

SEQ ID NO: 3964787 - RNA, 14 nt, Staphylococcus aureus subsp. aureus Mu50
uuguaaacuucuuu

SEQ ID NO: 3964788 - RNA, 16 nt, Staphylococcus aureus subsp. aureus Mu50
uuguaaacuucuuuuc

SEQ ID NO: 3964789 - RNA, 18 nt, Staphylococcus aureus subsp. aureus Mu50
uuguaaagcaugaauagc

SEQ ID NO: 3964790 - RNA, 20 nt, Staphylococcus aureus subsp. aureus Mu50
uuguaaagcaugaauagcuu

SEQ ID NO: 3964791 - RNA, 23 nt, Staphylococcus aureus subsp. aureus Mu50
uuguaaagcuuuaguuaaauagu

SEQ ID NO: 3964792 - RNA, 21 nt, Staphylococcus aureus subsp. aureus Mu50
uuguaaauauuuuuuaaaaug

SEQ ID NO: 3964793 - RNA, 20 nt, Staphylococcus aureus subsp. aureus Mu50
uuguaaauuuauuuuuaauu

SEQ ID NO: 3964794 - RNA, 20 nt, Staphylococcus aureus subsp. aureus Mu50
uuguaacaagcauuuuucaa

SEQ ID NO: 3964795 - RNA, 17 nt, Staphylococcus aureus subsp. aureus Mu50
uuguaacacacuuauaa

SEQ ID NO: 3964796 - RNA, 18 nt, Staphylococcus aureus subsp. aureus Mu50
uuguaacacacuuauaau

SEQ ID NO: 3964797 - RNA, 21 nt, Staphylococcus aureus subsp. aureus Mu50
uuguaacucaauaugaaaccu

SEQ ID NO: 3964798 - RNA, 21 nt, Staphylococcus aureus subsp. aureus Mu50
uuguaagcucaugaaucagau

SEQ ID NO: 3964799 - RNA, 21 nt, Staphylococcus aureus subsp. aureus Mu50
uuguaaucccauuuuaaaguc

SEQ ID NO: 3964800 - RNA, 19 nt, Staphylococcus aureus subsp. aureus Mu50
uuguaauccuuguucuauu

SEQ ID NO: 3964801 - RNA, 21 nt, Staphylococcus aureus subsp. aureus Mu50
uuguaauuagugcaaguaauu

SEQ ID NO: 3964802 - RNA, 21 nt, Staphylococcus aureus subsp. aureus Mu50
uuguacaaaaaauuguaaguc

SEQ ID NO: 3964803 - RNA, 19 nt, Staphylococcus aureus subsp. aureus Mu50
uuguacacauccucauaau

SEQ ID NO: 3964804 - RNA, 20 nt, Staphylococcus aureus subsp. aureus Mu50
uuguacacauccucauaauu

SEQ ID NO: 3964805 - RNA, 23 nt, Staphylococcus aureus subsp. aureus Mu50
uuguacaguaauauucaacuugu

SEQ ID NO: 3964806 - RNA, 21 nt, Staphylococcus aureus subsp. aureus Mu50
uuguaccaaauaaauuaaauu

SEQ ID NO: 3964807 - RNA, 19 nt, Staphylococcus aureus subsp. aureus Mu50
uuguacgcuucaauuauuu

SEQ ID NO: 3964808 - RNA, 11 nt, Staphylococcus aureus subsp. aureus Mu50
uuguacuucuu

SEQ ID NO: 3964809 - RNA, 24 nt, Staphylococcus aureus subsp. aureus Mu50
uuguagccuccgccaccaaacaua

SEQ ID NO: 3964810 - RNA, 20 nt, Staphylococcus aureus subsp. aureus Mu50
uuguagccuucaacuaaugu

SEQ ID NO: 3964811 - RNA, 16 nt, Staphylococcus aureus subsp. aureus Mu50
uuguagcuugaauaau

SEQ ID NO: 3964812 - RNA, 19 nt, Staphylococcus aureus subsp. aureus Mu50
uuguauaccuauuccuauu

SEQ ID NO: 3964813 - RNA, 18 nt, Staphylococcus aureus subsp. aureus Mu50
uuguauagaauguguaug

SEQ ID NO: 3964814 - RNA, 15 nt, Staphylococcus aureus subsp. aureus Mu50
uuguauauucuuuuu

SEQ ID NO: 3964815 - RNA, 16 nt, Staphylococcus aureus subsp. aureus Mu50
uuguaucaacauuaau

SEQ ID NO: 3964816 - RNA, 24 nt, Staphylococcus aureus subsp. aureus Mu50
uuguaucucugaaaaacuucuuaa

SEQ ID NO: 3964817 - RNA, 15 nt, Staphylococcus aureus subsp. aureus Mu50
uuguaugaauaauau

SEQ ID NO: 3964818 - RNA, 16 nt, Staphylococcus aureus subsp. aureus Mu50
uuguaugauaaccauu

SEQ ID NO: 3964819 - RNA, 19 nt, Staphylococcus aureus subsp. aureus Mu50
uuguauugaucuacauaau

SEQ ID NO: 3964820 - RNA, 18 nt, Staphylococcus aureus subsp. aureus Mu50
uuguauuguuuucaucau

SEQ ID NO: 3964821 - RNA, 18 nt, Staphylococcus aureus subsp. aureus Mu50
uuguauuuaauaaguuaa

SEQ ID NO: 3964822 - RNA, 16 nt, Staphylococcus aureus subsp. aureus Mu50
uuguauuucaucaugu

SEQ ID NO: 3964823 - RNA, 18 nt, Staphylococcus aureus subsp. aureus Mu50
uuguauuuccuuaauaug

SEQ ID NO: 3964824 - RNA, 21 nt, Staphylococcus aureus subsp. aureus Mu50
uuguauuuccuuaauaugcac

SEQ ID NO: 3964825 - RNA, 17 nt, Staphylococcus aureus subsp. aureus Mu50
uuguauuuuauuuauuu

SEQ ID NO: 3964826 - RNA, 13 nt, Staphylococcus aureus subsp. aureus Mu50
uuguauuuuucaa

SEQ ID NO: 3964827 - RNA, 15 nt, Staphylococcus aureus subsp. aureus Mu50
uuguauuuuucaaau

SEQ ID NO: 3964828 - RNA, 19 nt, Staphylococcus aureus subsp. aureus Mu50
uugucacaaucuguucaua

SEQ ID NO: 3964829 - RNA, 21 nt, Staphylococcus aureus subsp. aureus Mu50
uugucacaaucuguucauaau

SEQ ID NO: 3964830 - RNA, 19 nt, Staphylococcus aureus subsp. aureus Mu50
uugucacuuggauucaaau

SEQ ID NO: 3964831 - RNA, 17 nt, Staphylococcus aureus subsp. aureus Mu50
uugucauaauagauaau

SEQ ID NO: 3964832 - RNA, 12 nt, Staphylococcus aureus subsp. aureus Mu50
uugucaucuuuu

SEQ ID NO: 3964833 - RNA, 11 nt, Staphylococcus aureus subsp. aureus Mu50
uugucaugccu

SEQ ID NO: 3964834 - RNA, 14 nt, Staphylococcus aureus subsp. aureus Mu50
uugucaugccuuca

SEQ ID NO: 3964835 - RNA, 19 nt, Staphylococcus aureus subsp. aureus Mu50
uugucauuugaacaucauu

SEQ ID NO: 3964836 - RNA, 16 nt, Staphylococcus aureus subsp. aureus Mu50
uugucauuuugauuaa

SEQ ID NO: 3964837 - RNA, 22 nt, Staphylococcus aureus subsp. aureus Mu50
uuguccguuuuauauuuauuuu

SEQ ID NO: 3964838 - RNA, 20 nt, Staphylococcus aureus subsp. aureus Mu50
uugucuccacacuaaauguu

SEQ ID NO: 3964839 - RNA, 13 nt, Staphylococcus aureus subsp. aureus Mu50
uugucuuuuauau

SEQ ID NO: 3964840 - RNA, 15 nt, Staphylococcus aureus subsp. aureus Mu50
uugucuuuuauauuu

SEQ ID NO: 3964841 - RNA, 17 nt, Staphylococcus aureus subsp. aureus Mu50
uugucuuuuuuaucaug

SEQ ID NO: 3964842 - RNA, 16 nt, Staphylococcus aureus subsp. aureus Mu50
uugugaaaguuuuugu

SEQ ID NO: 3964843 - RNA, 18 nt, Staphylococcus aureus subsp. aureus Mu50
uugugaaauuagagaacg

SEQ ID NO: 3964844 - RNA, 17 nt, Staphylococcus aureus subsp. aureus Mu50
uugugacuuuguucaug

SEQ ID NO: 3964845 - RNA, 16 nt, Staphylococcus aureus subsp. aureus Mu50
uugugauaauucuuca

SEQ ID NO: 3964846 - RNA, 20 nt, Staphylococcus aureus subsp. aureus Mu50
uuguggcuacuaaucuuuuu

SEQ ID NO: 3964847 - RNA, 23 nt, Staphylococcus aureus subsp. aureus Mu50
uuguggcuacuaaucuuuuuuua

SEQ ID NO: 3964848 - RNA, 15 nt, Staphylococcus aureus subsp. aureus Mu50
uuguggcuuuuuuua

SEQ ID NO: 3964849 - RNA, 19 nt, Staphylococcus aureus subsp. aureus Mu50
uugugguaaucauguaaug

SEQ ID NO: 3964850 - RNA, 22 nt, Staphylococcus aureus subsp. aureus Mu50
uugugguaaugauuuugcuuua

SEQ ID NO: 3964851 - RNA, 23 nt, Staphylococcus aureus subsp. aureus Mu50
uugugguuguuaauguauuaauu

SEQ ID NO: 3964852 - RNA, 13 nt, Staphylococcus aureus subsp. aureus Mu50
uuguguauaaaug

SEQ ID NO: 3964853 - RNA, 16 nt, Staphylococcus aureus subsp. aureus Mu50
uuguguccauaaauau

SEQ ID NO: 3964854 - RNA, 13 nt, Staphylococcus aureus subsp. aureus Mu50
uuguguuauguau

SEQ ID NO: 3964855 - RNA, 13 nt, Staphylococcus aureus subsp. aureus Mu50
uuguguugaauca

SEQ ID NO: 3964856 - RNA, 21 nt, Staphylococcus aureus subsp. aureus Mu50
uuuaacuauguuacuuauaua

SEQ ID NO: 3964857 - RNA, 23 nt, Staphylococcus aureus subsp. aureus Mu50
uuuaacuuaauuaaaaaaagauu

SEQ ID NO: 3964858 - RNA, 24 nt, Staphylococcus aureus subsp. aureus Mu50
uuuaacuuaauuaaaaaaagauua

SEQ ID NO: 3964859 - RNA, 22 nt, Staphylococcus aureus subsp. aureus Mu50
uuuaacuuauauacguugauua

SEQ ID NO: 3964860 - RNA, 14 nt, Staphylococcus aureus subsp. aureus Mu50
uuuaacuuccuaaa

SEQ ID NO: 3964861 - RNA, 19 nt, Staphylococcus aureus subsp. aureus Mu50
uuuaacuucugauucuuca

SEQ ID NO: 3964862 - RNA, 15 nt, Staphylococcus aureus subsp. aureus Mu50
uuuaacuucuuuugu

SEQ ID NO: 3964863 - RNA, 17 nt, Staphylococcus aureus subsp. aureus Mu50
uuuaacuucuuuuguuu

SEQ ID NO: 3964864 - RNA, 16 nt, Staphylococcus aureus subsp. aureus Mu50
uuuaagaaaucaacaa

SEQ ID NO: 3964865 - RNA, 18 nt, Staphylococcus aureus subsp. aureus Mu50
uuuaagaagucgaauuca

SEQ ID NO: 3964866 - RNA, 14 nt, Staphylococcus aureus subsp. aureus Mu50
uuuaagaauguaca

SEQ ID NO: 3964867 - RNA, 14 nt, Staphylococcus aureus subsp. aureus Mu50
uuuaagaucaauau

SEQ ID NO: 3964868 - RNA, 15 nt, Staphylococcus aureus subsp. aureus Mu50
uuuaagaucaauauc

SEQ ID NO: 3964869 - RNA, 22 nt, Staphylococcus aureus subsp. aureus Mu50
uuuaagcuaucuaaaccuuuuu

SEQ ID NO: 3964870 - RNA, 12 nt, Staphylococcus aureus subsp. aureus Mu50
uuuaagcugcuc

SEQ ID NO: 3964871 - RNA, 15 nt, Staphylococcus aureus subsp. aureus Mu50
uuuaagcuuaucaac

SEQ ID NO: 3964872 - RNA, 20 nt, Staphylococcus aureus subsp. aureus Mu50
uuuaaguaauucauuugcuu

SEQ ID NO: 3964873 - RNA, 22 nt, Staphylococcus aureus subsp. aureus Mu50
uuuaaguaucggugauuuaauu

SEQ ID NO: 3964874 - RNA, 19 nt, Staphylococcus aureus subsp. aureus Mu50
uuuaagugaugaccaauau

SEQ ID NO: 3964875 - RNA, 14 nt, Staphylococcus aureus subsp. aureus Mu50
uuuaaguuuauaau

SEQ ID NO: 3964876 - RNA, 12 nt, Staphylococcus aureus subsp. aureus Mu50
uuuaauaaaaac

SEQ ID NO: 3964877 - RNA, 16 nt, Staphylococcus aureus subsp. aureus Mu50
uuuaauaaaucguguu

SEQ ID NO: 3964878 - RNA, 21 nt, Staphylococcus aureus subsp. aureus Mu50
uuuaauaaccuuuaaaacauc

SEQ ID NO: 3964879 - RNA, 13 nt, Staphylococcus aureus subsp. aureus Mu50
uuuaauaacuaaa

SEQ ID NO: 3964880 - RNA, 13 nt, Staphylococcus aureus subsp. aureus Mu50
uuuaauaaucaaa

SEQ ID NO: 3964881 - RNA, 24 nt, Staphylococcus aureus subsp. aureus Mu50
uuuaauaauuaaauauaaagacga

SEQ ID NO: 3964882 - RNA, 21 nt, Staphylococcus aureus subsp. aureus Mu50
uuuaauagcauuccuaauuau

SEQ ID NO: 3964883 - RNA, 22 nt, Staphylococcus aureus subsp. aureus Mu50
uuuaauagcauuccuaauuaua

SEQ ID NO: 3964884 - RNA, 16 nt, Staphylococcus aureus subsp. aureus Mu50
uuuaauaguacuuaau

SEQ ID NO: 3964885 - RNA, 23 nt, Staphylococcus aureus subsp. aureus Mu50
uuuaauaguacuuaauuuaaauu

SEQ ID NO: 3964886 - RNA, 12 nt, Staphylococcus aureus subsp. aureus Mu50
uuuaauauauuu

SEQ ID NO: 3964887 - RNA, 15 nt, Staphylococcus aureus subsp. aureus Mu50
uuuaauauauuuauu

SEQ ID NO: 3964888 - RNA, 12 nt, Staphylococcus aureus subsp. aureus Mu50
uuuaauauuaua

SEQ ID NO: 3964889 - RNA, 21 nt, Staphylococcus aureus subsp. aureus Mu50
uuuaauauugaaaugagcuua

SEQ ID NO: 3964890 - RNA, 18 nt, Staphylococcus aureus subsp. aureus Mu50
uuuaauauuguuaauuca

SEQ ID NO: 3964891 - RNA, 19 nt, Staphylococcus aureus subsp. aureus Mu50
uuuaauauuugauaacaaa

SEQ ID NO: 3964892 - RNA, 23 nt, Staphylococcus aureus subsp. aureus Mu50
uuuaaucacaucuuuuugauaau

SEQ ID NO: 3964893 - RNA, 16 nt, Staphylococcus aureus subsp. aureus Mu50
uuuaauccuucuccaa

SEQ ID NO: 3964894 - RNA, 21 nt, Staphylococcus aureus subsp. aureus Mu50
uuuaauccuucuccaaaaaua

SEQ ID NO: 3964895 - RNA, 18 nt, Staphylococcus aureus subsp. aureus Mu50
uuuaaucgcauuguuaaa

SEQ ID NO: 3964896 - RNA, 16 nt, Staphylococcus aureus subsp. aureus Mu50
uuuaaucguaacauau

SEQ ID NO: 3964897 - RNA, 19 nt, Staphylococcus aureus subsp. aureus Mu50
uuuaaucguaacauaucag

SEQ ID NO: 3964898 - RNA, 21 nt, Staphylococcus aureus subsp. aureus Mu50
uuuaaucguaacauaucagcu

SEQ ID NO: 3964899 - RNA, 21 nt, Staphylococcus aureus subsp. aureus Mu50
uuuaaucguauuagccaauaa

SEQ ID NO: 3964900 - RNA, 18 nt, Staphylococcus aureus subsp. aureus Mu50
uuuaaucuuauucgcacc

SEQ ID NO: 3964901 - RNA, 22 nt, Staphylococcus aureus subsp. aureus Mu50
uuuaaugagcuuuucuaaugcu

SEQ ID NO: 3964902 - RNA, 20 nt, Staphylococcus aureus subsp. aureus Mu50
uuuaaugauuuuucaucaau

SEQ ID NO: 3964903 - RNA, 17 nt, Staphylococcus aureus subsp. aureus Mu50
uuuaaugcgaaaaaacc

SEQ ID NO: 3964904 - RNA, 21 nt, Staphylococcus aureus subsp. aureus Mu50
uuuaaugggcgauaaaaguug

SEQ ID NO: 3964905 - RNA, 16 nt, Staphylococcus aureus subsp. aureus Mu50
uuuaauguaauuauuu

SEQ ID NO: 3964906 - RNA, 21 nt, Staphylococcus aureus subsp. aureus Mu50
uuuaauguacuucaauuuaug

SEQ ID NO: 3964907 - RNA, 20 nt, Staphylococcus aureus subsp. aureus Mu50
uuuaauguauaaauuaguuu

SEQ ID NO: 3964908 - RNA, 12 nt, Staphylococcus aureus subsp. aureus Mu50
uuuaauguguaa

SEQ ID NO: 3964909 - RNA, 16 nt, Staphylococcus aureus subsp. aureus Mu50
uuuaauuaaaauacaa

SEQ ID NO: 3964910 - RNA, 19 nt, Staphylococcus aureus subsp. aureus Mu50
uuuaauuaaguuaaaauaa

SEQ ID NO: 3964911 - RNA, 17 nt, Staphylococcus aureus subsp. aureus Mu50
uuuaauuaauuaucaua

SEQ ID NO: 3964912 - RNA, 21 nt, Staphylococcus aureus subsp. aureus Mu50
uuuaauuauuucccuggaaaa

SEQ ID NO: 3964913 - RNA, 17 nt, Staphylococcus aureus subsp. aureus Mu50
uuuaauuauuuuaaaaa

SEQ ID NO: 3964914 - RNA, 14 nt, Staphylococcus aureus subsp. aureus Mu50
uuuaauuccaaaga

SEQ ID NO: 3964915 - RNA, 21 nt, Staphylococcus aureus subsp. aureus Mu50
uuuaauuccaaagaaagcuaa

SEQ ID NO: 3964916 - RNA, 22 nt, Staphylococcus aureus subsp. aureus Mu50
uuuaauucuauuuuugauuuaa

SEQ ID NO: 3964917 - RNA, 23 nt, Staphylococcus aureus subsp. aureus Mu50
uuuaauugaaugaaaaaguugau

SEQ ID NO: 3964918 - RNA, 23 nt, Staphylococcus aureus subsp. aureus Mu50
uuuaauugcuguaaauauucguu

SEQ ID NO: 3964919 - RNA, 14 nt, Staphylococcus aureus subsp. aureus Mu50
uuuaauugguucuu

SEQ ID NO: 3964920 - RNA, 19 nt, Staphylococcus aureus subsp. aureus Mu50
uuuaauugguucuucuuuc

SEQ ID NO: 3964921 - RNA, 19 nt, Staphylococcus aureus subsp. aureus Mu50
uuuaauugguugauuaguu

SEQ ID NO: 3964922 - RNA, 21 nt, Staphylococcus aureus subsp. aureus Mu50
uuuaauuguuuaauaacaaaa

SEQ ID NO: 3964923 - RNA, 16 nt, Staphylococcus aureus subsp. aureus Mu50
uuuaauuuacaauuaa

SEQ ID NO: 3964924 - RNA, 18 nt, Staphylococcus aureus subsp. aureus Mu50
uuuaauuuacaauuaauu

SEQ ID NO: 3964925 - RNA, 21 nt, Staphylococcus aureus subsp. aureus Mu50
uuuaauuuaguuauaauuucu

SEQ ID NO: 3964926 - RNA, 14 nt, Staphylococcus aureus subsp. aureus Mu50
uuuaauuucacuuu

SEQ ID NO: 3964927 - RNA, 21 nt, Staphylococcus aureus subsp. aureus Mu50
uuuaauuucuaugaaaaaaau

SEQ ID NO: 3964928 - RNA, 16 nt, Staphylococcus aureus subsp. aureus Mu50
uuuaauuucugguaaa

SEQ ID NO: 3964929 - RNA, 23 nt, Staphylococcus aureus subsp. aureus Mu50
uuuaauuucugguaaaaaaauaa

SEQ ID NO: 3964930 - RNA, 14 nt, Staphylococcus aureus subsp. aureus Mu50
uuuaauuuucuaaa

SEQ ID NO: 3964931 - RNA, 18 nt, Staphylococcus aureus subsp. aureus Mu50
uuuaauuuucuaaauaua

SEQ ID NO: 3964932 - RNA, 16 nt, Staphylococcus aureus subsp. aureus Mu50
uuuaauuuuuaaugua

SEQ ID NO: 3964933 - RNA, 16 nt, Staphylococcus aureus subsp. aureus Mu50
uuuaauuuuucauuaa

SEQ ID NO: 3964934 - RNA, 17 nt, Staphylococcus aureus subsp. aureus Mu50
uuuaauuuuucauuaau

SEQ ID NO: 3964935 - RNA, 15 nt, Staphylococcus aureus subsp. aureus Mu50
uuuaauuuuucuaaa

SEQ ID NO: 3964936 - RNA, 20 nt, Staphylococcus aureus subsp. aureus Mu50
uuuacaaacuucacaucaug

SEQ ID NO: 3964937 - RNA, 19 nt, Staphylococcus aureus subsp. aureus Mu50
uuuacaaauguauaaauaa

SEQ ID NO: 3964938 - RNA, 22 nt, Staphylococcus aureus subsp. aureus Mu50
uuuacaaauguauaaauaauaa

SEQ ID NO: 3964939 - RNA, 20 nt, Staphylococcus aureus subsp. aureus Mu50
uuuacaagucuuauuuguuu

SEQ ID NO: 3964940 - RNA, 13 nt, Staphylococcus aureus subsp. aureus Mu50
uuuacaaucaacu

SEQ ID NO: 3964941 - RNA, 14 nt, Staphylococcus aureus subsp. aureus Mu50
uuuacaaucaacuu

SEQ ID NO: 3964942 - RNA, 16 nt, Staphylococcus aureus subsp. aureus Mu50
uuuacagguugaauaa

SEQ ID NO: 3964943 - RNA, 16 nt, Staphylococcus aureus subsp. aureus Mu50
uuucagcaguugcaca

SEQ ID NO: 3964944 - RNA, 18 nt, Staphylococcus aureus subsp. aureus Mu50
uuucagccacugucaugu

SEQ ID NO: 3964945 - RNA, 19 nt, Staphylococcus aureus subsp. aureus Mu50
uuucagcgauaacguacaa

SEQ ID NO: 3964946 - RNA, 19 nt, Staphylococcus aureus subsp. aureus Mu50
uuucaggcuuuguuuuuca

SEQ ID NO: 3964947 - RNA, 15 nt, Staphylococcus aureus subsp. aureus Mu50
uuucaguauacucau

SEQ ID NO: 3964948 - RNA, 19 nt, Staphylococcus aureus subsp. aureus Mu50
uuucaguucaucauagaca

SEQ ID NO: 3964949 - RNA, 14 nt, Staphylococcus aureus subsp. aureus Mu50
uuucaguucuuaga

SEQ ID NO: 3964950 - RNA, 16 nt, Staphylococcus aureus subsp. aureus Mu50
uuucauaaaguuuauu

SEQ ID NO: 3964951 - RNA, 18 nt, Staphylococcus aureus subsp. aureus Mu50
uuucauaaaguuuauuua

SEQ ID NO: 3964952 - RNA, 22 nt, Staphylococcus aureus subsp. aureus Mu50
uuucauaaaguuuauuuauguu

SEQ ID NO: 3964953 - RNA, 23 nt, Staphylococcus aureus subsp. aureus Mu50
uuucauaauuaacacauucaaau

SEQ ID NO: 3964954 - RNA, 22 nt, Staphylococcus aureus subsp. aureus Mu50
uuucauaccuugauuauaugcu

SEQ ID NO: 3964955 - RNA, 18 nt, Staphylococcus aureus subsp. aureus Mu50
uuucauagaaccauuucu

SEQ ID NO: 3964956 - RNA, 23 nt, Staphylococcus aureus subsp. aureus Mu50
uuucauagaugcauaaaaaccua

SEQ ID NO: 3964957 - RNA, 17 nt, Staphylococcus aureus subsp. aureus Mu50
uuucauauaaauagcuu

SEQ ID NO: 3964958 - RNA, 23 nt, Staphylococcus aureus subsp. aureus Mu50
uuucauauaaauagcuucuuaaa

SEQ ID NO: 3964959 - RNA, 16 nt, Staphylococcus aureus subsp. aureus Mu50
uuucauauaaugaaug

SEQ ID NO: 3964960 - RNA, 21 nt, Staphylococcus aureus subsp. aureus Mu50
uuucauaugcaucaacagaua

SEQ ID NO: 3964961 - RNA, 13 nt, Staphylococcus aureus subsp. aureus Mu50
uuucaucaauauc

SEQ ID NO: 3964962 - RNA, 14 nt, Staphylococcus aureus subsp. aureus Mu50
uuucaucaauauca

SEQ ID NO: 3964963 - RNA, 20 nt, Staphylococcus aureus subsp. aureus Mu50
uuucaucaugugcuuuguuu

SEQ ID NO: 3964964 - RNA, 15 nt, Staphylococcus aureus subsp. aureus Mu50
uuucaucauuaguuu

SEQ ID NO: 3964965 - RNA, 11 nt, Staphylococcus aureus subsp. aureus Mu50
uuucaucuuuc

SEQ ID NO: 3964966 - RNA, 18 nt, Staphylococcus aureus subsp. aureus Mu50
uuucaucuuucaaaugcu

SEQ ID NO: 3964967 - RNA, 15 nt, Staphylococcus aureus subsp. aureus Mu50
uuucaugauuuacua

SEQ ID NO: 3964968 - RNA, 16 nt, Staphylococcus aureus subsp. aureus Mu50
uuucauguucauaaua

SEQ ID NO: 3964969 - RNA, 20 nt, Staphylococcus aureus subsp. aureus Mu50
uuucauguuugauucuaaau

SEQ ID NO: 3964970 - RNA, 16 nt, Staphylococcus aureus subsp. aureus Mu50
uuucauuaauuuuuca

SEQ ID NO: 3964971 - RNA, 17 nt, Staphylococcus aureus subsp. aureus Mu50
uuucauuuaauccuucu

SEQ ID NO: 3964972 - RNA, 17 nt, Staphylococcus aureus subsp. aureus Mu50
uuucauuuacuucuucu

SEQ ID NO: 3964973 - RNA, 15 nt, Staphylococcus aureus subsp. aureus Mu50
uuucauuuuuauccc

SEQ ID NO: 3964974 - RNA, 13 nt, Staphylococcus aureus subsp. aureus Mu50
uuucauuuuuuca

SEQ ID NO: 3964975 - RNA, 18 nt, Staphylococcus aureus subsp. aureus Mu50
uuucauuuuuucaauguc

SEQ ID NO: 3964976 - RNA, 15 nt, Staphylococcus aureus subsp. aureus Mu50
uuuccaauaucuucu

SEQ ID NO: 3964977 - RNA, 19 nt, Staphylococcus aureus subsp. aureus Mu50
uuuccaaucuauuaaugcu

SEQ ID NO: 3964978 - RNA, 22 nt, Staphylococcus aureus subsp. aureus Mu50
uuuccaccggacaauguagaua

SEQ ID NO: 3964979 - RNA, 13 nt, Staphylococcus aureus subsp. aureus Mu50
uuuccacugcaac

SEQ ID NO: 3964980 - RNA, 14 nt, Staphylococcus aureus subsp. aureus Mu50
uuuccauaaauaaa

SEQ ID NO: 3964981 - RNA, 19 nt, Staphylococcus aureus subsp. aureus Mu50
uuuccauaaauaaaaugcu

SEQ ID NO: 3964982 - RNA, 21 nt, Staphylococcus aureus subsp. aureus Mu50
uuuccauaaauauuuaaaaua

SEQ ID NO: 3964983 - RNA, 14 nt, Staphylococcus aureus subsp. aureus Mu50
uuuccauucguaua

SEQ ID NO: 3964984 - RNA, 17 nt, Staphylococcus aureus subsp. aureus Mu50
uuuccauuuaucaacaa

SEQ ID NO: 3964985 - RNA, 18 nt, Staphylococcus aureus subsp. aureus Mu50
uuuccuacacuguuuuau

SEQ ID NO: 3964986 - RNA, 21 nt, Staphylococcus aureus subsp. aureus Mu50
uuuccucgguuuuauuuuuau

SEQ ID NO: 3964987 - RNA, 22 nt, Staphylococcus aureus subsp. aureus Mu50
uuuccucuuuaaagcuaaaugu

SEQ ID NO: 3964988 - RNA, 20 nt, Staphylococcus aureus subsp. aureus Mu50
uuucgaaaagaaauucuaca

SEQ ID NO: 3964989 - RNA, 17 nt, Staphylococcus aureus subsp. aureus Mu50
uuucgaacgcuugaaaa

SEQ ID NO: 3964990 - RNA, 21 nt, Staphylococcus aureus subsp. aureus Mu50
uuucgaacuuuuguucuaagu

SEQ ID NO: 3964991 - RNA, 21 nt, Staphylococcus aureus subsp. aureus Mu50
uuucgacaucuagaugaaauu

SEQ ID NO: 3964992 - RNA, 20 nt, Staphylococcus aureus subsp. aureus Mu50
uuucgaccgcguauuccauu

SEQ ID NO: 3964993 - RNA, 21 nt, Staphylococcus aureus subsp. aureus Mu50
uuucgaguaugguugauuaca

SEQ ID NO: 3964994 - RNA, 13 nt, Staphylococcus aureus subsp. aureus Mu50
uuucgauauuugu

SEQ ID NO: 3964995 - RNA, 14 nt, Staphylococcus aureus subsp. aureus Mu50
uuucgauucauuua

SEQ ID NO: 3964996 - RNA, 14 nt, Staphylococcus aureus subsp. aureus Mu50
uuucgucagauuca

SEQ ID NO: 3964997 - RNA, 17 nt, Staphylococcus aureus subsp. aureus Mu50
uuucguguuccaauuuu

SEQ ID NO: 3964998 - RNA, 19 nt, Staphylococcus aureus subsp. aureus Mu50
uuucguguuccaauuuuau

SEQ ID NO: 3964999 - RNA, 23 nt, Staphylococcus aureus subsp. aureus Mu50
uuucguuagacucacuucuuaaa

SEQ ID NO: 3965000 - RNA, 19 nt, Staphylococcus aureus subsp. aureus Mu50
uuucuaaauucuuuuuguu

SEQ ID NO: 3965001 - RNA, 15 nt, Staphylococcus aureus subsp. aureus Mu50
uuucuaaguuuguug

SEQ ID NO: 3965002 - RNA, 15 nt, Staphylococcus aureus subsp. aureus Mu50
uuucuaaugcucauu

SEQ ID NO: 3965003 - RNA, 19 nt, Staphylococcus aureus subsp. aureus Mu50
uuucuaauugaaaucaucu

SEQ ID NO: 3965004 - RNA, 23 nt, Staphylococcus aureus subsp. aureus Mu50
uuucuaauugaaaucaucuuaug

SEQ ID NO: 3965005 - RNA, 21 nt, Staphylococcus aureus subsp. aureus Mu50
uuucuacaccuacaacuguug

SEQ ID NO: 3965006 - RNA, 22 nt, Staphylococcus aureus subsp. aureus Mu50
uuucuagcuuguuuguuacaua

SEQ ID NO: 3965007 - RNA, 17 nt, Staphylococcus aureus subsp. aureus Mu50
uuucuaggccacuaaga

SEQ ID NO: 3965008 - RNA, 22 nt, Staphylococcus aureus subsp. aureus Mu50
uuucuaggccacuaagaccaug

SEQ ID NO: 3965009 - RNA, 18 nt, Staphylococcus aureus subsp. aureus Mu50
uuucuaguuuaucuucag

SEQ ID NO: 3965010 - RNA, 14 nt, Staphylococcus aureus subsp. aureus Mu50
uuucuauaaagaau

SEQ ID NO: 3965011 - RNA, 16 nt, Staphylococcus aureus subsp. aureus Mu50
uuucuauaauauuuaa

SEQ ID NO: 3965012 - RNA, 23 nt, Staphylococcus aureus subsp. aureus Mu50
uuucuauaauauuuaaccacuuu

SEQ ID NO: 3965013 - RNA, 18 nt, Staphylococcus aureus subsp. aureus Mu50
uuucuauagaauuuuuca

SEQ ID NO: 3965014 - RNA, 12 nt, Staphylococcus aureus subsp. aureus Mu50
uuucuaucaaau

SEQ ID NO: 3965015 - RNA, 14 nt, Staphylococcus aureus subsp. aureus Mu50
uuucuaucaaauaa

SEQ ID NO: 3965016 - RNA, 15 nt, Staphylococcus aureus subsp. aureus Mu50
uuucuaucaaauaau

SEQ ID NO: 3965017 - RNA, 14 nt, Staphylococcus aureus subsp. aureus Mu50
uuucuauuaauaua

SEQ ID NO: 3965018 - RNA, 15 nt, Staphylococcus aureus subsp. aureus Mu50
uuucuauuaauauag

SEQ ID NO: 3965019 - RNA, 18 nt, Staphylococcus aureus subsp. aureus Mu50
uuucuauuaauauagaag

SEQ ID NO: 3965020 - RNA, 14 nt, Staphylococcus aureus subsp. aureus Mu50
uuucuauucaaaaa

SEQ ID NO: 3965021 - RNA, 14 nt, Staphylococcus aureus subsp. aureus Mu50
uuucucacugcugu

SEQ ID NO: 3965022 - RNA, 19 nt, Staphylococcus aureus subsp. aureus Mu50
uuucuccaguuuucaauuu

SEQ ID NO: 3965023 - RNA, 22 nt, Staphylococcus aureus subsp. aureus Mu50
uuucugacugugaagcugugcu

SEQ ID NO: 3965024 - RNA, 18 nt, Staphylococcus aureus subsp. aureus Mu50
uuucugacuuuuaaaaaa

SEQ ID NO: 3965025 - RNA, 16 nt, Staphylococcus aureus subsp. aureus Mu50
uuucugagaagaaaua

SEQ ID NO: 3965026 - RNA, 19 nt, Staphylococcus aureus subsp. aureus Mu50
uuucugagaagaaauauau

SEQ ID NO: 3965027 - RNA, 17 nt, Staphylococcus aureus subsp. aureus Mu50
uuucugcgauauagcuu

SEQ ID NO: 3965028 - RNA, 18 nt, Staphylococcus aureus subsp. aureus Mu50
uuucuggccacuaaugca

SEQ ID NO: 3965029 - RNA, 14 nt, Staphylococcus aureus subsp. aureus Mu50
uuucuggcucuucu

SEQ ID NO: 3965030 - RNA, 21 nt, Staphylococcus aureus subsp. aureus Mu50
uuugccagucauuguauaaaa

SEQ ID NO: 3965031 - RNA, 12 nt, Staphylococcus aureus subsp. aureus Mu50
uuugccauaauu

SEQ ID NO: 3965032 - RNA, 20 nt, Staphylococcus aureus subsp. aureus Mu50
uuugccccucauucacaaug

SEQ ID NO: 3965033 - RNA, 14 nt, Staphylococcus aureus subsp. aureus Mu50
uuugcgguguggcg

SEQ ID NO: 3965034 - RNA, 18 nt, Staphylococcus aureus subsp. aureus Mu50
uuugcgguuuuuuugauu

SEQ ID NO: 3965035 - RNA, 20 nt, Staphylococcus aureus subsp. aureus Mu50
uuugcguuuguguguuuuaa

SEQ ID NO: 3965036 - RNA, 20 nt, Staphylococcus aureus subsp. aureus Mu50
uuugcuaaccaucauaaaug

SEQ ID NO: 3965037 - RNA, 16 nt, Staphylococcus aureus subsp. aureus Mu50
uuugcuagugcuucca

SEQ ID NO: 3965038 - RNA, 20 nt, Staphylococcus aureus subsp. aureus Mu50
uuugcucaaaaaugcuuaua

SEQ ID NO: 3965039 - RNA, 17 nt, Staphylococcus aureus subsp. aureus Mu50
uuugcuggcgcaaugau

SEQ ID NO: 3965040 - RNA, 17 nt, Staphylococcus aureus subsp. aureus Mu50
uuugcuuaaaccuuaau

SEQ ID NO: 3965041 - RNA, 12 nt, Staphylococcus aureus subsp. aureus Mu50
uuugcuuuauca

SEQ ID NO: 3965042 - RNA, 19 nt, Staphylococcus aureus subsp. aureus Mu50
uuugcuuuggcuauuuuau

SEQ ID NO: 3965043 - RNA, 16 nt, Staphylococcus aureus subsp. aureus Mu50
uuugcuuuuuguaaug

SEQ ID NO: 3965044 - RNA, 15 nt, Staphylococcus aureus subsp. aureus Mu50
uuugcuuuuugugua

SEQ ID NO: 3965045 - RNA, 14 nt, Staphylococcus aureus subsp. aureus Mu50
uuuggaaauaucuu

SEQ ID NO: 3965046 - RNA, 14 nt, Staphylococcus aureus subsp. aureus Mu50
uuuggaaauuuauu

SEQ ID NO: 3965047 - RNA, 21 nt, Staphylococcus aureus subsp. aureus Mu50
uuuggaaauuuauuauaaaau

SEQ ID NO: 3965048 - RNA, 15 nt, Staphylococcus aureus subsp. aureus Mu50
uuuggaacauauuca

SEQ ID NO: 3965049 - RNA, 16 nt, Staphylococcus aureus subsp. aureus Mu50
uuuggaugaacaaaau

SEQ ID NO: 3965050 - RNA, 17 nt, Staphylococcus aureus subsp. aureus Mu50
uuuggaugcuuuucuau

SEQ ID NO: 3965051 - RNA, 19 nt, Staphylococcus aureus subsp. aureus Mu50
uuuggauuucuuuuuaaaa

SEQ ID NO: 3965052 - RNA, 21 nt, Staphylococcus aureus subsp. aureus Mu50
uuuggauuucuuuuuaaaauc

SEQ ID NO: 3965053 - RNA, 18 nt, Staphylococcus aureus subsp. aureus Mu50
uuuggcguaaugauauua

SEQ ID NO: 3965054 - RNA, 18 nt, Staphylococcus aureus subsp. aureus Mu50
uuugggaagcgucuuuuu

SEQ ID NO: 3965055 - RNA, 20 nt, Staphylococcus aureus subsp. aureus Mu50
uuugguaagcuaauuucuaa

SEQ ID NO: 3965056 - RNA, 18 nt, Staphylococcus aureus subsp. aureus Mu50
uuuggucaaguuuugguc

SEQ ID NO: 3965057 - RNA, 14 nt, Staphylococcus aureus subsp. aureus Mu50
uuuggucaccaaau

SEQ ID NO: 3965058 - RNA, 22 nt, Staphylococcus aureus subsp. aureus Mu50
uuugguggagaaccauuuuauu

SEQ ID NO: 3965059 - RNA, 22 nt, Staphylococcus aureus subsp. aureus Mu50
uuugguucaaucauucacuuca

SEQ ID NO: 3965060 - RNA, 16 nt, Staphylococcus aureus subsp. aureus Mu50
uuugguucuucuaucu

SEQ ID NO: 3965061 - RNA, 15 nt, Staphylococcus aureus subsp. aureus Mu50
uuugguuugcuuuaa

SEQ ID NO: 3965062 - RNA, 22 nt, Staphylococcus aureus subsp. aureus Mu50
uuuguaaagcuuuaguuaaaua

SEQ ID NO: 3965063 - RNA, 20 nt, Staphylococcus aureus subsp. aureus Mu50
uuuguaaauauuuuuuaaaa

SEQ ID NO: 3965064 - RNA, 14 nt, Staphylococcus aureus subsp. aureus Mu50
uuuguaaauuuuua

SEQ ID NO: 3965065 - RNA, 18 nt, Staphylococcus aureus subsp. aureus Mu50
uuuguaaccuaaaaacaa

SEQ ID NO: 3965066 - RNA, 20 nt, Staphylococcus aureus subsp. aureus Mu50
uuuguaaccuaaaaacaaag

SEQ ID NO: 3965067 - RNA, 19 nt, Staphylococcus aureus subsp. aureus Mu50
uuuguaagacaacaaaucg

SEQ ID NO: 3965068 - RNA, 13 nt, Staphylococcus aureus subsp. aureus Mu50
uuuguaauuagga

SEQ ID NO: 3965069 - RNA, 22 nt, Staphylococcus aureus subsp. aureus Mu50
uuuguaauugaugauuacucca

SEQ ID NO: 3965070 - RNA, 20 nt, Staphylococcus aureus subsp. aureus Mu50
uuuguacucuucguuuuaau

SEQ ID NO: 3965071 - RNA, 21 nt, Staphylococcus aureus subsp. aureus Mu50
uuuguaguccuucuuugaaau

SEQ ID NO: 3965072 - RNA, 19 nt, Staphylococcus aureus subsp. aureus Mu50
uuuguauaccuauuccuau

SEQ ID NO: 3965073 - RNA, 17 nt, Staphylococcus aureus subsp. aureus Mu50
uuuguaugauaaccauu

SEQ ID NO: 3965074 - RNA, 22 nt, Staphylococcus aureus subsp. aureus Mu50
uuuguauuuauguuuucuaguu

SEQ ID NO: 3965075 - RNA, 16 nt, Staphylococcus aureus subsp. aureus Mu50
uuuguauuuuucaaau

SEQ ID NO: 3965076 - RNA, 17 nt, Staphylococcus aureus subsp. aureus Mu50
uuugucaguaacuuugu

SEQ ID NO: 3965077 - RNA, 15 nt, Staphylococcus aureus subsp. aureus Mu50
uuugucaucuuuugu

SEQ ID NO: 3965078 - RNA, 19 nt, Staphylococcus aureus subsp. aureus Mu50
uuugucauuuugauuaagu

SEQ ID NO: 3965079 - RNA, 15 nt, Staphylococcus aureus subsp. aureus Mu50
uuugucuuacuaauu

SEQ ID NO: 3965080 - RNA, 21 nt, Staphylococcus aureus subsp. aureus Mu50
uuugugaauuuauuuuguagu

SEQ ID NO: 3965081 - RNA, 11 nt, Staphylococcus aureus subsp. aureus Mu50
uuugugguaau

SEQ ID NO: 3965082 - RNA, 16 nt, Staphylococcus aureus subsp. aureus Mu50
uuuguguaucuguaac

SEQ ID NO: 3965083 - RNA, 21 nt, Staphylococcus aureus subsp. aureus Mu50
uuuguuaccaaacaauacaua

SEQ ID NO: 3965084 - RNA, 14 nt, Staphylococcus aureus subsp. aureus Mu50
uuuguucaaucacu

SEQ ID NO: 3965085 - RNA, 17 nt, Staphylococcus aureus subsp. aureus Mu50
uuuguucaaucacuaua

SEQ ID NO: 3965086 - RNA, 19 nt, Staphylococcus aureus subsp. aureus Mu50
uuuguucuuggcucaacaa

SEQ ID NO: 3965087 - RNA, 23 nt, Staphylococcus aureus subsp. aureus Mu50
uuuguuggggcccacaccccaac

SEQ ID NO: 3965088 - RNA, 12 nt, Staphylococcus aureus subsp. aureus Mu50
uuuguuuuaaaa

SEQ ID NO: 3965089 - RNA, 12 nt, Staphylococcus aureus subsp. aureus Mu50
uuuguuuuaaau

SEQ ID NO: 3965090 - RNA, 14 nt, Staphylococcus aureus subsp. aureus Mu50
uuuguuuucacugu

SEQ ID NO: 3965091 - RNA, 14 nt, Staphylococcus aureus subsp. aureus Mu50
uuuguuuucaguaa

SEQ ID NO: 3965092 - RNA, 23 nt, Staphylococcus aureus subsp. aureus Mu50
uuuuaaaaaacaguguagcacaa

SEQ ID NO: 3965093 - RNA, 15 nt, Staphylococcus aureus subsp. aureus Mu50
uuuuaaaaaacauac

SEQ ID NO: 3965094 - RNA, 22 nt, Staphylococcus aureus subsp. aureus Mu50
uuuuaaaaaacauaccugcaua

SEQ ID NO: 3965095 - RNA, 19 nt, Staphylococcus aureus subsp. aureus Mu50
uuuuaaaaaauuuaaauaa

SEQ ID NO: 3965096 - RNA, 12 nt, Staphylococcus aureus subsp. aureus Mu50
uuuuaaaaaccu

SEQ ID NO: 3965097 - RNA, 18 nt, Staphylococcus aureus subsp. aureus Mu50
uuuuaaaaaguaauuaau

SEQ ID NO: 3965098 - RNA, 16 nt, Staphylococcus aureus subsp. aureus Mu50
uuuuaaaaauacagcu

SEQ ID NO: 3965099 - RNA, 15 nt, Staphylococcus aureus subsp. aureus Mu50
uuuuaaaaauucaua

SEQ ID NO: 3965100 - RNA, 18 nt, Staphylococcus aureus subsp. aureus Mu50
uuuuaaaagauaaauaaa

SEQ ID NO: 3965101 - RNA, 20 nt, Staphylococcus aureus subsp. aureus Mu50
uuuuaaaauaaaucuuuuga

SEQ ID NO: 3965102 - RNA, 20 nt, Staphylococcus aureus subsp. aureus Mu50
uuuuaaaauaaugauauauu

SEQ ID NO: 3965103 - RNA, 14 nt, Staphylococcus aureus subsp. aureus Mu50
uuuuaaaaugauag

SEQ ID NO: 3965104 - RNA, 14 nt, Staphylococcus aureus subsp. aureus Mu50
uuuuaaaauuauca

SEQ ID NO: 3965105 - RNA, 21 nt, Staphylococcus aureus subsp. aureus Mu50
uuuuaaaauuaugauuauauu

SEQ ID NO: 3965106 - RNA, 22 nt, Staphylococcus aureus subsp. aureus Mu50
uuuuaaacaugaacaaucagau

SEQ ID NO: 3965107 - RNA, 23 nt, Staphylococcus aureus subsp. aureus Mu50
uuuuaaacucauccauugaucuu

SEQ ID NO: 3965108 - RNA, 16 nt, Staphylococcus aureus subsp. aureus Mu50
uuuuaaagaaaaguuu

SEQ ID NO: 3965109 - RNA, 11 nt, Staphylococcus aureus subsp. aureus Mu50
uuuuaaaggac

SEQ ID NO: 3965110 - RNA, 20 nt, Staphylococcus aureus subsp. aureus Mu50
uuuuaaaggaccacuuagau

SEQ ID NO: 3965111 - RNA, 17 nt, Staphylococcus aureus subsp. aureus Mu50
uuuuaaagguuaaauau

SEQ ID NO: 3965112 - RNA, 22 nt, Staphylococcus aureus subsp. aureus Mu50
uuuuaaagguuaaauauuuaau

SEQ ID NO: 3965113 - RNA, 12 nt, Staphylococcus aureus subsp. aureus Mu50
uuuuaaaguuua

SEQ ID NO: 3965114 - RNA, 14 nt, Staphylococcus aureus subsp. aureus Mu50
uuuuaaaguuuaaa

SEQ ID NO: 3965115 - RNA, 18 nt, Staphylococcus aureus subsp. aureus Mu50
uuuuaaaguuuaaauauu

SEQ ID NO: 3965116 - RNA, 20 nt, Staphylococcus aureus subsp. aureus Mu50
uuuuaaaguuuaaauauuca

SEQ ID NO: 3965117 - RNA, 17 nt, Staphylococcus aureus subsp. aureus Mu50
uuuuauguauuuauuuu

SEQ ID NO: 3965118 - RNA, 23 nt, Staphylococcus aureus subsp. aureus Mu50
uuuuauguccagccauuaaaccu

SEQ ID NO: 3965119 - RNA, 18 nt, Staphylococcus aureus subsp. aureus Mu50
uuuuauguuuaaacauuu

SEQ ID NO: 3965120 - RNA, 20 nt, Staphylococcus aureus subsp. aureus Mu50
uuuuauguuuaaacauuuuu

SEQ ID NO: 3965121 - RNA, 14 nt, Staphylococcus aureus subsp. aureus Mu50
uuuuauguuuuaau

SEQ ID NO: 3965122 - RNA, 16 nt, Staphylococcus aureus subsp. aureus Mu50
uuuuauuaauuaaaaa

SEQ ID NO: 3965123 - RNA, 22 nt, Staphylococcus aureus subsp. aureus Mu50
uuuuauuacaaacauuccucua

SEQ ID NO: 3965124 - RNA, 22 nt, Staphylococcus aureus subsp. aureus Mu50
uuuuauuaucagcccaaucagu

SEQ ID NO: 3965125 - RNA, 20 nt, Staphylococcus aureus subsp. aureus Mu50
uuuuauucacuuuuuuuaau

SEQ ID NO: 3965126 - RNA, 15 nt, Staphylococcus aureus subsp. aureus Mu50
uuuuauuuaauuauu

SEQ ID NO: 3965127 - RNA, 16 nt, Staphylococcus aureus subsp. aureus Mu50
uuuuauuuacacacau

SEQ ID NO: 3965128 - RNA, 11 nt, Staphylococcus aureus subsp. aureus Mu50
uuuuauuuauc

SEQ ID NO: 3965129 - RNA, 13 nt, Staphylococcus aureus subsp. aureus Mu50
uuuuauuuuaacu

SEQ ID NO: 3965130 - RNA, 16 nt, Staphylococcus aureus subsp. aureus Mu50
uuuuauuuuaauauuu

SEQ ID NO: 3965131 - RNA, 13 nt, Staphylococcus aureus subsp. aureus Mu50
uuuucaaaaauag

SEQ ID NO: 3965132 - RNA, 18 nt, Staphylococcus aureus subsp. aureus Mu50
uuuucaaagcgaucauua

SEQ ID NO: 3965133 - RNA, 13 nt, Staphylococcus aureus subsp. aureus Mu50
uuuucaaauauau

SEQ ID NO: 3965134 - RNA, 18 nt, Staphylococcus aureus subsp. aureus Mu50
uuuucaacaguuuuaaag

SEQ ID NO: 3965135 - RNA, 17 nt, Staphylococcus aureus subsp. aureus Mu50
uuuucaacauaauauuu

SEQ ID NO: 3965136 - RNA, 18 nt, Staphylococcus aureus subsp. aureus Mu50
uuuucaacauaauauuuc

SEQ ID NO: 3965137 - RNA, 19 nt, Staphylococcus aureus subsp. aureus Mu50
uuuucaacauaauauuucu

SEQ ID NO: 3965138 - RNA, 16 nt, Staphylococcus aureus subsp. aureus Mu50
uuuucaacauuuuuua

SEQ ID NO: 3965139 - RNA, 18 nt, Staphylococcus aureus subsp. aureus Mu50
uuuucaagaccaaauauu

SEQ ID NO: 3965140 - RNA, 22 nt, Staphylococcus aureus subsp. aureus Mu50
uuuucaagaccaaauauuuuau

SEQ ID NO: 3965141 - RNA, 20 nt, Staphylococcus aureus subsp. aureus Mu50
uuuucaagagguuuuauuua

SEQ ID NO: 3965142 - RNA, 20 nt, Staphylococcus aureus subsp. aureus Mu50
uuuucaauaaauuuuauaua

SEQ ID NO: 3965143 - RNA, 21 nt, Staphylococcus aureus subsp. aureus Mu50
uuuucaauaauugauucucug

SEQ ID NO: 3965144 - RNA, 15 nt, Staphylococcus aureus subsp. aureus Mu50
uuuucaauauuugau

SEQ ID NO: 3965145 - RNA, 22 nt, Staphylococcus aureus subsp. aureus Mu50
uuuucaauucgcucacauguga

SEQ ID NO: 3965146 - RNA, 16 nt, Staphylococcus aureus subsp. aureus Mu50
uuuucacgaauaucuu

SEQ ID NO: 3965147 - RNA, 23 nt, Staphylococcus aureus subsp. aureus Mu50
uuuucacgaauaucuuaaagaau

SEQ ID NO: 3965148 - RNA, 22 nt, Staphylococcus aureus subsp. aureus Mu50
uuuucacuucgccaagccaucu

SEQ ID NO: 3965149 - RNA, 22 nt, Staphylococcus aureus subsp. aureus Mu50
uuuucagcuaauugucguucuu

SEQ ID NO: 3965150 - RNA, 20 nt, Staphylococcus aureus subsp. aureus Mu50
uuuucauagaacaaaaugua

SEQ ID NO: 3965151 - RNA, 17 nt, Staphylococcus aureus subsp. aureus Mu50
uuuucauagcuuuuuua

SEQ ID NO: 3965152 - RNA, 15 nt, Staphylococcus aureus subsp. aureus Mu50
uuuucaucaaucccu

SEQ ID NO: 3965153 - RNA, 12 nt, Staphylococcus aureus subsp. aureus Mu50
uuuucaucauaa

SEQ ID NO: 3965154 - RNA, 13 nt, Staphylococcus aureus subsp. aureus Mu50
uuuucaucauuua

SEQ ID NO: 3965155 - RNA, 19 nt, Staphylococcus aureus subsp. aureus Mu50
uuuucaucguucauauauu

SEQ ID NO: 3965156 - RNA, 18 nt, Staphylococcus aureus subsp. aureus Mu50
uuuucaugaaaaguugau

SEQ ID NO: 3965157 - RNA, 14 nt, Staphylococcus aureus subsp. aureus Mu50
uuuucaugauuuac

SEQ ID NO: 3965158 - RNA, 15 nt, Staphylococcus aureus subsp. aureus Mu50
uuuucauuuuaguua

SEQ ID NO: 3965159 - RNA, 23 nt, Staphylococcus aureus subsp. aureus Mu50
uuuucauuuuuaucccacuccuu

SEQ ID NO: 3965160 - RNA, 19 nt, Staphylococcus aureus subsp. aureus Mu50
uuuuccauaaauauuuaaa

SEQ ID NO: 3965161 - RNA, 22 nt, Staphylococcus aureus subsp. aureus Mu50
uuuuccuuccaauaauaaauca

SEQ ID NO: 3965162 - RNA, 18 nt, Staphylococcus aureus subsp. aureus Mu50
uuuucgaggucaucaaaa

SEQ ID NO: 3965163 - RNA, 21 nt, Staphylococcus aureus subsp. aureus Mu50
uuuucgaggucaucaaaaguu

SEQ ID NO: 3965164 - RNA, 15 nt, Staphylococcus aureus subsp. aureus Mu50
uuuucgguuuauuua

SEQ ID NO: 3965165 - RNA, 16 nt, Staphylococcus aureus subsp. aureus Mu50
uuuucuaaauaaacga

SEQ ID NO: 3965166 - RNA, 15 nt, Staphylococcus aureus subsp. aureus Mu50
uuuucuaaauauaua

SEQ ID NO: 3965167 - RNA, 21 nt, Staphylococcus aureus subsp. aureus Mu50
uuuucuaaaugauuuauucua

SEQ ID NO: 3965168 - RNA, 18 nt, Staphylococcus aureus subsp. aureus Mu50
uuuucuauaauauuuaac

SEQ ID NO: 3965169 - RNA, 23 nt, Staphylococcus aureus subsp. aureus Mu50
uuuucucaacaguuucuuggucu

SEQ ID NO: 3965170 - RNA, 15 nt, Staphylococcus aureus subsp. aureus Mu50
uuuucugcuuucgcu

SEQ ID NO: 3965171 - RNA, 20 nt, Staphylococcus aureus subsp. aureus Mu50
uuuucuuaguuugacaucua

SEQ ID NO: 3965172 - RNA, 17 nt, Staphylococcus aureus subsp. aureus Mu50
uuuucuuauaaaaaucu

SEQ ID NO: 3965173 - RNA, 16 nt, Staphylococcus aureus subsp. aureus Mu50
uuuucuuauuuauuca

SEQ ID NO: 3965174 - RNA, 22 nt, Staphylococcus aureus subsp. aureus Mu50
uuuucuugcauacgaauuaaaa

SEQ ID NO: 3965175 - RNA, 18 nt, Staphylococcus aureus subsp. aureus Mu50
uuuucuugguuugagaau

SEQ ID NO: 3965176 - RNA, 16 nt, Staphylococcus aureus subsp. aureus Mu50
uuuucuuucuuuuuua

SEQ ID NO: 3965177 - RNA, 13 nt, Staphylococcus aureus subsp. aureus Mu50
uuuucuuuuuuua

SEQ ID NO: 3965178 - RNA, 22 nt, Staphylococcus aureus subsp. aureus Mu50
uuuugaaacaucuaaauaguuu

SEQ ID NO: 3965179 - RNA, 19 nt, Staphylococcus aureus subsp. aureus Mu50
uuuugaaaccuuggcuuca

SEQ ID NO: 3965180 - RNA, 13 nt, Staphylococcus aureus subsp. aureus Mu50
uuuugaaauggua

SEQ ID NO: 3965181 - RNA, 14 nt, Staphylococcus aureus subsp. aureus Mu50
uuuugaaccuaaau

SEQ ID NO: 3965182 - RNA, 24 nt, Staphylococcus aureus subsp. aureus Mu50
uuuugaagaauaaaaaaguugauu

SEQ ID NO: 3965183 - RNA, 18 nt, Staphylococcus aureus subsp. aureus Mu50
uuuugaaguuacuauauu

SEQ ID NO: 3965184 - RNA, 12 nt, Staphylococcus aureus subsp. aureus Mu50
uuuugaauaauu

SEQ ID NO: 3965185 - RNA, 21 nt, Staphylococcus aureus subsp. aureus Mu50
uuuugaauauuugcuuuuugu

SEQ ID NO: 3965186 - RNA, 19 nt, Staphylococcus aureus subsp. aureus Mu50
uuuugaaucauacgaauuu

SEQ ID NO: 3965187 - RNA, 13 nt, Staphylococcus aureus subsp. aureus Mu50
uuuugaauuacag

SEQ ID NO: 3965188 - RNA, 17 nt, Staphylococcus aureus subsp. aureus Mu50
uuuugacauauuuuuua

SEQ ID NO: 3965189 - RNA, 20 nt, Staphylococcus aureus subsp. aureus Mu50
uuuugacuguuaaacaaggu

SEQ ID NO: 3965190 - RNA, 21 nt, Staphylococcus aureus subsp. aureus Mu50
uuuugagcacuuaauaaguca

SEQ ID NO: 3965191 - RNA, 23 nt, Staphylococcus aureus subsp. aureus Mu50
uuuugauauaaaaagugaaagua

SEQ ID NO: 3965192 - RNA, 19 nt, Staphylococcus aureus subsp. aureus Mu50
uuuugauguuuaugacaaa

SEQ ID NO: 3965193 - RNA, 20 nt, Staphylococcus aureus subsp. aureus Mu50
uuuugauuaguaaauauagu

SEQ ID NO: 3965194 - RNA, 20 nt, Staphylococcus aureus subsp. aureus Mu50
uuuugauuguuuaaacaugu

SEQ ID NO: 3965195 - RNA, 18 nt, Staphylococcus aureus subsp. aureus Mu50
uuuugauuuacgugcauu

SEQ ID NO: 3965196 - RNA, 13 nt, Staphylococcus aureus subsp. aureus Mu50
uuuugauuuauua

SEQ ID NO: 3965197 - RNA, 14 nt, Staphylococcus aureus subsp. aureus Mu50
uuuugcaaaacgca

SEQ ID NO: 3965198 - RNA, 21 nt, Staphylococcus aureus subsp. aureus Mu50
uuuugcccaugucaugaauuu

SEQ ID NO: 3965199 - RNA, 16 nt, Staphylococcus aureus subsp. aureus Mu50
uuuugcgaaaauauca

SEQ ID NO: 3965200 - RNA, 18 nt, Staphylococcus aureus subsp. aureus Mu50
uuuugcgaaaauaucauu

SEQ ID NO: 3965201 - RNA, 15 nt, Staphylococcus aureus subsp. aureus Mu50
uuuugcuaaccauca

SEQ ID NO: 3965202 - RNA, 22 nt, Staphylococcus aureus subsp. aureus Mu50
uuuugcuaaccaucauaaaugu

SEQ ID NO: 3965203 - RNA, 15 nt, Staphylococcus aureus subsp. aureus Mu50
uuuugcuauuucaac

SEQ ID NO: 3965204 - RNA, 14 nt, Staphylococcus aureus subsp. aureus Mu50
aaaaacauaaaaau

SEQ ID NO: 3965205 - RNA, 20 nt, Staphylococcus aureus subsp. aureus Mu50
aaaaacaucauuucugaagu

SEQ ID NO: 3965206 - RNA, 18 nt, Staphylococcus aureus subsp. aureus Mu50
aaaaaccgaacaucugaa

SEQ ID NO: 3965207 - RNA, 14 nt, Staphylococcus aureus subsp. aureus Mu50
aaaaaccguaauuu

SEQ ID NO: 3965208 - RNA, 18 nt, Staphylococcus aureus subsp. aureus Mu50
aaaaaccguaauuuuaau

SEQ ID NO: 3965209 - RNA, 19 nt, Staphylococcus aureus subsp. aureus Mu50
aaaaaccuagggauaauuu

SEQ ID NO: 3965210 - RNA, 17 nt, Staphylococcus aureus subsp. aureus Mu50
aaaaaccugaaacaaau

SEQ ID NO: 3965211 - RNA, 15 nt, Staphylococcus aureus subsp. aureus Mu50
aaaaacgcuuuuaaa

SEQ ID NO: 3965212 - RNA, 14 nt, Staphylococcus aureus subsp. aureus Mu50
aaaaacgguaauuu

SEQ ID NO: 3965213 - RNA, 22 nt, Staphylococcus aureus subsp. aureus Mu50
aaaaacgguaauuucuauuuau

SEQ ID NO: 3965214 - RNA, 22 nt, Staphylococcus aureus subsp. aureus Mu50
aaaaacgucgugucugaauaca

SEQ ID NO: 3965215 - RNA, 19 nt, Staphylococcus aureus subsp. aureus Mu50
aaaaacuguaaaucaucau

SEQ ID NO: 3965216 - RNA, 20 nt, Staphylococcus aureus subsp. aureus Mu50
aaaaacuucuuaacuugaaa

SEQ ID NO: 3965217 - RNA, 13 nt, Staphylococcus aureus subsp. aureus Mu50
aaaaagaacauaa

SEQ ID NO: 3965218 - RNA, 15 nt, Staphylococcus aureus subsp. aureus Mu50
aaaaagaauuucgaa

SEQ ID NO: 3965219 - RNA, 14 nt, Staphylococcus aureus subsp. aureus Mu50
aaaaagaugaaaaa

SEQ ID NO: 3965220 - RNA, 15 nt, Staphylococcus aureus subsp. aureus Mu50
aaaaagaugaaaaag

SEQ ID NO: 3965221 - RNA, 16 nt, Staphylococcus aureus subsp. aureus Mu50
aaaaagcucaauccug

SEQ ID NO: 3965222 - RNA, 20 nt, Staphylococcus aureus subsp. aureus Mu50
aaaaaggaagaacagcacau

SEQ ID NO: 3965223 - RNA, 22 nt, Staphylococcus aureus subsp. aureus Mu50
aaaaaggaugaugugaauguuu

SEQ ID NO: 3965224 - RNA, 15 nt, Staphylococcus aureus subsp. aureus Mu50
aaaaaguauuacuuu

SEQ ID NO: 3965225 - RNA, 18 nt, Staphylococcus aureus subsp. aureus Mu50
aaaaagucccgcuuaaaa

SEQ ID NO: 3965226 - RNA, 23 nt, Staphylococcus aureus subsp. aureus Mu50
aaaaagucccgcuuaaaaugauu

SEQ ID NO: 3965227 - RNA, 20 nt, Staphylococcus aureus subsp. aureus Mu50
aaaaagugaaaguauuagau

SEQ ID NO: 3965228 - RNA, 18 nt, Staphylococcus aureus subsp. aureus Mu50
aaaaagugauaauuaaaa

SEQ ID NO: 3965229 - RNA, 19 nt, Staphylococcus aureus subsp. aureus Mu50
aaaaaguuauaucaucaac

SEQ ID NO: 3965230 - RNA, 13 nt, Staphylococcus aureus subsp. aureus Mu50
aaaaaguuuaaag

SEQ ID NO: 3965231 - RNA, 14 nt, Staphylococcus aureus subsp. aureus Mu50
aaaaaguuucggaa

SEQ ID NO: 3965232 - RNA, 13 nt, Staphylococcus aureus subsp. aureus Mu50
aaaaaguuuuucu

SEQ ID NO: 3965233 - RNA, 11 nt, Staphylococcus aureus subsp. aureus Mu50
aaaaauaaaaa

SEQ ID NO: 3965234 - RNA, 16 nt, Staphylococcus aureus subsp. aureus Mu50
aaaaauaaaaccgagg

SEQ ID NO: 3965235 - RNA, 12 nt, Staphylococcus aureus subsp. aureus Mu50
aaaaauaaacca

SEQ ID NO: 3965236 - RNA, 20 nt, Staphylococcus aureus subsp. aureus Mu50
aaaaauaaagucauaugguu

SEQ ID NO: 3965237 - RNA, 20 nt, Staphylococcus aureus subsp. aureus Mu50
aaaaauaacuguaaaacauu

SEQ ID NO: 3965238 - RNA, 17 nt, Staphylococcus aureus subsp. aureus Mu50
aaaaauaauagcaaaau

SEQ ID NO: 3965239 - RNA, 12 nt, Staphylococcus aureus subsp. aureus Mu50
aaaaauaauccc

SEQ ID NO: 3965240 - RNA, 23 nt, Staphylococcus aureus subsp. aureus Mu50
aaaaauaaucccggaacuaauuu

SEQ ID NO: 3965241 - RNA, 14 nt, Staphylococcus aureus subsp. aureus Mu50
aaaaauaauuauga

SEQ ID NO: 3965242 - RNA, 19 nt, Staphylococcus aureus subsp. aureus Mu50
aaaaauaauuaugaaaagu

SEQ ID NO: 3965243 - RNA, 13 nt, Staphylococcus aureus subsp. aureus Mu50
aaaaauacauaau

SEQ ID NO: 3965244 - RNA, 21 nt, Staphylococcus aureus subsp. aureus Mu50
aaaaauagcguaauuauuaua

SEQ ID NO: 3965245 - RNA, 15 nt, Staphylococcus aureus subsp. aureus Mu50
aaaaauauauuucaa

SEQ ID NO: 3965246 - RNA, 14 nt, Staphylococcus aureus subsp. aureus Mu50
aaaaauauugaaua

SEQ ID NO: 3965247 - RNA, 14 nt, Staphylococcus aureus subsp. aureus Mu50
aaaaauauuuacau

SEQ ID NO: 3965248 - RNA, 10 nt, Staphylococcus aureus subsp. aureus Mu50
aaaaaucaaa

SEQ ID NO: 3965249 - RNA, 14 nt, Staphylococcus aureus subsp. aureus Mu50
aaaaaucaaagagg

SEQ ID NO: 3965250 - RNA, 15 nt, Staphylococcus aureus subsp. aureus Mu50
aaaaaucaaagaggc

SEQ ID NO: 3965251 - RNA, 22 nt, Staphylococcus aureus subsp. aureus Mu50
aaaaaucaguuuuuaaaucaaa

SEQ ID NO: 3965252 - RNA, 18 nt, Staphylococcus aureus subsp. aureus Mu50
aaaaaucauaaauaacac

SEQ ID NO: 3965253 - RNA, 17 nt, Staphylococcus aureus subsp. aureus Mu50
aaaaaucauccauaaaa

SEQ ID NO: 3965254 - RNA, 22 nt, Staphylococcus aureus subsp. aureus Mu50
aaaaauccggaacauuaaaagg

SEQ ID NO: 3965255 - RNA, 20 nt, Staphylococcus aureus subsp. aureus Mu50
aaaaauccucacaaauuuga

SEQ ID NO: 3965256 - RNA, 23 nt, Staphylococcus aureus subsp. aureus Mu50
aaaaaucgaauuuucaaagacgu

SEQ ID NO: 3965257 - RNA, 17 nt, Staphylococcus aureus subsp. aureus Mu50
aaaaaucggcuuucuaa

SEQ ID NO: 3965258 - RNA, 16 nt, Staphylococcus aureus subsp. aureus Mu50
aaaaaucuuuugauag

SEQ ID NO: 3965259 - RNA, 22 nt, Staphylococcus aureus subsp. aureus Mu50
aaaaaugccgagauuauuaugu

SEQ ID NO: 3965260 - RNA, 18 nt, Staphylococcus aureus subsp. aureus Mu50
aaaaaugcgcuuccaauu

SEQ ID NO: 3965261 - RNA, 19 nt, Staphylococcus aureus subsp. aureus Mu50
aaaaaugcgcuuccaauuu

SEQ ID NO: 3965262 - RNA, 17 nt, Staphylococcus aureus subsp. aureus Mu50
aaaaaugcuguuuuaug

SEQ ID NO: 3965263 - RNA, 21 nt, Staphylococcus aureus subsp. aureus Mu50
aaaaaugcuuauauaaacaaa

SEQ ID NO: 3965264 - RNA, 21 nt, Staphylococcus aureus subsp. aureus Mu50
aaaaauggcgaaaaagcuaaa

SEQ ID NO: 3965265 - RNA, 18 nt, Staphylococcus aureus subsp. aureus Mu50
aaaaauguaaauaaaaau

SEQ ID NO: 3965266 - RNA, 22 nt, Staphylococcus aureus subsp. aureus Mu50
aaaaaugucguauauguaauca

SEQ ID NO: 3965267 - RNA, 16 nt, Staphylococcus aureus subsp. aureus Mu50
aaaaaugugaccuuau

SEQ ID NO: 3965268 - RNA, 14 nt, Staphylococcus aureus subsp. aureus Mu50
aaaaauuaaaaauu

SEQ ID NO: 3965269 - RNA, 23 nt, Staphylococcus aureus subsp. aureus Mu50
aaaaauuaacuauacuuuuauag

SEQ ID NO: 3965270 - RNA, 14 nt, Staphylococcus aureus subsp. aureus Mu50
aaaaauuauuaaaa

SEQ ID NO: 3965271 - RNA, 20 nt, Staphylococcus aureus subsp. aureus Mu50
aaaaauuccuagcuuuuaug

SEQ ID NO: 3965272 - RNA, 22 nt, Staphylococcus aureus subsp. aureus Mu50
aaaaauugcuauauuaguauaa

SEQ ID NO: 3965273 - RNA, 19 nt, Staphylococcus aureus subsp. aureus Mu50
aaaaauuguucaauauuua

SEQ ID NO: 3965274 - RNA, 22 nt, Staphylococcus aureus subsp. aureus Mu50
aaaaauuguucaauauuuauca

SEQ ID NO: 3965275 - RNA, 16 nt, Staphylococcus aureus subsp. aureus Mu50
aaaaauuuaaauaaua

SEQ ID NO: 3965276 - RNA, 16 nt, Staphylococcus aureus subsp. aureus Mu50
aaaaauuuauucaaaa

SEQ ID NO: 3965277 - RNA, 18 nt, Staphylococcus aureus subsp. aureus Mu50
aaaaauuucaaaaauagc

SEQ ID NO: 3965278 - RNA, 15 nt, Staphylococcus aureus subsp. aureus Mu50
aaaacaaaaaaaccg

SEQ ID NO: 3965279 - RNA, 16 nt, Staphylococcus aureus subsp. aureus Mu50
aaaacaaaaaaaccga

SEQ ID NO: 3965280 - RNA, 15 nt, Staphylococcus aureus subsp. aureus Mu50
aaaacaaaaauaauc

SEQ ID NO: 3965281 - RNA, 13 nt, Staphylococcus aureus subsp. aureus Mu50
aaaacaaaacuug

SEQ ID NO: 3965282 - RNA, 19 nt, Staphylococcus aureus subsp. aureus Mu50
aaaacaaauuacacccuuu

SEQ ID NO: 3965283 - RNA, 21 nt, Staphylococcus aureus subsp. aureus Mu50
aaaacaauaauuuaauauuua

SEQ ID NO: 3965284 - RNA, 23 nt, Staphylococcus aureus subsp. aureus Mu50
aaaacaauaauuuaauauuuaga

SEQ ID NO: 3965285 - RNA, 13 nt, Staphylococcus aureus subsp. aureus Mu50
aaaacaauauuga

SEQ ID NO: 3965286 - RNA, 13 nt, Staphylococcus aureus subsp. aureus Mu50
aaaacaaugauua

SEQ ID NO: 3965287 - RNA, 17 nt, Staphylococcus aureus subsp. aureus Mu50
aaaacaaugauuaaaau

SEQ ID NO: 3965288 - RNA, 22 nt, Staphylococcus aureus subsp. aureus Mu50
aaaacacccugcuuaucauuac

SEQ ID NO: 3965289 - RNA, 19 nt, Staphylococcus aureus subsp. aureus Mu50
aaaacagaauuucaucaaa

SEQ ID NO: 3965290 - RNA, 18 nt, Staphylococcus aureus subsp. aureus Mu50
aaaacauaaauacaaaaa

SEQ ID NO: 3965291 - RNA, 19 nt, Staphylococcus aureus subsp. aureus Mu50
aaaaguguugacuuuauca

SEQ ID NO: 3965292 - RNA, 22 nt, Staphylococcus aureus subsp. aureus Mu50
aaaaguguugacuuuaucaauu

SEQ ID NO: 3965293 - RNA, 18 nt, Staphylococcus aureus subsp. aureus Mu50
aaaaguuauaucaucaac

SEQ ID NO: 3965294 - RNA, 19 nt, Staphylococcus aureus subsp. aureus Mu50
aaaaguugaucuacuaaag

SEQ ID NO: 3965295 - RNA, 17 nt, Staphylococcus aureus subsp. aureus Mu50
aaaaguugauuaaaagu

SEQ ID NO: 3965296 - RNA, 16 nt, Staphylococcus aureus subsp. aureus Mu50
aaaaguuguauucuga

SEQ ID NO: 3965297 - RNA, 13 nt, Staphylococcus aureus subsp. aureus Mu50
aaaaguuuaaagu

SEQ ID NO: 3965298 - RNA, 13 nt, Staphylococcus aureus subsp. aureus Mu50
aaaaguuucggaa

SEQ ID NO: 3965299 - RNA, 12 nt, Staphylococcus aureus subsp. aureus Mu50
aaaauaaaaaau

SEQ ID NO: 3965300 - RNA, 12 nt, Staphylococcus aureus subsp. aureus Mu50
aaaauaaaaacc

SEQ ID NO: 3965301 - RNA, 13 nt, Staphylococcus aureus subsp. aureus Mu50
aaaauaaaaacca

SEQ ID NO: 3965302 - RNA, 13 nt, Staphylococcus aureus subsp. aureus Mu50
aaaauaaaaacuu

SEQ ID NO: 3965303 - RNA, 13 nt, Staphylococcus aureus subsp. aureus Mu50
aaaauaaaaccga

SEQ ID NO: 3965304 - RNA, 22 nt, Staphylococcus aureus subsp. aureus Mu50
aaaauaaaaccgaggaaauccu

SEQ ID NO: 3965305 - RNA, 17 nt, Staphylococcus aureus subsp. aureus Mu50
aaaauaaaaugcaaaga

SEQ ID NO: 3965306 - RNA, 13 nt, Staphylococcus aureus subsp. aureus Mu50
aaaauaaaauuaa

SEQ ID NO: 3965307 - RNA, 13 nt, Staphylococcus aureus subsp. aureus Mu50
aaaauaaauaagc

SEQ ID NO: 3965308 - RNA, 18 nt, Staphylococcus aureus subsp. aureus Mu50
aaaauaacaacgauaauu

SEQ ID NO: 3965309 - RNA, 23 nt, Staphylococcus aureus subsp. aureus Mu50
aaaauaacauguuuguggcaccu

SEQ ID NO: 3965310 - RNA, 15 nt, Staphylococcus aureus subsp. aureus Mu50
aaaauaauagauaau

SEQ ID NO: 3965311 - RNA, 13 nt, Staphylococcus aureus subsp. aureus Mu50
aaaauaauaugaa

SEQ ID NO: 3965312 - RNA, 20 nt, Staphylococcus aureus subsp. aureus Mu50
aaaauaauuguucuucagaa

SEQ ID NO: 3965313 - RNA, 13 nt, Staphylococcus aureus subsp. aureus Mu50
aaaauaauuuuau

SEQ ID NO: 3965314 - RNA, 14 nt, Staphylococcus aureus subsp. aureus Mu50
aaaauacauaauua

SEQ ID NO: 3965315 - RNA, 17 nt, Staphylococcus aureus subsp. aureus Mu50
aaaauacauaauuaacu

SEQ ID NO: 3965316 - RNA, 21 nt, Staphylococcus aureus subsp. aureus Mu50
aaaauacgguacagauaggaa

SEQ ID NO: 3965317 - RNA, 20 nt, Staphylococcus aureus subsp. aureus Mu50
aaaauacuuuuugaugauuu

SEQ ID NO: 3965318 - RNA, 16 nt, Staphylococcus aureus subsp. aureus Mu50
aaaauagaaaaauuuc

SEQ ID NO: 3965319 - RNA, 20 nt, Staphylococcus aureus subsp. aureus Mu50
aaaauagaaaaauuucaaaa

SEQ ID NO: 3965320 - RNA, 15 nt, Staphylococcus aureus subsp. aureus Mu50
aaaauagauugaaaa

SEQ ID NO: 3965321 - RNA, 22 nt, Staphylococcus aureus subsp. aureus Mu50
aaaauagauugaaaaaauaacu

SEQ ID NO: 3965322 - RNA, 23 nt, Staphylococcus aureus subsp. aureus Mu50
aaaauagccauauucauauuacu

SEQ ID NO: 3965323 - RNA, 21 nt, Staphylococcus aureus subsp. aureus Mu50
aaaauagcguaauuauuauaa

SEQ ID NO: 3965324 - RNA, 20 nt, Staphylococcus aureus subsp. aureus Mu50
aaaauaguaaagugaaauaa

SEQ ID NO: 3965325 - RNA, 23 nt, Staphylococcus aureus subsp. aureus Mu50
aaaauagucggggccccaacaca

SEQ ID NO: 3965326 - RNA, 19 nt, Staphylococcus aureus subsp. aureus Mu50
aaaauaguucuuuaaauua

SEQ ID NO: 3965327 - RNA, 22 nt, Staphylococcus aureus subsp. aureus Mu50
aaaauaguucuuuaaauuauau

SEQ ID NO: 3965328 - RNA, 15 nt, Staphylococcus aureus subsp. aureus Mu50
aaaauauagcuauua

SEQ ID NO: 3965329 - RNA, 14 nt, Staphylococcus aureus subsp. aureus Mu50
aaaauauaugaaua

SEQ ID NO: 3965330 - RNA, 18 nt, Staphylococcus aureus subsp. aureus Mu50
aaaauaucaauuuauuau

SEQ ID NO: 3965331 - RNA, 11 nt, Staphylococcus aureus subsp. aureus Mu50
aaaauauccug

SEQ ID NO: 3965332 - RNA, 17 nt, Staphylococcus aureus subsp. aureus Mu50
aaaauaucugaaaaacc

SEQ ID NO: 3965333 - RNA, 19 nt, Staphylococcus aureus subsp. aureus Mu50
aaaauaucugaaaaaccaa

SEQ ID NO: 3965334 - RNA, 17 nt, Staphylococcus aureus subsp. aureus Mu50
aaaauaucuuuuuguuu

SEQ ID NO: 3965335 - RNA, 17 nt, Staphylococcus aureus subsp. aureus Mu50
aaaauaugacacauaca

SEQ ID NO: 3965336 - RNA, 15 nt, Staphylococcus aureus subsp. aureus Mu50
aaaauaugauuuaaa

SEQ ID NO: 3965337 - RNA, 19 nt, Staphylococcus aureus subsp. aureus Mu50
aaaauauguguuaacugau

SEQ ID NO: 3965338 - RNA, 20 nt, Staphylococcus aureus subsp. aureus Mu50
aaaauauguguuaacugaua

SEQ ID NO: 3965339 - RNA, 19 nt, Staphylococcus aureus subsp. aureus Mu50
aaaauauugcguuuaauuu

SEQ ID NO: 3965340 - RNA, 15 nt, Staphylococcus aureus subsp. aureus Mu50
aaaaucaacuuuucu

SEQ ID NO: 3965341 - RNA, 17 nt, Staphylococcus aureus subsp. aureus Mu50
aaaaucacgcuaacauu

SEQ ID NO: 3965342 - RNA, 14 nt, Staphylococcus aureus subsp. aureus Mu50
aaaaucauaaauaa

SEQ ID NO: 3965343 - RNA, 16 nt, Staphylococcus aureus subsp. aureus Mu50
aaaaucaucauuauac

SEQ ID NO: 3965344 - RNA, 21 nt, Staphylococcus aureus subsp. aureus Mu50
aaaaucauccauaaaaauacg

SEQ ID NO: 3965345 - RNA, 21 nt, Staphylococcus aureus subsp. aureus Mu50
aaaauccuaagcaucguaaaa

SEQ ID NO: 3965346 - RNA, 20 nt, Staphylococcus aureus subsp. aureus Mu50
aaaauccucacaaauuugaa

SEQ ID NO: 3965347 - RNA, 21 nt, Staphylococcus aureus subsp. aureus Mu50
aaaauccucacaaauuugaau

SEQ ID NO: 3965348 - RNA, 18 nt, Staphylococcus aureus subsp. aureus Mu50
aaaaucgcgucugauucu

SEQ ID NO: 3965349 - RNA, 21 nt, Staphylococcus aureus subsp. aureus Mu50
aaaaucgcgucugauucucua

SEQ ID NO: 3965350 - RNA, 22 nt, Staphylococcus aureus subsp. aureus Mu50
aaaaucgcgucugauucucuaa

SEQ ID NO: 3965351 - RNA, 19 nt, Staphylococcus aureus subsp. aureus Mu50
aaaaucggauuaacauuau

SEQ ID NO: 3965352 - RNA, 17 nt, Staphylococcus aureus subsp. aureus Mu50
aaaaucucauaauaauu

SEQ ID NO: 3965353 - RNA, 12 nt, Staphylococcus aureus subsp. aureus Mu50
aaaaucuuuacu

SEQ ID NO: 3965354 - RNA, 17 nt, Staphylococcus aureus subsp. aureus Mu50
aaaaugaagaauacaaa

SEQ ID NO: 3965355 - RNA, 13 nt, Staphylococcus aureus subsp. aureus Mu50
aaaaugaauaauu

SEQ ID NO: 3965356 - RNA, 20 nt, Staphylococcus aureus subsp. aureus Mu50
aaaaugaauaauugcuaaaa

SEQ ID NO: 3965357 - RNA, 24 nt, Staphylococcus aureus subsp. aureus Mu50
aaaaugaauaauugcuaaaauauc

SEQ ID NO: 3965358 - RNA, 13 nt, Staphylococcus aureus subsp. aureus Mu50
aaaaugaauagua

SEQ ID NO: 3965359 - RNA, 16 nt, Staphylococcus aureus subsp. aureus Mu50
aaaaugacgauacgua

SEQ ID NO: 3965360 - RNA, 19 nt, Staphylococcus aureus subsp. aureus Mu50
aaaaugacgugcuuuuaaa

SEQ ID NO: 3965361 - RNA, 14 nt, Staphylococcus aureus subsp. aureus Mu50
aaaaugaguacaac

SEQ ID NO: 3965362 - RNA, 19 nt, Staphylococcus aureus subsp. aureus Mu50
aaaaugauagcuaaacauu

SEQ ID NO: 3965363 - RNA, 21 nt, Staphylococcus aureus subsp. aureus Mu50
aaaaugauagcuaaacauuuu

SEQ ID NO: 3965364 - RNA, 13 nt, Staphylococcus aureus subsp. aureus Mu50
aaaaugauaucug

SEQ ID NO: 3965365 - RNA, 14 nt, Staphylococcus aureus subsp. aureus Mu50
aaaaugaugcacua

SEQ ID NO: 3965366 - RNA, 23 nt, Staphylococcus aureus subsp. aureus Mu50
aaaaugauguaacguuucuuugu

SEQ ID NO: 3965367 - RNA, 21 nt, Staphylococcus aureus subsp. aureus Mu50
aaaaugauucuuaucuuuaau

SEQ ID NO: 3965368 - RNA, 22 nt, Staphylococcus aureus subsp. aureus Mu50
aaaaugauuguuuuaaguggga

SEQ ID NO: 3965369 - RNA, 18 nt, Staphylococcus aureus subsp. aureus Mu50
aaaaugccaacuauaccu

SEQ ID NO: 3965370 - RNA, 23 nt, Staphylococcus aureus subsp. aureus Mu50
aaaaugcgcuuccaauuuaaaau

SEQ ID NO: 3965371 - RNA, 20 nt, Staphylococcus aureus subsp. aureus Mu50
aaaaugcucaaguugauuau

SEQ ID NO: 3965372 - RNA, 21 nt, Staphylococcus aureus subsp. aureus Mu50
aaaaugcucaaguugauuauu

SEQ ID NO: 3965373 - RNA, 14 nt, Staphylococcus aureus subsp. aureus Mu50
aaaauggauuuggu

SEQ ID NO: 3965374 - RNA, 18 nt, Staphylococcus aureus subsp. aureus Mu50
aaaauggugcgaauaaua

SEQ ID NO: 3965375 - RNA, 20 nt, Staphylococcus aureus subsp. aureus Mu50
aaaaugucauuugaauccaa

SEQ ID NO: 3965376 - RNA, 16 nt, Staphylococcus aureus subsp. aureus Mu50
aaaauguuaauaauga

SEQ ID NO: 3965377 - RNA, 20 nt, Staphylococcus aureus subsp. aureus Mu50
aaaauguuaauaaugacuga

SEQ ID NO: 3965378 - RNA, 13 nt, Staphylococcus aureus subsp. aureus Mu50
aaacauuuuauac

SEQ ID NO: 3965379 - RNA, 23 nt, Staphylococcus aureus subsp. aureus Mu50
aaacauuuugugacuuuguucau

SEQ ID NO: 3965380 - RNA, 16 nt, Staphylococcus aureus subsp. aureus Mu50
aaacauuuuuagaauc

SEQ ID NO: 3965381 - RNA, 18 nt, Staphylococcus aureus subsp. aureus Mu50
aaacauuuuuagaaucaa

SEQ ID NO: 3965382 - RNA, 15 nt, Staphylococcus aureus subsp. aureus Mu50
aaaccaaaaaaucca

SEQ ID NO: 3965383 - RNA, 12 nt, Staphylococcus aureus subsp. aureus Mu50
aaaccaacaauu

SEQ ID NO: 3965384 - RNA, 20 nt, Staphylococcus aureus subsp. aureus Mu50
aaaccaauaauccgagucau

SEQ ID NO: 3965385 - RNA, 13 nt, Staphylococcus aureus subsp. aureus Mu50
aaaccaauauuuc

SEQ ID NO: 3965386 - RNA, 13 nt, Staphylococcus aureus subsp. aureus Mu50
aaaccaauuuuaa

SEQ ID NO: 3965387 - RNA, 14 nt, Staphylococcus aureus subsp. aureus Mu50
aaaccaauuuuaac

SEQ ID NO: 3965388 - RNA, 15 nt, Staphylococcus aureus subsp. aureus Mu50
aaaccaauuuuaacu

SEQ ID NO: 3965389 - RNA, 17 nt, Staphylococcus aureus subsp. aureus Mu50
aaaccaccaaaaaucau

SEQ ID NO: 3965390 - RNA, 20 nt, Staphylococcus aureus subsp. aureus Mu50
aaaccaccaaaaaucaucca

SEQ ID NO: 3965391 - RNA, 15 nt, Staphylococcus aureus subsp. aureus Mu50
aaaccauagauaauu

SEQ ID NO: 3965392 - RNA, 20 nt, Staphylococcus aureus subsp. aureus Mu50
aaacccuuuaaacauauuua

SEQ ID NO: 3965393 - RNA, 18 nt, Staphylococcus aureus subsp. aureus Mu50
aaaccgagaaucuccauu

SEQ ID NO: 3965394 - RNA, 12 nt, Staphylococcus aureus subsp. aureus Mu50
aaaccgauuaau

SEQ ID NO: 3965395 - RNA, 23 nt, Staphylococcus aureus subsp. aureus Mu50
aaaccgcacuucuauauuaauag

SEQ ID NO: 3965396 - RNA, 13 nt, Staphylococcus aureus subsp. aureus Mu50
aaaccgcuauaaa

SEQ ID NO: 3965397 - RNA, 16 nt, Staphylococcus aureus subsp. aureus Mu50
aaaccguaauuuuaau

SEQ ID NO: 3965398 - RNA, 16 nt, Staphylococcus aureus subsp. aureus Mu50
aaaccguuauauauua

SEQ ID NO: 3965399 - RNA, 17 nt, Staphylococcus aureus subsp. aureus Mu50
aaaccuaaugcuuuaau

SEQ ID NO: 3965400 - RNA, 20 nt, Staphylococcus aureus subsp. aureus Mu50
aaaccuaaugcuuuaauaaa

SEQ ID NO: 3965401 - RNA, 16 nt, Staphylococcus aureus subsp. aureus Mu50
aaaccuaucaucaauc

SEQ ID NO: 3965402 - RNA, 17 nt, Staphylococcus aureus subsp. aureus Mu50
aaaccucuaaauaaaau

SEQ ID NO: 3965403 - RNA, 20 nt, Staphylococcus aureus subsp. aureus Mu50
aaaccucuaaauaaaauuaa

SEQ ID NO: 3965404 - RNA, 14 nt, Staphylococcus aureus subsp. aureus Mu50
aaaccuuacccaaa

SEQ ID NO: 3965405 - RNA, 23 nt, Staphylococcus aureus subsp. aureus Mu50
aaaccuucaaucaacgagucaua

SEQ ID NO: 3965406 - RNA, 20 nt, Staphylococcus aureus subsp. aureus Mu50
aaaccuuguuuuacaagguu

SEQ ID NO: 3965407 - RNA, 20 nt, Staphylococcus aureus subsp. aureus Mu50
aaaccuuugguucaaucauu

SEQ ID NO: 3965408 - RNA, 18 nt, Staphylococcus aureus subsp. aureus Mu50
aaaccuuuucaaauuaua

SEQ ID NO: 3965409 - RNA, 13 nt, Staphylococcus aureus subsp. aureus Mu50
aaacgacucauua

SEQ ID NO: 3965410 - RNA, 20 nt, Staphylococcus aureus subsp. aureus Mu50
aaacgagcuggugagaaauu

SEQ ID NO: 3965411 - RNA, 21 nt, Staphylococcus aureus subsp. aureus Mu50
aaacgauaagaauuaacaaca

SEQ ID NO: 3965412 - RNA, 16 nt, Staphylococcus aureus subsp. aureus Mu50
aaacgauacugcuuug

SEQ ID NO: 3965413 - RNA, 15 nt, Staphylococcus aureus subsp. aureus Mu50
aaacgauauagaccg

SEQ ID NO: 3965414 - RNA, 22 nt, Staphylococcus aureus subsp. aureus Mu50
aaacgauauagaccguugaaau

SEQ ID NO: 3965415 - RNA, 16 nt, Staphylococcus aureus subsp. aureus Mu50
aaacgauucauuauau

SEQ ID NO: 3965416 - RNA, 19 nt, Staphylococcus aureus subsp. aureus Mu50
aaacgauucauuauauggu

SEQ ID NO: 3965417 - RNA, 22 nt, Staphylococcus aureus subsp. aureus Mu50
aaacgauugauuaucauaugaa

SEQ ID NO: 3965418 - RNA, 21 nt, Staphylococcus aureus subsp. aureus Mu50
aaacgcaauacgaauaucugu

SEQ ID NO: 3965419 - RNA, 15 nt, Staphylococcus aureus subsp. aureus Mu50
aaacgccucaacacu

SEQ ID NO: 3965420 - RNA, 17 nt, Staphylococcus aureus subsp. aureus Mu50
aaacgccucaacacuuu

SEQ ID NO: 3965421 - RNA, 14 nt, Staphylococcus aureus subsp. aureus Mu50
aaacgccuuuccau

SEQ ID NO: 3965422 - RNA, 16 nt, Staphylococcus aureus subsp. aureus Mu50
aaacgccuuuccauug

SEQ ID NO: 3965423 - RNA, 17 nt, Staphylococcus aureus subsp. aureus Mu50
aaacgcugauuuuauaa

SEQ ID NO: 3965424 - RNA, 20 nt, Staphylococcus aureus subsp. aureus Mu50
aaacgguacagauaagaaua

SEQ ID NO: 3965425 - RNA, 14 nt, Staphylococcus aureus subsp. aureus Mu50
aaacguacauuuuu

SEQ ID NO: 3965426 - RNA, 17 nt, Staphylococcus aureus subsp. aureus Mu50
aaacguacauuuuuaug

SEQ ID NO: 3965427 - RNA, 22 nt, Staphylococcus aureus subsp. aureus Mu50
aaacguaucauuuaaaauauuu

SEQ ID NO: 3965428 - RNA, 13 nt, Staphylococcus aureus subsp. aureus Mu50
aaacguauguaca

SEQ ID NO: 3965429 - RNA, 22 nt, Staphylococcus aureus subsp. aureus Mu50
aaacgucacuuuauuaaauaac

SEQ ID NO: 3965430 - RNA, 15 nt, Staphylococcus aureus subsp. aureus Mu50
aaacgugacauuuuc

SEQ ID NO: 3965431 - RNA, 17 nt, Staphylococcus aureus subsp. aureus Mu50
aaacgugacauuuucaa

SEQ ID NO: 3965432 - RNA, 21 nt, Staphylococcus aureus subsp. aureus Mu50
aaacgugcaaauaaaaaaguu

SEQ ID NO: 3965433 - RNA, 22 nt, Staphylococcus aureus subsp. aureus Mu50
aaacguugaguauuacuugaaa

SEQ ID NO: 3965434 - RNA, 12 nt, Staphylococcus aureus subsp. aureus Mu50
aaacguuuaauu

SEQ ID NO: 3965435 - RNA, 18 nt, Staphylococcus aureus subsp. aureus Mu50
aaacuaaagguauucuau

SEQ ID NO: 3965436 - RNA, 15 nt, Staphylococcus aureus subsp. aureus Mu50
aaacuaaguuauuua

SEQ ID NO: 3965437 - RNA, 22 nt, Staphylococcus aureus subsp. aureus Mu50
aaacuaauaauuuguaauuccu

SEQ ID NO: 3965438 - RNA, 12 nt, Staphylococcus aureus subsp. aureus Mu50
aaacuaauagca

SEQ ID NO: 3965439 - RNA, 13 nt, Staphylococcus aureus subsp. aureus Mu50
aaacuaaucaaau

SEQ ID NO: 3965440 - RNA, 15 nt, Staphylococcus aureus subsp. aureus Mu50
aaacuacauuugguu

SEQ ID NO: 3965441 - RNA, 15 nt, Staphylococcus aureus subsp. aureus Mu50
aaacuagaaaacaua

SEQ ID NO: 3965442 - RNA, 18 nt, Staphylococcus aureus subsp. aureus Mu50
aaacuagcaguaauaugu

SEQ ID NO: 3965443 - RNA, 18 nt, Staphylococcus aureus subsp. aureus Mu50
aaacuauaauaauuggaa

SEQ ID NO: 3965444 - RNA, 22 nt, Staphylococcus aureus subsp. aureus Mu50
aaacuauuaucgaagaaacauu

SEQ ID NO: 3965445 - RNA, 15 nt, Staphylococcus aureus subsp. aureus Mu50
aaacucauacaaauu

SEQ ID NO: 3965446 - RNA, 23 nt, Staphylococcus aureus subsp. aureus Mu50
aaacucauaccaaaaacauuaac

SEQ ID NO: 3965447 - RNA, 23 nt, Staphylococcus aureus subsp. aureus Mu50
aaacucauccauugaucuuuuau

SEQ ID NO: 3965448 - RNA, 20 nt, Staphylococcus aureus subsp. aureus Mu50
aaacucaugcauaagaaaua

SEQ ID NO: 3965449 - RNA, 18 nt, Staphylococcus aureus subsp. aureus Mu50
aaacucguaaauuuuauc

SEQ ID NO: 3965450 - RNA, 22 nt, Staphylococcus aureus subsp. aureus Mu50
aaacucguaaauuuuaucuaaa

SEQ ID NO: 3965451 - RNA, 22 nt, Staphylococcus aureus subsp. aureus Mu50
aaacucguugcacucuuuucuc

SEQ ID NO: 3965452 - RNA, 14 nt, Staphylococcus aureus subsp. aureus Mu50
aaacucuaaaaguu

SEQ ID NO: 3965453 - RNA, 10 nt, Staphylococcus aureus subsp. aureus Mu50
aaacucucua

SEQ ID NO: 3965454 - RNA, 20 nt, Staphylococcus aureus subsp. aureus Mu50
aaacugauugggcugauaau

SEQ ID NO: 3965455 - RNA, 17 nt, Staphylococcus aureus subsp. aureus Mu50
aaacugugcaugacgau

SEQ ID NO: 3965456 - RNA, 13 nt, Staphylococcus aureus subsp. aureus Mu50
aaacuuaaaacua

SEQ ID NO: 3965457 - RNA, 23 nt, Staphylococcus aureus subsp. aureus Mu50
aaacuuaaauauucuuaucugua

SEQ ID NO: 3965458 - RNA, 14 nt, Staphylococcus aureus subsp. aureus Mu50
aaacuuaagaauac

SEQ ID NO: 3965459 - RNA, 19 nt, Staphylococcus aureus subsp. aureus Mu50
aaacuuaagaauacaugac

SEQ ID NO: 3965460 - RNA, 23 nt, Staphylococcus aureus subsp. aureus Mu50
aaacuuacauuacauauaucaac

SEQ ID NO: 3965461 - RNA, 21 nt, Staphylococcus aureus subsp. aureus Mu50
aaacuuauuaauuaauagaga

SEQ ID NO: 3965462 - RNA, 14 nt, Staphylococcus aureus subsp. aureus Mu50
aaacuuauuugcca

SEQ ID NO: 3965463 - RNA, 15 nt, Staphylococcus aureus subsp. aureus Mu50
aaacuucacaucaug

SEQ ID NO: 3965464 - RNA, 16 nt, Staphylococcus aureus subsp. aureus Mu50
aaacuucuaucacacg

SEQ ID NO: 3965465 - RNA, 16 nt, Staphylococcus aureus subsp. aureus Mu50
aaagcuuuuuugcuuu

SEQ ID NO: 3965466 - RNA, 21 nt, Staphylococcus aureus subsp. aureus Mu50
aaagcuuuuuugcuuuuauaa

SEQ ID NO: 3965467 - RNA, 16 nt, Staphylococcus aureus subsp. aureus Mu50
aaaggaaaucaaucca

SEQ ID NO: 3965468 - RNA, 20 nt, Staphylococcus aureus subsp. aureus Mu50
aaaggaaauggcuccauuua

SEQ ID NO: 3965469 - RNA, 20 nt, Staphylococcus aureus subsp. aureus Mu50
aaaggaaggauuuuagauuu

SEQ ID NO: 3965470 - RNA, 16 nt, Staphylococcus aureus subsp. aureus Mu50
aaaggaccacuuagau

SEQ ID NO: 3965471 - RNA, 14 nt, Staphylococcus aureus subsp. aureus Mu50
aaaggacuuaguag

SEQ ID NO: 3965472 - RNA, 21 nt, Staphylococcus aureus subsp. aureus Mu50
aaaggaggagauuguuauuau

SEQ ID NO: 3965473 - RNA, 22 nt, Staphylococcus aureus subsp. aureus Mu50
aaaggaggagauuguuauuaua

SEQ ID NO: 3965474 - RNA, 18 nt, Staphylococcus aureus subsp. aureus Mu50
aaaggaugugacaaauac

SEQ ID NO: 3965475 - RNA, 14 nt, Staphylococcus aureus subsp. aureus Mu50
aaaggauuauuaac

SEQ ID NO: 3965476 - RNA, 21 nt, Staphylococcus aureus subsp. aureus Mu50
aaaggauuauuaacuuuaaua

SEQ ID NO: 3965477 - RNA, 16 nt, Staphylococcus aureus subsp. aureus Mu50
aaaggcauaauaacca

SEQ ID NO: 3965478 - RNA, 15 nt, Staphylococcus aureus subsp. aureus Mu50
aaaggcauucuucca

SEQ ID NO: 3965479 - RNA, 18 nt, Staphylococcus aureus subsp. aureus Mu50
aaaggcucauuuguuaaa

SEQ ID NO: 3965480 - RNA, 17 nt, Staphylococcus aureus subsp. aureus Mu50
aaagggcuauuugauac

SEQ ID NO: 3965481 - RNA, 16 nt, Staphylococcus aureus subsp. aureus Mu50
aaagguaacuuuuuaa

SEQ ID NO: 3965482 - RNA, 19 nt, Staphylococcus aureus subsp. aureus Mu50
aaagguauucaaauaaaca

SEQ ID NO: 3965483 - RNA, 18 nt, Staphylococcus aureus subsp. aureus Mu50
aaagguauucuauuuuuc

SEQ ID NO: 3965484 - RNA, 21 nt, Staphylococcus aureus subsp. aureus Mu50
aaaggucaaaaaauuaaucaa

SEQ ID NO: 3965485 - RNA, 12 nt, Staphylococcus aureus subsp. aureus Mu50
aaaggucaucug

SEQ ID NO: 3965486 - RNA, 21 nt, Staphylococcus aureus subsp. aureus Mu50
aaaggucuauguacaauaauu

SEQ ID NO: 3965487 - RNA, 20 nt, Staphylococcus aureus subsp. aureus Mu50
aaagguuguuuuucaucauu

SEQ ID NO: 3965488 - RNA, 21 nt, Staphylococcus aureus subsp. aureus Mu50
aaagguuuacuauuaaaggaa

SEQ ID NO: 3965489 - RNA, 15 nt, Staphylococcus aureus subsp. aureus Mu50
aaaguaaauuacagu

SEQ ID NO: 3965490 - RNA, 13 nt, Staphylococcus aureus subsp. aureus Mu50
aaaguaacauacu

SEQ ID NO: 3965491 - RNA, 21 nt, Staphylococcus aureus subsp. aureus Mu50
aaaguaacauacuauaaaaau

SEQ ID NO: 3965492 - RNA, 16 nt, Staphylococcus aureus subsp. aureus Mu50
aaaguaaguaaaauaa

SEQ ID NO: 3965493 - RNA, 20 nt, Staphylococcus aureus subsp. aureus Mu50
aaaguaauaaguaauaauuu

SEQ ID NO: 3965494 - RNA, 22 nt, Staphylococcus aureus subsp. aureus Mu50
aaaguaauaugagugaaaguuu

SEQ ID NO: 3965495 - RNA, 14 nt, Staphylococcus aureus subsp. aureus Mu50
aaaguaauuaaaua

SEQ ID NO: 3965496 - RNA, 19 nt, Staphylococcus aureus subsp. aureus Mu50
aaaguacaaguugaucaaa

SEQ ID NO: 3965497 - RNA, 23 nt, Staphylococcus aureus subsp. aureus Mu50
aaaguacaaguugaucaaaaaug

SEQ ID NO: 3965498 - RNA, 16 nt, Staphylococcus aureus subsp. aureus Mu50
aaaguaccuaaaauag

SEQ ID NO: 3965499 - RNA, 17 nt, Staphylococcus aureus subsp. aureus Mu50
aaaguaccuaaaauaga

SEQ ID NO: 3965500 - RNA, 22 nt, Staphylococcus aureus subsp. aureus Mu50
aaaguaccuaaaauagaaaaau

SEQ ID NO: 3965501 - RNA, 16 nt, Staphylococcus aureus subsp. aureus Mu50
aaaguagaauuauuua

SEQ ID NO: 3965502 - RNA, 18 nt, Staphylococcus aureus subsp. aureus Mu50
aaaguagaauuauuuaga

SEQ ID NO: 3965503 - RNA, 19 nt, Staphylococcus aureus subsp. aureus Mu50
aaaguagaauuauuuagaa

SEQ ID NO: 3965504 - RNA, 16 nt, Staphylococcus aureus subsp. aureus Mu50
aaaguagacauugaaa

SEQ ID NO: 3965505 - RNA, 22 nt, Staphylococcus aureus subsp. aureus Mu50
aaaguagguacacauguacguu

SEQ ID NO: 3965506 - RNA, 12 nt, Staphylococcus aureus subsp. aureus Mu50
aaaguauaaggu

SEQ ID NO: 3965507 - RNA, 13 nt, Staphylococcus aureus subsp. aureus Mu50
aaaguauauugcu

SEQ ID NO: 3965508 - RNA, 15 nt, Staphylococcus aureus subsp. aureus Mu50
aaaguaucagucauu

SEQ ID NO: 3965509 - RNA, 18 nt, Staphylococcus aureus subsp. aureus Mu50
aaaguaucuaugaaauuu

SEQ ID NO: 3965510 - RNA, 15 nt, Staphylococcus aureus subsp. aureus Mu50
aaaguauuacuuuau

SEQ ID NO: 3965511 - RNA, 13 nt, Staphylococcus aureus subsp. aureus Mu50
aaagucaacaauu

SEQ ID NO: 3965512 - RNA, 16 nt, Staphylococcus aureus subsp. aureus Mu50
aaagucaauuuaaaua

SEQ ID NO: 3965513 - RNA, 20 nt, Staphylococcus aureus subsp. aureus Mu50
aaagucagcuuacaauaaug

SEQ ID NO: 3965514 - RNA, 20 nt, Staphylococcus aureus subsp. aureus Mu50
aaagucauacuuaugagcaa

SEQ ID NO: 3965515 - RNA, 15 nt, Staphylococcus aureus subsp. aureus Mu50
aaagucauuaaaugu

SEQ ID NO: 3965516 - RNA, 17 nt, Staphylococcus aureus subsp. aureus Mu50
aaagucauuaaauguac

SEQ ID NO: 3965517 - RNA, 14 nt, Staphylococcus aureus subsp. aureus Mu50
aaagucgucucaau

SEQ ID NO: 3965518 - RNA, 17 nt, Staphylococcus aureus subsp. aureus Mu50
aaagucguuguugaaau

SEQ ID NO: 3965519 - RNA, 21 nt, Staphylococcus aureus subsp. aureus Mu50
aaagucguuguugaaauuaaa

SEQ ID NO: 3965520 - RNA, 22 nt, Staphylococcus aureus subsp. aureus Mu50
aaagucguuguugaaauuaaau

SEQ ID NO: 3965521 - RNA, 13 nt, Staphylococcus aureus subsp. aureus Mu50
aaagucuuuaaua

SEQ ID NO: 3965522 - RNA, 15 nt, Staphylococcus aureus subsp. aureus Mu50
aaagugaaaguauua

SEQ ID NO: 3965523 - RNA, 13 nt, Staphylococcus aureus subsp. aureus Mu50
aaagugaauauua

SEQ ID NO: 3965524 - RNA, 14 nt, Staphylococcus aureus subsp. aureus Mu50
aaagugauaauuaa

SEQ ID NO: 3965525 - RNA, 16 nt, Staphylococcus aureus subsp. aureus Mu50
aaagugauaauuaaaa

SEQ ID NO: 3965526 - RNA, 14 nt, Staphylococcus aureus subsp. aureus Mu50
aaagugcaauuauu

SEQ ID NO: 3965527 - RNA, 17 nt, Staphylococcus aureus subsp. aureus Mu50
aaagugcauauuuaaua

SEQ ID NO: 3965528 - RNA, 14 nt, Staphylococcus aureus subsp. aureus Mu50
aaagugguuuuacu

SEQ ID NO: 3965529 - RNA, 21 nt, Staphylococcus aureus subsp. aureus Mu50
aaagugguuuuacugcuucaa

SEQ ID NO: 3965530 - RNA, 16 nt, Staphylococcus aureus subsp. aureus Mu50
aaaguguugacuuuau

SEQ ID NO: 3965531 - RNA, 17 nt, Staphylococcus aureus subsp. aureus Mu50
aaaguuauaaauuauau

SEQ ID NO: 3965532 - RNA, 19 nt, Staphylococcus aureus subsp. aureus Mu50
aaaguuauaucaucaacaa

SEQ ID NO: 3965533 - RNA, 21 nt, Staphylococcus aureus subsp. aureus Mu50
aaaguuaucugcuuuucuauu

SEQ ID NO: 3965534 - RNA, 21 nt, Staphylococcus aureus subsp. aureus Mu50
aaaguucguaauugucuuuau

SEQ ID NO: 3965535 - RNA, 15 nt, Staphylococcus aureus subsp. aureus Mu50
aaaguugacaauaca

SEQ ID NO: 3965536 - RNA, 18 nt, Staphylococcus aureus subsp. aureus Mu50
aaaguugacaauacaaau

SEQ ID NO: 3965537 - RNA, 16 nt, Staphylococcus aureus subsp. aureus Mu50
aaaguugauuaaaagu

SEQ ID NO: 3965538 - RNA, 21 nt, Staphylococcus aureus subsp. aureus Mu50
aaaguugcacuugguucauaa

SEQ ID NO: 3965539 - RNA, 16 nt, Staphylococcus aureus subsp. aureus Mu50
aaaguuguaauuuaaa

SEQ ID NO: 3965540 - RNA, 18 nt, Staphylococcus aureus subsp. aureus Mu50
aaaguuguaauuuaaaau

SEQ ID NO: 3965541 - RNA, 16 nt, Staphylococcus aureus subsp. aureus Mu50
aaaguuguauucugaa

SEQ ID NO: 3965542 - RNA, 20 nt, Staphylococcus aureus subsp. aureus Mu50
aaaguuguauucugaaacuu

SEQ ID NO: 3965543 - RNA, 21 nt, Staphylococcus aureus subsp. aureus Mu50
aaaguuuaauugcuguaaaua

SEQ ID NO: 3965544 - RNA, 17 nt, Staphylococcus aureus subsp. aureus Mu50
aaaguuuauuuauguuc

SEQ ID NO: 3965545 - RNA, 11 nt, Staphylococcus aureus subsp. aureus Mu50
aaaguuuucau

SEQ ID NO: 3965546 - RNA, 21 nt, Staphylococcus aureus subsp. aureus Mu50
aaaguuuucauuuaacaugua

SEQ ID NO: 3965547 - RNA, 22 nt, Staphylococcus aureus subsp. aureus Mu50
aaaguuuugaaccuaaauucca

SEQ ID NO: 3965548 - RNA, 14 nt, Staphylococcus aureus subsp. aureus Mu50
aaaguuuuugucuu

SEQ ID NO: 3965549 - RNA, 17 nt, Staphylococcus aureus subsp. aureus Mu50
aaaguuuuugucuuaau

SEQ ID NO: 3965550 - RNA, 16 nt, Staphylococcus aureus subsp. aureus Mu50
aaaguuuuuuacuuuu

SEQ ID NO: 3965551 - RNA, 15 nt, Staphylococcus aureus subsp. aureus Mu50
aaauaaaaaaaugau

SEQ ID NO: 3965552 - RNA, 13 nt, Staphylococcus aureus subsp. aureus Mu50
aaauaaaaaauaa

SEQ ID NO: 3965553 - RNA, 22 nt, Staphylococcus aureus subsp. aureus Mu50
aaauagcugcaaucguugaaaa

SEQ ID NO: 3965554 - RNA, 21 nt, Staphylococcus aureus subsp. aureus Mu50
aaauagcuguuugauauugag

SEQ ID NO: 3965555 - RNA, 22 nt, Staphylococcus aureus subsp. aureus Mu50
aaauaggcgcuuguaaaauuuu

SEQ ID NO: 3965556 - RNA, 16 nt, Staphylococcus aureus subsp. aureus Mu50
aaauaguaaagugaaa

SEQ ID NO: 3965557 - RNA, 14 nt, Staphylococcus aureus subsp. aureus Mu50
aaauaguaagguuu

SEQ ID NO: 3965558 - RNA, 15 nt, Staphylococcus aureus subsp. aureus Mu50
aaauagugauugcuu

SEQ ID NO: 3965559 - RNA, 18 nt, Staphylococcus aureus subsp. aureus Mu50
aaauaguuaagauuuuaa

SEQ ID NO: 3965560 - RNA, 19 nt, Staphylococcus aureus subsp. aureus Mu50
aaauaguucaaaauacuca

SEQ ID NO: 3965561 - RNA, 19 nt, Staphylococcus aureus subsp. aureus Mu50
aaauaguucuuuaaauuau

SEQ ID NO: 3965562 - RNA, 20 nt, Staphylococcus aureus subsp. aureus Mu50
aaauaguucuuuaaauuaua

SEQ ID NO: 3965563 - RNA, 21 nt, Staphylococcus aureus subsp. aureus Mu50
aaauaguucuuuaaauuauau

SEQ ID NO: 3965564 - RNA, 20 nt, Staphylococcus aureus subsp. aureus Mu50
aaauaguuuuucauauucac

SEQ ID NO: 3965565 - RNA, 12 nt, Staphylococcus aureus subsp. aureus Mu50
aaauauaaauuu

SEQ ID NO: 3965566 - RNA, 16 nt, Staphylococcus aureus subsp. aureus Mu50
aaauauaaccuaaaaa

SEQ ID NO: 3965567 - RNA, 20 nt, Staphylococcus aureus subsp. aureus Mu50
aaauauaauagaaauaauca

SEQ ID NO: 3965568 - RNA, 21 nt, Staphylococcus aureus subsp. aureus Mu50
aaauauaauagaaauaaucac

SEQ ID NO: 3965569 - RNA, 12 nt, Staphylococcus aureus subsp. aureus Mu50
aaauauaaugau

SEQ ID NO: 3965570 - RNA, 17 nt, Staphylococcus aureus subsp. aureus Mu50
aaauauaauguauaaaa

SEQ ID NO: 3965571 - RNA, 19 nt, Staphylococcus aureus subsp. aureus Mu50
aaauauaauguauaaaaca

SEQ ID NO: 3965572 - RNA, 16 nt, Staphylococcus aureus subsp. aureus Mu50
aaauauaccaaccaaa

SEQ ID NO: 3965573 - RNA, 19 nt, Staphylococcus aureus subsp. aureus Mu50
aaauauaccaaccaaaacc

SEQ ID NO: 3965574 - RNA, 17 nt, Staphylococcus aureus subsp. aureus Mu50
aaauauaguaauaaaag

SEQ ID NO: 3965575 - RNA, 18 nt, Staphylococcus aureus subsp. aureus Mu50
aaauauaguaauaaaagu

SEQ ID NO: 3965576 - RNA, 17 nt, Staphylococcus aureus subsp. aureus Mu50
aaauauaguaauuguua

SEQ ID NO: 3965577 - RNA, 15 nt, Staphylococcus aureus subsp. aureus Mu50
aaauauaguuaaagu

SEQ ID NO: 3965578 - RNA, 22 nt, Staphylococcus aureus subsp. aureus Mu50
aaauauauaaggcgcucucuuu

SEQ ID NO: 3965579 - RNA, 23 nt, Staphylococcus aureus subsp. aureus Mu50
aaauauauaaggcgcucucuuuu

SEQ ID NO: 3965580 - RNA, 20 nt, Staphylococcus aureus subsp. aureus Mu50
aaauauaucaacguuaauau

SEQ ID NO: 3965581 - RNA, 23 nt, Staphylococcus aureus subsp. aureus Mu50
aaauauaucuaauacuuucacuu

SEQ ID NO: 3965582 - RNA, 22 nt, Staphylococcus aureus subsp. aureus Mu50
aaauauauugcacauaaaaaau

SEQ ID NO: 3965583 - RNA, 12 nt, Staphylococcus aureus subsp. aureus Mu50
aaauauauuguc

SEQ ID NO: 3965584 - RNA, 19 nt, Staphylococcus aureus subsp. aureus Mu50
aaauaucaaaauauaaaau

SEQ ID NO: 3965585 - RNA, 18 nt, Staphylococcus aureus subsp. aureus Mu50
aaauaucaguaauaauac

SEQ ID NO: 3965586 - RNA, 15 nt, Staphylococcus aureus subsp. aureus Mu50
aaauaucauaaaugc

SEQ ID NO: 3965587 - RNA, 15 nt, Staphylococcus aureus subsp. aureus Mu50
aaauaucaugcaaaa

SEQ ID NO: 3965588 - RNA, 19 nt, Staphylococcus aureus subsp. aureus Mu50
aaauaucaugcaaaacuaa

SEQ ID NO: 3965589 - RNA, 20 nt, Staphylococcus aureus subsp. aureus Mu50
aaauauccuggaauauuaac

SEQ ID NO: 3965590 - RNA, 19 nt, Staphylococcus aureus subsp. aureus Mu50
aaauaucgacaaauuaaaa

SEQ ID NO: 3965591 - RNA, 20 nt, Staphylococcus aureus subsp. aureus Mu50
aaauaucgacaaauuaaaaa

SEQ ID NO: 3965592 - RNA, 19 nt, Staphylococcus aureus subsp. aureus Mu50
aaauaucuuuuucuaaguu

SEQ ID NO: 3965593 - RNA, 15 nt, Staphylococcus aureus subsp. aureus Mu50
aaauaugacacauac

SEQ ID NO: 3965594 - RNA, 16 nt, Staphylococcus aureus subsp. aureus Mu50
aaauaugacacauaca

SEQ ID NO: 3965595 - RNA, 22 nt, Staphylococcus aureus subsp. aureus Mu50
aaauaugacgcgugaauuaaaa

SEQ ID NO: 3965596 - RNA, 12 nt, Staphylococcus aureus subsp. aureus Mu50
aaauaugauaac

SEQ ID NO: 3965597 - RNA, 13 nt, Staphylococcus aureus subsp. aureus Mu50
aaauaugauugaa

SEQ ID NO: 3965598 - RNA, 15 nt, Staphylococcus aureus subsp. aureus Mu50
aaauaugauuuaaaa

SEQ ID NO: 3965599 - RNA, 19 nt, Staphylococcus aureus subsp. aureus Mu50
aaauauggaauuucauaua

SEQ ID NO: 3965600 - RNA, 17 nt, Staphylococcus aureus subsp. aureus Mu50
aaauauguaaucagguu

SEQ ID NO: 3965601 - RNA, 21 nt, Staphylococcus aureus subsp. aureus Mu50
aaauauguauguuuuaucaau

SEQ ID NO: 3965602 - RNA, 18 nt, Staphylococcus aureus subsp. aureus Mu50
aaauauuaauauaaaaua

SEQ ID NO: 3965603 - RNA, 22 nt, Staphylococcus aureus subsp. aureus Mu50
aaauauuaauauaaaauaaagu

SEQ ID NO: 3965604 - RNA, 13 nt, Staphylococcus aureus subsp. aureus Mu50
aaauauuauuaaa

SEQ ID NO: 3965605 - RNA, 15 nt, Staphylococcus aureus subsp. aureus Mu50
aaauauuauuaaauc

SEQ ID NO: 3965606 - RNA, 17 nt, Staphylococcus aureus subsp. aureus Mu50
aaauauucuuuaauaua

SEQ ID NO: 3965607 - RNA, 15 nt, Staphylococcus aureus subsp. aureus Mu50
aaauauugaacaauu

SEQ ID NO: 3965608 - RNA, 19 nt, Staphylococcus aureus subsp. aureus Mu50
aaauauugcguuuaauuua

SEQ ID NO: 3965609 - RNA, 16 nt, Staphylococcus aureus subsp. aureus Mu50
aaauauuguaaucacu

SEQ ID NO: 3965610 - RNA, 16 nt, Staphylococcus aureus subsp. aureus Mu50
aaauauuuaaaauauu

SEQ ID NO: 3965611 - RNA, 15 nt, Staphylococcus aureus subsp. aureus Mu50
aaauauuuaaacuag

SEQ ID NO: 3965612 - RNA, 20 nt, Staphylococcus aureus subsp. aureus Mu50
aaauauuuaaacuaguaaua

SEQ ID NO: 3965613 - RNA, 12 nt, Staphylococcus aureus subsp. aureus Mu50
aaauauuuaacu

SEQ ID NO: 3965614 - RNA, 12 nt, Staphylococcus aureus subsp. aureus Mu50
aaauauuuacau

SEQ ID NO: 3965615 - RNA, 21 nt, Staphylococcus aureus subsp. aureus Mu50
aaauauuuacauugccacuuu

SEQ ID NO: 3965616 - RNA, 15 nt, Staphylococcus aureus subsp. aureus Mu50
aaauauuuaucuuua

SEQ ID NO: 3965617 - RNA, 23 nt, Staphylococcus aureus subsp. aureus Mu50
aaauauuucuaaaccauuuucaa

SEQ ID NO: 3965618 - RNA, 12 nt, Staphylococcus aureus subsp. aureus Mu50
aaauauuugaaa

SEQ ID NO: 3965619 - RNA, 13 nt, Staphylococcus aureus subsp. aureus Mu50
aaauauuugaaaa

SEQ ID NO: 3965620 - RNA, 14 nt, Staphylococcus aureus subsp. aureus Mu50
aaauauuugaaaau

SEQ ID NO: 3965621 - RNA, 23 nt, Staphylococcus aureus subsp. aureus Mu50
aaauauuuucugcgauauagcuu

SEQ ID NO: 3965622 - RNA, 16 nt, Staphylococcus aureus subsp. aureus Mu50
aaauauuuuuaauuau

SEQ ID NO: 3965623 - RNA, 17 nt, Staphylococcus aureus subsp. aureus Mu50
aaauauuuuuaauuauu

SEQ ID NO: 3965624 - RNA, 23 nt, Staphylococcus aureus subsp. aureus Mu50
aaauauuuuuaauuauuuuaaaa

SEQ ID NO: 3965625 - RNA, 15 nt, Staphylococcus aureus subsp. aureus Mu50
aaauauuuuuuaaaa

SEQ ID NO: 3965626 - RNA, 18 nt, Staphylococcus aureus subsp. aureus Mu50
aaauauuuuuuaaaauga

SEQ ID NO: 3965627 - RNA, 14 nt, Staphylococcus aureus subsp. aureus Mu50
aaauauuuuuucug

SEQ ID NO: 3965628 - RNA, 14 nt, Staphylococcus aureus subsp. aureus Mu50
aaaucaaaaauaau

SEQ ID NO: 3965629 - RNA, 15 nt, Staphylococcus aureus subsp. aureus Mu50
aaaucaaauauacuu

SEQ ID NO: 3965630 - RNA, 22 nt, Staphylococcus aureus subsp. aureus Mu50
aaaucaaauauacuuuuaccau

SEQ ID NO: 3965631 - RNA, 14 nt, Staphylococcus aureus subsp. aureus Mu50
aaaucaacaccaac

SEQ ID NO: 3965632 - RNA, 22 nt, Staphylococcus aureus subsp. aureus Mu50
aaaucaacccaucauguacagu

SEQ ID NO: 3965633 - RNA, 14 nt, Staphylococcus aureus subsp. aureus Mu50
aaaucaaguguugu

SEQ ID NO: 3965634 - RNA, 12 nt, Staphylococcus aureus subsp. aureus Mu50
aaaucaauccau

SEQ ID NO: 3965635 - RNA, 13 nt, Staphylococcus aureus subsp. aureus Mu50
aaaucaauccauc

SEQ ID NO: 3965636 - RNA, 15 nt, Staphylococcus aureus subsp. aureus Mu50
aaaucaauccaucaa

SEQ ID NO: 3965637 - RNA, 13 nt, Staphylococcus aureus subsp. aureus Mu50
aaaucaauguacu

SEQ ID NO: 3965638 - RNA, 14 nt, Staphylococcus aureus subsp. aureus Mu50
aaaucaauguacua

SEQ ID NO: 3965639 - RNA, 19 nt, Staphylococcus aureus subsp. aureus Mu50
aaaucacauaugauaauua

SEQ ID NO: 3965640 - RNA, 12 nt, Staphylococcus aureus subsp. aureus Mu50
aaaucaccaaca

SEQ ID NO: 3965641 - RNA, 20 nt, Staphylococcus aureus subsp. aureus Mu50
aaaugaauguuaagacauau

SEQ ID NO: 3965642 - RNA, 23 nt, Staphylococcus aureus subsp. aureus Mu50
aaaugaauguuaagacauaugca

SEQ ID NO: 3965643 - RNA, 14 nt, Staphylococcus aureus subsp. aureus Mu50
aaaugaauuauuua

SEQ ID NO: 3965644 - RNA, 21 nt, Staphylococcus aureus subsp. aureus Mu50
aaaugaauuauuuaaaaugcu

SEQ ID NO: 3965645 - RNA, 19 nt, Staphylococcus aureus subsp. aureus Mu50
aaaugaauugucuuaauau

SEQ ID NO: 3965646 - RNA, 13 nt, Staphylococcus aureus subsp. aureus Mu50
aaaugaauuuuga

SEQ ID NO: 3965647 - RNA, 16 nt, Staphylococcus aureus subsp. aureus Mu50
aaaugaccuuaauaua

SEQ ID NO: 3965648 - RNA, 19 nt, Staphylococcus aureus subsp. aureus Mu50
aaaugacgauaccuuuaau

SEQ ID NO: 3965649 - RNA, 22 nt, Staphylococcus aureus subsp. aureus Mu50
aaaugacgauaccuuuaauaau

SEQ ID NO: 3965650 - RNA, 23 nt, Staphylococcus aureus subsp. aureus Mu50
aaaugacgauaccuuuaauaaua

SEQ ID NO: 3965651 - RNA, 23 nt, Staphylococcus aureus subsp. aureus Mu50
aaaugacgcucgagcucuucaaa

SEQ ID NO: 3965652 - RNA, 23 nt, Staphylococcus aureus subsp. aureus Mu50
aaaugacgugcuuuuaaauguau

SEQ ID NO: 3965653 - RNA, 16 nt, Staphylococcus aureus subsp. aureus Mu50
aaaugacuaccuguug

SEQ ID NO: 3965654 - RNA, 21 nt, Staphylococcus aureus subsp. aureus Mu50
aaaugacugaauuaauaucca

SEQ ID NO: 3965655 - RNA, 23 nt, Staphylococcus aureus subsp. aureus Mu50
aaaugacugaauuaauauccaaa

SEQ ID NO: 3965656 - RNA, 16 nt, Staphylococcus aureus subsp. aureus Mu50
aaaugauaauuuaaua

SEQ ID NO: 3965657 - RNA, 15 nt, Staphylococcus aureus subsp. aureus Mu50
aaaugauacauuauu

SEQ ID NO: 3965658 - RNA, 22 nt, Staphylococcus aureus subsp. aureus Mu50
aaaugaucuuuguagccuucaa

SEQ ID NO: 3965659 - RNA, 16 nt, Staphylococcus aureus subsp. aureus Mu50
aaaugauuaauaacau

SEQ ID NO: 3965660 - RNA, 20 nt, Staphylococcus aureus subsp. aureus Mu50
aaaugauuuauucuaaauau

SEQ ID NO: 3965661 - RNA, 22 nt, Staphylococcus aureus subsp. aureus Mu50
aaaugauuuauucuaaauauau

SEQ ID NO: 3965662 - RNA, 23 nt, Staphylococcus aureus subsp. aureus Mu50
aaaugauuuauucuaaauauauu

SEQ ID NO: 3965663 - RNA, 14 nt, Staphylococcus aureus subsp. aureus Mu50
aaaugauuucacuu

SEQ ID NO: 3965664 - RNA, 13 nt, Staphylococcus aureus subsp. aureus Mu50
aaaugcaauacau

SEQ ID NO: 3965665 - RNA, 14 nt, Staphylococcus aureus subsp. aureus Mu50
aaaugcaauuuuuc

SEQ ID NO: 3965666 - RNA, 21 nt, Staphylococcus aureus subsp. aureus Mu50
aaaugcaauuuuucacuuaua

SEQ ID NO: 3965667 - RNA, 19 nt, Staphylococcus aureus subsp. aureus Mu50
aaaugcacugagcaacaaa

SEQ ID NO: 3965668 - RNA, 22 nt, Staphylococcus aureus subsp. aureus Mu50
aaaugccuucuguacguuuuaa

SEQ ID NO: 3965669 - RNA, 21 nt, Staphylococcus aureus subsp. aureus Mu50
aaaugcgcuuccaauuuaaaa

SEQ ID NO: 3965670 - RNA, 13 nt, Staphylococcus aureus subsp. aureus Mu50
aaaugcuaaaagu

SEQ ID NO: 3965671 - RNA, 14 nt, Staphylococcus aureus subsp. aureus Mu50
aaaugcuaaaagua

SEQ ID NO: 3965672 - RNA, 17 nt, Staphylococcus aureus subsp. aureus Mu50
aaaugcuacaauuuccu

SEQ ID NO: 3965673 - RNA, 23 nt, Staphylococcus aureus subsp. aureus Mu50
aaaugcuauauuuagaaugauga

SEQ ID NO: 3965674 - RNA, 19 nt, Staphylococcus aureus subsp. aureus Mu50
aaaugcucaaguugauuau

SEQ ID NO: 3965675 - RNA, 16 nt, Staphylococcus aureus subsp. aureus Mu50
aaaugcucccuucaaa

SEQ ID NO: 3965676 - RNA, 13 nt, Staphylococcus aureus subsp. aureus Mu50
aaaugcuguuuua

SEQ ID NO: 3965677 - RNA, 14 nt, Staphylococcus aureus subsp. aureus Mu50
aaaugcuguuuuau

SEQ ID NO: 3965678 - RNA, 20 nt, Staphylococcus aureus subsp. aureus Mu50
aaaugcuuauauaaacaaaa

SEQ ID NO: 3965679 - RNA, 15 nt, Staphylococcus aureus subsp. aureus Mu50
aaauggaaagacguu

SEQ ID NO: 3965680 - RNA, 22 nt, Staphylococcus aureus subsp. aureus Mu50
aaauggaaccacgucuuaaucg

SEQ ID NO: 3965681 - RNA, 17 nt, Staphylococcus aureus subsp. aureus Mu50
aaauggacuaacgucau

SEQ ID NO: 3965682 - RNA, 23 nt, Staphylococcus aureus subsp. aureus Mu50
aaauggcaucuggcaaauugccu

SEQ ID NO: 3965683 - RNA, 20 nt, Staphylococcus aureus subsp. aureus Mu50
aaauggugaacuaaauugaa

SEQ ID NO: 3965684 - RNA, 19 nt, Staphylococcus aureus subsp. aureus Mu50
aaauggugcgaauaauaau

SEQ ID NO: 3965685 - RNA, 16 nt, Staphylococcus aureus subsp. aureus Mu50
aaaugguucgaugaau

SEQ ID NO: 3965686 - RNA, 23 nt, Staphylococcus aureus subsp. aureus Mu50
aaaugguuuucuuuuucuauaca

SEQ ID NO: 3965687 - RNA, 15 nt, Staphylococcus aureus subsp. aureus Mu50
aaauguaacauuaaa

SEQ ID NO: 3965688 - RNA, 23 nt, Staphylococcus aureus subsp. aureus Mu50
aaauguaacauuaaaaauaaaag

SEQ ID NO: 3965689 - RNA, 15 nt, Staphylococcus aureus subsp. aureus Mu50
aaauguacauuguaa

SEQ ID NO: 3965690 - RNA, 12 nt, Staphylococcus aureus subsp. aureus Mu50
aaauguauaaau

SEQ ID NO: 3965691 - RNA, 16 nt, Staphylococcus aureus subsp. aureus Mu50
aaauguauuaaacauu

SEQ ID NO: 3965692 - RNA, 22 nt, Staphylococcus aureus subsp. aureus Mu50
aaauguauuauucucucauuug

SEQ ID NO: 3965693 - RNA, 18 nt, Staphylococcus aureus subsp. aureus Mu50
aaauguauuuuuacuuuu

SEQ ID NO: 3965694 - RNA, 15 nt, Staphylococcus aureus subsp. aureus Mu50
aaaugucaguuuuga

SEQ ID NO: 3965695 - RNA, 16 nt, Staphylococcus aureus subsp. aureus Mu50
aaaugucaguuuugaa

SEQ ID NO: 3965696 - RNA, 21 nt, Staphylococcus aureus subsp. aureus Mu50
aaaugucaguuuugaagaaua

SEQ ID NO: 3965697 - RNA, 14 nt, Staphylococcus aureus subsp. aureus Mu50
aaaugucauuugaa

SEQ ID NO: 3965698 - RNA, 21 nt, Staphylococcus aureus subsp. aureus Mu50
aaauguccgacuugauaaaaa

SEQ ID NO: 3965699 - RNA, 21 nt, Staphylococcus aureus subsp. aureus Mu50
aaauguuaaagauuauuauua

SEQ ID NO: 3965700 - RNA, 16 nt, Staphylococcus aureus subsp. aureus Mu50
aaauguuaaauucuaa

SEQ ID NO: 3965701 - RNA, 14 nt, Staphylococcus aureus subsp. aureus Mu50
aaauguuaaugcuu

SEQ ID NO: 3965702 - RNA, 19 nt, Staphylococcus aureus subsp. aureus Mu50
aaauguuaaugcuucguaa

SEQ ID NO: 3965703 - RNA, 15 nt, Staphylococcus aureus subsp. aureus Mu50
aaauguuacacaaau

SEQ ID NO: 3965704 - RNA, 21 nt, Staphylococcus aureus subsp. aureus Mu50
aaauguuacacaaauuaaaac

SEQ ID NO: 3965705 - RNA, 22 nt, Staphylococcus aureus subsp. aureus Mu50
aaauguuaucaauaucuucgcc

SEQ ID NO: 3965706 - RNA, 19 nt, Staphylococcus aureus subsp. aureus Mu50
aaauguuauuaaccaucau

SEQ ID NO: 3965707 - RNA, 18 nt, Staphylococcus aureus subsp. aureus Mu50
aaauguugacuacucaau

SEQ ID NO: 3965708 - RNA, 16 nt, Staphylococcus aureus subsp. aureus Mu50
aaauguuuaacaauaa

SEQ ID NO: 3965709 - RNA, 19 nt, Staphylococcus aureus subsp. aureus Mu50
aaauguuuuauguauuuau

SEQ ID NO: 3965710 - RNA, 18 nt, Staphylococcus aureus subsp. aureus Mu50
aaauuaaaaaacaaaacu

SEQ ID NO: 3965711 - RNA, 17 nt, Staphylococcus aureus subsp. aureus Mu50
aaauuaaaaaacaauaa

SEQ ID NO: 3965712 - RNA, 20 nt, Staphylococcus aureus subsp. aureus Mu50
aaauuaaaaagguacuaaug

SEQ ID NO: 3965713 - RNA, 16 nt, Staphylococcus aureus subsp. aureus Mu50
aaauuaaaaauuucgc

SEQ ID NO: 3965714 - RNA, 17 nt, Staphylococcus aureus subsp. aureus Mu50
aaauuaaagcaaauuau

SEQ ID NO: 3965715 - RNA, 20 nt, Staphylococcus aureus subsp. aureus Mu50
aaauuaaagcuagaaacaau

SEQ ID NO: 3965716 - RNA, 14 nt, Staphylococcus aureus subsp. aureus Mu50
aaauuaaauaugac

SEQ ID NO: 3965717 - RNA, 15 nt, Staphylococcus aureus subsp. aureus Mu50
aaauuaaauuuuguu

SEQ ID NO: 3965718 - RNA, 11 nt, Staphylococcus aureus subsp. aureus Mu50
aaauuaacuag

SEQ ID NO: 3965719 - RNA, 14 nt, Staphylococcus aureus subsp. aureus Mu50
aaauuaacuuaaaa

SEQ ID NO: 3965720 - RNA, 15 nt, Staphylococcus aureus subsp. aureus Mu50
aaauuaagaagaaau

SEQ ID NO: 3965721 - RNA, 16 nt, Staphylococcus aureus subsp. aureus Mu50
aaauuaagaagaaaua

SEQ ID NO: 3965722 - RNA, 18 nt, Staphylococcus aureus subsp. aureus Mu50
aaauuaagaagaaauacu

SEQ ID NO: 3965723 - RNA, 15 nt, Staphylococcus aureus subsp. aureus Mu50
aaauuaagaauaauc

SEQ ID NO: 3965724 - RNA, 12 nt, Staphylococcus aureus subsp. aureus Mu50
aaauuaauaauu

SEQ ID NO: 3965725 - RNA, 17 nt, Staphylococcus aureus subsp. aureus Mu50
aaauuaauaauuuucca

SEQ ID NO: 3965726 - RNA, 17 nt, Staphylococcus aureus subsp. aureus Mu50
aaauuaauaugaacaaa

SEQ ID NO: 3965727 - RNA, 21 nt, Staphylococcus aureus subsp. aureus Mu50
aaauuaauaugaacaaaaaau

SEQ ID NO: 3965728 - RNA, 13 nt, Staphylococcus aureus subsp. aureus Mu50
aaauuuaaaauaa

SEQ ID NO: 3965729 - RNA, 12 nt, Staphylococcus aureus subsp. aureus Mu50
aaauuuaaaugu

SEQ ID NO: 3965730 - RNA, 20 nt, Staphylococcus aureus subsp. aureus Mu50
aaauuuaacucaacuuaaau

SEQ ID NO: 3965731 - RNA, 15 nt, Staphylococcus aureus subsp. aureus Mu50
aaauuuaauauuguu

SEQ ID NO: 3965732 - RNA, 13 nt, Staphylococcus aureus subsp. aureus Mu50
aaauuuacaaaug

SEQ ID NO: 3965733 - RNA, 21 nt, Staphylococcus aureus subsp. aureus Mu50
aaauuuacgaaaguagaauua

SEQ ID NO: 3965734 - RNA, 21 nt, Staphylococcus aureus subsp. aureus Mu50
aaauuuaguuaaguauuuaaa

SEQ ID NO: 3965735 - RNA, 13 nt, Staphylococcus aureus subsp. aureus Mu50
aaauuuauaauac

SEQ ID NO: 3965736 - RNA, 22 nt, Staphylococcus aureus subsp. aureus Mu50
aaauuuauauagucuaugaaua

SEQ ID NO: 3965737 - RNA, 12 nt, Staphylococcus aureus subsp. aureus Mu50
aaauuuaucauu

SEQ ID NO: 3965738 - RNA, 12 nt, Staphylococcus aureus subsp. aureus Mu50
aaauuuauuaua

SEQ ID NO: 3965739 - RNA, 16 nt, Staphylococcus aureus subsp. aureus Mu50
aaauuuauuauaaaau

SEQ ID NO: 3965740 - RNA, 17 nt, Staphylococcus aureus subsp. aureus Mu50
aaauuuauuauaaaaua

SEQ ID NO: 3965741 - RNA, 18 nt, Staphylococcus aureus subsp. aureus Mu50
aaauuuauuauaaaauag

SEQ ID NO: 3965742 - RNA, 20 nt, Staphylococcus aureus subsp. aureus Mu50
aaauuuauuauaaaauagaa

SEQ ID NO: 3965743 - RNA, 14 nt, Staphylococcus aureus subsp. aureus Mu50
aaauuuauucaaaa

SEQ ID NO: 3965744 - RNA, 18 nt, Staphylococcus aureus subsp. aureus Mu50
aaauuuauucaaaauuca

SEQ ID NO: 3965745 - RNA, 21 nt, Staphylococcus aureus subsp. aureus Mu50
aaauuuauucaaaauucaaua

SEQ ID NO: 3965746 - RNA, 21 nt, Staphylococcus aureus subsp. aureus Mu50
aaauuuauucaaaucauaagu

SEQ ID NO: 3965747 - RNA, 17 nt, Staphylococcus aureus subsp. aureus Mu50
aaauuuauuuuuaauuu

SEQ ID NO: 3965748 - RNA, 21 nt, Staphylococcus aureus subsp. aureus Mu50
aaauuucaagguauacacaaa

SEQ ID NO: 3965749 - RNA, 19 nt, Staphylococcus aureus subsp. aureus Mu50
aaauuucaccgcuuucaau

SEQ ID NO: 3965750 - RNA, 14 nt, Staphylococcus aureus subsp. aureus Mu50
aaauuucauaaagu

SEQ ID NO: 3965751 - RNA, 16 nt, Staphylococcus aureus subsp. aureus Mu50
aaauuucauaaaguuu

SEQ ID NO: 3965752 - RNA, 20 nt, Staphylococcus aureus subsp. aureus Mu50
aaauuuccaaaguaauauga

SEQ ID NO: 3965753 - RNA, 21 nt, Staphylococcus aureus subsp. aureus Mu50
aaauuuccucaccuucauuuu

SEQ ID NO: 3965754 - RNA, 18 nt, Staphylococcus aureus subsp. aureus Mu50
aaauuucgauuaauugaa

SEQ ID NO: 3965755 - RNA, 17 nt, Staphylococcus aureus subsp. aureus Mu50
aaauuugaaauauacca

SEQ ID NO: 3965756 - RNA, 15 nt, Staphylococcus aureus subsp. aureus Mu50
aaauuugguacauaa

SEQ ID NO: 3965757 - RNA, 21 nt, Staphylococcus aureus subsp. aureus Mu50
aaauuugguacauaauagacu

SEQ ID NO: 3965758 - RNA, 18 nt, Staphylococcus aureus subsp. aureus Mu50
aaauuuguguucaaauca

SEQ ID NO: 3965759 - RNA, 14 nt, Staphylococcus aureus subsp. aureus Mu50
aaauuuuacgaaaa

SEQ ID NO: 3965760 - RNA, 12 nt, Staphylococcus aureus subsp. aureus Mu50
aaauuuuauaua

SEQ ID NO: 3965761 - RNA, 15 nt, Staphylococcus aureus subsp. aureus Mu50
aaauuuugaauuaca

SEQ ID NO: 3965762 - RNA, 17 nt, Staphylococcus aureus subsp. aureus Mu50
aaauuuuuaagaagcuu

SEQ ID NO: 3965763 - RNA, 17 nt, Staphylococcus aureus subsp. aureus Mu50
aaauuuuuaguuaaagu

SEQ ID NO: 3965764 - RNA, 11 nt, Staphylococcus aureus subsp. aureus Mu50
aaauuuuucac

SEQ ID NO: 3965765 - RNA, 14 nt, Staphylococcus aureus subsp. aureus Mu50
aaauuuuucacuuc

SEQ ID NO: 3965766 - RNA, 15 nt, Staphylococcus aureus subsp. aureus Mu50
aaauuuuucacuuca

SEQ ID NO: 3965767 - RNA, 21 nt, Staphylococcus aureus subsp. aureus Mu50
aaauuuuucacuucaaacaaa

SEQ ID NO: 3965768 - RNA, 20 nt, Staphylococcus aureus subsp. aureus Mu50
aaauuuuuuagugaaaaagu

SEQ ID NO: 3965769 - RNA, 17 nt, Staphylococcus aureus subsp. aureus Mu50
aaauuuuuuguaaacau

SEQ ID NO: 3965770 - RNA, 13 nt, Staphylococcus aureus subsp. aureus Mu50
aacaaaaauugcu

SEQ ID NO: 3965771 - RNA, 22 nt, Staphylococcus aureus subsp. aureus Mu50
aacaaaacuugagcuauucaua

SEQ ID NO: 3965772 - RNA, 12 nt, Staphylococcus aureus subsp. aureus Mu50
aacaaaagaaag

SEQ ID NO: 3965773 - RNA, 12 nt, Staphylococcus aureus subsp. aureus Mu50
aacaaaagaugu

SEQ ID NO: 3965774 - RNA, 18 nt, Staphylococcus aureus subsp. aureus Mu50
aacaaaauauacuaaauu

SEQ ID NO: 3965775 - RNA, 13 nt, Staphylococcus aureus subsp. aureus Mu50
aacaaaauuaaau

SEQ ID NO: 3965776 - RNA, 14 nt, Staphylococcus aureus subsp. aureus Mu50
aacaaaauuaaaua

SEQ ID NO: 3965777 - RNA, 13 nt, Staphylococcus aureus subsp. aureus Mu50
aacaaaauuaaga

SEQ ID NO: 3965778 - RNA, 13 nt, Staphylococcus aureus subsp. aureus Mu50
aacaaacauaaau

SEQ ID NO: 3965779 - RNA, 22 nt, Staphylococcus aureus subsp. aureus Mu50
aacaaacauuaaucuauauaaa

SEQ ID NO: 3965780 - RNA, 18 nt, Staphylococcus aureus subsp. aureus Mu50
aacaaacgcugauuuaau

SEQ ID NO: 3965781 - RNA, 11 nt, Staphylococcus aureus subsp. aureus Mu50
aacaaagaagc

SEQ ID NO: 3965782 - RNA, 19 nt, Staphylococcus aureus subsp. aureus Mu50
aacaaagucucuaguaucu

SEQ ID NO: 3965783 - RNA, 14 nt, Staphylococcus aureus subsp. aureus Mu50
aacaaauauaauac

SEQ ID NO: 3965784 - RNA, 22 nt, Staphylococcus aureus subsp. aureus Mu50
aacaaauauaauguauaaaaca

SEQ ID NO: 3965785 - RNA, 13 nt, Staphylococcus aureus subsp. aureus Mu50
aacaaaucuauaa

SEQ ID NO: 3965786 - RNA, 17 nt, Staphylococcus aureus subsp. aureus Mu50
aacaaaucuuuuaaauu

SEQ ID NO: 3965787 - RNA, 19 nt, Staphylococcus aureus subsp. aureus Mu50
aacaaaugaaaaaguaaaa

SEQ ID NO: 3965788 - RNA, 12 nt, Staphylococcus aureus subsp. aureus Mu50
aacaaauuaaaa

SEQ ID NO: 3965789 - RNA, 15 nt, Staphylococcus aureus subsp. aureus Mu50
aacaaauucauauua

SEQ ID NO: 3965790 - RNA, 20 nt, Staphylococcus aureus subsp. aureus Mu50
aacaaauucauauuaacugu

SEQ ID NO: 3965791 - RNA, 13 nt, Staphylococcus aureus subsp. aureus Mu50
aacaaauuuaacu

SEQ ID NO: 3965792 - RNA, 22 nt, Staphylococcus aureus subsp. aureus Mu50
aacaacaaauauaauguauaaa

SEQ ID NO: 3965793 - RNA, 15 nt, Staphylococcus aureus subsp. aureus Mu50
aacaacaucacuuua

SEQ ID NO: 3965794 - RNA, 20 nt, Staphylococcus aureus subsp. aureus Mu50
aacaaccgucccauaaaaga

SEQ ID NO: 3965795 - RNA, 23 nt, Staphylococcus aureus subsp. aureus Mu50
aacaaccguuuuaaguacagcau

SEQ ID NO: 3965796 - RNA, 23 nt, Staphylococcus aureus subsp. aureus Mu50
aacaaccucugauacuucaccau

SEQ ID NO: 3965797 - RNA, 18 nt, Staphylococcus aureus subsp. aureus Mu50
aacaaccugugauaaaaa

SEQ ID NO: 3965798 - RNA, 14 nt, Staphylococcus aureus subsp. aureus Mu50
aacaacuaaagguc

SEQ ID NO: 3965799 - RNA, 15 nt, Staphylococcus aureus subsp. aureus Mu50
aacaacuaagauaua

SEQ ID NO: 3965800 - RNA, 23 nt, Staphylococcus aureus subsp. aureus Mu50
aacaacugcaauagcuauaacuc

SEQ ID NO: 3965801 - RNA, 23 nt, Staphylococcus aureus subsp. aureus Mu50
aacaacuuuaauuuuucauuaau

SEQ ID NO: 3965802 - RNA, 15 nt, Staphylococcus aureus subsp. aureus Mu50
aacaacuuuguuuuc

SEQ ID NO: 3965803 - RNA, 17 nt, Staphylococcus aureus subsp. aureus Mu50
aacaagaaguuuccaac

SEQ ID NO: 3965804 - RNA, 14 nt, Staphylococcus aureus subsp. aureus Mu50
aacaagauucauac

SEQ ID NO: 3965805 - RNA, 15 nt, Staphylococcus aureus subsp. aureus Mu50
aacaagcaucaugaa

SEQ ID NO: 3965806 - RNA, 21 nt, Staphylococcus aureus subsp. aureus Mu50
aacaagcauuuuucaauuaua

SEQ ID NO: 3965807 - RNA, 17 nt, Staphylococcus aureus subsp. aureus Mu50
aacaagccuuaaaauau

SEQ ID NO: 3965808 - RNA, 20 nt, Staphylococcus aureus subsp. aureus Mu50
aacaagccuuaaaauauuua

SEQ ID NO: 3965809 - RNA, 17 nt, Staphylococcus aureus subsp. aureus Mu50
aacaagcuuuuuucaau

SEQ ID NO: 3965810 - RNA, 18 nt, Staphylococcus aureus subsp. aureus Mu50
aacaagcuuuuuucaauu

SEQ ID NO: 3965811 - RNA, 19 nt, Staphylococcus aureus subsp. aureus Mu50
aacaagguacacuagucuu

SEQ ID NO: 3965812 - RNA, 18 nt, Staphylococcus aureus subsp. aureus Mu50
aacaagguucuaaaucuu

SEQ ID NO: 3965813 - RNA, 20 nt, Staphylococcus aureus subsp. aureus Mu50
aacaaguauaaaugcagcug

SEQ ID NO: 3965814 - RNA, 15 nt, Staphylococcus aureus subsp. aureus Mu50
aacaauaaaaaacca

SEQ ID NO: 3965815 - RNA, 13 nt, Staphylococcus aureus subsp. aureus Mu50
aacaauaauugau

SEQ ID NO: 3965816 - RNA, 14 nt, Staphylococcus aureus subsp. aureus Mu50
aacaucacuugcug

SEQ ID NO: 3965817 - RNA, 21 nt, Staphylococcus aureus subsp. aureus Mu50
aacaucacuuuaggguucauu

SEQ ID NO: 3965818 - RNA, 16 nt, Staphylococcus aureus subsp. aureus Mu50
aacaucauaaucgcca

SEQ ID NO: 3965819 - RNA, 13 nt, Staphylococcus aureus subsp. aureus Mu50
aacaucaucuuua

SEQ ID NO: 3965820 - RNA, 13 nt, Staphylococcus aureus subsp. aureus Mu50
aacaucauucaca

SEQ ID NO: 3965821 - RNA, 15 nt, Staphylococcus aureus subsp. aureus Mu50
aacaucauuucugaa

SEQ ID NO: 3965822 - RNA, 22 nt, Staphylococcus aureus subsp. aureus Mu50
aacauccugcuuauuaauuguu

SEQ ID NO: 3965823 - RNA, 22 nt, Staphylococcus aureus subsp. aureus Mu50
aacauccuuugauguuuucuau

SEQ ID NO: 3965824 - RNA, 20 nt, Staphylococcus aureus subsp. aureus Mu50
aacaucgauuuaucauuauu

SEQ ID NO: 3965825 - RNA, 17 nt, Staphylococcus aureus subsp. aureus Mu50
aacaucuaauacauuau

SEQ ID NO: 3965826 - RNA, 14 nt, Staphylococcus aureus subsp. aureus Mu50
aacaucugaaaaaa

SEQ ID NO: 3965827 - RNA, 15 nt, Staphylococcus aureus subsp. aureus Mu50
aacaucugaaucuga

SEQ ID NO: 3965828 - RNA, 16 nt, Staphylococcus aureus subsp. aureus Mu50
aacaucugaaucugaa

SEQ ID NO: 3965829 - RNA, 13 nt, Staphylococcus aureus subsp. aureus Mu50
aacaucuucaaca

SEQ ID NO: 3965830 - RNA, 17 nt, Staphylococcus aureus subsp. aureus Mu50
aacaugaacaaucagau

SEQ ID NO: 3965831 - RNA, 18 nt, Staphylococcus aureus subsp. aureus Mu50
aacaugaaugauauugau

SEQ ID NO: 3965832 - RNA, 23 nt, Staphylococcus aureus subsp. aureus Mu50
aacaugaccuaauauauuacuaa

SEQ ID NO: 3965833 - RNA, 22 nt, Staphylococcus aureus subsp. aureus Mu50
aacaugauacugaaauuucaua

SEQ ID NO: 3965834 - RNA, 21 nt, Staphylococcus aureus subsp. aureus Mu50
aacaugauucaugauauguuc

SEQ ID NO: 3965835 - RNA, 18 nt, Staphylococcus aureus subsp. aureus Mu50
aacaugauugaaauccuu

SEQ ID NO: 3965836 - RNA, 20 nt, Staphylococcus aureus subsp. aureus Mu50
aacaugcuuggacauauacu

SEQ ID NO: 3965837 - RNA, 16 nt, Staphylococcus aureus subsp. aureus Mu50
aacauggucaaucacu

SEQ ID NO: 3965838 - RNA, 22 nt, Staphylococcus aureus subsp. aureus Mu50
aacaugguuuucuuuuuaucau

SEQ ID NO: 3965839 - RNA, 17 nt, Staphylococcus aureus subsp. aureus Mu50
aacauguacaauuuuua

SEQ ID NO: 3965840 - RNA, 18 nt, Staphylococcus aureus subsp. aureus Mu50
aacauguacaauuuuuaa

SEQ ID NO: 3965841 - RNA, 13 nt, Staphylococcus aureus subsp. aureus Mu50
aacaugugcaagu

SEQ ID NO: 3965842 - RNA, 13 nt, Staphylococcus aureus subsp. aureus Mu50
aacauguguauga

SEQ ID NO: 3965843 - RNA, 21 nt, Staphylococcus aureus subsp. aureus Mu50
aacauguugauaaaaaggauc

SEQ ID NO: 3965844 - RNA, 17 nt, Staphylococcus aureus subsp. aureus Mu50
aacauuaaaauaauuaa

SEQ ID NO: 3965845 - RNA, 18 nt, Staphylococcus aureus subsp. aureus Mu50
aacauuaaaauaauuaaa

SEQ ID NO: 3965846 - RNA, 15 nt, Staphylococcus aureus subsp. aureus Mu50
aacauuaaaaugaua

SEQ ID NO: 3965847 - RNA, 20 nt, Staphylococcus aureus subsp. aureus Mu50
aacauuaaaauguguuuuca

SEQ ID NO: 3965848 - RNA, 14 nt, Staphylococcus aureus subsp. aureus Mu50
aacauuaaauuauu

SEQ ID NO: 3965849 - RNA, 17 nt, Staphylococcus aureus subsp. aureus Mu50
aacauuaaauuauuaga

SEQ ID NO: 3965850 - RNA, 20 nt, Staphylococcus aureus subsp. aureus Mu50
aacauuaaucuauauaaaaa

SEQ ID NO: 3965851 - RNA, 22 nt, Staphylococcus aureus subsp. aureus Mu50
aacauuacaugcaccuuuacaa

SEQ ID NO: 3965852 - RNA, 17 nt, Staphylococcus aureus subsp. aureus Mu50
aacauuacccuuuaaac

SEQ ID NO: 3965853 - RNA, 18 nt, Staphylococcus aureus subsp. aureus Mu50
aacauuacccuuuaaacu

SEQ ID NO: 3965854 - RNA, 20 nt, Staphylococcus aureus subsp. aureus Mu50
aacauuacuaauugaucagc

SEQ ID NO: 3965855 - RNA, 18 nt, Staphylococcus aureus subsp. aureus Mu50
aacauuacuuuaacaguu

SEQ ID NO: 3965856 - RNA, 19 nt, Staphylococcus aureus subsp. aureus Mu50
aacauuagcaugauaaagu

SEQ ID NO: 3965857 - RNA, 18 nt, Staphylococcus aureus subsp. aureus Mu50
aacauuaggauguucagc

SEQ ID NO: 3965858 - RNA, 14 nt, Staphylococcus aureus subsp. aureus Mu50
aacauuauuaaaca

SEQ ID NO: 3965859 - RNA, 18 nt, Staphylococcus aureus subsp. aureus Mu50
aacauuauuuauauuuag

SEQ ID NO: 3965860 - RNA, 19 nt, Staphylococcus aureus subsp. aureus Mu50
aacauuauuuauauuuaga

SEQ ID NO: 3965861 - RNA, 14 nt, Staphylococcus aureus subsp. aureus Mu50
aacauuauuuuugu

SEQ ID NO: 3965862 - RNA, 17 nt, Staphylococcus aureus subsp. aureus Mu50
aacauucuucaaaaaau

SEQ ID NO: 3965863 - RNA, 20 nt, Staphylococcus aureus subsp. aureus Mu50
aacauucuucaaaaaauaau

SEQ ID NO: 3965864 - RNA, 20 nt, Staphylococcus aureus subsp. aureus Mu50
aacauugaacgauaacaauu

SEQ ID NO: 3965865 - RNA, 20 nt, Staphylococcus aureus subsp. aureus Mu50
aacauuuaaaaaaugcgcuu

SEQ ID NO: 3965866 - RNA, 12 nt, Staphylococcus aureus subsp. aureus Mu50
aacauuuauaua

SEQ ID NO: 3965867 - RNA, 13 nt, Staphylococcus aureus subsp. aureus Mu50
aacauuucagcau

SEQ ID NO: 3965868 - RNA, 16 nt, Staphylococcus aureus subsp. aureus Mu50
aacauuuguccgauuu

SEQ ID NO: 3965869 - RNA, 22 nt, Staphylococcus aureus subsp. aureus Mu50
aacauuuugauacguaaacacu

SEQ ID NO: 3965870 - RNA, 11 nt, Staphylococcus aureus subsp. aureus Mu50
aacauuuuuag

SEQ ID NO: 3965871 - RNA, 16 nt, Staphylococcus aureus subsp. aureus Mu50
aacauuuuuagaauca

SEQ ID NO: 3965872 - RNA, 20 nt, Staphylococcus aureus subsp. aureus Mu50
aacauuuuugaauuuaauac

SEQ ID NO: 3965873 - RNA, 20 nt, Staphylococcus aureus subsp. aureus Mu50
aacauuuuugugcaaaaguu

SEQ ID NO: 3965874 - RNA, 21 nt, Staphylococcus aureus subsp. aureus Mu50
aaccaaaaaauccaagcgcuu

SEQ ID NO: 3965875 - RNA, 18 nt, Staphylococcus aureus subsp. aureus Mu50
aaccaaaaccaaaugaac

SEQ ID NO: 3965876 - RNA, 19 nt, Staphylococcus aureus subsp. aureus Mu50
aaccaaaagaaauucgcuu

SEQ ID NO: 3965877 - RNA, 18 nt, Staphylococcus aureus subsp. aureus Mu50
aaccaaaccauaaguaaa

SEQ ID NO: 3965878 - RNA, 20 nt, Staphylococcus aureus subsp. aureus Mu50
aaccaaaucggaauaaaaua

SEQ ID NO: 3965879 - RNA, 19 nt, Staphylococcus aureus subsp. aureus Mu50
aaccaacuuucucaaguaa

SEQ ID NO: 3965880 - RNA, 23 nt, Staphylococcus aureus subsp. aureus Mu50
aaccaaucaucgcaaauacauaa

SEQ ID NO: 3965881 - RNA, 17 nt, Staphylococcus aureus subsp. aureus Mu50
aaccaauuaauuguaaa

SEQ ID NO: 3965882 - RNA, 17 nt, Staphylococcus aureus subsp. aureus Mu50
aaccaauuauuaaagcu

SEQ ID NO: 3965883 - RNA, 16 nt, Staphylococcus aureus subsp. aureus Mu50
aaccaccaaaaaucau

SEQ ID NO: 3965884 - RNA, 19 nt, Staphylococcus aureus subsp. aureus Mu50
aaccaccaguauaaccaug

SEQ ID NO: 3965885 - RNA, 15 nt, Staphylococcus aureus subsp. aureus Mu50
aaccaccugauaaua

SEQ ID NO: 3965886 - RNA, 20 nt, Staphylococcus aureus subsp. aureus Mu50
aaccacgcaucauguauaug

SEQ ID NO: 3965887 - RNA, 18 nt, Staphylococcus aureus subsp. aureus Mu50
aaccagcuaacaaaagug

SEQ ID NO: 3965888 - RNA, 16 nt, Staphylococcus aureus subsp. aureus Mu50
aaccagcuaaccaaau

SEQ ID NO: 3965889 - RNA, 18 nt, Staphylococcus aureus subsp. aureus Mu50
aaccagcuaaccaaauaa

SEQ ID NO: 3965890 - RNA, 20 nt, Staphylococcus aureus subsp. aureus Mu50
aaccagcuaaccaaauaauu

SEQ ID NO: 3965891 - RNA, 14 nt, Staphylococcus aureus subsp. aureus Mu50
aaccaguauaauuu

SEQ ID NO: 3965892 - RNA, 19 nt, Staphylococcus aureus subsp. aureus Mu50
aaccaguucgaaaauuaua

SEQ ID NO: 3965893 - RNA, 13 nt, Staphylococcus aureus subsp. aureus Mu50
aaccauaacaauu

SEQ ID NO: 3965894 - RNA, 16 nt, Staphylococcus aureus subsp. aureus Mu50
aaccauaacaauuuug

SEQ ID NO: 3965895 - RNA, 17 nt, Staphylococcus aureus subsp. aureus Mu50
aaccauaaguaaaacug

SEQ ID NO: 3965896 - RNA, 16 nt, Staphylococcus aureus subsp. aureus Mu50
aaccauacauaugcua

SEQ ID NO: 3965897 - RNA, 21 nt, Staphylococcus aureus subsp. aureus Mu50
aaccauagauaauugcuauaa

SEQ ID NO: 3965898 - RNA, 16 nt, Staphylococcus aureus subsp. aureus Mu50
aaccauaguaauaaaa

SEQ ID NO: 3965899 - RNA, 18 nt, Staphylococcus aureus subsp. aureus Mu50
aaccauaguaauaaaaug

SEQ ID NO: 3965900 - RNA, 13 nt, Staphylococcus aureus subsp. aureus Mu50
aaccauagugcgu

SEQ ID NO: 3965901 - RNA, 15 nt, Staphylococcus aureus subsp. aureus Mu50
aaccaucauaaaugu

SEQ ID NO: 3965902 - RNA, 16 nt, Staphylococcus aureus subsp. aureus Mu50
aaccaucauaaauguu

SEQ ID NO: 3965903 - RNA, 14 nt, Staphylococcus aureus subsp. aureus Mu50
aacgucauuuuuaa

SEQ ID NO: 3965904 - RNA, 13 nt, Staphylococcus aureus subsp. aureus Mu50
aacguccaaacac

SEQ ID NO: 3965905 - RNA, 22 nt, Staphylococcus aureus subsp. aureus Mu50
aacgugaggcccauaaauuacu

SEQ ID NO: 3965906 - RNA, 18 nt, Staphylococcus aureus subsp. aureus Mu50
aacguuauucauuugugu

SEQ ID NO: 3965907 - RNA, 18 nt, Staphylococcus aureus subsp. aureus Mu50
aacguuauucguuaacaa

SEQ ID NO: 3965908 - RNA, 16 nt, Staphylococcus aureus subsp. aureus Mu50
aacguuauuuucaaua

SEQ ID NO: 3965909 - RNA, 20 nt, Staphylococcus aureus subsp. aureus Mu50
aacguucaaucguuucuucc

SEQ ID NO: 3965910 - RNA, 14 nt, Staphylococcus aureus subsp. aureus Mu50
aacguucacuuggu

SEQ ID NO: 3965911 - RNA, 17 nt, Staphylococcus aureus subsp. aureus Mu50
aacguucauauaugaua

SEQ ID NO: 3965912 - RNA, 22 nt, Staphylococcus aureus subsp. aureus Mu50
aacguugaguauuacuugaaaa

SEQ ID NO: 3965913 - RNA, 15 nt, Staphylococcus aureus subsp. aureus Mu50
aacguuugaagaaug

SEQ ID NO: 3965914 - RNA, 12 nt, Staphylococcus aureus subsp. aureus Mu50
aacguuuucacu

SEQ ID NO: 3965915 - RNA, 13 nt, Staphylococcus aureus subsp. aureus Mu50
aacguuuucacuu

SEQ ID NO: 3965916 - RNA, 15 nt, Staphylococcus aureus subsp. aureus Mu50
aacuaaacauugcuu

SEQ ID NO: 3965917 - RNA, 10 nt, Staphylococcus aureus subsp. aureus Mu50
aacuaaacca

SEQ ID NO: 3965918 - RNA, 13 nt, Staphylococcus aureus subsp. aureus Mu50
aacuaaauuaaaa

SEQ ID NO: 3965919 - RNA, 14 nt, Staphylococcus aureus subsp. aureus Mu50
aacuaaauuaaaag

SEQ ID NO: 3965920 - RNA, 18 nt, Staphylococcus aureus subsp. aureus Mu50
aacuaacacgucacaugg

SEQ ID NO: 3965921 - RNA, 17 nt, Staphylococcus aureus subsp. aureus Mu50
aacuaacauaauuuuua

SEQ ID NO: 3965922 - RNA, 16 nt, Staphylococcus aureus subsp. aureus Mu50
aacuaacuaauaacuc

SEQ ID NO: 3965923 - RNA, 17 nt, Staphylococcus aureus subsp. aureus Mu50
aacuaaguuauuuagua

SEQ ID NO: 3965924 - RNA, 14 nt, Staphylococcus aureus subsp. aureus Mu50
aacuaauaauuugu

SEQ ID NO: 3965925 - RNA, 15 nt, Staphylococcus aureus subsp. aureus Mu50
aacuaauaauuugua

SEQ ID NO: 3965926 - RNA, 12 nt, Staphylococcus aureus subsp. aureus Mu50
aacuaauagcau

SEQ ID NO: 3965927 - RNA, 16 nt, Staphylococcus aureus subsp. aureus Mu50
aacuaauguuaaaaua

SEQ ID NO: 3965928 - RNA, 16 nt, Staphylococcus aureus subsp. aureus Mu50
aacuacacuuaauaua

SEQ ID NO: 3965929 - RNA, 20 nt, Staphylococcus aureus subsp. aureus Mu50
aacuacgauaccggcaacug

SEQ ID NO: 3965930 - RNA, 14 nt, Staphylococcus aureus subsp. aureus Mu50
aacuacgcauuuua

SEQ ID NO: 3965931 - RNA, 17 nt, Staphylococcus aureus subsp. aureus Mu50
aacuagaaaacauaaau

SEQ ID NO: 3965932 - RNA, 18 nt, Staphylococcus aureus subsp. aureus Mu50
aacuagaacaagaauuau

SEQ ID NO: 3965933 - RNA, 22 nt, Staphylococcus aureus subsp. aureus Mu50
aacuagauguucacauucuuga

SEQ ID NO: 3965934 - RNA, 22 nt, Staphylococcus aureus subsp. aureus Mu50
aacuaguguaaugucucuuuuc

SEQ ID NO: 3965935 - RNA, 14 nt, Staphylococcus aureus subsp. aureus Mu50
aacuauaacaauag

SEQ ID NO: 3965936 - RNA, 19 nt, Staphylococcus aureus subsp. aureus Mu50
aacuauaaccuauuaaauc

SEQ ID NO: 3965937 - RNA, 17 nt, Staphylococcus aureus subsp. aureus Mu50
aacuauaauaauuggaa

SEQ ID NO: 3965938 - RNA, 14 nt, Staphylococcus aureus subsp. aureus Mu50
aacuauaaucauua

SEQ ID NO: 3965939 - RNA, 20 nt, Staphylococcus aureus subsp. aureus Mu50
aacuauauauaguugaucaa

SEQ ID NO: 3965940 - RNA, 16 nt, Staphylococcus aureus subsp. aureus Mu50
aacuauaugaaauguu

SEQ ID NO: 3965941 - RNA, 14 nt, Staphylococcus aureus subsp. aureus Mu50
aacuaucaauauaa

SEQ ID NO: 3965942 - RNA, 15 nt, Staphylococcus aureus subsp. aureus Mu50
aacuaucgauacuaa

SEQ ID NO: 3965943 - RNA, 22 nt, Staphylococcus aureus subsp. aureus Mu50
aacuaucgauacuaaacgauaa

SEQ ID NO: 3965944 - RNA, 14 nt, Staphylococcus aureus subsp. aureus Mu50
aacuaucugauuaa

SEQ ID NO: 3965945 - RNA, 16 nt, Staphylococcus aureus subsp. aureus Mu50
aacuaugaauagauga

SEQ ID NO: 3965946 - RNA, 22 nt, Staphylococcus aureus subsp. aureus Mu50
aacuauguuacuuauauauuca

SEQ ID NO: 3965947 - RNA, 17 nt, Staphylococcus aureus subsp. aureus Mu50
aacuauuaucgaagaaa

SEQ ID NO: 3965948 - RNA, 14 nt, Staphylococcus aureus subsp. aureus Mu50
aacuauugaaaaua

SEQ ID NO: 3965949 - RNA, 21 nt, Staphylococcus aureus subsp. aureus Mu50
aacuauugaaaauagaaagaa

SEQ ID NO: 3965950 - RNA, 17 nt, Staphylococcus aureus subsp. aureus Mu50
aacuauuuuaaauuaca

SEQ ID NO: 3965951 - RNA, 17 nt, Staphylococcus aureus subsp. aureus Mu50
aacucaaaaagccaaca

SEQ ID NO: 3965952 - RNA, 15 nt, Staphylococcus aureus subsp. aureus Mu50
aacucaacuuaaaua

SEQ ID NO: 3965953 - RNA, 15 nt, Staphylococcus aureus subsp. aureus Mu50
aacucacguaaaaug

SEQ ID NO: 3965954 - RNA, 24 nt, Staphylococcus aureus subsp. aureus Mu50
aacucagacugggacauagaucaa

SEQ ID NO: 3965955 - RNA, 14 nt, Staphylococcus aureus subsp. aureus Mu50
aacucauaccaaaa

SEQ ID NO: 3965956 - RNA, 17 nt, Staphylococcus aureus subsp. aureus Mu50
aacucauccauugaucu

SEQ ID NO: 3965957 - RNA, 19 nt, Staphylococcus aureus subsp. aureus Mu50
aacucguuauagauaagua

SEQ ID NO: 3965958 - RNA, 21 nt, Staphylococcus aureus subsp. aureus Mu50
aacucguugcacucuuuucuc

SEQ ID NO: 3965959 - RNA, 15 nt, Staphylococcus aureus subsp. aureus Mu50
aacucuaaaaguugu

SEQ ID NO: 3965960 - RNA, 17 nt, Staphylococcus aureus subsp. aureus Mu50
aacucuaaaaguuguaa

SEQ ID NO: 3965961 - RNA, 18 nt, Staphylococcus aureus subsp. aureus Mu50
aacucuaaaaguuguaau

SEQ ID NO: 3965962 - RNA, 19 nt, Staphylococcus aureus subsp. aureus Mu50
aacucuaaaaguuguaauu

SEQ ID NO: 3965963 - RNA, 21 nt, Staphylococcus aureus subsp. aureus Mu50
aacucuaaaaguuguaauuua

SEQ ID NO: 3965964 - RNA, 14 nt, Staphylococcus aureus subsp. aureus Mu50
aacucuaaauauaa

SEQ ID NO: 3965965 - RNA, 17 nt, Staphylococcus aureus subsp. aureus Mu50
aacucuaaauauaauag

SEQ ID NO: 3965966 - RNA, 22 nt, Staphylococcus aureus subsp. aureus Mu50
aacucuaaauauaauagaaaua

SEQ ID NO: 3965967 - RNA, 15 nt, Staphylococcus aureus subsp. aureus Mu50
aacucucuaaaaagc

SEQ ID NO: 3965968 - RNA, 14 nt, Staphylococcus aureus subsp. aureus Mu50
aacucugagcacuu

SEQ ID NO: 3965969 - RNA, 17 nt, Staphylococcus aureus subsp. aureus Mu50
aacucugauauugaucu

SEQ ID NO: 3965970 - RNA, 18 nt, Staphylococcus aureus subsp. aureus Mu50
aacucuuuaauuuuacca

SEQ ID NO: 3965971 - RNA, 14 nt, Staphylococcus aureus subsp. aureus Mu50
aacugaaauuuuuc

SEQ ID NO: 3965972 - RNA, 13 nt, Staphylococcus aureus subsp. aureus Mu50
aacugaauuucgu

SEQ ID NO: 3965973 - RNA, 21 nt, Staphylococcus aureus subsp. aureus Mu50
aacugaguucaauuaaauuau

SEQ ID NO: 3965974 - RNA, 17 nt, Staphylococcus aureus subsp. aureus Mu50
aacugauaaaaggggaa

SEQ ID NO: 3965975 - RNA, 17 nt, Staphylococcus aureus subsp. aureus Mu50
aacugaucauuuucauu

SEQ ID NO: 3965976 - RNA, 22 nt, Staphylococcus aureus subsp. aureus Mu50
aacugauugggcugauaauaaa

SEQ ID NO: 3965977 - RNA, 21 nt, Staphylococcus aureus subsp. aureus Mu50
aacugcaaacuugauucaaua

SEQ ID NO: 3965978 - RNA, 20 nt, Staphylococcus aureus subsp. aureus Mu50
aacugcauguacaucuuuag

SEQ ID NO: 3965979 - RNA, 22 nt, Staphylococcus aureus subsp. aureus Mu50
aacugccaaaaugguuaaaauc

SEQ ID NO: 3965980 - RNA, 12 nt, Staphylococcus aureus subsp. aureus Mu50
aacugccuaaua

SEQ ID NO: 3965981 - RNA, 14 nt, Staphylococcus aureus subsp. aureus Mu50
aacugcuaauuuuu

SEQ ID NO: 3965982 - RNA, 17 nt, Staphylococcus aureus subsp. aureus Mu50
aacugcuuuuuauuaug

SEQ ID NO: 3965983 - RNA, 14 nt, Staphylococcus aureus subsp. aureus Mu50
aacugggauauaga

SEQ ID NO: 3965984 - RNA, 13 nt, Staphylococcus aureus subsp. aureus Mu50
aacugugauucau

SEQ ID NO: 3965985 - RNA, 21 nt, Staphylococcus aureus subsp. aureus Mu50
aacugugcaugacgauaauga

SEQ ID NO: 3965986 - RNA, 23 nt, Staphylococcus aureus subsp. aureus Mu50
aacugugcaugacgauaaugaaa

SEQ ID NO: 3965987 - RNA, 22 nt, Staphylococcus aureus subsp. aureus Mu50
aacuguucuaaccauucguaau

SEQ ID NO: 3965988 - RNA, 11 nt, Staphylococcus aureus subsp. aureus Mu50
aacuuaaauau

SEQ ID NO: 3965989 - RNA, 20 nt, Staphylococcus aureus subsp. aureus Mu50
aacuuaaugcuucaaaugua

SEQ ID NO: 3965990 - RNA, 12 nt, Staphylococcus aureus subsp. aureus Mu50
aacuuaauuaaa

SEQ ID NO: 3965991 - RNA, 21 nt, Staphylococcus aureus subsp. aureus Mu50
aagaacuaaugguuucauaaa

SEQ ID NO: 3965992 - RNA, 13 nt, Staphylococcus aureus subsp. aureus Mu50
aagaagaaauacu

SEQ ID NO: 3965993 - RNA, 18 nt, Staphylococcus aureus subsp. aureus Mu50
aagaagauuaugaaaaca

SEQ ID NO: 3965994 - RNA, 22 nt, Staphylococcus aureus subsp. aureus Mu50
aagaagauuaugaaaacauuau

SEQ ID NO: 3965995 - RNA, 19 nt, Staphylococcus aureus subsp. aureus Mu50
aagaaggaugaguuuaaaa

SEQ ID NO: 3965996 - RNA, 19 nt, Staphylococcus aureus subsp. aureus Mu50
aagaauaaaaaaguugauu

SEQ ID NO: 3965997 - RNA, 14 nt, Staphylococcus aureus subsp. aureus Mu50
aagaauaaacaaca

SEQ ID NO: 3965998 - RNA, 17 nt, Staphylococcus aureus subsp. aureus Mu50
aagaauacaaauauuaa

SEQ ID NO: 3965999 - RNA, 15 nt, Staphylococcus aureus subsp. aureus Mu50
aagaauauaacgaau

SEQ ID NO: 3966000 - RNA, 16 nt, Staphylococcus aureus subsp. aureus Mu50
aagaauauaagugauu

SEQ ID NO: 3966001 - RNA, 20 nt, Staphylococcus aureus subsp. aureus Mu50
aagaauaugauauugauugu

SEQ ID NO: 3966002 - RNA, 21 nt, Staphylococcus aureus subsp. aureus Mu50
aagaauccuaugccaaauaac

SEQ ID NO: 3966003 - RNA, 14 nt, Staphylococcus aureus subsp. aureus Mu50
aagaaugauacugu

SEQ ID NO: 3966004 - RNA, 16 nt, Staphylococcus aureus subsp. aureus Mu50
aagaaugauuuauaaa

SEQ ID NO: 3966005 - RNA, 17 nt, Staphylococcus aureus subsp. aureus Mu50
aagaaugauuuauaaaa

SEQ ID NO: 3966006 - RNA, 19 nt, Staphylococcus aureus subsp. aureus Mu50
aagaauguacaauuuuuua

SEQ ID NO: 3966007 - RNA, 14 nt, Staphylococcus aureus subsp. aureus Mu50
aagaauuaaguagu

SEQ ID NO: 3966008 - RNA, 21 nt, Staphylococcus aureus subsp. aureus Mu50
aagaauuaauucgccuaaaug

SEQ ID NO: 3966009 - RNA, 13 nt, Staphylococcus aureus subsp. aureus Mu50
aagaauuauucaa

SEQ ID NO: 3966010 - RNA, 16 nt, Staphylococcus aureus subsp. aureus Mu50
aagaauuauucaagua

SEQ ID NO: 3966011 - RNA, 13 nt, Staphylococcus aureus subsp. aureus Mu50
aagaauuuaaaag

SEQ ID NO: 3966012 - RNA, 20 nt, Staphylococcus aureus subsp. aureus Mu50
aagacauacagucaauacaa

SEQ ID NO: 3966013 - RNA, 22 nt, Staphylococcus aureus subsp. aureus Mu50
aagacauacucacaaaaaacac

SEQ ID NO: 3966014 - RNA, 12 nt, Staphylococcus aureus subsp. aureus Mu50
aagacauaugca

SEQ ID NO: 3966015 - RNA, 16 nt, Staphylococcus aureus subsp. aureus Mu50
aagaccaaauauuuua

SEQ ID NO: 3966016 - RNA, 14 nt, Staphylococcus aureus subsp. aureus Mu50
aagaccauuuuaua

SEQ ID NO: 3966017 - RNA, 15 nt, Staphylococcus aureus subsp. aureus Mu50
aagaccauuuuauau

SEQ ID NO: 3966018 - RNA, 16 nt, Staphylococcus aureus subsp. aureus Mu50
aagaccccgaaaagag

SEQ ID NO: 3966019 - RNA, 14 nt, Staphylococcus aureus subsp. aureus Mu50
aagaccguauccug

SEQ ID NO: 3966020 - RNA, 15 nt, Staphylococcus aureus subsp. aureus Mu50
aagacgcagagccga

SEQ ID NO: 3966021 - RNA, 17 nt, Staphylococcus aureus subsp. aureus Mu50
aagacguuguaaugaca

SEQ ID NO: 3966022 - RNA, 13 nt, Staphylococcus aureus subsp. aureus Mu50
aagacuacgaaua

SEQ ID NO: 3966023 - RNA, 16 nt, Staphylococcus aureus subsp. aureus Mu50
aagacucaauuucauu

SEQ ID NO: 3966024 - RNA, 15 nt, Staphylococcus aureus subsp. aureus Mu50
aagacuucccaaucg

SEQ ID NO: 3966025 - RNA, 12 nt, Staphylococcus aureus subsp. aureus Mu50
aagacuucccua

SEQ ID NO: 3966026 - RNA, 21 nt, Staphylococcus aureus subsp. aureus Mu50
aagacuucccuauauguaggg

SEQ ID NO: 3966027 - RNA, 15 nt, Staphylococcus aureus subsp. aureus Mu50
aagagauaagaaaau

SEQ ID NO: 3966028 - RNA, 21 nt, Staphylococcus aureus subsp. aureus Mu50
aagagauacugguuaguaaaa

SEQ ID NO: 3966029 - RNA, 17 nt, Staphylococcus aureus subsp. aureus Mu50
aagagcaauuaaaguca

SEQ ID NO: 3966030 - RNA, 17 nt, Staphylococcus aureus subsp. aureus Mu50
aagagccacuaaugauu

SEQ ID NO: 3966031 - RNA, 19 nt, Staphylococcus aureus subsp. aureus Mu50
aagagguauacaguuaugc

SEQ ID NO: 3966032 - RNA, 15 nt, Staphylococcus aureus subsp. aureus Mu50
aagauaaacaagcca

SEQ ID NO: 3966033 - RNA, 20 nt, Staphylococcus aureus subsp. aureus Mu50
aagauaaacaagccaagaua

SEQ ID NO: 3966034 - RNA, 13 nt, Staphylococcus aureus subsp. aureus Mu50
aagauaaauaaaa

SEQ ID NO: 3966035 - RNA, 23 nt, Staphylococcus aureus subsp. aureus Mu50
aagauaaauaaaaggcauucuuc

SEQ ID NO: 3966036 - RNA, 22 nt, Staphylococcus aureus subsp. aureus Mu50
aagauaagaugguuugaguaaa

SEQ ID NO: 3966037 - RNA, 15 nt, Staphylococcus aureus subsp. aureus Mu50
aagauaccuuuuucu

SEQ ID NO: 3966038 - RNA, 15 nt, Staphylococcus aureus subsp. aureus Mu50
aagauacuuuuaaau

SEQ ID NO: 3966039 - RNA, 19 nt, Staphylococcus aureus subsp. aureus Mu50
aagauagaaugaauaauuc

SEQ ID NO: 3966040 - RNA, 20 nt, Staphylococcus aureus subsp. aureus Mu50
aagauaggauuuacaccuau

SEQ ID NO: 3966041 - RNA, 20 nt, Staphylococcus aureus subsp. aureus Mu50
aagauaggauuugcaccuau

SEQ ID NO: 3966042 - RNA, 23 nt, Staphylococcus aureus subsp. aureus Mu50
aagauaggauuugcaccuauacc

SEQ ID NO: 3966043 - RNA, 15 nt, Staphylococcus aureus subsp. aureus Mu50
aagauauaaggaaaa

SEQ ID NO: 3966044 - RNA, 14 nt, Staphylococcus aureus subsp. aureus Mu50
aagauauagaauuc

SEQ ID NO: 3966045 - RNA, 20 nt, Staphylococcus aureus subsp. aureus Mu50
aagauauauaacuaugguca

SEQ ID NO: 3966046 - RNA, 15 nt, Staphylococcus aureus subsp. aureus Mu50
aagauauauuguaag

SEQ ID NO: 3966047 - RNA, 15 nt, Staphylococcus aureus subsp. aureus Mu50
aagauaucuggauua

SEQ ID NO: 3966048 - RNA, 16 nt, Staphylococcus aureus subsp. aureus Mu50
aagaucaacaaugcca

SEQ ID NO: 3966049 - RNA, 20 nt, Staphylococcus aureus subsp. aureus Mu50
aagaucauuuucaacauaau

SEQ ID NO: 3966050 - RNA, 16 nt, Staphylococcus aureus subsp. aureus Mu50
aagaucgauacuuuuu

SEQ ID NO: 3966051 - RNA, 12 nt, Staphylococcus aureus subsp. aureus Mu50
aagaugaaaaag

SEQ ID NO: 3966052 - RNA, 20 nt, Staphylococcus aureus subsp. aureus Mu50
aagaugaaaaagucuuucuc

SEQ ID NO: 3966053 - RNA, 19 nt, Staphylococcus aureus subsp. aureus Mu50
aagaugauuauucucuuua

SEQ ID NO: 3966054 - RNA, 21 nt, Staphylococcus aureus subsp. aureus Mu50
aagaugauuauucucuuuauu

SEQ ID NO: 3966055 - RNA, 14 nt, Staphylococcus aureus subsp. aureus Mu50
aagaugcuuuaauu

SEQ ID NO: 3966056 - RNA, 22 nt, Staphylococcus aureus subsp. aureus Mu50
aagaugguuugaguaaauuaau

SEQ ID NO: 3966057 - RNA, 18 nt, Staphylococcus aureus subsp. aureus Mu50
aagaugguuuuguuuugc

SEQ ID NO: 3966058 - RNA, 16 nt, Staphylococcus aureus subsp. aureus Mu50
aagauguguugaaacu

SEQ ID NO: 3966059 - RNA, 23 nt, Staphylococcus aureus subsp. aureus Mu50
aagauguugaguuguaaguuauu

SEQ ID NO: 3966060 - RNA, 19 nt, Staphylococcus aureus subsp. aureus Mu50
aagauuagcuaugaagaaa

SEQ ID NO: 3966061 - RNA, 17 nt, Staphylococcus aureus subsp. aureus Mu50
aagauuaguagucaaaa

SEQ ID NO: 3966062 - RNA, 15 nt, Staphylococcus aureus subsp. aureus Mu50
aagauuaugaaaaca

SEQ ID NO: 3966063 - RNA, 21 nt, Staphylococcus aureus subsp. aureus Mu50
aagauuaugaaaacauuauua

SEQ ID NO: 3966064 - RNA, 22 nt, Staphylococcus aureus subsp. aureus Mu50
aagauuaugaaaacauuauuaa

SEQ ID NO: 3966065 - RNA, 18 nt, Staphylococcus aureus subsp. aureus Mu50
aagauuauuauuacaaug

SEQ ID NO: 3966066 - RNA, 21 nt, Staphylococcus aureus subsp. aureus Mu50
aagauuauuugcgauaucagc

SEQ ID NO: 3966067 - RNA, 15 nt, Staphylococcus aureus subsp. aureus Mu50
aagauucaacuuguu

SEQ ID NO: 3966068 - RNA, 17 nt, Staphylococcus aureus subsp. aureus Mu50
aagauuuaauaaagugu

SEQ ID NO: 3966069 - RNA, 20 nt, Staphylococcus aureus subsp. aureus Mu50
aagauuuguagcuugaauaa

SEQ ID NO: 3966070 - RNA, 22 nt, Staphylococcus aureus subsp. aureus Mu50
aagauuuguagcuugaauaaua

SEQ ID NO: 3966071 - RNA, 23 nt, Staphylococcus aureus subsp. aureus Mu50
aagauuuguagcuugaauaauau

SEQ ID NO: 3966072 - RNA, 22 nt, Staphylococcus aureus subsp. aureus Mu50
aagauuuuguugaacguuuauu

SEQ ID NO: 3966073 - RNA, 15 nt, Staphylococcus aureus subsp. aureus Mu50
aagauuuuuaacauu

SEQ ID NO: 3966074 - RNA, 20 nt, Staphylococcus aureus subsp. aureus Mu50
aagauuuuuuauguuuaauu

SEQ ID NO: 3966075 - RNA, 23 nt, Staphylococcus aureus subsp. aureus Mu50
aagcaauacgauugcaauugcuu

SEQ ID NO: 3966076 - RNA, 13 nt, Staphylococcus aureus subsp. aureus Mu50
aagcaaucauaau

SEQ ID NO: 3966077 - RNA, 18 nt, Staphylococcus aureus subsp. aureus Mu50
aagcaaucuuaguacaaa

SEQ ID NO: 3966078 - RNA, 14 nt, Staphylococcus aureus subsp. aureus Mu50
aaggcucauuuguu

SEQ ID NO: 3966079 - RNA, 19 nt, Staphylococcus aureus subsp. aureus Mu50
aaggcucauuuguuaaauu

SEQ ID NO: 3966080 - RNA, 13 nt, Staphylococcus aureus subsp. aureus Mu50
aagggagcauuuc

SEQ ID NO: 3966081 - RNA, 15 nt, Staphylococcus aureus subsp. aureus Mu50
aagggagguauauac

SEQ ID NO: 3966082 - RNA, 13 nt, Staphylococcus aureus subsp. aureus Mu50
aagggaguauuuu

SEQ ID NO: 3966083 - RNA, 20 nt, Staphylococcus aureus subsp. aureus Mu50
aagggaucggucuugaaaac

SEQ ID NO: 3966084 - RNA, 20 nt, Staphylococcus aureus subsp. aureus Mu50
aagggaucguucuuugauua

SEQ ID NO: 3966085 - RNA, 12 nt, Staphylococcus aureus subsp. aureus Mu50
aagggcaaaaaa

SEQ ID NO: 3966086 - RNA, 22 nt, Staphylococcus aureus subsp. aureus Mu50
aaggggaugggagaaauuuuuc

SEQ ID NO: 3966087 - RNA, 15 nt, Staphylococcus aureus subsp. aureus Mu50
aaggggguaauacua

SEQ ID NO: 3966088 - RNA, 23 nt, Staphylococcus aureus subsp. aureus Mu50
aaggggguaauacuauaugaaaa

SEQ ID NO: 3966089 - RNA, 16 nt, Staphylococcus aureus subsp. aureus Mu50
aagggguauguuuguu

SEQ ID NO: 3966090 - RNA, 23 nt, Staphylococcus aureus subsp. aureus Mu50
aagggguuuuuucuuauguauau

SEQ ID NO: 3966091 - RNA, 22 nt, Staphylococcus aureus subsp. aureus Mu50
aaggguguuuagauagcucuau

SEQ ID NO: 3966092 - RNA, 16 nt, Staphylococcus aureus subsp. aureus Mu50
aagguaauuuaacauu

SEQ ID NO: 3966093 - RNA, 21 nt, Staphylococcus aureus subsp. aureus Mu50
aagguauaucuucauuuaaaa

SEQ ID NO: 3966094 - RNA, 15 nt, Staphylococcus aureus subsp. aureus Mu50
aagguauucuauuuu

SEQ ID NO: 3966095 - RNA, 16 nt, Staphylococcus aureus subsp. aureus Mu50
aaggucaaaaaauuaa

SEQ ID NO: 3966096 - RNA, 15 nt, Staphylococcus aureus subsp. aureus Mu50
aaggugauugaacaa

SEQ ID NO: 3966097 - RNA, 18 nt, Staphylococcus aureus subsp. aureus Mu50
aagguuaaauauuuaauu

SEQ ID NO: 3966098 - RNA, 23 nt, Staphylococcus aureus subsp. aureus Mu50
aagguuguuuuucaucauuaaaa

SEQ ID NO: 3966099 - RNA, 22 nt, Staphylococcus aureus subsp. aureus Mu50
aaguaaagggagguauauacaa

SEQ ID NO: 3966100 - RNA, 12 nt, Staphylococcus aureus subsp. aureus Mu50
aaguaaauaaua

SEQ ID NO: 3966101 - RNA, 21 nt, Staphylococcus aureus subsp. aureus Mu50
aaguaaauguuuuauguauuu

SEQ ID NO: 3966102 - RNA, 20 nt, Staphylococcus aureus subsp. aureus Mu50
aaguaacauacuauaaaaau

SEQ ID NO: 3966103 - RNA, 13 nt, Staphylococcus aureus subsp. aureus Mu50
aaguaacucaagu

SEQ ID NO: 3966104 - RNA, 19 nt, Staphylococcus aureus subsp. aureus Mu50
aaguaagcagagccauaau

SEQ ID NO: 3966105 - RNA, 13 nt, Staphylococcus aureus subsp. aureus Mu50
aaguaaguaaaau

SEQ ID NO: 3966106 - RNA, 14 nt, Staphylococcus aureus subsp. aureus Mu50
aaguaaguaaaaua

SEQ ID NO: 3966107 - RNA, 14 nt, Staphylococcus aureus subsp. aureus Mu50
aaguaauaaaauaa

SEQ ID NO: 3966108 - RNA, 19 nt, Staphylococcus aureus subsp. aureus Mu50
aaguaauaaaauaaaaaaa

SEQ ID NO: 3966109 - RNA, 17 nt, Staphylococcus aureus subsp. aureus Mu50
aaguaauaaguaauaau

SEQ ID NO: 3966110 - RNA, 18 nt, Staphylococcus aureus subsp. aureus Mu50
aaguaauaaguaauaauu

SEQ ID NO: 3966111 - RNA, 20 nt, Staphylococcus aureus subsp. aureus Mu50
aaguaauaauuuauugauaa

SEQ ID NO: 3966112 - RNA, 16 nt, Staphylococcus aureus subsp. aureus Mu50
aaguaauagcaaccau

SEQ ID NO: 3966113 - RNA, 16 nt, Staphylococcus aureus subsp. aureus Mu50
aaguaaugauacgcac

SEQ ID NO: 3966114 - RNA, 24 nt, Staphylococcus aureus subsp. aureus Mu50
aaguaaugcuguacuauauucaau

SEQ ID NO: 3966115 - RNA, 19 nt, Staphylococcus aureus subsp. aureus Mu50
aaguaauguuaaacacuca

SEQ ID NO: 3966116 - RNA, 13 nt, Staphylococcus aureus subsp. aureus Mu50
aaguaauuaaaua

SEQ ID NO: 3966117 - RNA, 14 nt, Staphylococcus aureus subsp. aureus Mu50
aaguaauuaaauac

SEQ ID NO: 3966118 - RNA, 17 nt, Staphylococcus aureus subsp. aureus Mu50
aaguaauuuaauugguu

SEQ ID NO: 3966119 - RNA, 13 nt, Staphylococcus aureus subsp. aureus Mu50
aaguacaaauaau

SEQ ID NO: 3966120 - RNA, 17 nt, Staphylococcus aureus subsp. aureus Mu50
aaguacaaauaauacag

SEQ ID NO: 3966121 - RNA, 19 nt, Staphylococcus aureus subsp. aureus Mu50
aaguacacgaauaccaaga

SEQ ID NO: 3966122 - RNA, 21 nt, Staphylococcus aureus subsp. aureus Mu50
aaguaccuaaaauagaaaaau

SEQ ID NO: 3966123 - RNA, 21 nt, Staphylococcus aureus subsp. aureus Mu50
aaguacgacgguauaaaaaaa

SEQ ID NO: 3966124 - RNA, 14 nt, Staphylococcus aureus subsp. aureus Mu50
aaguacuuacaaau

SEQ ID NO: 3966125 - RNA, 15 nt, Staphylococcus aureus subsp. aureus Mu50
aaguacuuacaaaua

SEQ ID NO: 3966126 - RNA, 16 nt, Staphylococcus aureus subsp. aureus Mu50
aaguacuuacaaauau

SEQ ID NO: 3966127 - RNA, 22 nt, Staphylococcus aureus subsp. aureus Mu50
aaguacuuaccuuucaaauaua

SEQ ID NO: 3966128 - RNA, 17 nt, Staphylococcus aureus subsp. aureus Mu50
aaguacuucggugcuug

SEQ ID NO: 3966129 - RNA, 13 nt, Staphylococcus aureus subsp. aureus Mu50
aaguacuuuacca

SEQ ID NO: 3966130 - RNA, 15 nt, Staphylococcus aureus subsp. aureus Mu50
aaguagaaccuauau

SEQ ID NO: 3966131 - RNA, 16 nt, Staphylococcus aureus subsp. aureus Mu50
aaguagacauugaaua

SEQ ID NO: 3966132 - RNA, 18 nt, Staphylococcus aureus subsp. aureus Mu50
aaguagauugauauccuu

SEQ ID NO: 3966133 - RNA, 23 nt, Staphylococcus aureus subsp. aureus Mu50
aaguagcucaaaacaauuuaaaa

SEQ ID NO: 3966134 - RNA, 21 nt, Staphylococcus aureus subsp. aureus Mu50
aaguagucgaagaagauuaug

SEQ ID NO: 3966135 - RNA, 19 nt, Staphylococcus aureus subsp. aureus Mu50
aaguagucuacaguaaauu

SEQ ID NO: 3966136 - RNA, 14 nt, Staphylococcus aureus subsp. aureus Mu50
aaguaguuguuaua

SEQ ID NO: 3966137 - RNA, 17 nt, Staphylococcus aureus subsp. aureus Mu50
aaguaguuguuauauuc

SEQ ID NO: 3966138 - RNA, 17 nt, Staphylococcus aureus subsp. aureus Mu50
aaguaguuucauugcuu

SEQ ID NO: 3966139 - RNA, 19 nt, Staphylococcus aureus subsp. aureus Mu50
aaguauaaguagcucaaaa

SEQ ID NO: 3966140 - RNA, 15 nt, Staphylococcus aureus subsp. aureus Mu50
aaguauaauuaaacu

SEQ ID NO: 3966141 - RNA, 21 nt, Staphylococcus aureus subsp. aureus Mu50
aaguauacuugaagaaucagg

SEQ ID NO: 3966142 - RNA, 18 nt, Staphylococcus aureus subsp. aureus Mu50
aaguauagcuuuuaucca

SEQ ID NO: 3966143 - RNA, 16 nt, Staphylococcus aureus subsp. aureus Mu50
aaguauauaauugauu

SEQ ID NO: 3966144 - RNA, 14 nt, Staphylococcus aureus subsp. aureus Mu50
aaguauauacuaau

SEQ ID NO: 3966145 - RNA, 15 nt, Staphylococcus aureus subsp. aureus Mu50
aaguauauacuaauc

SEQ ID NO: 3966146 - RNA, 13 nt, Staphylococcus aureus subsp. aureus Mu50
aaguauaugaauc

SEQ ID NO: 3966147 - RNA, 20 nt, Staphylococcus aureus subsp. aureus Mu50
aaguauaugaaucgauauaa

SEQ ID NO: 3966148 - RNA, 16 nt, Staphylococcus aureus subsp. aureus Mu50
aaguaucggugauuua

SEQ ID NO: 3966149 - RNA, 17 nt, Staphylococcus aureus subsp. aureus Mu50
aaguaucggugauuuaa

SEQ ID NO: 3966150 - RNA, 18 nt, Staphylococcus aureus subsp. aureus Mu50
aaguaucuaugaaauuuu

SEQ ID NO: 3966151 - RNA, 12 nt, Staphylococcus aureus subsp. aureus Mu50
aaguaucuguga

SEQ ID NO: 3966152 - RNA, 20 nt, Staphylococcus aureus subsp. aureus Mu50
aaguaucugugaauaugcuu

SEQ ID NO: 3966153 - RNA, 21 nt, Staphylococcus aureus subsp. aureus Mu50
aaguaucugugaauaugcuuu

SEQ ID NO: 3966154 - RNA, 21 nt, Staphylococcus aureus subsp. aureus Mu50
aaguaugagacgcauugcaag

SEQ ID NO: 3966155 - RNA, 17 nt, Staphylococcus aureus subsp. aureus Mu50
aaguaugagugauagaa

SEQ ID NO: 3966156 - RNA, 20 nt, Staphylococcus aureus subsp. aureus Mu50
aaguauggacuaagauauaa

SEQ ID NO: 3966157 - RNA, 20 nt, Staphylococcus aureus subsp. aureus Mu50
aaguaugucaucuucaauuc

SEQ ID NO: 3966158 - RNA, 22 nt, Staphylococcus aureus subsp. aureus Mu50
aaguaugucaucuucaauucuu

SEQ ID NO: 3966159 - RNA, 15 nt, Staphylococcus aureus subsp. aureus Mu50
aaguauguugucaua

SEQ ID NO: 3966160 - RNA, 13 nt, Staphylococcus aureus subsp. aureus Mu50
aaguauuacuuua

SEQ ID NO: 3966161 - RNA, 14 nt, Staphylococcus aureus subsp. aureus Mu50
aaguauuagauaua

SEQ ID NO: 3966162 - RNA, 15 nt, Staphylococcus aureus subsp. aureus Mu50
aaguauuagauauau

SEQ ID NO: 3966163 - RNA, 19 nt, Staphylococcus aureus subsp. aureus Mu50
aaguauuagauauauuuga

SEQ ID NO: 3966164 - RNA, 14 nt, Staphylococcus aureus subsp. aureus Mu50
aaguauuaugauug

SEQ ID NO: 3966165 - RNA, 16 nt, Staphylococcus aureus subsp. aureus Mu50
aaguauuaugauugcu

SEQ ID NO: 3966166 - RNA, 18 nt, Staphylococcus aureus subsp. aureus Mu50
aaguugauuauucuauau

SEQ ID NO: 3966167 - RNA, 17 nt, Staphylococcus aureus subsp. aureus Mu50
aaguugcacauuauaaa

SEQ ID NO: 3966168 - RNA, 16 nt, Staphylococcus aureus subsp. aureus Mu50
aaguugcauauaaaaa

SEQ ID NO: 3966169 - RNA, 19 nt, Staphylococcus aureus subsp. aureus Mu50
aaguuggcggggccccaac

SEQ ID NO: 3966170 - RNA, 23 nt, Staphylococcus aureus subsp. aureus Mu50
aaguuggcggggccccaacacag

SEQ ID NO: 3966171 - RNA, 14 nt, Staphylococcus aureus subsp. aureus Mu50
aaguuggugugcaa

SEQ ID NO: 3966172 - RNA, 15 nt, Staphylococcus aureus subsp. aureus Mu50
aaguuguaauuuaaa

SEQ ID NO: 3966173 - RNA, 16 nt, Staphylococcus aureus subsp. aureus Mu50
aaguuguaauuuaaaa

SEQ ID NO: 3966174 - RNA, 19 nt, Staphylococcus aureus subsp. aureus Mu50
aaguuguggucuaaccauc

SEQ ID NO: 3966175 - RNA, 16 nt, Staphylococcus aureus subsp. aureus Mu50
aaguuguugaaauuuc

SEQ ID NO: 3966176 - RNA, 11 nt, Staphylococcus aureus subsp. aureus Mu50
aaguuuaaaua

SEQ ID NO: 3966177 - RNA, 12 nt, Staphylococcus aureus subsp. aureus Mu50
aaguuuaaauau

SEQ ID NO: 3966178 - RNA, 16 nt, Staphylococcus aureus subsp. aureus Mu50
aaguuuaaaugugcaa

SEQ ID NO: 3966179 - RNA, 18 nt, Staphylococcus aureus subsp. aureus Mu50
aaguuuaagucaguccau

SEQ ID NO: 3966180 - RNA, 16 nt, Staphylococcus aureus subsp. aureus Mu50
aaguuuauacuuaaua

SEQ ID NO: 3966181 - RNA, 16 nt, Staphylococcus aureus subsp. aureus Mu50
aaguuucggaaaaaga

SEQ ID NO: 3966182 - RNA, 22 nt, Staphylococcus aureus subsp. aureus Mu50
aaguuucggaaaaagaugaaaa

SEQ ID NO: 3966183 - RNA, 13 nt, Staphylococcus aureus subsp. aureus Mu50
aaguuugaaucau

SEQ ID NO: 3966184 - RNA, 23 nt, Staphylococcus aureus subsp. aureus Mu50
aaguuuguauauucuuuuuaacu

SEQ ID NO: 3966185 - RNA, 19 nt, Staphylococcus aureus subsp. aureus Mu50
aaguuugucuuugaacaua

SEQ ID NO: 3966186 - RNA, 20 nt, Staphylococcus aureus subsp. aureus Mu50
aaguuugucuuugaacauau

SEQ ID NO: 3966187 - RNA, 18 nt, Staphylococcus aureus subsp. aureus Mu50
aaguuuuagcuuguuguu

SEQ ID NO: 3966188 - RNA, 13 nt, Staphylococcus aureus subsp. aureus Mu50
aaguuuucauuuu

SEQ ID NO: 3966189 - RNA, 13 nt, Staphylococcus aureus subsp. aureus Mu50
aaguuuuucaggg

SEQ ID NO: 3966190 - RNA, 13 nt, Staphylococcus aureus subsp. aureus Mu50
aaguuuuugaaua

SEQ ID NO: 3966191 - RNA, 13 nt, Staphylococcus aureus subsp. aureus Mu50
aauaaaaaaccaa

SEQ ID NO: 3966192 - RNA, 13 nt, Staphylococcus aureus subsp. aureus Mu50
aauaaaaaaugca

SEQ ID NO: 3966193 - RNA, 15 nt, Staphylococcus aureus subsp. aureus Mu50
aauaaaaaaugcacu

SEQ ID NO: 3966194 - RNA, 21 nt, Staphylococcus aureus subsp. aureus Mu50
aauaaaaaccaauauuucugg

SEQ ID NO: 3966195 - RNA, 18 nt, Staphylococcus aureus subsp. aureus Mu50
aauaaaaaccagcuaaca

SEQ ID NO: 3966196 - RNA, 17 nt, Staphylococcus aureus subsp. aureus Mu50
aauaaaaacuucuauca

SEQ ID NO: 3966197 - RNA, 21 nt, Staphylococcus aureus subsp. aureus Mu50
aauaaaaauauugcguuuaau

SEQ ID NO: 3966198 - RNA, 12 nt, Staphylococcus aureus subsp. aureus Mu50
aauaaaaaugcc

SEQ ID NO: 3966199 - RNA, 15 nt, Staphylococcus aureus subsp. aureus Mu50
aauaaaaauuauaua

SEQ ID NO: 3966200 - RNA, 17 nt, Staphylococcus aureus subsp. aureus Mu50
aauaaaaauuauauaaa

SEQ ID NO: 3966201 - RNA, 19 nt, Staphylococcus aureus subsp. aureus Mu50
aauaaaaccgguacuuuca

SEQ ID NO: 3966202 - RNA, 21 nt, Staphylococcus aureus subsp. aureus Mu50
aauaaaacgacucauuauaaa

SEQ ID NO: 3966203 - RNA, 20 nt, Staphylococcus aureus subsp. aureus Mu50
aauaaaacgugcaaauaaaa

SEQ ID NO: 3966204 - RNA, 19 nt, Staphylococcus aureus subsp. aureus Mu50
aauaaaacuuauaacugau

SEQ ID NO: 3966205 - RNA, 13 nt, Staphylococcus aureus subsp. aureus Mu50
aauaaaauauauc

SEQ ID NO: 3966206 - RNA, 15 nt, Staphylococcus aureus subsp. aureus Mu50
aauaaaauauaucuu

SEQ ID NO: 3966207 - RNA, 16 nt, Staphylococcus aureus subsp. aureus Mu50
aauaaaauauaucuua

SEQ ID NO: 3966208 - RNA, 14 nt, Staphylococcus aureus subsp. aureus Mu50
aauaaaaucaaagc

SEQ ID NO: 3966209 - RNA, 12 nt, Staphylococcus aureus subsp. aureus Mu50
aauaaaaugaug

SEQ ID NO: 3966210 - RNA, 14 nt, Staphylococcus aureus subsp. aureus Mu50
aauaaaaugcaaag

SEQ ID NO: 3966211 - RNA, 14 nt, Staphylococcus aureus subsp. aureus Mu50
aauaaaaugcuaca

SEQ ID NO: 3966212 - RNA, 13 nt, Staphylococcus aureus subsp. aureus Mu50
aauaaaauuaaaa

SEQ ID NO: 3966213 - RNA, 15 nt, Staphylococcus aureus subsp. aureus Mu50
aauaaaauucuauaa

SEQ ID NO: 3966214 - RNA, 22 nt, Staphylococcus aureus subsp. aureus Mu50
aauaaaauugugccauuugcaa

SEQ ID NO: 3966215 - RNA, 22 nt, Staphylococcus aureus subsp. aureus Mu50
aauaaacaacugcaauagcuau

SEQ ID NO: 3966216 - RNA, 12 nt, Staphylococcus aureus subsp. aureus Mu50
aauaaaccagug

SEQ ID NO: 3966217 - RNA, 22 nt, Staphylococcus aureus subsp. aureus Mu50
aauaaaccgauuguuucaccag

SEQ ID NO: 3966218 - RNA, 18 nt, Staphylococcus aureus subsp. aureus Mu50
aauaaaccuacaauauag

SEQ ID NO: 3966219 - RNA, 21 nt, Staphylococcus aureus subsp. aureus Mu50
aauaaaccuacaauauagaaa

SEQ ID NO: 3966220 - RNA, 18 nt, Staphylococcus aureus subsp. aureus Mu50
aauaaacuuuaugaaauu

SEQ ID NO: 3966221 - RNA, 21 nt, Staphylococcus aureus subsp. aureus Mu50
aauaaagauuauaucuuuaua

SEQ ID NO: 3966222 - RNA, 18 nt, Staphylococcus aureus subsp. aureus Mu50
aauaaagcaauguugcau

SEQ ID NO: 3966223 - RNA, 22 nt, Staphylococcus aureus subsp. aureus Mu50
aauaaagcguccucuugugaaa

SEQ ID NO: 3966224 - RNA, 12 nt, Staphylococcus aureus subsp. aureus Mu50
aauaaauaacuu

SEQ ID NO: 3966225 - RNA, 14 nt, Staphylococcus aureus subsp. aureus Mu50
aauaaauacaauag

SEQ ID NO: 3966226 - RNA, 21 nt, Staphylococcus aureus subsp. aureus Mu50
aauaaauaggaugaaaaagau

SEQ ID NO: 3966227 - RNA, 18 nt, Staphylococcus aureus subsp. aureus Mu50
aauaaaucacgccauaau

SEQ ID NO: 3966228 - RNA, 13 nt, Staphylococcus aureus subsp. aureus Mu50
aauaaaucauacg

SEQ ID NO: 3966229 - RNA, 21 nt, Staphylococcus aureus subsp. aureus Mu50
aauaaaucauuaguuguauca

SEQ ID NO: 3966230 - RNA, 13 nt, Staphylococcus aureus subsp. aureus Mu50
aauaaaucuuucc

SEQ ID NO: 3966231 - RNA, 19 nt, Staphylococcus aureus subsp. aureus Mu50
aauaaaugacauuuaauac

SEQ ID NO: 3966232 - RNA, 21 nt, Staphylococcus aureus subsp. aureus Mu50
aauaaaugacuucacauuuau

SEQ ID NO: 3966233 - RNA, 20 nt, Staphylococcus aureus subsp. aureus Mu50
aauaaaugcuauauuuagaa

SEQ ID NO: 3966234 - RNA, 13 nt, Staphylococcus aureus subsp. aureus Mu50
aauaaauguuaaa

SEQ ID NO: 3966235 - RNA, 21 nt, Staphylococcus aureus subsp. aureus Mu50
aauaaauguuaaagauuauua

SEQ ID NO: 3966236 - RNA, 14 nt, Staphylococcus aureus subsp. aureus Mu50
aauaaauuaaauuu

SEQ ID NO: 3966237 - RNA, 18 nt, Staphylococcus aureus subsp. aureus Mu50
aauaaauugacucaaaga

SEQ ID NO: 3966238 - RNA, 17 nt, Staphylococcus aureus subsp. aureus Mu50
aauaaauuguauuucuu

SEQ ID NO: 3966239 - RNA, 15 nt, Staphylococcus aureus subsp. aureus Mu50
aauaaauuuuauaua

SEQ ID NO: 3966240 - RNA, 17 nt, Staphylococcus aureus subsp. aureus Mu50
aauaaauuuugcgaaaa

SEQ ID NO: 3966241 - RNA, 21 nt, Staphylococcus aureus subsp. aureus Mu50
aauaaauuuugcgaaaauauc

SEQ ID NO: 3966242 - RNA, 18 nt, Staphylococcus aureus subsp. aureus Mu50
aauaacaaaauuaaauau

SEQ ID NO: 3966243 - RNA, 13 nt, Staphylococcus aureus subsp. aureus Mu50
aauaacaaacauu

SEQ ID NO: 3966244 - RNA, 22 nt, Staphylococcus aureus subsp. aureus Mu50
aauaacaacgauaauuguuaaa

SEQ ID NO: 3966245 - RNA, 22 nt, Staphylococcus aureus subsp. aureus Mu50
aauaacaauagugacuuuuaua

SEQ ID NO: 3966246 - RNA, 21 nt, Staphylococcus aureus subsp. aureus Mu50
aauaacaccaauugaauauuu

SEQ ID NO: 3966247 - RNA, 22 nt, Staphylococcus aureus subsp. aureus Mu50
aauaacaccaauugaauauuuu

SEQ ID NO: 3966248 - RNA, 17 nt, Staphylococcus aureus subsp. aureus Mu50
aauaacacgauuugguu

SEQ ID NO: 3966249 - RNA, 22 nt, Staphylococcus aureus subsp. aureus Mu50
aauaacacgauuugguugaacu

SEQ ID NO: 3966250 - RNA, 19 nt, Staphylococcus aureus subsp. aureus Mu50
aauaacauccccaaaaaua

SEQ ID NO: 3966251 - RNA, 12 nt, Staphylococcus aureus subsp. aureus Mu50
aauaacaucuaa

SEQ ID NO: 3966252 - RNA, 15 nt, Staphylococcus aureus subsp. aureus Mu50
aauaacaucuaaauu

SEQ ID NO: 3966253 - RNA, 13 nt, Staphylococcus aureus subsp. aureus Mu50
aauaacauugaac

SEQ ID NO: 3966254 - RNA, 17 nt, Staphylococcus aureus subsp. aureus Mu50
aauaauuuaacuaauca

SEQ ID NO: 3966255 - RNA, 16 nt, Staphylococcus aureus subsp. aureus Mu50
aauaauuuaauauuua

SEQ ID NO: 3966256 - RNA, 16 nt, Staphylococcus aureus subsp. aureus Mu50
aauaauuuacauuaau

SEQ ID NO: 3966257 - RNA, 17 nt, Staphylococcus aureus subsp. aureus Mu50
aauaauuuacauuaauu

SEQ ID NO: 3966258 - RNA, 19 nt, Staphylococcus aureus subsp. aureus Mu50
aauaauuucaguucuuaga

SEQ ID NO: 3966259 - RNA, 19 nt, Staphylococcus aureus subsp. aureus Mu50
aauaauuucggauuaucug

SEQ ID NO: 3966260 - RNA, 17 nt, Staphylococcus aureus subsp. aureus Mu50
aauaauuuguaauuccu

SEQ ID NO: 3966261 - RNA, 16 nt, Staphylococcus aureus subsp. aureus Mu50
aauaauuuuaaaaaua

SEQ ID NO: 3966262 - RNA, 20 nt, Staphylococcus aureus subsp. aureus Mu50
aauaauuuuaaaaauaaaaa

SEQ ID NO: 3966263 - RNA, 14 nt, Staphylococcus aureus subsp. aureus Mu50
aauaauuuugauau

SEQ ID NO: 3966264 - RNA, 14 nt, Staphylococcus aureus subsp. aureus Mu50
aauacaaaaauaua

SEQ ID NO: 3966265 - RNA, 12 nt, Staphylococcus aureus subsp. aureus Mu50
aauacaaacccu

SEQ ID NO: 3966266 - RNA, 21 nt, Staphylococcus aureus subsp. aureus Mu50
aauacaaacccuuuaaacaua

SEQ ID NO: 3966267 - RNA, 22 nt, Staphylococcus aureus subsp. aureus Mu50
aauacaaagccuuaauaucaug

SEQ ID NO: 3966268 - RNA, 13 nt, Staphylococcus aureus subsp. aureus Mu50
aauacaaauauua

SEQ ID NO: 3966269 - RNA, 16 nt, Staphylococcus aureus subsp. aureus Mu50
aauacaaauauuaagu

SEQ ID NO: 3966270 - RNA, 19 nt, Staphylococcus aureus subsp. aureus Mu50
aauacaagucuuuacucua

SEQ ID NO: 3966271 - RNA, 13 nt, Staphylococcus aureus subsp. aureus Mu50
aauacaauuucuu

SEQ ID NO: 3966272 - RNA, 18 nt, Staphylococcus aureus subsp. aureus Mu50
aauacaauuucuucauuu

SEQ ID NO: 3966273 - RNA, 21 nt, Staphylococcus aureus subsp. aureus Mu50
aauacaauuucuucauuuuca

SEQ ID NO: 3966274 - RNA, 21 nt, Staphylococcus aureus subsp. aureus Mu50
aauacacgacgcuaaacaaag

SEQ ID NO: 3966275 - RNA, 22 nt, Staphylococcus aureus subsp. aureus Mu50
aauacacgacgcuaaacaaagg

SEQ ID NO: 3966276 - RNA, 15 nt, Staphylococcus aureus subsp. aureus Mu50
aauacacuugauaaa

SEQ ID NO: 3966277 - RNA, 18 nt, Staphylococcus aureus subsp. aureus Mu50
aauacacuugauaaaacu

SEQ ID NO: 3966278 - RNA, 23 nt, Staphylococcus aureus subsp. aureus Mu50
aauacacuugauaaaacuaauga

SEQ ID NO: 3966279 - RNA, 11 nt, Staphylococcus aureus subsp. aureus Mu50
aauacagauga

SEQ ID NO: 3966280 - RNA, 15 nt, Staphylococcus aureus subsp. aureus Mu50
aauacagaugaugcu

SEQ ID NO: 3966281 - RNA, 19 nt, Staphylococcus aureus subsp. aureus Mu50
aauacagcuagcaagaaua

SEQ ID NO: 3966282 - RNA, 15 nt, Staphylococcus aureus subsp. aureus Mu50
aauacauaaugguuc

SEQ ID NO: 3966283 - RNA, 15 nt, Staphylococcus aureus subsp. aureus Mu50
aauacauaauuaacu

SEQ ID NO: 3966284 - RNA, 16 nt, Staphylococcus aureus subsp. aureus Mu50
aauacauacugauuaa

SEQ ID NO: 3966285 - RNA, 21 nt, Staphylococcus aureus subsp. aureus Mu50
aauacauacugauuaaacugu

SEQ ID NO: 3966286 - RNA, 18 nt, Staphylococcus aureus subsp. aureus Mu50
aauacauagguucaucuu

SEQ ID NO: 3966287 - RNA, 14 nt, Staphylococcus aureus subsp. aureus Mu50
aauacaucaucaag

SEQ ID NO: 3966288 - RNA, 14 nt, Staphylococcus aureus subsp. aureus Mu50
aauacauccauacu

SEQ ID NO: 3966289 - RNA, 21 nt, Staphylococcus aureus subsp. aureus Mu50
aauacauccauacuucuauuu

SEQ ID NO: 3966290 - RNA, 18 nt, Staphylococcus aureus subsp. aureus Mu50
aauacaucuaauaaauau

SEQ ID NO: 3966291 - RNA, 20 nt, Staphylococcus aureus subsp. aureus Mu50
aauacaucuaauaaauauag

SEQ ID NO: 3966292 - RNA, 15 nt, Staphylococcus aureus subsp. aureus Mu50
aauacaugaguaaaa

SEQ ID NO: 3966293 - RNA, 22 nt, Staphylococcus aureus subsp. aureus Mu50
aauacaugaguaaaacucaugc

SEQ ID NO: 3966294 - RNA, 19 nt, Staphylococcus aureus subsp. aureus Mu50
aauacaugugggauaucuu

SEQ ID NO: 3966295 - RNA, 20 nt, Staphylococcus aureus subsp. aureus Mu50
aauacaugugggauaucuuc

SEQ ID NO: 3966296 - RNA, 17 nt, Staphylococcus aureus subsp. aureus Mu50
aauacauuauguucuuc

SEQ ID NO: 3966297 - RNA, 16 nt, Staphylococcus aureus subsp. aureus Mu50
aauacauuucaaaaaa

SEQ ID NO: 3966298 - RNA, 15 nt, Staphylococcus aureus subsp. aureus Mu50
aauacauuuuuauac

SEQ ID NO: 3966299 - RNA, 16 nt, Staphylococcus aureus subsp. aureus Mu50
aauacauuuuuauaca

SEQ ID NO: 3966300 - RNA, 20 nt, Staphylococcus aureus subsp. aureus Mu50
aauaccacgacucauuagau

SEQ ID NO: 3966301 - RNA, 18 nt, Staphylococcus aureus subsp. aureus Mu50
aauaccagaugaaccaaa

SEQ ID NO: 3966302 - RNA, 21 nt, Staphylococcus aureus subsp. aureus Mu50
aauaccagaugaaccaaaaaa

SEQ ID NO: 3966303 - RNA, 14 nt, Staphylococcus aureus subsp. aureus Mu50
aauaccauaauuaa

SEQ ID NO: 3966304 - RNA, 19 nt, Staphylococcus aureus subsp. aureus Mu50
aauaccauugugaugauaa

SEQ ID NO: 3966305 - RNA, 21 nt, Staphylococcus aureus subsp. aureus Mu50
aauaccauugugaugauaauu

SEQ ID NO: 3966306 - RNA, 18 nt, Staphylococcus aureus subsp. aureus Mu50
aauacccuacuauauauc

SEQ ID NO: 3966307 - RNA, 20 nt, Staphylococcus aureus subsp. aureus Mu50
aauacccuacuauauaucac

SEQ ID NO: 3966308 - RNA, 15 nt, Staphylococcus aureus subsp. aureus Mu50
aauaccgaauaauuu

SEQ ID NO: 3966309 - RNA, 20 nt, Staphylococcus aureus subsp. aureus Mu50
aauaccguuauagcucauua

SEQ ID NO: 3966310 - RNA, 17 nt, Staphylococcus aureus subsp. aureus Mu50
aauaccuaaccauaaca

SEQ ID NO: 3966311 - RNA, 18 nt, Staphylococcus aureus subsp. aureus Mu50
aauaccuaauugcuuaau

SEQ ID NO: 3966312 - RNA, 21 nt, Staphylococcus aureus subsp. aureus Mu50
aauaccuaauugcuuaauauc

SEQ ID NO: 3966313 - RNA, 16 nt, Staphylococcus aureus subsp. aureus Mu50
aauaccuaccacaaua

SEQ ID NO: 3966314 - RNA, 22 nt, Staphylococcus aureus subsp. aureus Mu50
aauaccuaugauauaugcugca

SEQ ID NO: 3966315 - RNA, 17 nt, Staphylococcus aureus subsp. aureus Mu50
aauaccuccccaacuua

SEQ ID NO: 3966316 - RNA, 18 nt, Staphylococcus aureus subsp. aureus Mu50
aauaccucuacauuauau

SEQ ID NO: 3966317 - RNA, 20 nt, Staphylococcus aureus subsp. aureus Mu50
aauaccuuugccguauuuca

SEQ ID NO: 3966318 - RNA, 13 nt, Staphylococcus aureus subsp. aureus Mu50
aauaccuuuuucu

SEQ ID NO: 3966319 - RNA, 20 nt, Staphylococcus aureus subsp. aureus Mu50
aauaccuuuuucuaaaccaa

SEQ ID NO: 3966320 - RNA, 16 nt, Staphylococcus aureus subsp. aureus Mu50
aauacgaaguguuaua

SEQ ID NO: 3966321 - RNA, 16 nt, Staphylococcus aureus subsp. aureus Mu50
aauacgaauuucauag

SEQ ID NO: 3966322 - RNA, 15 nt, Staphylococcus aureus subsp. aureus Mu50
aauacgaguggauac

SEQ ID NO: 3966323 - RNA, 21 nt, Staphylococcus aureus subsp. aureus Mu50
aauacgaguggauacuauacu

SEQ ID NO: 3966324 - RNA, 21 nt, Staphylococcus aureus subsp. aureus Mu50
aauacgaguguuuuaaucuua

SEQ ID NO: 3966325 - RNA, 13 nt, Staphylococcus aureus subsp. aureus Mu50
aauacgauaauaa

SEQ ID NO: 3966326 - RNA, 16 nt, Staphylococcus aureus subsp. aureus Mu50
aauacgauaauaacua

SEQ ID NO: 3966327 - RNA, 21 nt, Staphylococcus aureus subsp. aureus Mu50
aauacgaugaugauuuauaaa

SEQ ID NO: 3966328 - RNA, 21 nt, Staphylococcus aureus subsp. aureus Mu50
aauacgccaaauaucaguaau

SEQ ID NO: 3966329 - RNA, 22 nt, Staphylococcus aureus subsp. aureus Mu50
aauacgccaaauaucaguaaua

SEQ ID NO: 3966330 - RNA, 20 nt, Staphylococcus aureus subsp. aureus Mu50
aauacguguguuuucuuuuc

SEQ ID NO: 3966331 - RNA, 21 nt, Staphylococcus aureus subsp. aureus Mu50
aauacguguguuuucuuuuca

SEQ ID NO: 3966332 - RNA, 15 nt, Staphylococcus aureus subsp. aureus Mu50
aauacguuaccuacg

SEQ ID NO: 3966333 - RNA, 20 nt, Staphylococcus aureus subsp. aureus Mu50
aauacguuuaauaaugguuc

SEQ ID NO: 3966334 - RNA, 16 nt, Staphylococcus aureus subsp. aureus Mu50
aauacguuuaauguau

SEQ ID NO: 3966335 - RNA, 14 nt, Staphylococcus aureus subsp. aureus Mu50
aauacuaacaauua

SEQ ID NO: 3966336 - RNA, 14 nt, Staphylococcus aureus subsp. aureus Mu50
aauacuaagauuag

SEQ ID NO: 3966337 - RNA, 19 nt, Staphylococcus aureus subsp. aureus Mu50
aauacuaaucaaagaaaaa

SEQ ID NO: 3966338 - RNA, 15 nt, Staphylococcus aureus subsp. aureus Mu50
aauacuaauuucuau

SEQ ID NO: 3966339 - RNA, 20 nt, Staphylococcus aureus subsp. aureus Mu50
aauacuaauuucuauagaaa

SEQ ID NO: 3966340 - RNA, 22 nt, Staphylococcus aureus subsp. aureus Mu50
aauacuacacuccccuuaucaa

SEQ ID NO: 3966341 - RNA, 23 nt, Staphylococcus aureus subsp. aureus Mu50
aauauaacuucuauuaagaaaua

SEQ ID NO: 3966342 - RNA, 16 nt, Staphylococcus aureus subsp. aureus Mu50
aauauaaguaaucaua

SEQ ID NO: 3966343 - RNA, 17 nt, Staphylococcus aureus subsp. aureus Mu50
aauauaagugauuucuu

SEQ ID NO: 3966344 - RNA, 15 nt, Staphylococcus aureus subsp. aureus Mu50
aauauaauaccuaca

SEQ ID NO: 3966345 - RNA, 20 nt, Staphylococcus aureus subsp. aureus Mu50
aauauaauacuguauuuuaa

SEQ ID NO: 3966346 - RNA, 13 nt, Staphylococcus aureus subsp. aureus Mu50
aauauaauagaaa

SEQ ID NO: 3966347 - RNA, 15 nt, Staphylococcus aureus subsp. aureus Mu50
aauauaauagaaaua

SEQ ID NO: 3966348 - RNA, 13 nt, Staphylococcus aureus subsp. aureus Mu50
aauauaauauaca

SEQ ID NO: 3966349 - RNA, 20 nt, Staphylococcus aureus subsp. aureus Mu50
aauauaauauacacaaaaag

SEQ ID NO: 3966350 - RNA, 14 nt, Staphylococcus aureus subsp. aureus Mu50
aauauaauguauaa

SEQ ID NO: 3966351 - RNA, 15 nt, Staphylococcus aureus subsp. aureus Mu50
aauauaauuauuaaa

SEQ ID NO: 3966352 - RNA, 17 nt, Staphylococcus aureus subsp. aureus Mu50
aauauaauuauuaaacu

SEQ ID NO: 3966353 - RNA, 15 nt, Staphylococcus aureus subsp. aureus Mu50
aauauaauuuuuuga

SEQ ID NO: 3966354 - RNA, 12 nt, Staphylococcus aureus subsp. aureus Mu50
aauauacaauag

SEQ ID NO: 3966355 - RNA, 22 nt, Staphylococcus aureus subsp. aureus Mu50
aauauacaauaguauaaauauc

SEQ ID NO: 3966356 - RNA, 14 nt, Staphylococcus aureus subsp. aureus Mu50
aauauacacaaaaa

SEQ ID NO: 3966357 - RNA, 15 nt, Staphylococcus aureus subsp. aureus Mu50
aauauacacaaaaag

SEQ ID NO: 3966358 - RNA, 23 nt, Staphylococcus aureus subsp. aureus Mu50
aauauacacaaaaagacuuccaa

SEQ ID NO: 3966359 - RNA, 20 nt, Staphylococcus aureus subsp. aureus Mu50
aauauaccaaccaaaaccaa

SEQ ID NO: 3966360 - RNA, 22 nt, Staphylococcus aureus subsp. aureus Mu50
aauauacccagaugaauuuuua

SEQ ID NO: 3966361 - RNA, 15 nt, Staphylococcus aureus subsp. aureus Mu50
aauauacuaaaguuc

SEQ ID NO: 3966362 - RNA, 18 nt, Staphylococcus aureus subsp. aureus Mu50
aauauacuaaauuugaaa

SEQ ID NO: 3966363 - RNA, 19 nt, Staphylococcus aureus subsp. aureus Mu50
aauauacuuaauuuaaauc

SEQ ID NO: 3966364 - RNA, 16 nt, Staphylococcus aureus subsp. aureus Mu50
aauauagaagauauaa

SEQ ID NO: 3966365 - RNA, 21 nt, Staphylococcus aureus subsp. aureus Mu50
aauauagaagugcgguuuaau

SEQ ID NO: 3966366 - RNA, 19 nt, Staphylococcus aureus subsp. aureus Mu50
aauauagauuugaauuaaa

SEQ ID NO: 3966367 - RNA, 17 nt, Staphylococcus aureus subsp. aureus Mu50
aauauagcaauuuucga

SEQ ID NO: 3966368 - RNA, 18 nt, Staphylococcus aureus subsp. aureus Mu50
aauauagcuauuacuaua

SEQ ID NO: 3966369 - RNA, 16 nt, Staphylococcus aureus subsp. aureus Mu50
aauauagcugugauuu

SEQ ID NO: 3966370 - RNA, 22 nt, Staphylococcus aureus subsp. aureus Mu50
aauauagcugugauuugaucaa

SEQ ID NO: 3966371 - RNA, 15 nt, Staphylococcus aureus subsp. aureus Mu50
aauauaguaauaaaa

SEQ ID NO: 3966372 - RNA, 21 nt, Staphylococcus aureus subsp. aureus Mu50
aauauaguaauaaaagucgau

SEQ ID NO: 3966373 - RNA, 18 nt, Staphylococcus aureus subsp. aureus Mu50
aauauaguaauuguuaua

SEQ ID NO: 3966374 - RNA, 21 nt, Staphylococcus aureus subsp. aureus Mu50
aauauaguggugguacuuuuu

SEQ ID NO: 3966375 - RNA, 15 nt, Staphylococcus aureus subsp. aureus Mu50
aauauaguuaaaguu

SEQ ID NO: 3966376 - RNA, 23 nt, Staphylococcus aureus subsp. aureus Mu50
aauauauagcgcgcuuauugaaa

SEQ ID NO: 3966377 - RNA, 16 nt, Staphylococcus aureus subsp. aureus Mu50
aauauaucaucucuau

SEQ ID NO: 3966378 - RNA, 18 nt, Staphylococcus aureus subsp. aureus Mu50
aauauaucuaauacuuuc

SEQ ID NO: 3966379 - RNA, 20 nt, Staphylococcus aureus subsp. aureus Mu50
aauauaugaauaagucuaau

SEQ ID NO: 3966380 - RNA, 16 nt, Staphylococcus aureus subsp. aureus Mu50
aauauauguauaacau

SEQ ID NO: 3966381 - RNA, 19 nt, Staphylococcus aureus subsp. aureus Mu50
aauauauguauaacauuau

SEQ ID NO: 3966382 - RNA, 20 nt, Staphylococcus aureus subsp. aureus Mu50
aauauauguauaacauuauu

SEQ ID NO: 3966383 - RNA, 20 nt, Staphylococcus aureus subsp. aureus Mu50
aauauauuaacaacuuuauu

SEQ ID NO: 3966384 - RNA, 16 nt, Staphylococcus aureus subsp. aureus Mu50
aauauauuaauuuuac

SEQ ID NO: 3966385 - RNA, 22 nt, Staphylococcus aureus subsp. aureus Mu50
aauauauuagugauauuuuucg

SEQ ID NO: 3966386 - RNA, 23 nt, Staphylococcus aureus subsp. aureus Mu50
aauauauuagugauauuuuucga

SEQ ID NO: 3966387 - RNA, 22 nt, Staphylococcus aureus subsp. aureus Mu50
aauauauucggcaaaagauguu

SEQ ID NO: 3966388 - RNA, 20 nt, Staphylococcus aureus subsp. aureus Mu50
aauauauugucgacuuuuag

SEQ ID NO: 3966389 - RNA, 13 nt, Staphylococcus aureus subsp. aureus Mu50
aauauauuuauuu

SEQ ID NO: 3966390 - RNA, 16 nt, Staphylococcus aureus subsp. aureus Mu50
aauauauuuauuuuug

SEQ ID NO: 3966391 - RNA, 14 nt, Staphylococcus aureus subsp. aureus Mu50
aauauauuuuaugu

SEQ ID NO: 3966392 - RNA, 14 nt, Staphylococcus aureus subsp. aureus Mu50
aauaucaaaauaua

SEQ ID NO: 3966393 - RNA, 14 nt, Staphylococcus aureus subsp. aureus Mu50
aauaucaagauguu

SEQ ID NO: 3966394 - RNA, 18 nt, Staphylococcus aureus subsp. aureus Mu50
aauaucaagauguuugca

SEQ ID NO: 3966395 - RNA, 13 nt, Staphylococcus aureus subsp. aureus Mu50
aauaucaauaauu

SEQ ID NO: 3966396 - RNA, 22 nt, Staphylococcus aureus subsp. aureus Mu50
aauaucaauuuauuauuaacug

SEQ ID NO: 3966397 - RNA, 13 nt, Staphylococcus aureus subsp. aureus Mu50
aauaucaauuuuu

SEQ ID NO: 3966398 - RNA, 14 nt, Staphylococcus aureus subsp. aureus Mu50
aauaucaauuuuua

SEQ ID NO: 3966399 - RNA, 16 nt, Staphylococcus aureus subsp. aureus Mu50
aauaucaauuuuuacu

SEQ ID NO: 3966400 - RNA, 16 nt, Staphylococcus aureus subsp. aureus Mu50
aauaucacuaucagcu

SEQ ID NO: 3966401 - RNA, 22 nt, Staphylococcus aureus subsp. aureus Mu50
aauaucagguacaaauggaaua

SEQ ID NO: 3966402 - RNA, 16 nt, Staphylococcus aureus subsp. aureus Mu50
aauaucaguaauaaua

SEQ ID NO: 3966403 - RNA, 16 nt, Staphylococcus aureus subsp. aureus Mu50
aauaucauaaaugcau

SEQ ID NO: 3966404 - RNA, 18 nt, Staphylococcus aureus subsp. aureus Mu50
aauaucauaccguacaaa

SEQ ID NO: 3966405 - RNA, 23 nt, Staphylococcus aureus subsp. aureus Mu50
aauaucauauucaaaauaacuua

SEQ ID NO: 3966406 - RNA, 19 nt, Staphylococcus aureus subsp. aureus Mu50
aauaucauauuugaauacu

SEQ ID NO: 3966407 - RNA, 22 nt, Staphylococcus aureus subsp. aureus Mu50
aauaucaucauuuaaauauuuc

SEQ ID NO: 3966408 - RNA, 12 nt, Staphylococcus aureus subsp. aureus Mu50
aauauccaaaau

SEQ ID NO: 3966409 - RNA, 18 nt, Staphylococcus aureus subsp. aureus Mu50
aauauccugcaguugauu

SEQ ID NO: 3966410 - RNA, 14 nt, Staphylococcus aureus subsp. aureus Mu50
aauaucgacaaauu

SEQ ID NO: 3966411 - RNA, 22 nt, Staphylococcus aureus subsp. aureus Mu50
aauaucgacaaauuaaaaaaca

SEQ ID NO: 3966412 - RNA, 21 nt, Staphylococcus aureus subsp. aureus Mu50
aauaucgauuuuggcacauaa

SEQ ID NO: 3966413 - RNA, 16 nt, Staphylococcus aureus subsp. aureus Mu50
aauaucuaaacaauuc

SEQ ID NO: 3966414 - RNA, 14 nt, Staphylococcus aureus subsp. aureus Mu50
aauaucuaaagauu

SEQ ID NO: 3966415 - RNA, 15 nt, Staphylococcus aureus subsp. aureus Mu50
aauaucuaaagauuu

SEQ ID NO: 3966416 - RNA, 20 nt, Staphylococcus aureus subsp. aureus Mu50
aauaucuaaagauuucaguu

SEQ ID NO: 3966417 - RNA, 16 nt, Staphylococcus aureus subsp. aureus Mu50
aauaucugaaaaacca

SEQ ID NO: 3966418 - RNA, 14 nt, Staphylococcus aureus subsp. aureus Mu50
aauaucuuacugcu

SEQ ID NO: 3966419 - RNA, 13 nt, Staphylococcus aureus subsp. aureus Mu50
aauaucuucagcu

SEQ ID NO: 3966420 - RNA, 23 nt, Staphylococcus aureus subsp. aureus Mu50
aauaucuucguguccuagacgau

SEQ ID NO: 3966421 - RNA, 13 nt, Staphylococcus aureus subsp. aureus Mu50
aauaucuucuuua

SEQ ID NO: 3966422 - RNA, 19 nt, Staphylococcus aureus subsp. aureus Mu50
aauaucuucuuuuaauauu

SEQ ID NO: 3966423 - RNA, 13 nt, Staphylococcus aureus subsp. aureus Mu50
aauaucuugucau

SEQ ID NO: 3966424 - RNA, 21 nt, Staphylococcus aureus subsp. aureus Mu50
aauaucuuuugcguccucaug

SEQ ID NO: 3966425 - RNA, 23 nt, Staphylococcus aureus subsp. aureus Mu50
aauaugaacaaaaaauaaaaacu

SEQ ID NO: 3966426 - RNA, 19 nt, Staphylococcus aureus subsp. aureus Mu50
aauaugaaucuagaauaua

SEQ ID NO: 3966427 - RNA, 17 nt, Staphylococcus aureus subsp. aureus Mu50
aauaugaauugcuuguu

SEQ ID NO: 3966428 - RNA, 23 nt, Staphylococcus aureus subsp. aureus Mu50
aaucaaagggcuucgauucauaa

SEQ ID NO: 3966429 - RNA, 22 nt, Staphylococcus aureus subsp. aureus Mu50
aaucaaaguucguaauugucuu

SEQ ID NO: 3966430 - RNA, 20 nt, Staphylococcus aureus subsp. aureus Mu50
aaucaaauuagucauccaaa

SEQ ID NO: 3966431 - RNA, 17 nt, Staphylococcus aureus subsp. aureus Mu50
aaucaacaguuuuauua

SEQ ID NO: 3966432 - RNA, 15 nt, Staphylococcus aureus subsp. aureus Mu50
aaucaacgagucaua

SEQ ID NO: 3966433 - RNA, 19 nt, Staphylococcus aureus subsp. aureus Mu50
aaucaacguauauaaguua

SEQ ID NO: 3966434 - RNA, 22 nt, Staphylococcus aureus subsp. aureus Mu50
aaucaacguauauaaguuaaaa

SEQ ID NO: 3966435 - RNA, 23 nt, Staphylococcus aureus subsp. aureus Mu50
aaucaacuuuuuguuaauuuuuu

SEQ ID NO: 3966436 - RNA, 16 nt, Staphylococcus aureus subsp. aureus Mu50
aaucaagcuagcauca

SEQ ID NO: 3966437 - RNA, 23 nt, Staphylococcus aureus subsp. aureus Mu50
aaucaauguucuaugcucuacaa

SEQ ID NO: 3966438 - RNA, 18 nt, Staphylococcus aureus subsp. aureus Mu50
aaucaauugcauacguaa

SEQ ID NO: 3966439 - RNA, 14 nt, Staphylococcus aureus subsp. aureus Mu50
aaucacaauacgaa

SEQ ID NO: 3966440 - RNA, 15 nt, Staphylococcus aureus subsp. aureus Mu50
aaucacaguuauaua

SEQ ID NO: 3966441 - RNA, 19 nt, Staphylococcus aureus subsp. aureus Mu50
aaucacgauuuucaaguaa

SEQ ID NO: 3966442 - RNA, 17 nt, Staphylococcus aureus subsp. aureus Mu50
aaucacgcuaacauuca

SEQ ID NO: 3966443 - RNA, 20 nt, Staphylococcus aureus subsp. aureus Mu50
aaucacuaucuguuguuaua

SEQ ID NO: 3966444 - RNA, 20 nt, Staphylococcus aureus subsp. aureus Mu50
aaucacuccucuauuuuaug

SEQ ID NO: 3966445 - RNA, 21 nt, Staphylococcus aureus subsp. aureus Mu50
aaucacuccucuauuuuauga

SEQ ID NO: 3966446 - RNA, 22 nt, Staphylococcus aureus subsp. aureus Mu50
aaucacuccucuauuuuaugau

SEQ ID NO: 3966447 - RNA, 18 nt, Staphylococcus aureus subsp. aureus Mu50
aaucagaaggcuguucug

SEQ ID NO: 3966448 - RNA, 20 nt, Staphylococcus aureus subsp. aureus Mu50
aaucagaaggcuguucugga

SEQ ID NO: 3966449 - RNA, 16 nt, Staphylococcus aureus subsp. aureus Mu50
aaucagcuauaaaagu

SEQ ID NO: 3966450 - RNA, 12 nt, Staphylococcus aureus subsp. aureus Mu50
aaucagcuuuuu

SEQ ID NO: 3966451 - RNA, 24 nt, Staphylococcus aureus subsp. aureus Mu50
aaucagcuuuuucacauugccuaa

SEQ ID NO: 3966452 - RNA, 22 nt, Staphylococcus aureus subsp. aureus Mu50
aaucagguuuaaacaguuuaau

SEQ ID NO: 3966453 - RNA, 17 nt, Staphylococcus aureus subsp. aureus Mu50
aaucaguaauaucaagg

SEQ ID NO: 3966454 - RNA, 19 nt, Staphylococcus aureus subsp. aureus Mu50
aaucaguaguuuuaaaagu

SEQ ID NO: 3966455 - RNA, 21 nt, Staphylococcus aureus subsp. aureus Mu50
aaucaguauaaucagcaaugu

SEQ ID NO: 3966456 - RNA, 16 nt, Staphylococcus aureus subsp. aureus Mu50
aaucagugaaauauca

SEQ ID NO: 3966457 - RNA, 21 nt, Staphylococcus aureus subsp. aureus Mu50
aaucaguuucaucaaguauaa

SEQ ID NO: 3966458 - RNA, 17 nt, Staphylococcus aureus subsp. aureus Mu50
aaucaguuuuuaaauca

SEQ ID NO: 3966459 - RNA, 15 nt, Staphylococcus aureus subsp. aureus Mu50
aaucaguuuuugaau

SEQ ID NO: 3966460 - RNA, 20 nt, Staphylococcus aureus subsp. aureus Mu50
aaucauaaugaauaauuaaa

SEQ ID NO: 3966461 - RNA, 23 nt, Staphylococcus aureus subsp. aureus Mu50
aaucauaaugaauaauuaaaaaa

SEQ ID NO: 3966462 - RNA, 20 nt, Staphylococcus aureus subsp. aureus Mu50
aaucauagaggcacagugga

SEQ ID NO: 3966463 - RNA, 22 nt, Staphylococcus aureus subsp. aureus Mu50
aaucauagauauaagaaaucca

SEQ ID NO: 3966464 - RNA, 16 nt, Staphylococcus aureus subsp. aureus Mu50
aaucauagcaacaucg

SEQ ID NO: 3966465 - RNA, 12 nt, Staphylococcus aureus subsp. aureus Mu50
aaucaucauuau

SEQ ID NO: 3966466 - RNA, 12 nt, Staphylococcus aureus subsp. aureus Mu50
aaucaucauugc

SEQ ID NO: 3966467 - RNA, 16 nt, Staphylococcus aureus subsp. aureus Mu50
aaucauccauaaaaau

SEQ ID NO: 3966468 - RNA, 21 nt, Staphylococcus aureus subsp. aureus Mu50
aaucaucgaacaugaaugaua

SEQ ID NO: 3966469 - RNA, 18 nt, Staphylococcus aureus subsp. aureus Mu50
aaucaucguauuucauau

SEQ ID NO: 3966470 - RNA, 13 nt, Staphylococcus aureus subsp. aureus Mu50
aaucaugacauag

SEQ ID NO: 3966471 - RNA, 15 nt, Staphylococcus aureus subsp. aureus Mu50
aaucaugcauucuau

SEQ ID NO: 3966472 - RNA, 22 nt, Staphylococcus aureus subsp. aureus Mu50
aaucauguaaugcuuaaaaaca

SEQ ID NO: 3966473 - RNA, 17 nt, Staphylococcus aureus subsp. aureus Mu50
aaucauuaauaauuaaa

SEQ ID NO: 3966474 - RNA, 18 nt, Staphylococcus aureus subsp. aureus Mu50
aaucauuaauaauuaaac

SEQ ID NO: 3966475 - RNA, 18 nt, Staphylococcus aureus subsp. aureus Mu50
aaucauuagcgaaaaccu

SEQ ID NO: 3966476 - RNA, 23 nt, Staphylococcus aureus subsp. aureus Mu50
aaucauuaguuaugugcuaaucu

SEQ ID NO: 3966477 - RNA, 13 nt, Staphylococcus aureus subsp. aureus Mu50
aaucauuauagca

SEQ ID NO: 3966478 - RNA, 21 nt, Staphylococcus aureus subsp. aureus Mu50
aaucauucauggccaaauguu

SEQ ID NO: 3966479 - RNA, 21 nt, Staphylococcus aureus subsp. aureus Mu50
aaucauucuuuauagaaacca

SEQ ID NO: 3966480 - RNA, 22 nt, Staphylococcus aureus subsp. aureus Mu50
aaucauucuuuauagaaaccaa

SEQ ID NO: 3966481 - RNA, 18 nt, Staphylococcus aureus subsp. aureus Mu50
aaucauugguuucaucau

SEQ ID NO: 3966482 - RNA, 19 nt, Staphylococcus aureus subsp. aureus Mu50
aaucauugguuucaucaua

SEQ ID NO: 3966483 - RNA, 20 nt, Staphylococcus aureus subsp. aureus Mu50
aaucauugguuucaucauau

SEQ ID NO: 3966484 - RNA, 14 nt, Staphylococcus aureus subsp. aureus Mu50
aaucauuguaaaug

SEQ ID NO: 3966485 - RNA, 19 nt, Staphylococcus aureus subsp. aureus Mu50
aaucauuguaaaugaucau

SEQ ID NO: 3966486 - RNA, 21 nt, Staphylococcus aureus subsp. aureus Mu50
aaucauuguggcuuuuuuuau

SEQ ID NO: 3966487 - RNA, 17 nt, Staphylococcus aureus subsp. aureus Mu50
aaucauuguguauuguu

SEQ ID NO: 3966488 - RNA, 11 nt, Staphylococcus aureus subsp. aureus Mu50
aaucauuuaaa

SEQ ID NO: 3966489 - RNA, 15 nt, Staphylococcus aureus subsp. aureus Mu50
aaucauuuaaauuag

SEQ ID NO: 3966490 - RNA, 16 nt, Staphylococcus aureus subsp. aureus Mu50
aaucauuuuagcaccg

SEQ ID NO: 3966491 - RNA, 16 nt, Staphylococcus aureus subsp. aureus Mu50
aauccaaaauaaucga

SEQ ID NO: 3966492 - RNA, 21 nt, Staphylococcus aureus subsp. aureus Mu50
aauccaaaaucuuuacuugua

SEQ ID NO: 3966493 - RNA, 20 nt, Staphylococcus aureus subsp. aureus Mu50
aauccaaagcugaauuuuag

SEQ ID NO: 3966494 - RNA, 18 nt, Staphylococcus aureus subsp. aureus Mu50
aauccaagauauauaacu

SEQ ID NO: 3966495 - RNA, 16 nt, Staphylococcus aureus subsp. aureus Mu50
aauccaagcaaucuua

SEQ ID NO: 3966496 - RNA, 17 nt, Staphylococcus aureus subsp. aureus Mu50
aauccaagugacaacau

SEQ ID NO: 3966497 - RNA, 12 nt, Staphylococcus aureus subsp. aureus Mu50
aauccaauuaaa

SEQ ID NO: 3966498 - RNA, 18 nt, Staphylococcus aureus subsp. aureus Mu50
aauccaauuaaauauuua

SEQ ID NO: 3966499 - RNA, 13 nt, Staphylococcus aureus subsp. aureus Mu50
aauccaguaauca

SEQ ID NO: 3966500 - RNA, 19 nt, Staphylococcus aureus subsp. aureus Mu50
aauccaguaaucaaagauu

SEQ ID NO: 3966501 - RNA, 21 nt, Staphylococcus aureus subsp. aureus Mu50
aauccauacguaucaaaauuu

SEQ ID NO: 3966502 - RNA, 21 nt, Staphylococcus aureus subsp. aureus Mu50
aaucccaaguuacaauaucau

SEQ ID NO: 3966503 - RNA, 19 nt, Staphylococcus aureus subsp. aureus Mu50
aaucccauaaugacuauaa

SEQ ID NO: 3966504 - RNA, 23 nt, Staphylococcus aureus subsp. aureus Mu50
aaucccauaccuacaaauaugua

SEQ ID NO: 3966505 - RNA, 16 nt, Staphylococcus aureus subsp. aureus Mu50
aaucccauuuuaaagu

SEQ ID NO: 3966506 - RNA, 22 nt, Staphylococcus aureus subsp. aureus Mu50
aaucccgccgucuccauuauau

SEQ ID NO: 3966507 - RNA, 20 nt, Staphylococcus aureus subsp. aureus Mu50
aauccgauuuugauauaaaa

SEQ ID NO: 3966508 - RNA, 23 nt, Staphylococcus aureus subsp. aureus Mu50
aauccguaacgaugguugcuuca

SEQ ID NO: 3966509 - RNA, 20 nt, Staphylococcus aureus subsp. aureus Mu50
aauccguuaaaauuuuaauu

SEQ ID NO: 3966510 - RNA, 13 nt, Staphylococcus aureus subsp. aureus Mu50
aauccugauucca

SEQ ID NO: 3966511 - RNA, 19 nt, Staphylococcus aureus subsp. aureus Mu50
aauccugugacucaaugau

SEQ ID NO: 3966512 - RNA, 14 nt, Staphylococcus aureus subsp. aureus Mu50
aauccuucaucaau

SEQ ID NO: 3966513 - RNA, 20 nt, Staphylococcus aureus subsp. aureus Mu50
aauccuuguucuauuugaua

SEQ ID NO: 3966514 - RNA, 21 nt, Staphylococcus aureus subsp. aureus Mu50
aauccuuguucuauuugauaa

SEQ ID NO: 3966515 - RNA, 21 nt, Staphylococcus aureus subsp. aureus Mu50
aaucuuuugagacguuuucca

SEQ ID NO: 3966516 - RNA, 21 nt, Staphylococcus aureus subsp. aureus Mu50
aaucuuuuguaagacuuccca

SEQ ID NO: 3966517 - RNA, 13 nt, Staphylococcus aureus subsp. aureus Mu50
aaucuuuuuuuaa

SEQ ID NO: 3966518 - RNA, 14 nt, Staphylococcus aureus subsp. aureus Mu50
aaugaaaaaacgag

SEQ ID NO: 3966519 - RNA, 21 nt, Staphylococcus aureus subsp. aureus Mu50
aaugaacaacaaauugugauu

SEQ ID NO: 3966520 - RNA, 17 nt, Staphylococcus aureus subsp. aureus Mu50
aaugaaccagcuaacca

SEQ ID NO: 3966521 - RNA, 18 nt, Staphylococcus aureus subsp. aureus Mu50
aaugaaccagcuaaccaa

SEQ ID NO: 3966522 - RNA, 20 nt, Staphylococcus aureus subsp. aureus Mu50
aaugaaccagcuaaccaaau

SEQ ID NO: 3966523 - RNA, 18 nt, Staphylococcus aureus subsp. aureus Mu50
aaugaacuucucuuaguu

SEQ ID NO: 3966524 - RNA, 12 nt, Staphylococcus aureus subsp. aureus Mu50
aaugaagaauac

SEQ ID NO: 3966525 - RNA, 15 nt, Staphylococcus aureus subsp. aureus Mu50
aaugaagaauacaaa

SEQ ID NO: 3966526 - RNA, 19 nt, Staphylococcus aureus subsp. aureus Mu50
aaugaagaauacaaauauu

SEQ ID NO: 3966527 - RNA, 17 nt, Staphylococcus aureus subsp. aureus Mu50
aaugaagauuuuguuga

SEQ ID NO: 3966528 - RNA, 18 nt, Staphylococcus aureus subsp. aureus Mu50
aaugaaguaauauauaaa

SEQ ID NO: 3966529 - RNA, 16 nt, Staphylococcus aureus subsp. aureus Mu50
aaugaauaaugacaaa

SEQ ID NO: 3966530 - RNA, 21 nt, Staphylococcus aureus subsp. aureus Mu50
aaugaauaaugacaaauuauc

SEQ ID NO: 3966531 - RNA, 15 nt, Staphylococcus aureus subsp. aureus Mu50
aaugaauaauuaaaa

SEQ ID NO: 3966532 - RNA, 16 nt, Staphylococcus aureus subsp. aureus Mu50
aaugaauaauuaaaaa

SEQ ID NO: 3966533 - RNA, 14 nt, Staphylococcus aureus subsp. aureus Mu50
aaugaauaauucca

SEQ ID NO: 3966534 - RNA, 12 nt, Staphylococcus aureus subsp. aureus Mu50
aaugaauaauug

SEQ ID NO: 3966535 - RNA, 16 nt, Staphylococcus aureus subsp. aureus Mu50
aaugaaucaauugcau

SEQ ID NO: 3966536 - RNA, 13 nt, Staphylococcus aureus subsp. aureus Mu50
aaugaauguuaag

SEQ ID NO: 3966537 - RNA, 19 nt, Staphylococcus aureus subsp. aureus Mu50
aaugaauuauuuaaaaugc

SEQ ID NO: 3966538 - RNA, 19 nt, Staphylococcus aureus subsp. aureus Mu50
aaugaauucauucaauacg

SEQ ID NO: 3966539 - RNA, 12 nt, Staphylococcus aureus subsp. aureus Mu50
aaugaauugcuu

SEQ ID NO: 3966540 - RNA, 23 nt, Staphylococcus aureus subsp. aureus Mu50
aaugaauuguuaguuuucuuaaa

SEQ ID NO: 3966541 - RNA, 15 nt, Staphylococcus aureus subsp. aureus Mu50
aaugaauuucuaauu

SEQ ID NO: 3966542 - RNA, 17 nt, Staphylococcus aureus subsp. aureus Mu50
aaugacagcagacuucu

SEQ ID NO: 3966543 - RNA, 17 nt, Staphylococcus aureus subsp. aureus Mu50
aaugacaucaucuauaa

SEQ ID NO: 3966544 - RNA, 17 nt, Staphylococcus aureus subsp. aureus Mu50
aaugacauccauacaaa

SEQ ID NO: 3966545 - RNA, 14 nt, Staphylococcus aureus subsp. aureus Mu50
aaugacaucuacaa

SEQ ID NO: 3966546 - RNA, 20 nt, Staphylococcus aureus subsp. aureus Mu50
aaugacucaagugaaucuaa

SEQ ID NO: 3966547 - RNA, 14 nt, Staphylococcus aureus subsp. aureus Mu50
aaugacugaauuaa

SEQ ID NO: 3966548 - RNA, 16 nt, Staphylococcus aureus subsp. aureus Mu50
aaugacugagaaaaau

SEQ ID NO: 3966549 - RNA, 20 nt, Staphylococcus aureus subsp. aureus Mu50
aaugacuucacauuuauccu

SEQ ID NO: 3966550 - RNA, 20 nt, Staphylococcus aureus subsp. aureus Mu50
aaugacuucuuuauauuuau

SEQ ID NO: 3966551 - RNA, 19 nt, Staphylococcus aureus subsp. aureus Mu50
aaugagcaucuugucuagu

SEQ ID NO: 3966552 - RNA, 17 nt, Staphylococcus aureus subsp. aureus Mu50
aaugaguaugacgaaau

SEQ ID NO: 3966553 - RNA, 20 nt, Staphylococcus aureus subsp. aureus Mu50
aaugauacauuauuaaauag

SEQ ID NO: 3966554 - RNA, 20 nt, Staphylococcus aureus subsp. aureus Mu50
aaugauagcgugauuuuuca

SEQ ID NO: 3966555 - RNA, 12 nt, Staphylococcus aureus subsp. aureus Mu50
aaugauaucuuu

SEQ ID NO: 3966556 - RNA, 17 nt, Staphylococcus aureus subsp. aureus Mu50
aaugauaucuuuuccaa

SEQ ID NO: 3966557 - RNA, 18 nt, Staphylococcus aureus subsp. aureus Mu50
aaugauauuaccuucaag

SEQ ID NO: 3966558 - RNA, 22 nt, Staphylococcus aureus subsp. aureus Mu50
aaugauauuugaucguugaaua

SEQ ID NO: 3966559 - RNA, 20 nt, Staphylococcus aureus subsp. aureus Mu50
aaugaucaucguauagaugu

SEQ ID NO: 3966560 - RNA, 21 nt, Staphylococcus aureus subsp. aureus Mu50
aaugaugcauaagauuuugaa

SEQ ID NO: 3966561 - RNA, 17 nt, Staphylococcus aureus subsp. aureus Mu50
aaugauuaaaaaucaaa

SEQ ID NO: 3966562 - RNA, 14 nt, Staphylococcus aureus subsp. aureus Mu50
aaugauuaaaauua

SEQ ID NO: 3966563 - RNA, 15 nt, Staphylococcus aureus subsp. aureus Mu50
aaugauuaaaguguu

SEQ ID NO: 3966564 - RNA, 21 nt, Staphylococcus aureus subsp. aureus Mu50
aaugauuacuuuaagauuauu

SEQ ID NO: 3966565 - RNA, 17 nt, Staphylococcus aureus subsp. aureus Mu50
aaugauugcauugauuu

SEQ ID NO: 3966566 - RNA, 22 nt, Staphylococcus aureus subsp. aureus Mu50
aaugauugucuuauaagauaua

SEQ ID NO: 3966567 - RNA, 13 nt, Staphylococcus aureus subsp. aureus Mu50
aaugauuguuuua

SEQ ID NO: 3966568 - RNA, 16 nt, Staphylococcus aureus subsp. aureus Mu50
aaugauuguuuuaagu

SEQ ID NO: 3966569 - RNA, 23 nt, Staphylococcus aureus subsp. aureus Mu50
aaugauuuaauaaaaaccaauau

SEQ ID NO: 3966570 - RNA, 16 nt, Staphylococcus aureus subsp. aureus Mu50
aaugauuuauucuaaa

SEQ ID NO: 3966571 - RNA, 19 nt, Staphylococcus aureus subsp. aureus Mu50
aaugauuugugguaaucau

SEQ ID NO: 3966572 - RNA, 18 nt, Staphylococcus aureus subsp. aureus Mu50
aaugauuuuauaauauua

SEQ ID NO: 3966573 - RNA, 19 nt, Staphylococcus aureus subsp. aureus Mu50
aaugauuuuauaauauuau

SEQ ID NO: 3966574 - RNA, 14 nt, Staphylococcus aureus subsp. aureus Mu50
aaugauuuugcuuu

SEQ ID NO: 3966575 - RNA, 22 nt, Staphylococcus aureus subsp. aureus Mu50
aaugauuuuuauuauugucauc

SEQ ID NO: 3966576 - RNA, 19 nt, Staphylococcus aureus subsp. aureus Mu50
aaugcaaaucaaauacauc

SEQ ID NO: 3966577 - RNA, 20 nt, Staphylococcus aureus subsp. aureus Mu50
aaugcaaaucucgucacaua

SEQ ID NO: 3966578 - RNA, 15 nt, Staphylococcus aureus subsp. aureus Mu50
aaugcaacuugauca

SEQ ID NO: 3966579 - RNA, 17 nt, Staphylococcus aureus subsp. aureus Mu50
aaugcaauacauuaaua

SEQ ID NO: 3966580 - RNA, 21 nt, Staphylococcus aureus subsp. aureus Mu50
aaugcaauacauuaauauaaa

SEQ ID NO: 3966581 - RNA, 13 nt, Staphylococcus aureus subsp. aureus Mu50
aaugcaccaacaa

SEQ ID NO: 3966582 - RNA, 15 nt, Staphylococcus aureus subsp. aureus Mu50
aaugcaccuauaaua

SEQ ID NO: 3966583 - RNA, 20 nt, Staphylococcus aureus subsp. aureus Mu50
aaugcacgagcaacaucuuu

SEQ ID NO: 3966584 - RNA, 21 nt, Staphylococcus aureus subsp. aureus Mu50
aaugcacgagcaacaucuuuu

SEQ ID NO: 3966585 - RNA, 13 nt, Staphylococcus aureus subsp. aureus Mu50
aaugcacugcuaa

SEQ ID NO: 3966586 - RNA, 19 nt, Staphylococcus aureus subsp. aureus Mu50
aaugcagauucuucaccaa

SEQ ID NO: 3966587 - RNA, 13 nt, Staphylococcus aureus subsp. aureus Mu50
aaugcauagcucu

SEQ ID NO: 3966588 - RNA, 19 nt, Staphylococcus aureus subsp. aureus Mu50
aaugcauagcucuucuuuu

SEQ ID NO: 3966589 - RNA, 19 nt, Staphylococcus aureus subsp. aureus Mu50
aaugcauccaaauauuaaa

SEQ ID NO: 3966590 - RNA, 17 nt, Staphylococcus aureus subsp. aureus Mu50
aaugcauuacuacuuua

SEQ ID NO: 3966591 - RNA, 20 nt, Staphylococcus aureus subsp. aureus Mu50
aaugccauuguuauccaaaa

SEQ ID NO: 3966592 - RNA, 16 nt, Staphylococcus aureus subsp. aureus Mu50
aaugccggucauaaca

SEQ ID NO: 3966593 - RNA, 15 nt, Staphylococcus aureus subsp. aureus Mu50
aaugccuaauuuugu

SEQ ID NO: 3966594 - RNA, 21 nt, Staphylococcus aureus subsp. aureus Mu50
aaugccuuaucuauagguaau

SEQ ID NO: 3966595 - RNA, 18 nt, Staphylococcus aureus subsp. aureus Mu50
aaugcgaagauuuuuaac

SEQ ID NO: 3966596 - RNA, 16 nt, Staphylococcus aureus subsp. aureus Mu50
aaugcgacguuguucu

SEQ ID NO: 3966597 - RNA, 13 nt, Staphylococcus aureus subsp. aureus Mu50
aaugcgcaaugaa

SEQ ID NO: 3966598 - RNA, 21 nt, Staphylococcus aureus subsp. aureus Mu50
aaugcguggauguguuuuaau

SEQ ID NO: 3966599 - RNA, 17 nt, Staphylococcus aureus subsp. aureus Mu50
aaugcuaaaaguauaaa

SEQ ID NO: 3966600 - RNA, 16 nt, Staphylococcus aureus subsp. aureus Mu50
aaugcuaauuuaacug

SEQ ID NO: 3966601 - RNA, 15 nt, Staphylococcus aureus subsp. aureus Mu50
aaugcuacaauuucc

SEQ ID NO: 3966602 - RNA, 15 nt, Staphylococcus aureus subsp. aureus Mu50
aaugcuacuauuaaa

SEQ ID NO: 3966603 - RNA, 23 nt, Staphylococcus aureus subsp. aureus Mu50
aauguucuggaauaccuaauuca

SEQ ID NO: 3966604 - RNA, 23 nt, Staphylococcus aureus subsp. aureus Mu50
aauguuguuugcggcuuccucuc

SEQ ID NO: 3966605 - RNA, 13 nt, Staphylococcus aureus subsp. aureus Mu50
aauguuuaacaau

SEQ ID NO: 3966606 - RNA, 15 nt, Staphylococcus aureus subsp. aureus Mu50
aauguuuauaucuuu

SEQ ID NO: 3966607 - RNA, 14 nt, Staphylococcus aureus subsp. aureus Mu50
aauguuuaucaauu

SEQ ID NO: 3966608 - RNA, 13 nt, Staphylococcus aureus subsp. aureus Mu50
aauguuucuccua

SEQ ID NO: 3966609 - RNA, 19 nt, Staphylococcus aureus subsp. aureus Mu50
aauguuucuucaauugucu

SEQ ID NO: 3966610 - RNA, 12 nt, Staphylococcus aureus subsp. aureus Mu50
aauguuugcuuu

SEQ ID NO: 3966611 - RNA, 18 nt, Staphylococcus aureus subsp. aureus Mu50
aauguuugcuuuuuguaa

SEQ ID NO: 3966612 - RNA, 23 nt, Staphylococcus aureus subsp. aureus Mu50
aauguuuucagccacugucaugu

SEQ ID NO: 3966613 - RNA, 16 nt, Staphylococcus aureus subsp. aureus Mu50
aauguuuuggaaaaau

SEQ ID NO: 3966614 - RNA, 18 nt, Staphylococcus aureus subsp. aureus Mu50
aauguuuuugauaguaau

SEQ ID NO: 3966615 - RNA, 18 nt, Staphylococcus aureus subsp. aureus Mu50
aauuaaaaaacaauaaaa

SEQ ID NO: 3966616 - RNA, 20 nt, Staphylococcus aureus subsp. aureus Mu50
aauuaaaacagcaaauaaaa

SEQ ID NO: 3966617 - RNA, 16 nt, Staphylococcus aureus subsp. aureus Mu50
aauuaaaacuauaaua

SEQ ID NO: 3966618 - RNA, 20 nt, Staphylococcus aureus subsp. aureus Mu50
aauuaaaacuuucagagaua

SEQ ID NO: 3966619 - RNA, 12 nt, Staphylococcus aureus subsp. aureus Mu50
aauuaaaauaac

SEQ ID NO: 3966620 - RNA, 12 nt, Staphylococcus aureus subsp. aureus Mu50
aauuaaaauaca

SEQ ID NO: 3966621 - RNA, 13 nt, Staphylococcus aureus subsp. aureus Mu50
aauuaaaauguua

SEQ ID NO: 3966622 - RNA, 15 nt, Staphylococcus aureus subsp. aureus Mu50
aauuaaaauuuguua

SEQ ID NO: 3966623 - RNA, 20 nt, Staphylococcus aureus subsp. aureus Mu50
aauuaaacgcucaacuauau

SEQ ID NO: 3966624 - RNA, 17 nt, Staphylococcus aureus subsp. aureus Mu50
aauuaaacuuaagaaua

SEQ ID NO: 3966625 - RNA, 15 nt, Staphylococcus aureus subsp. aureus Mu50
aauuaaagauuaaaa

SEQ ID NO: 3966626 - RNA, 18 nt, Staphylococcus aureus subsp. aureus Mu50
aauuaaagauuaaaauau

SEQ ID NO: 3966627 - RNA, 21 nt, Staphylococcus aureus subsp. aureus Mu50
aauuaaagucaauuuaaauaa

SEQ ID NO: 3966628 - RNA, 13 nt, Staphylococcus aureus subsp. aureus Mu50
aauuaaagugaau

SEQ ID NO: 3966629 - RNA, 16 nt, Staphylococcus aureus subsp. aureus Mu50
aauuaaauaaaaauau

SEQ ID NO: 3966630 - RNA, 15 nt, Staphylococcus aureus subsp. aureus Mu50
aauuaaaucgauuaa

SEQ ID NO: 3966631 - RNA, 13 nt, Staphylococcus aureus subsp. aureus Mu50
aauuaaauguuua

SEQ ID NO: 3966632 - RNA, 18 nt, Staphylococcus aureus subsp. aureus Mu50
aauuaaccuugauuuaau

SEQ ID NO: 3966633 - RNA, 20 nt, Staphylococcus aureus subsp. aureus Mu50
aauuaacuagugccucuuuu

SEQ ID NO: 3966634 - RNA, 19 nt, Staphylococcus aureus subsp. aureus Mu50
aauuaacuauacuuuuaua

SEQ ID NO: 3966635 - RNA, 14 nt, Staphylococcus aureus subsp. aureus Mu50
aauuaacuugauau

SEQ ID NO: 3966636 - RNA, 22 nt, Staphylococcus aureus subsp. aureus Mu50
aauuaagaaaaucauucauuug

SEQ ID NO: 3966637 - RNA, 15 nt, Staphylococcus aureus subsp. aureus Mu50
aauuaaguuaaaaua

SEQ ID NO: 3966638 - RNA, 22 nt, Staphylococcus aureus subsp. aureus Mu50
aauuaauaacauccccaaaaau

SEQ ID NO: 3966639 - RNA, 15 nt, Staphylococcus aureus subsp. aureus Mu50
aauuaauaauuuuuu

SEQ ID NO: 3966640 - RNA, 16 nt, Staphylococcus aureus subsp. aureus Mu50
aauuaauacaucaaua

SEQ ID NO: 3966641 - RNA, 17 nt, Staphylococcus aureus subsp. aureus Mu50
aauuaauacaucaauau

SEQ ID NO: 3966642 - RNA, 16 nt, Staphylococcus aureus subsp. aureus Mu50
aauuaauagagacauu

SEQ ID NO: 3966643 - RNA, 19 nt, Staphylococcus aureus subsp. aureus Mu50
aauuaauagagacauuuua

SEQ ID NO: 3966644 - RNA, 16 nt, Staphylococcus aureus subsp. aureus Mu50
aauuaauauccaaaau

SEQ ID NO: 3966645 - RNA, 18 nt, Staphylococcus aureus subsp. aureus Mu50
aauuaaucggaucauuau

SEQ ID NO: 3966646 - RNA, 19 nt, Staphylococcus aureus subsp. aureus Mu50
aauuaaugccauuguuauc

SEQ ID NO: 3966647 - RNA, 14 nt, Staphylococcus aureus subsp. aureus Mu50
aauuaauuaaaauu

SEQ ID NO: 3966648 - RNA, 22 nt, Staphylococcus aureus subsp. aureus Mu50
aauuaauuacuuucauuguaaa

SEQ ID NO: 3966649 - RNA, 20 nt, Staphylococcus aureus subsp. aureus Mu50
aauuaauucgccuaaauggu

SEQ ID NO: 3966650 - RNA, 22 nt, Staphylococcus aureus subsp. aureus Mu50
aauuaauucgccuaaaugguuu

SEQ ID NO: 3966651 - RNA, 13 nt, Staphylococcus aureus subsp. aureus Mu50
aauuaauuguaaa

SEQ ID NO: 3966652 - RNA, 12 nt, Staphylococcus aureus subsp. aureus Mu50
aauuaauuuugu

SEQ ID NO: 3966653 - RNA, 16 nt, Staphylococcus aureus subsp. aureus Mu50
aauuacaaaaguauga

SEQ ID NO: 3966654 - RNA, 15 nt, Staphylococcus aureus subsp. aureus Mu50
aauuacaaauuaucu

SEQ ID NO: 3966655 - RNA, 20 nt, Staphylococcus aureus subsp. aureus Mu50
aauuacaauauaauuuccua

SEQ ID NO: 3966656 - RNA, 18 nt, Staphylococcus aureus subsp. aureus Mu50
aauuacaccugcaauaua

SEQ ID NO: 3966657 - RNA, 17 nt, Staphylococcus aureus subsp. aureus Mu50
aauuaccaaugaauaaa

SEQ ID NO: 3966658 - RNA, 16 nt, Staphylococcus aureus subsp. aureus Mu50
aauuaccguuuauuuc

SEQ ID NO: 3966659 - RNA, 18 nt, Staphylococcus aureus subsp. aureus Mu50
aauuaccguuuauuucgu

SEQ ID NO: 3966660 - RNA, 21 nt, Staphylococcus aureus subsp. aureus Mu50
aauuaccguuuauuucgugga

SEQ ID NO: 3966661 - RNA, 21 nt, Staphylococcus aureus subsp. aureus Mu50
aauuaccuuuccauucguaua

SEQ ID NO: 3966662 - RNA, 14 nt, Staphylococcus aureus subsp. aureus Mu50
aauuacgacaagaa

SEQ ID NO: 3966663 - RNA, 16 nt, Staphylococcus aureus subsp. aureus Mu50
aauuacgacaagaauu

SEQ ID NO: 3966664 - RNA, 15 nt, Staphylococcus aureus subsp. aureus Mu50
aauuacgucauaaaa

SEQ ID NO: 3966665 - RNA, 14 nt, Staphylococcus aureus subsp. aureus Mu50
aauuacguuuacua

SEQ ID NO: 3966666 - RNA, 20 nt, Staphylococcus aureus subsp. aureus Mu50
aauuacuguaaauaugaacu

SEQ ID NO: 3966667 - RNA, 21 nt, Staphylococcus aureus subsp. aureus Mu50
aauuacuguuaggauaaagau

SEQ ID NO: 3966668 - RNA, 21 nt, Staphylococcus aureus subsp. aureus Mu50
aauuacuugcacaccagugcc

SEQ ID NO: 3966669 - RNA, 18 nt, Staphylococcus aureus subsp. aureus Mu50
aauuacuuucauuguaaa

SEQ ID NO: 3966670 - RNA, 17 nt, Staphylococcus aureus subsp. aureus Mu50
aauuagaaaaauaugau

SEQ ID NO: 3966671 - RNA, 18 nt, Staphylococcus aureus subsp. aureus Mu50
aauuagaaaaauaugauu

SEQ ID NO: 3966672 - RNA, 19 nt, Staphylococcus aureus subsp. aureus Mu50
aauuagaaaaauaugauug

SEQ ID NO: 3966673 - RNA, 23 nt, Staphylococcus aureus subsp. aureus Mu50
aauuagaaaaauaugauugcaaa

SEQ ID NO: 3966674 - RNA, 13 nt, Staphylococcus aureus subsp. aureus Mu50
aauuagaaccauc

SEQ ID NO: 3966675 - RNA, 14 nt, Staphylococcus aureus subsp. aureus Mu50
aauuagaauauaug

SEQ ID NO: 3966676 - RNA, 17 nt, Staphylococcus aureus subsp. aureus Mu50
aauuagaugaaauggaa

SEQ ID NO: 3966677 - RNA, 14 nt, Staphylococcus aureus subsp. aureus Mu50
aauuagauuuaaaa

SEQ ID NO: 3966678 - RNA, 20 nt, Staphylococcus aureus subsp. aureus Mu50
aauuagauuuaaaaugucau

SEQ ID NO: 3966679 - RNA, 13 nt, Staphylococcus aureus subsp. aureus Mu50
aauuagauuuugu

SEQ ID NO: 3966680 - RNA, 19 nt, Staphylococcus aureus subsp. aureus Mu50
aauuagccccaguauagaa

SEQ ID NO: 3966681 - RNA, 22 nt, Staphylococcus aureus subsp. aureus Mu50
aauuagccgaaaaacaucauuu

SEQ ID NO: 3966682 - RNA, 16 nt, Staphylococcus aureus subsp. aureus Mu50
aauuaggauuaacaua

SEQ ID NO: 3966683 - RNA, 17 nt, Staphylococcus aureus subsp. aureus Mu50
aauuaggauuaacauaa

SEQ ID NO: 3966684 - RNA, 21 nt, Staphylococcus aureus subsp. aureus Mu50
aauuagguauaguguuugaca

SEQ ID NO: 3966685 - RNA, 23 nt, Staphylococcus aureus subsp. aureus Mu50
aauuagguauaguguuugacaag

SEQ ID NO: 3966686 - RNA, 21 nt, Staphylococcus aureus subsp. aureus Mu50
aauuagucaucaaccucauuu

SEQ ID NO: 3966687 - RNA, 18 nt, Staphylococcus aureus subsp. aureus Mu50
aauuagucccauuaacac

SEQ ID NO: 3966688 - RNA, 16 nt, Staphylococcus aureus subsp. aureus Mu50
aauuauaaaugauuaa

SEQ ID NO: 3966689 - RNA, 17 nt, Staphylococcus aureus subsp. aureus Mu50
aauuauaaaugauuaaa

SEQ ID NO: 3966690 - RNA, 23 nt, Staphylococcus aureus subsp. aureus Mu50
aauuauaaccgcuacaauuauaa

SEQ ID NO: 3966691 - RNA, 15 nt, Staphylococcus aureus subsp. aureus Mu50
aauucgccuaaaugg

SEQ ID NO: 3966692 - RNA, 21 nt, Staphylococcus aureus subsp. aureus Mu50
aauucgccuaaaugguuuuga

SEQ ID NO: 3966693 - RNA, 22 nt, Staphylococcus aureus subsp. aureus Mu50
aauucgcuugauuaauuuuauc

SEQ ID NO: 3966694 - RNA, 17 nt, Staphylococcus aureus subsp. aureus Mu50
aauucgcuuguaacaag

SEQ ID NO: 3966695 - RNA, 23 nt, Staphylococcus aureus subsp. aureus Mu50
aauucgcuuguaacaagcuuuuu

SEQ ID NO: 3966696 - RNA, 19 nt, Staphylococcus aureus subsp. aureus Mu50
aauucgucuguuucauaua

SEQ ID NO: 3966697 - RNA, 19 nt, Staphylococcus aureus subsp. aureus Mu50
aauucguuuugcuaaccau

SEQ ID NO: 3966698 - RNA, 20 nt, Staphylococcus aureus subsp. aureus Mu50
aauucguuuugcuaaccauc

SEQ ID NO: 3966699 - RNA, 22 nt, Staphylococcus aureus subsp. aureus Mu50
aauucguuuugcuaaccaucau

SEQ ID NO: 3966700 - RNA, 15 nt, Staphylococcus aureus subsp. aureus Mu50
aauucuaaaagaauu

SEQ ID NO: 3966701 - RNA, 16 nt, Staphylococcus aureus subsp. aureus Mu50
aauucuaaaagaauua

SEQ ID NO: 3966702 - RNA, 14 nt, Staphylococcus aureus subsp. aureus Mu50
aauucuaacugcaa

SEQ ID NO: 3966703 - RNA, 13 nt, Staphylococcus aureus subsp. aureus Mu50
aauucuaagucuc

SEQ ID NO: 3966704 - RNA, 24 nt, Staphylococcus aureus subsp. aureus Mu50
aauucuauccuaagcauaauucaa

SEQ ID NO: 3966705 - RNA, 13 nt, Staphylococcus aureus subsp. aureus Mu50
aauucuauuuuug

SEQ ID NO: 3966706 - RNA, 17 nt, Staphylococcus aureus subsp. aureus Mu50
aauucuauuuuugauuu

SEQ ID NO: 3966707 - RNA, 19 nt, Staphylococcus aureus subsp. aureus Mu50
aauucuauuuuugauuuaa

SEQ ID NO: 3966708 - RNA, 13 nt, Staphylococcus aureus subsp. aureus Mu50
aauucucuuuguu

SEQ ID NO: 3966709 - RNA, 21 nt, Staphylococcus aureus subsp. aureus Mu50
aauucucuuuguuggggccca

SEQ ID NO: 3966710 - RNA, 13 nt, Staphylococcus aureus subsp. aureus Mu50
aauucucuuuuaa

SEQ ID NO: 3966711 - RNA, 21 nt, Staphylococcus aureus subsp. aureus Mu50
aauucugaaaucaguuuuuga

SEQ ID NO: 3966712 - RNA, 22 nt, Staphylococcus aureus subsp. aureus Mu50
aauucugaaaucaguuuuugaa

SEQ ID NO: 3966713 - RNA, 23 nt, Staphylococcus aureus subsp. aureus Mu50
aauucuggauuaaacccuucaga

SEQ ID NO: 3966714 - RNA, 14 nt, Staphylococcus aureus subsp. aureus Mu50
aauucugguuuaau

SEQ ID NO: 3966715 - RNA, 16 nt, Staphylococcus aureus subsp. aureus Mu50
aauucuguuucaaagc

SEQ ID NO: 3966716 - RNA, 15 nt, Staphylococcus aureus subsp. aureus Mu50
aauucuuaaaaagca

SEQ ID NO: 3966717 - RNA, 23 nt, Staphylococcus aureus subsp. aureus Mu50
aauucuuaaucgagugauucagg

SEQ ID NO: 3966718 - RNA, 23 nt, Staphylococcus aureus subsp. aureus Mu50
aauucuucaaauuuaacguguaa

SEQ ID NO: 3966719 - RNA, 16 nt, Staphylococcus aureus subsp. aureus Mu50
aauucuucaaccauuu

SEQ ID NO: 3966720 - RNA, 19 nt, Staphylococcus aureus subsp. aureus Mu50
aauucuucaucaauaacua

SEQ ID NO: 3966721 - RNA, 16 nt, Staphylococcus aureus subsp. aureus Mu50
aauucuucaucuucuu

SEQ ID NO: 3966722 - RNA, 22 nt, Staphylococcus aureus subsp. aureus Mu50
aauucuucuuuagauugaucag

SEQ ID NO: 3966723 - RNA, 18 nt, Staphylococcus aureus subsp. aureus Mu50
aauucuuuucaagaaauu

SEQ ID NO: 3966724 - RNA, 13 nt, Staphylococcus aureus subsp. aureus Mu50
aauucuuuuguaa

SEQ ID NO: 3966725 - RNA, 16 nt, Staphylococcus aureus subsp. aureus Mu50
aauucuuuuucagcua

SEQ ID NO: 3966726 - RNA, 21 nt, Staphylococcus aureus subsp. aureus Mu50
aauucuuuuucagcuaauugu

SEQ ID NO: 3966727 - RNA, 23 nt, Staphylococcus aureus subsp. aureus Mu50
aauucuuuuucagcuaauugucg

SEQ ID NO: 3966728 - RNA, 15 nt, Staphylococcus aureus subsp. aureus Mu50
aauugaaaaucuaau

SEQ ID NO: 3966729 - RNA, 17 nt, Staphylococcus aureus subsp. aureus Mu50
aauugaaauagaaacua

SEQ ID NO: 3966730 - RNA, 16 nt, Staphylococcus aureus subsp. aureus Mu50
aauugaaauuaacugu

SEQ ID NO: 3966731 - RNA, 18 nt, Staphylococcus aureus subsp. aureus Mu50
aauugaaauuaacuguau

SEQ ID NO: 3966732 - RNA, 17 nt, Staphylococcus aureus subsp. aureus Mu50
aauugaaggccauuuuu

SEQ ID NO: 3966733 - RNA, 22 nt, Staphylococcus aureus subsp. aureus Mu50
aauugaaguacauuaaaacaau

SEQ ID NO: 3966734 - RNA, 18 nt, Staphylococcus aureus subsp. aureus Mu50
aauugaaucuuuguuaua

SEQ ID NO: 3966735 - RNA, 21 nt, Staphylococcus aureus subsp. aureus Mu50
aauugaaugaaaaaguugauc

SEQ ID NO: 3966736 - RNA, 14 nt, Staphylococcus aureus subsp. aureus Mu50
aauugaaugaaaau

SEQ ID NO: 3966737 - RNA, 21 nt, Staphylococcus aureus subsp. aureus Mu50
aauugaauuucgcacaauguu

SEQ ID NO: 3966738 - RNA, 18 nt, Staphylococcus aureus subsp. aureus Mu50
aauugacgcauuaaugau

SEQ ID NO: 3966739 - RNA, 19 nt, Staphylococcus aureus subsp. aureus Mu50
aauugacgcauuaaugauu

SEQ ID NO: 3966740 - RNA, 17 nt, Staphylococcus aureus subsp. aureus Mu50
aauugacucaaagauau

SEQ ID NO: 3966741 - RNA, 22 nt, Staphylococcus aureus subsp. aureus Mu50
aauugacucaaagauauacuua

SEQ ID NO: 3966742 - RNA, 19 nt, Staphylococcus aureus subsp. aureus Mu50
aauugacuuacauuuuaau

SEQ ID NO: 3966743 - RNA, 22 nt, Staphylococcus aureus subsp. aureus Mu50
aauugacuuacauuuuaauaaa

SEQ ID NO: 3966744 - RNA, 19 nt, Staphylococcus aureus subsp. aureus Mu50
aauugagaaguauuaugau

SEQ ID NO: 3966745 - RNA, 20 nt, Staphylococcus aureus subsp. aureus Mu50
aauugagagaaguuucuaua

SEQ ID NO: 3966746 - RNA, 14 nt, Staphylococcus aureus subsp. aureus Mu50
aauugaguauuaaa

SEQ ID NO: 3966747 - RNA, 23 nt, Staphylococcus aureus subsp. aureus Mu50
aauugaguauuaaauuugaaagu

SEQ ID NO: 3966748 - RNA, 19 nt, Staphylococcus aureus subsp. aureus Mu50
aauugaguauuaaauuugu

SEQ ID NO: 3966749 - RNA, 16 nt, Staphylococcus aureus subsp. aureus Mu50
aauugaguuguugcaa

SEQ ID NO: 3966750 - RNA, 17 nt, Staphylococcus aureus subsp. aureus Mu50
aauugaguuuuuuaaaa

SEQ ID NO: 3966751 - RNA, 20 nt, Staphylococcus aureus subsp. aureus Mu50
aauugaucagcauuuaagcu

SEQ ID NO: 3966752 - RNA, 14 nt, Staphylococcus aureus subsp. aureus Mu50
aauugaugauuacu

SEQ ID NO: 3966753 - RNA, 13 nt, Staphylococcus aureus subsp. aureus Mu50
aauugauggaaaa

SEQ ID NO: 3966754 - RNA, 21 nt, Staphylococcus aureus subsp. aureus Mu50
aauugaugugccuuucuaaua

SEQ ID NO: 3966755 - RNA, 22 nt, Staphylococcus aureus subsp. aureus Mu50
aauugauuacaccacuuaggau

SEQ ID NO: 3966756 - RNA, 17 nt, Staphylococcus aureus subsp. aureus Mu50
aauugauuauaaugauu

SEQ ID NO: 3966757 - RNA, 23 nt, Staphylococcus aureus subsp. aureus Mu50
aauugauucucuguagauaucaa

SEQ ID NO: 3966758 - RNA, 21 nt, Staphylococcus aureus subsp. aureus Mu50
aauugauugcucuaagcauuc

SEQ ID NO: 3966759 - RNA, 20 nt, Staphylococcus aureus subsp. aureus Mu50
aauugauuguggugaaauaa

SEQ ID NO: 3966760 - RNA, 19 nt, Staphylococcus aureus subsp. aureus Mu50
aauugauuucuaauugaaa

SEQ ID NO: 3966761 - RNA, 18 nt, Staphylococcus aureus subsp. aureus Mu50
aauugauuuugaaucaca

SEQ ID NO: 3966762 - RNA, 22 nt, Staphylococcus aureus subsp. aureus Mu50
aauugcaacgcaucacaaaauu

SEQ ID NO: 3966763 - RNA, 18 nt, Staphylococcus aureus subsp. aureus Mu50
aauugcaaugaauaacaa

SEQ ID NO: 3966764 - RNA, 15 nt, Staphylococcus aureus subsp. aureus Mu50
aauugcaauggcaac

SEQ ID NO: 3966765 - RNA, 18 nt, Staphylococcus aureus subsp. aureus Mu50
aauugcauuacuacaaac

SEQ ID NO: 3966766 - RNA, 23 nt, Staphylococcus aureus subsp. aureus Mu50
aauugcauuacuacaaacuugau

SEQ ID NO: 3966767 - RNA, 15 nt, Staphylococcus aureus subsp. aureus Mu50
aauugcgauugcuag

SEQ ID NO: 3966768 - RNA, 15 nt, Staphylococcus aureus subsp. aureus Mu50
aauugcuaaaaaaau

SEQ ID NO: 3966769 - RNA, 14 nt, Staphylococcus aureus subsp. aureus Mu50
aauugcuaaaauau

SEQ ID NO: 3966770 - RNA, 17 nt, Staphylococcus aureus subsp. aureus Mu50
aauugcuaaaauaucaa

SEQ ID NO: 3966771 - RNA, 20 nt, Staphylococcus aureus subsp. aureus Mu50
aauugcuauauuaguauaau

SEQ ID NO: 3966772 - RNA, 14 nt, Staphylococcus aureus subsp. aureus Mu50
aauugcucuuuaac

SEQ ID NO: 3966773 - RNA, 17 nt, Staphylococcus aureus subsp. aureus Mu50
aauugcucuuuaacaau

SEQ ID NO: 3966774 - RNA, 18 nt, Staphylococcus aureus subsp. aureus Mu50
aauugcucuuuaacaaug

SEQ ID NO: 3966775 - RNA, 19 nt, Staphylococcus aureus subsp. aureus Mu50
aauugcugauauaauagaa

SEQ ID NO: 3966776 - RNA, 16 nt, Staphylococcus aureus subsp. aureus Mu50
aauugcuugaaauuau

SEQ ID NO: 3966777 - RNA, 13 nt, Staphylococcus aureus subsp. aureus Mu50
aauugcuuguucu

SEQ ID NO: 3966778 - RNA, 21 nt, Staphylococcus aureus subsp. aureus Mu50
aauuuagucauuacaaaucau

SEQ ID NO: 3966779 - RNA, 20 nt, Staphylococcus aureus subsp. aureus Mu50
aauuuaguccuucuuuacua

SEQ ID NO: 3966780 - RNA, 13 nt, Staphylococcus aureus subsp. aureus Mu50
aauuuagugaaac

SEQ ID NO: 3966781 - RNA, 18 nt, Staphylococcus aureus subsp. aureus Mu50
aauuuagugaaacaauuu

SEQ ID NO: 3966782 - RNA, 20 nt, Staphylococcus aureus subsp. aureus Mu50
aauuuaguucaccauuucgu

SEQ ID NO: 3966783 - RNA, 17 nt, Staphylococcus aureus subsp. aureus Mu50
aauuuauaaaaagagau

SEQ ID NO: 3966784 - RNA, 15 nt, Staphylococcus aureus subsp. aureus Mu50
aauuuaucaauuucu

SEQ ID NO: 3966785 - RNA, 17 nt, Staphylococcus aureus subsp. aureus Mu50
aauuuaucaauuucuau

SEQ ID NO: 3966786 - RNA, 15 nt, Staphylococcus aureus subsp. aureus Mu50
aauuuaucugcaaaa

SEQ ID NO: 3966787 - RNA, 14 nt, Staphylococcus aureus subsp. aureus Mu50
aauuuaucuuaauc

SEQ ID NO: 3966788 - RNA, 14 nt, Staphylococcus aureus subsp. aureus Mu50
aauuuaugauuguu

SEQ ID NO: 3966789 - RNA, 13 nt, Staphylococcus aureus subsp. aureus Mu50
aauuuaugguaaa

SEQ ID NO: 3966790 - RNA, 12 nt, Staphylococcus aureus subsp. aureus Mu50
aauuuauuauaa

SEQ ID NO: 3966791 - RNA, 22 nt, Staphylococcus aureus subsp. aureus Mu50
aauuuauuauaaaauagaagua

SEQ ID NO: 3966792 - RNA, 13 nt, Staphylococcus aureus subsp. aureus Mu50
aauuuauuuugua

SEQ ID NO: 3966793 - RNA, 17 nt, Staphylococcus aureus subsp. aureus Mu50
aauuuauuuuuaauuuc

SEQ ID NO: 3966794 - RNA, 13 nt, Staphylococcus aureus subsp. aureus Mu50
aauuucaaaaaua

SEQ ID NO: 3966795 - RNA, 12 nt, Staphylococcus aureus subsp. aureus Mu50
aauuucaaaaua

SEQ ID NO: 3966796 - RNA, 15 nt, Staphylococcus aureus subsp. aureus Mu50
aauuucaaaauagua

SEQ ID NO: 3966797 - RNA, 17 nt, Staphylococcus aureus subsp. aureus Mu50
aauuucaacauuacuaa

SEQ ID NO: 3966798 - RNA, 21 nt, Staphylococcus aureus subsp. aureus Mu50
aauuucaagguauacacaaau

SEQ ID NO: 3966799 - RNA, 23 nt, Staphylococcus aureus subsp. aureus Mu50
aauuucaauuuggaaauaucuua

SEQ ID NO: 3966800 - RNA, 17 nt, Staphylococcus aureus subsp. aureus Mu50
aauuucaccuuguaaau

SEQ ID NO: 3966801 - RNA, 21 nt, Staphylococcus aureus subsp. aureus Mu50
aauuucacgcugaaauuuuuu

SEQ ID NO: 3966802 - RNA, 21 nt, Staphylococcus aureus subsp. aureus Mu50
aauuucaguaggacauauaaa

SEQ ID NO: 3966803 - RNA, 15 nt, Staphylococcus aureus subsp. aureus Mu50
aauuucaguaucaug

SEQ ID NO: 3966804 - RNA, 21 nt, Staphylococcus aureus subsp. aureus Mu50
aauuucaguucuuagauuuuc

SEQ ID NO: 3966805 - RNA, 19 nt, Staphylococcus aureus subsp. aureus Mu50
aauuucauaguuaucgauu

SEQ ID NO: 3966806 - RNA, 16 nt, Staphylococcus aureus subsp. aureus Mu50
aauuucaucaaaucca

SEQ ID NO: 3966807 - RNA, 16 nt, Staphylococcus aureus subsp. aureus Mu50
aauuuccaaaguaaua

SEQ ID NO: 3966808 - RNA, 18 nt, Staphylococcus aureus subsp. aureus Mu50
aauuuccaaaguaauaug

SEQ ID NO: 3966809 - RNA, 16 nt, Staphylococcus aureus subsp. aureus Mu50
aauuuccaauaucuuc

SEQ ID NO: 3966810 - RNA, 18 nt, Staphylococcus aureus subsp. aureus Mu50
aauuuccaauaucuucuu

SEQ ID NO: 3966811 - RNA, 14 nt, Staphylococcus aureus subsp. aureus Mu50
aauuucgaaaagaa

SEQ ID NO: 3966812 - RNA, 19 nt, Staphylococcus aureus subsp. aureus Mu50
aauuucgaaaagaaauucu

SEQ ID NO: 3966813 - RNA, 16 nt, Staphylococcus aureus subsp. aureus Mu50
aauuucgacaucuaga

SEQ ID NO: 3966814 - RNA, 23 nt, Staphylococcus aureus subsp. aureus Mu50
aauuucgacaucuagaugaaauu

SEQ ID NO: 3966815 - RNA, 12 nt, Staphylococcus aureus subsp. aureus Mu50
aauuucgauuaa

SEQ ID NO: 3966816 - RNA, 18 nt, Staphylococcus aureus subsp. aureus Mu50
aauuucgccucaucuaau

SEQ ID NO: 3966817 - RNA, 14 nt, Staphylococcus aureus subsp. aureus Mu50
aauuucuaauuaaa

SEQ ID NO: 3966818 - RNA, 19 nt, Staphylococcus aureus subsp. aureus Mu50
aauuucuauagaaaaagua

SEQ ID NO: 3966819 - RNA, 14 nt, Staphylococcus aureus subsp. aureus Mu50
aauuucuaugaaaa

SEQ ID NO: 3966820 - RNA, 17 nt, Staphylococcus aureus subsp. aureus Mu50
aauuucuaugaaaaaaa

SEQ ID NO: 3966821 - RNA, 23 nt, Staphylococcus aureus subsp. aureus Mu50
aauuucuaugaaaaaaaucgaau

SEQ ID NO: 3966822 - RNA, 12 nt, Staphylococcus aureus subsp. aureus Mu50
aauuucuauuua

SEQ ID NO: 3966823 - RNA, 23 nt, Staphylococcus aureus subsp. aureus Mu50
aauuucuauuuauugagauagaa

SEQ ID NO: 3966824 - RNA, 19 nt, Staphylococcus aureus subsp. aureus Mu50
aauuucucccguuugauuu

SEQ ID NO: 3966825 - RNA, 18 nt, Staphylococcus aureus subsp. aureus Mu50
aauuucucuuucaagacc

SEQ ID NO: 3966826 - RNA, 15 nt, Staphylococcus aureus subsp. aureus Mu50
aauuucugaacauaa

SEQ ID NO: 3966827 - RNA, 16 nt, Staphylococcus aureus subsp. aureus Mu50
aauuucuguaaccaaa

SEQ ID NO: 3966828 - RNA, 21 nt, Staphylococcus aureus subsp. aureus Mu50
aauuucuguaauaauaucacc

SEQ ID NO: 3966829 - RNA, 23 nt, Staphylococcus aureus subsp. aureus Mu50
aauuucuguuuacgccauaagaa

SEQ ID NO: 3966830 - RNA, 16 nt, Staphylococcus aureus subsp. aureus Mu50
aauuugaaaguaaauu

SEQ ID NO: 3966831 - RNA, 16 nt, Staphylococcus aureus subsp. aureus Mu50
aauuugaaauauacca

SEQ ID NO: 3966832 - RNA, 21 nt, Staphylococcus aureus subsp. aureus Mu50
aauuugagcaauucuugaaaa

SEQ ID NO: 3966833 - RNA, 19 nt, Staphylococcus aureus subsp. aureus Mu50
aauuugaggauacauaaau

SEQ ID NO: 3966834 - RNA, 13 nt, Staphylococcus aureus subsp. aureus Mu50
aauuugauuaaaa

SEQ ID NO: 3966835 - RNA, 23 nt, Staphylococcus aureus subsp. aureus Mu50
aauuugauuaaaaacgucucuau

SEQ ID NO: 3966836 - RNA, 16 nt, Staphylococcus aureus subsp. aureus Mu50
aauuugcacaaagaua

SEQ ID NO: 3966837 - RNA, 13 nt, Staphylococcus aureus subsp. aureus Mu50
aauuuguaauucc

SEQ ID NO: 3966838 - RNA, 18 nt, Staphylococcus aureus subsp. aureus Mu50
aauuuguaccaaauaaau

SEQ ID NO: 3966839 - RNA, 21 nt, Staphylococcus aureus subsp. aureus Mu50
aauuuguaccaaauaaauuaa

SEQ ID NO: 3966840 - RNA, 15 nt, Staphylococcus aureus subsp. aureus Mu50
aauuugucauuucuu

SEQ ID NO: 3966841 - RNA, 20 nt, Staphylococcus aureus subsp. aureus Mu50
aauuugucauuucuucuuuu

SEQ ID NO: 3966842 - RNA, 17 nt, Staphylococcus aureus subsp. aureus Mu50
aauuuguguucaaauca

SEQ ID NO: 3966843 - RNA, 19 nt, Staphylococcus aureus subsp. aureus Mu50
aauuuguguucaaaucaca

SEQ ID NO: 3966844 - RNA, 15 nt, Staphylococcus aureus subsp. aureus Mu50
aauuuguuuuaaaua

SEQ ID NO: 3966845 - RNA, 18 nt, Staphylococcus aureus subsp. aureus Mu50
aauuuguuuuauuuucga

SEQ ID NO: 3966846 - RNA, 16 nt, Staphylococcus aureus subsp. aureus Mu50
aauuuuaacuuauaua

SEQ ID NO: 3966847 - RNA, 14 nt, Staphylococcus aureus subsp. aureus Mu50
aauuuuaaguuaau

SEQ ID NO: 3966848 - RNA, 15 nt, Staphylococcus aureus subsp. aureus Mu50
aauuuuaaguuaauu

SEQ ID NO: 3966849 - RNA, 15 nt, Staphylococcus aureus subsp. aureus Mu50
aauuuuaauauauuu

SEQ ID NO: 3966850 - RNA, 12 nt, Staphylococcus aureus subsp. aureus Mu50
aauuuuaauauu

SEQ ID NO: 3966851 - RNA, 20 nt, Staphylococcus aureus subsp. aureus Mu50
aauuuuaauuaauuaucaua

SEQ ID NO: 3966852 - RNA, 12 nt, Staphylococcus aureus subsp. aureus Mu50
aauuuuaccaug

SEQ ID NO: 3966853 - RNA, 16 nt, Staphylococcus aureus subsp. aureus Mu50
aauuuuaccauguuuu

SEQ ID NO: 3966854 - RNA, 16 nt, Staphylococcus aureus subsp. aureus Mu50
aauuuuagccaaauua

SEQ ID NO: 3966855 - RNA, 20 nt, Staphylococcus aureus subsp. aureus Mu50
aauuuuagccaaauuacugu

SEQ ID NO: 3966856 - RNA, 22 nt, Staphylococcus aureus subsp. aureus Mu50
aauuuuauaaauuaaaugcaau

SEQ ID NO: 3966857 - RNA, 19 nt, Staphylococcus aureus subsp. aureus Mu50
aauuuuauauagacaguag

SEQ ID NO: 3966858 - RNA, 22 nt, Staphylococcus aureus subsp. aureus Mu50
aauuuuaucuaaagcuauaaaa

SEQ ID NO: 3966859 - RNA, 19 nt, Staphylococcus aureus subsp. aureus Mu50
aauuuuaucuuauuauuaa

SEQ ID NO: 3966860 - RNA, 22 nt, Staphylococcus aureus subsp. aureus Mu50
aauuuuaugucccaaugcugaa

SEQ ID NO: 3966861 - RNA, 17 nt, Staphylococcus aureus subsp. aureus Mu50
aauuuuauuagguaaua

SEQ ID NO: 3966862 - RNA, 21 nt, Staphylococcus aureus subsp. aureus Mu50
aauuuuccuuccaauaauaaa

SEQ ID NO: 3966863 - RNA, 15 nt, Staphylococcus aureus subsp. aureus Mu50
aauuuucuaaauaua

SEQ ID NO: 3966864 - RNA, 16 nt, Staphylococcus aureus subsp. aureus Mu50
aauuuucuguccaaaa

SEQ ID NO: 3966865 - RNA, 12 nt, Staphylococcus aureus subsp. aureus Mu50
aauuuugaagaa

SEQ ID NO: 3966866 - RNA, 13 nt, Staphylococcus aureus subsp. aureus Mu50
acaacuucuucuc

SEQ ID NO: 3966867 - RNA, 17 nt, Staphylococcus aureus subsp. aureus Mu50
acaacuuuaauuuuuca

SEQ ID NO: 3966868 - RNA, 15 nt, Staphylococcus aureus subsp. aureus Mu50
acaacuuuauuauac

SEQ ID NO: 3966869 - RNA, 15 nt, Staphylococcus aureus subsp. aureus Mu50
acaagcaucaugaaa

SEQ ID NO: 3966870 - RNA, 16 nt, Staphylococcus aureus subsp. aureus Mu50
acaagccaagauaaau

SEQ ID NO: 3966871 - RNA, 21 nt, Staphylococcus aureus subsp. aureus Mu50
acaagccaagauaaaucauca

SEQ ID NO: 3966872 - RNA, 22 nt, Staphylococcus aureus subsp. aureus Mu50
acaagccuuaaaauauuuaacu

SEQ ID NO: 3966873 - RNA, 15 nt, Staphylococcus aureus subsp. aureus Mu50
acaagcuuuucauuu

SEQ ID NO: 3966874 - RNA, 19 nt, Staphylococcus aureus subsp. aureus Mu50
acaagcuuuucauuuuuau

SEQ ID NO: 3966875 - RNA, 18 nt, Staphylococcus aureus subsp. aureus Mu50
acaagguaugaaauaaca

SEQ ID NO: 3966876 - RNA, 15 nt, Staphylococcus aureus subsp. aureus Mu50
acaagguuucaagag

SEQ ID NO: 3966877 - RNA, 18 nt, Staphylococcus aureus subsp. aureus Mu50
acaaguacaauaauaccu

SEQ ID NO: 3966878 - RNA, 14 nt, Staphylococcus aureus subsp. aureus Mu50
acaaguauaaaugc

SEQ ID NO: 3966879 - RNA, 20 nt, Staphylococcus aureus subsp. aureus Mu50
acaaguauaaaugcagcugu

SEQ ID NO: 3966880 - RNA, 13 nt, Staphylococcus aureus subsp. aureus Mu50
acaagucauuauc

SEQ ID NO: 3966881 - RNA, 16 nt, Staphylococcus aureus subsp. aureus Mu50
acaagucauuauccaa

SEQ ID NO: 3966882 - RNA, 22 nt, Staphylococcus aureus subsp. aureus Mu50
acaagucuaguucgaacacaca

SEQ ID NO: 3966883 - RNA, 20 nt, Staphylococcus aureus subsp. aureus Mu50
acaagucuuauuuguuuaau

SEQ ID NO: 3966884 - RNA, 21 nt, Staphylococcus aureus subsp. aureus Mu50
acaagucuuauuuguuuaauu

SEQ ID NO: 3966885 - RNA, 19 nt, Staphylococcus aureus subsp. aureus Mu50
acaaguugcugaauaaaau

SEQ ID NO: 3966886 - RNA, 16 nt, Staphylococcus aureus subsp. aureus Mu50
acaaguuuacagguug

SEQ ID NO: 3966887 - RNA, 18 nt, Staphylococcus aureus subsp. aureus Mu50
acaaguuucgcagcuuua

SEQ ID NO: 3966888 - RNA, 23 nt, Staphylococcus aureus subsp. aureus Mu50
acaaguuuuaccccuguugaaua

SEQ ID NO: 3966889 - RNA, 15 nt, Staphylococcus aureus subsp. aureus Mu50
acaauaaaaaaccaa

SEQ ID NO: 3966890 - RNA, 14 nt, Staphylococcus aureus subsp. aureus Mu50
acaauaaaauuacu

SEQ ID NO: 3966891 - RNA, 14 nt, Staphylococcus aureus subsp. aureus Mu50
acaauaaagacaua

SEQ ID NO: 3966892 - RNA, 14 nt, Staphylococcus aureus subsp. aureus Mu50
acaauaacaccugu

SEQ ID NO: 3966893 - RNA, 14 nt, Staphylococcus aureus subsp. aureus Mu50
acaauaaccauuuc

SEQ ID NO: 3966894 - RNA, 16 nt, Staphylococcus aureus subsp. aureus Mu50
acaauaaccauuucau

SEQ ID NO: 3966895 - RNA, 15 nt, Staphylococcus aureus subsp. aureus Mu50
acaauaagcgcaauu

SEQ ID NO: 3966896 - RNA, 15 nt, Staphylococcus aureus subsp. aureus Mu50
acaauacaaaucgau

SEQ ID NO: 3966897 - RNA, 15 nt, Staphylococcus aureus subsp. aureus Mu50
acaauacauaauggu

SEQ ID NO: 3966898 - RNA, 12 nt, Staphylococcus aureus subsp. aureus Mu50
acaauacgauga

SEQ ID NO: 3966899 - RNA, 16 nt, Staphylococcus aureus subsp. aureus Mu50
acaauagguacaacua

SEQ ID NO: 3966900 - RNA, 13 nt, Staphylococcus aureus subsp. aureus Mu50
acaauaguacuaa

SEQ ID NO: 3966901 - RNA, 22 nt, Staphylococcus aureus subsp. aureus Mu50
acaauaguauuaacuauaaaua

SEQ ID NO: 3966902 - RNA, 19 nt, Staphylococcus aureus subsp. aureus Mu50
acaauauaauuuccuaaaa

SEQ ID NO: 3966903 - RNA, 22 nt, Staphylococcus aureus subsp. aureus Mu50
acaauauagaaaaugaguacaa

SEQ ID NO: 3966904 - RNA, 14 nt, Staphylococcus aureus subsp. aureus Mu50
acaauauuaaaauu

SEQ ID NO: 3966905 - RNA, 12 nt, Staphylococcus aureus subsp. aureus Mu50
acaauauucaau

SEQ ID NO: 3966906 - RNA, 23 nt, Staphylococcus aureus subsp. aureus Mu50
acaauauuuuuacauauuuauac

SEQ ID NO: 3966907 - RNA, 14 nt, Staphylococcus aureus subsp. aureus Mu50
acaaucacgauuaa

SEQ ID NO: 3966908 - RNA, 15 nt, Staphylococcus aureus subsp. aureus Mu50
acaaucagauaaguu

SEQ ID NO: 3966909 - RNA, 16 nt, Staphylococcus aureus subsp. aureus Mu50
acaaucaguaauaaug

SEQ ID NO: 3966910 - RNA, 21 nt, Staphylococcus aureus subsp. aureus Mu50
acaaucauagauauaagaaau

SEQ ID NO: 3966911 - RNA, 14 nt, Staphylococcus aureus subsp. aureus Mu50
acaaucgaauguau

SEQ ID NO: 3966912 - RNA, 20 nt, Staphylococcus aureus subsp. aureus Mu50
acaaucgaauguauugcuau

SEQ ID NO: 3966913 - RNA, 17 nt, Staphylococcus aureus subsp. aureus Mu50
acaaucggaagcauauu

SEQ ID NO: 3966914 - RNA, 19 nt, Staphylococcus aureus subsp. aureus Mu50
acaaucguugaagauguau

SEQ ID NO: 3966915 - RNA, 21 nt, Staphylococcus aureus subsp. aureus Mu50
acaaucguugaagauguauuu

SEQ ID NO: 3966916 - RNA, 19 nt, Staphylococcus aureus subsp. aureus Mu50
acaaucuccauuagaacua

SEQ ID NO: 3966917 - RNA, 13 nt, Staphylococcus aureus subsp. aureus Mu50
acaaucuguucau

SEQ ID NO: 3966918 - RNA, 14 nt, Staphylococcus aureus subsp. aureus Mu50
acaaucuuaucaua

SEQ ID NO: 3966919 - RNA, 23 nt, Staphylococcus aureus subsp. aureus Mu50
acaaucuuuuucaugcuauuuaa

SEQ ID NO: 3966920 - RNA, 15 nt, Staphylococcus aureus subsp. aureus Mu50
acaaugaaaaaacga

SEQ ID NO: 3966921 - RNA, 14 nt, Staphylococcus aureus subsp. aureus Mu50
acaaugauuaaaau

SEQ ID NO: 3966922 - RNA, 21 nt, Staphylococcus aureus subsp. aureus Mu50
acaaugauugaauauuguugu

SEQ ID NO: 3966923 - RNA, 21 nt, Staphylococcus aureus subsp. aureus Mu50
acaaugcagcuguauuuaaua

SEQ ID NO: 3966924 - RNA, 18 nt, Staphylococcus aureus subsp. aureus Mu50
acaaugcauccaaauauu

SEQ ID NO: 3966925 - RNA, 20 nt, Staphylococcus aureus subsp. aureus Mu50
acaaugcauccaaauauuaa

SEQ ID NO: 3966926 - RNA, 13 nt, Staphylococcus aureus subsp. aureus Mu50
acaaugcgcaaug

SEQ ID NO: 3966927 - RNA, 17 nt, Staphylococcus aureus subsp. aureus Mu50
acaaugcgcaaugaaaa

SEQ ID NO: 3966928 - RNA, 15 nt, Staphylococcus aureus subsp. aureus Mu50
acaauggaugccgcu

SEQ ID NO: 3966929 - RNA, 13 nt, Staphylococcus aureus subsp. aureus Mu50
acaauguauuacc

SEQ ID NO: 3966930 - RNA, 19 nt, Staphylococcus aureus subsp. aureus Mu50
acaauguuauuagauacuu

SEQ ID NO: 3966931 - RNA, 15 nt, Staphylococcus aureus subsp. aureus Mu50
acaauuaaagugaau

SEQ ID NO: 3966932 - RNA, 13 nt, Staphylococcus aureus subsp. aureus Mu50
acaauuaauuacu

SEQ ID NO: 3966933 - RNA, 15 nt, Staphylococcus aureus subsp. aureus Mu50
acaauuauaauaaaa

SEQ ID NO: 3966934 - RNA, 14 nt, Staphylococcus aureus subsp. aureus Mu50
acaauucauuaaua

SEQ ID NO: 3966935 - RNA, 13 nt, Staphylococcus aureus subsp. aureus Mu50
acaauugcagaga

SEQ ID NO: 3966936 - RNA, 14 nt, Staphylococcus aureus subsp. aureus Mu50
acaauuguaguaau

SEQ ID NO: 3966937 - RNA, 14 nt, Staphylococcus aureus subsp. aureus Mu50
acaauuuaaaaagc

SEQ ID NO: 3966938 - RNA, 18 nt, Staphylococcus aureus subsp. aureus Mu50
acaauuuaaaaagcagua

SEQ ID NO: 3966939 - RNA, 15 nt, Staphylococcus aureus subsp. aureus Mu50
acaauuuagaugagu

SEQ ID NO: 3966940 - RNA, 13 nt, Staphylococcus aureus subsp. aureus Mu50
acaauuucgcuua

SEQ ID NO: 3966941 - RNA, 14 nt, Staphylococcus aureus subsp. aureus Mu50
acaauuugaggaua

SEQ ID NO: 3966942 - RNA, 22 nt, Staphylococcus aureus subsp. aureus Mu50
acaauuuguaacuauugaaaau

SEQ ID NO: 3966943 - RNA, 12 nt, Staphylococcus aureus subsp. aureus Mu50
acaauuuuaaau

SEQ ID NO: 3966944 - RNA, 15 nt, Staphylococcus aureus subsp. aureus Mu50
acaauuuuccuucca

SEQ ID NO: 3966945 - RNA, 16 nt, Staphylococcus aureus subsp. aureus Mu50
acaauuuuccuuccaa

SEQ ID NO: 3966946 - RNA, 16 nt, Staphylococcus aureus subsp. aureus Mu50
acaauuuucucauuaa

SEQ ID NO: 3966947 - RNA, 15 nt, Staphylococcus aureus subsp. aureus Mu50
acaauuuuuaaaaac

SEQ ID NO: 3966948 - RNA, 18 nt, Staphylococcus aureus subsp. aureus Mu50
acaauuuuugggaagaau

SEQ ID NO: 3966949 - RNA, 19 nt, Staphylococcus aureus subsp. aureus Mu50
acaauuuuugggaagaaua

SEQ ID NO: 3966950 - RNA, 22 nt, Staphylococcus aureus subsp. aureus Mu50
acacaaagaauuucgaaaagaa

SEQ ID NO: 3966951 - RNA, 14 nt, Staphylococcus aureus subsp. aureus Mu50
acacaacgauagau

SEQ ID NO: 3966952 - RNA, 18 nt, Staphylococcus aureus subsp. aureus Mu50
acacaaugcccuuaaagc

SEQ ID NO: 3966953 - RNA, 16 nt, Staphylococcus aureus subsp. aureus Mu50
acacacaugauaauuu

SEQ ID NO: 3966954 - RNA, 15 nt, Staphylococcus aureus subsp. aureus Mu50
acagguaaauuuaaa

SEQ ID NO: 3966955 - RNA, 23 nt, Staphylococcus aureus subsp. aureus Mu50
acaguaaucaugcauucuaugau

SEQ ID NO: 3966956 - RNA, 17 nt, Staphylococcus aureus subsp. aureus Mu50
acaguacaaauaacaaa

SEQ ID NO: 3966957 - RNA, 21 nt, Staphylococcus aureus subsp. aureus Mu50
acaguacgauuauuuggauaa

SEQ ID NO: 3966958 - RNA, 20 nt, Staphylococcus aureus subsp. aureus Mu50
acaguaguuaauugaaugaa

SEQ ID NO: 3966959 - RNA, 23 nt, Staphylococcus aureus subsp. aureus Mu50
acaguaguuaauugaaugaaaau

SEQ ID NO: 3966960 - RNA, 14 nt, Staphylococcus aureus subsp. aureus Mu50
acaguaucuucagu

SEQ ID NO: 3966961 - RNA, 15 nt, Staphylococcus aureus subsp. aureus Mu50
acagucaacugcugc

SEQ ID NO: 3966962 - RNA, 23 nt, Staphylococcus aureus subsp. aureus Mu50
acagucaacugcugcuaaaauaa

SEQ ID NO: 3966963 - RNA, 15 nt, Staphylococcus aureus subsp. aureus Mu50
acagugacugauuca

SEQ ID NO: 3966964 - RNA, 17 nt, Staphylococcus aureus subsp. aureus Mu50
acagugacugauucacc

SEQ ID NO: 3966965 - RNA, 19 nt, Staphylococcus aureus subsp. aureus Mu50
acaguguaugaugaacuua

SEQ ID NO: 3966966 - RNA, 14 nt, Staphylococcus aureus subsp. aureus Mu50
acaguuacuucagu

SEQ ID NO: 3966967 - RNA, 22 nt, Staphylococcus aureus subsp. aureus Mu50
acaguuacuuucgcuugcaaag

SEQ ID NO: 3966968 - RNA, 23 nt, Staphylococcus aureus subsp. aureus Mu50
acaguuacuuucgcuugcaaaga

SEQ ID NO: 3966969 - RNA, 20 nt, Staphylococcus aureus subsp. aureus Mu50
acaguuaugccugaagcgcu

SEQ ID NO: 3966970 - RNA, 16 nt, Staphylococcus aureus subsp. aureus Mu50
acaguucuauagguuu

SEQ ID NO: 3966971 - RNA, 22 nt, Staphylococcus aureus subsp. aureus Mu50
acaguucuauagguuuauaaaa

SEQ ID NO: 3966972 - RNA, 22 nt, Staphylococcus aureus subsp. aureus Mu50
acaguuucuuggucugcuguau

SEQ ID NO: 3966973 - RNA, 16 nt, Staphylococcus aureus subsp. aureus Mu50
acauaaaaauaauccc

SEQ ID NO: 3966974 - RNA, 18 nt, Staphylococcus aureus subsp. aureus Mu50
acauaaaaaugcucaagu

SEQ ID NO: 3966975 - RNA, 14 nt, Staphylococcus aureus subsp. aureus Mu50
acauaaaacuuaca

SEQ ID NO: 3966976 - RNA, 12 nt, Staphylococcus aureus subsp. aureus Mu50
acauaaaauuua

SEQ ID NO: 3966977 - RNA, 14 nt, Staphylococcus aureus subsp. aureus Mu50
acauaaaauuuaaa

SEQ ID NO: 3966978 - RNA, 14 nt, Staphylococcus aureus subsp. aureus Mu50
acauaaauaaacuu

SEQ ID NO: 3966979 - RNA, 16 nt, Staphylococcus aureus subsp. aureus Mu50
acauaaauacaaaaau

SEQ ID NO: 3966980 - RNA, 17 nt, Staphylococcus aureus subsp. aureus Mu50
acauaaauacaaaaaua

SEQ ID NO: 3966981 - RNA, 21 nt, Staphylococcus aureus subsp. aureus Mu50
acauaaauauggauuuugaag

SEQ ID NO: 3966982 - RNA, 18 nt, Staphylococcus aureus subsp. aureus Mu50
acauaaaugcuaaaagua

SEQ ID NO: 3966983 - RNA, 18 nt, Staphylococcus aureus subsp. aureus Mu50
acauaaauuaagcaugac

SEQ ID NO: 3966984 - RNA, 15 nt, Staphylococcus aureus subsp. aureus Mu50
acauaacacaaguua

SEQ ID NO: 3966985 - RNA, 17 nt, Staphylococcus aureus subsp. aureus Mu50
acauaacagcuaaaaau

SEQ ID NO: 3966986 - RNA, 17 nt, Staphylococcus aureus subsp. aureus Mu50
acauaaccgaugugauu

SEQ ID NO: 3966987 - RNA, 18 nt, Staphylococcus aureus subsp. aureus Mu50
acauaaccgaugugauuu

SEQ ID NO: 3966988 - RNA, 22 nt, Staphylococcus aureus subsp. aureus Mu50
acauaaccuaauucgccaucuu

SEQ ID NO: 3966989 - RNA, 15 nt, Staphylococcus aureus subsp. aureus Mu50
acauaaccuugcuuu

SEQ ID NO: 3966990 - RNA, 21 nt, Staphylococcus aureus subsp. aureus Mu50
acauaaggucuuggacuaaua

SEQ ID NO: 3966991 - RNA, 22 nt, Staphylococcus aureus subsp. aureus Mu50
acauaauuaacuuucuuuuguu

SEQ ID NO: 3966992 - RNA, 18 nt, Staphylococcus aureus subsp. aureus Mu50
acauaauuuaucaauuuc

SEQ ID NO: 3966993 - RNA, 16 nt, Staphylococcus aureus subsp. aureus Mu50
acauaauuuuuauuua

SEQ ID NO: 3966994 - RNA, 22 nt, Staphylococcus aureus subsp. aureus Mu50
acauaauuuuuauuuacacaca

SEQ ID NO: 3966995 - RNA, 16 nt, Staphylococcus aureus subsp. aureus Mu50
acauacaccuucagau

SEQ ID NO: 3966996 - RNA, 15 nt, Staphylococcus aureus subsp. aureus Mu50
acauacagucaauac

SEQ ID NO: 3966997 - RNA, 14 nt, Staphylococcus aureus subsp. aureus Mu50
acauacauuuugaa

SEQ ID NO: 3966998 - RNA, 19 nt, Staphylococcus aureus subsp. aureus Mu50
acauaccaguggaaauuau

SEQ ID NO: 3966999 - RNA, 22 nt, Staphylococcus aureus subsp. aureus Mu50
acauaccaguggaaauuaugua

SEQ ID NO: 3967000 - RNA, 14 nt, Staphylococcus aureus subsp. aureus Mu50
acauacuauaaaaa

SEQ ID NO: 3967001 - RNA, 22 nt, Staphylococcus aureus subsp. aureus Mu50
acauagaauaacgucauauguu

SEQ ID NO: 3967002 - RNA, 16 nt, Staphylococcus aureus subsp. aureus Mu50
acauagaccuuuauuu

SEQ ID NO: 3967003 - RNA, 16 nt, Staphylococcus aureus subsp. aureus Mu50
acauagaguaauuuua

SEQ ID NO: 3967004 - RNA, 17 nt, Staphylococcus aureus subsp. aureus Mu50
acauagaguaauuuuac

SEQ ID NO: 3967005 - RNA, 22 nt, Staphylococcus aureus subsp. aureus Mu50
acauagguauaaucauuuaaac

SEQ ID NO: 3967006 - RNA, 22 nt, Staphylococcus aureus subsp. aureus Mu50
acauaguuucuucuauuauauu

SEQ ID NO: 3967007 - RNA, 16 nt, Staphylococcus aureus subsp. aureus Mu50
acauauaaaaaauuau

SEQ ID NO: 3967008 - RNA, 16 nt, Staphylococcus aureus subsp. aureus Mu50
acauauaaaucauuuc

SEQ ID NO: 3967009 - RNA, 13 nt, Staphylococcus aureus subsp. aureus Mu50
acauauaagaauu

SEQ ID NO: 3967010 - RNA, 18 nt, Staphylococcus aureus subsp. aureus Mu50
acauaucagcuuuuucau

SEQ ID NO: 3967011 - RNA, 19 nt, Staphylococcus aureus subsp. aureus Mu50
acauauguacuauuaucua

SEQ ID NO: 3967012 - RNA, 23 nt, Staphylococcus aureus subsp. aureus Mu50
acauaugucuuucuaaguuugaa

SEQ ID NO: 3967013 - RNA, 20 nt, Staphylococcus aureus subsp. aureus Mu50
acauauguguaugauagaau

SEQ ID NO: 3967014 - RNA, 15 nt, Staphylococcus aureus subsp. aureus Mu50
acauauuauaaaagu

SEQ ID NO: 3967015 - RNA, 14 nt, Staphylococcus aureus subsp. aureus Mu50
acauauuauauaua

SEQ ID NO: 3967016 - RNA, 18 nt, Staphylococcus aureus subsp. aureus Mu50
acauauuaugauacgcuu

SEQ ID NO: 3967017 - RNA, 18 nt, Staphylococcus aureus subsp. aureus Mu50
acauauucaguauaugua

SEQ ID NO: 3967018 - RNA, 19 nt, Staphylococcus aureus subsp. aureus Mu50
acauauucauaauaucgau

SEQ ID NO: 3967019 - RNA, 13 nt, Staphylococcus aureus subsp. aureus Mu50
acauauugcauuu

SEQ ID NO: 3967020 - RNA, 13 nt, Staphylococcus aureus subsp. aureus Mu50
acauauuggcuug

SEQ ID NO: 3967021 - RNA, 21 nt, Staphylococcus aureus subsp. aureus Mu50
acauauuggcuugcuucauua

SEQ ID NO: 3967022 - RNA, 15 nt, Staphylococcus aureus subsp. aureus Mu50
acauauuuauacuga

SEQ ID NO: 3967023 - RNA, 15 nt, Staphylococcus aureus subsp. aureus Mu50
acauauuuuaacuau

SEQ ID NO: 3967024 - RNA, 19 nt, Staphylococcus aureus subsp. aureus Mu50
acaucaaauagacaccaaa

SEQ ID NO: 3967025 - RNA, 22 nt, Staphylococcus aureus subsp. aureus Mu50
acaucaaauagacaccaaaaaa

SEQ ID NO: 3967026 - RNA, 17 nt, Staphylococcus aureus subsp. aureus Mu50
acaucaauaucuucuuc

SEQ ID NO: 3967027 - RNA, 20 nt, Staphylococcus aureus subsp. aureus Mu50
acaucacuauacgcaaucau

SEQ ID NO: 3967028 - RNA, 14 nt, Staphylococcus aureus subsp. aureus Mu50
acaucacuugcugu

SEQ ID NO: 3967029 - RNA, 22 nt, Staphylococcus aureus subsp. aureus Mu50
acaucacuugcuguugcaauaa

SEQ ID NO: 3967030 - RNA, 15 nt, Staphylococcus aureus subsp. aureus Mu50
acaucagauauaagu

SEQ ID NO: 3967031 - RNA, 23 nt, Staphylococcus aureus subsp. aureus Mu50
acaucaguaaaaacgaaauuguu

SEQ ID NO: 3967032 - RNA, 11 nt, Staphylococcus aureus subsp. aureus Mu50
acaucauaaau

SEQ ID NO: 3967033 - RNA, 22 nt, Staphylococcus aureus subsp. aureus Mu50
acaucauaauaaaucuaucuac

SEQ ID NO: 3967034 - RNA, 17 nt, Staphylococcus aureus subsp. aureus Mu50
acaucaucgccagcauu

SEQ ID NO: 3967035 - RNA, 17 nt, Staphylococcus aureus subsp. aureus Mu50
acaucaucuuuaauuuu

SEQ ID NO: 3967036 - RNA, 13 nt, Staphylococcus aureus subsp. aureus Mu50
acaucauuaaaua

SEQ ID NO: 3967037 - RNA, 17 nt, Staphylococcus aureus subsp. aureus Mu50
acaucauuaaauauuua

SEQ ID NO: 3967038 - RNA, 15 nt, Staphylococcus aureus subsp. aureus Mu50
acaucauucacaagu

SEQ ID NO: 3967039 - RNA, 16 nt, Staphylococcus aureus subsp. aureus Mu50
acaucauugauagaua

SEQ ID NO: 3967040 - RNA, 14 nt, Staphylococcus aureus subsp. aureus Mu50
acaucauuguuuua

SEQ ID NO: 3967041 - RNA, 18 nt, Staphylococcus aureus subsp. aureus Mu50
acauuggauuacuuccau

SEQ ID NO: 3967042 - RNA, 13 nt, Staphylococcus aureus subsp. aureus Mu50
acauuguaaauau

SEQ ID NO: 3967043 - RNA, 21 nt, Staphylococcus aureus subsp. aureus Mu50
acauuguaaauauaguaauaa

SEQ ID NO: 3967044 - RNA, 15 nt, Staphylococcus aureus subsp. aureus Mu50
acauuguuuagucuu

SEQ ID NO: 3967045 - RNA, 18 nt, Staphylococcus aureus subsp. aureus Mu50
acauuuaaaaaaugcgcu

SEQ ID NO: 3967046 - RNA, 12 nt, Staphylococcus aureus subsp. aureus Mu50
acauuuaaauau

SEQ ID NO: 3967047 - RNA, 13 nt, Staphylococcus aureus subsp. aureus Mu50
acauuuaaauaua

SEQ ID NO: 3967048 - RNA, 15 nt, Staphylococcus aureus subsp. aureus Mu50
acauuuaauacuuuu

SEQ ID NO: 3967049 - RNA, 18 nt, Staphylococcus aureus subsp. aureus Mu50
acauuuacuuaagaacua

SEQ ID NO: 3967050 - RNA, 12 nt, Staphylococcus aureus subsp. aureus Mu50
acauuucccauu

SEQ ID NO: 3967051 - RNA, 23 nt, Staphylococcus aureus subsp. aureus Mu50
acauuucccauuuaucuaacaau

SEQ ID NO: 3967052 - RNA, 20 nt, Staphylococcus aureus subsp. aureus Mu50
acauuugaccaaguaugaga

SEQ ID NO: 3967053 - RNA, 14 nt, Staphylococcus aureus subsp. aureus Mu50
acauuugauaacca

SEQ ID NO: 3967054 - RNA, 20 nt, Staphylococcus aureus subsp. aureus Mu50
acauuugguggagaaccuuu

SEQ ID NO: 3967055 - RNA, 20 nt, Staphylococcus aureus subsp. aureus Mu50
acauuuguaaauauuuuuua

SEQ ID NO: 3967056 - RNA, 22 nt, Staphylococcus aureus subsp. aureus Mu50
acauuuguaaauauuuuuuaaa

SEQ ID NO: 3967057 - RNA, 22 nt, Staphylococcus aureus subsp. aureus Mu50
acauuuuaaaucuaauuauuca

SEQ ID NO: 3967058 - RNA, 15 nt, Staphylococcus aureus subsp. aureus Mu50
acauuuuaauaaaau

SEQ ID NO: 3967059 - RNA, 14 nt, Staphylococcus aureus subsp. aureus Mu50
acauuuuaugucca

SEQ ID NO: 3967060 - RNA, 18 nt, Staphylococcus aureus subsp. aureus Mu50
acauuuucaaguuuaaaa

SEQ ID NO: 3967061 - RNA, 22 nt, Staphylococcus aureus subsp. aureus Mu50
acauuuugcucuaaacuucuau

SEQ ID NO: 3967062 - RNA, 21 nt, Staphylococcus aureus subsp. aureus Mu50
acauuuuuauacaacuucacu

SEQ ID NO: 3967063 - RNA, 23 nt, Staphylococcus aureus subsp. aureus Mu50
acauuuuuauacaacuucacuuc

SEQ ID NO: 3967064 - RNA, 18 nt, Staphylococcus aureus subsp. aureus Mu50
acauuuuugugcaaaagu

SEQ ID NO: 3967065 - RNA, 18 nt, Staphylococcus aureus subsp. aureus Mu50
accaaaaaacagaggucu

SEQ ID NO: 3967066 - RNA, 15 nt, Staphylococcus aureus subsp. aureus Mu50
accaaaaaauccaag

SEQ ID NO: 3967067 - RNA, 15 nt, Staphylococcus aureus subsp. aureus Mu50
accaaaaaucaucca

SEQ ID NO: 3967068 - RNA, 16 nt, Staphylococcus aureus subsp. aureus Mu50
accaaacaauacauaa

SEQ ID NO: 3967069 - RNA, 17 nt, Staphylococcus aureus subsp. aureus Mu50
accaaaccauaaguaaa

SEQ ID NO: 3967070 - RNA, 22 nt, Staphylococcus aureus subsp. aureus Mu50
accaaauaaauaagugauaaau

SEQ ID NO: 3967071 - RNA, 19 nt, Staphylococcus aureus subsp. aureus Mu50
accaaaucggaauaaaaua

SEQ ID NO: 3967072 - RNA, 14 nt, Staphylococcus aureus subsp. aureus Mu50
accaaauuuuauac

SEQ ID NO: 3967073 - RNA, 15 nt, Staphylococcus aureus subsp. aureus Mu50
accaacaacuuuguu

SEQ ID NO: 3967074 - RNA, 21 nt, Staphylococcus aureus subsp. aureus Mu50
accaacaauagguacaacuaa

SEQ ID NO: 3967075 - RNA, 18 nt, Staphylococcus aureus subsp. aureus Mu50
accaacaccuaauauuuu

SEQ ID NO: 3967076 - RNA, 16 nt, Staphylococcus aureus subsp. aureus Mu50
accaacauauuuuaac

SEQ ID NO: 3967077 - RNA, 21 nt, Staphylococcus aureus subsp. aureus Mu50
accaacugucgguucaucuaa

SEQ ID NO: 3967078 - RNA, 12 nt, Staphylococcus aureus subsp. aureus Mu50
accaacuuuuuu

SEQ ID NO: 3967079 - RNA, 22 nt, Staphylococcus aureus subsp. aureus Mu50
accaagaccagguccugggaau

SEQ ID NO: 3967080 - RNA, 22 nt, Staphylococcus aureus subsp. aureus Mu50
accaagcccaugcccgauaaaa

SEQ ID NO: 3967081 - RNA, 15 nt, Staphylococcus aureus subsp. aureus Mu50
accaaggguuucugg

SEQ ID NO: 3967082 - RNA, 13 nt, Staphylococcus aureus subsp. aureus Mu50
accaaguaaugau

SEQ ID NO: 3967083 - RNA, 24 nt, Staphylococcus aureus subsp. aureus Mu50
accaaguaugagacgcauugcaag

SEQ ID NO: 3967084 - RNA, 14 nt, Staphylococcus aureus subsp. aureus Mu50
accaaguucacuaa

SEQ ID NO: 3967085 - RNA, 14 nt, Staphylococcus aureus subsp. aureus Mu50
accaauaauccgag

SEQ ID NO: 3967086 - RNA, 11 nt, Staphylococcus aureus subsp. aureus Mu50
accaauaauua

SEQ ID NO: 3967087 - RNA, 11 nt, Staphylococcus aureus subsp. aureus Mu50
accaaucgaag

SEQ ID NO: 3967088 - RNA, 24 nt, Staphylococcus aureus subsp. aureus Mu50
accaauuaauuguaaagcaugaau

SEQ ID NO: 3967089 - RNA, 16 nt, Staphylococcus aureus subsp. aureus Mu50
accaauugaaauuaac

SEQ ID NO: 3967090 - RNA, 16 nt, Staphylococcus aureus subsp. aureus Mu50
accaauuguuucagcu

SEQ ID NO: 3967091 - RNA, 12 nt, Staphylococcus aureus subsp. aureus Mu50
accaauuuuuag

SEQ ID NO: 3967092 - RNA, 13 nt, Staphylococcus aureus subsp. aureus Mu50
accacacagcauu

SEQ ID NO: 3967093 - RNA, 23 nt, Staphylococcus aureus subsp. aureus Mu50
accacacuuuaaacaagcaucau

SEQ ID NO: 3967094 - RNA, 14 nt, Staphylococcus aureus subsp. aureus Mu50
accacauaaaaaua

SEQ ID NO: 3967095 - RNA, 16 nt, Staphylococcus aureus subsp. aureus Mu50
accacauaaaaauaau

SEQ ID NO: 3967096 - RNA, 14 nt, Staphylococcus aureus subsp. aureus Mu50
accacauccccuuu

SEQ ID NO: 3967097 - RNA, 23 nt, Staphylococcus aureus subsp. aureus Mu50
accaccaccugugacaaaugccu

SEQ ID NO: 3967098 - RNA, 21 nt, Staphylococcus aureus subsp. aureus Mu50
accaccuacgcccaucaucac

SEQ ID NO: 3967099 - RNA, 20 nt, Staphylococcus aureus subsp. aureus Mu50
accaccugugacaaaugccu

SEQ ID NO: 3967100 - RNA, 23 nt, Staphylococcus aureus subsp. aureus Mu50
accacgacucauuagauaaaaua

SEQ ID NO: 3967101 - RNA, 19 nt, Staphylococcus aureus subsp. aureus Mu50
accacgauaucuagcugcu

SEQ ID NO: 3967102 - RNA, 19 nt, Staphylococcus aureus subsp. aureus Mu50
accacuauaauuucuuaau

SEQ ID NO: 3967103 - RNA, 19 nt, Staphylococcus aureus subsp. aureus Mu50
accacuggccuuuaaugau

SEQ ID NO: 3967104 - RNA, 16 nt, Staphylococcus aureus subsp. aureus Mu50
accacuguauuuacua

SEQ ID NO: 3967105 - RNA, 17 nt, Staphylococcus aureus subsp. aureus Mu50
accacuucuucaccugc

SEQ ID NO: 3967106 - RNA, 21 nt, Staphylococcus aureus subsp. aureus Mu50
accacuugaauacuuuuuaac

SEQ ID NO: 3967107 - RNA, 23 nt, Staphylococcus aureus subsp. aureus Mu50
accacuugaauacuuuuuaacug

SEQ ID NO: 3967108 - RNA, 15 nt, Staphylococcus aureus subsp. aureus Mu50
accacuuuuguuaaa

SEQ ID NO: 3967109 - RNA, 18 nt, Staphylococcus aureus subsp. aureus Mu50
accacuuuuguuaaaaaa

SEQ ID NO: 3967110 - RNA, 21 nt, Staphylococcus aureus subsp. aureus Mu50
accacuuuuguuaaaaaaugg

SEQ ID NO: 3967111 - RNA, 15 nt, Staphylococcus aureus subsp. aureus Mu50
accagcuaaaccauc

SEQ ID NO: 3967112 - RNA, 18 nt, Staphylococcus aureus subsp. aureus Mu50
accagcuaaccaaauaau

SEQ ID NO: 3967113 - RNA, 22 nt, Staphylococcus aureus subsp. aureus Mu50
accagcucguuuuuucauugua

SEQ ID NO: 3967114 - RNA, 17 nt, Staphylococcus aureus subsp. aureus Mu50
accaguauaaccaugua

SEQ ID NO: 3967115 - RNA, 14 nt, Staphylococcus aureus subsp. aureus Mu50
accaguauaauuuu

SEQ ID NO: 3967116 - RNA, 14 nt, Staphylococcus aureus subsp. aureus Mu50
accagucguaauga

SEQ ID NO: 3967117 - RNA, 18 nt, Staphylococcus aureus subsp. aureus Mu50
accaguggaaauuaugua

SEQ ID NO: 3967118 - RNA, 16 nt, Staphylococcus aureus subsp. aureus Mu50
accaguucgaaaauua

SEQ ID NO: 3967119 - RNA, 22 nt, Staphylococcus aureus subsp. aureus Mu50
accaguuugugguaaugauuuu

SEQ ID NO: 3967120 - RNA, 14 nt, Staphylococcus aureus subsp. aureus Mu50
accauaaauguaac

SEQ ID NO: 3967121 - RNA, 17 nt, Staphylococcus aureus subsp. aureus Mu50
accauaacaauuuuguu

SEQ ID NO: 3967122 - RNA, 20 nt, Staphylococcus aureus subsp. aureus Mu50
accauacuaaaacaugauac

SEQ ID NO: 3967123 - RNA, 14 nt, Staphylococcus aureus subsp. aureus Mu50
accauacucuaacu

SEQ ID NO: 3967124 - RNA, 15 nt, Staphylococcus aureus subsp. aureus Mu50
accauacucuaacuu

SEQ ID NO: 3967125 - RNA, 17 nt, Staphylococcus aureus subsp. aureus Mu50
accauagauuauauuau

SEQ ID NO: 3967126 - RNA, 16 nt, Staphylococcus aureus subsp. aureus Mu50
accauaguaauaaaau

SEQ ID NO: 3967127 - RNA, 16 nt, Staphylococcus aureus subsp. aureus Mu50
accauauuuuuagaaa

SEQ ID NO: 3967128 - RNA, 15 nt, Staphylococcus aureus subsp. aureus Mu50
accucauuugacaua

SEQ ID NO: 3967129 - RNA, 19 nt, Staphylococcus aureus subsp. aureus Mu50
accucuaaauaaaauuaaa

SEQ ID NO: 3967130 - RNA, 20 nt, Staphylococcus aureus subsp. aureus Mu50
accucuaggauuaaaagcau

SEQ ID NO: 3967131 - RNA, 21 nt, Staphylococcus aureus subsp. aureus Mu50
accucugauguguuauguuag

SEQ ID NO: 3967132 - RNA, 15 nt, Staphylococcus aureus subsp. aureus Mu50
accucuugauaaaau

SEQ ID NO: 3967133 - RNA, 16 nt, Staphylococcus aureus subsp. aureus Mu50
accucuugauaaaaua

SEQ ID NO: 3967134 - RNA, 14 nt, Staphylococcus aureus subsp. aureus Mu50
accugauaauacaa

SEQ ID NO: 3967135 - RNA, 19 nt, Staphylococcus aureus subsp. aureus Mu50
accugaugaauagauaauc

SEQ ID NO: 3967136 - RNA, 14 nt, Staphylococcus aureus subsp. aureus Mu50
accugcuucuguaa

SEQ ID NO: 3967137 - RNA, 17 nt, Staphylococcus aureus subsp. aureus Mu50
accugucuuaauucauu

SEQ ID NO: 3967138 - RNA, 17 nt, Staphylococcus aureus subsp. aureus Mu50
accugugacaaaugccu

SEQ ID NO: 3967139 - RNA, 14 nt, Staphylococcus aureus subsp. aureus Mu50
accugugauaaaaa

SEQ ID NO: 3967140 - RNA, 12 nt, Staphylococcus aureus subsp. aureus Mu50
accugugauaac

SEQ ID NO: 3967141 - RNA, 19 nt, Staphylococcus aureus subsp. aureus Mu50
accuguuauugcaauaaaa

SEQ ID NO: 3967142 - RNA, 20 nt, Staphylococcus aureus subsp. aureus Mu50
accuguucuuuauuuaaagg

SEQ ID NO: 3967143 - RNA, 23 nt, Staphylococcus aureus subsp. aureus Mu50
accuguuucuuuacuucuuucaa

SEQ ID NO: 3967144 - RNA, 22 nt, Staphylococcus aureus subsp. aureus Mu50
accuuaaauauaguugccaugu

SEQ ID NO: 3967145 - RNA, 13 nt, Staphylococcus aureus subsp. aureus Mu50
accuuaauaauga

SEQ ID NO: 3967146 - RNA, 18 nt, Staphylococcus aureus subsp. aureus Mu50
accuuaauaaugaauucu

SEQ ID NO: 3967147 - RNA, 18 nt, Staphylococcus aureus subsp. aureus Mu50
accuuacccaaaaaauug

SEQ ID NO: 3967148 - RNA, 20 nt, Staphylococcus aureus subsp. aureus Mu50
accuuacccaaaaaauugua

SEQ ID NO: 3967149 - RNA, 21 nt, Staphylococcus aureus subsp. aureus Mu50
accuuacuacgcauuauuaag

SEQ ID NO: 3967150 - RNA, 15 nt, Staphylococcus aureus subsp. aureus Mu50
accuucaguuucuac

SEQ ID NO: 3967151 - RNA, 19 nt, Staphylococcus aureus subsp. aureus Mu50
accuucaguuucuacugua

SEQ ID NO: 3967152 - RNA, 14 nt, Staphylococcus aureus subsp. aureus Mu50
accuucauuuucaa

SEQ ID NO: 3967153 - RNA, 17 nt, Staphylococcus aureus subsp. aureus Mu50
accuucgagugcuuuua

SEQ ID NO: 3967154 - RNA, 17 nt, Staphylococcus aureus subsp. aureus Mu50
accuucgcauacuuuuu

SEQ ID NO: 3967155 - RNA, 18 nt, Staphylococcus aureus subsp. aureus Mu50
accuucuucuacccauaa

SEQ ID NO: 3967156 - RNA, 16 nt, Staphylococcus aureus subsp. aureus Mu50
accuugaaugauauua

SEQ ID NO: 3967157 - RNA, 15 nt, Staphylococcus aureus subsp. aureus Mu50
accuuguuaaaauaa

SEQ ID NO: 3967158 - RNA, 20 nt, Staphylococcus aureus subsp. aureus Mu50
accuuguucuuuacuccaaa

SEQ ID NO: 3967159 - RNA, 14 nt, Staphylococcus aureus subsp. aureus Mu50
accuuuaaaacauc

SEQ ID NO: 3967160 - RNA, 16 nt, Staphylococcus aureus subsp. aureus Mu50
accuuuaaaacaucau

SEQ ID NO: 3967161 - RNA, 19 nt, Staphylococcus aureus subsp. aureus Mu50
accuuuaaaacaucauuca

SEQ ID NO: 3967162 - RNA, 17 nt, Staphylococcus aureus subsp. aureus Mu50
accuuuaauaauauuga

SEQ ID NO: 3967163 - RNA, 13 nt, Staphylococcus aureus subsp. aureus Mu50
accuuuaauaucu

SEQ ID NO: 3967164 - RNA, 13 nt, Staphylococcus aureus subsp. aureus Mu50
accuuuaauuaca

SEQ ID NO: 3967165 - RNA, 14 nt, Staphylococcus aureus subsp. aureus Mu50
accuuuacuuucau

SEQ ID NO: 3967166 - RNA, 17 nt, Staphylococcus aureus subsp. aureus Mu50
accuuuagacaauauuu

SEQ ID NO: 3967167 - RNA, 23 nt, Staphylococcus aureus subsp. aureus Mu50
accuuuagacaauauuuuuacau

SEQ ID NO: 3967168 - RNA, 23 nt, Staphylococcus aureus subsp. aureus Mu50
accuuuaugugcaucauuuauau

SEQ ID NO: 3967169 - RNA, 14 nt, Staphylococcus aureus subsp. aureus Mu50
accuuuauuauuua

SEQ ID NO: 3967170 - RNA, 16 nt, Staphylococcus aureus subsp. aureus Mu50
accuuuauuauuuaau

SEQ ID NO: 3967171 - RNA, 12 nt, Staphylococcus aureus subsp. aureus Mu50
accuuucaaaua

SEQ ID NO: 3967172 - RNA, 16 nt, Staphylococcus aureus subsp. aureus Mu50
accuuucaaauauauc

SEQ ID NO: 3967173 - RNA, 14 nt, Staphylococcus aureus subsp. aureus Mu50
accuuucgauaaac

SEQ ID NO: 3967174 - RNA, 22 nt, Staphylococcus aureus subsp. aureus Mu50
accuuucgcagcuucuuuaaca

SEQ ID NO: 3967175 - RNA, 12 nt, Staphylococcus aureus subsp. aureus Mu50
accuuugucuuu

SEQ ID NO: 3967176 - RNA, 21 nt, Staphylococcus aureus subsp. aureus Mu50
accuuuuaauaguacuuaauu

SEQ ID NO: 3967177 - RNA, 19 nt, Staphylococcus aureus subsp. aureus Mu50
accuuuuauccccucaauu

SEQ ID NO: 3967178 - RNA, 12 nt, Staphylococcus aureus subsp. aureus Mu50
accuuuuuuaac

SEQ ID NO: 3967179 - RNA, 14 nt, Staphylococcus aureus subsp. aureus Mu50
acgaaauaguucaa

SEQ ID NO: 3967180 - RNA, 13 nt, Staphylococcus aureus subsp. aureus Mu50
acgaaaugcaaug

SEQ ID NO: 3967181 - RNA, 20 nt, Staphylococcus aureus subsp. aureus Mu50
acgaaauggugaacuaaauu

SEQ ID NO: 3967182 - RNA, 23 nt, Staphylococcus aureus subsp. aureus Mu50
acgaacaagucuugcaauaccuc

SEQ ID NO: 3967183 - RNA, 22 nt, Staphylococcus aureus subsp. aureus Mu50
acgaagcgaguuauauuguuaa

SEQ ID NO: 3967184 - RNA, 22 nt, Staphylococcus aureus subsp. aureus Mu50
acgaagcgggccucaucgaguu

SEQ ID NO: 3967185 - RNA, 17 nt, Staphylococcus aureus subsp. aureus Mu50
acgaaguuauauuggca

SEQ ID NO: 3967186 - RNA, 14 nt, Staphylococcus aureus subsp. aureus Mu50
acgaaguuuaaaug

SEQ ID NO: 3967187 - RNA, 21 nt, Staphylococcus aureus subsp. aureus Mu50
acgaauaucuuaaagaauuaa

SEQ ID NO: 3967188 - RNA, 12 nt, Staphylococcus aureus subsp. aureus Mu50
acgaaucuuaau

SEQ ID NO: 3967189 - RNA, 23 nt, Staphylococcus aureus subsp. aureus Mu50
acgaauguuccuuguuuuaaacu

SEQ ID NO: 3967190 - RNA, 17 nt, Staphylococcus aureus subsp. aureus Mu50
acgaauuaaaauaacuc

SEQ ID NO: 3967191 - RNA, 22 nt, Staphylococcus aureus subsp. aureus Mu50
acgacaacuugaacuaaaacga

SEQ ID NO: 3967192 - RNA, 22 nt, Staphylococcus aureus subsp. aureus Mu50
acgacaaucacagcaauaauaa

SEQ ID NO: 3967193 - RNA, 12 nt, Staphylococcus aureus subsp. aureus Mu50
acgacaauucca

SEQ ID NO: 3967194 - RNA, 14 nt, Staphylococcus aureus subsp. aureus Mu50
acgacacuuuuuag

SEQ ID NO: 3967195 - RNA, 14 nt, Staphylococcus aureus subsp. aureus Mu50
acgacauuguuuag

SEQ ID NO: 3967196 - RNA, 22 nt, Staphylococcus aureus subsp. aureus Mu50
acgacauuuuuagacauuaaaa

SEQ ID NO: 3967197 - RNA, 15 nt, Staphylococcus aureus subsp. aureus Mu50
acgacgcuaaacaaa

SEQ ID NO: 3967198 - RNA, 15 nt, Staphylococcus aureus subsp. aureus Mu50
acgacgguauaaaaa

SEQ ID NO: 3967199 - RNA, 19 nt, Staphylococcus aureus subsp. aureus Mu50
acgacucuccaaauauugu

SEQ ID NO: 3967200 - RNA, 13 nt, Staphylococcus aureus subsp. aureus Mu50
acgacuugaaauc

SEQ ID NO: 3967201 - RNA, 16 nt, Staphylococcus aureus subsp. aureus Mu50
acgagaauuucguuau

SEQ ID NO: 3967202 - RNA, 16 nt, Staphylococcus aureus subsp. aureus Mu50
acgagcuggugagaaa

SEQ ID NO: 3967203 - RNA, 20 nt, Staphylococcus aureus subsp. aureus Mu50
acgaggucuuuuuacugacu

SEQ ID NO: 3967204 - RNA, 14 nt, Staphylococcus aureus subsp. aureus Mu50
acgaguauuaucac

SEQ ID NO: 3967205 - RNA, 20 nt, Staphylococcus aureus subsp. aureus Mu50
acgaguguuuuaaucuuauu

SEQ ID NO: 3967206 - RNA, 19 nt, Staphylococcus aureus subsp. aureus Mu50
acgauaacaauuuauuaaa

SEQ ID NO: 3967207 - RNA, 16 nt, Staphylococcus aureus subsp. aureus Mu50
acgauaacuacacuua

SEQ ID NO: 3967208 - RNA, 16 nt, Staphylococcus aureus subsp. aureus Mu50
acgauaagaauuaaca

SEQ ID NO: 3967209 - RNA, 18 nt, Staphylococcus aureus subsp. aureus Mu50
acgauaagaauuaacaac

SEQ ID NO: 3967210 - RNA, 23 nt, Staphylococcus aureus subsp. aureus Mu50
acgauacaucguguugcucgccu

SEQ ID NO: 3967211 - RNA, 18 nt, Staphylococcus aureus subsp. aureus Mu50
acgauaccggcaacuggu

SEQ ID NO: 3967212 - RNA, 14 nt, Staphylococcus aureus subsp. aureus Mu50
acgauagauuuauc

SEQ ID NO: 3967213 - RNA, 16 nt, Staphylococcus aureus subsp. aureus Mu50
acgauagauuuaucac

SEQ ID NO: 3967214 - RNA, 23 nt, Staphylococcus aureus subsp. aureus Mu50
acgauauaacauuaaaaugauau

SEQ ID NO: 3967215 - RNA, 20 nt, Staphylococcus aureus subsp. aureus Mu50
acgaucaacugcuucacgau

SEQ ID NO: 3967216 - RNA, 20 nt, Staphylococcus aureus subsp. aureus Mu50
acgaucaguugagucaauuu

SEQ ID NO: 3967217 - RNA, 17 nt, Staphylococcus aureus subsp. aureus Mu50
acgaucauaaauauuuu

SEQ ID NO: 3967218 - RNA, 20 nt, Staphylococcus aureus subsp. aureus Mu50
acgaugagcgcauaaauuuu

SEQ ID NO: 3967219 - RNA, 13 nt, Staphylococcus aureus subsp. aureus Mu50
acgaugaugauuu

SEQ ID NO: 3967220 - RNA, 18 nt, Staphylococcus aureus subsp. aureus Mu50
acgauuaauaaaauucua

SEQ ID NO: 3967221 - RNA, 22 nt, Staphylococcus aureus subsp. aureus Mu50
acgauuaauaaaauucuauaau

SEQ ID NO: 3967222 - RNA, 22 nt, Staphylococcus aureus subsp. aureus Mu50
acgauuacgcucauaugucugu

SEQ ID NO: 3967223 - RNA, 16 nt, Staphylococcus aureus subsp. aureus Mu50
acgauugaacaucucu

SEQ ID NO: 3967224 - RNA, 18 nt, Staphylococcus aureus subsp. aureus Mu50
acgauuuauuaguuuuua

SEQ ID NO: 3967225 - RNA, 16 nt, Staphylococcus aureus subsp. aureus Mu50
acgauuucuaguuuau

SEQ ID NO: 3967226 - RNA, 19 nt, Staphylococcus aureus subsp. aureus Mu50
acgauuucuaguuuaucuu

SEQ ID NO: 3967227 - RNA, 23 nt, Staphylococcus aureus subsp. aureus Mu50
acgauuuguucaaugauuuuaua

SEQ ID NO: 3967228 - RNA, 20 nt, Staphylococcus aureus subsp. aureus Mu50
acgauuuucaaguaaugaua

SEQ ID NO: 3967229 - RNA, 15 nt, Staphylococcus aureus subsp. aureus Mu50
acgauuuugucuuuu

SEQ ID NO: 3967230 - RNA, 14 nt, Staphylococcus aureus subsp. aureus Mu50
acgauuuuuaaaau

SEQ ID NO: 3967231 - RNA, 16 nt, Staphylococcus aureus subsp. aureus Mu50
acgauuuuuaaaaugc

SEQ ID NO: 3967232 - RNA, 17 nt, Staphylococcus aureus subsp. aureus Mu50
acgcaaaacaauaugaa

SEQ ID NO: 3967233 - RNA, 17 nt, Staphylococcus aureus subsp. aureus Mu50
acgcaauuuaauauuau

SEQ ID NO: 3967234 - RNA, 18 nt, Staphylococcus aureus subsp. aureus Mu50
acgcacuaucaaugacau

SEQ ID NO: 3967235 - RNA, 19 nt, Staphylococcus aureus subsp. aureus Mu50
acgcacuaucaaugacauc

SEQ ID NO: 3967236 - RNA, 14 nt, Staphylococcus aureus subsp. aureus Mu50
acgcaguugaaaaa

SEQ ID NO: 3967237 - RNA, 15 nt, Staphylococcus aureus subsp. aureus Mu50
acgcaguugaaaaag

SEQ ID NO: 3967238 - RNA, 13 nt, Staphylococcus aureus subsp. aureus Mu50
acgcauuaaugau

SEQ ID NO: 3967239 - RNA, 18 nt, Staphylococcus aureus subsp. aureus Mu50
acgcauuauuaagggggu

SEQ ID NO: 3967240 - RNA, 18 nt, Staphylococcus aureus subsp. aureus Mu50
acgcauuuuaaauaaaau

SEQ ID NO: 3967241 - RNA, 18 nt, Staphylococcus aureus subsp. aureus Mu50
acgccaaucacaauauaa

SEQ ID NO: 3967242 - RNA, 20 nt, Staphylococcus aureus subsp. aureus Mu50
acgccaaucacaauauaaca

SEQ ID NO: 3967243 - RNA, 16 nt, Staphylococcus aureus subsp. aureus Mu50
acgccauaagaaaaua

SEQ ID NO: 3967244 - RNA, 13 nt, Staphylococcus aureus subsp. aureus Mu50
acgcuaaaauuuc

SEQ ID NO: 3967245 - RNA, 15 nt, Staphylococcus aureus subsp. aureus Mu50
acgcuaauuuuacuc

SEQ ID NO: 3967246 - RNA, 17 nt, Staphylococcus aureus subsp. aureus Mu50
acgcucaaucgcaucug

SEQ ID NO: 3967247 - RNA, 19 nt, Staphylococcus aureus subsp. aureus Mu50
acgcucaugaguuucucau

SEQ ID NO: 3967248 - RNA, 23 nt, Staphylococcus aureus subsp. aureus Mu50
acgcucaugaguuucucaucuac

SEQ ID NO: 3967249 - RNA, 15 nt, Staphylococcus aureus subsp. aureus Mu50
acgcugaaauuuuuu

SEQ ID NO: 3967250 - RNA, 16 nt, Staphylococcus aureus subsp. aureus Mu50
acgcugauuuaauagc

SEQ ID NO: 3967251 - RNA, 16 nt, Staphylococcus aureus subsp. aureus Mu50
acgcugguaauauuuu

SEQ ID NO: 3967252 - RNA, 16 nt, Staphylococcus aureus subsp. aureus Mu50
acgcuguaccuucuga

SEQ ID NO: 3967253 - RNA, 15 nt, Staphylococcus aureus subsp. aureus Mu50
acgcuguuuuaaauu

SEQ ID NO: 3967254 - RNA, 16 nt, Staphylococcus aureus subsp. aureus Mu50
acgcuuauucgaacga

SEQ ID NO: 3967255 - RNA, 20 nt, Staphylococcus aureus subsp. aureus Mu50
acgcuucauauaaagucgua

SEQ ID NO: 3967256 - RNA, 18 nt, Staphylococcus aureus subsp. aureus Mu50
acgcuuuauucuucccaa

SEQ ID NO: 3967257 - RNA, 23 nt, Staphylococcus aureus subsp. aureus Mu50
acgcuuuuuaaaaaauuuaaaua

SEQ ID NO: 3967258 - RNA, 12 nt, Staphylococcus aureus subsp. aureus Mu50
acggaaaugacu

SEQ ID NO: 3967259 - RNA, 14 nt, Staphylococcus aureus subsp. aureus Mu50
acggaauaacuuuu

SEQ ID NO: 3967260 - RNA, 17 nt, Staphylococcus aureus subsp. aureus Mu50
acggcacauucauaccg

SEQ ID NO: 3967261 - RNA, 13 nt, Staphylococcus aureus subsp. aureus Mu50
acgggaacaucau

SEQ ID NO: 3967262 - RNA, 18 nt, Staphylococcus aureus subsp. aureus Mu50
acgguaacuuuuuacauu

SEQ ID NO: 3967263 - RNA, 12 nt, Staphylococcus aureus subsp. aureus Mu50
acgguacagaua

SEQ ID NO: 3967264 - RNA, 18 nt, Staphylococcus aureus subsp. aureus Mu50
acgguaggaccucuuauu

SEQ ID NO: 3967265 - RNA, 21 nt, Staphylococcus aureus subsp. aureus Mu50
acgguauuuucaaaacugcca

SEQ ID NO: 3967266 - RNA, 16 nt, Staphylococcus aureus subsp. aureus Mu50
acgguuguauuucauc

SEQ ID NO: 3967267 - RNA, 13 nt, Staphylococcus aureus subsp. aureus Mu50
acgguuugaaaaa

SEQ ID NO: 3967268 - RNA, 14 nt, Staphylococcus aureus subsp. aureus Mu50
acguaaaauaugau

SEQ ID NO: 3967269 - RNA, 19 nt, Staphylococcus aureus subsp. aureus Mu50
acguaaguguaaaugaaag

SEQ ID NO: 3967270 - RNA, 14 nt, Staphylococcus aureus subsp. aureus Mu50
acguaaguuugcua

SEQ ID NO: 3967271 - RNA, 16 nt, Staphylococcus aureus subsp. aureus Mu50
acguaaucuaauacau

SEQ ID NO: 3967272 - RNA, 20 nt, Staphylococcus aureus subsp. aureus Mu50
acguauacuuucgaucuucu

SEQ ID NO: 3967273 - RNA, 20 nt, Staphylococcus aureus subsp. aureus Mu50
acguauagaugcuaauguaa

SEQ ID NO: 3967274 - RNA, 18 nt, Staphylococcus aureus subsp. aureus Mu50
acguauauaaguuaaaau

SEQ ID NO: 3967275 - RNA, 19 nt, Staphylococcus aureus subsp. aureus Mu50
acguauauaaguuaaaauu

SEQ ID NO: 3967276 - RNA, 20 nt, Staphylococcus aureus subsp. aureus Mu50
acguauauaaguuaaaauug

SEQ ID NO: 3967277 - RNA, 15 nt, Staphylococcus aureus subsp. aureus Mu50
acguauauacgauug

SEQ ID NO: 3967278 - RNA, 23 nt, Staphylococcus aureus subsp. aureus Mu50
acguauauacgauugaguugaaa

SEQ ID NO: 3967279 - RNA, 15 nt, Staphylococcus aureus subsp. aureus Mu50
acguaucaaaauuuu

SEQ ID NO: 3967280 - RNA, 15 nt, Staphylococcus aureus subsp. aureus Mu50
acgucacuuuauuaa

SEQ ID NO: 3967281 - RNA, 19 nt, Staphylococcus aureus subsp. aureus Mu50
acgucauauguuuuauaau

SEQ ID NO: 3967282 - RNA, 14 nt, Staphylococcus aureus subsp. aureus Mu50
acgucauuuuuaau

SEQ ID NO: 3967283 - RNA, 16 nt, Staphylococcus aureus subsp. aureus Mu50
acguccaaacacaaau

SEQ ID NO: 3967284 - RNA, 22 nt, Staphylococcus aureus subsp. aureus Mu50
acgucgcaacaggaccacucaa

SEQ ID NO: 3967285 - RNA, 10 nt, Staphylococcus aureus subsp. aureus Mu50
acgucuaccu

SEQ ID NO: 3967286 - RNA, 16 nt, Staphylococcus aureus subsp. aureus Mu50
acgucuuguaucaaca

SEQ ID NO: 3967287 - RNA, 22 nt, Staphylococcus aureus subsp. aureus Mu50
acgucuuguaucaacauuaaua

SEQ ID NO: 3967288 - RNA, 13 nt, Staphylococcus aureus subsp. aureus Mu50
acgugaacaacau

SEQ ID NO: 3967289 - RNA, 22 nt, Staphylococcus aureus subsp. aureus Mu50
acgugaggcccauaaauuacuu

SEQ ID NO: 3967290 - RNA, 20 nt, Staphylococcus aureus subsp. aureus Mu50
acgugauaaugacucaagug

SEQ ID NO: 3967291 - RNA, 14 nt, Staphylococcus aureus subsp. aureus Mu50
acgugcaaauaaaa

SEQ ID NO: 3967292 - RNA, 16 nt, Staphylococcus aureus subsp. aureus Mu50
acgugcuuuaaaguug

SEQ ID NO: 3967293 - RNA, 21 nt, Staphylococcus aureus subsp. aureus Mu50
acgugcuuuccaaauugcaaa

SEQ ID NO: 3967294 - RNA, 20 nt, Staphylococcus aureus subsp. aureus Mu50
acgugcuuuuaaauguauuu

SEQ ID NO: 3967295 - RNA, 16 nt, Staphylococcus aureus subsp. aureus Mu50
acguuaguauaaacgu

SEQ ID NO: 3967296 - RNA, 20 nt, Staphylococcus aureus subsp. aureus Mu50
acguuauucguuaacaauca

SEQ ID NO: 3967297 - RNA, 13 nt, Staphylococcus aureus subsp. aureus Mu50
acguuauuuucaa

SEQ ID NO: 3967298 - RNA, 19 nt, Staphylococcus aureus subsp. aureus Mu50
acguuauuuucaauauuug

SEQ ID NO: 3967299 - RNA, 13 nt, Staphylococcus aureus subsp. aureus Mu50
acguuauuuuuug

SEQ ID NO: 3967300 - RNA, 17 nt, Staphylococcus aureus subsp. aureus Mu50
acguucaaucguuucuu

SEQ ID NO: 3967301 - RNA, 21 nt, Staphylococcus aureus subsp. aureus Mu50
acguucgauaacguugccaua

SEQ ID NO: 3967302 - RNA, 22 nt, Staphylococcus aureus subsp. aureus Mu50
acguucuucagguguaguagcu

SEQ ID NO: 3967303 - RNA, 15 nt, Staphylococcus aureus subsp. aureus Mu50
acguugauguaauuc

SEQ ID NO: 3967304 - RNA, 19 nt, Staphylococcus aureus subsp. aureus Mu50
acuagauaguuuauacuuu

SEQ ID NO: 3967305 - RNA, 13 nt, Staphylococcus aureus subsp. aureus Mu50
acuaguaauagaa

SEQ ID NO: 3967306 - RNA, 18 nt, Staphylococcus aureus subsp. aureus Mu50
acuaguacgaaaugcaau

SEQ ID NO: 3967307 - RNA, 17 nt, Staphylococcus aureus subsp. aureus Mu50
acuaguuuguaauaauu

SEQ ID NO: 3967308 - RNA, 15 nt, Staphylococcus aureus subsp. aureus Mu50
acuauaaaaaacagc

SEQ ID NO: 3967309 - RNA, 16 nt, Staphylococcus aureus subsp. aureus Mu50
acuauaaaaaacagca

SEQ ID NO: 3967310 - RNA, 15 nt, Staphylococcus aureus subsp. aureus Mu50
acuauaaaaauuuau

SEQ ID NO: 3967311 - RNA, 13 nt, Staphylococcus aureus subsp. aureus Mu50
acuauaaaauuca

SEQ ID NO: 3967312 - RNA, 17 nt, Staphylococcus aureus subsp. aureus Mu50
acuauaaauacaaauau

SEQ ID NO: 3967313 - RNA, 18 nt, Staphylococcus aureus subsp. aureus Mu50
acuauaaauacaaauaua

SEQ ID NO: 3967314 - RNA, 15 nt, Staphylococcus aureus subsp. aureus Mu50
acuauaacaauaguu

SEQ ID NO: 3967315 - RNA, 14 nt, Staphylococcus aureus subsp. aureus Mu50
acuauaauaauuaa

SEQ ID NO: 3967316 - RNA, 20 nt, Staphylococcus aureus subsp. aureus Mu50
acuauaaugauguauuuuag

SEQ ID NO: 3967317 - RNA, 14 nt, Staphylococcus aureus subsp. aureus Mu50
acuauacaaucaua

SEQ ID NO: 3967318 - RNA, 13 nt, Staphylococcus aureus subsp. aureus Mu50
acuauaccauuuu

SEQ ID NO: 3967319 - RNA, 16 nt, Staphylococcus aureus subsp. aureus Mu50
acuauaccauuuuuau

SEQ ID NO: 3967320 - RNA, 21 nt, Staphylococcus aureus subsp. aureus Mu50
acuauaccuagggaugauaua

SEQ ID NO: 3967321 - RNA, 16 nt, Staphylococcus aureus subsp. aureus Mu50
acuauacugaugaaaa

SEQ ID NO: 3967322 - RNA, 15 nt, Staphylococcus aureus subsp. aureus Mu50
acuauagauaggaua

SEQ ID NO: 3967323 - RNA, 19 nt, Staphylococcus aureus subsp. aureus Mu50
acuauauuucacacagcuu

SEQ ID NO: 3967324 - RNA, 13 nt, Staphylococcus aureus subsp. aureus Mu50
acuaucaauauaa

SEQ ID NO: 3967325 - RNA, 17 nt, Staphylococcus aureus subsp. aureus Mu50
acuaucuacaauaacca

SEQ ID NO: 3967326 - RNA, 14 nt, Staphylococcus aureus subsp. aureus Mu50
acuaucuauaauac

SEQ ID NO: 3967327 - RNA, 13 nt, Staphylococcus aureus subsp. aureus Mu50
acuaucuguuguu

SEQ ID NO: 3967328 - RNA, 18 nt, Staphylococcus aureus subsp. aureus Mu50
acuaucuguuguuauaua

SEQ ID NO: 3967329 - RNA, 15 nt, Staphylococcus aureus subsp. aureus Mu50
acuaucuucaucaua

SEQ ID NO: 3967330 - RNA, 18 nt, Staphylococcus aureus subsp. aureus Mu50
acuaucuucaucauauuc

SEQ ID NO: 3967331 - RNA, 16 nt, Staphylococcus aureus subsp. aureus Mu50
acuaugaauagaugau

SEQ ID NO: 3967332 - RNA, 21 nt, Staphylococcus aureus subsp. aureus Mu50
acuaugcaaaugaaauucuuu

SEQ ID NO: 3967333 - RNA, 17 nt, Staphylococcus aureus subsp. aureus Mu50
acuaugcauaauaccaa

SEQ ID NO: 3967334 - RNA, 20 nt, Staphylococcus aureus subsp. aureus Mu50
acuaugcauaauaccaauug

SEQ ID NO: 3967335 - RNA, 12 nt, Staphylococcus aureus subsp. aureus Mu50
acuaugugaagu

SEQ ID NO: 3967336 - RNA, 19 nt, Staphylococcus aureus subsp. aureus Mu50
acuauguuacuuauauauu

SEQ ID NO: 3967337 - RNA, 15 nt, Staphylococcus aureus subsp. aureus Mu50
acuauuaaaggaaau

SEQ ID NO: 3967338 - RNA, 17 nt, Staphylococcus aureus subsp. aureus Mu50
acuauuaucuauccauu

SEQ ID NO: 3967339 - RNA, 16 nt, Staphylococcus aureus subsp. aureus Mu50
acuauucccacucaau

SEQ ID NO: 3967340 - RNA, 15 nt, Staphylococcus aureus subsp. aureus Mu50
acuauucuuucuugc

SEQ ID NO: 3967341 - RNA, 21 nt, Staphylococcus aureus subsp. aureus Mu50
acuauugauauucuaaaaaau

SEQ ID NO: 3967342 - RNA, 19 nt, Staphylococcus aureus subsp. aureus Mu50
acuauuuaaucuuaauauu

SEQ ID NO: 3967343 - RNA, 19 nt, Staphylococcus aureus subsp. aureus Mu50
acuauuucgcuuuuuuuau

SEQ ID NO: 3967344 - RNA, 21 nt, Staphylococcus aureus subsp. aureus Mu50
acuauuuguuaugguauuuau

SEQ ID NO: 3967345 - RNA, 22 nt, Staphylococcus aureus subsp. aureus Mu50
acuauuuguuaugguauuuaua

SEQ ID NO: 3967346 - RNA, 11 nt, Staphylococcus aureus subsp. aureus Mu50
acuauuuuuga

SEQ ID NO: 3967347 - RNA, 20 nt, Staphylococcus aureus subsp. aureus Mu50
acucaaaaagccaacacauu

SEQ ID NO: 3967348 - RNA, 16 nt, Staphylococcus aureus subsp. aureus Mu50
acucaaaauuaaagcu

SEQ ID NO: 3967349 - RNA, 17 nt, Staphylococcus aureus subsp. aureus Mu50
acucaaaauuaaagcuu

SEQ ID NO: 3967350 - RNA, 14 nt, Staphylococcus aureus subsp. aureus Mu50
acucaaauauaaau

SEQ ID NO: 3967351 - RNA, 21 nt, Staphylococcus aureus subsp. aureus Mu50
acucaacacgauagucauaac

SEQ ID NO: 3967352 - RNA, 16 nt, Staphylococcus aureus subsp. aureus Mu50
acucaaugauuguaau

SEQ ID NO: 3967353 - RNA, 12 nt, Staphylococcus aureus subsp. aureus Mu50
acucaauucucu

SEQ ID NO: 3967354 - RNA, 16 nt, Staphylococcus aureus subsp. aureus Mu50
acucaauucucuaacu

SEQ ID NO: 3967355 - RNA, 15 nt, Staphylococcus aureus subsp. aureus Mu50
acucaauuucauuug

SEQ ID NO: 3967356 - RNA, 18 nt, Staphylococcus aureus subsp. aureus Mu50
acucaauuucauuugaaa

SEQ ID NO: 3967357 - RNA, 18 nt, Staphylococcus aureus subsp. aureus Mu50
acucacagacuuuuuacu

SEQ ID NO: 3967358 - RNA, 20 nt, Staphylococcus aureus subsp. aureus Mu50
acucacauucugcccugcaa

SEQ ID NO: 3967359 - RNA, 22 nt, Staphylococcus aureus subsp. aureus Mu50
acucacauucugcccugcaaug

SEQ ID NO: 3967360 - RNA, 15 nt, Staphylococcus aureus subsp. aureus Mu50
acucaccugcagcau

SEQ ID NO: 3967361 - RNA, 16 nt, Staphylococcus aureus subsp. aureus Mu50
acucaccugcagcauc

SEQ ID NO: 3967362 - RNA, 15 nt, Staphylococcus aureus subsp. aureus Mu50
acucacugcacuuau

SEQ ID NO: 3967363 - RNA, 12 nt, Staphylococcus aureus subsp. aureus Mu50
acucacuucuua

SEQ ID NO: 3967364 - RNA, 18 nt, Staphylococcus aureus subsp. aureus Mu50
acucagaaucuuacauug

SEQ ID NO: 3967365 - RNA, 16 nt, Staphylococcus aureus subsp. aureus Mu50
acucaggcuuaauuaa

SEQ ID NO: 3967366 - RNA, 17 nt, Staphylococcus aureus subsp. aureus Mu50
acucaggcuuaauuaau

SEQ ID NO: 3967367 - RNA, 19 nt, Staphylococcus aureus subsp. aureus Mu50
acucaguuauauuaagguc

SEQ ID NO: 3967368 - RNA, 16 nt, Staphylococcus aureus subsp. aureus Mu50
acucaguuuauugagg

SEQ ID NO: 3967369 - RNA, 14 nt, Staphylococcus aureus subsp. aureus Mu50
acucauaaucaagu

SEQ ID NO: 3967370 - RNA, 15 nt, Staphylococcus aureus subsp. aureus Mu50
acucauaccaaaaac

SEQ ID NO: 3967371 - RNA, 16 nt, Staphylococcus aureus subsp. aureus Mu50
acucauaccaaaaaca

SEQ ID NO: 3967372 - RNA, 19 nt, Staphylococcus aureus subsp. aureus Mu50
acucauaccaaaaacauua

SEQ ID NO: 3967373 - RNA, 21 nt, Staphylococcus aureus subsp. aureus Mu50
acucauaccaaaaacauuaac

SEQ ID NO: 3967374 - RNA, 18 nt, Staphylococcus aureus subsp. aureus Mu50
acucauccauugaucuuu

SEQ ID NO: 3967375 - RNA, 18 nt, Staphylococcus aureus subsp. aureus Mu50
acucauuagauaaaauaa

SEQ ID NO: 3967376 - RNA, 17 nt, Staphylococcus aureus subsp. aureus Mu50
acuccaguuuauaacug

SEQ ID NO: 3967377 - RNA, 18 nt, Staphylococcus aureus subsp. aureus Mu50
acucccgcaaauauuaaa

SEQ ID NO: 3967378 - RNA, 20 nt, Staphylococcus aureus subsp. aureus Mu50
acucccgcauuauuauuaaa

SEQ ID NO: 3967379 - RNA, 22 nt, Staphylococcus aureus subsp. aureus Mu50
acucccgcauuauuauuaaauu

SEQ ID NO: 3967380 - RNA, 15 nt, Staphylococcus aureus subsp. aureus Mu50
acucccuaauaacug

SEQ ID NO: 3967381 - RNA, 15 nt, Staphylococcus aureus subsp. aureus Mu50
acuccuccaaagcua

SEQ ID NO: 3967382 - RNA, 15 nt, Staphylococcus aureus subsp. aureus Mu50
acuccuuacaauaaa

SEQ ID NO: 3967383 - RNA, 23 nt, Staphylococcus aureus subsp. aureus Mu50
acucguuauagauaaguagugga

SEQ ID NO: 3967384 - RNA, 13 nt, Staphylococcus aureus subsp. aureus Mu50
acucguuuuucca

SEQ ID NO: 3967385 - RNA, 15 nt, Staphylococcus aureus subsp. aureus Mu50
acucguuuuuccaug

SEQ ID NO: 3967386 - RNA, 13 nt, Staphylococcus aureus subsp. aureus Mu50
acucuaaaaguug

SEQ ID NO: 3967387 - RNA, 20 nt, Staphylococcus aureus subsp. aureus Mu50
acucuaaaaguuguaauuua

SEQ ID NO: 3967388 - RNA, 21 nt, Staphylococcus aureus subsp. aureus Mu50
acucuaaaaguuguaauuuaa

SEQ ID NO: 3967389 - RNA, 17 nt, Staphylococcus aureus subsp. aureus Mu50
acucuagagguaaaucu

SEQ ID NO: 3967390 - RNA, 18 nt, Staphylococcus aureus subsp. aureus Mu50
acucuagagguaaaucua

SEQ ID NO: 3967391 - RNA, 15 nt, Staphylococcus aureus subsp. aureus Mu50
acucugaaaagccua

SEQ ID NO: 3967392 - RNA, 18 nt, Staphylococcus aureus subsp. aureus Mu50
acuuguaucaucgccaug

SEQ ID NO: 3967393 - RNA, 21 nt, Staphylococcus aureus subsp. aureus Mu50
acuuguccguuuuauauuuau

SEQ ID NO: 3967394 - RNA, 15 nt, Staphylococcus aureus subsp. aureus Mu50
acuugucguauucuu

SEQ ID NO: 3967395 - RNA, 17 nt, Staphylococcus aureus subsp. aureus Mu50
acuugucguauucuuca

SEQ ID NO: 3967396 - RNA, 21 nt, Staphylococcus aureus subsp. aureus Mu50
acuugucuaccgaaugaguuu

SEQ ID NO: 3967397 - RNA, 23 nt, Staphylococcus aureus subsp. aureus Mu50
acuugugacaaucgcuugcuucu

SEQ ID NO: 3967398 - RNA, 20 nt, Staphylococcus aureus subsp. aureus Mu50
acuugugcgcgacguuuaaa

SEQ ID NO: 3967399 - RNA, 19 nt, Staphylococcus aureus subsp. aureus Mu50
acuuguucaacaacugcga

SEQ ID NO: 3967400 - RNA, 22 nt, Staphylococcus aureus subsp. aureus Mu50
acuuguucaauacuucuuguuc

SEQ ID NO: 3967401 - RNA, 13 nt, Staphylococcus aureus subsp. aureus Mu50
acuuguugauaua

SEQ ID NO: 3967402 - RNA, 16 nt, Staphylococcus aureus subsp. aureus Mu50
acuuguuuguuuuugu

SEQ ID NO: 3967403 - RNA, 14 nt, Staphylococcus aureus subsp. aureus Mu50
acuuuaaaauugua

SEQ ID NO: 3967404 - RNA, 16 nt, Staphylococcus aureus subsp. aureus Mu50
acuuuaaaauuguaua

SEQ ID NO: 3967405 - RNA, 20 nt, Staphylococcus aureus subsp. aureus Mu50
acuuuaaaauuguauagaau

SEQ ID NO: 3967406 - RNA, 22 nt, Staphylococcus aureus subsp. aureus Mu50
acuuuaaaauuguauagaaugu

SEQ ID NO: 3967407 - RNA, 22 nt, Staphylococcus aureus subsp. aureus Mu50
acuuuaaaguuaaaguuuuguu

SEQ ID NO: 3967408 - RNA, 11 nt, Staphylococcus aureus subsp. aureus Mu50
acuuuaacuuc

SEQ ID NO: 3967409 - RNA, 16 nt, Staphylococcus aureus subsp. aureus Mu50
acuuuaacuucuuuug

SEQ ID NO: 3967410 - RNA, 22 nt, Staphylococcus aureus subsp. aureus Mu50
acuuuaauaccagcauccauug

SEQ ID NO: 3967411 - RNA, 21 nt, Staphylococcus aureus subsp. aureus Mu50
acuuuaauacuaccguuuuua

SEQ ID NO: 3967412 - RNA, 20 nt, Staphylococcus aureus subsp. aureus Mu50
acuuuaauugcucuuuaaca

SEQ ID NO: 3967413 - RNA, 21 nt, Staphylococcus aureus subsp. aureus Mu50
acuuuaauuuagugaaacaau

SEQ ID NO: 3967414 - RNA, 14 nt, Staphylococcus aureus subsp. aureus Mu50
acuuuaauuuuuca

SEQ ID NO: 3967415 - RNA, 15 nt, Staphylococcus aureus subsp. aureus Mu50
acuuuaauuuuucau

SEQ ID NO: 3967416 - RNA, 16 nt, Staphylococcus aureus subsp. aureus Mu50
acuuuaauuuuucauu

SEQ ID NO: 3967417 - RNA, 17 nt, Staphylococcus aureus subsp. aureus Mu50
acuuuaauuuuucauua

SEQ ID NO: 3967418 - RNA, 20 nt, Staphylococcus aureus subsp. aureus Mu50
acuuuaauuuuucauuaaua

SEQ ID NO: 3967419 - RNA, 11 nt, Staphylococcus aureus subsp. aureus Mu50
acuuuaccauc

SEQ ID NO: 3967420 - RNA, 23 nt, Staphylococcus aureus subsp. aureus Mu50
acuuuagaaagugauucccaaag

SEQ ID NO: 3967421 - RNA, 14 nt, Staphylococcus aureus subsp. aureus Mu50
acuuuaguauuaua

SEQ ID NO: 3967422 - RNA, 15 nt, Staphylococcus aureus subsp. aureus Mu50
acuuuauaauuuuug

SEQ ID NO: 3967423 - RNA, 12 nt, Staphylococcus aureus subsp. aureus Mu50
acuuuauauaua

SEQ ID NO: 3967424 - RNA, 20 nt, Staphylococcus aureus subsp. aureus Mu50
acuuuauauauaaagaaaua

SEQ ID NO: 3967425 - RNA, 14 nt, Staphylococcus aureus subsp. aureus Mu50
acuuuaugaaauuu

SEQ ID NO: 3967426 - RNA, 18 nt, Staphylococcus aureus subsp. aureus Mu50
acuuuaugaaauuucagu

SEQ ID NO: 3967427 - RNA, 22 nt, Staphylococcus aureus subsp. aureus Mu50
acuuuauuucuauaucuauuua

SEQ ID NO: 3967428 - RNA, 16 nt, Staphylococcus aureus subsp. aureus Mu50
acuuucacucauauua

SEQ ID NO: 3967429 - RNA, 15 nt, Staphylococcus aureus subsp. aureus Mu50
acuuucacuuuuuau

SEQ ID NO: 3967430 - RNA, 16 nt, Staphylococcus aureus subsp. aureus Mu50
acuuucacuuuuuaua

SEQ ID NO: 3967431 - RNA, 18 nt, Staphylococcus aureus subsp. aureus Mu50
acuuucaguaauuguuac

SEQ ID NO: 3967432 - RNA, 17 nt, Staphylococcus aureus subsp. aureus Mu50
acuuuccgccuucaauc

SEQ ID NO: 3967433 - RNA, 14 nt, Staphylococcus aureus subsp. aureus Mu50
acuuucgaucuucu

SEQ ID NO: 3967434 - RNA, 15 nt, Staphylococcus aureus subsp. aureus Mu50
acuuucgcuugcaaa

SEQ ID NO: 3967435 - RNA, 16 nt, Staphylococcus aureus subsp. aureus Mu50
acuuucgcuugcaaag

SEQ ID NO: 3967436 - RNA, 14 nt, Staphylococcus aureus subsp. aureus Mu50
acuuucuaauuguu

SEQ ID NO: 3967437 - RNA, 15 nt, Staphylococcus aureus subsp. aureus Mu50
acuuucuaauuguuu

SEQ ID NO: 3967438 - RNA, 21 nt, Staphylococcus aureus subsp. aureus Mu50
acuuucuacucugauuacaua

SEQ ID NO: 3967439 - RNA, 22 nt, Staphylococcus aureus subsp. aureus Mu50
acuuucucaucuauuuaauaau

SEQ ID NO: 3967440 - RNA, 22 nt, Staphylococcus aureus subsp. aureus Mu50
acuuugaagggagcauuucauu

SEQ ID NO: 3967441 - RNA, 23 nt, Staphylococcus aureus subsp. aureus Mu50
acuuugaauugguugaucaauua

SEQ ID NO: 3967442 - RNA, 19 nt, Staphylococcus aureus subsp. aureus Mu50
acuuuggaaauuuauuaua

SEQ ID NO: 3967443 - RNA, 15 nt, Staphylococcus aureus subsp. aureus Mu50
acuuuggcaaaguca

SEQ ID NO: 3967444 - RNA, 17 nt, Staphylococcus aureus subsp. aureus Mu50
acuuuggucaacuuuuu

SEQ ID NO: 3967445 - RNA, 16 nt, Staphylococcus aureus subsp. aureus Mu50
acuuugucugcaauuu

SEQ ID NO: 3967446 - RNA, 22 nt, Staphylococcus aureus subsp. aureus Mu50
acuuuguucugcuuuuucuuua

SEQ ID NO: 3967447 - RNA, 18 nt, Staphylococcus aureus subsp. aureus Mu50
acuuuuacaaacuucaca

SEQ ID NO: 3967448 - RNA, 23 nt, Staphylococcus aureus subsp. aureus Mu50
acuuuuacuuucucaucuauuua

SEQ ID NO: 3967449 - RNA, 17 nt, Staphylococcus aureus subsp. aureus Mu50
acuuuuagaguuuuuau

SEQ ID NO: 3967450 - RNA, 22 nt, Staphylococcus aureus subsp. aureus Mu50
acuuuuagaguuuuuauuauua

SEQ ID NO: 3967451 - RNA, 13 nt, Staphylococcus aureus subsp. aureus Mu50
acuuuuagauuau

SEQ ID NO: 3967452 - RNA, 17 nt, Staphylococcus aureus subsp. aureus Mu50
acuuuuauaaucuuuua

SEQ ID NO: 3967453 - RNA, 15 nt, Staphylococcus aureus subsp. aureus Mu50
acuuuuauagaaaau

SEQ ID NO: 3967454 - RNA, 20 nt, Staphylococcus aureus subsp. aureus Mu50
acuuuuauagaaaauuaacu

SEQ ID NO: 3967455 - RNA, 14 nt, Staphylococcus aureus subsp. aureus Mu50
acuuuuauuacuua

SEQ ID NO: 3967456 - RNA, 20 nt, Staphylococcus aureus subsp. aureus Mu50
acuuuuauugccauaaagua

SEQ ID NO: 3967457 - RNA, 20 nt, Staphylococcus aureus subsp. aureus Mu50
acuuuuauuuguauuguaua

SEQ ID NO: 3967458 - RNA, 15 nt, Staphylococcus aureus subsp. aureus Mu50
acuuuuauuuuuuau

SEQ ID NO: 3967459 - RNA, 22 nt, Staphylococcus aureus subsp. aureus Mu50
acuuuuauuuuuuauaaagaua

SEQ ID NO: 3967460 - RNA, 19 nt, Staphylococcus aureus subsp. aureus Mu50
acuuuuccuugauucuuau

SEQ ID NO: 3967461 - RNA, 20 nt, Staphylococcus aureus subsp. aureus Mu50
acuuuuccuugauucuuaua

SEQ ID NO: 3967462 - RNA, 23 nt, Staphylococcus aureus subsp. aureus Mu50
acuuuucucgauuaauuuucuuu

SEQ ID NO: 3967463 - RNA, 12 nt, Staphylococcus aureus subsp. aureus Mu50
acuuuucuuauc

SEQ ID NO: 3967464 - RNA, 11 nt, Staphylococcus aureus subsp. aureus Mu50
acuuuugauuu

SEQ ID NO: 3967465 - RNA, 16 nt, Staphylococcus aureus subsp. aureus Mu50
acuuuugauuuugaau

SEQ ID NO: 3967466 - RNA, 16 nt, Staphylococcus aureus subsp. aureus Mu50
acuuuugggaagcguc

SEQ ID NO: 3967467 - RNA, 23 nt, Staphylococcus aureus subsp. aureus Mu50
acuuuuggucuguugaagucaau

SEQ ID NO: 3967468 - RNA, 19 nt, Staphylococcus aureus subsp. aureus Mu50
acuuuuguuaaaaaaugga

SEQ ID NO: 3967469 - RNA, 23 nt, Staphylococcus aureus subsp. aureus Mu50
acuuuuuaaacguacauuuuuau

SEQ ID NO: 3967470 - RNA, 14 nt, Staphylococcus aureus subsp. aureus Mu50
acuuuuuaaaggac

SEQ ID NO: 3967471 - RNA, 14 nt, Staphylococcus aureus subsp. aureus Mu50
acuuuuuaauaaua

SEQ ID NO: 3967472 - RNA, 20 nt, Staphylococcus aureus subsp. aureus Mu50
acuuuuuacuaggaauauaa

SEQ ID NO: 3967473 - RNA, 23 nt, Staphylococcus aureus subsp. aureus Mu50
acuuuuuacuaggaauauaaaac

SEQ ID NO: 3967474 - RNA, 18 nt, Staphylococcus aureus subsp. aureus Mu50
acuuuuuauaucaaaauc

SEQ ID NO: 3967475 - RNA, 21 nt, Staphylococcus aureus subsp. aureus Mu50
acuuuuuauuaguauucaaaa

SEQ ID NO: 3967476 - RNA, 15 nt, Staphylococcus aureus subsp. aureus Mu50
acuuuuucaacugua

SEQ ID NO: 3967477 - RNA, 16 nt, Staphylococcus aureus subsp. aureus Mu50
acuuuuucagaaugaa

SEQ ID NO: 3967478 - RNA, 18 nt, Staphylococcus aureus subsp. aureus Mu50
acuuuuucagaaugaacu

SEQ ID NO: 3967479 - RNA, 17 nt, Staphylococcus aureus subsp. aureus Mu50
agaaucagcuaaauauu

SEQ ID NO: 3967480 - RNA, 13 nt, Staphylococcus aureus subsp. aureus Mu50
agaaucaucuaaa

SEQ ID NO: 3967481 - RNA, 19 nt, Staphylococcus aureus subsp. aureus Mu50
agaauccuaugccaaauaa

SEQ ID NO: 3967482 - RNA, 20 nt, Staphylococcus aureus subsp. aureus Mu50
agaaucgaaccaaauuuuau

SEQ ID NO: 3967483 - RNA, 14 nt, Staphylococcus aureus subsp. aureus Mu50
agaaucuccauuua

SEQ ID NO: 3967484 - RNA, 15 nt, Staphylococcus aureus subsp. aureus Mu50
agaaucuccauuuaa

SEQ ID NO: 3967485 - RNA, 22 nt, Staphylococcus aureus subsp. aureus Mu50
agaaucuuacauugauaaaaua

SEQ ID NO: 3967486 - RNA, 23 nt, Staphylococcus aureus subsp. aureus Mu50
agaaucuuggaaguaucugugaa

SEQ ID NO: 3967487 - RNA, 16 nt, Staphylococcus aureus subsp. aureus Mu50
agaaugaauaauucca

SEQ ID NO: 3967488 - RNA, 18 nt, Staphylococcus aureus subsp. aureus Mu50
agaaugaauaauuccagu

SEQ ID NO: 3967489 - RNA, 19 nt, Staphylococcus aureus subsp. aureus Mu50
agaaugacaccuaauacca

SEQ ID NO: 3967490 - RNA, 12 nt, Staphylococcus aureus subsp. aureus Mu50
agaaugauauaa

SEQ ID NO: 3967491 - RNA, 18 nt, Staphylococcus aureus subsp. aureus Mu50
agaaugcaccaacaauag

SEQ ID NO: 3967492 - RNA, 16 nt, Staphylococcus aureus subsp. aureus Mu50
agaaugccauaccugc

SEQ ID NO: 3967493 - RNA, 22 nt, Staphylococcus aureus subsp. aureus Mu50
agaaugcgaagauuuuuaacau

SEQ ID NO: 3967494 - RNA, 17 nt, Staphylococcus aureus subsp. aureus Mu50
agaauguacaauuuuuu

SEQ ID NO: 3967495 - RNA, 17 nt, Staphylococcus aureus subsp. aureus Mu50
agaaugucgauauuucu

SEQ ID NO: 3967496 - RNA, 13 nt, Staphylococcus aureus subsp. aureus Mu50
agaauuaaagucu

SEQ ID NO: 3967497 - RNA, 15 nt, Staphylococcus aureus subsp. aureus Mu50
agaauuaaugaaaua

SEQ ID NO: 3967498 - RNA, 18 nt, Staphylococcus aureus subsp. aureus Mu50
agaauuauucaaguaaua

SEQ ID NO: 3967499 - RNA, 14 nt, Staphylococcus aureus subsp. aureus Mu50
agaauuauuuugga

SEQ ID NO: 3967500 - RNA, 16 nt, Staphylococcus aureus subsp. aureus Mu50
agaauucaauuucuca

SEQ ID NO: 3967501 - RNA, 16 nt, Staphylococcus aureus subsp. aureus Mu50
agaauucuaaaagaau

SEQ ID NO: 3967502 - RNA, 17 nt, Staphylococcus aureus subsp. aureus Mu50
agaauuuaaaagagaau

SEQ ID NO: 3967503 - RNA, 17 nt, Staphylococcus aureus subsp. aureus Mu50
agaauuuaagcuuacga

SEQ ID NO: 3967504 - RNA, 17 nt, Staphylococcus aureus subsp. aureus Mu50
agaauuucgaaaagaaa

SEQ ID NO: 3967505 - RNA, 18 nt, Staphylococcus aureus subsp. aureus Mu50
agaauuucgaaaagaaau

SEQ ID NO: 3967506 - RNA, 21 nt, Staphylococcus aureus subsp. aureus Mu50
agaauuucgaaaagaaauucu

SEQ ID NO: 3967507 - RNA, 16 nt, Staphylococcus aureus subsp. aureus Mu50
agaauuuuaauuaauu

SEQ ID NO: 3967508 - RNA, 20 nt, Staphylococcus aureus subsp. aureus Mu50
agaauuuuucauauacuuaa

SEQ ID NO: 3967509 - RNA, 16 nt, Staphylococcus aureus subsp. aureus Mu50
agacaaguauacuuga

SEQ ID NO: 3967510 - RNA, 15 nt, Staphylococcus aureus subsp. aureus Mu50
agacaauauuuuuac

SEQ ID NO: 3967511 - RNA, 17 nt, Staphylococcus aureus subsp. aureus Mu50
agacaauauuuuuacau

SEQ ID NO: 3967512 - RNA, 20 nt, Staphylococcus aureus subsp. aureus Mu50
agacaauguucuuuucaaca

SEQ ID NO: 3967513 - RNA, 10 nt, Staphylococcus aureus subsp. aureus Mu50
agacagaaau

SEQ ID NO: 3967514 - RNA, 16 nt, Staphylococcus aureus subsp. aureus Mu50
agacauaaaaaaagag

SEQ ID NO: 3967515 - RNA, 17 nt, Staphylococcus aureus subsp. aureus Mu50
agacauaaauauggauu

SEQ ID NO: 3967516 - RNA, 17 nt, Staphylococcus aureus subsp. aureus Mu50
agacauaaccuugcuuu

SEQ ID NO: 3967517 - RNA, 20 nt, Staphylococcus aureus subsp. aureus Mu50
agacauaaggucuuggacua

SEQ ID NO: 3967518 - RNA, 22 nt, Staphylococcus aureus subsp. aureus Mu50
agacauacagucaauacaaaga

SEQ ID NO: 3967519 - RNA, 22 nt, Staphylococcus aureus subsp. aureus Mu50
agacauauagcggugucaauau

SEQ ID NO: 3967520 - RNA, 18 nt, Staphylococcus aureus subsp. aureus Mu50
agacauuaaaaaaucgaa

SEQ ID NO: 3967521 - RNA, 21 nt, Staphylococcus aureus subsp. aureus Mu50
agacauugaaaggaacauuuc

SEQ ID NO: 3967522 - RNA, 13 nt, Staphylococcus aureus subsp. aureus Mu50
agaccuaugaauu

SEQ ID NO: 3967523 - RNA, 16 nt, Staphylococcus aureus subsp. aureus Mu50
agaccuucuucucuaa

SEQ ID NO: 3967524 - RNA, 22 nt, Staphylococcus aureus subsp. aureus Mu50
agaccuucuucucuaaucacuu

SEQ ID NO: 3967525 - RNA, 12 nt, Staphylococcus aureus subsp. aureus Mu50
agacgaacauca

SEQ ID NO: 3967526 - RNA, 16 nt, Staphylococcus aureus subsp. aureus Mu50
agacgcuguuuuaaau

SEQ ID NO: 3967527 - RNA, 21 nt, Staphylococcus aureus subsp. aureus Mu50
agacuaaaaaacuaacuuuau

SEQ ID NO: 3967528 - RNA, 17 nt, Staphylococcus aureus subsp. aureus Mu50
agacuaaaaugaaugaa

SEQ ID NO: 3967529 - RNA, 18 nt, Staphylococcus aureus subsp. aureus Mu50
agacuaaaaugaaugaag

SEQ ID NO: 3967530 - RNA, 19 nt, Staphylococcus aureus subsp. aureus Mu50
agacuaguguaccuuguuu

SEQ ID NO: 3967531 - RNA, 13 nt, Staphylococcus aureus subsp. aureus Mu50
agacucaauuuca

SEQ ID NO: 3967532 - RNA, 22 nt, Staphylococcus aureus subsp. aureus Mu50
agacucaauuucauuugaaaua

SEQ ID NO: 3967533 - RNA, 17 nt, Staphylococcus aureus subsp. aureus Mu50
agacuguuuuuuuguuu

SEQ ID NO: 3967534 - RNA, 19 nt, Staphylococcus aureus subsp. aureus Mu50
agacuuauuugaaugcaaa

SEQ ID NO: 3967535 - RNA, 16 nt, Staphylococcus aureus subsp. aureus Mu50
agacuucguugcacuu

SEQ ID NO: 3967536 - RNA, 16 nt, Staphylococcus aureus subsp. aureus Mu50
agacuucuuucaauua

SEQ ID NO: 3967537 - RNA, 22 nt, Staphylococcus aureus subsp. aureus Mu50
agacuugguuacuuaguaagga

SEQ ID NO: 3967538 - RNA, 23 nt, Staphylococcus aureus subsp. aureus Mu50
agacuugguuacuuaguaaggaa

SEQ ID NO: 3967539 - RNA, 11 nt, Staphylococcus aureus subsp. aureus Mu50
agacuuucuug

SEQ ID NO: 3967540 - RNA, 16 nt, Staphylococcus aureus subsp. aureus Mu50
agagaaacaaaacaaa

SEQ ID NO: 3967541 - RNA, 21 nt, Staphylococcus aureus subsp. aureus Mu50
agagaaacaaaacaaaaaaua

SEQ ID NO: 3967542 - RNA, 17 nt, Staphylococcus aureus subsp. aureus Mu50
agagaaacgugacggua

SEQ ID NO: 3967543 - RNA, 11 nt, Staphylococcus aureus subsp. aureus Mu50
agagaaauucg

SEQ ID NO: 3967544 - RNA, 20 nt, Staphylococcus aureus subsp. aureus Mu50
agagaaauucgaaaagaaau

SEQ ID NO: 3967545 - RNA, 21 nt, Staphylococcus aureus subsp. aureus Mu50
agagaaauucgaaaagaaauu

SEQ ID NO: 3967546 - RNA, 12 nt, Staphylococcus aureus subsp. aureus Mu50
agagaacagcag

SEQ ID NO: 3967547 - RNA, 19 nt, Staphylococcus aureus subsp. aureus Mu50
agagaauauagauuuugua

SEQ ID NO: 3967548 - RNA, 13 nt, Staphylococcus aureus subsp. aureus Mu50
agagaaucaauua

SEQ ID NO: 3967549 - RNA, 20 nt, Staphylococcus aureus subsp. aureus Mu50
agagaaucaauuauugaaaa

SEQ ID NO: 3967550 - RNA, 19 nt, Staphylococcus aureus subsp. aureus Mu50
agagaaucgaaccaaauuu

SEQ ID NO: 3967551 - RNA, 17 nt, Staphylococcus aureus subsp. aureus Mu50
agagaauuucgaaaaga

SEQ ID NO: 3967552 - RNA, 20 nt, Staphylococcus aureus subsp. aureus Mu50
agagaauuucgaaaagaaau

SEQ ID NO: 3967553 - RNA, 17 nt, Staphylococcus aureus subsp. aureus Mu50
agagacuuauuuuauac

SEQ ID NO: 3967554 - RNA, 23 nt, Staphylococcus aureus subsp. aureus Mu50
agagaugggcuaagguuguucua

SEQ ID NO: 3967555 - RNA, 16 nt, Staphylococcus aureus subsp. aureus Mu50
agagauguauaaaacu

SEQ ID NO: 3967556 - RNA, 16 nt, Staphylococcus aureus subsp. aureus Mu50
agagcacgagaaaugu

SEQ ID NO: 3967557 - RNA, 15 nt, Staphylococcus aureus subsp. aureus Mu50
agagccagaaacccu

SEQ ID NO: 3967558 - RNA, 20 nt, Staphylococcus aureus subsp. aureus Mu50
agaggcugguggaaagucag

SEQ ID NO: 3967559 - RNA, 17 nt, Staphylococcus aureus subsp. aureus Mu50
agagguaaaucuguuua

SEQ ID NO: 3967560 - RNA, 21 nt, Staphylococcus aureus subsp. aureus Mu50
agagguaaaucuguuuaaauu

SEQ ID NO: 3967561 - RNA, 24 nt, Staphylococcus aureus subsp. aureus Mu50
agagguuuugcacuaauggcacuu

SEQ ID NO: 3967562 - RNA, 17 nt, Staphylococcus aureus subsp. aureus Mu50
agaguaguucggaugag

SEQ ID NO: 3967563 - RNA, 15 nt, Staphylococcus aureus subsp. aureus Mu50
agaguuaaagucaua

SEQ ID NO: 3967564 - RNA, 16 nt, Staphylococcus aureus subsp. aureus Mu50
agaguuaauccucauu

SEQ ID NO: 3967565 - RNA, 16 nt, Staphylococcus aureus subsp. aureus Mu50
agaguuuuuauuauua

SEQ ID NO: 3967566 - RNA, 15 nt, Staphylococcus aureus subsp. aureus Mu50
agauuugaaauuuau

SEQ ID NO: 3967567 - RNA, 19 nt, Staphylococcus aureus subsp. aureus Mu50
agauuugaaauuuauuaua

SEQ ID NO: 3967568 - RNA, 20 nt, Staphylococcus aureus subsp. aureus Mu50
agauuugaauuaaaguggaa

SEQ ID NO: 3967569 - RNA, 12 nt, Staphylococcus aureus subsp. aureus Mu50
agauuuuaaauc

SEQ ID NO: 3967570 - RNA, 14 nt, Staphylococcus aureus subsp. aureus Mu50
agauuuuaaaucaa

SEQ ID NO: 3967571 - RNA, 14 nt, Staphylococcus aureus subsp. aureus Mu50
agauuuuauauaaa

SEQ ID NO: 3967572 - RNA, 19 nt, Staphylococcus aureus subsp. aureus Mu50
agauuuuaugcuuuacuug

SEQ ID NO: 3967573 - RNA, 18 nt, Staphylococcus aureus subsp. aureus Mu50
agauuuugaauuuuauaa

SEQ ID NO: 3967574 - RNA, 22 nt, Staphylococcus aureus subsp. aureus Mu50
agauuuuuuauguuuaauuuga

SEQ ID NO: 3967575 - RNA, 15 nt, Staphylococcus aureus subsp. aureus Mu50
agcaaaaauauuuaa

SEQ ID NO: 3967576 - RNA, 17 nt, Staphylococcus aureus subsp. aureus Mu50
agcaaaaauauuuaaac

SEQ ID NO: 3967577 - RNA, 16 nt, Staphylococcus aureus subsp. aureus Mu50
agcaaaauuauguaaa

SEQ ID NO: 3967578 - RNA, 22 nt, Staphylococcus aureus subsp. aureus Mu50
agcaaaauuauguaaaaaauau

SEQ ID NO: 3967579 - RNA, 13 nt, Staphylococcus aureus subsp. aureus Mu50
agcaaauaaaauc

SEQ ID NO: 3967580 - RNA, 17 nt, Staphylococcus aureus subsp. aureus Mu50
agcaaauacuucaagag

SEQ ID NO: 3967581 - RNA, 13 nt, Staphylococcus aureus subsp. aureus Mu50
agcaaauauuucu

SEQ ID NO: 3967582 - RNA, 16 nt, Staphylococcus aureus subsp. aureus Mu50
agcaaaugcacuguau

SEQ ID NO: 3967583 - RNA, 19 nt, Staphylococcus aureus subsp. aureus Mu50
agcaaaugcuuaagaaauu

SEQ ID NO: 3967584 - RNA, 20 nt, Staphylococcus aureus subsp. aureus Mu50
agcaaauuauauagaaaacu

SEQ ID NO: 3967585 - RNA, 20 nt, Staphylococcus aureus subsp. aureus Mu50
agcaaauugauuaaauaaau

SEQ ID NO: 3967586 - RNA, 14 nt, Staphylococcus aureus subsp. aureus Mu50
agcaacauuauuuu

SEQ ID NO: 3967587 - RNA, 13 nt, Staphylococcus aureus subsp. aureus Mu50
agcaaccauauuu

SEQ ID NO: 3967588 - RNA, 17 nt, Staphylococcus aureus subsp. aureus Mu50
agcaacgauaccaaaua

SEQ ID NO: 3967589 - RNA, 15 nt, Staphylococcus aureus subsp. aureus Mu50
agcaacgaugucacu

SEQ ID NO: 3967590 - RNA, 19 nt, Staphylococcus aureus subsp. aureus Mu50
agcaagucuucuaaaaaau

SEQ ID NO: 3967591 - RNA, 13 nt, Staphylococcus aureus subsp. aureus Mu50
agcaauaauaauu

SEQ ID NO: 3967592 - RNA, 14 nt, Staphylococcus aureus subsp. aureus Mu50
agcaauaucaucau

SEQ ID NO: 3967593 - RNA, 16 nt, Staphylococcus aureus subsp. aureus Mu50
agcaauaucaucauuu

SEQ ID NO: 3967594 - RNA, 22 nt, Staphylococcus aureus subsp. aureus Mu50
agcaaucaauacaauuuuaccu

SEQ ID NO: 3967595 - RNA, 15 nt, Staphylococcus aureus subsp. aureus Mu50
agcaaugaguugauc

SEQ ID NO: 3967596 - RNA, 22 nt, Staphylococcus aureus subsp. aureus Mu50
agcaauuaaagucaauuuaaau

SEQ ID NO: 3967597 - RNA, 20 nt, Staphylococcus aureus subsp. aureus Mu50
agcaauucuugaaaaguuug

SEQ ID NO: 3967598 - RNA, 17 nt, Staphylococcus aureus subsp. aureus Mu50
agcaauugaaucaaaua

SEQ ID NO: 3967599 - RNA, 15 nt, Staphylococcus aureus subsp. aureus Mu50
agcaauuuucgauau

SEQ ID NO: 3967600 - RNA, 22 nt, Staphylococcus aureus subsp. aureus Mu50
agcacaccuaauucauauauac

SEQ ID NO: 3967601 - RNA, 15 nt, Staphylococcus aureus subsp. aureus Mu50
agcacagaaaauuau

SEQ ID NO: 3967602 - RNA, 19 nt, Staphylococcus aureus subsp. aureus Mu50
agcacagcgauuaaaugau

SEQ ID NO: 3967603 - RNA, 17 nt, Staphylococcus aureus subsp. aureus Mu50
agcacauuuuuaguuag

SEQ ID NO: 3967604 - RNA, 20 nt, Staphylococcus aureus subsp. aureus Mu50
agcacauuuuuaguuagaaa

SEQ ID NO: 3967605 - RNA, 14 nt, Staphylococcus aureus subsp. aureus Mu50
agcaccauuauuaa

SEQ ID NO: 3967606 - RNA, 16 nt, Staphylococcus aureus subsp. aureus Mu50
agcaccgacaauuaua

SEQ ID NO: 3967607 - RNA, 23 nt, Staphylococcus aureus subsp. aureus Mu50
agcaccgauuuggucagcgacau

SEQ ID NO: 3967608 - RNA, 18 nt, Staphylococcus aureus subsp. aureus Mu50
agcaccguaacauaugua

SEQ ID NO: 3967609 - RNA, 23 nt, Staphylococcus aureus subsp. aureus Mu50
agcaccguaacauauguacuauu

SEQ ID NO: 3967610 - RNA, 16 nt, Staphylococcus aureus subsp. aureus Mu50
agcaccuuaccuacuu

SEQ ID NO: 3967611 - RNA, 16 nt, Staphylococcus aureus subsp. aureus Mu50
agcacgagaaauguca

SEQ ID NO: 3967612 - RNA, 18 nt, Staphylococcus aureus subsp. aureus Mu50
agcacuagccguuauuuu

SEQ ID NO: 3967613 - RNA, 20 nt, Staphylococcus aureus subsp. aureus Mu50
agcacuauaacaagguguuc

SEQ ID NO: 3967614 - RNA, 15 nt, Staphylococcus aureus subsp. aureus Mu50
agcacuuaauaaguc

SEQ ID NO: 3967615 - RNA, 19 nt, Staphylococcus aureus subsp. aureus Mu50
agcagcaguugacuguaaa

SEQ ID NO: 3967616 - RNA, 20 nt, Staphylococcus aureus subsp. aureus Mu50
agcaguaagauaauuuucaa

SEQ ID NO: 3967617 - RNA, 20 nt, Staphylococcus aureus subsp. aureus Mu50
agcaguaaguugauuucuac

SEQ ID NO: 3967618 - RNA, 21 nt, Staphylococcus aureus subsp. aureus Mu50
agcaguugacuguaaaacaau

SEQ ID NO: 3967619 - RNA, 21 nt, Staphylococcus aureus subsp. aureus Mu50
agcaguugcacaaauugcaau

SEQ ID NO: 3967620 - RNA, 21 nt, Staphylococcus aureus subsp. aureus Mu50
agcaguuguugguuuugcaac

SEQ ID NO: 3967621 - RNA, 14 nt, Staphylococcus aureus subsp. aureus Mu50
agcaguuucugaga

SEQ ID NO: 3967622 - RNA, 16 nt, Staphylococcus aureus subsp. aureus Mu50
agcauaucuuuaucau

SEQ ID NO: 3967623 - RNA, 19 nt, Staphylococcus aureus subsp. aureus Mu50
agcauaucuuuaucauuau

SEQ ID NO: 3967624 - RNA, 20 nt, Staphylococcus aureus subsp. aureus Mu50
agcauaugguaaaucgucau

SEQ ID NO: 3967625 - RNA, 15 nt, Staphylococcus aureus subsp. aureus Mu50
agcaucaaaaauaaa

SEQ ID NO: 3967626 - RNA, 19 nt, Staphylococcus aureus subsp. aureus Mu50
agcaucacaguguugaauu

SEQ ID NO: 3967627 - RNA, 19 nt, Staphylococcus aureus subsp. aureus Mu50
agcaucgauuuauuauuac

SEQ ID NO: 3967628 - RNA, 14 nt, Staphylococcus aureus subsp. aureus Mu50
agcaucguaaaaaa

SEQ ID NO: 3967629 - RNA, 17 nt, Staphylococcus aureus subsp. aureus Mu50
agcaucguaaaaaacaa

SEQ ID NO: 3967630 - RNA, 23 nt, Staphylococcus aureus subsp. aureus Mu50
agcaucugcaugguuugcugguu

SEQ ID NO: 3967631 - RNA, 17 nt, Staphylococcus aureus subsp. aureus Mu50
agcaucuuuuacugcuu

SEQ ID NO: 3967632 - RNA, 15 nt, Staphylococcus aureus subsp. aureus Mu50
agcaugaaucgcauu

SEQ ID NO: 3967633 - RNA, 20 nt, Staphylococcus aureus subsp. aureus Mu50
agcaugaaucgcauuuaaau

SEQ ID NO: 3967634 - RNA, 16 nt, Staphylococcus aureus subsp. aureus Mu50
agcaugacuguaagua

SEQ ID NO: 3967635 - RNA, 20 nt, Staphylococcus aureus subsp. aureus Mu50
agcauuaaauuccaugucaa

SEQ ID NO: 3967636 - RNA, 19 nt, Staphylococcus aureus subsp. aureus Mu50
agcauuaaucguauuuuua

SEQ ID NO: 3967637 - RNA, 17 nt, Staphylococcus aureus subsp. aureus Mu50
agcauuacgccaccagu

SEQ ID NO: 3967638 - RNA, 20 nt, Staphylococcus aureus subsp. aureus Mu50
agcauuacgccaccaguuuc

SEQ ID NO: 3967639 - RNA, 22 nt, Staphylococcus aureus subsp. aureus Mu50
agcauuagcaaauauuauuaaa

SEQ ID NO: 3967640 - RNA, 20 nt, Staphylococcus aureus subsp. aureus Mu50
agcauuauuauuuuaauagc

SEQ ID NO: 3967641 - RNA, 22 nt, Staphylococcus aureus subsp. aureus Mu50
agcauuauuugcugcuaauuga

SEQ ID NO: 3967642 - RNA, 17 nt, Staphylococcus aureus subsp. aureus Mu50
agcauugggacauaaaa

SEQ ID NO: 3967643 - RNA, 20 nt, Staphylococcus aureus subsp. aureus Mu50
agcauugggacauaaaauua

SEQ ID NO: 3967644 - RNA, 14 nt, Staphylococcus aureus subsp. aureus Mu50
agcauuucuuuauu

SEQ ID NO: 3967645 - RNA, 14 nt, Staphylococcus aureus subsp. aureus Mu50
agcauuuuuauauc

SEQ ID NO: 3967646 - RNA, 17 nt, Staphylococcus aureus subsp. aureus Mu50
agccaaaggcaaaaugu

SEQ ID NO: 3967647 - RNA, 23 nt, Staphylococcus aureus subsp. aureus Mu50
agccaaaucuuuaauaaccuuua

SEQ ID NO: 3967648 - RNA, 13 nt, Staphylococcus aureus subsp. aureus Mu50
agccaaauuacug

SEQ ID NO: 3967649 - RNA, 16 nt, Staphylococcus aureus subsp. aureus Mu50
agccaacacauaaaug

SEQ ID NO: 3967650 - RNA, 17 nt, Staphylococcus aureus subsp. aureus Mu50
agccaagauaaaucauc

SEQ ID NO: 3967651 - RNA, 22 nt, Staphylococcus aureus subsp. aureus Mu50
agccagcuuagcauagcguuca

SEQ ID NO: 3967652 - RNA, 18 nt, Staphylococcus aureus subsp. aureus Mu50
agccauaccuuauuucag

SEQ ID NO: 3967653 - RNA, 22 nt, Staphylococcus aureus subsp. aureus Mu50
agcuucugcaugggcuucugcu

SEQ ID NO: 3967654 - RNA, 13 nt, Staphylococcus aureus subsp. aureus Mu50
agcuucuuaaauc

SEQ ID NO: 3967655 - RNA, 16 nt, Staphylococcus aureus subsp. aureus Mu50
agcuucuuaaaucaac

SEQ ID NO: 3967656 - RNA, 20 nt, Staphylococcus aureus subsp. aureus Mu50
agcuucuuaaaucaacauca

SEQ ID NO: 3967657 - RNA, 22 nt, Staphylococcus aureus subsp. aureus Mu50
agcuucuuaaaucaacaucauc

SEQ ID NO: 3967658 - RNA, 15 nt, Staphylococcus aureus subsp. aureus Mu50
agcuugaauaauaua

SEQ ID NO: 3967659 - RNA, 16 nt, Staphylococcus aureus subsp. aureus Mu50
agcuugaauaauauau

SEQ ID NO: 3967660 - RNA, 18 nt, Staphylococcus aureus subsp. aureus Mu50
agcuugaauaauauauuu

SEQ ID NO: 3967661 - RNA, 19 nt, Staphylococcus aureus subsp. aureus Mu50
agcuugaauaauauauuua

SEQ ID NO: 3967662 - RNA, 19 nt, Staphylococcus aureus subsp. aureus Mu50
agcuugaucuaaaugaucu

SEQ ID NO: 3967663 - RNA, 15 nt, Staphylococcus aureus subsp. aureus Mu50
agcuugauuuaacaa

SEQ ID NO: 3967664 - RNA, 22 nt, Staphylococcus aureus subsp. aureus Mu50
agcuugauuuaacaaccucuga

SEQ ID NO: 3967665 - RNA, 14 nt, Staphylococcus aureus subsp. aureus Mu50
agcuugcuguucaa

SEQ ID NO: 3967666 - RNA, 16 nt, Staphylococcus aureus subsp. aureus Mu50
agcuugcuuacaauaa

SEQ ID NO: 3967667 - RNA, 18 nt, Staphylococcus aureus subsp. aureus Mu50
agcuugcuuacaauaauc

SEQ ID NO: 3967668 - RNA, 19 nt, Staphylococcus aureus subsp. aureus Mu50
agcuugggacagaaaacaa

SEQ ID NO: 3967669 - RNA, 14 nt, Staphylococcus aureus subsp. aureus Mu50
agcuuguaauccuu

SEQ ID NO: 3967670 - RNA, 15 nt, Staphylococcus aureus subsp. aureus Mu50
agcuuguuucagguu

SEQ ID NO: 3967671 - RNA, 13 nt, Staphylococcus aureus subsp. aureus Mu50
agcuuuaauaaua

SEQ ID NO: 3967672 - RNA, 16 nt, Staphylococcus aureus subsp. aureus Mu50
agcuuuaauaauauga

SEQ ID NO: 3967673 - RNA, 22 nt, Staphylococcus aureus subsp. aureus Mu50
agcuuuaaucauagcauuaaga

SEQ ID NO: 3967674 - RNA, 14 nt, Staphylococcus aureus subsp. aureus Mu50
agcuuuaauuuuuu

SEQ ID NO: 3967675 - RNA, 18 nt, Staphylococcus aureus subsp. aureus Mu50
agcuuucauuaauuuuuc

SEQ ID NO: 3967676 - RNA, 20 nt, Staphylococcus aureus subsp. aureus Mu50
agcuuucuuuuucaucuuuc

SEQ ID NO: 3967677 - RNA, 17 nt, Staphylococcus aureus subsp. aureus Mu50
agcuuuuacgccuucuu

SEQ ID NO: 3967678 - RNA, 21 nt, Staphylococcus aureus subsp. aureus Mu50
agcuuuuacgccuucuuuaua

SEQ ID NO: 3967679 - RNA, 14 nt, Staphylococcus aureus subsp. aureus Mu50
agcuuuucuaaugc

SEQ ID NO: 3967680 - RNA, 12 nt, Staphylococcus aureus subsp. aureus Mu50
agcuuuuguaaa

SEQ ID NO: 3967681 - RNA, 13 nt, Staphylococcus aureus subsp. aureus Mu50
agcuuuuguaaag

SEQ ID NO: 3967682 - RNA, 14 nt, Staphylococcus aureus subsp. aureus Mu50
aggaaaauaaaaac

SEQ ID NO: 3967683 - RNA, 16 nt, Staphylococcus aureus subsp. aureus Mu50
aggaaagccauuaaac

SEQ ID NO: 3967684 - RNA, 18 nt, Staphylococcus aureus subsp. aureus Mu50
aggaaauccgcauaaauu

SEQ ID NO: 3967685 - RNA, 17 nt, Staphylococcus aureus subsp. aureus Mu50
aggaaauggcuccauuu

SEQ ID NO: 3967686 - RNA, 23 nt, Staphylococcus aureus subsp. aureus Mu50
aggaacagcggaauacagaugau

SEQ ID NO: 3967687 - RNA, 21 nt, Staphylococcus aureus subsp. aureus Mu50
aggaacguguucuaaaaguug

SEQ ID NO: 3967688 - RNA, 18 nt, Staphylococcus aureus subsp. aureus Mu50
aggaagucgcaaucaccu

SEQ ID NO: 3967689 - RNA, 20 nt, Staphylococcus aureus subsp. aureus Mu50
aggaaguucucugcugcuuu

SEQ ID NO: 3967690 - RNA, 18 nt, Staphylococcus aureus subsp. aureus Mu50
aggaauaauuuuaaaaau

SEQ ID NO: 3967691 - RNA, 19 nt, Staphylococcus aureus subsp. aureus Mu50
aggaauaauuuuaaaaaua

SEQ ID NO: 3967692 - RNA, 21 nt, Staphylococcus aureus subsp. aureus Mu50
aggaauaauuuuaaaaauaaa

SEQ ID NO: 3967693 - RNA, 17 nt, Staphylococcus aureus subsp. aureus Mu50
aggaauaccacuuaauc

SEQ ID NO: 3967694 - RNA, 15 nt, Staphylococcus aureus subsp. aureus Mu50
aggaauauaaaacug

SEQ ID NO: 3967695 - RNA, 17 nt, Staphylococcus aureus subsp. aureus Mu50
aggaauaucuuucaaau

SEQ ID NO: 3967696 - RNA, 13 nt, Staphylococcus aureus subsp. aureus Mu50
aggaauaugaauu

SEQ ID NO: 3967697 - RNA, 16 nt, Staphylococcus aureus subsp. aureus Mu50
aggaauaugaauugcu

SEQ ID NO: 3967698 - RNA, 19 nt, Staphylococcus aureus subsp. aureus Mu50
aggacacauuuacuuaaga

SEQ ID NO: 3967699 - RNA, 13 nt, Staphylococcus aureus subsp. aureus Mu50
aggaccaaauaga

SEQ ID NO: 3967700 - RNA, 19 nt, Staphylococcus aureus subsp. aureus Mu50
aggaccacucaauucucua

SEQ ID NO: 3967701 - RNA, 12 nt, Staphylococcus aureus subsp. aureus Mu50
aggacuuuaugc

SEQ ID NO: 3967702 - RNA, 21 nt, Staphylococcus aureus subsp. aureus Mu50
aggagacauuucccauuuauc

SEQ ID NO: 3967703 - RNA, 22 nt, Staphylococcus aureus subsp. aureus Mu50
aggagcgagccauuauuauuuu

SEQ ID NO: 3967704 - RNA, 16 nt, Staphylococcus aureus subsp. aureus Mu50
aggauaagaacgagaa

SEQ ID NO: 3967705 - RNA, 17 nt, Staphylococcus aureus subsp. aureus Mu50
aggauaagaacgagaau

SEQ ID NO: 3967706 - RNA, 14 nt, Staphylococcus aureus subsp. aureus Mu50
aggauaauuauuag

SEQ ID NO: 3967707 - RNA, 15 nt, Staphylococcus aureus subsp. aureus Mu50
aggauacauaaaucu

SEQ ID NO: 3967708 - RNA, 18 nt, Staphylococcus aureus subsp. aureus Mu50
aggauacauaaaucuaau

SEQ ID NO: 3967709 - RNA, 19 nt, Staphylococcus aureus subsp. aureus Mu50
aggauacauaaaucuaaua

SEQ ID NO: 3967710 - RNA, 15 nt, Staphylococcus aureus subsp. aureus Mu50
aggauaucuacgccu

SEQ ID NO: 3967711 - RNA, 15 nt, Staphylococcus aureus subsp. aureus Mu50
aggauaugcuaaaca

SEQ ID NO: 3967712 - RNA, 21 nt, Staphylococcus aureus subsp. aureus Mu50
aggauaugcuguguaucauca

SEQ ID NO: 3967713 - RNA, 23 nt, Staphylococcus aureus subsp. aureus Mu50
aggauauuuauucuaaguuaaaa

SEQ ID NO: 3967714 - RNA, 13 nt, Staphylococcus aureus subsp. aureus Mu50
aggauauuuuuua

SEQ ID NO: 3967715 - RNA, 15 nt, Staphylococcus aureus subsp. aureus Mu50
aggaucaacugaaau

SEQ ID NO: 3967716 - RNA, 18 nt, Staphylococcus aureus subsp. aureus Mu50
aggaucaacugaaauuuu

SEQ ID NO: 3967717 - RNA, 18 nt, Staphylococcus aureus subsp. aureus Mu50
aggaucaagugcagaugu

SEQ ID NO: 3967718 - RNA, 15 nt, Staphylococcus aureus subsp. aureus Mu50
aggaugaguuuaaaa

SEQ ID NO: 3967719 - RNA, 18 nt, Staphylococcus aureus subsp. aureus Mu50
aggaugaguuuaaaaaua

SEQ ID NO: 3967720 - RNA, 15 nt, Staphylococcus aureus subsp. aureus Mu50
aggauguuauaaaau

SEQ ID NO: 3967721 - RNA, 14 nt, Staphylococcus aureus subsp. aureus Mu50
aggauguucaucaa

SEQ ID NO: 3967722 - RNA, 20 nt, Staphylococcus aureus subsp. aureus Mu50
aggauuauagguauaagaau

SEQ ID NO: 3967723 - RNA, 14 nt, Staphylococcus aureus subsp. aureus Mu50
aggauuauuaucaa

SEQ ID NO: 3967724 - RNA, 17 nt, Staphylococcus aureus subsp. aureus Mu50
aggauuuuagauuuagu

SEQ ID NO: 3967725 - RNA, 13 nt, Staphylococcus aureus subsp. aureus Mu50
aggauuuuuuuag

SEQ ID NO: 3967726 - RNA, 13 nt, Staphylococcus aureus subsp. aureus Mu50
aggcaacaaauau

SEQ ID NO: 3967727 - RNA, 11 nt, Staphylococcus aureus subsp. aureus Mu50
aggcaacuuuu

SEQ ID NO: 3967728 - RNA, 17 nt, Staphylococcus aureus subsp. aureus Mu50
aggcaacuuuuauuacu

SEQ ID NO: 3967729 - RNA, 12 nt, Staphylococcus aureus subsp. aureus Mu50
aggcaaugcaag

SEQ ID NO: 3967730 - RNA, 22 nt, Staphylococcus aureus subsp. aureus Mu50
aggcacagcggaauacagauga

SEQ ID NO: 3967731 - RNA, 23 nt, Staphylococcus aureus subsp. aureus Mu50
aggcacagcggaauacagaugau

SEQ ID NO: 3967732 - RNA, 23 nt, Staphylococcus aureus subsp. aureus Mu50
aggcacaguggauuacagaugau

SEQ ID NO: 3967733 - RNA, 17 nt, Staphylococcus aureus subsp. aureus Mu50
aggcauucaucuaacga

SEQ ID NO: 3967734 - RNA, 16 nt, Staphylococcus aureus subsp. aureus Mu50
aggcauucuuccaaca

SEQ ID NO: 3967735 - RNA, 14 nt, Staphylococcus aureus subsp. aureus Mu50
aggcgcgaauuaaa

SEQ ID NO: 3967736 - RNA, 18 nt, Staphylococcus aureus subsp. aureus Mu50
aggcgcuuguaaaauuuu

SEQ ID NO: 3967737 - RNA, 23 nt, Staphylococcus aureus subsp. aureus Mu50
aggcugaguauaccaauugcuga

SEQ ID NO: 3967738 - RNA, 22 nt, Staphylococcus aureus subsp. aureus Mu50
aggcuguucuggaauugggaaa

SEQ ID NO: 3967739 - RNA, 17 nt, Staphylococcus aureus subsp. aureus Mu50
aggcuuaaauauaauga

SEQ ID NO: 3967740 - RNA, 19 nt, Staphylococcus aureus subsp. aureus Mu50
aggcuuaaauauaaugauc

SEQ ID NO: 3967741 - RNA, 16 nt, Staphylococcus aureus subsp. aureus Mu50
aguaaucaagcaaugc

SEQ ID NO: 3967742 - RNA, 19 nt, Staphylococcus aureus subsp. aureus Mu50
aguaaucagcuuuuucaca

SEQ ID NO: 3967743 - RNA, 19 nt, Staphylococcus aureus subsp. aureus Mu50
aguaauccccgaagcacag

SEQ ID NO: 3967744 - RNA, 22 nt, Staphylococcus aureus subsp. aureus Mu50
aguaauccccgaagcacagaaa

SEQ ID NO: 3967745 - RNA, 15 nt, Staphylococcus aureus subsp. aureus Mu50
aguaaucguaucuuc

SEQ ID NO: 3967746 - RNA, 18 nt, Staphylococcus aureus subsp. aureus Mu50
aguaaucguaucuucacu

SEQ ID NO: 3967747 - RNA, 22 nt, Staphylococcus aureus subsp. aureus Mu50
aguaaucugcaaaugccucuuu

SEQ ID NO: 3967748 - RNA, 14 nt, Staphylococcus aureus subsp. aureus Mu50
aguaaugaagcuuc

SEQ ID NO: 3967749 - RNA, 16 nt, Staphylococcus aureus subsp. aureus Mu50
aguaauguuccauaua

SEQ ID NO: 3967750 - RNA, 16 nt, Staphylococcus aureus subsp. aureus Mu50
aguaauuaaauacuug

SEQ ID NO: 3967751 - RNA, 14 nt, Staphylococcus aureus subsp. aureus Mu50
aguaauuaauuccu

SEQ ID NO: 3967752 - RNA, 15 nt, Staphylococcus aureus subsp. aureus Mu50
aguaauucuuaaaaa

SEQ ID NO: 3967753 - RNA, 22 nt, Staphylococcus aureus subsp. aureus Mu50
aguaauuuaauugguucuucuu

SEQ ID NO: 3967754 - RNA, 14 nt, Staphylococcus aureus subsp. aureus Mu50
aguaauuucuccaa

SEQ ID NO: 3967755 - RNA, 12 nt, Staphylococcus aureus subsp. aureus Mu50
aguacaaauaau

SEQ ID NO: 3967756 - RNA, 13 nt, Staphylococcus aureus subsp. aureus Mu50
aguacaaauaaua

SEQ ID NO: 3967757 - RNA, 22 nt, Staphylococcus aureus subsp. aureus Mu50
aguacaacaguugcaccuaaac

SEQ ID NO: 3967758 - RNA, 15 nt, Staphylococcus aureus subsp. aureus Mu50
aguacacgaauacca

SEQ ID NO: 3967759 - RNA, 16 nt, Staphylococcus aureus subsp. aureus Mu50
aguacagcgguuugua

SEQ ID NO: 3967760 - RNA, 18 nt, Staphylococcus aureus subsp. aureus Mu50
aguacagcgguuuguaug

SEQ ID NO: 3967761 - RNA, 23 nt, Staphylococcus aureus subsp. aureus Mu50
aguacaguuaguggcauuauauu

SEQ ID NO: 3967762 - RNA, 22 nt, Staphylococcus aureus subsp. aureus Mu50
aguacauaaaugcuaaaaguau

SEQ ID NO: 3967763 - RNA, 21 nt, Staphylococcus aureus subsp. aureus Mu50
aguacauuuauuuucaauaaa

SEQ ID NO: 3967764 - RNA, 13 nt, Staphylococcus aureus subsp. aureus Mu50
aguaccuaaaaua

SEQ ID NO: 3967765 - RNA, 15 nt, Staphylococcus aureus subsp. aureus Mu50
aguacgaacaacuaa

SEQ ID NO: 3967766 - RNA, 23 nt, Staphylococcus aureus subsp. aureus Mu50
aguacgcaauuuaauauuauaag

SEQ ID NO: 3967767 - RNA, 18 nt, Staphylococcus aureus subsp. aureus Mu50
aguacggcugcuuuaacu

SEQ ID NO: 3967768 - RNA, 22 nt, Staphylococcus aureus subsp. aureus Mu50
aguacggcugcuuuaacuguac

SEQ ID NO: 3967769 - RNA, 21 nt, Staphylococcus aureus subsp. aureus Mu50
aguacuaaaccgauuaauaua

SEQ ID NO: 3967770 - RNA, 20 nt, Staphylococcus aureus subsp. aureus Mu50
aguacuaagcuuucauuaau

SEQ ID NO: 3967771 - RNA, 22 nt, Staphylococcus aureus subsp. aureus Mu50
aguacuaagcuuucauuaauuu

SEQ ID NO: 3967772 - RNA, 22 nt, Staphylococcus aureus subsp. aureus Mu50
aguacucaauguuaggugcuug

SEQ ID NO: 3967773 - RNA, 21 nt, Staphylococcus aureus subsp. aureus Mu50
aguacuuaauuuaaauuguca

SEQ ID NO: 3967774 - RNA, 23 nt, Staphylococcus aureus subsp. aureus Mu50
aguacuuggaaaauacuauacug

SEQ ID NO: 3967775 - RNA, 16 nt, Staphylococcus aureus subsp. aureus Mu50
aguacuuuaaaauugu

SEQ ID NO: 3967776 - RNA, 23 nt, Staphylococcus aureus subsp. aureus Mu50
aguacuuuaaaauuguauagaau

SEQ ID NO: 3967777 - RNA, 21 nt, Staphylococcus aureus subsp. aureus Mu50
aguacuuucgaguaauacuuu

SEQ ID NO: 3967778 - RNA, 17 nt, Staphylococcus aureus subsp. aureus Mu50
aguacuuuuacaaacuu

SEQ ID NO: 3967779 - RNA, 18 nt, Staphylococcus aureus subsp. aureus Mu50
aguagaauuauuuagaaa

SEQ ID NO: 3967780 - RNA, 19 nt, Staphylococcus aureus subsp. aureus Mu50
aguagauugauauccuuaa

SEQ ID NO: 3967781 - RNA, 21 nt, Staphylococcus aureus subsp. aureus Mu50
aguagauuuauuaaauauaug

SEQ ID NO: 3967782 - RNA, 16 nt, Staphylococcus aureus subsp. aureus Mu50
aguagccacaauuuug

SEQ ID NO: 3967783 - RNA, 17 nt, Staphylococcus aureus subsp. aureus Mu50
aguagcucaaaacaauu

SEQ ID NO: 3967784 - RNA, 20 nt, Staphylococcus aureus subsp. aureus Mu50
aguaggguauugaaauaaua

SEQ ID NO: 3967785 - RNA, 15 nt, Staphylococcus aureus subsp. aureus Mu50
aguaguguauucauu

SEQ ID NO: 3967786 - RNA, 18 nt, Staphylococcus aureus subsp. aureus Mu50
aguaguuaauugaaugaa

SEQ ID NO: 3967787 - RNA, 22 nt, Staphylococcus aureus subsp. aureus Mu50
aguaguuccguugaauuaacaa

SEQ ID NO: 3967788 - RNA, 17 nt, Staphylococcus aureus subsp. aureus Mu50
aguaguuguacuucuuu

SEQ ID NO: 3967789 - RNA, 20 nt, Staphylococcus aureus subsp. aureus Mu50
aguauaaaccgccaacuaau

SEQ ID NO: 3967790 - RNA, 16 nt, Staphylococcus aureus subsp. aureus Mu50
aguauaaacguccaaa

SEQ ID NO: 3967791 - RNA, 16 nt, Staphylococcus aureus subsp. aureus Mu50
aguauaaauaaaaaua

SEQ ID NO: 3967792 - RNA, 20 nt, Staphylococcus aureus subsp. aureus Mu50
aguauaaauaaaaauacaua

SEQ ID NO: 3967793 - RNA, 14 nt, Staphylococcus aureus subsp. aureus Mu50
aguauaaaugcagc

SEQ ID NO: 3967794 - RNA, 15 nt, Staphylococcus aureus subsp. aureus Mu50
aguauaaaugcagcu

SEQ ID NO: 3967795 - RNA, 21 nt, Staphylococcus aureus subsp. aureus Mu50
aguauaaguagcucaaaacaa

SEQ ID NO: 3967796 - RNA, 13 nt, Staphylococcus aureus subsp. aureus Mu50
aguauaauccauc

SEQ ID NO: 3967797 - RNA, 22 nt, Staphylococcus aureus subsp. aureus Mu50
aguauagauagacuuucuugau

SEQ ID NO: 3967798 - RNA, 20 nt, Staphylococcus aureus subsp. aureus Mu50
aguauagcgcagcaaaugcu

SEQ ID NO: 3967799 - RNA, 17 nt, Staphylococcus aureus subsp. aureus Mu50
aguauauaucaaauaca

SEQ ID NO: 3967800 - RNA, 17 nt, Staphylococcus aureus subsp. aureus Mu50
aguauauccgcaucuuu

SEQ ID NO: 3967801 - RNA, 18 nt, Staphylococcus aureus subsp. aureus Mu50
aguauauccgcaucuuuu

SEQ ID NO: 3967802 - RNA, 13 nt, Staphylococcus aureus subsp. aureus Mu50
aguauauucaaca

SEQ ID NO: 3967803 - RNA, 18 nt, Staphylococcus aureus subsp. aureus Mu50
aguaucauaauuuuguuu

SEQ ID NO: 3967804 - RNA, 22 nt, Staphylococcus aureus subsp. aureus Mu50
aguaucauguucuuauaaaaaa

SEQ ID NO: 3967805 - RNA, 21 nt, Staphylococcus aureus subsp. aureus Mu50
aguauccagaguuaaagucau

SEQ ID NO: 3967806 - RNA, 16 nt, Staphylococcus aureus subsp. aureus Mu50
aguauccugauuuaau

SEQ ID NO: 3967807 - RNA, 14 nt, Staphylococcus aureus subsp. aureus Mu50
aguaucgccaucau

SEQ ID NO: 3967808 - RNA, 16 nt, Staphylococcus aureus subsp. aureus Mu50
aguaucgccaucauuc

SEQ ID NO: 3967809 - RNA, 17 nt, Staphylococcus aureus subsp. aureus Mu50
aguaucuaaauauuaaa

SEQ ID NO: 3967810 - RNA, 14 nt, Staphylococcus aureus subsp. aureus Mu50
aguaucuaugaaau

SEQ ID NO: 3967811 - RNA, 18 nt, Staphylococcus aureus subsp. aureus Mu50
aguaugagacgcauugca

SEQ ID NO: 3967812 - RNA, 18 nt, Staphylococcus aureus subsp. aureus Mu50
aguaugauagaugauaca

SEQ ID NO: 3967813 - RNA, 18 nt, Staphylococcus aureus subsp. aureus Mu50
aguauggcgaaauguuuu

SEQ ID NO: 3967814 - RNA, 18 nt, Staphylococcus aureus subsp. aureus Mu50
aguauuaacuauaaauag

SEQ ID NO: 3967815 - RNA, 18 nt, Staphylococcus aureus subsp. aureus Mu50
aguauuagauauauuuga

SEQ ID NO: 3967816 - RNA, 14 nt, Staphylococcus aureus subsp. aureus Mu50
aguauuaucacaua

SEQ ID NO: 3967817 - RNA, 18 nt, Staphylococcus aureus subsp. aureus Mu50
aguauugccaaauuucuc

SEQ ID NO: 3967818 - RNA, 21 nt, Staphylococcus aureus subsp. aureus Mu50
aguauugccguuauuuucaau

SEQ ID NO: 3967819 - RNA, 23 nt, Staphylococcus aureus subsp. aureus Mu50
aguauugccguuauuuucaauaa

SEQ ID NO: 3967820 - RNA, 15 nt, Staphylococcus aureus subsp. aureus Mu50
aguauuguuuuauau

SEQ ID NO: 3967821 - RNA, 21 nt, Staphylococcus aureus subsp. aureus Mu50
aguauuguuuuauauuuaaac

SEQ ID NO: 3967822 - RNA, 22 nt, Staphylococcus aureus subsp. aureus Mu50
aguauuguuuuauauuuaaacu

SEQ ID NO: 3967823 - RNA, 20 nt, Staphylococcus aureus subsp. aureus Mu50
aguauuuacuuuuccuugau

SEQ ID NO: 3967824 - RNA, 18 nt, Staphylococcus aureus subsp. aureus Mu50
aguauuugccuuuugaau

SEQ ID NO: 3967825 - RNA, 21 nt, Staphylococcus aureus subsp. aureus Mu50
aguauuuuugcguuaauaauu

SEQ ID NO: 3967826 - RNA, 16 nt, Staphylococcus aureus subsp. aureus Mu50
agucaacaauugcuaa

SEQ ID NO: 3967827 - RNA, 19 nt, Staphylococcus aureus subsp. aureus Mu50
agucaacaucguauucuuu

SEQ ID NO: 3967828 - RNA, 23 nt, Staphylococcus aureus subsp. aureus Mu50
agugccguccauuuccaugaaua

SEQ ID NO: 3967829 - RNA, 21 nt, Staphylococcus aureus subsp. aureus Mu50
agugcgggggauuauuuauau

SEQ ID NO: 3967830 - RNA, 19 nt, Staphylococcus aureus subsp. aureus Mu50
agugcgguuauuuauacag

SEQ ID NO: 3967831 - RNA, 19 nt, Staphylococcus aureus subsp. aureus Mu50
agugcuuccacuucaucua

SEQ ID NO: 3967832 - RNA, 22 nt, Staphylococcus aureus subsp. aureus Mu50
agugcuuccacuucaucuaaau

SEQ ID NO: 3967833 - RNA, 16 nt, Staphylococcus aureus subsp. aureus Mu50
agugcuuuuaaucaaa

SEQ ID NO: 3967834 - RNA, 18 nt, Staphylococcus aureus subsp. aureus Mu50
agugcuuuuaaucaaauu

SEQ ID NO: 3967835 - RNA, 14 nt, Staphylococcus aureus subsp. aureus Mu50
aguggaaauuaugu

SEQ ID NO: 3967836 - RNA, 18 nt, Staphylococcus aureus subsp. aureus Mu50
aguggaucacgauaaugu

SEQ ID NO: 3967837 - RNA, 19 nt, Staphylococcus aureus subsp. aureus Mu50
aguggauuacagaugaugc

SEQ ID NO: 3967838 - RNA, 15 nt, Staphylococcus aureus subsp. aureus Mu50
agugguguuuauauc

SEQ ID NO: 3967839 - RNA, 22 nt, Staphylococcus aureus subsp. aureus Mu50
aguguaauguuccccugaaaag

SEQ ID NO: 3967840 - RNA, 13 nt, Staphylococcus aureus subsp. aureus Mu50
aguguaccuuguu

SEQ ID NO: 3967841 - RNA, 17 nt, Staphylococcus aureus subsp. aureus Mu50
aguguagccaaauaaau

SEQ ID NO: 3967842 - RNA, 17 nt, Staphylococcus aureus subsp. aureus Mu50
aguguauucauuuuaaa

SEQ ID NO: 3967843 - RNA, 19 nt, Staphylococcus aureus subsp. aureus Mu50
aguguauucauuuuaaauu

SEQ ID NO: 3967844 - RNA, 16 nt, Staphylococcus aureus subsp. aureus Mu50
agugucacaaagaaau

SEQ ID NO: 3967845 - RNA, 15 nt, Staphylococcus aureus subsp. aureus Mu50
agugucgagauuuua

SEQ ID NO: 3967846 - RNA, 23 nt, Staphylococcus aureus subsp. aureus Mu50
agugugcaggauaacguucacuu

SEQ ID NO: 3967847 - RNA, 13 nt, Staphylococcus aureus subsp. aureus Mu50
aguguuauauugu

SEQ ID NO: 3967848 - RNA, 19 nt, Staphylococcus aureus subsp. aureus Mu50
aguguugaauuucaaaaua

SEQ ID NO: 3967849 - RNA, 19 nt, Staphylococcus aureus subsp. aureus Mu50
aguguugaggcguuucaga

SEQ ID NO: 3967850 - RNA, 17 nt, Staphylococcus aureus subsp. aureus Mu50
aguguuuaugaaagucu

SEQ ID NO: 3967851 - RNA, 13 nt, Staphylococcus aureus subsp. aureus Mu50
aguguuucauaau

SEQ ID NO: 3967852 - RNA, 13 nt, Staphylococcus aureus subsp. aureus Mu50
aguguuuguaaug

SEQ ID NO: 3967853 - RNA, 19 nt, Staphylococcus aureus subsp. aureus Mu50
aguguuuuauucgauaaua

SEQ ID NO: 3967854 - RNA, 16 nt, Staphylococcus aureus subsp. aureus Mu50
aguuaaaaauguaaau

SEQ ID NO: 3967855 - RNA, 11 nt, Staphylococcus aureus subsp. aureus Mu50
aguuaaaaccu

SEQ ID NO: 3967856 - RNA, 20 nt, Staphylococcus aureus subsp. aureus Mu50
aguuaaaaccuuuucaaauu

SEQ ID NO: 3967857 - RNA, 23 nt, Staphylococcus aureus subsp. aureus Mu50
aguuaaaaccuuuucaaauuaua

SEQ ID NO: 3967858 - RNA, 19 nt, Staphylococcus aureus subsp. aureus Mu50
aguuaaaauucaguaucua

SEQ ID NO: 3967859 - RNA, 18 nt, Staphylococcus aureus subsp. aureus Mu50
aguuaaagucauaggcuu

SEQ ID NO: 3967860 - RNA, 16 nt, Staphylococcus aureus subsp. aureus Mu50
aguuaaaucacugcuu

SEQ ID NO: 3967861 - RNA, 19 nt, Staphylococcus aureus subsp. aureus Mu50
aguuaaaucacugcuuuca

SEQ ID NO: 3967862 - RNA, 14 nt, Staphylococcus aureus subsp. aureus Mu50
aguuaaaucuguau

SEQ ID NO: 3967863 - RNA, 23 nt, Staphylococcus aureus subsp. aureus Mu50
aguuaaaucuuuaacuucugauu

SEQ ID NO: 3967864 - RNA, 20 nt, Staphylococcus aureus subsp. aureus Mu50
aguuaacggcguauucaauu

SEQ ID NO: 3967865 - RNA, 15 nt, Staphylococcus aureus subsp. aureus Mu50
aguuaacuauaacaa

SEQ ID NO: 3967866 - RNA, 20 nt, Staphylococcus aureus subsp. aureus Mu50
aguuaagugucuauguugaa

SEQ ID NO: 3967867 - RNA, 15 nt, Staphylococcus aureus subsp. aureus Mu50
aguuaauguaaaguu

SEQ ID NO: 3967868 - RNA, 12 nt, Staphylococcus aureus subsp. aureus Mu50
aguuaauuaugu

SEQ ID NO: 3967869 - RNA, 13 nt, Staphylococcus aureus subsp. aureus Mu50
aguuaauuauuua

SEQ ID NO: 3967870 - RNA, 21 nt, Staphylococcus aureus subsp. aureus Mu50
aguuacaaugcgguauugcau

SEQ ID NO: 3967871 - RNA, 15 nt, Staphylococcus aureus subsp. aureus Mu50
aguuacaugcucuuu

SEQ ID NO: 3967872 - RNA, 17 nt, Staphylococcus aureus subsp. aureus Mu50
aguuaccuacuacauuc

SEQ ID NO: 3967873 - RNA, 18 nt, Staphylococcus aureus subsp. aureus Mu50
aguuagaagaugauuauu

SEQ ID NO: 3967874 - RNA, 15 nt, Staphylococcus aureus subsp. aureus Mu50
aguuagacuaaaaaa

SEQ ID NO: 3967875 - RNA, 20 nt, Staphylococcus aureus subsp. aureus Mu50
aguuaggcgacuuaacuuaa

SEQ ID NO: 3967876 - RNA, 21 nt, Staphylococcus aureus subsp. aureus Mu50
aguuaggcgacuuaacuuaag

SEQ ID NO: 3967877 - RNA, 15 nt, Staphylococcus aureus subsp. aureus Mu50
aguuagguccuuuca

SEQ ID NO: 3967878 - RNA, 19 nt, Staphylococcus aureus subsp. aureus Mu50
aguuauaccauauuuaugg

SEQ ID NO: 3967879 - RNA, 15 nt, Staphylococcus aureus subsp. aureus Mu50
aguuauaucaucaac

SEQ ID NO: 3967880 - RNA, 14 nt, Staphylococcus aureus subsp. aureus Mu50
aguuauauuguuaa

SEQ ID NO: 3967881 - RNA, 20 nt, Staphylococcus aureus subsp. aureus Mu50
aguuaucggcuaaaguuaua

SEQ ID NO: 3967882 - RNA, 22 nt, Staphylococcus aureus subsp. aureus Mu50
aguuaucggcuaaaguuauaaa

SEQ ID NO: 3967883 - RNA, 17 nt, Staphylococcus aureus subsp. aureus Mu50
aguuaugacuaacgaaa

SEQ ID NO: 3967884 - RNA, 12 nt, Staphylococcus aureus subsp. aureus Mu50
aguuauuaaauc

SEQ ID NO: 3967885 - RNA, 15 nt, Staphylococcus aureus subsp. aureus Mu50
aguuauuuuaauaac

SEQ ID NO: 3967886 - RNA, 15 nt, Staphylococcus aureus subsp. aureus Mu50
aguucaaaauacuca

SEQ ID NO: 3967887 - RNA, 20 nt, Staphylococcus aureus subsp. aureus Mu50
aguucaaagcgauaaaguau

SEQ ID NO: 3967888 - RNA, 16 nt, Staphylococcus aureus subsp. aureus Mu50
aguucaaauugaacuu

SEQ ID NO: 3967889 - RNA, 19 nt, Staphylococcus aureus subsp. aureus Mu50
aguucaacagggguuuuua

SEQ ID NO: 3967890 - RNA, 15 nt, Staphylococcus aureus subsp. aureus Mu50
aguucacaacaaagu

SEQ ID NO: 3967891 - RNA, 13 nt, Staphylococcus aureus subsp. aureus Mu50
aguucacaugaau

SEQ ID NO: 3967892 - RNA, 21 nt, Staphylococcus aureus subsp. aureus Mu50
aguucaccguaaucuuuuaac

SEQ ID NO: 3967893 - RNA, 20 nt, Staphylococcus aureus subsp. aureus Mu50
aguucacuaaauucaauaau

SEQ ID NO: 3967894 - RNA, 16 nt, Staphylococcus aureus subsp. aureus Mu50
aguucaggaucaagug

SEQ ID NO: 3967895 - RNA, 19 nt, Staphylococcus aureus subsp. aureus Mu50
aguucaucuggugcaauau

SEQ ID NO: 3967896 - RNA, 18 nt, Staphylococcus aureus subsp. aureus Mu50
aguuccguugaauuaaca

SEQ ID NO: 3967897 - RNA, 16 nt, Staphylococcus aureus subsp. aureus Mu50
aguucgaacacacacu

SEQ ID NO: 3967898 - RNA, 21 nt, Staphylococcus aureus subsp. aureus Mu50
aguucuagauuauuuaaaaau

SEQ ID NO: 3967899 - RNA, 21 nt, Staphylococcus aureus subsp. aureus Mu50
aguucuauagguuuauaaaaa

SEQ ID NO: 3967900 - RNA, 15 nt, Staphylococcus aureus subsp. aureus Mu50
aguucuauauaauuu

SEQ ID NO: 3967901 - RNA, 16 nt, Staphylococcus aureus subsp. aureus Mu50
aguucuauauaauuua

SEQ ID NO: 3967902 - RNA, 14 nt, Staphylococcus aureus subsp. aureus Mu50
aguucuuagauuuu

SEQ ID NO: 3967903 - RNA, 21 nt, Staphylococcus aureus subsp. aureus Mu50
aguugaaaauaaucgaacaga

SEQ ID NO: 3967904 - RNA, 16 nt, Staphylococcus aureus subsp. aureus Mu50
aguugaagaaauuuga

SEQ ID NO: 3967905 - RNA, 22 nt, Staphylococcus aureus subsp. aureus Mu50
aguugaagcuaauucauauuca

SEQ ID NO: 3967906 - RNA, 15 nt, Staphylococcus aureus subsp. aureus Mu50
aguugaauauaaaaa

SEQ ID NO: 3967907 - RNA, 14 nt, Staphylococcus aureus subsp. aureus Mu50
aguugacaauacaa

SEQ ID NO: 3967908 - RNA, 15 nt, Staphylococcus aureus subsp. aureus Mu50
aguugacaauacaaa

SEQ ID NO: 3967909 - RNA, 17 nt, Staphylococcus aureus subsp. aureus Mu50
aguugagucaauuucuu

SEQ ID NO: 3967910 - RNA, 22 nt, Staphylococcus aureus subsp. aureus Mu50
aguugaucaaaaauguuaucua

SEQ ID NO: 3967911 - RNA, 22 nt, Staphylococcus aureus subsp. aureus Mu50
aguugauuuaagauuuaauaaa

SEQ ID NO: 3967912 - RNA, 21 nt, Staphylococcus aureus subsp. aureus Mu50
aguugcacauuauaaagcugc

SEQ ID NO: 3967913 - RNA, 22 nt, Staphylococcus aureus subsp. aureus Mu50
aguugcauaaucaauuucaccu

SEQ ID NO: 3967914 - RNA, 16 nt, Staphylococcus aureus subsp. aureus Mu50
aguugcugaauaaaau

SEQ ID NO: 3967915 - RNA, 17 nt, Staphylococcus aureus subsp. aureus Mu50
aguugcugaauaaaaua

SEQ ID NO: 3967916 - RNA, 20 nt, Staphylococcus aureus subsp. aureus Mu50
aguuggcugauagaugaaaa

SEQ ID NO: 3967917 - RNA, 16 nt, Staphylococcus aureus subsp. aureus Mu50
aguuggggaugggccc

SEQ ID NO: 3967918 - RNA, 14 nt, Staphylococcus aureus subsp. aureus Mu50
aguugguuuagaca

SEQ ID NO: 3967919 - RNA, 19 nt, Staphylococcus aureus subsp. aureus Mu50
aguuguacuacuugauucu

SEQ ID NO: 3967920 - RNA, 15 nt, Staphylococcus aureus subsp. aureus Mu50
aguuguccauuuuau

SEQ ID NO: 3967921 - RNA, 18 nt, Staphylococcus aureus subsp. aureus Mu50
aguuguccauuuuaugca

SEQ ID NO: 3967922 - RNA, 13 nt, Staphylococcus aureus subsp. aureus Mu50
aguuguguaauaa

SEQ ID NO: 3967923 - RNA, 21 nt, Staphylococcus aureus subsp. aureus Mu50
aguuguuauauucuagauuca

SEQ ID NO: 3967924 - RNA, 17 nt, Staphylococcus aureus subsp. aureus Mu50
aguuguuauuuuugcua

SEQ ID NO: 3967925 - RNA, 18 nt, Staphylococcus aureus subsp. aureus Mu50
aguuguugaaauuucugu

SEQ ID NO: 3967926 - RNA, 22 nt, Staphylococcus aureus subsp. aureus Mu50
aguuguuuuuuguuuucaaaug

SEQ ID NO: 3967927 - RNA, 15 nt, Staphylococcus aureus subsp. aureus Mu50
aguuuaacaauacua

SEQ ID NO: 3967928 - RNA, 17 nt, Staphylococcus aureus subsp. aureus Mu50
aguuuaagucuaacuuu

SEQ ID NO: 3967929 - RNA, 21 nt, Staphylococcus aureus subsp. aureus Mu50
aguuuaaucguauuagccaau

SEQ ID NO: 3967930 - RNA, 20 nt, Staphylococcus aureus subsp. aureus Mu50
aguuuacgaucauaaauauu

SEQ ID NO: 3967931 - RNA, 23 nt, Staphylococcus aureus subsp. aureus Mu50
aguuuagauucacuguauaaaua

SEQ ID NO: 3967932 - RNA, 17 nt, Staphylococcus aureus subsp. aureus Mu50
aguuuagguugauuucu

SEQ ID NO: 3967933 - RNA, 21 nt, Staphylococcus aureus subsp. aureus Mu50
aguuuauaaucuuuuuuacua

SEQ ID NO: 3967934 - RNA, 22 nt, Staphylococcus aureus subsp. aureus Mu50
aguuuaucuucaguaauuucuc

SEQ ID NO: 3967935 - RNA, 14 nt, Staphylococcus aureus subsp. aureus Mu50
aguuuauuaauauu

SEQ ID NO: 3967936 - RNA, 16 nt, Staphylococcus aureus subsp. aureus Mu50
aguuuauuaauauuag

SEQ ID NO: 3967937 - RNA, 18 nt, Staphylococcus aureus subsp. aureus Mu50
aguuucaucuucaacuuu

SEQ ID NO: 3967938 - RNA, 21 nt, Staphylococcus aureus subsp. aureus Mu50
aguuuccauaaauaaaaugcu

SEQ ID NO: 3967939 - RNA, 17 nt, Staphylococcus aureus subsp. aureus Mu50
aguuucgcagcuuuaua

SEQ ID NO: 3967940 - RNA, 15 nt, Staphylococcus aureus subsp. aureus Mu50
aguuucguuguacag

SEQ ID NO: 3967941 - RNA, 13 nt, Staphylococcus aureus subsp. aureus Mu50
aguuugaaauaau

SEQ ID NO: 3967942 - RNA, 19 nt, Staphylococcus aureus subsp. aureus Mu50
aguuugaaggugauaaugu

SEQ ID NO: 3967943 - RNA, 14 nt, Staphylococcus aureus subsp. aureus Mu50
aguuugacaucuau

SEQ ID NO: 3967944 - RNA, 22 nt, Staphylococcus aureus subsp. aureus Mu50
aguuugaucauaauucaguguu

SEQ ID NO: 3967945 - RNA, 18 nt, Staphylococcus aureus subsp. aureus Mu50
aguuuguuggucuuucuu

SEQ ID NO: 3967946 - RNA, 15 nt, Staphylococcus aureus subsp. aureus Mu50
aguuuguuucuaaau

SEQ ID NO: 3967947 - RNA, 16 nt, Staphylococcus aureus subsp. aureus Mu50
aguuuguuucuaaauu

SEQ ID NO: 3967948 - RNA, 20 nt, Staphylococcus aureus subsp. aureus Mu50
aguuuguuucuaaauucuuu

SEQ ID NO: 3967949 - RNA, 15 nt, Staphylococcus aureus subsp. aureus Mu50
aguuuuauuuauaaa

SEQ ID NO: 3967950 - RNA, 22 nt, Staphylococcus aureus subsp. aureus Mu50
aguuuuauuuauaaacaauaaa

SEQ ID NO: 3967951 - RNA, 19 nt, Staphylococcus aureus subsp. aureus Mu50
aguuuucaggaauuguuaa

SEQ ID NO: 3967952 - RNA, 22 nt, Staphylococcus aureus subsp. aureus Mu50
aguuuucauuuuuucaaugucu

SEQ ID NO: 3967953 - RNA, 21 nt, Staphylococcus aureus subsp. aureus Mu50
aguuuucggcuagauuuuaaa

SEQ ID NO: 3967954 - RNA, 19 nt, Staphylococcus aureus subsp. aureus Mu50
aguuuugaagaauaaaaaa

SEQ ID NO: 3967955 - RNA, 17 nt, Staphylococcus aureus subsp. aureus Mu50
aguuuuugaauaucuaa

SEQ ID NO: 3967956 - RNA, 22 nt, Staphylococcus aureus subsp. aureus Mu50
aguuuuugguagcauuuuagau

SEQ ID NO: 3967957 - RNA, 16 nt, Staphylococcus aureus subsp. aureus Mu50
aguuuuuuaaaauaau

SEQ ID NO: 3967958 - RNA, 16 nt, Staphylococcus aureus subsp. aureus Mu50
aguuuuuuuaaaguuu

SEQ ID NO: 3967959 - RNA, 15 nt, Staphylococcus aureus subsp. aureus Mu50
auaaaaaaauuaacu

SEQ ID NO: 3967960 - RNA, 17 nt, Staphylococcus aureus subsp. aureus Mu50
auaaaaaaauuaacuau

SEQ ID NO: 3967961 - RNA, 13 nt, Staphylococcus aureus subsp. aureus Mu50
auaaaaaacaaua

SEQ ID NO: 3967962 - RNA, 12 nt, Staphylococcus aureus subsp. aureus Mu50
auaaaaaauaac

SEQ ID NO: 3967963 - RNA, 14 nt, Staphylococcus aureus subsp. aureus Mu50
auaaaaaauaacuc

SEQ ID NO: 3967964 - RNA, 14 nt, Staphylococcus aureus subsp. aureus Mu50
auaaaaaaugaaug

SEQ ID NO: 3967965 - RNA, 13 nt, Staphylococcus aureus subsp. aureus Mu50
auaaaaaauuauu

SEQ ID NO: 3967966 - RNA, 17 nt, Staphylococcus aureus subsp. aureus Mu50
auaaaaacagcagugaa

SEQ ID NO: 3967967 - RNA, 19 nt, Staphylococcus aureus subsp. aureus Mu50
auaaaaacagcagugaagu

SEQ ID NO: 3967968 - RNA, 18 nt, Staphylococcus aureus subsp. aureus Mu50
auaaaaacucuaaaaguu

SEQ ID NO: 3967969 - RNA, 19 nt, Staphylococcus aureus subsp. aureus Mu50
auaaaaagaauaugauauu

SEQ ID NO: 3967970 - RNA, 18 nt, Staphylococcus aureus subsp. aureus Mu50
auaaaaagaucauuaaaa

SEQ ID NO: 3967971 - RNA, 18 nt, Staphylococcus aureus subsp. aureus Mu50
auaaaaaggagcgacaau

SEQ ID NO: 3967972 - RNA, 12 nt, Staphylococcus aureus subsp. aureus Mu50
auaaaaauaaaa

SEQ ID NO: 3967973 - RNA, 16 nt, Staphylococcus aureus subsp. aureus Mu50
auaaaaauacauaauu

SEQ ID NO: 3967974 - RNA, 17 nt, Staphylococcus aureus subsp. aureus Mu50
auaaaaaucuuggugau

SEQ ID NO: 3967975 - RNA, 21 nt, Staphylococcus aureus subsp. aureus Mu50
auaaaacaagacuacgaauac

SEQ ID NO: 3967976 - RNA, 16 nt, Staphylococcus aureus subsp. aureus Mu50
auaaaaccuucaauca

SEQ ID NO: 3967977 - RNA, 20 nt, Staphylococcus aureus subsp. aureus Mu50
auaaaacgacucauuauaaa

SEQ ID NO: 3967978 - RNA, 15 nt, Staphylococcus aureus subsp. aureus Mu50
auaaaacgauaagaa

SEQ ID NO: 3967979 - RNA, 22 nt, Staphylococcus aureus subsp. aureus Mu50
auaaaacgugcaaauaaaaaag

SEQ ID NO: 3967980 - RNA, 17 nt, Staphylococcus aureus subsp. aureus Mu50
auaaaacuaauuaggua

SEQ ID NO: 3967981 - RNA, 13 nt, Staphylococcus aureus subsp. aureus Mu50
auaaaacuuacau

SEQ ID NO: 3967982 - RNA, 20 nt, Staphylococcus aureus subsp. aureus Mu50
auaaaacuuacauuacauau

SEQ ID NO: 3967983 - RNA, 21 nt, Staphylococcus aureus subsp. aureus Mu50
auaaaacuuacauuacauaua

SEQ ID NO: 3967984 - RNA, 23 nt, Staphylococcus aureus subsp. aureus Mu50
auaaaacuuacauuacauauauc

SEQ ID NO: 3967985 - RNA, 19 nt, Staphylococcus aureus subsp. aureus Mu50
auaaaacuuauaacugaua

SEQ ID NO: 3967986 - RNA, 21 nt, Staphylococcus aureus subsp. aureus Mu50
auaaaagauauaaacauuuau

SEQ ID NO: 3967987 - RNA, 18 nt, Staphylococcus aureus subsp. aureus Mu50
auaaaagccucuaaugau

SEQ ID NO: 3967988 - RNA, 20 nt, Staphylococcus aureus subsp. aureus Mu50
auaaaaguacuuuaaaauug

SEQ ID NO: 3967989 - RNA, 16 nt, Staphylococcus aureus subsp. aureus Mu50
auaaaagucgauaaau

SEQ ID NO: 3967990 - RNA, 18 nt, Staphylococcus aureus subsp. aureus Mu50
auaaaagucgauaaauau

SEQ ID NO: 3967991 - RNA, 19 nt, Staphylococcus aureus subsp. aureus Mu50
auaaaagucgauaaauaug

SEQ ID NO: 3967992 - RNA, 16 nt, Staphylococcus aureus subsp. aureus Mu50
auaaaaguuaggcgac

SEQ ID NO: 3967993 - RNA, 21 nt, Staphylococcus aureus subsp. aureus Mu50
auaaaaguuaggcgacuuaac

SEQ ID NO: 3967994 - RNA, 17 nt, Staphylococcus aureus subsp. aureus Mu50
auaaaauaaaaaaauga

SEQ ID NO: 3967995 - RNA, 12 nt, Staphylococcus aureus subsp. aureus Mu50
auaaaauaaaau

SEQ ID NO: 3967996 - RNA, 12 nt, Staphylococcus aureus subsp. aureus Mu50
auaaaauaaaua

SEQ ID NO: 3967997 - RNA, 13 nt, Staphylococcus aureus subsp. aureus Mu50
auaaaauaaauaa

SEQ ID NO: 3967998 - RNA, 23 nt, Staphylococcus aureus subsp. aureus Mu50
auaaaauaauuguucuucagaaa

SEQ ID NO: 3967999 - RNA, 23 nt, Staphylococcus aureus subsp. aureus Mu50
auaaaauaccagaugaaccaaaa

SEQ ID NO: 3968000 - RNA, 20 nt, Staphylococcus aureus subsp. aureus Mu50
auaaaauauaucuuaugaua

SEQ ID NO: 3968001 - RNA, 18 nt, Staphylococcus aureus subsp. aureus Mu50
auaaaaucauuaauaauu

SEQ ID NO: 3968002 - RNA, 22 nt, Staphylococcus aureus subsp. aureus Mu50
auaaauccuaagucuuuuaaau

SEQ ID NO: 3968003 - RNA, 16 nt, Staphylococcus aureus subsp. aureus Mu50
auaaaucgauaaaaug

SEQ ID NO: 3968004 - RNA, 20 nt, Staphylococcus aureus subsp. aureus Mu50
auaaaucgauaaaauguacg

SEQ ID NO: 3968005 - RNA, 14 nt, Staphylococcus aureus subsp. aureus Mu50
auaaaucuaauacu

SEQ ID NO: 3968006 - RNA, 15 nt, Staphylococcus aureus subsp. aureus Mu50
auaaaucuaucuacu

SEQ ID NO: 3968007 - RNA, 19 nt, Staphylococcus aureus subsp. aureus Mu50
auaaaugaauuauuuaaaa

SEQ ID NO: 3968008 - RNA, 22 nt, Staphylococcus aureus subsp. aureus Mu50
auaaaugaauuauuuaaaaugc

SEQ ID NO: 3968009 - RNA, 13 nt, Staphylococcus aureus subsp. aureus Mu50
auaaaugacauuu

SEQ ID NO: 3968010 - RNA, 18 nt, Staphylococcus aureus subsp. aureus Mu50
auaaaugacuucacauuu

SEQ ID NO: 3968011 - RNA, 22 nt, Staphylococcus aureus subsp. aureus Mu50
auaaaugcagcuguauaaccau

SEQ ID NO: 3968012 - RNA, 17 nt, Staphylococcus aureus subsp. aureus Mu50
auaaaugcuaaaaguau

SEQ ID NO: 3968013 - RNA, 20 nt, Staphylococcus aureus subsp. aureus Mu50
auaaaugcuaaaaguauaaa

SEQ ID NO: 3968014 - RNA, 21 nt, Staphylococcus aureus subsp. aureus Mu50
auaaaugucacugcaaacaca

SEQ ID NO: 3968015 - RNA, 12 nt, Staphylococcus aureus subsp. aureus Mu50
auaaauguuaaa

SEQ ID NO: 3968016 - RNA, 19 nt, Staphylococcus aureus subsp. aureus Mu50
auaaauguuaaagauuauu

SEQ ID NO: 3968017 - RNA, 18 nt, Staphylococcus aureus subsp. aureus Mu50
auaaauguuauugcuuau

SEQ ID NO: 3968018 - RNA, 16 nt, Staphylococcus aureus subsp. aureus Mu50
auaaauguuuauaucu

SEQ ID NO: 3968019 - RNA, 14 nt, Staphylococcus aureus subsp. aureus Mu50
auaaauuaauauga

SEQ ID NO: 3968020 - RNA, 15 nt, Staphylococcus aureus subsp. aureus Mu50
auaaauuaauaugaa

SEQ ID NO: 3968021 - RNA, 18 nt, Staphylococcus aureus subsp. aureus Mu50
auaaauucucuaauuucu

SEQ ID NO: 3968022 - RNA, 19 nt, Staphylococcus aureus subsp. aureus Mu50
auaaauucucuuggauagu

SEQ ID NO: 3968023 - RNA, 15 nt, Staphylococcus aureus subsp. aureus Mu50
auaaauugaaguaca

SEQ ID NO: 3968024 - RNA, 22 nt, Staphylococcus aureus subsp. aureus Mu50
auaaauugaguuuuuuaaaaua

SEQ ID NO: 3968025 - RNA, 13 nt, Staphylococcus aureus subsp. aureus Mu50
auaaauugauauu

SEQ ID NO: 3968026 - RNA, 20 nt, Staphylococcus aureus subsp. aureus Mu50
auaaauuuaacguuauucau

SEQ ID NO: 3968027 - RNA, 22 nt, Staphylococcus aureus subsp. aureus Mu50
auaaauuuaacguuauucauuu

SEQ ID NO: 3968028 - RNA, 15 nt, Staphylococcus aureus subsp. aureus Mu50
auaaauuuagauauu

SEQ ID NO: 3968029 - RNA, 21 nt, Staphylococcus aureus subsp. aureus Mu50
auaaauuucaagguauacaca

SEQ ID NO: 3968030 - RNA, 23 nt, Staphylococcus aureus subsp. aureus Mu50
auaaauuuguaccaaauaaauua

SEQ ID NO: 3968031 - RNA, 19 nt, Staphylococcus aureus subsp. aureus Mu50
auaaauuuuacgaaaauau

SEQ ID NO: 3968032 - RNA, 21 nt, Staphylococcus aureus subsp. aureus Mu50
auaaauuuucuguuuaauuaa

SEQ ID NO: 3968033 - RNA, 17 nt, Staphylococcus aureus subsp. aureus Mu50
auaaauuuugaauuaca

SEQ ID NO: 3968034 - RNA, 19 nt, Staphylococcus aureus subsp. aureus Mu50
auaaauuuugaauuacaga

SEQ ID NO: 3968035 - RNA, 19 nt, Staphylococcus aureus subsp. aureus Mu50
auaaauuuugcgaaaauau

SEQ ID NO: 3968036 - RNA, 17 nt, Staphylococcus aureus subsp. aureus Mu50
auaaauuuuuaguuaaa

SEQ ID NO: 3968037 - RNA, 14 nt, Staphylococcus aureus subsp. aureus Mu50
auaacaaaacgauu

SEQ ID NO: 3968038 - RNA, 11 nt, Staphylococcus aureus subsp. aureus Mu50
auaacaaacau

SEQ ID NO: 3968039 - RNA, 16 nt, Staphylococcus aureus subsp. aureus Mu50
auaacaacuacuuaaa

SEQ ID NO: 3968040 - RNA, 16 nt, Staphylococcus aureus subsp. aureus Mu50
auaacaauuuauuaaa

SEQ ID NO: 3968041 - RNA, 18 nt, Staphylococcus aureus subsp. aureus Mu50
auaacaauuuuaaaucuu

SEQ ID NO: 3968042 - RNA, 12 nt, Staphylococcus aureus subsp. aureus Mu50
auaacacaaguu

SEQ ID NO: 3968043 - RNA, 14 nt, Staphylococcus aureus subsp. aureus Mu50
auaacaccaauuaa

SEQ ID NO: 3968044 - RNA, 18 nt, Staphylococcus aureus subsp. aureus Mu50
auaacaccuacugauuga

SEQ ID NO: 3968045 - RNA, 16 nt, Staphylococcus aureus subsp. aureus Mu50
auaacaccuuucauuu

SEQ ID NO: 3968046 - RNA, 19 nt, Staphylococcus aureus subsp. aureus Mu50
auaacagcuaaaaauucug

SEQ ID NO: 3968047 - RNA, 16 nt, Staphylococcus aureus subsp. aureus Mu50
auaacagcuacaaaua

SEQ ID NO: 3968048 - RNA, 17 nt, Staphylococcus aureus subsp. aureus Mu50
auaacagcuacaaauaa

SEQ ID NO: 3968049 - RNA, 18 nt, Staphylococcus aureus subsp. aureus Mu50
auaacagcuacaaauaau

SEQ ID NO: 3968050 - RNA, 21 nt, Staphylococcus aureus subsp. aureus Mu50
auaacagcuacaaauaaugag

SEQ ID NO: 3968051 - RNA, 22 nt, Staphylococcus aureus subsp. aureus Mu50
auaacaggugcuuacuuuuaaa

SEQ ID NO: 3968052 - RNA, 16 nt, Staphylococcus aureus subsp. aureus Mu50
auaacauacguuauuu

SEQ ID NO: 3968053 - RNA, 15 nt, Staphylococcus aureus subsp. aureus Mu50
auaacaucaaauaga

SEQ ID NO: 3968054 - RNA, 13 nt, Staphylococcus aureus subsp. aureus Mu50
auaacaucuaaau

SEQ ID NO: 3968055 - RNA, 18 nt, Staphylococcus aureus subsp. aureus Mu50
auaacauucuucaaaaaa

SEQ ID NO: 3968056 - RNA, 19 nt, Staphylococcus aureus subsp. aureus Mu50
auaacauucuucaaaaaau

SEQ ID NO: 3968057 - RNA, 23 nt, Staphylococcus aureus subsp. aureus Mu50
auaacauugaacgauaacaauuu

SEQ ID NO: 3968058 - RNA, 15 nt, Staphylococcus aureus subsp. aureus Mu50
auaacauuuaagaaa

SEQ ID NO: 3968059 - RNA, 22 nt, Staphylococcus aureus subsp. aureus Mu50
auaaccaccaucccauuaaacc

SEQ ID NO: 3968060 - RNA, 17 nt, Staphylococcus aureus subsp. aureus Mu50
auaaccauguaaaauua

SEQ ID NO: 3968061 - RNA, 18 nt, Staphylococcus aureus subsp. aureus Mu50
auaaccauguaaaauuag

SEQ ID NO: 3968062 - RNA, 17 nt, Staphylococcus aureus subsp. aureus Mu50
auaaccauguauaucua

SEQ ID NO: 3968063 - RNA, 15 nt, Staphylococcus aureus subsp. aureus Mu50
auaaccauuaugauu

SEQ ID NO: 3968064 - RNA, 17 nt, Staphylococcus aureus subsp. aureus Mu50
auaaccauuucaucaua

SEQ ID NO: 3968065 - RNA, 17 nt, Staphylococcus aureus subsp. aureus Mu50
auaacccauuuucaaaa

SEQ ID NO: 3968066 - RNA, 19 nt, Staphylococcus aureus subsp. aureus Mu50
auaaccgaaauauuguaau

SEQ ID NO: 3968067 - RNA, 16 nt, Staphylococcus aureus subsp. aureus Mu50
auaaccgcuacaauua

SEQ ID NO: 3968068 - RNA, 17 nt, Staphylococcus aureus subsp. aureus Mu50
auaaccgucacaaacca

SEQ ID NO: 3968069 - RNA, 20 nt, Staphylococcus aureus subsp. aureus Mu50
auaaccgucacaaaccauuc

SEQ ID NO: 3968070 - RNA, 20 nt, Staphylococcus aureus subsp. aureus Mu50
auaaccuaauucgccaucuu

SEQ ID NO: 3968071 - RNA, 22 nt, Staphylococcus aureus subsp. aureus Mu50
auaaccuagguuaaagauggcu

SEQ ID NO: 3968072 - RNA, 14 nt, Staphylococcus aureus subsp. aureus Mu50
auaaccuguaauug

SEQ ID NO: 3968073 - RNA, 23 nt, Staphylococcus aureus subsp. aureus Mu50
auaaccuuguucuuuacuccaaa

SEQ ID NO: 3968074 - RNA, 15 nt, Staphylococcus aureus subsp. aureus Mu50
auaaccuuuaaaaca

SEQ ID NO: 3968075 - RNA, 14 nt, Staphylococcus aureus subsp. aureus Mu50
auaacgacacuuuu

SEQ ID NO: 3968076 - RNA, 20 nt, Staphylococcus aureus subsp. aureus Mu50
auaacgacacuuuuuaguga

SEQ ID NO: 3968077 - RNA, 19 nt, Staphylococcus aureus subsp. aureus Mu50
auaacgagcaguauauauc

SEQ ID NO: 3968078 - RNA, 20 nt, Staphylococcus aureus subsp. aureus Mu50
auaacgagcaguauauauca

SEQ ID NO: 3968079 - RNA, 24 nt, Staphylococcus aureus subsp. aureus Mu50
auaacgagcaguauauaucaaaua

SEQ ID NO: 3968080 - RNA, 16 nt, Staphylococcus aureus subsp. aureus Mu50
auaacgucauauguuu

SEQ ID NO: 3968081 - RNA, 16 nt, Staphylococcus aureus subsp. aureus Mu50
auaacguucuguuuug

SEQ ID NO: 3968082 - RNA, 20 nt, Staphylococcus aureus subsp. aureus Mu50
auaacuagaacaagaauuau

SEQ ID NO: 3968083 - RNA, 14 nt, Staphylococcus aureus subsp. aureus Mu50
auaacuagaaugau

SEQ ID NO: 3968084 - RNA, 14 nt, Staphylococcus aureus subsp. aureus Mu50
auaacuagcaauuu

SEQ ID NO: 3968085 - RNA, 15 nt, Staphylococcus aureus subsp. aureus Mu50
auaacuauaaucauu

SEQ ID NO: 3968086 - RNA, 20 nt, Staphylococcus aureus subsp. aureus Mu50
auaacuauggucaucaauug

SEQ ID NO: 3968087 - RNA, 16 nt, Staphylococcus aureus subsp. aureus Mu50
auaacucaaauaucua

SEQ ID NO: 3968088 - RNA, 21 nt, Staphylococcus aureus subsp. aureus Mu50
auaacucaaauaucuaaacaa

SEQ ID NO: 3968089 - RNA, 21 nt, Staphylococcus aureus subsp. aureus Mu50
auaauauaaaacgauaagaau

SEQ ID NO: 3968090 - RNA, 13 nt, Staphylococcus aureus subsp. aureus Mu50
auaauauaaauaa

SEQ ID NO: 3968091 - RNA, 14 nt, Staphylococcus aureus subsp. aureus Mu50
auaauauaaauaaa

SEQ ID NO: 3968092 - RNA, 16 nt, Staphylococcus aureus subsp. aureus Mu50
auaauauaacaugcua

SEQ ID NO: 3968093 - RNA, 13 nt, Staphylococcus aureus subsp. aureus Mu50
auaauauacacaa

SEQ ID NO: 3968094 - RNA, 13 nt, Staphylococcus aureus subsp. aureus Mu50
auaauauauccug

SEQ ID NO: 3968095 - RNA, 22 nt, Staphylococcus aureus subsp. aureus Mu50
auaauauauccugccaauauau

SEQ ID NO: 3968096 - RNA, 13 nt, Staphylococcus aureus subsp. aureus Mu50
auaauauauuaac

SEQ ID NO: 3968097 - RNA, 16 nt, Staphylococcus aureus subsp. aureus Mu50
auaauauauuaacaac

SEQ ID NO: 3968098 - RNA, 13 nt, Staphylococcus aureus subsp. aureus Mu50
auaauauauuuag

SEQ ID NO: 3968099 - RNA, 22 nt, Staphylococcus aureus subsp. aureus Mu50
auaauaucaccuuuuuuaagau

SEQ ID NO: 3968100 - RNA, 20 nt, Staphylococcus aureus subsp. aureus Mu50
auaauaugccauaguaauaa

SEQ ID NO: 3968101 - RNA, 18 nt, Staphylococcus aureus subsp. aureus Mu50
auaauaugugcaugagac

SEQ ID NO: 3968102 - RNA, 19 nt, Staphylococcus aureus subsp. aureus Mu50
auaauauuauucuuuauau

SEQ ID NO: 3968103 - RNA, 17 nt, Staphylococcus aureus subsp. aureus Mu50
auaauauugaugaauaa

SEQ ID NO: 3968104 - RNA, 12 nt, Staphylococcus aureus subsp. aureus Mu50
auaauauuuaac

SEQ ID NO: 3968105 - RNA, 17 nt, Staphylococcus aureus subsp. aureus Mu50
auaauauuuaaccacuu

SEQ ID NO: 3968106 - RNA, 20 nt, Staphylococcus aureus subsp. aureus Mu50
auaauauuuugaauuguaau

SEQ ID NO: 3968107 - RNA, 17 nt, Staphylococcus aureus subsp. aureus Mu50
auaaucaaaccaccaaa

SEQ ID NO: 3968108 - RNA, 14 nt, Staphylococcus aureus subsp. aureus Mu50
auaaucaagaauau

SEQ ID NO: 3968109 - RNA, 15 nt, Staphylococcus aureus subsp. aureus Mu50
auaaucaagaauaua

SEQ ID NO: 3968110 - RNA, 22 nt, Staphylococcus aureus subsp. aureus Mu50
auaaucaagaauauaagugauu

SEQ ID NO: 3968111 - RNA, 22 nt, Staphylococcus aureus subsp. aureus Mu50
auaaucaagucugcauuaauuu

SEQ ID NO: 3968112 - RNA, 14 nt, Staphylococcus aureus subsp. aureus Mu50
auaaucaauuucac

SEQ ID NO: 3968113 - RNA, 14 nt, Staphylococcus aureus subsp. aureus Mu50
auaaucaguauuua

SEQ ID NO: 3968114 - RNA, 16 nt, Staphylococcus aureus subsp. aureus Mu50
auaaucaguauuuacu

SEQ ID NO: 3968115 - RNA, 22 nt, Staphylococcus aureus subsp. aureus Mu50
auaaucauaauaagauuuuuua

SEQ ID NO: 3968116 - RNA, 12 nt, Staphylococcus aureus subsp. aureus Mu50
auaaucaucauu

SEQ ID NO: 3968117 - RNA, 15 nt, Staphylococcus aureus subsp. aureus Mu50
auaauccaagauaua

SEQ ID NO: 3968118 - RNA, 11 nt, Staphylococcus aureus subsp. aureus Mu50
auaauccauuc

SEQ ID NO: 3968119 - RNA, 18 nt, Staphylococcus aureus subsp. aureus Mu50
auaaucccaaccauucua

SEQ ID NO: 3968120 - RNA, 20 nt, Staphylococcus aureus subsp. aureus Mu50
auaaucccaaccauucuacc

SEQ ID NO: 3968121 - RNA, 16 nt, Staphylococcus aureus subsp. aureus Mu50
auaaucgaacagaaaa

SEQ ID NO: 3968122 - RNA, 19 nt, Staphylococcus aureus subsp. aureus Mu50
auaaucgaacauaaauaaa

SEQ ID NO: 3968123 - RNA, 16 nt, Staphylococcus aureus subsp. aureus Mu50
auaaucgagguaguac

SEQ ID NO: 3968124 - RNA, 12 nt, Staphylococcus aureus subsp. aureus Mu50
auaaucgccauc

SEQ ID NO: 3968125 - RNA, 19 nt, Staphylococcus aureus subsp. aureus Mu50
auaaucgguaauuacuugu

SEQ ID NO: 3968126 - RNA, 19 nt, Staphylococcus aureus subsp. aureus Mu50
auaaucguauucauaucau

SEQ ID NO: 3968127 - RNA, 13 nt, Staphylococcus aureus subsp. aureus Mu50
auaaucuauaaau

SEQ ID NO: 3968128 - RNA, 12 nt, Staphylococcus aureus subsp. aureus Mu50
auaaucuaucuu

SEQ ID NO: 3968129 - RNA, 17 nt, Staphylococcus aureus subsp. aureus Mu50
auaaucucauucuuuaa

SEQ ID NO: 3968130 - RNA, 18 nt, Staphylococcus aureus subsp. aureus Mu50
auaaucucuucaauuuau

SEQ ID NO: 3968131 - RNA, 23 nt, Staphylococcus aureus subsp. aureus Mu50
auaaucucuucaauuuauuuuua

SEQ ID NO: 3968132 - RNA, 19 nt, Staphylococcus aureus subsp. aureus Mu50
auaaucuucauuaauuaca

SEQ ID NO: 3968133 - RNA, 16 nt, Staphylococcus aureus subsp. aureus Mu50
auaaucuuuaacauuu

SEQ ID NO: 3968134 - RNA, 14 nt, Staphylococcus aureus subsp. aureus Mu50
auaaucuuuauuaa

SEQ ID NO: 3968135 - RNA, 17 nt, Staphylococcus aureus subsp. aureus Mu50
auaaucuuuauuaauaa

SEQ ID NO: 3968136 - RNA, 17 nt, Staphylococcus aureus subsp. aureus Mu50
auaaucuuuuuuacuaa

SEQ ID NO: 3968137 - RNA, 19 nt, Staphylococcus aureus subsp. aureus Mu50
auaaucuuuuuuacuaaaa

SEQ ID NO: 3968138 - RNA, 23 nt, Staphylococcus aureus subsp. aureus Mu50
auaaugaacaagggccauccauu

SEQ ID NO: 3968139 - RNA, 15 nt, Staphylococcus aureus subsp. aureus Mu50
auaaugaauaauuaa

SEQ ID NO: 3968140 - RNA, 18 nt, Staphylococcus aureus subsp. aureus Mu50
auaaugaauaauuaaaaa

SEQ ID NO: 3968141 - RNA, 21 nt, Staphylococcus aureus subsp. aureus Mu50
auaaugaauucauucaauacg

SEQ ID NO: 3968142 - RNA, 23 nt, Staphylococcus aureus subsp. aureus Mu50
auaaugaauucauucaauacgaa

SEQ ID NO: 3968143 - RNA, 15 nt, Staphylococcus aureus subsp. aureus Mu50
auaaugacaaauuau

SEQ ID NO: 3968144 - RNA, 19 nt, Staphylococcus aureus subsp. aureus Mu50
auaaugacaaauuaucacu

SEQ ID NO: 3968145 - RNA, 15 nt, Staphylococcus aureus subsp. aureus Mu50
auaaugacuauaaca

SEQ ID NO: 3968146 - RNA, 14 nt, Staphylococcus aureus subsp. aureus Mu50
auaaugacucaagu

SEQ ID NO: 3968147 - RNA, 15 nt, Staphylococcus aureus subsp. aureus Mu50
auaaugacugacacu

SEQ ID NO: 3968148 - RNA, 14 nt, Staphylococcus aureus subsp. aureus Mu50
auaaugauaaauua

SEQ ID NO: 3968149 - RNA, 21 nt, Staphylococcus aureus subsp. aureus Mu50
auaaugauguauuuuagcuaa

SEQ ID NO: 3968150 - RNA, 13 nt, Staphylococcus aureus subsp. aureus Mu50
auaaugauugucu

SEQ ID NO: 3968151 - RNA, 14 nt, Staphylococcus aureus subsp. aureus Mu50
auaaugauuuuuau

SEQ ID NO: 3968152 - RNA, 18 nt, Staphylococcus aureus subsp. aureus Mu50
auaaugauuuuuauuauu

SEQ ID NO: 3968153 - RNA, 24 nt, Staphylococcus aureus subsp. aureus Mu50
auaaugauuuuuauuauugucauc

SEQ ID NO: 3968154 - RNA, 20 nt, Staphylococcus aureus subsp. aureus Mu50
auaaugcacgcgugccaaca

SEQ ID NO: 3968155 - RNA, 14 nt, Staphylococcus aureus subsp. aureus Mu50
auaaugcuacuauu

SEQ ID NO: 3968156 - RNA, 19 nt, Staphylococcus aureus subsp. aureus Mu50
auaaugcuacuauuaaaua

SEQ ID NO: 3968157 - RNA, 20 nt, Staphylococcus aureus subsp. aureus Mu50
auaauggacgguauuuucaa

SEQ ID NO: 3968158 - RNA, 17 nt, Staphylococcus aureus subsp. aureus Mu50
auaaugguugaauaaca

SEQ ID NO: 3968159 - RNA, 18 nt, Staphylococcus aureus subsp. aureus Mu50
auaaugguugaauaacac

SEQ ID NO: 3968160 - RNA, 20 nt, Staphylococcus aureus subsp. aureus Mu50
auaaugguugaauaacacua

SEQ ID NO: 3968161 - RNA, 15 nt, Staphylococcus aureus subsp. aureus Mu50
auaauguaauuguuu

SEQ ID NO: 3968162 - RNA, 21 nt, Staphylococcus aureus subsp. aureus Mu50
auaauguaauuguuuuuucuu

SEQ ID NO: 3968163 - RNA, 12 nt, Staphylococcus aureus subsp. aureus Mu50
auaauguacaug

SEQ ID NO: 3968164 - RNA, 15 nt, Staphylococcus aureus subsp. aureus Mu50
auaauguacauguau

SEQ ID NO: 3968165 - RNA, 16 nt, Staphylococcus aureus subsp. aureus Mu50
auaaugucuuacuugu

SEQ ID NO: 3968166 - RNA, 16 nt, Staphylococcus aureus subsp. aureus Mu50
auaaugugaaaaaucu

SEQ ID NO: 3968167 - RNA, 14 nt, Staphylococcus aureus subsp. aureus Mu50
auaaugugucaaau

SEQ ID NO: 3968168 - RNA, 15 nt, Staphylococcus aureus subsp. aureus Mu50
auaaugugucaaaua

SEQ ID NO: 3968169 - RNA, 22 nt, Staphylococcus aureus subsp. aureus Mu50
auaauguucccuuaccauuucu

SEQ ID NO: 3968170 - RNA, 14 nt, Staphylococcus aureus subsp. aureus Mu50
auaauguuuccauu

SEQ ID NO: 3968171 - RNA, 21 nt, Staphylococcus aureus subsp. aureus Mu50
auaauguuuccugauauuuca

SEQ ID NO: 3968172 - RNA, 21 nt, Staphylococcus aureus subsp. aureus Mu50
auaauuaaaauaagauauaua

SEQ ID NO: 3968173 - RNA, 12 nt, Staphylococcus aureus subsp. aureus Mu50
auaauuaaacua

SEQ ID NO: 3968174 - RNA, 13 nt, Staphylococcus aureus subsp. aureus Mu50
auaauuaaacuaa

SEQ ID NO: 3968175 - RNA, 24 nt, Staphylococcus aureus subsp. aureus Mu50
auaauuaaacuaauagcauuugua

SEQ ID NO: 3968176 - RNA, 18 nt, Staphylococcus aureus subsp. aureus Mu50
auaauuaaauaaaaauau

SEQ ID NO: 3968177 - RNA, 18 nt, Staphylococcus aureus subsp. aureus Mu50
auacauaucggcccauaa

SEQ ID NO: 3968178 - RNA, 14 nt, Staphylococcus aureus subsp. aureus Mu50
auacauaucuuuug

SEQ ID NO: 3968179 - RNA, 15 nt, Staphylococcus aureus subsp. aureus Mu50
auacauaucuuuugc

SEQ ID NO: 3968180 - RNA, 13 nt, Staphylococcus aureus subsp. aureus Mu50
auacaucaauauc

SEQ ID NO: 3968181 - RNA, 14 nt, Staphylococcus aureus subsp. aureus Mu50
auacaucaauaucu

SEQ ID NO: 3968182 - RNA, 12 nt, Staphylococcus aureus subsp. aureus Mu50
auacaucaauuu

SEQ ID NO: 3968183 - RNA, 14 nt, Staphylococcus aureus subsp. aureus Mu50
auacaucaauuucu

SEQ ID NO: 3968184 - RNA, 14 nt, Staphylococcus aureus subsp. aureus Mu50
auacaucaucaagu

SEQ ID NO: 3968185 - RNA, 16 nt, Staphylococcus aureus subsp. aureus Mu50
auacaucaucgccagc

SEQ ID NO: 3968186 - RNA, 14 nt, Staphylococcus aureus subsp. aureus Mu50
auacauccauacuu

SEQ ID NO: 3968187 - RNA, 20 nt, Staphylococcus aureus subsp. aureus Mu50
auacauccauacuucuauuu

SEQ ID NO: 3968188 - RNA, 16 nt, Staphylococcus aureus subsp. aureus Mu50
auacauguacauuauc

SEQ ID NO: 3968189 - RNA, 15 nt, Staphylococcus aureus subsp. aureus Mu50
auacauuaauauaaa

SEQ ID NO: 3968190 - RNA, 17 nt, Staphylococcus aureus subsp. aureus Mu50
auacauuaauauaaaua

SEQ ID NO: 3968191 - RNA, 18 nt, Staphylococcus aureus subsp. aureus Mu50
auacauuaauauaaauau

SEQ ID NO: 3968192 - RNA, 15 nt, Staphylococcus aureus subsp. aureus Mu50
auacauuauuaaaua

SEQ ID NO: 3968193 - RNA, 13 nt, Staphylococcus aureus subsp. aureus Mu50
auacauuuugaaa

SEQ ID NO: 3968194 - RNA, 15 nt, Staphylococcus aureus subsp. aureus Mu50
auacauuuugcucua

SEQ ID NO: 3968195 - RNA, 15 nt, Staphylococcus aureus subsp. aureus Mu50
auacauuuuuauaca

SEQ ID NO: 3968196 - RNA, 16 nt, Staphylococcus aureus subsp. aureus Mu50
auacauuuuuauacaa

SEQ ID NO: 3968197 - RNA, 12 nt, Staphylococcus aureus subsp. aureus Mu50
auaccaaacugc

SEQ ID NO: 3968198 - RNA, 14 nt, Staphylococcus aureus subsp. aureus Mu50
auaccaaauaaaua

SEQ ID NO: 3968199 - RNA, 14 nt, Staphylococcus aureus subsp. aureus Mu50
auaccaaauauauu

SEQ ID NO: 3968200 - RNA, 15 nt, Staphylococcus aureus subsp. aureus Mu50
auaccaaauauauuu

SEQ ID NO: 3968201 - RNA, 18 nt, Staphylococcus aureus subsp. aureus Mu50
auaccaaccaaaaccaaa

SEQ ID NO: 3968202 - RNA, 12 nt, Staphylococcus aureus subsp. aureus Mu50
auaccaagacca

SEQ ID NO: 3968203 - RNA, 21 nt, Staphylococcus aureus subsp. aureus Mu50
auaccaaggguuucuggcucu

SEQ ID NO: 3968204 - RNA, 19 nt, Staphylococcus aureus subsp. aureus Mu50
auaccacaucgcauaauau

SEQ ID NO: 3968205 - RNA, 23 nt, Staphylococcus aureus subsp. aureus Mu50
auaccacaucgcauaauaucuua

SEQ ID NO: 3968206 - RNA, 14 nt, Staphylococcus aureus subsp. aureus Mu50
auaccacuuaaucg

SEQ ID NO: 3968207 - RNA, 22 nt, Staphylococcus aureus subsp. aureus Mu50
auaccacuuaaucguucccauu

SEQ ID NO: 3968208 - RNA, 20 nt, Staphylococcus aureus subsp. aureus Mu50
auaccacuugaauacuuuuu

SEQ ID NO: 3968209 - RNA, 17 nt, Staphylococcus aureus subsp. aureus Mu50
auaccaguggaaauuau

SEQ ID NO: 3968210 - RNA, 15 nt, Staphylococcus aureus subsp. aureus Mu50
auaccauaauuaaau

SEQ ID NO: 3968211 - RNA, 18 nt, Staphylococcus aureus subsp. aureus Mu50
auaccauuccaaaaauug

SEQ ID NO: 3968212 - RNA, 14 nt, Staphylococcus aureus subsp. aureus Mu50
auacccaccacauu

SEQ ID NO: 3968213 - RNA, 13 nt, Staphylococcus aureus subsp. aureus Mu50
auacccugcuuua

SEQ ID NO: 3968214 - RNA, 13 nt, Staphylococcus aureus subsp. aureus Mu50
auaccgaauaauu

SEQ ID NO: 3968215 - RNA, 14 nt, Staphylococcus aureus subsp. aureus Mu50
auaccgaauaauuu

SEQ ID NO: 3968216 - RNA, 18 nt, Staphylococcus aureus subsp. aureus Mu50
auaccgaauaauuuugau

SEQ ID NO: 3968217 - RNA, 21 nt, Staphylococcus aureus subsp. aureus Mu50
auaccgaauaauuuugauaua

SEQ ID NO: 3968218 - RNA, 22 nt, Staphylococcus aureus subsp. aureus Mu50
auaccguacaaagguaauagaa

SEQ ID NO: 3968219 - RNA, 20 nt, Staphylococcus aureus subsp. aureus Mu50
auaccguuaguacggcugcu

SEQ ID NO: 3968220 - RNA, 14 nt, Staphylococcus aureus subsp. aureus Mu50
auaccuaaaauacc

SEQ ID NO: 3968221 - RNA, 16 nt, Staphylococcus aureus subsp. aureus Mu50
auaccuaaagcuaaua

SEQ ID NO: 3968222 - RNA, 20 nt, Staphylococcus aureus subsp. aureus Mu50
auaccuaagcugauuaaaau

SEQ ID NO: 3968223 - RNA, 22 nt, Staphylococcus aureus subsp. aureus Mu50
auaccuaaugcgacaucgccaa

SEQ ID NO: 3968224 - RNA, 18 nt, Staphylococcus aureus subsp. aureus Mu50
auaccuaauucaauaccu

SEQ ID NO: 3968225 - RNA, 19 nt, Staphylococcus aureus subsp. aureus Mu50
auaccuaauugcuuaauau

SEQ ID NO: 3968226 - RNA, 13 nt, Staphylococcus aureus subsp. aureus Mu50
auaccuacaaaua

SEQ ID NO: 3968227 - RNA, 21 nt, Staphylococcus aureus subsp. aureus Mu50
auaccuacaaauauguaauca

SEQ ID NO: 3968228 - RNA, 22 nt, Staphylococcus aureus subsp. aureus Mu50
auaccuacugugugaucauacg

SEQ ID NO: 3968229 - RNA, 22 nt, Staphylococcus aureus subsp. aureus Mu50
auaccuaucccuguaaaaccau

SEQ ID NO: 3968230 - RNA, 15 nt, Staphylococcus aureus subsp. aureus Mu50
auaccuauuccuauu

SEQ ID NO: 3968231 - RNA, 18 nt, Staphylococcus aureus subsp. aureus Mu50
auaccucuacauuauauu

SEQ ID NO: 3968232 - RNA, 17 nt, Staphylococcus aureus subsp. aureus Mu50
auaccuugauuauaugc

SEQ ID NO: 3968233 - RNA, 12 nt, Staphylococcus aureus subsp. aureus Mu50
auaccuuuaaau

SEQ ID NO: 3968234 - RNA, 14 nt, Staphylococcus aureus subsp. aureus Mu50
auaccuuuaaaucu

SEQ ID NO: 3968235 - RNA, 16 nt, Staphylococcus aureus subsp. aureus Mu50
auaccuuuaauaucua

SEQ ID NO: 3968236 - RNA, 21 nt, Staphylococcus aureus subsp. aureus Mu50
auaccuuuaauaucuaauucu

SEQ ID NO: 3968237 - RNA, 18 nt, Staphylococcus aureus subsp. aureus Mu50
auaccuuuaauuguuaaa

SEQ ID NO: 3968238 - RNA, 23 nt, Staphylococcus aureus subsp. aureus Mu50
auaccuuuaauuguuaaaucacc

SEQ ID NO: 3968239 - RNA, 13 nt, Staphylococcus aureus subsp. aureus Mu50
auaccuuuuaauu

SEQ ID NO: 3968240 - RNA, 12 nt, Staphylococcus aureus subsp. aureus Mu50
auaccuuuuucu

SEQ ID NO: 3968241 - RNA, 15 nt, Staphylococcus aureus subsp. aureus Mu50
auacgacauuuuuag

SEQ ID NO: 3968242 - RNA, 20 nt, Staphylococcus aureus subsp. aureus Mu50
auacgacauuuuuagacauu

SEQ ID NO: 3968243 - RNA, 17 nt, Staphylococcus aureus subsp. aureus Mu50
auacgagcuuugcucau

SEQ ID NO: 3968244 - RNA, 24 nt, Staphylococcus aureus subsp. aureus Mu50
auacgagcuuugcucauagaugac

SEQ ID NO: 3968245 - RNA, 15 nt, Staphylococcus aureus subsp. aureus Mu50
auacgaguguuuuaa

SEQ ID NO: 3968246 - RNA, 19 nt, Staphylococcus aureus subsp. aureus Mu50
auacgauaauaacuagaac

SEQ ID NO: 3968247 - RNA, 19 nt, Staphylococcus aureus subsp. aureus Mu50
auacgaugaugauuuauaa

SEQ ID NO: 3968248 - RNA, 16 nt, Staphylococcus aureus subsp. aureus Mu50
auacgauuuguucaau

SEQ ID NO: 3968249 - RNA, 14 nt, Staphylococcus aureus subsp. aureus Mu50
auacgccuaaauau

SEQ ID NO: 3968250 - RNA, 17 nt, Staphylococcus aureus subsp. aureus Mu50
auacggcaaauucaacu

SEQ ID NO: 3968251 - RNA, 12 nt, Staphylococcus aureus subsp. aureus Mu50
auacguaaacac

SEQ ID NO: 3968252 - RNA, 20 nt, Staphylococcus aureus subsp. aureus Mu50
auacguacgguagucuccca

SEQ ID NO: 3968253 - RNA, 15 nt, Staphylococcus aureus subsp. aureus Mu50
auacguauauagagu

SEQ ID NO: 3968254 - RNA, 14 nt, Staphylococcus aureus subsp. aureus Mu50
auacguaucaaaau

SEQ ID NO: 3968255 - RNA, 20 nt, Staphylococcus aureus subsp. aureus Mu50
auacguaucaagaaaaaguu

SEQ ID NO: 3968256 - RNA, 16 nt, Staphylococcus aureus subsp. aureus Mu50
auacguguguuuucuu

SEQ ID NO: 3968257 - RNA, 23 nt, Staphylococcus aureus subsp. aureus Mu50
auacguguguuuucuuuucaaaa

SEQ ID NO: 3968258 - RNA, 16 nt, Staphylococcus aureus subsp. aureus Mu50
auacguuauuucaaua

SEQ ID NO: 3968259 - RNA, 21 nt, Staphylococcus aureus subsp. aureus Mu50
auacguuauuucaauaauaau

SEQ ID NO: 3968260 - RNA, 14 nt, Staphylococcus aureus subsp. aureus Mu50
auacguuauuuuuu

SEQ ID NO: 3968261 - RNA, 17 nt, Staphylococcus aureus subsp. aureus Mu50
auacguuuaauaauggu

SEQ ID NO: 3968262 - RNA, 14 nt, Staphylococcus aureus subsp. aureus Mu50
auacguuuauaucu

SEQ ID NO: 3968263 - RNA, 16 nt, Staphylococcus aureus subsp. aureus Mu50
auacguuuauaucuua

SEQ ID NO: 3968264 - RNA, 13 nt, Staphylococcus aureus subsp. aureus Mu50
auacguuuccaau

SEQ ID NO: 3968265 - RNA, 22 nt, Staphylococcus aureus subsp. aureus Mu50
auagaugacuguagaaaacaug

SEQ ID NO: 3968266 - RNA, 24 nt, Staphylococcus aureus subsp. aureus Mu50
auagaugaugugacgauauuuguu

SEQ ID NO: 3968267 - RNA, 15 nt, Staphylococcus aureus subsp. aureus Mu50
auagaugugucuuuu

SEQ ID NO: 3968268 - RNA, 15 nt, Staphylococcus aureus subsp. aureus Mu50
auagauugaaaaaau

SEQ ID NO: 3968269 - RNA, 16 nt, Staphylococcus aureus subsp. aureus Mu50
auagauugccauucau

SEQ ID NO: 3968270 - RNA, 23 nt, Staphylococcus aureus subsp. aureus Mu50
auagauuuaucaccuuuaggcaa

SEQ ID NO: 3968271 - RNA, 15 nt, Staphylococcus aureus subsp. aureus Mu50
auagauuugaauuaa

SEQ ID NO: 3968272 - RNA, 18 nt, Staphylococcus aureus subsp. aureus Mu50
auagauuugaauuaaagu

SEQ ID NO: 3968273 - RNA, 13 nt, Staphylococcus aureus subsp. aureus Mu50
auagauuuuguau

SEQ ID NO: 3968274 - RNA, 21 nt, Staphylococcus aureus subsp. aureus Mu50
auagcaaauugauuaaauaaa

SEQ ID NO: 3968275 - RNA, 21 nt, Staphylococcus aureus subsp. aureus Mu50
auagcaaccauauuuuuagaa

SEQ ID NO: 3968276 - RNA, 17 nt, Staphylococcus aureus subsp. aureus Mu50
auagcaaguuuauaaau

SEQ ID NO: 3968277 - RNA, 17 nt, Staphylococcus aureus subsp. aureus Mu50
auagcaaugaauuaaua

SEQ ID NO: 3968278 - RNA, 18 nt, Staphylococcus aureus subsp. aureus Mu50
auagcaaugaauuaauag

SEQ ID NO: 3968279 - RNA, 23 nt, Staphylococcus aureus subsp. aureus Mu50
auagcaauuugagccauuguuau

SEQ ID NO: 3968280 - RNA, 21 nt, Staphylococcus aureus subsp. aureus Mu50
auagcaccguaacauauguac

SEQ ID NO: 3968281 - RNA, 19 nt, Staphylococcus aureus subsp. aureus Mu50
auagcauaaaauuucugcu

SEQ ID NO: 3968282 - RNA, 22 nt, Staphylococcus aureus subsp. aureus Mu50
auagcauaaaauuucugcuucu

SEQ ID NO: 3968283 - RNA, 17 nt, Staphylococcus aureus subsp. aureus Mu50
auagcauuccuaauuau

SEQ ID NO: 3968284 - RNA, 18 nt, Staphylococcus aureus subsp. aureus Mu50
auagcauuccuaauuaua

SEQ ID NO: 3968285 - RNA, 13 nt, Staphylococcus aureus subsp. aureus Mu50
auagcauuucuuu

SEQ ID NO: 3968286 - RNA, 22 nt, Staphylococcus aureus subsp. aureus Mu50
auagcgauuuuaaagaaaaguu

SEQ ID NO: 3968287 - RNA, 17 nt, Staphylococcus aureus subsp. aureus Mu50
auagcgcagcaaaugcu

SEQ ID NO: 3968288 - RNA, 21 nt, Staphylococcus aureus subsp. aureus Mu50
auagcgcucuggauuuuucuu

SEQ ID NO: 3968289 - RNA, 14 nt, Staphylococcus aureus subsp. aureus Mu50
auagcgguguuuug

SEQ ID NO: 3968290 - RNA, 17 nt, Staphylococcus aureus subsp. aureus Mu50
auagcgguguuuugaga

SEQ ID NO: 3968291 - RNA, 21 nt, Staphylococcus aureus subsp. aureus Mu50
auagcucaauugaaucuuugu

SEQ ID NO: 3968292 - RNA, 17 nt, Staphylococcus aureus subsp. aureus Mu50
auagcucauuacaaagu

SEQ ID NO: 3968293 - RNA, 18 nt, Staphylococcus aureus subsp. aureus Mu50
auagcucuucuuuuucuu

SEQ ID NO: 3968294 - RNA, 22 nt, Staphylococcus aureus subsp. aureus Mu50
auagcucuucuuuuucuugcau

SEQ ID NO: 3968295 - RNA, 12 nt, Staphylococcus aureus subsp. aureus Mu50
auagcugcuuua

SEQ ID NO: 3968296 - RNA, 14 nt, Staphylococcus aureus subsp. aureus Mu50
auagcuggcuuuuu

SEQ ID NO: 3968297 - RNA, 15 nt, Staphylococcus aureus subsp. aureus Mu50
auagcuguuugauau

SEQ ID NO: 3968298 - RNA, 16 nt, Staphylococcus aureus subsp. aureus Mu50
auagcuuucguuucuu

SEQ ID NO: 3968299 - RNA, 14 nt, Staphylococcus aureus subsp. aureus Mu50
auaggaaacuuaaa

SEQ ID NO: 3968300 - RNA, 16 nt, Staphylococcus aureus subsp. aureus Mu50
auaggaaacuuaaaua

SEQ ID NO: 3968301 - RNA, 12 nt, Staphylococcus aureus subsp. aureus Mu50
auaggauauuuu

SEQ ID NO: 3968302 - RNA, 17 nt, Staphylococcus aureus subsp. aureus Mu50
auaggauuauuaucaaa

SEQ ID NO: 3968303 - RNA, 16 nt, Staphylococcus aureus subsp. aureus Mu50
auaggauuuacaccua

SEQ ID NO: 3968304 - RNA, 19 nt, Staphylococcus aureus subsp. aureus Mu50
auaggauuugcaccuauac

SEQ ID NO: 3968305 - RNA, 14 nt, Staphylococcus aureus subsp. aureus Mu50
auaggcuugccaau

SEQ ID NO: 3968306 - RNA, 19 nt, Staphylococcus aureus subsp. aureus Mu50
auagguaaccuuaaauaua

SEQ ID NO: 3968307 - RNA, 14 nt, Staphylococcus aureus subsp. aureus Mu50
auagguauaaucau

SEQ ID NO: 3968308 - RNA, 16 nt, Staphylococcus aureus subsp. aureus Mu50
auagguauaaucauuu

SEQ ID NO: 3968309 - RNA, 13 nt, Staphylococcus aureus subsp. aureus Mu50
auagguaucuuaa

SEQ ID NO: 3968310 - RNA, 13 nt, Staphylococcus aureus subsp. aureus Mu50
auaguaagaaaag

SEQ ID NO: 3968311 - RNA, 16 nt, Staphylococcus aureus subsp. aureus Mu50
auaguaauuguuauaa

SEQ ID NO: 3968312 - RNA, 13 nt, Staphylococcus aureus subsp. aureus Mu50
auaguacagucau

SEQ ID NO: 3968313 - RNA, 16 nt, Staphylococcus aureus subsp. aureus Mu50
auaguacagucaucuu

SEQ ID NO: 3968314 - RNA, 19 nt, Staphylococcus aureus subsp. aureus Mu50
auaguacauuuauuuucaa

SEQ ID NO: 3968315 - RNA, 17 nt, Staphylococcus aureus subsp. aureus Mu50
auaguacuuaauuuaaa

SEQ ID NO: 3968316 - RNA, 23 nt, Staphylococcus aureus subsp. aureus Mu50
auaguauagcgcagcaaaugcuu

SEQ ID NO: 3968317 - RNA, 17 nt, Staphylococcus aureus subsp. aureus Mu50
auaguauuaacuauaaa

SEQ ID NO: 3968318 - RNA, 19 nt, Staphylococcus aureus subsp. aureus Mu50
auaguauuaacuauaaaua

SEQ ID NO: 3968319 - RNA, 14 nt, Staphylococcus aureus subsp. aureus Mu50
auagucaucuguua

SEQ ID NO: 3968320 - RNA, 12 nt, Staphylococcus aureus subsp. aureus Mu50
auagucaucuua

SEQ ID NO: 3968321 - RNA, 16 nt, Staphylococcus aureus subsp. aureus Mu50
auagucauuacauuuu

SEQ ID NO: 3968322 - RNA, 18 nt, Staphylococcus aureus subsp. aureus Mu50
auagucauuacauuuuau

SEQ ID NO: 3968323 - RNA, 14 nt, Staphylococcus aureus subsp. aureus Mu50
auagucauucauaa

SEQ ID NO: 3968324 - RNA, 17 nt, Staphylococcus aureus subsp. aureus Mu50
auagucauucauaauuu

SEQ ID NO: 3968325 - RNA, 18 nt, Staphylococcus aureus subsp. aureus Mu50
auagucauucauaauuug

SEQ ID NO: 3968326 - RNA, 22 nt, Staphylococcus aureus subsp. aureus Mu50
auagucauucauaauuuguuga

SEQ ID NO: 3968327 - RNA, 19 nt, Staphylococcus aureus subsp. aureus Mu50
auaguccgcguguacuuua

SEQ ID NO: 3968328 - RNA, 20 nt, Staphylococcus aureus subsp. aureus Mu50
auaguccgcguguacuuuac

SEQ ID NO: 3968329 - RNA, 22 nt, Staphylococcus aureus subsp. aureus Mu50
auaguccgcguguacuuuacca

SEQ ID NO: 3968330 - RNA, 18 nt, Staphylococcus aureus subsp. aureus Mu50
auaguccggggccccaac

SEQ ID NO: 3968331 - RNA, 16 nt, Staphylococcus aureus subsp. aureus Mu50
auagucuuaaacauaa

SEQ ID NO: 3968332 - RNA, 22 nt, Staphylococcus aureus subsp. aureus Mu50
auagucuuaaacauaacaugac

SEQ ID NO: 3968333 - RNA, 19 nt, Staphylococcus aureus subsp. aureus Mu50
auagucuucggcuuuguaa

SEQ ID NO: 3968334 - RNA, 19 nt, Staphylococcus aureus subsp. aureus Mu50
auagugagcguauuauuau

SEQ ID NO: 3968335 - RNA, 19 nt, Staphylococcus aureus subsp. aureus Mu50
auagugcuuguuuauuaca

SEQ ID NO: 3968336 - RNA, 19 nt, Staphylococcus aureus subsp. aureus Mu50
auaguggaugcucguauag

SEQ ID NO: 3968337 - RNA, 17 nt, Staphylococcus aureus subsp. aureus Mu50
auagugucgagauuuua

SEQ ID NO: 3968338 - RNA, 16 nt, Staphylococcus aureus subsp. aureus Mu50
auaguuaagauuuuaa

SEQ ID NO: 3968339 - RNA, 20 nt, Staphylococcus aureus subsp. aureus Mu50
auaguuaagauuuuaacuuc

SEQ ID NO: 3968340 - RNA, 14 nt, Staphylococcus aureus subsp. aureus Mu50
auaguucuuuaaau

SEQ ID NO: 3968341 - RNA, 15 nt, Staphylococcus aureus subsp. aureus Mu50
auaguucuuuaaauu

SEQ ID NO: 3968342 - RNA, 16 nt, Staphylococcus aureus subsp. aureus Mu50
auaguucuuuaaauua

SEQ ID NO: 3968343 - RNA, 18 nt, Staphylococcus aureus subsp. aureus Mu50
auaguucuuuaaauuaua

SEQ ID NO: 3968344 - RNA, 20 nt, Staphylococcus aureus subsp. aureus Mu50
auaguugaaucggugucuuu

SEQ ID NO: 3968345 - RNA, 23 nt, Staphylococcus aureus subsp. aureus Mu50
auaguugagcguuuaauuagaaa

SEQ ID NO: 3968346 - RNA, 20 nt, Staphylococcus aureus subsp. aureus Mu50
auaguugucuuuacauucuu

SEQ ID NO: 3968347 - RNA, 15 nt, Staphylococcus aureus subsp. aureus Mu50
auaguuucaaugccu

SEQ ID NO: 3968348 - RNA, 23 nt, Staphylococcus aureus subsp. aureus Mu50
auaguuucaaugccuugucuauu

SEQ ID NO: 3968349 - RNA, 15 nt, Staphylococcus aureus subsp. aureus Mu50
auaguuuucuucacu

SEQ ID NO: 3968350 - RNA, 17 nt, Staphylococcus aureus subsp. aureus Mu50
auaguuuuucauauuca

SEQ ID NO: 3968351 - RNA, 16 nt, Staphylococcus aureus subsp. aureus Mu50
auauaaaaaauuauua

SEQ ID NO: 3968352 - RNA, 21 nt, Staphylococcus aureus subsp. aureus Mu50
auauaugaauugaguauuaaa

SEQ ID NO: 3968353 - RNA, 12 nt, Staphylococcus aureus subsp. aureus Mu50
auauaugauaaa

SEQ ID NO: 3968354 - RNA, 18 nt, Staphylococcus aureus subsp. aureus Mu50
auauaugccgauugcucu

SEQ ID NO: 3968355 - RNA, 20 nt, Staphylococcus aureus subsp. aureus Mu50
auauaugcguagcaacauua

SEQ ID NO: 3968356 - RNA, 15 nt, Staphylococcus aureus subsp. aureus Mu50
auauauguaacauaa

SEQ ID NO: 3968357 - RNA, 18 nt, Staphylococcus aureus subsp. aureus Mu50
auauauuaacaacuuuau

SEQ ID NO: 3968358 - RNA, 22 nt, Staphylococcus aureus subsp. aureus Mu50
auauauuacuaaccuauuaaaa

SEQ ID NO: 3968359 - RNA, 15 nt, Staphylococcus aureus subsp. aureus Mu50
auauauuagugauau

SEQ ID NO: 3968360 - RNA, 22 nt, Staphylococcus aureus subsp. aureus Mu50
auauauuaucguaauuguuaaa

SEQ ID NO: 3968361 - RNA, 15 nt, Staphylococcus aureus subsp. aureus Mu50
auauauucaucucuu

SEQ ID NO: 3968362 - RNA, 13 nt, Staphylococcus aureus subsp. aureus Mu50
auauauucguuac

SEQ ID NO: 3968363 - RNA, 18 nt, Staphylococcus aureus subsp. aureus Mu50
auauauucguuacaaaug

SEQ ID NO: 3968364 - RNA, 20 nt, Staphylococcus aureus subsp. aureus Mu50
auauauucguuacaaaugaa

SEQ ID NO: 3968365 - RNA, 15 nt, Staphylococcus aureus subsp. aureus Mu50
auauauugucgacuu

SEQ ID NO: 3968366 - RNA, 16 nt, Staphylococcus aureus subsp. aureus Mu50
auauauuuauuuuuga

SEQ ID NO: 3968367 - RNA, 19 nt, Staphylococcus aureus subsp. aureus Mu50
auauauuuauuuuugauag

SEQ ID NO: 3968368 - RNA, 12 nt, Staphylococcus aureus subsp. aureus Mu50
auauauuugaaa

SEQ ID NO: 3968369 - RNA, 17 nt, Staphylococcus aureus subsp. aureus Mu50
auauauuugaaagguaa

SEQ ID NO: 3968370 - RNA, 21 nt, Staphylococcus aureus subsp. aureus Mu50
auauauuuggaggugaugaga

SEQ ID NO: 3968371 - RNA, 18 nt, Staphylococcus aureus subsp. aureus Mu50
auauauuuguauaugcaa

SEQ ID NO: 3968372 - RNA, 18 nt, Staphylococcus aureus subsp. aureus Mu50
auauauuuugcaauaauu

SEQ ID NO: 3968373 - RNA, 12 nt, Staphylococcus aureus subsp. aureus Mu50
auauauuuuguu

SEQ ID NO: 3968374 - RNA, 14 nt, Staphylococcus aureus subsp. aureus Mu50
auauauuuuguuaa

SEQ ID NO: 3968375 - RNA, 21 nt, Staphylococcus aureus subsp. aureus Mu50
auaucaaaaaauacguuuaau

SEQ ID NO: 3968376 - RNA, 17 nt, Staphylococcus aureus subsp. aureus Mu50
auaucaaaauauaaaau

SEQ ID NO: 3968377 - RNA, 17 nt, Staphylococcus aureus subsp. aureus Mu50
auaucaaauacauuuca

SEQ ID NO: 3968378 - RNA, 21 nt, Staphylococcus aureus subsp. aureus Mu50
auaucaaauacauuucaaaaa

SEQ ID NO: 3968379 - RNA, 22 nt, Staphylococcus aureus subsp. aureus Mu50
auaucaacauguuccgcuacaa

SEQ ID NO: 3968380 - RNA, 17 nt, Staphylococcus aureus subsp. aureus Mu50
auaucaacguuaauaua

SEQ ID NO: 3968381 - RNA, 14 nt, Staphylococcus aureus subsp. aureus Mu50
auaucaaguuuuaa

SEQ ID NO: 3968382 - RNA, 15 nt, Staphylococcus aureus subsp. aureus Mu50
auaucaauaaugcug

SEQ ID NO: 3968383 - RNA, 20 nt, Staphylococcus aureus subsp. aureus Mu50
auaucaauuguugcaaaaua

SEQ ID NO: 3968384 - RNA, 20 nt, Staphylococcus aureus subsp. aureus Mu50
auaucaauuuauuauuaacu

SEQ ID NO: 3968385 - RNA, 17 nt, Staphylococcus aureus subsp. aureus Mu50
auaucacaacacauaaa

SEQ ID NO: 3968386 - RNA, 19 nt, Staphylococcus aureus subsp. aureus Mu50
auaucacgaucuuuaaagu

SEQ ID NO: 3968387 - RNA, 17 nt, Staphylococcus aureus subsp. aureus Mu50
auaucacugaaugcuaa

SEQ ID NO: 3968388 - RNA, 20 nt, Staphylococcus aureus subsp. aureus Mu50
auaucagcuaaguuaaauau

SEQ ID NO: 3968389 - RNA, 22 nt, Staphylococcus aureus subsp. aureus Mu50
auaucagcuaaguuaaauauca

SEQ ID NO: 3968390 - RNA, 13 nt, Staphylococcus aureus subsp. aureus Mu50
auaucagcuuuuu

SEQ ID NO: 3968391 - RNA, 18 nt, Staphylococcus aureus subsp. aureus Mu50
auaucaguaauaauacgc

SEQ ID NO: 3968392 - RNA, 17 nt, Staphylococcus aureus subsp. aureus Mu50
auaucauaccaaaaagu

SEQ ID NO: 3968393 - RNA, 20 nt, Staphylococcus aureus subsp. aureus Mu50
auaucauaccaaaaaguauu

SEQ ID NO: 3968394 - RNA, 23 nt, Staphylococcus aureus subsp. aureus Mu50
auaucauauuugaauacuuuauu

SEQ ID NO: 3968395 - RNA, 18 nt, Staphylococcus aureus subsp. aureus Mu50
auaucaucaacaaucuuu

SEQ ID NO: 3968396 - RNA, 19 nt, Staphylococcus aureus subsp. aureus Mu50
auaucaucaacaaucuuuu

SEQ ID NO: 3968397 - RNA, 17 nt, Staphylococcus aureus subsp. aureus Mu50
auaucaucucuaugucu

SEQ ID NO: 3968398 - RNA, 15 nt, Staphylococcus aureus subsp. aureus Mu50
auaucaugaauguca

SEQ ID NO: 3968399 - RNA, 22 nt, Staphylococcus aureus subsp. aureus Mu50
auaucaugcacaauauucguag

SEQ ID NO: 3968400 - RNA, 22 nt, Staphylococcus aureus subsp. aureus Mu50
auaucaugggcaguaauuuuca

SEQ ID NO: 3968401 - RNA, 23 nt, Staphylococcus aureus subsp. aureus Mu50
auaucauucuguguaaauauaaa

SEQ ID NO: 3968402 - RNA, 12 nt, Staphylococcus aureus subsp. aureus Mu50
auaucauuuuau

SEQ ID NO: 3968403 - RNA, 20 nt, Staphylococcus aureus subsp. aureus Mu50
auaucauuuuauccaaacca

SEQ ID NO: 3968404 - RNA, 21 nt, Staphylococcus aureus subsp. aureus Mu50
auauccaaaauccugaaauua

SEQ ID NO: 3968405 - RNA, 17 nt, Staphylococcus aureus subsp. aureus Mu50
auauccacgguuuacca

SEQ ID NO: 3968406 - RNA, 21 nt, Staphylococcus aureus subsp. aureus Mu50
auauccacgguuuaccacuua

SEQ ID NO: 3968407 - RNA, 18 nt, Staphylococcus aureus subsp. aureus Mu50
auauccuggaauauuaac

SEQ ID NO: 3968408 - RNA, 16 nt, Staphylococcus aureus subsp. aureus Mu50
auauccuguuucauau

SEQ ID NO: 3968409 - RNA, 14 nt, Staphylococcus aureus subsp. aureus Mu50
auauccuucauuag

SEQ ID NO: 3968410 - RNA, 16 nt, Staphylococcus aureus subsp. aureus Mu50
auaucgacaccauuua

SEQ ID NO: 3968411 - RNA, 15 nt, Staphylococcus aureus subsp. aureus Mu50
auaucgauaaaugua

SEQ ID NO: 3968412 - RNA, 22 nt, Staphylococcus aureus subsp. aureus Mu50
auaucgauaaauguauuaaaca

SEQ ID NO: 3968413 - RNA, 21 nt, Staphylococcus aureus subsp. aureus Mu50
auaucgaugacuuugucuuua

SEQ ID NO: 3968414 - RNA, 14 nt, Staphylococcus aureus subsp. aureus Mu50
auaucgauuaauag

SEQ ID NO: 3968415 - RNA, 24 nt, Staphylococcus aureus subsp. aureus Mu50
auaucgauuuuggcacauaaauca

SEQ ID NO: 3968416 - RNA, 17 nt, Staphylococcus aureus subsp. aureus Mu50
auaucgcgcaucaaaaa

SEQ ID NO: 3968417 - RNA, 19 nt, Staphylococcus aureus subsp. aureus Mu50
auaucgucguaacucuuua

SEQ ID NO: 3968418 - RNA, 11 nt, Staphylococcus aureus subsp. aureus Mu50
auaucuaaguc

SEQ ID NO: 3968419 - RNA, 23 nt, Staphylococcus aureus subsp. aureus Mu50
auaucuaauacuuucacuuuuua

SEQ ID NO: 3968420 - RNA, 17 nt, Staphylococcus aureus subsp. aureus Mu50
auaucuacagagaauca

SEQ ID NO: 3968421 - RNA, 23 nt, Staphylococcus aureus subsp. aureus Mu50
auaucuacagagaaucaauuauu

SEQ ID NO: 3968422 - RNA, 22 nt, Staphylococcus aureus subsp. aureus Mu50
auaucuagcugcuucugcugua

SEQ ID NO: 3968423 - RNA, 14 nt, Staphylococcus aureus subsp. aureus Mu50
auaucuauuuuucg

SEQ ID NO: 3968424 - RNA, 12 nt, Staphylococcus aureus subsp. aureus Mu50
auaucucaagau

SEQ ID NO: 3968425 - RNA, 20 nt, Staphylococcus aureus subsp. aureus Mu50
auaucucaagauauccauua

SEQ ID NO: 3968426 - RNA, 15 nt, Staphylococcus aureus subsp. aureus Mu50
auaucuguugcauua

SEQ ID NO: 3968427 - RNA, 14 nt, Staphylococcus aureus subsp. aureus Mu50
auaucuuaaguaca

SEQ ID NO: 3968428 - RNA, 19 nt, Staphylococcus aureus subsp. aureus Mu50
auaucuuaaguacauaaau

SEQ ID NO: 3968429 - RNA, 21 nt, Staphylococcus aureus subsp. aureus Mu50
auaucuuacugcuguuuuuua

SEQ ID NO: 3968430 - RNA, 16 nt, Staphylococcus aureus subsp. aureus Mu50
auaucuuaugauacuu

SEQ ID NO: 3968431 - RNA, 21 nt, Staphylococcus aureus subsp. aureus Mu50
auaucuucuucuaaccacuuc

SEQ ID NO: 3968432 - RNA, 17 nt, Staphylococcus aureus subsp. aureus Mu50
auaucuugcuuggauaa

SEQ ID NO: 3968433 - RNA, 20 nt, Staphylococcus aureus subsp. aureus Mu50
auaucuugcuuggauaauug

SEQ ID NO: 3968434 - RNA, 22 nt, Staphylococcus aureus subsp. aureus Mu50
auaucuugcuuggauaauugca

SEQ ID NO: 3968435 - RNA, 15 nt, Staphylococcus aureus subsp. aureus Mu50
auaucuuuauuugau

SEQ ID NO: 3968436 - RNA, 16 nt, Staphylococcus aureus subsp. aureus Mu50
auaucuuucaaauuaa

SEQ ID NO: 3968437 - RNA, 21 nt, Staphylococcus aureus subsp. aureus Mu50
auaucuuucaauuaauuuaaa

SEQ ID NO: 3968438 - RNA, 20 nt, Staphylococcus aureus subsp. aureus Mu50
auaucuuuuauacauguaca

SEQ ID NO: 3968439 - RNA, 20 nt, Staphylococcus aureus subsp. aureus Mu50
auauuaucguaauuguuaaa

SEQ ID NO: 3968440 - RNA, 22 nt, Staphylococcus aureus subsp. aureus Mu50
auauuaugauacgcuuuuuaaa

SEQ ID NO: 3968441 - RNA, 13 nt, Staphylococcus aureus subsp. aureus Mu50
auauuauguuagu

SEQ ID NO: 3968442 - RNA, 23 nt, Staphylococcus aureus subsp. aureus Mu50
auauuauguuagugacaagguau

SEQ ID NO: 3968443 - RNA, 14 nt, Staphylococcus aureus subsp. aureus Mu50
auauuauuaaauca

SEQ ID NO: 3968444 - RNA, 13 nt, Staphylococcus aureus subsp. aureus Mu50
auauuauuacuua

SEQ ID NO: 3968445 - RNA, 13 nt, Staphylococcus aureus subsp. aureus Mu50
auauuauuucaau

SEQ ID NO: 3968446 - RNA, 24 nt, Staphylococcus aureus subsp. aureus Mu50
auauuauuuugcaauugcaaugaa

SEQ ID NO: 3968447 - RNA, 18 nt, Staphylococcus aureus subsp. aureus Mu50
auauuauuuugcuuuaau

SEQ ID NO: 3968448 - RNA, 13 nt, Staphylococcus aureus subsp. aureus Mu50
auauuauuuuuaa

SEQ ID NO: 3968449 - RNA, 14 nt, Staphylococcus aureus subsp. aureus Mu50
auauuauuuuuaag

SEQ ID NO: 3968450 - RNA, 14 nt, Staphylococcus aureus subsp. aureus Mu50
auauucaaaauaac

SEQ ID NO: 3968451 - RNA, 14 nt, Staphylococcus aureus subsp. aureus Mu50
auauucaacuuauu

SEQ ID NO: 3968452 - RNA, 19 nt, Staphylococcus aureus subsp. aureus Mu50
auauucaacuuauuauuua

SEQ ID NO: 3968453 - RNA, 22 nt, Staphylococcus aureus subsp. aureus Mu50
auauucaacuuauuauuuaucg

SEQ ID NO: 3968454 - RNA, 16 nt, Staphylococcus aureus subsp. aureus Mu50
auauucaauaauuauu

SEQ ID NO: 3968455 - RNA, 12 nt, Staphylococcus aureus subsp. aureus Mu50
auauucaaugaa

SEQ ID NO: 3968456 - RNA, 13 nt, Staphylococcus aureus subsp. aureus Mu50
auauucaaugaau

SEQ ID NO: 3968457 - RNA, 14 nt, Staphylococcus aureus subsp. aureus Mu50
auauucaaugaauu

SEQ ID NO: 3968458 - RNA, 20 nt, Staphylococcus aureus subsp. aureus Mu50
auauucacgauauaacauua

SEQ ID NO: 3968459 - RNA, 19 nt, Staphylococcus aureus subsp. aureus Mu50
auauucaguauauguauag

SEQ ID NO: 3968460 - RNA, 15 nt, Staphylococcus aureus subsp. aureus Mu50
auauucauauuacuu

SEQ ID NO: 3968461 - RNA, 22 nt, Staphylococcus aureus subsp. aureus Mu50
auauucauguucuuguaauccu

SEQ ID NO: 3968462 - RNA, 22 nt, Staphylococcus aureus subsp. aureus Mu50
auauucauuccuaagaauguaa

SEQ ID NO: 3968463 - RNA, 19 nt, Staphylococcus aureus subsp. aureus Mu50
auauuccacgcucacauua

SEQ ID NO: 3968464 - RNA, 20 nt, Staphylococcus aureus subsp. aureus Mu50
auauuccacgcucacauuaa

SEQ ID NO: 3968465 - RNA, 20 nt, Staphylococcus aureus subsp. aureus Mu50
auauucgauacauaaaacau

SEQ ID NO: 3968466 - RNA, 15 nt, Staphylococcus aureus subsp. aureus Mu50
auauucgcgaacguu

SEQ ID NO: 3968467 - RNA, 23 nt, Staphylococcus aureus subsp. aureus Mu50
auauucgcgaacguuauuuucaa

SEQ ID NO: 3968468 - RNA, 15 nt, Staphylococcus aureus subsp. aureus Mu50
auauucgcuuaaaaa

SEQ ID NO: 3968469 - RNA, 16 nt, Staphylococcus aureus subsp. aureus Mu50
auauucgcuuaaaaac

SEQ ID NO: 3968470 - RNA, 15 nt, Staphylococcus aureus subsp. aureus Mu50
auauucguaaauccu

SEQ ID NO: 3968471 - RNA, 20 nt, Staphylococcus aureus subsp. aureus Mu50
auauucguagcaugacauua

SEQ ID NO: 3968472 - RNA, 13 nt, Staphylococcus aureus subsp. aureus Mu50
auauucguuacaa

SEQ ID NO: 3968473 - RNA, 22 nt, Staphylococcus aureus subsp. aureus Mu50
auauucuagauucauauuuaua

SEQ ID NO: 3968474 - RNA, 22 nt, Staphylococcus aureus subsp. aureus Mu50
auauucuccaacucuaacagcu

SEQ ID NO: 3968475 - RNA, 13 nt, Staphylococcus aureus subsp. aureus Mu50
auauucucugcuu

SEQ ID NO: 3968476 - RNA, 17 nt, Staphylococcus aureus subsp. aureus Mu50
auauucucugcuucuaa

SEQ ID NO: 3968477 - RNA, 17 nt, Staphylococcus aureus subsp. aureus Mu50
auauucuggaugguuau

SEQ ID NO: 3968478 - RNA, 15 nt, Staphylococcus aureus subsp. aureus Mu50
auauucuuuaauaua

SEQ ID NO: 3968479 - RNA, 18 nt, Staphylococcus aureus subsp. aureus Mu50
auauucuuucguuuucau

SEQ ID NO: 3968480 - RNA, 22 nt, Staphylococcus aureus subsp. aureus Mu50
auauucuuucguuuucaucaac

SEQ ID NO: 3968481 - RNA, 23 nt, Staphylococcus aureus subsp. aureus Mu50
auauucuuucguuuucaucaacg

SEQ ID NO: 3968482 - RNA, 14 nt, Staphylococcus aureus subsp. aureus Mu50
auauucuuuuuaac

SEQ ID NO: 3968483 - RNA, 17 nt, Staphylococcus aureus subsp. aureus Mu50
auauucuuuuuaacuau

SEQ ID NO: 3968484 - RNA, 19 nt, Staphylococcus aureus subsp. aureus Mu50
auauugaaaguguaugcau

SEQ ID NO: 3968485 - RNA, 22 nt, Staphylococcus aureus subsp. aureus Mu50
auauugaaaugagcuuaaguua

SEQ ID NO: 3968486 - RNA, 15 nt, Staphylococcus aureus subsp. aureus Mu50
auauugaagaugcuu

SEQ ID NO: 3968487 - RNA, 22 nt, Staphylococcus aureus subsp. aureus Mu50
auauugaauaaucauccauaua

SEQ ID NO: 3968488 - RNA, 16 nt, Staphylococcus aureus subsp. aureus Mu50
auauugaauugaaaaa

SEQ ID NO: 3968489 - RNA, 17 nt, Staphylococcus aureus subsp. aureus Mu50
auauugaauugaaaaau

SEQ ID NO: 3968490 - RNA, 19 nt, Staphylococcus aureus subsp. aureus Mu50
auauugaauugaaaaauua

SEQ ID NO: 3968491 - RNA, 15 nt, Staphylococcus aureus subsp. aureus Mu50
auauugagaauauua

SEQ ID NO: 3968492 - RNA, 16 nt, Staphylococcus aureus subsp. aureus Mu50
auauugagaauauuaa

SEQ ID NO: 3968493 - RNA, 23 nt, Staphylococcus aureus subsp. aureus Mu50
auauugagaauauuaagauguau

SEQ ID NO: 3968494 - RNA, 16 nt, Staphylococcus aureus subsp. aureus Mu50
auauugaugaauaaau

SEQ ID NO: 3968495 - RNA, 20 nt, Staphylococcus aureus subsp. aureus Mu50
auauugauucuagugaaaua

SEQ ID NO: 3968496 - RNA, 16 nt, Staphylococcus aureus subsp. aureus Mu50
auauuggacuuugcug

SEQ ID NO: 3968497 - RNA, 22 nt, Staphylococcus aureus subsp. aureus Mu50
auauuggcaguguuugacugaa

SEQ ID NO: 3968498 - RNA, 19 nt, Staphylococcus aureus subsp. aureus Mu50
auauuguagggaguauugu

SEQ ID NO: 3968499 - RNA, 13 nt, Staphylococcus aureus subsp. aureus Mu50
auauuguauuuua

SEQ ID NO: 3968500 - RNA, 20 nt, Staphylococcus aureus subsp. aureus Mu50
auauugugccgcuucuacaa

SEQ ID NO: 3968501 - RNA, 14 nt, Staphylococcus aureus subsp. aureus Mu50
auauuguuaaaauu

SEQ ID NO: 3968502 - RNA, 16 nt, Staphylococcus aureus subsp. aureus Mu50
auauuguuaaaauuug

SEQ ID NO: 3968503 - RNA, 13 nt, Staphylococcus aureus subsp. aureus Mu50
auauuguuaauuc

SEQ ID NO: 3968504 - RNA, 22 nt, Staphylococcus aureus subsp. aureus Mu50
auauuuaaaaaauacuaagauu

SEQ ID NO: 3968505 - RNA, 15 nt, Staphylococcus aureus subsp. aureus Mu50
auauuuaaaauauua

SEQ ID NO: 3968506 - RNA, 12 nt, Staphylococcus aureus subsp. aureus Mu50
auauuuaaacua

SEQ ID NO: 3968507 - RNA, 19 nt, Staphylococcus aureus subsp. aureus Mu50
auauuuaaacucucuaaaa

SEQ ID NO: 3968508 - RNA, 17 nt, Staphylococcus aureus subsp. aureus Mu50
auauuuaaaugucuuuc

SEQ ID NO: 3968509 - RNA, 15 nt, Staphylococcus aureus subsp. aureus Mu50
auauuuaacaaaauu

SEQ ID NO: 3968510 - RNA, 16 nt, Staphylococcus aureus subsp. aureus Mu50
auauuuaacaaaauua

SEQ ID NO: 3968511 - RNA, 19 nt, Staphylococcus aureus subsp. aureus Mu50
auauuuaacaucaauuacu

SEQ ID NO: 3968512 - RNA, 13 nt, Staphylococcus aureus subsp. aureus Mu50
auauuuaaccuuu

SEQ ID NO: 3968513 - RNA, 13 nt, Staphylococcus aureus subsp. aureus Mu50
auauuuacacaga

SEQ ID NO: 3968514 - RNA, 21 nt, Staphylococcus aureus subsp. aureus Mu50
auauuuacacagaaugauaua

SEQ ID NO: 3968515 - RNA, 20 nt, Staphylococcus aureus subsp. aureus Mu50
auauuuagaauaagaaauaa

SEQ ID NO: 3968516 - RNA, 18 nt, Staphylococcus aureus subsp. aureus Mu50
auauuuagaaugaugagu

SEQ ID NO: 3968517 - RNA, 19 nt, Staphylococcus aureus subsp. aureus Mu50
auauuuagaaugaugagua

SEQ ID NO: 3968518 - RNA, 22 nt, Staphylococcus aureus subsp. aureus Mu50
auauuuagauuggucaaacuua

SEQ ID NO: 3968519 - RNA, 22 nt, Staphylococcus aureus subsp. aureus Mu50
auauuuaucgcgauuauuacca

SEQ ID NO: 3968520 - RNA, 13 nt, Staphylococcus aureus subsp. aureus Mu50
auauuuauuaagg

SEQ ID NO: 3968521 - RNA, 17 nt, Staphylococcus aureus subsp. aureus Mu50
auauuuauuguuuuuaa

SEQ ID NO: 3968522 - RNA, 22 nt, Staphylococcus aureus subsp. aureus Mu50
auauuuauuguuuuuaaaaucu

SEQ ID NO: 3968523 - RNA, 13 nt, Staphylococcus aureus subsp. aureus Mu50
auauuuauuuaau

SEQ ID NO: 3968524 - RNA, 13 nt, Staphylococcus aureus subsp. aureus Mu50
auauuuauuuuaa

SEQ ID NO: 3968525 - RNA, 15 nt, Staphylococcus aureus subsp. aureus Mu50
auauuuauuuuauaa

SEQ ID NO: 3968526 - RNA, 14 nt, Staphylococcus aureus subsp. aureus Mu50
auauuuauuuuuga

SEQ ID NO: 3968527 - RNA, 18 nt, Staphylococcus aureus subsp. aureus Mu50
aucaaugacauccauaca

SEQ ID NO: 3968528 - RNA, 22 nt, Staphylococcus aureus subsp. aureus Mu50
aucaaugagcaagucuucuaaa

SEQ ID NO: 3968529 - RNA, 15 nt, Staphylococcus aureus subsp. aureus Mu50
aucaaugguugaugu

SEQ ID NO: 3968530 - RNA, 13 nt, Staphylococcus aureus subsp. aureus Mu50
aucaauuaaacuu

SEQ ID NO: 3968531 - RNA, 12 nt, Staphylococcus aureus subsp. aureus Mu50
aucaauugaaug

SEQ ID NO: 3968532 - RNA, 15 nt, Staphylococcus aureus subsp. aureus Mu50
aucaauuuaauuaag

SEQ ID NO: 3968533 - RNA, 17 nt, Staphylococcus aureus subsp. aureus Mu50
aucaauuucuguaauaa

SEQ ID NO: 3968534 - RNA, 19 nt, Staphylococcus aureus subsp. aureus Mu50
aucaauuucuguaauaaua

SEQ ID NO: 3968535 - RNA, 19 nt, Staphylococcus aureus subsp. aureus Mu50
aucaauuuuuacuaaauca

SEQ ID NO: 3968536 - RNA, 20 nt, Staphylococcus aureus subsp. aureus Mu50
aucaauuuuuacuaaaucau

SEQ ID NO: 3968537 - RNA, 23 nt, Staphylococcus aureus subsp. aureus Mu50
aucacaauacgaaaucaaaaaua

SEQ ID NO: 3968538 - RNA, 15 nt, Staphylococcus aureus subsp. aureus Mu50
aucacacucuccccg

SEQ ID NO: 3968539 - RNA, 16 nt, Staphylococcus aureus subsp. aureus Mu50
aucacaguuauauauu

SEQ ID NO: 3968540 - RNA, 18 nt, Staphylococcus aureus subsp. aureus Mu50
aucacauaugauaauuaa

SEQ ID NO: 3968541 - RNA, 15 nt, Staphylococcus aureus subsp. aureus Mu50
aucacauucaauauu

SEQ ID NO: 3968542 - RNA, 23 nt, Staphylococcus aureus subsp. aureus Mu50
aucaccaacaacuuuguuuucag

SEQ ID NO: 3968543 - RNA, 15 nt, Staphylococcus aureus subsp. aureus Mu50
aucaccagauuuuaa

SEQ ID NO: 3968544 - RNA, 14 nt, Staphylococcus aureus subsp. aureus Mu50
aucaccuuuuuuaa

SEQ ID NO: 3968545 - RNA, 16 nt, Staphylococcus aureus subsp. aureus Mu50
aucacgauaauguaua

SEQ ID NO: 3968546 - RNA, 14 nt, Staphylococcus aureus subsp. aureus Mu50
aucacgauuuucaa

SEQ ID NO: 3968547 - RNA, 13 nt, Staphylococcus aureus subsp. aureus Mu50
aucacuaaaguaa

SEQ ID NO: 3968548 - RNA, 19 nt, Staphylococcus aureus subsp. aureus Mu50
aucacuauauuucacacag

SEQ ID NO: 3968549 - RNA, 14 nt, Staphylococcus aureus subsp. aureus Mu50
aucacuccucuauu

SEQ ID NO: 3968550 - RNA, 21 nt, Staphylococcus aureus subsp. aureus Mu50
aucacugcauauaaagucaua

SEQ ID NO: 3968551 - RNA, 22 nt, Staphylococcus aureus subsp. aureus Mu50
aucacuugcuguugcaauaaaa

SEQ ID NO: 3968552 - RNA, 21 nt, Staphylococcus aureus subsp. aureus Mu50
aucacuugguaaaacaucgua

SEQ ID NO: 3968553 - RNA, 13 nt, Staphylococcus aureus subsp. aureus Mu50
aucacuuuuuaaa

SEQ ID NO: 3968554 - RNA, 12 nt, Staphylococcus aureus subsp. aureus Mu50
aucagacuaaaa

SEQ ID NO: 3968555 - RNA, 13 nt, Staphylococcus aureus subsp. aureus Mu50
aucagacuaaaau

SEQ ID NO: 3968556 - RNA, 22 nt, Staphylococcus aureus subsp. aureus Mu50
aucagcauuaaucguauuuuua

SEQ ID NO: 3968557 - RNA, 23 nt, Staphylococcus aureus subsp. aureus Mu50
aucagcauuuaagcuaucuaaac

SEQ ID NO: 3968558 - RNA, 18 nt, Staphylococcus aureus subsp. aureus Mu50
aucagcuaaguuaaauau

SEQ ID NO: 3968559 - RNA, 17 nt, Staphylococcus aureus subsp. aureus Mu50
aucagcuauaaaaguac

SEQ ID NO: 3968560 - RNA, 14 nt, Staphylococcus aureus subsp. aureus Mu50
aucagcucuuaaau

SEQ ID NO: 3968561 - RNA, 11 nt, Staphylococcus aureus subsp. aureus Mu50
aucagcuuuaa

SEQ ID NO: 3968562 - RNA, 17 nt, Staphylococcus aureus subsp. aureus Mu50
aucagcuuuaauaauau

SEQ ID NO: 3968563 - RNA, 15 nt, Staphylococcus aureus subsp. aureus Mu50
aucagcuuuuucauu

SEQ ID NO: 3968564 - RNA, 15 nt, Staphylococcus aureus subsp. aureus Mu50
aucaggaccaaauag

SEQ ID NO: 3968565 - RNA, 15 nt, Staphylococcus aureus subsp. aureus Mu50
aucagggaaaucauc

SEQ ID NO: 3968566 - RNA, 13 nt, Staphylococcus aureus subsp. aureus Mu50
aucaguaauaaua

SEQ ID NO: 3968567 - RNA, 16 nt, Staphylococcus aureus subsp. aureus Mu50
aucaguaccaaagaaa

SEQ ID NO: 3968568 - RNA, 18 nt, Staphylococcus aureus subsp. aureus Mu50
aucaguaguuuuaaaagu

SEQ ID NO: 3968569 - RNA, 20 nt, Staphylococcus aureus subsp. aureus Mu50
aucaguauaaucagcaaugu

SEQ ID NO: 3968570 - RNA, 14 nt, Staphylococcus aureus subsp. aureus Mu50
aucaguauuuacuu

SEQ ID NO: 3968571 - RNA, 18 nt, Staphylococcus aureus subsp. aureus Mu50
aucagucauucacauaca

SEQ ID NO: 3968572 - RNA, 17 nt, Staphylococcus aureus subsp. aureus Mu50
aucaguccgcuuuuuca

SEQ ID NO: 3968573 - RNA, 18 nt, Staphylococcus aureus subsp. aureus Mu50
aucaguccgcuuuuucau

SEQ ID NO: 3968574 - RNA, 23 nt, Staphylococcus aureus subsp. aureus Mu50
aucagucucuaaaacuuuuucaa

SEQ ID NO: 3968575 - RNA, 19 nt, Staphylococcus aureus subsp. aureus Mu50
aucagugugauuuuggaac

SEQ ID NO: 3968576 - RNA, 16 nt, Staphylococcus aureus subsp. aureus Mu50
aucaguuauuuuaaua

SEQ ID NO: 3968577 - RNA, 16 nt, Staphylococcus aureus subsp. aureus Mu50
aucaguugagucaauu

SEQ ID NO: 3968578 - RNA, 21 nt, Staphylococcus aureus subsp. aureus Mu50
aucaguuucaucaaguauaaa

SEQ ID NO: 3968579 - RNA, 19 nt, Staphylococcus aureus subsp. aureus Mu50
aucaguuugcacuucaaaa

SEQ ID NO: 3968580 - RNA, 16 nt, Staphylococcus aureus subsp. aureus Mu50
aucaguuuuuaaauca

SEQ ID NO: 3968581 - RNA, 14 nt, Staphylococcus aureus subsp. aureus Mu50
aucaguuuuugaau

SEQ ID NO: 3968582 - RNA, 19 nt, Staphylococcus aureus subsp. aureus Mu50
aucaguuuuugaauauuug

SEQ ID NO: 3968583 - RNA, 13 nt, Staphylococcus aureus subsp. aureus Mu50
aucauaaagauaa

SEQ ID NO: 3968584 - RNA, 14 nt, Staphylococcus aureus subsp. aureus Mu50
aucauaaauaacac

SEQ ID NO: 3968585 - RNA, 12 nt, Staphylococcus aureus subsp. aureus Mu50
aucauaaauauu

SEQ ID NO: 3968586 - RNA, 19 nt, Staphylococcus aureus subsp. aureus Mu50
aucauaauaagauuuuuua

SEQ ID NO: 3968587 - RNA, 17 nt, Staphylococcus aureus subsp. aureus Mu50
aucauaaucauaaaaau

SEQ ID NO: 3968588 - RNA, 16 nt, Staphylococcus aureus subsp. aureus Mu50
aucauaaucugcugcu

SEQ ID NO: 3968589 - RNA, 22 nt, Staphylococcus aureus subsp. aureus Mu50
aucauaaugaauaauuaaaaaa

SEQ ID NO: 3968590 - RNA, 19 nt, Staphylococcus aureus subsp. aureus Mu50
aucauaauucccuguuaug

SEQ ID NO: 3968591 - RNA, 14 nt, Staphylococcus aureus subsp. aureus Mu50
aucauaauuuuguu

SEQ ID NO: 3968592 - RNA, 19 nt, Staphylococcus aureus subsp. aureus Mu50
aucauaccagcaaguguau

SEQ ID NO: 3968593 - RNA, 13 nt, Staphylococcus aureus subsp. aureus Mu50
aucauacgagaaa

SEQ ID NO: 3968594 - RNA, 16 nt, Staphylococcus aureus subsp. aureus Mu50
aucauacgagaaauua

SEQ ID NO: 3968595 - RNA, 12 nt, Staphylococcus aureus subsp. aureus Mu50
aucauacguacg

SEQ ID NO: 3968596 - RNA, 16 nt, Staphylococcus aureus subsp. aureus Mu50
aucauagauauaagaa

SEQ ID NO: 3968597 - RNA, 16 nt, Staphylococcus aureus subsp. aureus Mu50
aucauagcauuaagau

SEQ ID NO: 3968598 - RNA, 18 nt, Staphylococcus aureus subsp. aureus Mu50
aucauagcauuaagauga

SEQ ID NO: 3968599 - RNA, 14 nt, Staphylococcus aureus subsp. aureus Mu50
aucauaucauacca

SEQ ID NO: 3968600 - RNA, 15 nt, Staphylococcus aureus subsp. aureus Mu50
aucauauucaaaaua

SEQ ID NO: 3968601 - RNA, 21 nt, Staphylococcus aureus subsp. aureus Mu50
aucauauuugaauacuuuauu

SEQ ID NO: 3968602 - RNA, 20 nt, Staphylococcus aureus subsp. aureus Mu50
aucaucaacaaucuuuuuca

SEQ ID NO: 3968603 - RNA, 18 nt, Staphylococcus aureus subsp. aureus Mu50
aucaucaccauacuaaaa

SEQ ID NO: 3968604 - RNA, 21 nt, Staphylococcus aureus subsp. aureus Mu50
aucaucaccauacuaaaacau

SEQ ID NO: 3968605 - RNA, 15 nt, Staphylococcus aureus subsp. aureus Mu50
aucauccauaaaaau

SEQ ID NO: 3968606 - RNA, 16 nt, Staphylococcus aureus subsp. aureus Mu50
aucauccauaaaaaua

SEQ ID NO: 3968607 - RNA, 17 nt, Staphylococcus aureus subsp. aureus Mu50
aucaucgcaaauacaua

SEQ ID NO: 3968608 - RNA, 20 nt, Staphylococcus aureus subsp. aureus Mu50
aucaucgcaaauacauaauc

SEQ ID NO: 3968609 - RNA, 17 nt, Staphylococcus aureus subsp. aureus Mu50
aucaucgccagcauuac

SEQ ID NO: 3968610 - RNA, 24 nt, Staphylococcus aureus subsp. aureus Mu50
aucaucgccaugacguauacaaau

SEQ ID NO: 3968611 - RNA, 14 nt, Staphylococcus aureus subsp. aureus Mu50
aucaucuauucaac

SEQ ID NO: 3968612 - RNA, 20 nt, Staphylococcus aureus subsp. aureus Mu50
aucaucucugcuuuaauaua

SEQ ID NO: 3968613 - RNA, 17 nt, Staphylococcus aureus subsp. aureus Mu50
aucaucugcaagugcuu

SEQ ID NO: 3968614 - RNA, 21 nt, Staphylococcus aureus subsp. aureus Mu50
aucaucuuaacaacuuuaauu

SEQ ID NO: 3968615 - RNA, 20 nt, Staphylococcus aureus subsp. aureus Mu50
auccuaagcauaauucaacu

SEQ ID NO: 3968616 - RNA, 18 nt, Staphylococcus aureus subsp. aureus Mu50
auccuaagcaucguaaaa

SEQ ID NO: 3968617 - RNA, 17 nt, Staphylococcus aureus subsp. aureus Mu50
auccuaugccaaauaac

SEQ ID NO: 3968618 - RNA, 24 nt, Staphylococcus aureus subsp. aureus Mu50
auccucacaaauuugaauauacuu

SEQ ID NO: 3968619 - RNA, 13 nt, Staphylococcus aureus subsp. aureus Mu50
auccucauaauua

SEQ ID NO: 3968620 - RNA, 21 nt, Staphylococcus aureus subsp. aureus Mu50
auccucauaauuaucauauaa

SEQ ID NO: 3968621 - RNA, 17 nt, Staphylococcus aureus subsp. aureus Mu50
auccucauuaauaaauu

SEQ ID NO: 3968622 - RNA, 21 nt, Staphylococcus aureus subsp. aureus Mu50
auccucgguauuuaauguuuu

SEQ ID NO: 3968623 - RNA, 24 nt, Staphylococcus aureus subsp. aureus Mu50
auccugauuuaauguuaaacaaua

SEQ ID NO: 3968624 - RNA, 14 nt, Staphylococcus aureus subsp. aureus Mu50
auccuggaauauua

SEQ ID NO: 3968625 - RNA, 17 nt, Staphylococcus aureus subsp. aureus Mu50
auccuggaauauuaaca

SEQ ID NO: 3968626 - RNA, 16 nt, Staphylococcus aureus subsp. aureus Mu50
auccuucucaucauuu

SEQ ID NO: 3968627 - RNA, 14 nt, Staphylococcus aureus subsp. aureus Mu50
auccuuuaaugcuu

SEQ ID NO: 3968628 - RNA, 21 nt, Staphylococcus aureus subsp. aureus Mu50
auccuuuaaugcuuuagcauu

SEQ ID NO: 3968629 - RNA, 18 nt, Staphylococcus aureus subsp. aureus Mu50
auccuuuauauucuaaua

SEQ ID NO: 3968630 - RNA, 16 nt, Staphylococcus aureus subsp. aureus Mu50
auccuuugcucaccuu

SEQ ID NO: 3968631 - RNA, 15 nt, Staphylococcus aureus subsp. aureus Mu50
aucgaaaauuucagg

SEQ ID NO: 3968632 - RNA, 18 nt, Staphylococcus aureus subsp. aureus Mu50
aucgaacaaaugaaaaag

SEQ ID NO: 3968633 - RNA, 13 nt, Staphylococcus aureus subsp. aureus Mu50
aucgaacagaaaa

SEQ ID NO: 3968634 - RNA, 22 nt, Staphylococcus aureus subsp. aureus Mu50
aucgaacagaaaaucguuauaa

SEQ ID NO: 3968635 - RNA, 23 nt, Staphylococcus aureus subsp. aureus Mu50
aucgaacuaguacgaaaugcaau

SEQ ID NO: 3968636 - RNA, 20 nt, Staphylococcus aureus subsp. aureus Mu50
aucgaauaacuguuuaucau

SEQ ID NO: 3968637 - RNA, 21 nt, Staphylococcus aureus subsp. aureus Mu50
aucgaauucauuugcagaacg

SEQ ID NO: 3968638 - RNA, 16 nt, Staphylococcus aureus subsp. aureus Mu50
aucgacuaauuuuucu

SEQ ID NO: 3968639 - RNA, 15 nt, Staphylococcus aureus subsp. aureus Mu50
aucgacuuugucauu

SEQ ID NO: 3968640 - RNA, 21 nt, Staphylococcus aureus subsp. aureus Mu50
aucgagaggguacacuucaac

SEQ ID NO: 3968641 - RNA, 20 nt, Staphylococcus aureus subsp. aureus Mu50
aucgaguuugaaauaaucua

SEQ ID NO: 3968642 - RNA, 13 nt, Staphylococcus aureus subsp. aureus Mu50
aucgauaaaaugu

SEQ ID NO: 3968643 - RNA, 21 nt, Staphylococcus aureus subsp. aureus Mu50
aucgauaaauguauuaaacau

SEQ ID NO: 3968644 - RNA, 20 nt, Staphylococcus aureus subsp. aureus Mu50
aucgauacuggguuuuacca

SEQ ID NO: 3968645 - RNA, 18 nt, Staphylococcus aureus subsp. aureus Mu50
aucgauauagcauaaaau

SEQ ID NO: 3968646 - RNA, 16 nt, Staphylococcus aureus subsp. aureus Mu50
aucgauauaguagcuu

SEQ ID NO: 3968647 - RNA, 19 nt, Staphylococcus aureus subsp. aureus Mu50
aucgauauugagaauauua

SEQ ID NO: 3968648 - RNA, 23 nt, Staphylococcus aureus subsp. aureus Mu50
aucgaucgguauuuucauuuuag

SEQ ID NO: 3968649 - RNA, 15 nt, Staphylococcus aureus subsp. aureus Mu50
aucgaucuaaauaua

SEQ ID NO: 3968650 - RNA, 19 nt, Staphylococcus aureus subsp. aureus Mu50
aucgaugacuuugucuuua

SEQ ID NO: 3968651 - RNA, 18 nt, Staphylococcus aureus subsp. aureus Mu50
aucgauuaguuuuugguu

SEQ ID NO: 3968652 - RNA, 22 nt, Staphylococcus aureus subsp. aureus Mu50
aucgauuuaacauaaaaaugcu

SEQ ID NO: 3968653 - RNA, 22 nt, Staphylococcus aureus subsp. aureus Mu50
aucgauuuuauaucuuucugaa

SEQ ID NO: 3968654 - RNA, 16 nt, Staphylococcus aureus subsp. aureus Mu50
aucgcaaauacauaau

SEQ ID NO: 3968655 - RNA, 17 nt, Staphylococcus aureus subsp. aureus Mu50
aucgcaccgucaaacuu

SEQ ID NO: 3968656 - RNA, 21 nt, Staphylococcus aureus subsp. aureus Mu50
aucgcagcaaugacacuaauu

SEQ ID NO: 3968657 - RNA, 17 nt, Staphylococcus aureus subsp. aureus Mu50
aucgcauguuuguaaau

SEQ ID NO: 3968658 - RNA, 20 nt, Staphylococcus aureus subsp. aureus Mu50
aucgcauucuugguuuuuua

SEQ ID NO: 3968659 - RNA, 16 nt, Staphylococcus aureus subsp. aureus Mu50
aucgcauuuaaauaua

SEQ ID NO: 3968660 - RNA, 23 nt, Staphylococcus aureus subsp. aureus Mu50
aucgcauuuuguuucaacauuuc

SEQ ID NO: 3968661 - RNA, 13 nt, Staphylococcus aureus subsp. aureus Mu50
aucgcccauacca

SEQ ID NO: 3968662 - RNA, 14 nt, Staphylococcus aureus subsp. aureus Mu50
aucgccuaaaaaua

SEQ ID NO: 3968663 - RNA, 15 nt, Staphylococcus aureus subsp. aureus Mu50
aucgccuaaaaauaa

SEQ ID NO: 3968664 - RNA, 16 nt, Staphylococcus aureus subsp. aureus Mu50
aucgccuaaaaauaaa

SEQ ID NO: 3968665 - RNA, 18 nt, Staphylococcus aureus subsp. aureus Mu50
aucgccuaaaaauaaaau

SEQ ID NO: 3968666 - RNA, 16 nt, Staphylococcus aureus subsp. aureus Mu50
aucgccuacuauaaau

SEQ ID NO: 3968667 - RNA, 19 nt, Staphylococcus aureus subsp. aureus Mu50
aucgcgcaucaaaaaugag

SEQ ID NO: 3968668 - RNA, 15 nt, Staphylococcus aureus subsp. aureus Mu50
aucgcuugcuucuuu

SEQ ID NO: 3968669 - RNA, 16 nt, Staphylococcus aureus subsp. aureus Mu50
aucgcuugcuucuuuc

SEQ ID NO: 3968670 - RNA, 15 nt, Staphylococcus aureus subsp. aureus Mu50
aucggaauaaaauaa

SEQ ID NO: 3968671 - RNA, 17 nt, Staphylococcus aureus subsp. aureus Mu50
aucggaauaaaauaaau

SEQ ID NO: 3968672 - RNA, 15 nt, Staphylococcus aureus subsp. aureus Mu50
aucggaucauuauuu

SEQ ID NO: 3968673 - RNA, 17 nt, Staphylococcus aureus subsp. aureus Mu50
aucggcaccaguagcua

SEQ ID NO: 3968674 - RNA, 15 nt, Staphylococcus aureus subsp. aureus Mu50
aucggcucuuuuugu

SEQ ID NO: 3968675 - RNA, 15 nt, Staphylococcus aureus subsp. aureus Mu50
aucgguaauuacuug

SEQ ID NO: 3968676 - RNA, 18 nt, Staphylococcus aureus subsp. aureus Mu50
aucgguaauuacuuguaa

SEQ ID NO: 3968677 - RNA, 14 nt, Staphylococcus aureus subsp. aureus Mu50
aucguaaaaaacaa

SEQ ID NO: 3968678 - RNA, 19 nt, Staphylococcus aureus subsp. aureus Mu50
aucguaaacacuauaaaag

SEQ ID NO: 3968679 - RNA, 20 nt, Staphylococcus aureus subsp. aureus Mu50
aucguaaagaucauuuucaa

SEQ ID NO: 3968680 - RNA, 18 nt, Staphylococcus aureus subsp. aureus Mu50
aucguaacauaucagcuu

SEQ ID NO: 3968681 - RNA, 16 nt, Staphylococcus aureus subsp. aureus Mu50
aucguauucuuuuaau

SEQ ID NO: 3968682 - RNA, 13 nt, Staphylococcus aureus subsp. aureus Mu50
aucgucaucacuu

SEQ ID NO: 3968683 - RNA, 23 nt, Staphylococcus aureus subsp. aureus Mu50
aucgucucacuuaauaaauaauu

SEQ ID NO: 3968684 - RNA, 20 nt, Staphylococcus aureus subsp. aureus Mu50
aucguguauuauugaaacua

SEQ ID NO: 3968685 - RNA, 22 nt, Staphylococcus aureus subsp. aureus Mu50
aucguguauuauugaaacuaau

SEQ ID NO: 3968686 - RNA, 14 nt, Staphylococcus aureus subsp. aureus Mu50
aucguuaaggaaag

SEQ ID NO: 3968687 - RNA, 17 nt, Staphylococcus aureus subsp. aureus Mu50
aucguuaaggaaagcuu

SEQ ID NO: 3968688 - RNA, 22 nt, Staphylococcus aureus subsp. aureus Mu50
aucguuaauaaaccuacaauau

SEQ ID NO: 3968689 - RNA, 20 nt, Staphylococcus aureus subsp. aureus Mu50
aucguuaauguauaaaaagu

SEQ ID NO: 3968690 - RNA, 19 nt, Staphylococcus aureus subsp. aureus Mu50
aucguuauaaguacaaaua

SEQ ID NO: 3968691 - RNA, 13 nt, Staphylococcus aureus subsp. aureus Mu50
aucguucaauguu

SEQ ID NO: 3968692 - RNA, 18 nt, Staphylococcus aureus subsp. aureus Mu50
aucguucaauguuauuaa

SEQ ID NO: 3968693 - RNA, 18 nt, Staphylococcus aureus subsp. aureus Mu50
aucguucauauauuuugu

SEQ ID NO: 3968694 - RNA, 14 nt, Staphylococcus aureus subsp. aureus Mu50
aucguucccauucu

SEQ ID NO: 3968695 - RNA, 15 nt, Staphylococcus aureus subsp. aureus Mu50
aucguucgaaguagc

SEQ ID NO: 3968696 - RNA, 17 nt, Staphylococcus aureus subsp. aureus Mu50
aucguuguaccacccca

SEQ ID NO: 3968697 - RNA, 16 nt, Staphylococcus aureus subsp. aureus Mu50
aucguuucaugcacuu

SEQ ID NO: 3968698 - RNA, 14 nt, Staphylococcus aureus subsp. aureus Mu50
aucuaaacauuuuu

SEQ ID NO: 3968699 - RNA, 17 nt, Staphylococcus aureus subsp. aureus Mu50
aucuaaacuauaauaau

SEQ ID NO: 3968700 - RNA, 16 nt, Staphylococcus aureus subsp. aureus Mu50
aucuaaagcuauaaaa

SEQ ID NO: 3968701 - RNA, 21 nt, Staphylococcus aureus subsp. aureus Mu50
aucuaaaugaucuuuguagcc

SEQ ID NO: 3968702 - RNA, 22 nt, Staphylococcus aureus subsp. aureus Mu50
aucuuaauauugauuaaucuau

SEQ ID NO: 3968703 - RNA, 19 nt, Staphylococcus aureus subsp. aureus Mu50
aucuuaaucagcuauaaaa

SEQ ID NO: 3968704 - RNA, 20 nt, Staphylococcus aureus subsp. aureus Mu50
aucuuaaucagcuauaaaag

SEQ ID NO: 3968705 - RNA, 18 nt, Staphylococcus aureus subsp. aureus Mu50
aucuuacauugauaaaau

SEQ ID NO: 3968706 - RNA, 19 nt, Staphylococcus aureus subsp. aureus Mu50
aucuuacauugauaaaaua

SEQ ID NO: 3968707 - RNA, 16 nt, Staphylococcus aureus subsp. aureus Mu50
aucuuaccuuuauguu

SEQ ID NO: 3968708 - RNA, 19 nt, Staphylococcus aureus subsp. aureus Mu50
aucuuagacgcuguuuuaa

SEQ ID NO: 3968709 - RNA, 20 nt, Staphylococcus aureus subsp. aureus Mu50
aucuuaggugucaucgcuuu

SEQ ID NO: 3968710 - RNA, 15 nt, Staphylococcus aureus subsp. aureus Mu50
aucuuaguacaaaau

SEQ ID NO: 3968711 - RNA, 12 nt, Staphylococcus aureus subsp. aureus Mu50
aucuuaucaaga

SEQ ID NO: 3968712 - RNA, 13 nt, Staphylococcus aureus subsp. aureus Mu50
aucuuaucaagaa

SEQ ID NO: 3968713 - RNA, 14 nt, Staphylococcus aureus subsp. aureus Mu50
aucuuaucauaauc

SEQ ID NO: 3968714 - RNA, 16 nt, Staphylococcus aureus subsp. aureus Mu50
aucuuaucggcucuuu

SEQ ID NO: 3968715 - RNA, 12 nt, Staphylococcus aureus subsp. aureus Mu50
aucuuauuauua

SEQ ID NO: 3968716 - RNA, 23 nt, Staphylococcus aureus subsp. aureus Mu50
aucuucaacauaacucaaauauc

SEQ ID NO: 3968717 - RNA, 17 nt, Staphylococcus aureus subsp. aureus Mu50
aucuucaacuucgauau

SEQ ID NO: 3968718 - RNA, 22 nt, Staphylococcus aureus subsp. aureus Mu50
aucuucaacuucgauaugauua

SEQ ID NO: 3968719 - RNA, 16 nt, Staphylococcus aureus subsp. aureus Mu50
aucuucaauauuuaaa

SEQ ID NO: 3968720 - RNA, 18 nt, Staphylococcus aureus subsp. aureus Mu50
aucuucaauauuuaaauu

SEQ ID NO: 3968721 - RNA, 18 nt, Staphylococcus aureus subsp. aureus Mu50
aucuucacgcuuauucga

SEQ ID NO: 3968722 - RNA, 14 nt, Staphylococcus aureus subsp. aureus Mu50
aucuucaguauaga

SEQ ID NO: 3968723 - RNA, 16 nt, Staphylococcus aureus subsp. aureus Mu50
aucuucccaucuuuua

SEQ ID NO: 3968724 - RNA, 23 nt, Staphylococcus aureus subsp. aureus Mu50
aucuucgacuacaaguuuauaau

SEQ ID NO: 3968725 - RNA, 22 nt, Staphylococcus aureus subsp. aureus Mu50
aucuucguauaguacuaaaagu

SEQ ID NO: 3968726 - RNA, 23 nt, Staphylococcus aureus subsp. aureus Mu50
aucuucguauaguacuaaaagua

SEQ ID NO: 3968727 - RNA, 18 nt, Staphylococcus aureus subsp. aureus Mu50
aucuucuaaaucaauaua

SEQ ID NO: 3968728 - RNA, 14 nt, Staphylococcus aureus subsp. aureus Mu50
aucuucuaauucca

SEQ ID NO: 3968729 - RNA, 23 nt, Staphylococcus aureus subsp. aureus Mu50
aucuucuaauucguuuugcuaac

SEQ ID NO: 3968730 - RNA, 22 nt, Staphylococcus aureus subsp. aureus Mu50
aucuucuccaaucaucauuaaa

SEQ ID NO: 3968731 - RNA, 21 nt, Staphylococcus aureus subsp. aureus Mu50
aucuucuggauagguaucacu

SEQ ID NO: 3968732 - RNA, 13 nt, Staphylococcus aureus subsp. aureus Mu50
aucuucuucaaaa

SEQ ID NO: 3968733 - RNA, 15 nt, Staphylococcus aureus subsp. aureus Mu50
aucuugagauuuuca

SEQ ID NO: 3968734 - RNA, 16 nt, Staphylococcus aureus subsp. aureus Mu50
aucuugauuauauuuu

SEQ ID NO: 3968735 - RNA, 19 nt, Staphylococcus aureus subsp. aureus Mu50
aucuugcaagccaucaaua

SEQ ID NO: 3968736 - RNA, 22 nt, Staphylococcus aureus subsp. aureus Mu50
aucuugcuuauugauauaagau

SEQ ID NO: 3968737 - RNA, 21 nt, Staphylococcus aureus subsp. aureus Mu50
aucuugucuaguucgauuuuu

SEQ ID NO: 3968738 - RNA, 17 nt, Staphylococcus aureus subsp. aureus Mu50
aucuuguucuaauuguu

SEQ ID NO: 3968739 - RNA, 23 nt, Staphylococcus aureus subsp. aureus Mu50
aucuuguucuucgucaaauucaa

SEQ ID NO: 3968740 - RNA, 16 nt, Staphylococcus aureus subsp. aureus Mu50
aucuuuaaagucaaca

SEQ ID NO: 3968741 - RNA, 20 nt, Staphylococcus aureus subsp. aureus Mu50
aucuuuaacauuuauucuuu

SEQ ID NO: 3968742 - RNA, 20 nt, Staphylococcus aureus subsp. aureus Mu50
aucuuuaauaaccuuuaaaa

SEQ ID NO: 3968743 - RNA, 14 nt, Staphylococcus aureus subsp. aureus Mu50
aucuuuaauacgaa

SEQ ID NO: 3968744 - RNA, 14 nt, Staphylococcus aureus subsp. aureus Mu50
aucuuuaaucaaag

SEQ ID NO: 3968745 - RNA, 15 nt, Staphylococcus aureus subsp. aureus Mu50
aucuuuaauuuacaa

SEQ ID NO: 3968746 - RNA, 18 nt, Staphylococcus aureus subsp. aureus Mu50
aucuuuaauuuacaauua

SEQ ID NO: 3968747 - RNA, 18 nt, Staphylococcus aureus subsp. aureus Mu50
aucuuuacgauaaacuaa

SEQ ID NO: 3968748 - RNA, 20 nt, Staphylococcus aureus subsp. aureus Mu50
aucuuuacgauaaacuaaaa

SEQ ID NO: 3968749 - RNA, 22 nt, Staphylococcus aureus subsp. aureus Mu50
aucuuuacgauaaacuaaaaag

SEQ ID NO: 3968750 - RNA, 21 nt, Staphylococcus aureus subsp. aureus Mu50
aucuuuagagacuuauuuuau

SEQ ID NO: 3968751 - RNA, 16 nt, Staphylococcus aureus subsp. aureus Mu50
aucuuuaguauuggua

SEQ ID NO: 3968752 - RNA, 17 nt, Staphylococcus aureus subsp. aureus Mu50
aucuuuaguauuucauc

SEQ ID NO: 3968753 - RNA, 19 nt, Staphylococcus aureus subsp. aureus Mu50
aucuuuaguauuucaucau

SEQ ID NO: 3968754 - RNA, 19 nt, Staphylococcus aureus subsp. aureus Mu50
aucuuuaucaguuuguccu

SEQ ID NO: 3968755 - RNA, 19 nt, Staphylococcus aureus subsp. aureus Mu50
aucuuuauuugauucuuca

SEQ ID NO: 3968756 - RNA, 11 nt, Staphylococcus aureus subsp. aureus Mu50
aucuuucaaag

SEQ ID NO: 3968757 - RNA, 12 nt, Staphylococcus aureus subsp. aureus Mu50
aucuuucaaagu

SEQ ID NO: 3968758 - RNA, 13 nt, Staphylococcus aureus subsp. aureus Mu50
aucuuucaaagua

SEQ ID NO: 3968759 - RNA, 20 nt, Staphylococcus aureus subsp. aureus Mu50
aucuuucaacgcauauucua

SEQ ID NO: 3968760 - RNA, 17 nt, Staphylococcus aureus subsp. aureus Mu50
aucuuucaauuaauuua

SEQ ID NO: 3968761 - RNA, 17 nt, Staphylococcus aureus subsp. aureus Mu50
aucuuucacaauuguau

SEQ ID NO: 3968762 - RNA, 22 nt, Staphylococcus aureus subsp. aureus Mu50
aucuuucuuuguguuugcuuuu

SEQ ID NO: 3968763 - RNA, 20 nt, Staphylococcus aureus subsp. aureus Mu50
aucuuuguaaccuaaaaaca

SEQ ID NO: 3968764 - RNA, 21 nt, Staphylococcus aureus subsp. aureus Mu50
aucuuugugucgcaagcguuc

SEQ ID NO: 3968765 - RNA, 18 nt, Staphylococcus aureus subsp. aureus Mu50
aucuuuguuauauuuuua

SEQ ID NO: 3968766 - RNA, 14 nt, Staphylococcus aureus subsp. aureus Mu50
aucuuuuaauucuu

SEQ ID NO: 3968767 - RNA, 12 nt, Staphylococcus aureus subsp. aureus Mu50
aucuuuuagcuu

SEQ ID NO: 3968768 - RNA, 18 nt, Staphylococcus aureus subsp. aureus Mu50
aucuuuuagguaauaauu

SEQ ID NO: 3968769 - RNA, 13 nt, Staphylococcus aureus subsp. aureus Mu50
aucuuuuauccaa

SEQ ID NO: 3968770 - RNA, 21 nt, Staphylococcus aureus subsp. aureus Mu50
aucuuuuauccaauguauaaa

SEQ ID NO: 3968771 - RNA, 17 nt, Staphylococcus aureus subsp. aureus Mu50
aucuuuucaucguucau

SEQ ID NO: 3968772 - RNA, 13 nt, Staphylococcus aureus subsp. aureus Mu50
aucuuuuccaaaa

SEQ ID NO: 3968773 - RNA, 20 nt, Staphylococcus aureus subsp. aureus Mu50
aucuuuuccaaaacaaaaau

SEQ ID NO: 3968774 - RNA, 23 nt, Staphylococcus aureus subsp. aureus Mu50
aucuuuuccauucauaaaagcaa

SEQ ID NO: 3968775 - RNA, 13 nt, Staphylococcus aureus subsp. aureus Mu50
aucuuuugcuucg

SEQ ID NO: 3968776 - RNA, 19 nt, Staphylococcus aureus subsp. aureus Mu50
aucuuuugguuuaucuguu

SEQ ID NO: 3968777 - RNA, 21 nt, Staphylococcus aureus subsp. aureus Mu50
aucuuuugguuuaucuguugu

SEQ ID NO: 3968778 - RNA, 23 nt, Staphylococcus aureus subsp. aureus Mu50
aucuuuuguaagacuucccaauc

SEQ ID NO: 3968779 - RNA, 14 nt, Staphylococcus aureus subsp. aureus Mu50
aucuuuuuaaaagg

SEQ ID NO: 3968780 - RNA, 21 nt, Staphylococcus aureus subsp. aureus Mu50
aucuuuuucaugcuauuuaaa

SEQ ID NO: 3968781 - RNA, 13 nt, Staphylococcus aureus subsp. aureus Mu50
aucuuuuugaaau

SEQ ID NO: 3968782 - RNA, 14 nt, Staphylococcus aureus subsp. aureus Mu50
aucuuuuugaaauu

SEQ ID NO: 3968783 - RNA, 15 nt, Staphylococcus aureus subsp. aureus Mu50
aucuuuuugaaauuu

SEQ ID NO: 3968784 - RNA, 22 nt, Staphylococcus aureus subsp. aureus Mu50
aucuuuuuuacuaaaaucacuu

SEQ ID NO: 3968785 - RNA, 23 nt, Staphylococcus aureus subsp. aureus Mu50
augaaaaagauucggaaaauaug

SEQ ID NO: 3968786 - RNA, 13 nt, Staphylococcus aureus subsp. aureus Mu50
augaaaaaguaaa

SEQ ID NO: 3968787 - RNA, 16 nt, Staphylococcus aureus subsp. aureus Mu50
augaaaacagguggaa

SEQ ID NO: 3968788 - RNA, 15 nt, Staphylococcus aureus subsp. aureus Mu50
augaaaaguaaauug

SEQ ID NO: 3968789 - RNA, 15 nt, Staphylococcus aureus subsp. aureus Mu50
augacuauuuuccau

SEQ ID NO: 3968790 - RNA, 19 nt, Staphylococcus aureus subsp. aureus Mu50
augacugagaaaaauauuu

SEQ ID NO: 3968791 - RNA, 20 nt, Staphylococcus aureus subsp. aureus Mu50
augacugagaaaaauauuuc

SEQ ID NO: 3968792 - RNA, 23 nt, Staphylococcus aureus subsp. aureus Mu50
augacugagaaaaauauuucuaa

SEQ ID NO: 3968793 - RNA, 14 nt, Staphylococcus aureus subsp. aureus Mu50
augacugcaaauac

SEQ ID NO: 3968794 - RNA, 13 nt, Staphylococcus aureus subsp. aureus Mu50
augacuguagaaa

SEQ ID NO: 3968795 - RNA, 20 nt, Staphylococcus aureus subsp. aureus Mu50
augacuuauuuuucaucauu

SEQ ID NO: 3968796 - RNA, 20 nt, Staphylococcus aureus subsp. aureus Mu50
augacuucacauuuauccuu

SEQ ID NO: 3968797 - RNA, 16 nt, Staphylococcus aureus subsp. aureus Mu50
augacuucuuuauauu

SEQ ID NO: 3968798 - RNA, 23 nt, Staphylococcus aureus subsp. aureus Mu50
augacuuuuuauuaguauucaaa

SEQ ID NO: 3968799 - RNA, 12 nt, Staphylococcus aureus subsp. aureus Mu50
augagaaauguu

SEQ ID NO: 3968800 - RNA, 22 nt, Staphylococcus aureus subsp. aureus Mu50
augagaagcugucuuacugcug

SEQ ID NO: 3968801 - RNA, 21 nt, Staphylococcus aureus subsp. aureus Mu50
augagacgcauugcaagacuu

SEQ ID NO: 3968802 - RNA, 21 nt, Staphylococcus aureus subsp. aureus Mu50
augagaguaauguuccauaua

SEQ ID NO: 3968803 - RNA, 20 nt, Staphylococcus aureus subsp. aureus Mu50
augagauuauuuuuuuaaau

SEQ ID NO: 3968804 - RNA, 15 nt, Staphylococcus aureus subsp. aureus Mu50
augagcgcauaaauu

SEQ ID NO: 3968805 - RNA, 19 nt, Staphylococcus aureus subsp. aureus Mu50
augagcuucuuuaaauaca

SEQ ID NO: 3968806 - RNA, 17 nt, Staphylococcus aureus subsp. aureus Mu50
augagguucaguagaau

SEQ ID NO: 3968807 - RNA, 19 nt, Staphylococcus aureus subsp. aureus Mu50
augagguucaguagaauug

SEQ ID NO: 3968808 - RNA, 11 nt, Staphylococcus aureus subsp. aureus Mu50
augaguacaac

SEQ ID NO: 3968809 - RNA, 21 nt, Staphylococcus aureus subsp. aureus Mu50
augaguccuuuuuaguaguuu

SEQ ID NO: 3968810 - RNA, 19 nt, Staphylococcus aureus subsp. aureus Mu50
augaguuaguggaucacga

SEQ ID NO: 3968811 - RNA, 17 nt, Staphylococcus aureus subsp. aureus Mu50
augaguugaagcuaauu

SEQ ID NO: 3968812 - RNA, 14 nt, Staphylococcus aureus subsp. aureus Mu50
augaguuuaaaaau

SEQ ID NO: 3968813 - RNA, 18 nt, Staphylococcus aureus subsp. aureus Mu50
augaguuuacuaaacuuu

SEQ ID NO: 3968814 - RNA, 17 nt, Staphylococcus aureus subsp. aureus Mu50
augaguuucucaucuac

SEQ ID NO: 3968815 - RNA, 24 nt, Staphylococcus aureus subsp. aureus Mu50
augaguuucucaucuacuauuuaa

SEQ ID NO: 3968816 - RNA, 19 nt, Staphylococcus aureus subsp. aureus Mu50
augauaaccauuaugauua

SEQ ID NO: 3968817 - RNA, 22 nt, Staphylococcus aureus subsp. aureus Mu50
augauaacucguaaucauagca

SEQ ID NO: 3968818 - RNA, 14 nt, Staphylococcus aureus subsp. aureus Mu50
augauaagaaucau

SEQ ID NO: 3968819 - RNA, 11 nt, Staphylococcus aureus subsp. aureus Mu50
augauaauuaa

SEQ ID NO: 3968820 - RNA, 18 nt, Staphylococcus aureus subsp. aureus Mu50
augauaauuaauuaaaau

SEQ ID NO: 3968821 - RNA, 22 nt, Staphylococcus aureus subsp. aureus Mu50
augauaauuuaauaacguacau

SEQ ID NO: 3968822 - RNA, 17 nt, Staphylococcus aureus subsp. aureus Mu50
augauaauuuaauaaug

SEQ ID NO: 3968823 - RNA, 22 nt, Staphylococcus aureus subsp. aureus Mu50
augauacaaacccauauaaaug

SEQ ID NO: 3968824 - RNA, 16 nt, Staphylococcus aureus subsp. aureus Mu50
augauacgcuuuuuaa

SEQ ID NO: 3968825 - RNA, 19 nt, Staphylococcus aureus subsp. aureus Mu50
augauacgcuuuuuaaaaa

SEQ ID NO: 3968826 - RNA, 19 nt, Staphylococcus aureus subsp. aureus Mu50
augauacguacguugaugu

SEQ ID NO: 3968827 - RNA, 18 nt, Staphylococcus aureus subsp. aureus Mu50
augauacgugguuuuauu

SEQ ID NO: 3968828 - RNA, 17 nt, Staphylococcus aureus subsp. aureus Mu50
augauacucaauaaaau

SEQ ID NO: 3968829 - RNA, 16 nt, Staphylococcus aureus subsp. aureus Mu50
augauagaauacuaaa

SEQ ID NO: 3968830 - RNA, 15 nt, Staphylococcus aureus subsp. aureus Mu50
augauagauuuagga

SEQ ID NO: 3968831 - RNA, 16 nt, Staphylococcus aureus subsp. aureus Mu50
augauagccgcuucau

SEQ ID NO: 3968832 - RNA, 20 nt, Staphylococcus aureus subsp. aureus Mu50
augauagccgcuucauugau

SEQ ID NO: 3968833 - RNA, 16 nt, Staphylococcus aureus subsp. aureus Mu50
augauagcuaaacauu

SEQ ID NO: 3968834 - RNA, 22 nt, Staphylococcus aureus subsp. aureus Mu50
augauaguguaugaauggcaau

SEQ ID NO: 3968835 - RNA, 13 nt, Staphylococcus aureus subsp. aureus Mu50
augauauauguaa

SEQ ID NO: 3968836 - RNA, 14 nt, Staphylococcus aureus subsp. aureus Mu50
augauauauucauc

SEQ ID NO: 3968837 - RNA, 16 nt, Staphylococcus aureus subsp. aureus Mu50
augauauccaaagcuu

SEQ ID NO: 3968838 - RNA, 16 nt, Staphylococcus aureus subsp. aureus Mu50
augauauuacauauaa

SEQ ID NO: 3968839 - RNA, 18 nt, Staphylococcus aureus subsp. aureus Mu50
augauauuaccuucaagu

SEQ ID NO: 3968840 - RNA, 16 nt, Staphylococcus aureus subsp. aureus Mu50
augauauugaaagugu

SEQ ID NO: 3968841 - RNA, 23 nt, Staphylococcus aureus subsp. aureus Mu50
augauauugauuugauucauuac

SEQ ID NO: 3968842 - RNA, 17 nt, Staphylococcus aureus subsp. aureus Mu50
augauauuuaacaaaau

SEQ ID NO: 3968843 - RNA, 18 nt, Staphylococcus aureus subsp. aureus Mu50
augaucagggaaaucauc

SEQ ID NO: 3968844 - RNA, 17 nt, Staphylococcus aureus subsp. aureus Mu50
augaugaacuuaaugcu

SEQ ID NO: 3968845 - RNA, 14 nt, Staphylococcus aureus subsp. aureus Mu50
augaugaauuguug

SEQ ID NO: 3968846 - RNA, 23 nt, Staphylococcus aureus subsp. aureus Mu50
augaugaauuguuguacauguau

SEQ ID NO: 3968847 - RNA, 16 nt, Staphylococcus aureus subsp. aureus Mu50
augaugagauaaaauc

SEQ ID NO: 3968848 - RNA, 17 nt, Staphylococcus aureus subsp. aureus Mu50
augaugagauaaaauca

SEQ ID NO: 3968849 - RNA, 20 nt, Staphylococcus aureus subsp. aureus Mu50
augaugauaaaaauaaaacc

SEQ ID NO: 3968850 - RNA, 14 nt, Staphylococcus aureus subsp. aureus Mu50
augaugauaaauug

SEQ ID NO: 3968851 - RNA, 15 nt, Staphylococcus aureus subsp. aureus Mu50
augaugauaaauuga

SEQ ID NO: 3968852 - RNA, 14 nt, Staphylococcus aureus subsp. aureus Mu50
augaugauuuaagu

SEQ ID NO: 3968853 - RNA, 21 nt, Staphylococcus aureus subsp. aureus Mu50
augaugcuucgcacaacugca

SEQ ID NO: 3968854 - RNA, 20 nt, Staphylococcus aureus subsp. aureus Mu50
augaugggaaaucaguaaua

SEQ ID NO: 3968855 - RNA, 17 nt, Staphylococcus aureus subsp. aureus Mu50
augauggguaguuaaua

SEQ ID NO: 3968856 - RNA, 15 nt, Staphylococcus aureus subsp. aureus Mu50
augauggguauuuug

SEQ ID NO: 3968857 - RNA, 14 nt, Staphylococcus aureus subsp. aureus Mu50
augaugucauguau

SEQ ID NO: 3968858 - RNA, 21 nt, Staphylococcus aureus subsp. aureus Mu50
augaugugcaaacgauauguu

SEQ ID NO: 3968859 - RNA, 15 nt, Staphylococcus aureus subsp. aureus Mu50
augauguuaaaaaau

SEQ ID NO: 3968860 - RNA, 21 nt, Staphylococcus aureus subsp. aureus Mu50
augauguuaaaaaauauguau

SEQ ID NO: 3968861 - RNA, 16 nt, Staphylococcus aureus subsp. aureus Mu50
augauguucaauauuu

SEQ ID NO: 3968862 - RNA, 16 nt, Staphylococcus aureus subsp. aureus Mu50
augauuaaaaaucaaa

SEQ ID NO: 3968863 - RNA, 24 nt, Staphylococcus aureus subsp. aureus Mu50
augauuaaaaaucaaagaggcuuu

SEQ ID NO: 3968864 - RNA, 18 nt, Staphylococcus aureus subsp. aureus Mu50
augauuaaagcgauaaua

SEQ ID NO: 3968865 - RNA, 21 nt, Staphylococcus aureus subsp. aureus Mu50
augauuaaaguguuucaacau

SEQ ID NO: 3968866 - RNA, 17 nt, Staphylococcus aureus subsp. aureus Mu50
augauuaacuuucuaau

SEQ ID NO: 3968867 - RNA, 14 nt, Staphylococcus aureus subsp. aureus Mu50
augauuaauaaagu

SEQ ID NO: 3968868 - RNA, 14 nt, Staphylococcus aureus subsp. aureus Mu50
augauuaauuaaag

SEQ ID NO: 3968869 - RNA, 22 nt, Staphylococcus aureus subsp. aureus Mu50
augauuaauuaaagauuaaaau

SEQ ID NO: 3968870 - RNA, 19 nt, Staphylococcus aureus subsp. aureus Mu50
augauuacuccaauuacca

SEQ ID NO: 3968871 - RNA, 16 nt, Staphylococcus aureus subsp. aureus Mu50
augauuacuuuaagau

SEQ ID NO: 3968872 - RNA, 20 nt, Staphylococcus aureus subsp. aureus Mu50
augauuacuuuaagauuauu

SEQ ID NO: 3968873 - RNA, 22 nt, Staphylococcus aureus subsp. aureus Mu50
augauuacuuuaagauuauuug

SEQ ID NO: 3968874 - RNA, 20 nt, Staphylococcus aureus subsp. aureus Mu50
augauuagcgcaccaauuau

SEQ ID NO: 3968875 - RNA, 13 nt, Staphylococcus aureus subsp. aureus Mu50
augauuauauuuu

SEQ ID NO: 3968876 - RNA, 16 nt, Staphylococcus aureus subsp. aureus Mu50
augcuaauuuaacugc

SEQ ID NO: 3968877 - RNA, 21 nt, Staphylococcus aureus subsp. aureus Mu50
augcuacacgaguauuaucac

SEQ ID NO: 3968878 - RNA, 14 nt, Staphylococcus aureus subsp. aureus Mu50
augcuauuuaaauc

SEQ ID NO: 3968879 - RNA, 19 nt, Staphylococcus aureus subsp. aureus Mu50
augcucuauauauccauuc

SEQ ID NO: 3968880 - RNA, 20 nt, Staphylococcus aureus subsp. aureus Mu50
augcucuauauauccauuca

SEQ ID NO: 3968881 - RNA, 19 nt, Staphylococcus aureus subsp. aureus Mu50
augcucucuucaaaguaga

SEQ ID NO: 3968882 - RNA, 16 nt, Staphylococcus aureus subsp. aureus Mu50
augcucuuuagguaaa

SEQ ID NO: 3968883 - RNA, 17 nt, Staphylococcus aureus subsp. aureus Mu50
augcugaauaaauaacu

SEQ ID NO: 3968884 - RNA, 20 nt, Staphylococcus aureus subsp. aureus Mu50
augcugcaagucucauaucu

SEQ ID NO: 3968885 - RNA, 21 nt, Staphylococcus aureus subsp. aureus Mu50
augcugcuucuucagguguuu

SEQ ID NO: 3968886 - RNA, 19 nt, Staphylococcus aureus subsp. aureus Mu50
augcugucaaacaacaauc

SEQ ID NO: 3968887 - RNA, 18 nt, Staphylococcus aureus subsp. aureus Mu50
augcuguuggcaaaacaa

SEQ ID NO: 3968888 - RNA, 12 nt, Staphylococcus aureus subsp. aureus Mu50
augcuguuuuau

SEQ ID NO: 3968889 - RNA, 15 nt, Staphylococcus aureus subsp. aureus Mu50
augcuuaaaaacaau

SEQ ID NO: 3968890 - RNA, 18 nt, Staphylococcus aureus subsp. aureus Mu50
augcuuaaaaacaauauu

SEQ ID NO: 3968891 - RNA, 16 nt, Staphylococcus aureus subsp. aureus Mu50
augcuuaauaaaauca

SEQ ID NO: 3968892 - RNA, 18 nt, Staphylococcus aureus subsp. aureus Mu50
augcuuaauuuguuuuaa

SEQ ID NO: 3968893 - RNA, 21 nt, Staphylococcus aureus subsp. aureus Mu50
augcuuagcgaacgcuagcau

SEQ ID NO: 3968894 - RNA, 12 nt, Staphylococcus aureus subsp. aureus Mu50
augcuucaaagu

SEQ ID NO: 3968895 - RNA, 15 nt, Staphylococcus aureus subsp. aureus Mu50
augcuucaaagucaa

SEQ ID NO: 3968896 - RNA, 22 nt, Staphylococcus aureus subsp. aureus Mu50
augcuuccuuuuuguuauaucu

SEQ ID NO: 3968897 - RNA, 17 nt, Staphylococcus aureus subsp. aureus Mu50
augcuucgaauuuaaca

SEQ ID NO: 3968898 - RNA, 19 nt, Staphylococcus aureus subsp. aureus Mu50
augcuucgcacaacugcau

SEQ ID NO: 3968899 - RNA, 22 nt, Staphylococcus aureus subsp. aureus Mu50
augcuucgcacaacugcauaaa

SEQ ID NO: 3968900 - RNA, 19 nt, Staphylococcus aureus subsp. aureus Mu50
augcuucgcaucacugcau

SEQ ID NO: 3968901 - RNA, 22 nt, Staphylococcus aureus subsp. aureus Mu50
augcuucgcaucacugcauaua

SEQ ID NO: 3968902 - RNA, 16 nt, Staphylococcus aureus subsp. aureus Mu50
augcuucugguucuuc

SEQ ID NO: 3968903 - RNA, 21 nt, Staphylococcus aureus subsp. aureus Mu50
augcuugaauguuugaaguga

SEQ ID NO: 3968904 - RNA, 17 nt, Staphylococcus aureus subsp. aureus Mu50
augcuuggacauauacu

SEQ ID NO: 3968905 - RNA, 14 nt, Staphylococcus aureus subsp. aureus Mu50
augcuuuaaaucga

SEQ ID NO: 3968906 - RNA, 20 nt, Staphylococcus aureus subsp. aureus Mu50
augcuuuaugugcagcuuga

SEQ ID NO: 3968907 - RNA, 15 nt, Staphylococcus aureus subsp. aureus Mu50
augcuuuuaauauua

SEQ ID NO: 3968908 - RNA, 17 nt, Staphylococcus aureus subsp. aureus Mu50
augcuuuuaauauuaua

SEQ ID NO: 3968909 - RNA, 13 nt, Staphylococcus aureus subsp. aureus Mu50
augcuuuuuuuac

SEQ ID NO: 3968910 - RNA, 15 nt, Staphylococcus aureus subsp. aureus Mu50
auggaaaaguuuuuu

SEQ ID NO: 3968911 - RNA, 20 nt, Staphylococcus aureus subsp. aureus Mu50
auggaaaauguuaucaauau

SEQ ID NO: 3968912 - RNA, 17 nt, Staphylococcus aureus subsp. aureus Mu50
auggaaaggcguuuuuu

SEQ ID NO: 3968913 - RNA, 21 nt, Staphylococcus aureus subsp. aureus Mu50
auggaaguuguugcuuuggua

SEQ ID NO: 3968914 - RNA, 16 nt, Staphylococcus aureus subsp. aureus Mu50
auggaauagucccuuu

SEQ ID NO: 3968915 - RNA, 16 nt, Staphylococcus aureus subsp. aureus Mu50
auggacaguuuuuaua

SEQ ID NO: 3968916 - RNA, 17 nt, Staphylococcus aureus subsp. aureus Mu50
auggacuaagauauaag

SEQ ID NO: 3968917 - RNA, 22 nt, Staphylococcus aureus subsp. aureus Mu50
auggacuaagauauaaggaaaa

SEQ ID NO: 3968918 - RNA, 15 nt, Staphylococcus aureus subsp. aureus Mu50
auggagcggaagaua

SEQ ID NO: 3968919 - RNA, 13 nt, Staphylococcus aureus subsp. aureus Mu50
auggauauucaau

SEQ ID NO: 3968920 - RNA, 18 nt, Staphylococcus aureus subsp. aureus Mu50
auggauauucaaugaauu

SEQ ID NO: 3968921 - RNA, 21 nt, Staphylococcus aureus subsp. aureus Mu50
auggaucauaaucauaaaaau

SEQ ID NO: 3968922 - RNA, 20 nt, Staphylococcus aureus subsp. aureus Mu50
auggauuauuaugccuuuga

SEQ ID NO: 3968923 - RNA, 14 nt, Staphylococcus aureus subsp. aureus Mu50
auggauugauaaua

SEQ ID NO: 3968924 - RNA, 14 nt, Staphylococcus aureus subsp. aureus Mu50
auggauuucuuauu

SEQ ID NO: 3968925 - RNA, 15 nt, Staphylococcus aureus subsp. aureus Mu50
auggcagcgaucuuu

SEQ ID NO: 3968926 - RNA, 20 nt, Staphylococcus aureus subsp. aureus Mu50
auggcaucaucaccauacua

SEQ ID NO: 3968927 - RNA, 19 nt, Staphylococcus aureus subsp. aureus Mu50
auggcaucuggcaaauugc

SEQ ID NO: 3968928 - RNA, 20 nt, Staphylococcus aureus subsp. aureus Mu50
auggcaucuggcaaauugcc

SEQ ID NO: 3968929 - RNA, 20 nt, Staphylococcus aureus subsp. aureus Mu50
auggccaaauguugauaaua

SEQ ID NO: 3968930 - RNA, 15 nt, Staphylococcus aureus subsp. aureus Mu50
auggcuacuuuuuca

SEQ ID NO: 3968931 - RNA, 20 nt, Staphylococcus aureus subsp. aureus Mu50
auggcuagucuuuaacuuua

SEQ ID NO: 3968932 - RNA, 21 nt, Staphylococcus aureus subsp. aureus Mu50
auggcuagucuuuaacuuuaa

SEQ ID NO: 3968933 - RNA, 20 nt, Staphylococcus aureus subsp. aureus Mu50
auggcuauguuuuacgccaa

SEQ ID NO: 3968934 - RNA, 16 nt, Staphylococcus aureus subsp. aureus Mu50
auggcucguuuuuuua

SEQ ID NO: 3968935 - RNA, 16 nt, Staphylococcus aureus subsp. aureus Mu50
auggcugcaucaauau

SEQ ID NO: 3968936 - RNA, 17 nt, Staphylococcus aureus subsp. aureus Mu50
auggcugcaucaauaug

SEQ ID NO: 3968937 - RNA, 19 nt, Staphylococcus aureus subsp. aureus Mu50
auggcugcaucaauaugac

SEQ ID NO: 3968938 - RNA, 20 nt, Staphylococcus aureus subsp. aureus Mu50
auggcugcaucaauaugacc

SEQ ID NO: 3968939 - RNA, 22 nt, Staphylococcus aureus subsp. aureus Mu50
auggcuuagguuuaauuuuaaa

SEQ ID NO: 3968940 - RNA, 16 nt, Staphylococcus aureus subsp. aureus Mu50
auggcuucgcuaauaa

SEQ ID NO: 3968941 - RNA, 23 nt, Staphylococcus aureus subsp. aureus Mu50
auggcuuuuuuugcuguuuaguu

SEQ ID NO: 3968942 - RNA, 16 nt, Staphylococcus aureus subsp. aureus Mu50
augggagaaauuuuuc

SEQ ID NO: 3968943 - RNA, 19 nt, Staphylococcus aureus subsp. aureus Mu50
augggagugggacagaaau

SEQ ID NO: 3968944 - RNA, 21 nt, Staphylococcus aureus subsp. aureus Mu50
augggauuucacuugaccacu

SEQ ID NO: 3968945 - RNA, 12 nt, Staphylococcus aureus subsp. aureus Mu50
augggccccaac

SEQ ID NO: 3968946 - RNA, 21 nt, Staphylococcus aureus subsp. aureus Mu50
augggccccaacacagagaau

SEQ ID NO: 3968947 - RNA, 13 nt, Staphylococcus aureus subsp. aureus Mu50
auggguauuuugu

SEQ ID NO: 3968948 - RNA, 23 nt, Staphylococcus aureus subsp. aureus Mu50
augguaaaacccaguaucgauuu

SEQ ID NO: 3968949 - RNA, 16 nt, Staphylococcus aureus subsp. aureus Mu50
augguaaguauaauua

SEQ ID NO: 3968950 - RNA, 20 nt, Staphylococcus aureus subsp. aureus Mu50
augguaaguauaauuaaacu

SEQ ID NO: 3968951 - RNA, 15 nt, Staphylococcus aureus subsp. aureus Mu50
augguacuaaaguug

SEQ ID NO: 3968952 - RNA, 19 nt, Staphylococcus aureus subsp. aureus Mu50
augguaucaauagccauuu

SEQ ID NO: 3968953 - RNA, 21 nt, Staphylococcus aureus subsp. aureus Mu50
augguaucaauagccauuucc

SEQ ID NO: 3968954 - RNA, 17 nt, Staphylococcus aureus subsp. aureus Mu50
augguaucuuuaauuuc

SEQ ID NO: 3968955 - RNA, 14 nt, Staphylococcus aureus subsp. aureus Mu50
auggucaacuuuuu

SEQ ID NO: 3968956 - RNA, 20 nt, Staphylococcus aureus subsp. aureus Mu50
auggucaacuuuuuuaacuu

SEQ ID NO: 3968957 - RNA, 22 nt, Staphylococcus aureus subsp. aureus Mu50
auggucaaucacuccucuauuu

SEQ ID NO: 3968958 - RNA, 15 nt, Staphylococcus aureus subsp. aureus Mu50
auggucuggaauaaa

SEQ ID NO: 3968959 - RNA, 15 nt, Staphylococcus aureus subsp. aureus Mu50
auggugaacuaaauu

SEQ ID NO: 3968960 - RNA, 22 nt, Staphylococcus aureus subsp. aureus Mu50
auggugaacuguuaaacucaua

SEQ ID NO: 3968961 - RNA, 14 nt, Staphylococcus aureus subsp. aureus Mu50
auggugguaccaca

SEQ ID NO: 3968962 - RNA, 19 nt, Staphylococcus aureus subsp. aureus Mu50
auggugguaccacauacau

SEQ ID NO: 3968963 - RNA, 17 nt, Staphylococcus aureus subsp. aureus Mu50
augucauguauugucca

SEQ ID NO: 3968964 - RNA, 19 nt, Staphylococcus aureus subsp. aureus Mu50
auguccauacguuccuaaa

SEQ ID NO: 3968965 - RNA, 22 nt, Staphylococcus aureus subsp. aureus Mu50
augucccguuuaccuuaaauac

SEQ ID NO: 3968966 - RNA, 15 nt, Staphylococcus aureus subsp. aureus Mu50
auguccugaauguuc

SEQ ID NO: 3968967 - RNA, 14 nt, Staphylococcus aureus subsp. aureus Mu50
augucgaaaauagc

SEQ ID NO: 3968968 - RNA, 20 nt, Staphylococcus aureus subsp. aureus Mu50
augucgaaaauagcuauuaa

SEQ ID NO: 3968969 - RNA, 22 nt, Staphylococcus aureus subsp. aureus Mu50
augucgaaaauagcuauuaaaa

SEQ ID NO: 3968970 - RNA, 18 nt, Staphylococcus aureus subsp. aureus Mu50
augucgcacuauaaaauu

SEQ ID NO: 3968971 - RNA, 22 nt, Staphylococcus aureus subsp. aureus Mu50
augucguucaagaacaaucaau

SEQ ID NO: 3968972 - RNA, 16 nt, Staphylococcus aureus subsp. aureus Mu50
augucuagacuuauuu

SEQ ID NO: 3968973 - RNA, 16 nt, Staphylococcus aureus subsp. aureus Mu50
augucuagauuuuaaa

SEQ ID NO: 3968974 - RNA, 18 nt, Staphylococcus aureus subsp. aureus Mu50
augucucucuuucuuauu

SEQ ID NO: 3968975 - RNA, 22 nt, Staphylococcus aureus subsp. aureus Mu50
augucucuuucuuuuagcaauc

SEQ ID NO: 3968976 - RNA, 16 nt, Staphylococcus aureus subsp. aureus Mu50
augucuguacuuuuau

SEQ ID NO: 3968977 - RNA, 14 nt, Staphylococcus aureus subsp. aureus Mu50
augucuuacuuuua

SEQ ID NO: 3968978 - RNA, 15 nt, Staphylococcus aureus subsp. aureus Mu50
augucuuaucaauua

SEQ ID NO: 3968979 - RNA, 18 nt, Staphylococcus aureus subsp. aureus Mu50
augucuuucaaauacaca

SEQ ID NO: 3968980 - RNA, 14 nt, Staphylococcus aureus subsp. aureus Mu50
augucuuugaaaaa

SEQ ID NO: 3968981 - RNA, 19 nt, Staphylococcus aureus subsp. aureus Mu50
augugaaaauuuauucaaa

SEQ ID NO: 3968982 - RNA, 22 nt, Staphylococcus aureus subsp. aureus Mu50
augugaaauaaucccaaccauu

SEQ ID NO: 3968983 - RNA, 19 nt, Staphylococcus aureus subsp. aureus Mu50
augugaacaucuaguuauu

SEQ ID NO: 3968984 - RNA, 22 nt, Staphylococcus aureus subsp. aureus Mu50
augugaacaucuaguuauuuca

SEQ ID NO: 3968985 - RNA, 23 nt, Staphylococcus aureus subsp. aureus Mu50
augugaagugcgggggauuauuu

SEQ ID NO: 3968986 - RNA, 22 nt, Staphylococcus aureus subsp. aureus Mu50
augugacauaacagcuaaaaau

SEQ ID NO: 3968987 - RNA, 23 nt, Staphylococcus aureus subsp. aureus Mu50
augugacauaacagcuaaaaauu

SEQ ID NO: 3968988 - RNA, 22 nt, Staphylococcus aureus subsp. aureus Mu50
augugacuuuaaaucuuguucu

SEQ ID NO: 3968989 - RNA, 22 nt, Staphylococcus aureus subsp. aureus Mu50
augugagugguuuucuuuauuu

SEQ ID NO: 3968990 - RNA, 15 nt, Staphylococcus aureus subsp. aureus Mu50
augugauguguuguu

SEQ ID NO: 3968991 - RNA, 20 nt, Staphylococcus aureus subsp. aureus Mu50
augugcaacgguuugaaaaa

SEQ ID NO: 3968992 - RNA, 18 nt, Staphylococcus aureus subsp. aureus Mu50
augugcaaguauaaucca

SEQ ID NO: 3968993 - RNA, 21 nt, Staphylococcus aureus subsp. aureus Mu50
augugcaucauuuauaugaug

SEQ ID NO: 3968994 - RNA, 15 nt, Staphylococcus aureus subsp. aureus Mu50
augugccuuugcuuu

SEQ ID NO: 3968995 - RNA, 21 nt, Staphylococcus aureus subsp. aureus Mu50
augugccuuugcuuuuuauuu

SEQ ID NO: 3968996 - RNA, 15 nt, Staphylococcus aureus subsp. aureus Mu50
augugcuaaucuauu

SEQ ID NO: 3968997 - RNA, 22 nt, Staphylococcus aureus subsp. aureus Mu50
augugcugugucuuuugauuuu

SEQ ID NO: 3968998 - RNA, 15 nt, Staphylococcus aureus subsp. aureus Mu50
augugcuuuaucaac

SEQ ID NO: 3968999 - RNA, 16 nt, Staphylococcus aureus subsp. aureus Mu50
augugcuuuaucaaca

SEQ ID NO: 3969000 - RNA, 21 nt, Staphylococcus aureus subsp. aureus Mu50
augugcuuuguuuaucaauuu

SEQ ID NO: 3969001 - RNA, 17 nt, Staphylococcus aureus subsp. aureus Mu50
auguggaacaugauuca

SEQ ID NO: 3969002 - RNA, 17 nt, Staphylococcus aureus subsp. aureus Mu50
auguguaugauagaaua

SEQ ID NO: 3969003 - RNA, 17 nt, Staphylococcus aureus subsp. aureus Mu50
auguguaugaucaagcu

SEQ ID NO: 3969004 - RNA, 22 nt, Staphylococcus aureus subsp. aureus Mu50
augugucaaauaggcauaauga

SEQ ID NO: 3969005 - RNA, 16 nt, Staphylococcus aureus subsp. aureus Mu50
augugucauaauccau

SEQ ID NO: 3969006 - RNA, 22 nt, Staphylococcus aureus subsp. aureus Mu50
augugucauaauccauucuucu

SEQ ID NO: 3969007 - RNA, 16 nt, Staphylococcus aureus subsp. aureus Mu50
auguguuaaucaacgu

SEQ ID NO: 3969008 - RNA, 22 nt, Staphylococcus aureus subsp. aureus Mu50
auguguuaaucaacguauauaa

SEQ ID NO: 3969009 - RNA, 13 nt, Staphylococcus aureus subsp. aureus Mu50
auguguugcauua

SEQ ID NO: 3969010 - RNA, 14 nt, Staphylococcus aureus subsp. aureus Mu50
auguguugugauau

SEQ ID NO: 3969011 - RNA, 18 nt, Staphylococcus aureus subsp. aureus Mu50
auguguuucuagcuuguu

SEQ ID NO: 3969012 - RNA, 16 nt, Staphylococcus aureus subsp. aureus Mu50
auguguuuuaauaaua

SEQ ID NO: 3969013 - RNA, 21 nt, Staphylococcus aureus subsp. aureus Mu50
auguguuuucaacaguuuuaa

SEQ ID NO: 3969014 - RNA, 14 nt, Staphylococcus aureus subsp. aureus Mu50
auguuaaacaauac

SEQ ID NO: 3969015 - RNA, 16 nt, Staphylococcus aureus subsp. aureus Mu50
auguuaaauucuaaaa

SEQ ID NO: 3969016 - RNA, 18 nt, Staphylococcus aureus subsp. aureus Mu50
auguuacacaaauuaaaa

SEQ ID NO: 3969017 - RNA, 13 nt, Staphylococcus aureus subsp. aureus Mu50
auguuacugauga

SEQ ID NO: 3969018 - RNA, 14 nt, Staphylococcus aureus subsp. aureus Mu50
auguuacugaugaa

SEQ ID NO: 3969019 - RNA, 20 nt, Staphylococcus aureus subsp. aureus Mu50
auguuacugcacggauaccu

SEQ ID NO: 3969020 - RNA, 18 nt, Staphylococcus aureus subsp. aureus Mu50
auguuagugacaagguau

SEQ ID NO: 3969021 - RNA, 13 nt, Staphylococcus aureus subsp. aureus Mu50
auguuauaaaaug

SEQ ID NO: 3969022 - RNA, 20 nt, Staphylococcus aureus subsp. aureus Mu50
auguuauaaaaugaauaauu

SEQ ID NO: 3969023 - RNA, 19 nt, Staphylococcus aureus subsp. aureus Mu50
auguuauaaauucuaucua

SEQ ID NO: 3969024 - RNA, 12 nt, Staphylococcus aureus subsp. aureus Mu50
auguuaucaaua

SEQ ID NO: 3969025 - RNA, 22 nt, Staphylococcus aureus subsp. aureus Mu50
auguuaucgauauagcauaaaa

SEQ ID NO: 3969026 - RNA, 18 nt, Staphylococcus aureus subsp. aureus Mu50
auguuauuaaccaucaug

SEQ ID NO: 3969027 - RNA, 15 nt, Staphylococcus aureus subsp. aureus Mu50
auguuauuagauacu

SEQ ID NO: 3969028 - RNA, 22 nt, Staphylococcus aureus subsp. aureus Mu50
auguucaaaaaaugaauauaau

SEQ ID NO: 3969029 - RNA, 15 nt, Staphylococcus aureus subsp. aureus Mu50
auguucaauauuuuc

SEQ ID NO: 3969030 - RNA, 15 nt, Staphylococcus aureus subsp. aureus Mu50
auguucagaaauuua

SEQ ID NO: 3969031 - RNA, 18 nt, Staphylococcus aureus subsp. aureus Mu50
auguucauaauauaacau

SEQ ID NO: 3969032 - RNA, 16 nt, Staphylococcus aureus subsp. aureus Mu50
auguuccauauaaccu

SEQ ID NO: 3969033 - RNA, 22 nt, Staphylococcus aureus subsp. aureus Mu50
auguucccuuaccauuucuuca

SEQ ID NO: 3969034 - RNA, 18 nt, Staphylococcus aureus subsp. aureus Mu50
auguuccgcuacaaaaca

SEQ ID NO: 3969035 - RNA, 23 nt, Staphylococcus aureus subsp. aureus Mu50
auguuccuuguuuuaaacuuauu

SEQ ID NO: 3969036 - RNA, 15 nt, Staphylococcus aureus subsp. aureus Mu50
auguucuuauaaaaa

SEQ ID NO: 3969037 - RNA, 18 nt, Staphylococcus aureus subsp. aureus Mu50
auguucuuauaaaaaaca

SEQ ID NO: 3969038 - RNA, 22 nt, Staphylococcus aureus subsp. aureus Mu50
auguucuuuucaacauuuuuua

SEQ ID NO: 3969039 - RNA, 19 nt, Staphylococcus aureus subsp. aureus Mu50
auguugacucguuauucaa

SEQ ID NO: 3969040 - RNA, 14 nt, Staphylococcus aureus subsp. aureus Mu50
auguugauaaaaag

SEQ ID NO: 3969041 - RNA, 21 nt, Staphylococcus aureus subsp. aureus Mu50
auguugcauccccagccauuu

SEQ ID NO: 3969042 - RNA, 22 nt, Staphylococcus aureus subsp. aureus Mu50
auguuggaaaaggucaaaaaau

SEQ ID NO: 3969043 - RNA, 19 nt, Staphylococcus aureus subsp. aureus Mu50
auguugguucaucaaacaa

SEQ ID NO: 3969044 - RNA, 21 nt, Staphylococcus aureus subsp. aureus Mu50
auguugucauaccaaauaaau

SEQ ID NO: 3969045 - RNA, 21 nt, Staphylococcus aureus subsp. aureus Mu50
auguugugauacuuucuaaga

SEQ ID NO: 3969046 - RNA, 16 nt, Staphylococcus aureus subsp. aureus Mu50
auguuguuauaaagga

SEQ ID NO: 3969047 - RNA, 14 nt, Staphylococcus aureus subsp. aureus Mu50
auguuguuauauaa

SEQ ID NO: 3969048 - RNA, 21 nt, Staphylococcus aureus subsp. aureus Mu50
auguuguuugcggcuuccucu

SEQ ID NO: 3969049 - RNA, 16 nt, Staphylococcus aureus subsp. aureus Mu50
auguuuaaacauuuuu

SEQ ID NO: 3969050 - RNA, 17 nt, Staphylococcus aureus subsp. aureus Mu50
auuaacaauauuaaauu

SEQ ID NO: 3969051 - RNA, 13 nt, Staphylococcus aureus subsp. aureus Mu50
auuaacacauuca

SEQ ID NO: 3969052 - RNA, 16 nt, Staphylococcus aureus subsp. aureus Mu50
auuaacacauucaaau

SEQ ID NO: 3969053 - RNA, 19 nt, Staphylococcus aureus subsp. aureus Mu50
auuaacacauucaaauaaa

SEQ ID NO: 3969054 - RNA, 14 nt, Staphylococcus aureus subsp. aureus Mu50
auuaacacauucuu

SEQ ID NO: 3969055 - RNA, 22 nt, Staphylococcus aureus subsp. aureus Mu50
auuaacacauucuuauuugaaa

SEQ ID NO: 3969056 - RNA, 23 nt, Staphylococcus aureus subsp. aureus Mu50
auuaacacauucuuauuugaaau

SEQ ID NO: 3969057 - RNA, 14 nt, Staphylococcus aureus subsp. aureus Mu50
auuaacauuaucca

SEQ ID NO: 3969058 - RNA, 16 nt, Staphylococcus aureus subsp. aureus Mu50
auuaacauuauccauu

SEQ ID NO: 3969059 - RNA, 15 nt, Staphylococcus aureus subsp. aureus Mu50
auuaaccaucaugac

SEQ ID NO: 3969060 - RNA, 14 nt, Staphylococcus aureus subsp. aureus Mu50
auuaaccuugauuu

SEQ ID NO: 3969061 - RNA, 16 nt, Staphylococcus aureus subsp. aureus Mu50
auuaacgucaacagca

SEQ ID NO: 3969062 - RNA, 18 nt, Staphylococcus aureus subsp. aureus Mu50
auuaacgucaacagcaua

SEQ ID NO: 3969063 - RNA, 21 nt, Staphylococcus aureus subsp. aureus Mu50
auuaacuguaccaucacuaaa

SEQ ID NO: 3969064 - RNA, 22 nt, Staphylococcus aureus subsp. aureus Mu50
auuaacuguuagacuugguuac

SEQ ID NO: 3969065 - RNA, 18 nt, Staphylococcus aureus subsp. aureus Mu50
auuaacuuaaaauuuaaa

SEQ ID NO: 3969066 - RNA, 20 nt, Staphylococcus aureus subsp. aureus Mu50
auuaacuuaaaauuuaaaua

SEQ ID NO: 3969067 - RNA, 20 nt, Staphylococcus aureus subsp. aureus Mu50
auuaacuuacuuuuguaaaa

SEQ ID NO: 3969068 - RNA, 16 nt, Staphylococcus aureus subsp. aureus Mu50
auuaacuugauaucau

SEQ ID NO: 3969069 - RNA, 19 nt, Staphylococcus aureus subsp. aureus Mu50
auuaagaagaaauacuuga

SEQ ID NO: 3969070 - RNA, 21 nt, Staphylococcus aureus subsp. aureus Mu50
auuaagaauaaucgaacauaa

SEQ ID NO: 3969071 - RNA, 17 nt, Staphylococcus aureus subsp. aureus Mu50
auuaagaaugcaccaac

SEQ ID NO: 3969072 - RNA, 21 nt, Staphylococcus aureus subsp. aureus Mu50
auuaagcaauguaacuuggcu

SEQ ID NO: 3969073 - RNA, 15 nt, Staphylococcus aureus subsp. aureus Mu50
auuaagcauuugucu

SEQ ID NO: 3969074 - RNA, 17 nt, Staphylococcus aureus subsp. aureus Mu50
auuaagcuaugcuuuuu

SEQ ID NO: 3969075 - RNA, 19 nt, Staphylococcus aureus subsp. aureus Mu50
auuaagcuugaaacaaggu

SEQ ID NO: 3969076 - RNA, 15 nt, Staphylococcus aureus subsp. aureus Mu50
auuaaguaaucugca

SEQ ID NO: 3969077 - RNA, 15 nt, Staphylococcus aureus subsp. aureus Mu50
auuaaguacuuuuac

SEQ ID NO: 3969078 - RNA, 16 nt, Staphylococcus aureus subsp. aureus Mu50
auuaaguacuuuuaca

SEQ ID NO: 3969079 - RNA, 17 nt, Staphylococcus aureus subsp. aureus Mu50
auuaaguacuuuuacaa

SEQ ID NO: 3969080 - RNA, 15 nt, Staphylococcus aureus subsp. aureus Mu50
auuaaguauaucuuu

SEQ ID NO: 3969081 - RNA, 15 nt, Staphylococcus aureus subsp. aureus Mu50
auuaagucuagcauu

SEQ ID NO: 3969082 - RNA, 16 nt, Staphylococcus aureus subsp. aureus Mu50
auuaagugcaauaaca

SEQ ID NO: 3969083 - RNA, 14 nt, Staphylococcus aureus subsp. aureus Mu50
auuaauaaaauucu

SEQ ID NO: 3969084 - RNA, 21 nt, Staphylococcus aureus subsp. aureus Mu50
auuaauaaauaauaacccgaa

SEQ ID NO: 3969085 - RNA, 18 nt, Staphylococcus aureus subsp. aureus Mu50
auuaauaacauccccaaa

SEQ ID NO: 3969086 - RNA, 20 nt, Staphylococcus aureus subsp. aureus Mu50
auuaauaagugcuguuacuu

SEQ ID NO: 3969087 - RNA, 14 nt, Staphylococcus aureus subsp. aureus Mu50
auuaauaauuaaac

SEQ ID NO: 3969088 - RNA, 18 nt, Staphylococcus aureus subsp. aureus Mu50
auuaauaauuuuccaucu

SEQ ID NO: 3969089 - RNA, 14 nt, Staphylococcus aureus subsp. aureus Mu50
auuaauagaaagug

SEQ ID NO: 3969090 - RNA, 15 nt, Staphylococcus aureus subsp. aureus Mu50
auuaauagaaagugc

SEQ ID NO: 3969091 - RNA, 21 nt, Staphylococcus aureus subsp. aureus Mu50
auuaauagagaaagaauaaau

SEQ ID NO: 3969092 - RNA, 12 nt, Staphylococcus aureus subsp. aureus Mu50
auuaauagagac

SEQ ID NO: 3969093 - RNA, 17 nt, Staphylococcus aureus subsp. aureus Mu50
auuaauaggauuauuau

SEQ ID NO: 3969094 - RNA, 19 nt, Staphylococcus aureus subsp. aureus Mu50
auuaauaggauuauuauca

SEQ ID NO: 3969095 - RNA, 16 nt, Staphylococcus aureus subsp. aureus Mu50
auuaauagguuauuug

SEQ ID NO: 3969096 - RNA, 12 nt, Staphylococcus aureus subsp. aureus Mu50
auuaauaguaaa

SEQ ID NO: 3969097 - RNA, 20 nt, Staphylococcus aureus subsp. aureus Mu50
auuaauauaaauaucaauug

SEQ ID NO: 3969098 - RNA, 18 nt, Staphylococcus aureus subsp. aureus Mu50
auuaaucauaaugaauaa

SEQ ID NO: 3969099 - RNA, 16 nt, Staphylococcus aureus subsp. aureus Mu50
auuaauccaucuacac

SEQ ID NO: 3969100 - RNA, 18 nt, Staphylococcus aureus subsp. aureus Mu50
auuaaucccuucaaaauu

SEQ ID NO: 3969101 - RNA, 22 nt, Staphylococcus aureus subsp. aureus Mu50
auuaaucuauggaaaauguuau

SEQ ID NO: 3969102 - RNA, 16 nt, Staphylococcus aureus subsp. aureus Mu50
auuaaugaaauaccua

SEQ ID NO: 3969103 - RNA, 20 nt, Staphylococcus aureus subsp. aureus Mu50
auuaaugcucuauauaucca

SEQ ID NO: 3969104 - RNA, 18 nt, Staphylococcus aureus subsp. aureus Mu50
auuaauggcaacuaagau

SEQ ID NO: 3969105 - RNA, 21 nt, Staphylococcus aureus subsp. aureus Mu50
auuaauguucaaaaaaugaau

SEQ ID NO: 3969106 - RNA, 15 nt, Staphylococcus aureus subsp. aureus Mu50
auuaauguucaauuu

SEQ ID NO: 3969107 - RNA, 13 nt, Staphylococcus aureus subsp. aureus Mu50
auuaauguuugau

SEQ ID NO: 3969108 - RNA, 14 nt, Staphylococcus aureus subsp. aureus Mu50
auuaauuaaagauu

SEQ ID NO: 3969109 - RNA, 23 nt, Staphylococcus aureus subsp. aureus Mu50
auuaauuacagcgugauucaucu

SEQ ID NO: 3969110 - RNA, 21 nt, Staphylococcus aureus subsp. aureus Mu50
auuaauuacuguaaauaugaa

SEQ ID NO: 3969111 - RNA, 16 nt, Staphylococcus aureus subsp. aureus Mu50
auuaauuacuuucauu

SEQ ID NO: 3969112 - RNA, 12 nt, Staphylococcus aureus subsp. aureus Mu50
auuaauuaucau

SEQ ID NO: 3969113 - RNA, 11 nt, Staphylococcus aureus subsp. aureus Mu50
auuaauuauua

SEQ ID NO: 3969114 - RNA, 21 nt, Staphylococcus aureus subsp. aureus Mu50
auuaauuauugagaauauuua

SEQ ID NO: 3969115 - RNA, 13 nt, Staphylococcus aureus subsp. aureus Mu50
auuaauugaaaaa

SEQ ID NO: 3969116 - RNA, 15 nt, Staphylococcus aureus subsp. aureus Mu50
auuaauuggauuuuu

SEQ ID NO: 3969117 - RNA, 15 nt, Staphylococcus aureus subsp. aureus Mu50
auuaauuuaaaugcu

SEQ ID NO: 3969118 - RNA, 20 nt, Staphylococcus aureus subsp. aureus Mu50
auuaauuuacucaaaccauc

SEQ ID NO: 3969119 - RNA, 21 nt, Staphylococcus aureus subsp. aureus Mu50
auuaauuuacucaaaccaucu

SEQ ID NO: 3969120 - RNA, 17 nt, Staphylococcus aureus subsp. aureus Mu50
auuaauuucauguucau

SEQ ID NO: 3969121 - RNA, 18 nt, Staphylococcus aureus subsp. aureus Mu50
auuaauuucauuguaacu

SEQ ID NO: 3969122 - RNA, 13 nt, Staphylococcus aureus subsp. aureus Mu50
auuaauuugauaa

SEQ ID NO: 3969123 - RNA, 20 nt, Staphylococcus aureus subsp. aureus Mu50
auuaauuuuaucuuauuauu

SEQ ID NO: 3969124 - RNA, 13 nt, Staphylococcus aureus subsp. aureus Mu50
auuaauuuucuuu

SEQ ID NO: 3969125 - RNA, 11 nt, Staphylococcus aureus subsp. aureus Mu50
auuaauuuuuc

SEQ ID NO: 3969126 - RNA, 15 nt, Staphylococcus aureus subsp. aureus Mu50
auuaauuuuucaaaa

SEQ ID NO: 3969127 - RNA, 17 nt, Staphylococcus aureus subsp. aureus Mu50
auuaauuuuucaaaugu

SEQ ID NO: 3969128 - RNA, 13 nt, Staphylococcus aureus subsp. aureus Mu50
auuacaaaucaug

SEQ ID NO: 3969129 - RNA, 15 nt, Staphylococcus aureus subsp. aureus Mu50
auuacaaaucaugac

SEQ ID NO: 3969130 - RNA, 15 nt, Staphylococcus aureus subsp. aureus Mu50
auuacaacuuauucu

SEQ ID NO: 3969131 - RNA, 12 nt, Staphylococcus aureus subsp. aureus Mu50
auuacaaugaaa

SEQ ID NO: 3969132 - RNA, 18 nt, Staphylococcus aureus subsp. aureus Mu50
auuacaaugaaaaaacga

SEQ ID NO: 3969133 - RNA, 17 nt, Staphylococcus aureus subsp. aureus Mu50
auuacaccauuguuaua

SEQ ID NO: 3969134 - RNA, 18 nt, Staphylococcus aureus subsp. aureus Mu50
auuacacccuuuaaauuu

SEQ ID NO: 3969135 - RNA, 19 nt, Staphylococcus aureus subsp. aureus Mu50
auuacacgcauuacuuuag

SEQ ID NO: 3969136 - RNA, 23 nt, Staphylococcus aureus subsp. aureus Mu50
auuacagauuccugcaaaauguu

SEQ ID NO: 3969137 - RNA, 21 nt, Staphylococcus aureus subsp. aureus Mu50
auuacagcguaacuaaagaau

SEQ ID NO: 3969138 - RNA, 20 nt, Staphylococcus aureus subsp. aureus Mu50
auuagugauauuuuucgaau

SEQ ID NO: 3969139 - RNA, 21 nt, Staphylococcus aureus subsp. aureus Mu50
auuaguucuggcaaagaaucc

SEQ ID NO: 3969140 - RNA, 16 nt, Staphylococcus aureus subsp. aureus Mu50
auuaguuuuuaaaauu

SEQ ID NO: 3969141 - RNA, 17 nt, Staphylococcus aureus subsp. aureus Mu50
auuaguuuuuaaaauua

SEQ ID NO: 3969142 - RNA, 21 nt, Staphylococcus aureus subsp. aureus Mu50
auuaguuuuuaaaauuaucaa

SEQ ID NO: 3969143 - RNA, 22 nt, Staphylococcus aureus subsp. aureus Mu50
auuaguuuuuaaaauuaucaau

SEQ ID NO: 3969144 - RNA, 12 nt, Staphylococcus aureus subsp. aureus Mu50
auuauaaaauaa

SEQ ID NO: 3969145 - RNA, 13 nt, Staphylococcus aureus subsp. aureus Mu50
auuauaaaauaaa

SEQ ID NO: 3969146 - RNA, 14 nt, Staphylococcus aureus subsp. aureus Mu50
auuauaaaauaaau

SEQ ID NO: 3969147 - RNA, 19 nt, Staphylococcus aureus subsp. aureus Mu50
auuauaaaccuaaugcuuu

SEQ ID NO: 3969148 - RNA, 13 nt, Staphylococcus aureus subsp. aureus Mu50
auuauaaaugauu

SEQ ID NO: 3969149 - RNA, 22 nt, Staphylococcus aureus subsp. aureus Mu50
auuauaaauuugguacauaaua

SEQ ID NO: 3969150 - RNA, 23 nt, Staphylococcus aureus subsp. aureus Mu50
auuauaaauuugguacauaauag

SEQ ID NO: 3969151 - RNA, 16 nt, Staphylococcus aureus subsp. aureus Mu50
auuauaaccgcuacaa

SEQ ID NO: 3969152 - RNA, 20 nt, Staphylococcus aureus subsp. aureus Mu50
auuauaaguagugauuuuuu

SEQ ID NO: 3969153 - RNA, 14 nt, Staphylococcus aureus subsp. aureus Mu50
auuauaauaaauag

SEQ ID NO: 3969154 - RNA, 18 nt, Staphylococcus aureus subsp. aureus Mu50
auuauaauaaauagacug

SEQ ID NO: 3969155 - RNA, 17 nt, Staphylococcus aureus subsp. aureus Mu50
auuauaaugauugucuu

SEQ ID NO: 3969156 - RNA, 13 nt, Staphylococcus aureus subsp. aureus Mu50
auuauaaugauuu

SEQ ID NO: 3969157 - RNA, 16 nt, Staphylococcus aureus subsp. aureus Mu50
auuauaaugauuuuua

SEQ ID NO: 3969158 - RNA, 14 nt, Staphylococcus aureus subsp. aureus Mu50
auuauaauuguuca

SEQ ID NO: 3969159 - RNA, 17 nt, Staphylococcus aureus subsp. aureus Mu50
auuauaauuuuguuuca

SEQ ID NO: 3969160 - RNA, 15 nt, Staphylococcus aureus subsp. aureus Mu50
auuauacaaauuaua

SEQ ID NO: 3969161 - RNA, 13 nt, Staphylococcus aureus subsp. aureus Mu50
auuauacacuuuu

SEQ ID NO: 3969162 - RNA, 16 nt, Staphylococcus aureus subsp. aureus Mu50
auuauacgugcuuuaa

SEQ ID NO: 3969163 - RNA, 18 nt, Staphylococcus aureus subsp. aureus Mu50
auuauacgugcuuuaaag

SEQ ID NO: 3969164 - RNA, 21 nt, Staphylococcus aureus subsp. aureus Mu50
auuauacgugcuuuaaaguug

SEQ ID NO: 3969165 - RNA, 17 nt, Staphylococcus aureus subsp. aureus Mu50
auuauacugcucuuuau

SEQ ID NO: 3969166 - RNA, 21 nt, Staphylococcus aureus subsp. aureus Mu50
auuauacuuuacauuucucgu

SEQ ID NO: 3969167 - RNA, 16 nt, Staphylococcus aureus subsp. aureus Mu50
auuauagucuuaaaca

SEQ ID NO: 3969168 - RNA, 18 nt, Staphylococcus aureus subsp. aureus Mu50
auuauagucuuaaacaua

SEQ ID NO: 3969169 - RNA, 19 nt, Staphylococcus aureus subsp. aureus Mu50
auuauagucuuaaacauaa

SEQ ID NO: 3969170 - RNA, 19 nt, Staphylococcus aureus subsp. aureus Mu50
auuauauaauucuucaaau

SEQ ID NO: 3969171 - RNA, 19 nt, Staphylococcus aureus subsp. aureus Mu50
auuauauacccaccacauu

SEQ ID NO: 3969172 - RNA, 14 nt, Staphylococcus aureus subsp. aureus Mu50
auuauauagucugc

SEQ ID NO: 3969173 - RNA, 15 nt, Staphylococcus aureus subsp. aureus Mu50
auuauauauauuaaa

SEQ ID NO: 3969174 - RNA, 17 nt, Staphylococcus aureus subsp. aureus Mu50
auuauauauauuaaagu

SEQ ID NO: 3969175 - RNA, 21 nt, Staphylococcus aureus subsp. aureus Mu50
auuauaugguucguccauuca

SEQ ID NO: 3969176 - RNA, 14 nt, Staphylococcus aureus subsp. aureus Mu50
auuauauuaucauu

SEQ ID NO: 3969177 - RNA, 12 nt, Staphylococcus aureus subsp. aureus Mu50
auuauauuucuc

SEQ ID NO: 3969178 - RNA, 14 nt, Staphylococcus aureus subsp. aureus Mu50
auuauauuuucuca

SEQ ID NO: 3969179 - RNA, 19 nt, Staphylococcus aureus subsp. aureus Mu50
auuauauuuugaaucagua

SEQ ID NO: 3969180 - RNA, 13 nt, Staphylococcus aureus subsp. aureus Mu50
auuauauuuuucu

SEQ ID NO: 3969181 - RNA, 21 nt, Staphylococcus aureus subsp. aureus Mu50
auuauauuuuucuucaguuaa

SEQ ID NO: 3969182 - RNA, 13 nt, Staphylococcus aureus subsp. aureus Mu50
auuaucaaagaaa

SEQ ID NO: 3969183 - RNA, 17 nt, Staphylococcus aureus subsp. aureus Mu50
auuaucaauagaugaaa

SEQ ID NO: 3969184 - RNA, 21 nt, Staphylococcus aureus subsp. aureus Mu50
auuaucaccuucaaacuuuca

SEQ ID NO: 3969185 - RNA, 20 nt, Staphylococcus aureus subsp. aureus Mu50
auuaucauauaaaucaaaua

SEQ ID NO: 3969186 - RNA, 14 nt, Staphylococcus aureus subsp. aureus Mu50
auuaucauuaaauu

SEQ ID NO: 3969187 - RNA, 17 nt, Staphylococcus aureus subsp. aureus Mu50
auuaucauuaaauugcu

SEQ ID NO: 3969188 - RNA, 13 nt, Staphylococcus aureus subsp. aureus Mu50
auuaucauuaacc

SEQ ID NO: 3969189 - RNA, 23 nt, Staphylococcus aureus subsp. aureus Mu50
auuauccaaggauguuauaaaau

SEQ ID NO: 3969190 - RNA, 17 nt, Staphylococcus aureus subsp. aureus Mu50
auuauccauucuuuguu

SEQ ID NO: 3969191 - RNA, 14 nt, Staphylococcus aureus subsp. aureus Mu50
auuauccuacugcu

SEQ ID NO: 3969192 - RNA, 14 nt, Staphylococcus aureus subsp. aureus Mu50
auuauccucaaaua

SEQ ID NO: 3969193 - RNA, 18 nt, Staphylococcus aureus subsp. aureus Mu50
auuauccucaaauauauu

SEQ ID NO: 3969194 - RNA, 21 nt, Staphylococcus aureus subsp. aureus Mu50
auuaucgaagaaacauuauau

SEQ ID NO: 3969195 - RNA, 22 nt, Staphylococcus aureus subsp. aureus Mu50
auuaucgaagaaacauuauaua

SEQ ID NO: 3969196 - RNA, 17 nt, Staphylococcus aureus subsp. aureus Mu50
auuaucguaauuguuaa

SEQ ID NO: 3969197 - RNA, 20 nt, Staphylococcus aureus subsp. aureus Mu50
auuaucguaauuguuaaacc

SEQ ID NO: 3969198 - RNA, 15 nt, Staphylococcus aureus subsp. aureus Mu50
auuaucuaaagaaau

SEQ ID NO: 3969199 - RNA, 22 nt, Staphylococcus aureus subsp. aureus Mu50
auuaucuauccauuugguuuaa

SEQ ID NO: 3969200 - RNA, 22 nt, Staphylococcus aureus subsp. aureus Mu50
auuaucuguaauuaauccaucu

SEQ ID NO: 3969201 - RNA, 18 nt, Staphylococcus aureus subsp. aureus Mu50
auuaucuuaagucaucaa

SEQ ID NO: 3969202 - RNA, 20 nt, Staphylococcus aureus subsp. aureus Mu50
auuaucuuaagucaucaauc

SEQ ID NO: 3969203 - RNA, 22 nt, Staphylococcus aureus subsp. aureus Mu50
auuaucuuuaauuuacaauuaa

SEQ ID NO: 3969204 - RNA, 12 nt, Staphylococcus aureus subsp. aureus Mu50
auuaucuuuacg

SEQ ID NO: 3969205 - RNA, 23 nt, Staphylococcus aureus subsp. aureus Mu50
auuaucuuuacgauaaacuaaaa

SEQ ID NO: 3969206 - RNA, 17 nt, Staphylococcus aureus subsp. aureus Mu50
auuaucuuuaguauuuc

SEQ ID NO: 3969207 - RNA, 13 nt, Staphylococcus aureus subsp. aureus Mu50
auuaucuuucaau

SEQ ID NO: 3969208 - RNA, 18 nt, Staphylococcus aureus subsp. aureus Mu50
auuaucuuuguaaauuuu

SEQ ID NO: 3969209 - RNA, 15 nt, Staphylococcus aureus subsp. aureus Mu50
auuaugaaaacauua

SEQ ID NO: 3969210 - RNA, 13 nt, Staphylococcus aureus subsp. aureus Mu50
auuaugacaacau

SEQ ID NO: 3969211 - RNA, 15 nt, Staphylococcus aureus subsp. aureus Mu50
auuaugacaacauaa

SEQ ID NO: 3969212 - RNA, 16 nt, Staphylococcus aureus subsp. aureus Mu50
auuaugacaacauaac

SEQ ID NO: 3969213 - RNA, 15 nt, Staphylococcus aureus subsp. aureus Mu50
auuaugacuaacauu

SEQ ID NO: 3969214 - RNA, 21 nt, Staphylococcus aureus subsp. aureus Mu50
auuaugaggcugaguauacca

SEQ ID NO: 3969215 - RNA, 17 nt, Staphylococcus aureus subsp. aureus Mu50
auuaugauacgcuuuuu

SEQ ID NO: 3969216 - RNA, 12 nt, Staphylococcus aureus subsp. aureus Mu50
auuaugauauac

SEQ ID NO: 3969217 - RNA, 15 nt, Staphylococcus aureus subsp. aureus Mu50
auuaugauuaauccu

SEQ ID NO: 3969218 - RNA, 14 nt, Staphylococcus aureus subsp. aureus Mu50
auuaugauuauauu

SEQ ID NO: 3969219 - RNA, 22 nt, Staphylococcus aureus subsp. aureus Mu50
auuaugcauauguaauacaaaa

SEQ ID NO: 3969220 - RNA, 14 nt, Staphylococcus aureus subsp. aureus Mu50
auuaugcccaacca

SEQ ID NO: 3969221 - RNA, 21 nt, Staphylococcus aureus subsp. aureus Mu50
auuaugccuauuugacacauu

SEQ ID NO: 3969222 - RNA, 19 nt, Staphylococcus aureus subsp. aureus Mu50
auuauggagcggaagauag

SEQ ID NO: 3969223 - RNA, 14 nt, Staphylococcus aureus subsp. aureus Mu50
auuauguagcuuug

SEQ ID NO: 3969224 - RNA, 19 nt, Staphylococcus aureus subsp. aureus Mu50
auuauguauuuuuauuuau

SEQ ID NO: 3969225 - RNA, 21 nt, Staphylococcus aureus subsp. aureus Mu50
auuaugucgagguguuuuuuu

SEQ ID NO: 3969226 - RNA, 17 nt, Staphylococcus aureus subsp. aureus Mu50
auucagucaguaaaaau

SEQ ID NO: 3969227 - RNA, 18 nt, Staphylococcus aureus subsp. aureus Mu50
auucagucaguaaaaaua

SEQ ID NO: 3969228 - RNA, 23 nt, Staphylococcus aureus subsp. aureus Mu50
auucauaaaauuuaaaacaauga

SEQ ID NO: 3969229 - RNA, 20 nt, Staphylococcus aureus subsp. aureus Mu50
auucauaaaugacugaauua

SEQ ID NO: 3969230 - RNA, 14 nt, Staphylococcus aureus subsp. aureus Mu50
auucauaaaugcuu

SEQ ID NO: 3969231 - RNA, 19 nt, Staphylococcus aureus subsp. aureus Mu50
auucauaacguguuugcuc

SEQ ID NO: 3969232 - RNA, 12 nt, Staphylococcus aureus subsp. aureus Mu50
auucauaauauc

SEQ ID NO: 3969233 - RNA, 22 nt, Staphylococcus aureus subsp. aureus Mu50
auucauaauuuguugauaguaa

SEQ ID NO: 3969234 - RNA, 17 nt, Staphylococcus aureus subsp. aureus Mu50
auucauacacuaucauu

SEQ ID NO: 3969235 - RNA, 19 nt, Staphylococcus aureus subsp. aureus Mu50
auucauacacugcacauca

SEQ ID NO: 3969236 - RNA, 21 nt, Staphylococcus aureus subsp. aureus Mu50
auucauacacugcacaucaua

SEQ ID NO: 3969237 - RNA, 23 nt, Staphylococcus aureus subsp. aureus Mu50
auucauacacugcacaucauaau

SEQ ID NO: 3969238 - RNA, 17 nt, Staphylococcus aureus subsp. aureus Mu50
auucauauauacugccc

SEQ ID NO: 3969239 - RNA, 14 nt, Staphylococcus aureus subsp. aureus Mu50
auucauaucuuuca

SEQ ID NO: 3969240 - RNA, 18 nt, Staphylococcus aureus subsp. aureus Mu50
auucauaucuuucaauua

SEQ ID NO: 3969241 - RNA, 19 nt, Staphylococcus aureus subsp. aureus Mu50
auucauaucuuucaauuaa

SEQ ID NO: 3969242 - RNA, 12 nt, Staphylococcus aureus subsp. aureus Mu50
auucauauuaac

SEQ ID NO: 3969243 - RNA, 16 nt, Staphylococcus aureus subsp. aureus Mu50
auucauauucaaauuu

SEQ ID NO: 3969244 - RNA, 14 nt, Staphylococcus aureus subsp. aureus Mu50
auucauauuuauau

SEQ ID NO: 3969245 - RNA, 17 nt, Staphylococcus aureus subsp. aureus Mu50
auucauauuuauauuua

SEQ ID NO: 3969246 - RNA, 13 nt, Staphylococcus aureus subsp. aureus Mu50
auucaucaucauu

SEQ ID NO: 3969247 - RNA, 15 nt, Staphylococcus aureus subsp. aureus Mu50
auucaucgucucacu

SEQ ID NO: 3969248 - RNA, 16 nt, Staphylococcus aureus subsp. aureus Mu50
auucaucucagcaaua

SEQ ID NO: 3969249 - RNA, 14 nt, Staphylococcus aureus subsp. aureus Mu50
auucaucuuaucaa

SEQ ID NO: 3969250 - RNA, 17 nt, Staphylococcus aureus subsp. aureus Mu50
auucaucuuaucaagaa

SEQ ID NO: 3969251 - RNA, 14 nt, Staphylococcus aureus subsp. aureus Mu50
auucaucuucaaac

SEQ ID NO: 3969252 - RNA, 21 nt, Staphylococcus aureus subsp. aureus Mu50
auucaugaaucgaacuaguac

SEQ ID NO: 3969253 - RNA, 15 nt, Staphylococcus aureus subsp. aureus Mu50
auucaugauauguuc

SEQ ID NO: 3969254 - RNA, 22 nt, Staphylococcus aureus subsp. aureus Mu50
auucauggccaaauguugauaa

SEQ ID NO: 3969255 - RNA, 22 nt, Staphylococcus aureus subsp. aureus Mu50
auucauguucuuguaauccuaa

SEQ ID NO: 3969256 - RNA, 20 nt, Staphylococcus aureus subsp. aureus Mu50
auucauuaagcuuuguuuga

SEQ ID NO: 3969257 - RNA, 16 nt, Staphylococcus aureus subsp. aureus Mu50
auucauuacaaccauu

SEQ ID NO: 3969258 - RNA, 14 nt, Staphylococcus aureus subsp. aureus Mu50
auucauuacauguu

SEQ ID NO: 3969259 - RNA, 19 nt, Staphylococcus aureus subsp. aureus Mu50
auucauuacauguuacuga

SEQ ID NO: 3969260 - RNA, 21 nt, Staphylococcus aureus subsp. aureus Mu50
auucauuccuaagaauguaau

SEQ ID NO: 3969261 - RNA, 16 nt, Staphylococcus aureus subsp. aureus Mu50
auucauuuaaaaauca

SEQ ID NO: 3969262 - RNA, 19 nt, Staphylococcus aureus subsp. aureus Mu50
auucauuuaaaaaucaaag

SEQ ID NO: 3969263 - RNA, 20 nt, Staphylococcus aureus subsp. aureus Mu50
auucauuuaaaaaucaaaga

SEQ ID NO: 3969264 - RNA, 20 nt, Staphylococcus aureus subsp. aureus Mu50
auucauuucgauuaauuuaa

SEQ ID NO: 3969265 - RNA, 18 nt, Staphylococcus aureus subsp. aureus Mu50
auucauuuguauuaauuu

SEQ ID NO: 3969266 - RNA, 13 nt, Staphylococcus aureus subsp. aureus Mu50
auucauuuuaaau

SEQ ID NO: 3969267 - RNA, 19 nt, Staphylococcus aureus subsp. aureus Mu50
auucauuuuaaauucaacu

SEQ ID NO: 3969268 - RNA, 14 nt, Staphylococcus aureus subsp. aureus Mu50
auucauuuuauaaa

SEQ ID NO: 3969269 - RNA, 14 nt, Staphylococcus aureus subsp. aureus Mu50
auuccaaaaauugu

SEQ ID NO: 3969270 - RNA, 15 nt, Staphylococcus aureus subsp. aureus Mu50
auuccaaaaauugua

SEQ ID NO: 3969271 - RNA, 19 nt, Staphylococcus aureus subsp. aureus Mu50
auuccaaagaaagcuaaua

SEQ ID NO: 3969272 - RNA, 22 nt, Staphylococcus aureus subsp. aureus Mu50
auuccaagagaauuaauaauuu

SEQ ID NO: 3969273 - RNA, 16 nt, Staphylococcus aureus subsp. aureus Mu50
auuccaauuucaagug

SEQ ID NO: 3969274 - RNA, 14 nt, Staphylococcus aureus subsp. aureus Mu50
auuccacuacaauc

SEQ ID NO: 3969275 - RNA, 16 nt, Staphylococcus aureus subsp. aureus Mu50
auuccacuacaaucau

SEQ ID NO: 3969276 - RNA, 15 nt, Staphylococcus aureus subsp. aureus Mu50
auuccaugucaauuu

SEQ ID NO: 3969277 - RNA, 17 nt, Staphylococcus aureus subsp. aureus Mu50
auuccaugucaauuuuu

SEQ ID NO: 3969278 - RNA, 20 nt, Staphylococcus aureus subsp. aureus Mu50
auuccauuggaaguucuuuu

SEQ ID NO: 3969279 - RNA, 19 nt, Staphylococcus aureus subsp. aureus Mu50
auuccauuucgauaccuaa

SEQ ID NO: 3969280 - RNA, 15 nt, Staphylococcus aureus subsp. aureus Mu50
auuccuaauaaauau

SEQ ID NO: 3969281 - RNA, 15 nt, Staphylococcus aureus subsp. aureus Mu50
auuccuaauuauauu

SEQ ID NO: 3969282 - RNA, 15 nt, Staphylococcus aureus subsp. aureus Mu50
auuccuagcuuuuau

SEQ ID NO: 3969283 - RNA, 17 nt, Staphylococcus aureus subsp. aureus Mu50
auuccuagcuuuuaugu

SEQ ID NO: 3969284 - RNA, 15 nt, Staphylococcus aureus subsp. aureus Mu50
auuccuauuacuaca

SEQ ID NO: 3969285 - RNA, 18 nt, Staphylococcus aureus subsp. aureus Mu50
auuccugauacaaugauu

SEQ ID NO: 3969286 - RNA, 16 nt, Staphylococcus aureus subsp. aureus Mu50
auuccugcaaaauguu

SEQ ID NO: 3969287 - RNA, 19 nt, Staphylococcus aureus subsp. aureus Mu50
auuccugcaaaauguuaca

SEQ ID NO: 3969288 - RNA, 22 nt, Staphylococcus aureus subsp. aureus Mu50
auuccuuggugucgaaauuguu

SEQ ID NO: 3969289 - RNA, 20 nt, Staphylococcus aureus subsp. aureus Mu50
auucgaaaagaaauucuaca

SEQ ID NO: 3969290 - RNA, 15 nt, Staphylococcus aureus subsp. aureus Mu50
auucgaaagccaauu

SEQ ID NO: 3969291 - RNA, 18 nt, Staphylococcus aureus subsp. aureus Mu50
auucgaacuaucaauaua

SEQ ID NO: 3969292 - RNA, 20 nt, Staphylococcus aureus subsp. aureus Mu50
auucgaacuaucaauauaau

SEQ ID NO: 3969293 - RNA, 19 nt, Staphylococcus aureus subsp. aureus Mu50
auucgacucaaacaauaaa

SEQ ID NO: 3969294 - RNA, 19 nt, Staphylococcus aureus subsp. aureus Mu50
auucgaugcuaaaaauauu

SEQ ID NO: 3969295 - RNA, 21 nt, Staphylococcus aureus subsp. aureus Mu50
auucgaugcuaaaaauauuga

SEQ ID NO: 3969296 - RNA, 16 nt, Staphylococcus aureus subsp. aureus Mu50
auucgcaccacuggcc

SEQ ID NO: 3969297 - RNA, 16 nt, Staphylococcus aureus subsp. aureus Mu50
auucgccaucuuuuuu

SEQ ID NO: 3969298 - RNA, 15 nt, Staphylococcus aureus subsp. aureus Mu50
auucgccuaaauggu

SEQ ID NO: 3969299 - RNA, 22 nt, Staphylococcus aureus subsp. aureus Mu50
auucgcgaacguuauuuucaau

SEQ ID NO: 3969300 - RNA, 17 nt, Staphylococcus aureus subsp. aureus Mu50
auucgcuuguaacaagc

SEQ ID NO: 3969301 - RNA, 13 nt, Staphylococcus aureus subsp. aureus Mu50
auucgcuuguuca

SEQ ID NO: 3969302 - RNA, 14 nt, Staphylococcus aureus subsp. aureus Mu50
auucgcuuguucag

SEQ ID NO: 3969303 - RNA, 13 nt, Staphylococcus aureus subsp. aureus Mu50
auucggauuauau

SEQ ID NO: 3969304 - RNA, 24 nt, Staphylococcus aureus subsp. aureus Mu50
auucguaaauccuuuauauucuaa

SEQ ID NO: 3969305 - RNA, 15 nt, Staphylococcus aureus subsp. aureus Mu50
auucguaauuuauga

SEQ ID NO: 3969306 - RNA, 21 nt, Staphylococcus aureus subsp. aureus Mu50
auucgucuacauauuggcuug

SEQ ID NO: 3969307 - RNA, 23 nt, Staphylococcus aureus subsp. aureus Mu50
auucguugauuuagcauacauua

SEQ ID NO: 3969308 - RNA, 21 nt, Staphylococcus aureus subsp. aureus Mu50
auucuaaaaaauuaaaaauuu

SEQ ID NO: 3969309 - RNA, 14 nt, Staphylococcus aureus subsp. aureus Mu50
auucuaaaacggaa

SEQ ID NO: 3969310 - RNA, 14 nt, Staphylococcus aureus subsp. aureus Mu50
auucuaaguuaaaa

SEQ ID NO: 3969311 - RNA, 17 nt, Staphylococcus aureus subsp. aureus Mu50
auucuaaguuaaaaccu

SEQ ID NO: 3969312 - RNA, 18 nt, Staphylococcus aureus subsp. aureus Mu50
auucuaauacaaaccuau

SEQ ID NO: 3969313 - RNA, 13 nt, Staphylococcus aureus subsp. aureus Mu50
auucuacaaacaa

SEQ ID NO: 3969314 - RNA, 15 nt, Staphylococcus aureus subsp. aureus Mu50
auugauaaauuuuua

SEQ ID NO: 3969315 - RNA, 16 nt, Staphylococcus aureus subsp. aureus Mu50
auugauaaauuuuuag

SEQ ID NO: 3969316 - RNA, 23 nt, Staphylococcus aureus subsp. aureus Mu50
auugauagcaccguaacauaugu

SEQ ID NO: 3969317 - RNA, 21 nt, Staphylococcus aureus subsp. aureus Mu50
auugauauuaugccauucauu

SEQ ID NO: 3969318 - RNA, 16 nt, Staphylococcus aureus subsp. aureus Mu50
auugauauucuaaaaa

SEQ ID NO: 3969319 - RNA, 15 nt, Staphylococcus aureus subsp. aureus Mu50
auugaucgauuguuu

SEQ ID NO: 3969320 - RNA, 12 nt, Staphylococcus aureus subsp. aureus Mu50
auugaucugauu

SEQ ID NO: 3969321 - RNA, 19 nt, Staphylococcus aureus subsp. aureus Mu50
auugaucuuuuauaaugaa

SEQ ID NO: 3969322 - RNA, 20 nt, Staphylococcus aureus subsp. aureus Mu50
auugaugaaagacugacuaa

SEQ ID NO: 3969323 - RNA, 14 nt, Staphylococcus aureus subsp. aureus Mu50
auugaugaauaaau

SEQ ID NO: 3969324 - RNA, 20 nt, Staphylococcus aureus subsp. aureus Mu50
auugauggcuucucuuaguu

SEQ ID NO: 3969325 - RNA, 16 nt, Staphylococcus aureus subsp. aureus Mu50
auugaugucaauuuca

SEQ ID NO: 3969326 - RNA, 19 nt, Staphylococcus aureus subsp. aureus Mu50
auugaugugccuuucuaau

SEQ ID NO: 3969327 - RNA, 16 nt, Staphylococcus aureus subsp. aureus Mu50
auugauuauaaugauu

SEQ ID NO: 3969328 - RNA, 15 nt, Staphylococcus aureus subsp. aureus Mu50
auugauuaucauaug

SEQ ID NO: 3969329 - RNA, 13 nt, Staphylococcus aureus subsp. aureus Mu50
auugauucuuugg

SEQ ID NO: 3969330 - RNA, 17 nt, Staphylococcus aureus subsp. aureus Mu50
auugauucuuuggugaa

SEQ ID NO: 3969331 - RNA, 17 nt, Staphylococcus aureus subsp. aureus Mu50
auugauuucagcaccga

SEQ ID NO: 3969332 - RNA, 21 nt, Staphylococcus aureus subsp. aureus Mu50
auugcaaaaauaauaugaauu

SEQ ID NO: 3969333 - RNA, 14 nt, Staphylococcus aureus subsp. aureus Mu50
auugcaaaugcaau

SEQ ID NO: 3969334 - RNA, 16 nt, Staphylococcus aureus subsp. aureus Mu50
auugcaaauuaucauu

SEQ ID NO: 3969335 - RNA, 20 nt, Staphylococcus aureus subsp. aureus Mu50
auugcaacgcaucacaaaau

SEQ ID NO: 3969336 - RNA, 21 nt, Staphylococcus aureus subsp. aureus Mu50
auugcaacgcaucacaaaauu

SEQ ID NO: 3969337 - RNA, 13 nt, Staphylococcus aureus subsp. aureus Mu50
auugcaaugaaua

SEQ ID NO: 3969338 - RNA, 19 nt, Staphylococcus aureus subsp. aureus Mu50
auugcaaugaauaacaaga

SEQ ID NO: 3969339 - RNA, 23 nt, Staphylococcus aureus subsp. aureus Mu50
auugcacuaugcauaauaccaau

SEQ ID NO: 3969340 - RNA, 12 nt, Staphylococcus aureus subsp. aureus Mu50
auugcacuuuuu

SEQ ID NO: 3969341 - RNA, 19 nt, Staphylococcus aureus subsp. aureus Mu50
auugcauacguaaauggua

SEQ ID NO: 3969342 - RNA, 21 nt, Staphylococcus aureus subsp. aureus Mu50
auugccaguaucucuuuucua

SEQ ID NO: 3969343 - RNA, 16 nt, Staphylococcus aureus subsp. aureus Mu50
auugccauagaaaugu

SEQ ID NO: 3969344 - RNA, 14 nt, Staphylococcus aureus subsp. aureus Mu50
auugccauauaccg

SEQ ID NO: 3969345 - RNA, 18 nt, Staphylococcus aureus subsp. aureus Mu50
auugccguuauuuucaau

SEQ ID NO: 3969346 - RNA, 19 nt, Staphylococcus aureus subsp. aureus Mu50
auugccuaaccuguuugag

SEQ ID NO: 3969347 - RNA, 16 nt, Staphylococcus aureus subsp. aureus Mu50
auugccuguagaauuu

SEQ ID NO: 3969348 - RNA, 16 nt, Staphylococcus aureus subsp. aureus Mu50
auugcgaaaaauaauu

SEQ ID NO: 3969349 - RNA, 13 nt, Staphylococcus aureus subsp. aureus Mu50
auugcuaaaaaaa

SEQ ID NO: 3969350 - RNA, 20 nt, Staphylococcus aureus subsp. aureus Mu50
auugcuaaaaaaauuaaaau

SEQ ID NO: 3969351 - RNA, 17 nt, Staphylococcus aureus subsp. aureus Mu50
auugcuaauccauacgu

SEQ ID NO: 3969352 - RNA, 22 nt, Staphylococcus aureus subsp. aureus Mu50
auugcuauaagaacuaaugguu

SEQ ID NO: 3969353 - RNA, 22 nt, Staphylococcus aureus subsp. aureus Mu50
auugcuauauuaguauaauuua

SEQ ID NO: 3969354 - RNA, 16 nt, Staphylococcus aureus subsp. aureus Mu50
auugcucuuuaacaau

SEQ ID NO: 3969355 - RNA, 23 nt, Staphylococcus aureus subsp. aureus Mu50
auugcugccacuguagaaacaca

SEQ ID NO: 3969356 - RNA, 23 nt, Staphylococcus aureus subsp. aureus Mu50
auugcugcuguacaauuucgcuu

SEQ ID NO: 3969357 - RNA, 19 nt, Staphylococcus aureus subsp. aureus Mu50
auugcuguaaauauucguu

SEQ ID NO: 3969358 - RNA, 18 nt, Staphylococcus aureus subsp. aureus Mu50
auugcuguaaccccuugu

SEQ ID NO: 3969359 - RNA, 15 nt, Staphylococcus aureus subsp. aureus Mu50
auugcuuauuuuugu

SEQ ID NO: 3969360 - RNA, 21 nt, Staphylococcus aureus subsp. aureus Mu50
auugcuugaaauuauuauuua

SEQ ID NO: 3969361 - RNA, 18 nt, Staphylococcus aureus subsp. aureus Mu50
auugcuuguccucuaaaa

SEQ ID NO: 3969362 - RNA, 16 nt, Staphylococcus aureus subsp. aureus Mu50
auugcuuuagaaaguc

SEQ ID NO: 3969363 - RNA, 19 nt, Staphylococcus aureus subsp. aureus Mu50
auuggaaucaucuuuuuga

SEQ ID NO: 3969364 - RNA, 18 nt, Staphylococcus aureus subsp. aureus Mu50
auuggaaucccaaugcuu

SEQ ID NO: 3969365 - RNA, 18 nt, Staphylococcus aureus subsp. aureus Mu50
auuggauaauuucuucuu

SEQ ID NO: 3969366 - RNA, 23 nt, Staphylococcus aureus subsp. aureus Mu50
auuggauuacuuccauugcuucu

SEQ ID NO: 3969367 - RNA, 12 nt, Staphylococcus aureus subsp. aureus Mu50
auuggcagauag

SEQ ID NO: 3969368 - RNA, 16 nt, Staphylococcus aureus subsp. aureus Mu50
auuggcaguaguugac

SEQ ID NO: 3969369 - RNA, 23 nt, Staphylococcus aureus subsp. aureus Mu50
auugggagcaaucaauacaauuu

SEQ ID NO: 3969370 - RNA, 22 nt, Staphylococcus aureus subsp. aureus Mu50
auuggguggucguaauuugguc

SEQ ID NO: 3969371 - RNA, 19 nt, Staphylococcus aureus subsp. aureus Mu50
auugguaaauuuaucauuu

SEQ ID NO: 3969372 - RNA, 20 nt, Staphylococcus aureus subsp. aureus Mu50
auugguaaauuuaucauuuu

SEQ ID NO: 3969373 - RNA, 22 nt, Staphylococcus aureus subsp. aureus Mu50
auugguaggaggcuuuugcuuu

SEQ ID NO: 3969374 - RNA, 15 nt, Staphylococcus aureus subsp. aureus Mu50
auugguugaucaauu

SEQ ID NO: 3969375 - RNA, 16 nt, Staphylococcus aureus subsp. aureus Mu50
auugguugauuaguuu

SEQ ID NO: 3969376 - RNA, 13 nt, Staphylococcus aureus subsp. aureus Mu50
auugguuucauca

SEQ ID NO: 3969377 - RNA, 17 nt, Staphylococcus aureus subsp. aureus Mu50
auugguuugugauuuuu

SEQ ID NO: 3969378 - RNA, 18 nt, Staphylococcus aureus subsp. aureus Mu50
auugguuuucauguguca

SEQ ID NO: 3969379 - RNA, 21 nt, Staphylococcus aureus subsp. aureus Mu50
auugguuuuuacuauaauaau

SEQ ID NO: 3969380 - RNA, 20 nt, Staphylococcus aureus subsp. aureus Mu50
auugguuuuuagugaaaaga

SEQ ID NO: 3969381 - RNA, 13 nt, Staphylococcus aureus subsp. aureus Mu50
auuguaaaacaaa

SEQ ID NO: 3969382 - RNA, 14 nt, Staphylococcus aureus subsp. aureus Mu50
auuguaaaaugcuc

SEQ ID NO: 3969383 - RNA, 13 nt, Staphylococcus aureus subsp. aureus Mu50
auuguaaaaugua

SEQ ID NO: 3969384 - RNA, 14 nt, Staphylococcus aureus subsp. aureus Mu50
auuguaaauauagu

SEQ ID NO: 3969385 - RNA, 18 nt, Staphylococcus aureus subsp. aureus Mu50
auuguaaauauaguaaua

SEQ ID NO: 3969386 - RNA, 21 nt, Staphylococcus aureus subsp. aureus Mu50
auuguaagauaacgagugaaa

SEQ ID NO: 3969387 - RNA, 16 nt, Staphylococcus aureus subsp. aureus Mu50
auuguaagucgaaagu

SEQ ID NO: 3969388 - RNA, 22 nt, Staphylococcus aureus subsp. aureus Mu50
auuguaagucgaaaguacccag

SEQ ID NO: 3969389 - RNA, 11 nt, Staphylococcus aureus subsp. aureus Mu50
auuguaauaaa

SEQ ID NO: 3969390 - RNA, 21 nt, Staphylococcus aureus subsp. aureus Mu50
auuguaauaaccaugccagcu

SEQ ID NO: 3969391 - RNA, 15 nt, Staphylococcus aureus subsp. aureus Mu50
auuguaauaauaauc

SEQ ID NO: 3969392 - RNA, 23 nt, Staphylococcus aureus subsp. aureus Mu50
auuguaauaauaaucuuuaacau

SEQ ID NO: 3969393 - RNA, 19 nt, Staphylococcus aureus subsp. aureus Mu50
auuguaccaguaacaauaa

SEQ ID NO: 3969394 - RNA, 21 nt, Staphylococcus aureus subsp. aureus Mu50
auuguacgcuucaauuauuuc

SEQ ID NO: 3969395 - RNA, 14 nt, Staphylococcus aureus subsp. aureus Mu50
auuguaguaaugaa

SEQ ID NO: 3969396 - RNA, 20 nt, Staphylococcus aureus subsp. aureus Mu50
auuguaucguuaccuuuuaa

SEQ ID NO: 3969397 - RNA, 16 nt, Staphylococcus aureus subsp. aureus Mu50
auuguaucuugucauu

SEQ ID NO: 3969398 - RNA, 15 nt, Staphylococcus aureus subsp. aureus Mu50
auuguaugaauaaua

SEQ ID NO: 3969399 - RNA, 16 nt, Staphylococcus aureus subsp. aureus Mu50
auuguauuagcaauuu

SEQ ID NO: 3969400 - RNA, 17 nt, Staphylococcus aureus subsp. aureus Mu50
auuguauuauccucaaa

SEQ ID NO: 3969401 - RNA, 12 nt, Staphylococcus aureus subsp. aureus Mu50
auuuaacuaauc

SEQ ID NO: 3969402 - RNA, 21 nt, Staphylococcus aureus subsp. aureus Mu50
auuuaacuuucccuacugcuu

SEQ ID NO: 3969403 - RNA, 16 nt, Staphylococcus aureus subsp. aureus Mu50
auuuaagaaacgucuu

SEQ ID NO: 3969404 - RNA, 14 nt, Staphylococcus aureus subsp. aureus Mu50
auuuaagauuuaau

SEQ ID NO: 3969405 - RNA, 18 nt, Staphylococcus aureus subsp. aureus Mu50
auuuaauaaaccagugcg

SEQ ID NO: 3969406 - RNA, 13 nt, Staphylococcus aureus subsp. aureus Mu50
auuuaauaacgaa

SEQ ID NO: 3969407 - RNA, 15 nt, Staphylococcus aureus subsp. aureus Mu50
auuuaauaaguuaau

SEQ ID NO: 3969408 - RNA, 13 nt, Staphylococcus aureus subsp. aureus Mu50
auuuaauaaugcu

SEQ ID NO: 3969409 - RNA, 12 nt, Staphylococcus aureus subsp. aureus Mu50
auuuaauaaugu

SEQ ID NO: 3969410 - RNA, 19 nt, Staphylococcus aureus subsp. aureus Mu50
auuuaauacuuuucucgau

SEQ ID NO: 3969411 - RNA, 19 nt, Staphylococcus aureus subsp. aureus Mu50
auuuaaucguaacauauca

SEQ ID NO: 3969412 - RNA, 14 nt, Staphylococcus aureus subsp. aureus Mu50
auuuaaucguagga

SEQ ID NO: 3969413 - RNA, 23 nt, Staphylococcus aureus subsp. aureus Mu50
auuuaaucuauuaacugaccuaa

SEQ ID NO: 3969414 - RNA, 20 nt, Staphylococcus aureus subsp. aureus Mu50
auuuaauggucuaauaucaa

SEQ ID NO: 3969415 - RNA, 22 nt, Staphylococcus aureus subsp. aureus Mu50
auuuaauggucuaauaucaauu

SEQ ID NO: 3969416 - RNA, 16 nt, Staphylococcus aureus subsp. aureus Mu50
auuuaauguuaaacaa

SEQ ID NO: 3969417 - RNA, 12 nt, Staphylococcus aureus subsp. aureus Mu50
auuuaauguuuu

SEQ ID NO: 3969418 - RNA, 16 nt, Staphylococcus aureus subsp. aureus Mu50
auuuaauuauuucucu

SEQ ID NO: 3969419 - RNA, 14 nt, Staphylococcus aureus subsp. aureus Mu50
auuuaauuccauua

SEQ ID NO: 3969420 - RNA, 20 nt, Staphylococcus aureus subsp. aureus Mu50
auuuaauucugguuuaauga

SEQ ID NO: 3969421 - RNA, 13 nt, Staphylococcus aureus subsp. aureus Mu50
auuuaauuuaauu

SEQ ID NO: 3969422 - RNA, 13 nt, Staphylococcus aureus subsp. aureus Mu50
auuuaauuuuuaa

SEQ ID NO: 3969423 - RNA, 12 nt, Staphylococcus aureus subsp. aureus Mu50
auuuaauuuuuc

SEQ ID NO: 3969424 - RNA, 13 nt, Staphylococcus aureus subsp. aureus Mu50
auuuaauuuuucu

SEQ ID NO: 3969425 - RNA, 15 nt, Staphylococcus aureus subsp. aureus Mu50
auuuaauuuuucuaa

SEQ ID NO: 3969426 - RNA, 19 nt, Staphylococcus aureus subsp. aureus Mu50
auuuaauuuuucuaaauga

SEQ ID NO: 3969427 - RNA, 20 nt, Staphylococcus aureus subsp. aureus Mu50
auuuacaaauguauaaauaa

SEQ ID NO: 3969428 - RNA, 16 nt, Staphylococcus aureus subsp. aureus Mu50
auuuacacacaugaua

SEQ ID NO: 3969429 - RNA, 20 nt, Staphylococcus aureus subsp. aureus Mu50
auuuacacacaugauaauuu

SEQ ID NO: 3969430 - RNA, 17 nt, Staphylococcus aureus subsp. aureus Mu50
auuuacacagaaugaua

SEQ ID NO: 3969431 - RNA, 21 nt, Staphylococcus aureus subsp. aureus Mu50
auuuacacagaaugauauaac

SEQ ID NO: 3969432 - RNA, 17 nt, Staphylococcus aureus subsp. aureus Mu50
auuuacaccuauaccuc

SEQ ID NO: 3969433 - RNA, 16 nt, Staphylococcus aureus subsp. aureus Mu50
auuuacauuaauuugu

SEQ ID NO: 3969434 - RNA, 17 nt, Staphylococcus aureus subsp. aureus Mu50
auuuacauugccacuuu

SEQ ID NO: 3969435 - RNA, 19 nt, Staphylococcus aureus subsp. aureus Mu50
auuuaccaguuugaucaua

SEQ ID NO: 3969436 - RNA, 19 nt, Staphylococcus aureus subsp. aureus Mu50
auuuaccauuuucaauaaa

SEQ ID NO: 3969437 - RNA, 16 nt, Staphylococcus aureus subsp. aureus Mu50
auuuacccauuacauu

SEQ ID NO: 3969438 - RNA, 22 nt, Staphylococcus aureus subsp. aureus Mu50
auuuaccucuugauaaaauaaa

SEQ ID NO: 3969439 - RNA, 14 nt, Staphylococcus aureus subsp. aureus Mu50
auuuaccuucuucu

SEQ ID NO: 3969440 - RNA, 19 nt, Staphylococcus aureus subsp. aureus Mu50
auuuaccuuugucuuuuuu

SEQ ID NO: 3969441 - RNA, 21 nt, Staphylococcus aureus subsp. aureus Mu50
auuuaccuuugucuuuuuuau

SEQ ID NO: 3969442 - RNA, 16 nt, Staphylococcus aureus subsp. aureus Mu50
auuuacgauacaucau

SEQ ID NO: 3969443 - RNA, 16 nt, Staphylococcus aureus subsp. aureus Mu50
auuuacgguuauggug

SEQ ID NO: 3969444 - RNA, 18 nt, Staphylococcus aureus subsp. aureus Mu50
auuuacuccuuacaauaa

SEQ ID NO: 3969445 - RNA, 13 nt, Staphylococcus aureus subsp. aureus Mu50
auuuacuucuucu

SEQ ID NO: 3969446 - RNA, 22 nt, Staphylococcus aureus subsp. aureus Mu50
auuuacuugauuagauuugugu

SEQ ID NO: 3969447 - RNA, 22 nt, Staphylococcus aureus subsp. aureus Mu50
auuuacuuuuccuugauucuua

SEQ ID NO: 3969448 - RNA, 20 nt, Staphylococcus aureus subsp. aureus Mu50
auuuagaaacaaucguugaa

SEQ ID NO: 3969449 - RNA, 18 nt, Staphylococcus aureus subsp. aureus Mu50
auuuagaaacuuccaaca

SEQ ID NO: 3969450 - RNA, 21 nt, Staphylococcus aureus subsp. aureus Mu50
auuuagaagaacaauaauuga

SEQ ID NO: 3969451 - RNA, 19 nt, Staphylococcus aureus subsp. aureus Mu50
auuuagaauucuaaaagaa

SEQ ID NO: 3969452 - RNA, 20 nt, Staphylococcus aureus subsp. aureus Mu50
auuuagaauucuaaaagaau

SEQ ID NO: 3969453 - RNA, 22 nt, Staphylococcus aureus subsp. aureus Mu50
auuuagacaucauuguuuuagg

SEQ ID NO: 3969454 - RNA, 15 nt, Staphylococcus aureus subsp. aureus Mu50
auuuagauaaaaauu

SEQ ID NO: 3969455 - RNA, 20 nt, Staphylococcus aureus subsp. aureus Mu50
auuuagauagcggauuuauu

SEQ ID NO: 3969456 - RNA, 17 nt, Staphylococcus aureus subsp. aureus Mu50
auuuagaugcauaaaaa

SEQ ID NO: 3969457 - RNA, 20 nt, Staphylococcus aureus subsp. aureus Mu50
auuuagaugcauaaaaaaag

SEQ ID NO: 3969458 - RNA, 22 nt, Staphylococcus aureus subsp. aureus Mu50
auuuagaugcauaaaaaaagaa

SEQ ID NO: 3969459 - RNA, 18 nt, Staphylococcus aureus subsp. aureus Mu50
auuuagauuggucaaacu

SEQ ID NO: 3969460 - RNA, 16 nt, Staphylococcus aureus subsp. aureus Mu50
auuuagauuuauaacg

SEQ ID NO: 3969461 - RNA, 17 nt, Staphylococcus aureus subsp. aureus Mu50
auuuagauuuauaacga

SEQ ID NO: 3969462 - RNA, 14 nt, Staphylococcus aureus subsp. aureus Mu50
auuuagcaaauauu

SEQ ID NO: 3969463 - RNA, 15 nt, Staphylococcus aureus subsp. aureus Mu50
auuuagcaucaaaaa

SEQ ID NO: 3969464 - RNA, 17 nt, Staphylococcus aureus subsp. aureus Mu50
auuuagcaucaaaaaua

SEQ ID NO: 3969465 - RNA, 19 nt, Staphylococcus aureus subsp. aureus Mu50
auuuagguaauacaucauc

SEQ ID NO: 3969466 - RNA, 14 nt, Staphylococcus aureus subsp. aureus Mu50
auuuaguacauaug

SEQ ID NO: 3969467 - RNA, 18 nt, Staphylococcus aureus subsp. aureus Mu50
auuuaguacucaauguua

SEQ ID NO: 3969468 - RNA, 14 nt, Staphylococcus aureus subsp. aureus Mu50
auuuaguauaaaua

SEQ ID NO: 3969469 - RNA, 15 nt, Staphylococcus aureus subsp. aureus Mu50
auuuaguauaaauaa

SEQ ID NO: 3969470 - RNA, 22 nt, Staphylococcus aureus subsp. aureus Mu50
auuuaguauaaauaaaaauaca

SEQ ID NO: 3969471 - RNA, 15 nt, Staphylococcus aureus subsp. aureus Mu50
auuuaguaucucauu

SEQ ID NO: 3969472 - RNA, 15 nt, Staphylococcus aureus subsp. aureus Mu50
auuuagucauuacaa

SEQ ID NO: 3969473 - RNA, 15 nt, Staphylococcus aureus subsp. aureus Mu50
auuuaguccuucuuu

SEQ ID NO: 3969474 - RNA, 17 nt, Staphylococcus aureus subsp. aureus Mu50
auuuagugaaacaauuu

SEQ ID NO: 3969475 - RNA, 22 nt, Staphylococcus aureus subsp. aureus Mu50
auuuagugaaacaauuuguaac

SEQ ID NO: 3969476 - RNA, 15 nt, Staphylococcus aureus subsp. aureus Mu50
auuuaguuaaauaca

SEQ ID NO: 3969477 - RNA, 16 nt, Staphylococcus aureus subsp. aureus Mu50
auuuaguuaaguauuu

SEQ ID NO: 3969478 - RNA, 19 nt, Staphylococcus aureus subsp. aureus Mu50
auuuaguuaauuauuuaga

SEQ ID NO: 3969479 - RNA, 15 nt, Staphylococcus aureus subsp. aureus Mu50
auuuaguuauaauuu

SEQ ID NO: 3969480 - RNA, 17 nt, Staphylococcus aureus subsp. aureus Mu50
auuuaguuuuuuuaaag

SEQ ID NO: 3969481 - RNA, 19 nt, Staphylococcus aureus subsp. aureus Mu50
auuuauaaacaauuacaaa

SEQ ID NO: 3969482 - RNA, 15 nt, Staphylococcus aureus subsp. aureus Mu50
auuuauaacauuuaa

SEQ ID NO: 3969483 - RNA, 15 nt, Staphylococcus aureus subsp. aureus Mu50
auuuauacagugaau

SEQ ID NO: 3969484 - RNA, 14 nt, Staphylococcus aureus subsp. aureus Mu50
auuuauacuaaauu

SEQ ID NO: 3969485 - RNA, 15 nt, Staphylococcus aureus subsp. aureus Mu50
auuuauacuauaaau

SEQ ID NO: 3969486 - RNA, 16 nt, Staphylococcus aureus subsp. aureus Mu50
auuuauacuauaaaua

SEQ ID NO: 3969487 - RNA, 13 nt, Staphylococcus aureus subsp. aureus Mu50
auuuauagauuua

SEQ ID NO: 3969488 - RNA, 19 nt, Staphylococcus aureus subsp. aureus Mu50
auuuauauagucuaugaau

SEQ ID NO: 3969489 - RNA, 23 nt, Staphylococcus aureus subsp. aureus Mu50
auuucuauaucuauuuaucauac

SEQ ID NO: 3969490 - RNA, 21 nt, Staphylococcus aureus subsp. aureus Mu50
auuucugaaaugauacauuau

SEQ ID NO: 3969491 - RNA, 22 nt, Staphylococcus aureus subsp. aureus Mu50
auuucugaaaugauacauuauu

SEQ ID NO: 3969492 - RNA, 23 nt, Staphylococcus aureus subsp. aureus Mu50
auuucugaaaugauacauuauua

SEQ ID NO: 3969493 - RNA, 17 nt, Staphylococcus aureus subsp. aureus Mu50
auuucugaauuuuucaa

SEQ ID NO: 3969494 - RNA, 17 nt, Staphylococcus aureus subsp. aureus Mu50
auuucugcuucuuuuaa

SEQ ID NO: 3969495 - RNA, 13 nt, Staphylococcus aureus subsp. aureus Mu50
auuucugucccac

SEQ ID NO: 3969496 - RNA, 19 nt, Staphylococcus aureus subsp. aureus Mu50
auuucugucccacucccau

SEQ ID NO: 3969497 - RNA, 21 nt, Staphylococcus aureus subsp. aureus Mu50
auuucuguuuacgccauaaga

SEQ ID NO: 3969498 - RNA, 14 nt, Staphylococcus aureus subsp. aureus Mu50
auuucuuaccauuu

SEQ ID NO: 3969499 - RNA, 17 nt, Staphylococcus aureus subsp. aureus Mu50
auuucuucauuaucaau

SEQ ID NO: 3969500 - RNA, 18 nt, Staphylococcus aureus subsp. aureus Mu50
auuucuucauuaucaaua

SEQ ID NO: 3969501 - RNA, 17 nt, Staphylococcus aureus subsp. aureus Mu50
auuucuucauuuucauu

SEQ ID NO: 3969502 - RNA, 19 nt, Staphylococcus aureus subsp. aureus Mu50
auuucuucuccuucaaugu

SEQ ID NO: 3969503 - RNA, 17 nt, Staphylococcus aureus subsp. aureus Mu50
auuucuugcuucauuga

SEQ ID NO: 3969504 - RNA, 22 nt, Staphylococcus aureus subsp. aureus Mu50
auuucuugugcgguaaccauuu

SEQ ID NO: 3969505 - RNA, 21 nt, Staphylococcus aureus subsp. aureus Mu50
auuucuuuaagugacacacca

SEQ ID NO: 3969506 - RNA, 10 nt, Staphylococcus aureus subsp. aureus Mu50
auuucuuugu

SEQ ID NO: 3969507 - RNA, 13 nt, Staphylococcus aureus subsp. aureus Mu50
auuucuuuucauu

SEQ ID NO: 3969508 - RNA, 21 nt, Staphylococcus aureus subsp. aureus Mu50
auuucuuuucauuaucauuaa

SEQ ID NO: 3969509 - RNA, 15 nt, Staphylococcus aureus subsp. aureus Mu50
auuucuuuugaaucu

SEQ ID NO: 3969510 - RNA, 10 nt, Staphylococcus aureus subsp. aureus Mu50
auuucuuuuu

SEQ ID NO: 3969511 - RNA, 13 nt, Staphylococcus aureus subsp. aureus Mu50
auuucuuuuuaaa

SEQ ID NO: 3969512 - RNA, 15 nt, Staphylococcus aureus subsp. aureus Mu50
auuucuuuuuaaaau

SEQ ID NO: 3969513 - RNA, 17 nt, Staphylococcus aureus subsp. aureus Mu50
auuucuuuuuaaaaucg

SEQ ID NO: 3969514 - RNA, 12 nt, Staphylococcus aureus subsp. aureus Mu50
auuugaauacuu

SEQ ID NO: 3969515 - RNA, 19 nt, Staphylococcus aureus subsp. aureus Mu50
auuugaauauggaaaaugu

SEQ ID NO: 3969516 - RNA, 20 nt, Staphylococcus aureus subsp. aureus Mu50
auuugaaugcaaaucaaaua

SEQ ID NO: 3969517 - RNA, 22 nt, Staphylococcus aureus subsp. aureus Mu50
auuugaauugacuuacauuuua

SEQ ID NO: 3969518 - RNA, 15 nt, Staphylococcus aureus subsp. aureus Mu50
auuugacacauuauu

SEQ ID NO: 3969519 - RNA, 21 nt, Staphylococcus aureus subsp. aureus Mu50
auuugacacauuauugaaauu

SEQ ID NO: 3969520 - RNA, 20 nt, Staphylococcus aureus subsp. aureus Mu50
auuugagaaccacuauaauu

SEQ ID NO: 3969521 - RNA, 16 nt, Staphylococcus aureus subsp. aureus Mu50
auuugauaaauaaaau

SEQ ID NO: 3969522 - RNA, 13 nt, Staphylococcus aureus subsp. aureus Mu50
auuugauacaacu

SEQ ID NO: 3969523 - RNA, 23 nt, Staphylococcus aureus subsp. aureus Mu50
auuugauuaguaauuuuuaaauc

SEQ ID NO: 3969524 - RNA, 16 nt, Staphylococcus aureus subsp. aureus Mu50
auuugauuauucuuca

SEQ ID NO: 3969525 - RNA, 20 nt, Staphylococcus aureus subsp. aureus Mu50
auuugauuuaaaaaguuaau

SEQ ID NO: 3969526 - RNA, 21 nt, Staphylococcus aureus subsp. aureus Mu50
auuugauuuggguaauguuuu

SEQ ID NO: 3969527 - RNA, 14 nt, Staphylococcus aureus subsp. aureus Mu50
auuugcaacaauau

SEQ ID NO: 3969528 - RNA, 19 nt, Staphylococcus aureus subsp. aureus Mu50
auuugcacaaagauauguu

SEQ ID NO: 3969529 - RNA, 17 nt, Staphylococcus aureus subsp. aureus Mu50
auuugcaccuauaccuc

SEQ ID NO: 3969530 - RNA, 18 nt, Staphylococcus aureus subsp. aureus Mu50
auuugcaccuauaccucg

SEQ ID NO: 3969531 - RNA, 21 nt, Staphylococcus aureus subsp. aureus Mu50
auuugccccgccauucauaaa

SEQ ID NO: 3969532 - RNA, 17 nt, Staphylococcus aureus subsp. aureus Mu50
auuugcuagucauaauu

SEQ ID NO: 3969533 - RNA, 18 nt, Staphylococcus aureus subsp. aureus Mu50
auuugcuagucauaauuu

SEQ ID NO: 3969534 - RNA, 22 nt, Staphylococcus aureus subsp. aureus Mu50
auuugcuagucauaauuuaaaa

SEQ ID NO: 3969535 - RNA, 23 nt, Staphylococcus aureus subsp. aureus Mu50
auuugcugcuaauugauauggau

SEQ ID NO: 3969536 - RNA, 17 nt, Staphylococcus aureus subsp. aureus Mu50
auuuggaggugaugaga

SEQ ID NO: 3969537 - RNA, 17 nt, Staphylococcus aureus subsp. aureus Mu50
auuuggauaauuuuuaa

SEQ ID NO: 3969538 - RNA, 21 nt, Staphylococcus aureus subsp. aureus Mu50
auuuggauauuuauuuuaaua

SEQ ID NO: 3969539 - RNA, 21 nt, Staphylococcus aureus subsp. aureus Mu50
auuuggaugguaaguauaauu

SEQ ID NO: 3969540 - RNA, 19 nt, Staphylococcus aureus subsp. aureus Mu50
auuuggcguugcaccaagc

SEQ ID NO: 3969541 - RNA, 16 nt, Staphylococcus aureus subsp. aureus Mu50
auuuggguaauguuuu

SEQ ID NO: 3969542 - RNA, 21 nt, Staphylococcus aureus subsp. aureus Mu50
auuuggguaauguuuuuacaa

SEQ ID NO: 3969543 - RNA, 20 nt, Staphylococcus aureus subsp. aureus Mu50
auuugggucguuagaugaau

SEQ ID NO: 3969544 - RNA, 20 nt, Staphylococcus aureus subsp. aureus Mu50
auuuggucauagaaauuuua

SEQ ID NO: 3969545 - RNA, 21 nt, Staphylococcus aureus subsp. aureus Mu50
auuugguggagaaccaaaaau

SEQ ID NO: 3969546 - RNA, 21 nt, Staphylococcus aureus subsp. aureus Mu50
auuugguggagaaccaaaauu

SEQ ID NO: 3969547 - RNA, 22 nt, Staphylococcus aureus subsp. aureus Mu50
auuugguggagaaccaaaauua

SEQ ID NO: 3969548 - RNA, 20 nt, Staphylococcus aureus subsp. aureus Mu50
auuugguguacauaguugaa

SEQ ID NO: 3969549 - RNA, 16 nt, Staphylococcus aureus subsp. aureus Mu50
auuugguuaauacguu

SEQ ID NO: 3969550 - RNA, 16 nt, Staphylococcus aureus subsp. aureus Mu50
auuuguaaacaguaug

SEQ ID NO: 3969551 - RNA, 19 nt, Staphylococcus aureus subsp. aureus Mu50
auuuguaaagacaccauca

SEQ ID NO: 3969552 - RNA, 17 nt, Staphylococcus aureus subsp. aureus Mu50
auuuguaacuauugaaa

SEQ ID NO: 3969553 - RNA, 13 nt, Staphylococcus aureus subsp. aureus Mu50
auuuguaauacaa

SEQ ID NO: 3969554 - RNA, 16 nt, Staphylococcus aureus subsp. aureus Mu50
auuuguaaucccauuu

SEQ ID NO: 3969555 - RNA, 19 nt, Staphylococcus aureus subsp. aureus Mu50
auuuguaaucccauuuuaa

SEQ ID NO: 3969556 - RNA, 20 nt, Staphylococcus aureus subsp. aureus Mu50
auuuguaaucccauuuuaaa

SEQ ID NO: 3969557 - RNA, 24 nt, Staphylococcus aureus subsp. aureus Mu50
auuuguaauuccucuggaacuuua

SEQ ID NO: 3969558 - RNA, 14 nt, Staphylococcus aureus subsp. aureus Mu50
auuuguaccaaaua

SEQ ID NO: 3969559 - RNA, 17 nt, Staphylococcus aureus subsp. aureus Mu50
auuuguaccaaauaaau

SEQ ID NO: 3969560 - RNA, 20 nt, Staphylococcus aureus subsp. aureus Mu50
auuuguagagaugugaugcu

SEQ ID NO: 3969561 - RNA, 19 nt, Staphylococcus aureus subsp. aureus Mu50
auuuguagcuugaauaaua

SEQ ID NO: 3969562 - RNA, 22 nt, Staphylococcus aureus subsp. aureus Mu50
auuuguagcuugaauaauauau

SEQ ID NO: 3969563 - RNA, 17 nt, Staphylococcus aureus subsp. aureus Mu50
auuuguauagauuguau

SEQ ID NO: 3969564 - RNA, 19 nt, Staphylococcus aureus subsp. aureus Mu50
auuugucaucguauuucua

SEQ ID NO: 3969565 - RNA, 20 nt, Staphylococcus aureus subsp. aureus Mu50
auuugucaucguauuucuag

SEQ ID NO: 3969566 - RNA, 17 nt, Staphylococcus aureus subsp. aureus Mu50
auuuguggaaauaaaac

SEQ ID NO: 3969567 - RNA, 19 nt, Staphylococcus aureus subsp. aureus Mu50
auuugugguaaucauguaa

SEQ ID NO: 3969568 - RNA, 15 nt, Staphylococcus aureus subsp. aureus Mu50
auuuguguauaaaug

SEQ ID NO: 3969569 - RNA, 23 nt, Staphylococcus aureus subsp. aureus Mu50
auuuguguauaaaugucauagua

SEQ ID NO: 3969570 - RNA, 21 nt, Staphylococcus aureus subsp. aureus Mu50
auuuguguucaaaucacaagu

SEQ ID NO: 3969571 - RNA, 14 nt, Staphylococcus aureus subsp. aureus Mu50
auuuguuaaauuca

SEQ ID NO: 3969572 - RNA, 18 nt, Staphylococcus aureus subsp. aureus Mu50
auuuguuaauuuaauaau

SEQ ID NO: 3969573 - RNA, 14 nt, Staphylococcus aureus subsp. aureus Mu50
auuuguuacuucua

SEQ ID NO: 3969574 - RNA, 19 nt, Staphylococcus aureus subsp. aureus Mu50
auuuguuaugguauuuaua

SEQ ID NO: 3969575 - RNA, 13 nt, Staphylococcus aureus subsp. aureus Mu50
auuuguuuuaaau

SEQ ID NO: 3969576 - RNA, 19 nt, Staphylococcus aureus subsp. aureus Mu50
auuuucuugccaucaauuu

SEQ ID NO: 3969577 - RNA, 20 nt, Staphylococcus aureus subsp. aureus Mu50
auuuucuugccaucaauuuc

SEQ ID NO: 3969578 - RNA, 23 nt, Staphylococcus aureus subsp. aureus Mu50
auuuucuugccaucaauuucugu

SEQ ID NO: 3969579 - RNA, 13 nt, Staphylococcus aureus subsp. aureus Mu50
auuuucuuuuuua

SEQ ID NO: 3969580 - RNA, 20 nt, Staphylococcus aureus subsp. aureus Mu50
auuuucuuuuuuaauucuau

SEQ ID NO: 3969581 - RNA, 11 nt, Staphylococcus aureus subsp. aureus Mu50
auuuugaagaa

SEQ ID NO: 3969582 - RNA, 17 nt, Staphylococcus aureus subsp. aureus Mu50
auuuugaaucacauuaa

SEQ ID NO: 3969583 - RNA, 21 nt, Staphylococcus aureus subsp. aureus Mu50
auuuugacgccagaauaaauc

SEQ ID NO: 3969584 - RNA, 19 nt, Staphylococcus aureus subsp. aureus Mu50
auuuugagucguagauacu

SEQ ID NO: 3969585 - RNA, 22 nt, Staphylococcus aureus subsp. aureus Mu50
auuuugagucguagauacuacc

SEQ ID NO: 3969586 - RNA, 14 nt, Staphylococcus aureus subsp. aureus Mu50
auuuugcaacauua

SEQ ID NO: 3969587 - RNA, 22 nt, Staphylococcus aureus subsp. aureus Mu50
auuuugcgaaaauaucauuucu

SEQ ID NO: 3969588 - RNA, 16 nt, Staphylococcus aureus subsp. aureus Mu50
auuuugcucuaaacuu

SEQ ID NO: 3969589 - RNA, 19 nt, Staphylococcus aureus subsp. aureus Mu50
auuuugcucuaaacuucua

SEQ ID NO: 3969590 - RNA, 21 nt, Staphylococcus aureus subsp. aureus Mu50
auuuugcugccaaaaaguauu

SEQ ID NO: 3969591 - RNA, 17 nt, Staphylococcus aureus subsp. aureus Mu50
auuuugcuuuauuuucu

SEQ ID NO: 3969592 - RNA, 15 nt, Staphylococcus aureus subsp. aureus Mu50
auuuuggaacauauu

SEQ ID NO: 3969593 - RNA, 17 nt, Staphylococcus aureus subsp. aureus Mu50
auuuuggauaauaugag

SEQ ID NO: 3969594 - RNA, 16 nt, Staphylococcus aureus subsp. aureus Mu50
auuuuguauuagcauc

SEQ ID NO: 3969595 - RNA, 15 nt, Staphylococcus aureus subsp. aureus Mu50
auuuuguauuuuuca

SEQ ID NO: 3969596 - RNA, 23 nt, Staphylococcus aureus subsp. aureus Mu50
auuuuguauuuuucaaauaaaga

SEQ ID NO: 3969597 - RNA, 17 nt, Staphylococcus aureus subsp. aureus Mu50
auuuugucuuuuauauu

SEQ ID NO: 3969598 - RNA, 19 nt, Staphylococcus aureus subsp. aureus Mu50
auuuugucuuuuauauuuu

SEQ ID NO: 3969599 - RNA, 14 nt, Staphylococcus aureus subsp. aureus Mu50
auuuugugaauuua

SEQ ID NO: 3969600 - RNA, 14 nt, Staphylococcus aureus subsp. aureus Mu50
auuuuguucaguua

SEQ ID NO: 3969601 - RNA, 23 nt, Staphylococcus aureus subsp. aureus Mu50
auuuuguugaaacgguaucaaca

SEQ ID NO: 3969602 - RNA, 13 nt, Staphylococcus aureus subsp. aureus Mu50
auuuuguuucaaa

SEQ ID NO: 3969603 - RNA, 12 nt, Staphylococcus aureus subsp. aureus Mu50
auuuuguuuuaa

SEQ ID NO: 3969604 - RNA, 14 nt, Staphylococcus aureus subsp. aureus Mu50
auuuuguuuuaaaa

SEQ ID NO: 3969605 - RNA, 15 nt, Staphylococcus aureus subsp. aureus Mu50
auuuuguuuuaaaaa

SEQ ID NO: 3969606 - RNA, 15 nt, Staphylococcus aureus subsp. aureus Mu50
auuuuguuuugcuuc

SEQ ID NO: 3969607 - RNA, 21 nt, Staphylococcus aureus subsp. aureus Mu50
auuuuuaaaaaccuagggaua

SEQ ID NO: 3969608 - RNA, 15 nt, Staphylococcus aureus subsp. aureus Mu50
auuuuuaaaauuaug

SEQ ID NO: 3969609 - RNA, 13 nt, Staphylococcus aureus subsp. aureus Mu50
auuuuuaaaucua

SEQ ID NO: 3969610 - RNA, 17 nt, Staphylococcus aureus subsp. aureus Mu50
auuuuuaaauuacuaua

SEQ ID NO: 3969611 - RNA, 23 nt, Staphylococcus aureus subsp. aureus Mu50
auuuuuaacagcgugaauauaag

SEQ ID NO: 3969612 - RNA, 14 nt, Staphylococcus aureus subsp. aureus Mu50
auuuuuaauaauuu

SEQ ID NO: 3969613 - RNA, 16 nt, Staphylococcus aureus subsp. aureus Mu50
auuuuuaauaauuuga

SEQ ID NO: 3969614 - RNA, 12 nt, Staphylococcus aureus subsp. aureus Mu50
auuuuuaauaua

SEQ ID NO: 3969615 - RNA, 22 nt, Staphylococcus aureus subsp. aureus Mu50
auuuuuaauguauucuucuaau

SEQ ID NO: 3969616 - RNA, 15 nt, Staphylococcus aureus subsp. aureus Mu50
auuuuuaauuauuuu

SEQ ID NO: 3969617 - RNA, 17 nt, Staphylococcus aureus subsp. aureus Mu50
auuuuuagacauuaaaa

SEQ ID NO: 3969618 - RNA, 19 nt, Staphylococcus aureus subsp. aureus Mu50
auuuuuagacauuaaaaaa

SEQ ID NO: 3969619 - RNA, 12 nt, Staphylococcus aureus subsp. aureus Mu50
auuuuuaucauc

SEQ ID NO: 3969620 - RNA, 15 nt, Staphylococcus aureus subsp. aureus Mu50
auuuuuaucaucaug

SEQ ID NO: 3969621 - RNA, 21 nt, Staphylococcus aureus subsp. aureus Mu50
auuuuucaaauauaucaacgu

SEQ ID NO: 3969622 - RNA, 14 nt, Staphylococcus aureus subsp. aureus Mu50
auuuuucaaauguu

SEQ ID NO: 3969623 - RNA, 16 nt, Staphylococcus aureus subsp. aureus Mu50
auuuuucaauuaaaug

SEQ ID NO: 3969624 - RNA, 20 nt, Staphylococcus aureus subsp. aureus Mu50
auuuuucaucaauaucaaau

SEQ ID NO: 3969625 - RNA, 16 nt, Staphylococcus aureus subsp. aureus Mu50
auuuuucuaaaugauu

SEQ ID NO: 3969626 - RNA, 19 nt, Staphylococcus aureus subsp. aureus Mu50
auuuuucuaaaugauuuau

SEQ ID NO: 3969627 - RNA, 16 nt, Staphylococcus aureus subsp. aureus Mu50
auuuuucuuauaaaaa

SEQ ID NO: 3969628 - RNA, 21 nt, Staphylococcus aureus subsp. aureus Mu50
auuuuucuucaguuaaaucuu

SEQ ID NO: 3969629 - RNA, 19 nt, Staphylococcus aureus subsp. aureus Mu50
auuuuugaguaauuuaauc

SEQ ID NO: 3969630 - RNA, 17 nt, Staphylococcus aureus subsp. aureus Mu50
auuuuugauaacuguaa

SEQ ID NO: 3969631 - RNA, 19 nt, Staphylococcus aureus subsp. aureus Mu50
auuuuugcguuaauaauuu

SEQ ID NO: 3969632 - RNA, 20 nt, Staphylococcus aureus subsp. aureus Mu50
auuuuuggauucaccaauua

SEQ ID NO: 3969633 - RNA, 14 nt, Staphylococcus aureus subsp. aureus Mu50
auuuuugggaagaa

SEQ ID NO: 3969634 - RNA, 18 nt, Staphylococcus aureus subsp. aureus Mu50
auuuuuguaauacaucua

SEQ ID NO: 3969635 - RNA, 22 nt, Staphylococcus aureus subsp. aureus Mu50
auuuuuguaauacaucuaauaa

SEQ ID NO: 3969636 - RNA, 19 nt, Staphylococcus aureus subsp. aureus Mu50
auuuuuguaauugaugauu

SEQ ID NO: 3969637 - RNA, 16 nt, Staphylococcus aureus subsp. aureus Mu50
auuuuuguauuuaugu

SEQ ID NO: 3969638 - RNA, 23 nt, Staphylococcus aureus subsp. aureus Mu50
auuuuuuaaaugcguaguauaaa

SEQ ID NO: 3969639 - RNA, 18 nt, Staphylococcus aureus subsp. aureus Mu50
auuuuuuagacaaauguu

SEQ ID NO: 3969640 - RNA, 15 nt, Staphylococcus aureus subsp. aureus Mu50
auuuuuuauaaagau

SEQ ID NO: 3969641 - RNA, 12 nt, Staphylococcus aureus subsp. aureus Mu50
auuuuuugauau

SEQ ID NO: 3969642 - RNA, 12 nt, Staphylococcus aureus subsp. aureus Mu50
auuuuuuuaaag

SEQ ID NO: 3969643 - RNA, 12 nt, Staphylococcus aureus subsp. aureus Mu50
auuuuuuuaaau

SEQ ID NO: 3969644 - RNA, 21 nt, Staphylococcus aureus subsp. aureus Mu50
auuuuuuuaaaucuauauaaa

SEQ ID NO: 3969645 - RNA, 11 nt, Staphylococcus aureus subsp. aureus Mu50
auuuuuuuagg

SEQ ID NO: 3969646 - RNA, 15 nt, Staphylococcus aureus subsp. aureus Mu50
auuuuuuuauauuuu

SEQ ID NO: 3969647 - RNA, 12 nt, Staphylococcus aureus subsp. aureus Mu50
auuuuuuuaugc

SEQ ID NO: 3969648 - RNA, 18 nt, Staphylococcus aureus subsp. aureus Mu50
auuuuuuucacuaauuuc

SEQ ID NO: 3969649 - RNA, 18 nt, Staphylococcus aureus subsp. aureus Mu50
auuuuuuuccaagcauca

SEQ ID NO: 3969650 - RNA, 14 nt, Staphylococcus aureus subsp. aureus Mu50
auuuuuuuccuuuc

SEQ ID NO: 3969651 - RNA, 21 nt, Staphylococcus aureus subsp. aureus Mu50
auuuuuuucguaacauuuaaa

SEQ ID NO: 3969652 - RNA, 15 nt, Staphylococcus aureus subsp. aureus Mu50
auuuuuuucuuucuu

SEQ ID NO: 3969653 - RNA, 14 nt, Staphylococcus aureus subsp. aureus Mu50
auuuuuuuguucuu

SEQ ID NO: 3969654 - RNA, 23 nt, Staphylococcus aureus subsp. aureus Mu50
auuuuuuuuauuaauuaaaaaau

SEQ ID NO: 3969655 - RNA, 21 nt, Staphylococcus aureus subsp. aureus Mu50
caaaaaaaccgaacaucugaa

SEQ ID NO: 3969656 - RNA, 20 nt, Staphylococcus aureus subsp. aureus Mu50
caaaaaaagacacaucacua

SEQ ID NO: 3969657 - RNA, 15 nt, Staphylococcus aureus subsp. aureus Mu50
caaaaaaagcugauu

SEQ ID NO: 3969658 - RNA, 23 nt, Staphylococcus aureus subsp. aureus Mu50
caaaaaaggaugaugugaauguu

SEQ ID NO: 3969659 - RNA, 15 nt, Staphylococcus aureus subsp. aureus Mu50
caaaaaauaaaaacu

SEQ ID NO: 3969660 - RNA, 17 nt, Staphylococcus aureus subsp. aureus Mu50
caaaaaauacguuuaau

SEQ ID NO: 3969661 - RNA, 11 nt, Staphylococcus aureus subsp. aureus Mu50
caaaaaauauc

SEQ ID NO: 3969662 - RNA, 13 nt, Staphylococcus aureus subsp. aureus Mu50
caaaaaauaucuu

SEQ ID NO: 3969663 - RNA, 19 nt, Staphylococcus aureus subsp. aureus Mu50
caaaaaaucgaacaaauga

SEQ ID NO: 3969664 - RNA, 18 nt, Staphylococcus aureus subsp. aureus Mu50
caaacugccuaauacacu

SEQ ID NO: 3969665 - RNA, 15 nt, Staphylococcus aureus subsp. aureus Mu50
caaacuugauucaau

SEQ ID NO: 3969666 - RNA, 17 nt, Staphylococcus aureus subsp. aureus Mu50
caaacuuggcaaugaaa

SEQ ID NO: 3969667 - RNA, 15 nt, Staphylococcus aureus subsp. aureus Mu50
caaagaaaucaccag

SEQ ID NO: 3969668 - RNA, 22 nt, Staphylococcus aureus subsp. aureus Mu50
caaagaaauguaugauauaaac

SEQ ID NO: 3969669 - RNA, 20 nt, Staphylococcus aureus subsp. aureus Mu50
caaagaaccacgcaucaugu

SEQ ID NO: 3969670 - RNA, 20 nt, Staphylococcus aureus subsp. aureus Mu50
caaagaauuucgaaaagaaa

SEQ ID NO: 3969671 - RNA, 23 nt, Staphylococcus aureus subsp. aureus Mu50
caaagaauuucgaaaagaaauuc

SEQ ID NO: 3969672 - RNA, 20 nt, Staphylococcus aureus subsp. aureus Mu50
caaagacacggccugcaagu

SEQ ID NO: 3969673 - RNA, 17 nt, Staphylococcus aureus subsp. aureus Mu50
caaagaggcuuuaaaau

SEQ ID NO: 3969674 - RNA, 18 nt, Staphylococcus aureus subsp. aureus Mu50
caaagaggcuuuaaaauu

SEQ ID NO: 3969675 - RNA, 16 nt, Staphylococcus aureus subsp. aureus Mu50
caaagauauguuuaua

SEQ ID NO: 3969676 - RNA, 19 nt, Staphylococcus aureus subsp. aureus Mu50
caaagauuccuguaacaag

SEQ ID NO: 3969677 - RNA, 20 nt, Staphylococcus aureus subsp. aureus Mu50
caaagccuucuaucucuuua

SEQ ID NO: 3969678 - RNA, 16 nt, Staphylococcus aureus subsp. aureus Mu50
caaagcgaauuaucuu

SEQ ID NO: 3969679 - RNA, 22 nt, Staphylococcus aureus subsp. aureus Mu50
caaagcgauaaaguaugaguga

SEQ ID NO: 3969680 - RNA, 23 nt, Staphylococcus aureus subsp. aureus Mu50
caaagcuauauaugaauugagua

SEQ ID NO: 3969681 - RNA, 22 nt, Staphylococcus aureus subsp. aureus Mu50
caaagcucguugcagauuuugc

SEQ ID NO: 3969682 - RNA, 17 nt, Staphylococcus aureus subsp. aureus Mu50
caaagcugucaacuugu

SEQ ID NO: 3969683 - RNA, 17 nt, Staphylococcus aureus subsp. aureus Mu50
caaagguugcugcagcu

SEQ ID NO: 3969684 - RNA, 23 nt, Staphylococcus aureus subsp. aureus Mu50
caaagguuuacuauuaaaggaaa

SEQ ID NO: 3969685 - RNA, 19 nt, Staphylococcus aureus subsp. aureus Mu50
caaaguaacaugugcaagu

SEQ ID NO: 3969686 - RNA, 22 nt, Staphylococcus aureus subsp. aureus Mu50
caaaguaacaugugcaaguaua

SEQ ID NO: 3969687 - RNA, 19 nt, Staphylococcus aureus subsp. aureus Mu50
caaaguaauaugagugaaa

SEQ ID NO: 3969688 - RNA, 19 nt, Staphylococcus aureus subsp. aureus Mu50
caaaguaccaucucuauuu

SEQ ID NO: 3969689 - RNA, 20 nt, Staphylococcus aureus subsp. aureus Mu50
caaaguaccaucucuauuuu

SEQ ID NO: 3969690 - RNA, 20 nt, Staphylococcus aureus subsp. aureus Mu50
caaaguacucaaguaaucaa

SEQ ID NO: 3969691 - RNA, 23 nt, Staphylococcus aureus subsp. aureus Mu50
caaaguacucaaguaaucaagca

SEQ ID NO: 3969692 - RNA, 13 nt, Staphylococcus aureus subsp. aureus Mu50
caaaguagacauu

SEQ ID NO: 3969693 - RNA, 17 nt, Staphylococcus aureus subsp. aureus Mu50
caaaguagacauugaau

SEQ ID NO: 3969694 - RNA, 18 nt, Staphylococcus aureus subsp. aureus Mu50
caaaguagacauugaaua

SEQ ID NO: 3969695 - RNA, 16 nt, Staphylococcus aureus subsp. aureus Mu50
caaaguauauacuaau

SEQ ID NO: 3969696 - RNA, 17 nt, Staphylococcus aureus subsp. aureus Mu50
caaagucucuaguaucu

SEQ ID NO: 3969697 - RNA, 16 nt, Staphylococcus aureus subsp. aureus Mu50
caaagugcaauuauuu

SEQ ID NO: 3969698 - RNA, 13 nt, Staphylococcus aureus subsp. aureus Mu50
caaaguuaaccau

SEQ ID NO: 3969699 - RNA, 21 nt, Staphylococcus aureus subsp. aureus Mu50
caaaguucguaauugucuuua

SEQ ID NO: 3969700 - RNA, 16 nt, Staphylococcus aureus subsp. aureus Mu50
caaaguuuaauugcug

SEQ ID NO: 3969701 - RNA, 17 nt, Staphylococcus aureus subsp. aureus Mu50
caaaguuuauacuuaau

SEQ ID NO: 3969702 - RNA, 18 nt, Staphylococcus aureus subsp. aureus Mu50
caaauaaaaaaguuaucu

SEQ ID NO: 3969703 - RNA, 12 nt, Staphylococcus aureus subsp. aureus Mu50
caaauaaaauca

SEQ ID NO: 3969704 - RNA, 17 nt, Staphylococcus aureus subsp. aureus Mu50
caaauaaacacaucuau

SEQ ID NO: 3969705 - RNA, 18 nt, Staphylococcus aureus subsp. aureus Mu50
caaauaaaucaaacuuuu

SEQ ID NO: 3969706 - RNA, 19 nt, Staphylococcus aureus subsp. aureus Mu50
caaauaaaugacauuuaau

SEQ ID NO: 3969707 - RNA, 22 nt, Staphylococcus aureus subsp. aureus Mu50
caaauaaaugacauuuaauacu

SEQ ID NO: 3969708 - RNA, 20 nt, Staphylococcus aureus subsp. aureus Mu50
caaauaaauguccgacuuga

SEQ ID NO: 3969709 - RNA, 17 nt, Staphylococcus aureus subsp. aureus Mu50
caaauaaauuaaauuuu

SEQ ID NO: 3969710 - RNA, 18 nt, Staphylococcus aureus subsp. aureus Mu50
caaauaaauuaaauuuug

SEQ ID NO: 3969711 - RNA, 13 nt, Staphylococcus aureus subsp. aureus Mu50
caaauaacaaaca

SEQ ID NO: 3969712 - RNA, 15 nt, Staphylococcus aureus subsp. aureus Mu50
caaauaacguuaaua

SEQ ID NO: 3969713 - RNA, 16 nt, Staphylococcus aureus subsp. aureus Mu50
caaauaacguuaauau

SEQ ID NO: 3969714 - RNA, 20 nt, Staphylococcus aureus subsp. aureus Mu50
caaauaacguuaauauaauu

SEQ ID NO: 3969715 - RNA, 13 nt, Staphylococcus aureus subsp. aureus Mu50
caaauaauauaaa

SEQ ID NO: 3969716 - RNA, 14 nt, Staphylococcus aureus subsp. aureus Mu50
caaauaauaucuca

SEQ ID NO: 3969717 - RNA, 13 nt, Staphylococcus aureus subsp. aureus Mu50
caaauaaugaaua

SEQ ID NO: 3969718 - RNA, 19 nt, Staphylococcus aureus subsp. aureus Mu50
caaauaaugugaaaaaucu

SEQ ID NO: 3969719 - RNA, 14 nt, Staphylococcus aureus subsp. aureus Mu50
caaauacaguugua

SEQ ID NO: 3969720 - RNA, 16 nt, Staphylococcus aureus subsp. aureus Mu50
caaauacauaaucauu

SEQ ID NO: 3969721 - RNA, 15 nt, Staphylococcus aureus subsp. aureus Mu50
caaauacaucaauuu

SEQ ID NO: 3969722 - RNA, 16 nt, Staphylococcus aureus subsp. aureus Mu50
caaauacauuucaaaa

SEQ ID NO: 3969723 - RNA, 18 nt, Staphylococcus aureus subsp. aureus Mu50
caaauacauuucaaaaaa

SEQ ID NO: 3969724 - RNA, 19 nt, Staphylococcus aureus subsp. aureus Mu50
caaauacgaguguuuuaau

SEQ ID NO: 3969725 - RNA, 12 nt, Staphylococcus aureus subsp. aureus Mu50
caaauacuucaa

SEQ ID NO: 3969726 - RNA, 16 nt, Staphylococcus aureus subsp. aureus Mu50
caaauagacaccaaaa

SEQ ID NO: 3969727 - RNA, 14 nt, Staphylococcus aureus subsp. aureus Mu50
caaauagagaaaua

SEQ ID NO: 3969728 - RNA, 18 nt, Staphylococcus aureus subsp. aureus Mu50
caaauagagaaauacuau

SEQ ID NO: 3969729 - RNA, 21 nt, Staphylococcus aureus subsp. aureus Mu50
caaauaguuaagauuuuaacu

SEQ ID NO: 3969730 - RNA, 14 nt, Staphylococcus aureus subsp. aureus Mu50
caaauaguucaaau

SEQ ID NO: 3969731 - RNA, 21 nt, Staphylococcus aureus subsp. aureus Mu50
caaauauaauguauaaaacag

SEQ ID NO: 3969732 - RNA, 21 nt, Staphylococcus aureus subsp. aureus Mu50
caaauauacuugccuucaaau

SEQ ID NO: 3969733 - RNA, 13 nt, Staphylococcus aureus subsp. aureus Mu50
caaauauacuuuu

SEQ ID NO: 3969734 - RNA, 15 nt, Staphylococcus aureus subsp. aureus Mu50
caaauaucaguaaua

SEQ ID NO: 3969735 - RNA, 17 nt, Staphylococcus aureus subsp. aureus Mu50
caaauaucaguaauaau

SEQ ID NO: 3969736 - RNA, 18 nt, Staphylococcus aureus subsp. aureus Mu50
caaauaucaguaauaaua

SEQ ID NO: 3969737 - RNA, 15 nt, Staphylococcus aureus subsp. aureus Mu50
caaauauuaaauuau

SEQ ID NO: 3969738 - RNA, 14 nt, Staphylococcus aureus subsp. aureus Mu50
caaauauuucuaaa

SEQ ID NO: 3969739 - RNA, 15 nt, Staphylococcus aureus subsp. aureus Mu50
caaauauuucuaaac

SEQ ID NO: 3969740 - RNA, 19 nt, Staphylococcus aureus subsp. aureus Mu50
caaauccaaaaucuuuacu

SEQ ID NO: 3969741 - RNA, 23 nt, Staphylococcus aureus subsp. aureus Mu50
caaaucgauuaauuauaaguagu

SEQ ID NO: 3969742 - RNA, 19 nt, Staphylococcus aureus subsp. aureus Mu50
caaaucggaauaaaauaaa

SEQ ID NO: 3969743 - RNA, 23 nt, Staphylococcus aureus subsp. aureus Mu50
caaaucggcuauacauugauaaa

SEQ ID NO: 3969744 - RNA, 14 nt, Staphylococcus aureus subsp. aureus Mu50
caaaucguaaacau

SEQ ID NO: 3969745 - RNA, 19 nt, Staphylococcus aureus subsp. aureus Mu50
caaaucguuucaugcacuu

SEQ ID NO: 3969746 - RNA, 22 nt, Staphylococcus aureus subsp. aureus Mu50
caaaucucgucacauauaaaua

SEQ ID NO: 3969747 - RNA, 23 nt, Staphylococcus aureus subsp. aureus Mu50
caaaucucgucacauauaaauau

SEQ ID NO: 3969748 - RNA, 14 nt, Staphylococcus aureus subsp. aureus Mu50
caaaucuuuuaaau

SEQ ID NO: 3969749 - RNA, 15 nt, Staphylococcus aureus subsp. aureus Mu50
caaaucuuuuaaauu

SEQ ID NO: 3969750 - RNA, 18 nt, Staphylococcus aureus subsp. aureus Mu50
caaaugaaaaaguaaaau

SEQ ID NO: 3969751 - RNA, 23 nt, Staphylococcus aureus subsp. aureus Mu50
caacgcauauucuauuguuguuu

SEQ ID NO: 3969752 - RNA, 21 nt, Staphylococcus aureus subsp. aureus Mu50
caacguauaagugauaucagu

SEQ ID NO: 3969753 - RNA, 19 nt, Staphylococcus aureus subsp. aureus Mu50
caacguuauucguuaacaa

SEQ ID NO: 3969754 - RNA, 15 nt, Staphylococcus aureus subsp. aureus Mu50
caacguucuacucua

SEQ ID NO: 3969755 - RNA, 18 nt, Staphylococcus aureus subsp. aureus Mu50
caacuaaaggucccauua

SEQ ID NO: 3969756 - RNA, 22 nt, Staphylococcus aureus subsp. aureus Mu50
caacuaaaggucccauuaaaau

SEQ ID NO: 3969757 - RNA, 14 nt, Staphylococcus aureus subsp. aureus Mu50
caacuaaauuuucu

SEQ ID NO: 3969758 - RNA, 17 nt, Staphylococcus aureus subsp. aureus Mu50
caacuaagauauauugu

SEQ ID NO: 3969759 - RNA, 15 nt, Staphylococcus aureus subsp. aureus Mu50
caacuaauguuaaaa

SEQ ID NO: 3969760 - RNA, 18 nt, Staphylococcus aureus subsp. aureus Mu50
caacuaauguuaaaauaa

SEQ ID NO: 3969761 - RNA, 17 nt, Staphylococcus aureus subsp. aureus Mu50
caacuaauuuaaagcau

SEQ ID NO: 3969762 - RNA, 22 nt, Staphylococcus aureus subsp. aureus Mu50
caacuaauuuaaagcaucauau

SEQ ID NO: 3969763 - RNA, 19 nt, Staphylococcus aureus subsp. aureus Mu50
caacuacuuaaauuaagaa

SEQ ID NO: 3969764 - RNA, 15 nt, Staphylococcus aureus subsp. aureus Mu50
caacuauaugugucg

SEQ ID NO: 3969765 - RNA, 13 nt, Staphylococcus aureus subsp. aureus Mu50
caacugaaauuuu

SEQ ID NO: 3969766 - RNA, 16 nt, Staphylococcus aureus subsp. aureus Mu50
caacugaaauuuuucc

SEQ ID NO: 3969767 - RNA, 12 nt, Staphylococcus aureus subsp. aureus Mu50
caacugagaaau

SEQ ID NO: 3969768 - RNA, 17 nt, Staphylococcus aureus subsp. aureus Mu50
caacugaucauuuucau

SEQ ID NO: 3969769 - RNA, 18 nt, Staphylococcus aureus subsp. aureus Mu50
caacugcauauaaaguca

SEQ ID NO: 3969770 - RNA, 17 nt, Staphylococcus aureus subsp. aureus Mu50
caacugcauuacgcugu

SEQ ID NO: 3969771 - RNA, 14 nt, Staphylococcus aureus subsp. aureus Mu50
caacugcuuuuuau

SEQ ID NO: 3969772 - RNA, 18 nt, Staphylococcus aureus subsp. aureus Mu50
caacugucgguucaucua

SEQ ID NO: 3969773 - RNA, 17 nt, Staphylococcus aureus subsp. aureus Mu50
caacuuaaauggaugau

SEQ ID NO: 3969774 - RNA, 13 nt, Staphylococcus aureus subsp. aureus Mu50
caacuuaauaacc

SEQ ID NO: 3969775 - RNA, 22 nt, Staphylococcus aureus subsp. aureus Mu50
caacuuaauaaccauguaaaau

SEQ ID NO: 3969776 - RNA, 11 nt, Staphylococcus aureus subsp. aureus Mu50
caacuuaauac

SEQ ID NO: 3969777 - RNA, 18 nt, Staphylococcus aureus subsp. aureus Mu50
caacuuaauacgauaaua

SEQ ID NO: 3969778 - RNA, 22 nt, Staphylococcus aureus subsp. aureus Mu50
caacuuaauacgauaauaacua

SEQ ID NO: 3969779 - RNA, 13 nt, Staphylococcus aureus subsp. aureus Mu50
caacuuagaauuu

SEQ ID NO: 3969780 - RNA, 15 nt, Staphylococcus aureus subsp. aureus Mu50
caacuuauaauauua

SEQ ID NO: 3969781 - RNA, 13 nt, Staphylococcus aureus subsp. aureus Mu50
caacuuauuauuu

SEQ ID NO: 3969782 - RNA, 14 nt, Staphylococcus aureus subsp. aureus Mu50
caacuuauucuuca

SEQ ID NO: 3969783 - RNA, 19 nt, Staphylococcus aureus subsp. aureus Mu50
caacuucuucuccguauuu

SEQ ID NO: 3969784 - RNA, 22 nt, Staphylococcus aureus subsp. aureus Mu50
caacuugugguuggaagucugc

SEQ ID NO: 3969785 - RNA, 18 nt, Staphylococcus aureus subsp. aureus Mu50
caacuuuaagacuuugau

SEQ ID NO: 3969786 - RNA, 21 nt, Staphylococcus aureus subsp. aureus Mu50
caacuuuaauuuuucauuaau

SEQ ID NO: 3969787 - RNA, 17 nt, Staphylococcus aureus subsp. aureus Mu50
caacuuuacgauaaaua

SEQ ID NO: 3969788 - RNA, 21 nt, Staphylococcus aureus subsp. aureus Mu50
caacuuuagcauauucgcuua

SEQ ID NO: 3969789 - RNA, 21 nt, Staphylococcus aureus subsp. aureus Mu50
caacuuuuagaguuuuuauua

SEQ ID NO: 3969790 - RNA, 16 nt, Staphylococcus aureus subsp. aureus Mu50
caacuuuuuaauaaua

SEQ ID NO: 3969791 - RNA, 24 nt, Staphylococcus aureus subsp. aureus Mu50
caacuuuuuaauaauacuucuaau

SEQ ID NO: 3969792 - RNA, 21 nt, Staphylococcus aureus subsp. aureus Mu50
caacuuuuuguuaauuuuuua

SEQ ID NO: 3969793 - RNA, 23 nt, Staphylococcus aureus subsp. aureus Mu50
caacuuuuuuaacagcugcaguc

SEQ ID NO: 3969794 - RNA, 17 nt, Staphylococcus aureus subsp. aureus Mu50
caagaaauguuaaauua

SEQ ID NO: 3969795 - RNA, 14 nt, Staphylococcus aureus subsp. aureus Mu50
caagaacuuuaaaa

SEQ ID NO: 3969796 - RNA, 21 nt, Staphylococcus aureus subsp. aureus Mu50
caagaagacauuggauuacuu

SEQ ID NO: 3969797 - RNA, 17 nt, Staphylococcus aureus subsp. aureus Mu50
caagaaguaauguuaaa

SEQ ID NO: 3969798 - RNA, 16 nt, Staphylococcus aureus subsp. aureus Mu50
caagaauuaaugaaau

SEQ ID NO: 3969799 - RNA, 22 nt, Staphylococcus aureus subsp. aureus Mu50
caagaauuauggcagauccaua

SEQ ID NO: 3969800 - RNA, 23 nt, Staphylococcus aureus subsp. aureus Mu50
caagaauuauggcagauccauaa

SEQ ID NO: 3969801 - RNA, 18 nt, Staphylococcus aureus subsp. aureus Mu50
caagagaauuaauaauuu

SEQ ID NO: 3969802 - RNA, 14 nt, Staphylococcus aureus subsp. aureus Mu50
caagagauaagaaa

SEQ ID NO: 3969803 - RNA, 22 nt, Staphylococcus aureus subsp. aureus Mu50
caagagccuuguuggcuuuuuu

SEQ ID NO: 3969804 - RNA, 14 nt, Staphylococcus aureus subsp. aureus Mu50
caagauaaaucauc

SEQ ID NO: 3969805 - RNA, 24 nt, Staphylococcus aureus subsp. aureus Mu50
caagauaacuagcaaaugcacugu

SEQ ID NO: 3969806 - RNA, 16 nt, Staphylococcus aureus subsp. aureus Mu50
caagauuaugacaaca

SEQ ID NO: 3969807 - RNA, 21 nt, Staphylococcus aureus subsp. aureus Mu50
caagauuaugacaacauaaca

SEQ ID NO: 3969808 - RNA, 23 nt, Staphylococcus aureus subsp. aureus Mu50
caagauuaugacaacauaacaaa

SEQ ID NO: 3969809 - RNA, 21 nt, Staphylococcus aureus subsp. aureus Mu50
caagauuggcugugcuauaau

SEQ ID NO: 3969810 - RNA, 16 nt, Staphylococcus aureus subsp. aureus Mu50
caagcaauacgauugc

SEQ ID NO: 3969811 - RNA, 13 nt, Staphylococcus aureus subsp. aureus Mu50
caagcaaucuuag

SEQ ID NO: 3969812 - RNA, 14 nt, Staphylococcus aureus subsp. aureus Mu50
caagcauaccuaca

SEQ ID NO: 3969813 - RNA, 12 nt, Staphylococcus aureus subsp. aureus Mu50
caagcaucauug

SEQ ID NO: 3969814 - RNA, 15 nt, Staphylococcus aureus subsp. aureus Mu50
caagccaagauaaau

SEQ ID NO: 3969815 - RNA, 20 nt, Staphylococcus aureus subsp. aureus Mu50
caagcuaucguuuauugaua

SEQ ID NO: 3969816 - RNA, 18 nt, Staphylococcus aureus subsp. aureus Mu50
caagcucgcggccuuuuu

SEQ ID NO: 3969817 - RNA, 16 nt, Staphylococcus aureus subsp. aureus Mu50
caagcuuuauuuuuug

SEQ ID NO: 3969818 - RNA, 18 nt, Staphylococcus aureus subsp. aureus Mu50
caagcuuuucauuuuuau

SEQ ID NO: 3969819 - RNA, 16 nt, Staphylococcus aureus subsp. aureus Mu50
caagcuuuuuaggaau

SEQ ID NO: 3969820 - RNA, 14 nt, Staphylococcus aureus subsp. aureus Mu50
caagcuuuuuucaa

SEQ ID NO: 3969821 - RNA, 13 nt, Staphylococcus aureus subsp. aureus Mu50
caaggaagcauga

SEQ ID NO: 3969822 - RNA, 20 nt, Staphylococcus aureus subsp. aureus Mu50
caaggaagucaccauauuua

SEQ ID NO: 3969823 - RNA, 18 nt, Staphylococcus aureus subsp. aureus Mu50
caaggauguuauaaaaug

SEQ ID NO: 3969824 - RNA, 20 nt, Staphylococcus aureus subsp. aureus Mu50
caaggauguuauaaaaugaa

SEQ ID NO: 3969825 - RNA, 22 nt, Staphylococcus aureus subsp. aureus Mu50
caaggauguuauaaaaugaaua

SEQ ID NO: 3969826 - RNA, 19 nt, Staphylococcus aureus subsp. aureus Mu50
caagguaugaaauaacaau

SEQ ID NO: 3969827 - RNA, 21 nt, Staphylococcus aureus subsp. aureus Mu50
caagguguucgggaauuuuuu

SEQ ID NO: 3969828 - RNA, 15 nt, Staphylococcus aureus subsp. aureus Mu50
caagguuuucgccaa

SEQ ID NO: 3969829 - RNA, 18 nt, Staphylococcus aureus subsp. aureus Mu50
caaguaacucaagugauu

SEQ ID NO: 3969830 - RNA, 17 nt, Staphylococcus aureus subsp. aureus Mu50
caaguacacgaauacca

SEQ ID NO: 3969831 - RNA, 20 nt, Staphylococcus aureus subsp. aureus Mu50
caaguagucuacaguaaauu

SEQ ID NO: 3969832 - RNA, 14 nt, Staphylococcus aureus subsp. aureus Mu50
caaguccaaauaau

SEQ ID NO: 3969833 - RNA, 20 nt, Staphylococcus aureus subsp. aureus Mu50
caagucguucucuuaaauau

SEQ ID NO: 3969834 - RNA, 15 nt, Staphylococcus aureus subsp. aureus Mu50
caagucuaacaguua

SEQ ID NO: 3969835 - RNA, 23 nt, Staphylococcus aureus subsp. aureus Mu50
caagucuaguucgaacacacacu

SEQ ID NO: 3969836 - RNA, 22 nt, Staphylococcus aureus subsp. aureus Mu50
caagucucauaucuauuuuucg

SEQ ID NO: 3969837 - RNA, 18 nt, Staphylococcus aureus subsp. aureus Mu50
caagucuucuaaaaaauc

SEQ ID NO: 3969838 - RNA, 15 nt, Staphylococcus aureus subsp. aureus Mu50
caauauacuuuuuaa

SEQ ID NO: 3969839 - RNA, 21 nt, Staphylococcus aureus subsp. aureus Mu50
caauauagaaaaugaguacaa

SEQ ID NO: 3969840 - RNA, 22 nt, Staphylococcus aureus subsp. aureus Mu50
caauauauaaugguucuauaau

SEQ ID NO: 3969841 - RNA, 15 nt, Staphylococcus aureus subsp. aureus Mu50
caauauauucaccua

SEQ ID NO: 3969842 - RNA, 13 nt, Staphylococcus aureus subsp. aureus Mu50
caauaucauauuu

SEQ ID NO: 3969843 - RNA, 18 nt, Staphylococcus aureus subsp. aureus Mu50
caauaucuucagcuaaaa

SEQ ID NO: 3969844 - RNA, 19 nt, Staphylococcus aureus subsp. aureus Mu50
caauaucuucuaauuccau

SEQ ID NO: 3969845 - RNA, 21 nt, Staphylococcus aureus subsp. aureus Mu50
caauaucuucuaauuccauca

SEQ ID NO: 3969846 - RNA, 22 nt, Staphylococcus aureus subsp. aureus Mu50
caauaucuucuuuuaauauuug

SEQ ID NO: 3969847 - RNA, 21 nt, Staphylococcus aureus subsp. aureus Mu50
caauaugauuaauaaaguaau

SEQ ID NO: 3969848 - RNA, 13 nt, Staphylococcus aureus subsp. aureus Mu50
caauauuaaaaua

SEQ ID NO: 3969849 - RNA, 13 nt, Staphylococcus aureus subsp. aureus Mu50
caauauuaaaauu

SEQ ID NO: 3969850 - RNA, 19 nt, Staphylococcus aureus subsp. aureus Mu50
caauauuaaucauaaugaa

SEQ ID NO: 3969851 - RNA, 14 nt, Staphylococcus aureus subsp. aureus Mu50
caauauucaauaau

SEQ ID NO: 3969852 - RNA, 16 nt, Staphylococcus aureus subsp. aureus Mu50
caauauucaauaauuc

SEQ ID NO: 3969853 - RNA, 12 nt, Staphylococcus aureus subsp. aureus Mu50
caauauucguaa

SEQ ID NO: 3969854 - RNA, 14 nt, Staphylococcus aureus subsp. aureus Mu50
caauauugaacaau

SEQ ID NO: 3969855 - RNA, 20 nt, Staphylococcus aureus subsp. aureus Mu50
caauauuuauauuaaauacu

SEQ ID NO: 3969856 - RNA, 17 nt, Staphylococcus aureus subsp. aureus Mu50
caauauuuaucaauaaa

SEQ ID NO: 3969857 - RNA, 22 nt, Staphylococcus aureus subsp. aureus Mu50
caauauuuuuacauauuuauac

SEQ ID NO: 3969858 - RNA, 23 nt, Staphylococcus aureus subsp. aureus Mu50
caaucaacgagucauaaauauaa

SEQ ID NO: 3969859 - RNA, 19 nt, Staphylococcus aureus subsp. aureus Mu50
caaucaacuuagaauuuac

SEQ ID NO: 3969860 - RNA, 15 nt, Staphylococcus aureus subsp. aureus Mu50
caaucaacuucauau

SEQ ID NO: 3969861 - RNA, 17 nt, Staphylococcus aureus subsp. aureus Mu50
caaucacagcaauaaua

SEQ ID NO: 3969862 - RNA, 17 nt, Staphylococcus aureus subsp. aureus Mu50
caaucaguaauaaugua

SEQ ID NO: 3969863 - RNA, 23 nt, Staphylococcus aureus subsp. aureus Mu50
caaucauaccggcaaauaacaau

SEQ ID NO: 3969864 - RNA, 21 nt, Staphylococcus aureus subsp. aureus Mu50
caaucaucgcaaauacauaau

SEQ ID NO: 3969865 - RNA, 23 nt, Staphylococcus aureus subsp. aureus Mu50
caaucaucgcaaauacauaauca

SEQ ID NO: 3969866 - RNA, 15 nt, Staphylococcus aureus subsp. aureus Mu50
caaucauucacuuca

SEQ ID NO: 3969867 - RNA, 21 nt, Staphylococcus aureus subsp. aureus Mu50
caauccaauauacaaugcuga

SEQ ID NO: 3969868 - RNA, 20 nt, Staphylococcus aureus subsp. aureus Mu50
caauccuauggcgcaauuuu

SEQ ID NO: 3969869 - RNA, 15 nt, Staphylococcus aureus subsp. aureus Mu50
caauccuuuguuugu

SEQ ID NO: 3969870 - RNA, 13 nt, Staphylococcus aureus subsp. aureus Mu50
caaucgauuuuau

SEQ ID NO: 3969871 - RNA, 18 nt, Staphylococcus aureus subsp. aureus Mu50
caaucgauuuuauaucuu

SEQ ID NO: 3969872 - RNA, 13 nt, Staphylococcus aureus subsp. aureus Mu50
caaucgcauuuug

SEQ ID NO: 3969873 - RNA, 22 nt, Staphylococcus aureus subsp. aureus Mu50
caaucgcuuuagcaauugaauc

SEQ ID NO: 3969874 - RNA, 17 nt, Staphylococcus aureus subsp. aureus Mu50
caaucguaacuaacaug

SEQ ID NO: 3969875 - RNA, 18 nt, Staphylococcus aureus subsp. aureus Mu50
caaucgucacaucacguu

SEQ ID NO: 3969876 - RNA, 13 nt, Staphylococcus aureus subsp. aureus Mu50
caaucguuaauuu

SEQ ID NO: 3969877 - RNA, 18 nt, Staphylococcus aureus subsp. aureus Mu50
caaucguugaaaaauauc

SEQ ID NO: 3969878 - RNA, 23 nt, Staphylococcus aureus subsp. aureus Mu50
caaucguugaagauguauuuggc

SEQ ID NO: 3969879 - RNA, 13 nt, Staphylococcus aureus subsp. aureus Mu50
caaucuauauaaa

SEQ ID NO: 3969880 - RNA, 14 nt, Staphylococcus aureus subsp. aureus Mu50
caaucuauauaaau

SEQ ID NO: 3969881 - RNA, 15 nt, Staphylococcus aureus subsp. aureus Mu50
caaucuauuuuaaac

SEQ ID NO: 3969882 - RNA, 21 nt, Staphylococcus aureus subsp. aureus Mu50
caaucuccauuagaacuaaga

SEQ ID NO: 3969883 - RNA, 14 nt, Staphylococcus aureus subsp. aureus Mu50
caaucucuuuagau

SEQ ID NO: 3969884 - RNA, 18 nt, Staphylococcus aureus subsp. aureus Mu50
caaucuuaguacaaaauu

SEQ ID NO: 3969885 - RNA, 18 nt, Staphylococcus aureus subsp. aureus Mu50
caaucuuaucauaaucuu

SEQ ID NO: 3969886 - RNA, 20 nt, Staphylococcus aureus subsp. aureus Mu50
caaugaaaacagguggaagu

SEQ ID NO: 3969887 - RNA, 15 nt, Staphylococcus aureus subsp. aureus Mu50
caaugaauaaauuga

SEQ ID NO: 3969888 - RNA, 16 nt, Staphylococcus aureus subsp. aureus Mu50
caaugaauaaauugau

SEQ ID NO: 3969889 - RNA, 17 nt, Staphylococcus aureus subsp. aureus Mu50
caaugaauaaauugaua

SEQ ID NO: 3969890 - RNA, 19 nt, Staphylococcus aureus subsp. aureus Mu50
caaugaauaaugacaaauu

SEQ ID NO: 3969891 - RNA, 17 nt, Staphylococcus aureus subsp. aureus Mu50
caaugaauucauuuuau

SEQ ID NO: 3969892 - RNA, 14 nt, Staphylococcus aureus subsp. aureus Mu50
caaugaauuuacuc

SEQ ID NO: 3969893 - RNA, 15 nt, Staphylococcus aureus subsp. aureus Mu50
caaugaauuucuaau

SEQ ID NO: 3969894 - RNA, 22 nt, Staphylococcus aureus subsp. aureus Mu50
caaugaauuucuaauuuaguau

SEQ ID NO: 3969895 - RNA, 17 nt, Staphylococcus aureus subsp. aureus Mu50
caaugacauccauacaa

SEQ ID NO: 3969896 - RNA, 18 nt, Staphylococcus aureus subsp. aureus Mu50
caaugacauccauacaaa

SEQ ID NO: 3969897 - RNA, 15 nt, Staphylococcus aureus subsp. aureus Mu50
caaugacugagaaaa

SEQ ID NO: 3969898 - RNA, 22 nt, Staphylococcus aureus subsp. aureus Mu50
caaugagcaucuugucuaguuc

SEQ ID NO: 3969899 - RNA, 17 nt, Staphylococcus aureus subsp. aureus Mu50
caaugaggauuguguaa

SEQ ID NO: 3969900 - RNA, 17 nt, Staphylococcus aureus subsp. aureus Mu50
caaugauaccuuuaaau

SEQ ID NO: 3969901 - RNA, 15 nt, Staphylococcus aureus subsp. aureus Mu50
caaugauagugaaua

SEQ ID NO: 3969902 - RNA, 18 nt, Staphylococcus aureus subsp. aureus Mu50
caaugauuaaaucuucua

SEQ ID NO: 3969903 - RNA, 21 nt, Staphylococcus aureus subsp. aureus Mu50
caaugauuacuuuaagauuau

SEQ ID NO: 3969904 - RNA, 19 nt, Staphylococcus aureus subsp. aureus Mu50
caaugauugaauauuguug

SEQ ID NO: 3969905 - RNA, 14 nt, Staphylococcus aureus subsp. aureus Mu50
caaugauuuuauaa

SEQ ID NO: 3969906 - RNA, 14 nt, Staphylococcus aureus subsp. aureus Mu50
caaugauuuuuaaa

SEQ ID NO: 3969907 - RNA, 18 nt, Staphylococcus aureus subsp. aureus Mu50
caaugauuuuuaaaaaua

SEQ ID NO: 3969908 - RNA, 15 nt, Staphylococcus aureus subsp. aureus Mu50
caaugcaaguuggcg

SEQ ID NO: 3969909 - RNA, 15 nt, Staphylococcus aureus subsp. aureus Mu50
caaugcaauugguag

SEQ ID NO: 3969910 - RNA, 16 nt, Staphylococcus aureus subsp. aureus Mu50
caaugcauccaaauau

SEQ ID NO: 3969911 - RNA, 13 nt, Staphylococcus aureus subsp. aureus Mu50
caaugcauuuaau

SEQ ID NO: 3969912 - RNA, 23 nt, Staphylococcus aureus subsp. aureus Mu50
caaugcauuuaauuuaauuuuag

SEQ ID NO: 3969913 - RNA, 16 nt, Staphylococcus aureus subsp. aureus Mu50
caaugcgcaaugaaaa

SEQ ID NO: 3969914 - RNA, 14 nt, Staphylococcus aureus subsp. aureus Mu50
caaugcuaucaugc

SEQ ID NO: 3969915 - RNA, 17 nt, Staphylococcus aureus subsp. aureus Mu50
caaugcugauaccuaag

SEQ ID NO: 3969916 - RNA, 15 nt, Staphylococcus aureus subsp. aureus Mu50
caauggaucuguuac

SEQ ID NO: 3969917 - RNA, 16 nt, Staphylococcus aureus subsp. aureus Mu50
caauggaucuguuaca

SEQ ID NO: 3969918 - RNA, 14 nt, Staphylococcus aureus subsp. aureus Mu50
caauggccauuuga

SEQ ID NO: 3969919 - RNA, 21 nt, Staphylococcus aureus subsp. aureus Mu50
caauguaacuuggcuuaaucu

SEQ ID NO: 3969920 - RNA, 22 nt, Staphylococcus aureus subsp. aureus Mu50
caauguaacuuggcuuaaucuc

SEQ ID NO: 3969921 - RNA, 22 nt, Staphylococcus aureus subsp. aureus Mu50
caauguaauuuucacuuucaau

SEQ ID NO: 3969922 - RNA, 22 nt, Staphylococcus aureus subsp. aureus Mu50
caauguacuaggaccuacaauu

SEQ ID NO: 3969923 - RNA, 13 nt, Staphylococcus aureus subsp. aureus Mu50
caauguauauuua

SEQ ID NO: 3969924 - RNA, 16 nt, Staphylococcus aureus subsp. aureus Mu50
caauguuaucuugcuu

SEQ ID NO: 3969925 - RNA, 16 nt, Staphylococcus aureus subsp. aureus Mu50
caauguuuaauuuucu

SEQ ID NO: 3969926 - RNA, 14 nt, Staphylococcus aureus subsp. aureus Mu50
cacacccauacucu

SEQ ID NO: 3969927 - RNA, 21 nt, Staphylococcus aureus subsp. aureus Mu50
cacaccuaauucauauauacu

SEQ ID NO: 3969928 - RNA, 12 nt, Staphylococcus aureus subsp. aureus Mu50
cacacuaaaugu

SEQ ID NO: 3969929 - RNA, 12 nt, Staphylococcus aureus subsp. aureus Mu50
cacacuauuaua

SEQ ID NO: 3969930 - RNA, 18 nt, Staphylococcus aureus subsp. aureus Mu50
cacacuauuguaagcuga

SEQ ID NO: 3969931 - RNA, 14 nt, Staphylococcus aureus subsp. aureus Mu50
cacacuuuaaacaa

SEQ ID NO: 3969932 - RNA, 18 nt, Staphylococcus aureus subsp. aureus Mu50
cacagacguuuuugaauc

SEQ ID NO: 3969933 - RNA, 21 nt, Staphylococcus aureus subsp. aureus Mu50
cacagagaaauucgaaaagaa

SEQ ID NO: 3969934 - RNA, 21 nt, Staphylococcus aureus subsp. aureus Mu50
cacagagaauuucgaaaagaa

SEQ ID NO: 3969935 - RNA, 21 nt, Staphylococcus aureus subsp. aureus Mu50
cacagcggaauacagaugaug

SEQ ID NO: 3969936 - RNA, 21 nt, Staphylococcus aureus subsp. aureus Mu50
cacaguggauuacagaugaug

SEQ ID NO: 3969937 - RNA, 14 nt, Staphylococcus aureus subsp. aureus Mu50
cacaguguugaauu

SEQ ID NO: 3969938 - RNA, 16 nt, Staphylococcus aureus subsp. aureus Mu50
cacauaaaaauaaucc

SEQ ID NO: 3969939 - RNA, 11 nt, Staphylococcus aureus subsp. aureus Mu50
cacauaaauca

SEQ ID NO: 3969940 - RNA, 12 nt, Staphylococcus aureus subsp. aureus Mu50
cacauaaaucaa

SEQ ID NO: 3969941 - RNA, 13 nt, Staphylococcus aureus subsp. aureus Mu50
cacauaaaucaau

SEQ ID NO: 3969942 - RNA, 15 nt, Staphylococcus aureus subsp. aureus Mu50
cacauagaguaauuu

SEQ ID NO: 3969943 - RNA, 14 nt, Staphylococcus aureus subsp. aureus Mu50
cacauauguccaua

SEQ ID NO: 3969944 - RNA, 20 nt, Staphylococcus aureus subsp. aureus Mu50
cacauaugucuuucuaaguu

SEQ ID NO: 3969945 - RNA, 16 nt, Staphylococcus aureus subsp. aureus Mu50
cacauccccuuugaua

SEQ ID NO: 3969946 - RNA, 20 nt, Staphylococcus aureus subsp. aureus Mu50
cacauccccuuugauaaguu

SEQ ID NO: 3969947 - RNA, 21 nt, Staphylococcus aureus subsp. aureus Mu50
cacaucgaucuaaauauauua

SEQ ID NO: 3969948 - RNA, 13 nt, Staphylococcus aureus subsp. aureus Mu50
cacaucuaugugg

SEQ ID NO: 3969949 - RNA, 16 nt, Staphylococcus aureus subsp. aureus Mu50
cacaucuuuuugauaa

SEQ ID NO: 3969950 - RNA, 17 nt, Staphylococcus aureus subsp. aureus Mu50
cacaucuuuuugauaau

SEQ ID NO: 3969951 - RNA, 21 nt, Staphylococcus aureus subsp. aureus Mu50
cacaugcacuuuauuaaaaau

SEQ ID NO: 3969952 - RNA, 12 nt, Staphylococcus aureus subsp. aureus Mu50
cacaugugaaau

SEQ ID NO: 3969953 - RNA, 15 nt, Staphylococcus aureus subsp. aureus Mu50
cacauuauugaaauu

SEQ ID NO: 3969954 - RNA, 17 nt, Staphylococcus aureus subsp. aureus Mu50
cacauucaaauaaauga

SEQ ID NO: 3969955 - RNA, 22 nt, Staphylococcus aureus subsp. aureus Mu50
cacauucaaauaaaugacauuu

SEQ ID NO: 3969956 - RNA, 18 nt, Staphylococcus aureus subsp. aureus Mu50
cacauuguuuacaaaguu

SEQ ID NO: 3969957 - RNA, 14 nt, Staphylococcus aureus subsp. aureus Mu50
cacauuuacuuaag

SEQ ID NO: 3969958 - RNA, 23 nt, Staphylococcus aureus subsp. aureus Mu50
cacauuuuuaguuagaaaguauu

SEQ ID NO: 3969959 - RNA, 15 nt, Staphylococcus aureus subsp. aureus Mu50
caccaaaaaucaucc

SEQ ID NO: 3969960 - RNA, 22 nt, Staphylococcus aureus subsp. aureus Mu50
caccaaauccaucuaauucaau

SEQ ID NO: 3969961 - RNA, 19 nt, Staphylococcus aureus subsp. aureus Mu50
caccaaguucacuaaauuc

SEQ ID NO: 3969962 - RNA, 23 nt, Staphylococcus aureus subsp. aureus Mu50
caccaaguucacuaaauucaaua

SEQ ID NO: 3969963 - RNA, 18 nt, Staphylococcus aureus subsp. aureus Mu50
caccaaugauagugaaua

SEQ ID NO: 3969964 - RNA, 13 nt, Staphylococcus aureus subsp. aureus Mu50
caccaauugaaua

SEQ ID NO: 3969965 - RNA, 14 nt, Staphylococcus aureus subsp. aureus Mu50
caccacauaaaaau

SEQ ID NO: 3969966 - RNA, 16 nt, Staphylococcus aureus subsp. aureus Mu50
caccaccugcaauuug

SEQ ID NO: 3969967 - RNA, 12 nt, Staphylococcus aureus subsp. aureus Mu50
caccagccucug

SEQ ID NO: 3969968 - RNA, 13 nt, Staphylococcus aureus subsp. aureus Mu50
caccagccucugu

SEQ ID NO: 3969969 - RNA, 23 nt, Staphylococcus aureus subsp. aureus Mu50
caccagccucuguguuggggccc

SEQ ID NO: 3969970 - RNA, 22 nt, Staphylococcus aureus subsp. aureus Mu50
caccaguagucacuguuugcca

SEQ ID NO: 3969971 - RNA, 21 nt, Staphylococcus aureus subsp. aureus Mu50
caccaguauaaccauguauau

SEQ ID NO: 3969972 - RNA, 12 nt, Staphylococcus aureus subsp. aureus Mu50
caccaguuucaa

SEQ ID NO: 3969973 - RNA, 16 nt, Staphylococcus aureus subsp. aureus Mu50
caccauacuaaaacau

SEQ ID NO: 3969974 - RNA, 17 nt, Staphylococcus aureus subsp. aureus Mu50
caccauacuaaaacaug

SEQ ID NO: 3969975 - RNA, 12 nt, Staphylococcus aureus subsp. aureus Mu50
caccauaugugg

SEQ ID NO: 3969976 - RNA, 21 nt, Staphylococcus aureus subsp. aureus Mu50
caccaucaacgccauauuuau

SEQ ID NO: 3969977 - RNA, 22 nt, Staphylococcus aureus subsp. aureus Mu50
caccaucuguaacuaauaugau

SEQ ID NO: 3969978 - RNA, 21 nt, Staphylococcus aureus subsp. aureus Mu50
caccauguacauugguuuuua

SEQ ID NO: 3969979 - RNA, 18 nt, Staphylococcus aureus subsp. aureus Mu50
caccauuuacuucauaag

SEQ ID NO: 3969980 - RNA, 22 nt, Staphylococcus aureus subsp. aureus Mu50
caccccaacucgcauugccugu

SEQ ID NO: 3969981 - RNA, 20 nt, Staphylococcus aureus subsp. aureus Mu50
caccguggaauuuaccauuu

SEQ ID NO: 3969982 - RNA, 13 nt, Staphylococcus aureus subsp. aureus Mu50
caccuacaaauau

SEQ ID NO: 3969983 - RNA, 17 nt, Staphylococcus aureus subsp. aureus Mu50
caccuauacauaacccu

SEQ ID NO: 3969984 - RNA, 13 nt, Staphylococcus aureus subsp. aureus Mu50
caccuauuuuuug

SEQ ID NO: 3969985 - RNA, 20 nt, Staphylococcus aureus subsp. aureus Mu50
caccuauuuuuugagcacuu

SEQ ID NO: 3969986 - RNA, 15 nt, Staphylococcus aureus subsp. aureus Mu50
caccugcagcauccu

SEQ ID NO: 3969987 - RNA, 21 nt, Staphylococcus aureus subsp. aureus Mu50
caccuggucguacuuucaaau

SEQ ID NO: 3969988 - RNA, 21 nt, Staphylococcus aureus subsp. aureus Mu50
caccuguuacuugagaaccau

SEQ ID NO: 3969989 - RNA, 23 nt, Staphylococcus aureus subsp. aureus Mu50
caccuuaucacuuggaauaauac

SEQ ID NO: 3969990 - RNA, 14 nt, Staphylococcus aureus subsp. aureus Mu50
caccuuguuaaaau

SEQ ID NO: 3969991 - RNA, 17 nt, Staphylococcus aureus subsp. aureus Mu50
caccuuguuuaaguuuu

SEQ ID NO: 3969992 - RNA, 15 nt, Staphylococcus aureus subsp. aureus Mu50
caccuuuacaacaua

SEQ ID NO: 3969993 - RNA, 16 nt, Staphylococcus aureus subsp. aureus Mu50
caccuuuaucuguaac

SEQ ID NO: 3969994 - RNA, 19 nt, Staphylococcus aureus subsp. aureus Mu50
caccuuuggcuacugcacc

SEQ ID NO: 3969995 - RNA, 22 nt, Staphylococcus aureus subsp. aureus Mu50
cacgaaauggugaacuaaauug

SEQ ID NO: 3969996 - RNA, 14 nt, Staphylococcus aureus subsp. aureus Mu50
cacgacauguaggu

SEQ ID NO: 3969997 - RNA, 17 nt, Staphylococcus aureus subsp. aureus Mu50
cacgacgcuaaacaaag

SEQ ID NO: 3969998 - RNA, 19 nt, Staphylococcus aureus subsp. aureus Mu50
cacgacgcuaaacaaaggg

SEQ ID NO: 3969999 - RNA, 20 nt, Staphylococcus aureus subsp. aureus Mu50
cacgauaaaaauaaaaaacg

SEQ ID NO: 3970000 - RNA, 23 nt, Staphylococcus aureus subsp. aureus Mu50
cacgauauaacauuaaaaugaua

SEQ ID NO: 3970001 - RNA, 17 nt, Staphylococcus aureus subsp. aureus Mu50
cacgauaucuagcugcu

SEQ ID NO: 3970002 - RNA, 21 nt, Staphylococcus aureus subsp. aureus Mu50
cacgauaucuagcugcuucug

SEQ ID NO: 3970003 - RNA, 13 nt, Staphylococcus aureus subsp. aureus Mu50
cacgaucuuuaaa

SEQ ID NO: 3970004 - RNA, 22 nt, Staphylococcus aureus subsp. aureus Mu50
cacgauuucuuuaugauaauaa

SEQ ID NO: 3970005 - RNA, 14 nt, Staphylococcus aureus subsp. aureus Mu50
cacgauuuuuaaaa

SEQ ID NO: 3970006 - RNA, 14 nt, Staphylococcus aureus subsp. aureus Mu50
cacgcaauaucaua

SEQ ID NO: 3970007 - RNA, 19 nt, Staphylococcus aureus subsp. aureus Mu50
cacgcauaccacuugaaua

SEQ ID NO: 3970008 - RNA, 14 nt, Staphylococcus aureus subsp. aureus Mu50
cacgcauuacuuua

SEQ ID NO: 3970009 - RNA, 21 nt, Staphylococcus aureus subsp. aureus Mu50
cacgcccgacaucauaaauga

SEQ ID NO: 3970010 - RNA, 23 nt, Staphylococcus aureus subsp. aureus Mu50
cacgcuaacauucagugcaauga

SEQ ID NO: 3970011 - RNA, 16 nt, Staphylococcus aureus subsp. aureus Mu50
cacgcugaaauuuuuu

SEQ ID NO: 3970012 - RNA, 17 nt, Staphylococcus aureus subsp. aureus Mu50
cacguauauacgauuga

SEQ ID NO: 3970013 - RNA, 23 nt, Staphylococcus aureus subsp. aureus Mu50
cacgugcuucguuuuuaguguua

SEQ ID NO: 3970014 - RNA, 19 nt, Staphylococcus aureus subsp. aureus Mu50
cagaacuaugaauagauga

SEQ ID NO: 3970015 - RNA, 21 nt, Staphylococcus aureus subsp. aureus Mu50
cagaagaaaacuauuuuaaaa

SEQ ID NO: 3970016 - RNA, 20 nt, Staphylococcus aureus subsp. aureus Mu50
cagaaucuuacauugauaaa

SEQ ID NO: 3970017 - RNA, 20 nt, Staphylococcus aureus subsp. aureus Mu50
cagaaugaacuucucuuagu

SEQ ID NO: 3970018 - RNA, 15 nt, Staphylococcus aureus subsp. aureus Mu50
cagaauuucaucaaa

SEQ ID NO: 3970019 - RNA, 17 nt, Staphylococcus aureus subsp. aureus Mu50
cagacuucuuucaauua

SEQ ID NO: 3970020 - RNA, 16 nt, Staphylococcus aureus subsp. aureus Mu50
cagagaaauucgaaaa

SEQ ID NO: 3970021 - RNA, 15 nt, Staphylococcus aureus subsp. aureus Mu50
cagagaauuucgaaa

SEQ ID NO: 3970022 - RNA, 16 nt, Staphylococcus aureus subsp. aureus Mu50
cagagaauuucgaaaa

SEQ ID NO: 3970023 - RNA, 17 nt, Staphylococcus aureus subsp. aureus Mu50
cagagccauaaugagag

SEQ ID NO: 3970024 - RNA, 19 nt, Staphylococcus aureus subsp. aureus Mu50
cagaggagcucauguuuca

SEQ ID NO: 3970025 - RNA, 16 nt, Staphylococcus aureus subsp. aureus Mu50
cagauaagaauauuua

SEQ ID NO: 3970026 - RNA, 18 nt, Staphylococcus aureus subsp. aureus Mu50
cagauaagaauauuuaag

SEQ ID NO: 3970027 - RNA, 14 nt, Staphylococcus aureus subsp. aureus Mu50
cagauaauuauuuc

SEQ ID NO: 3970028 - RNA, 16 nt, Staphylococcus aureus subsp. aureus Mu50
cagauaauuauuucua

SEQ ID NO: 3970029 - RNA, 14 nt, Staphylococcus aureus subsp. aureus Mu50
cagauaauugaaaa

SEQ ID NO: 3970030 - RNA, 15 nt, Staphylococcus aureus subsp. aureus Mu50
cagauccauaaggau

SEQ ID NO: 3970031 - RNA, 21 nt, Staphylococcus aureus subsp. aureus Mu50
cagaucucaauccaauuaaau

SEQ ID NO: 3970032 - RNA, 14 nt, Staphylococcus aureus subsp. aureus Mu50
cagaugaauaaugu

SEQ ID NO: 3970033 - RNA, 19 nt, Staphylococcus aureus subsp. aureus Mu50
cagauguucaguuguuuuu

SEQ ID NO: 3970034 - RNA, 17 nt, Staphylococcus aureus subsp. aureus Mu50
cagauguugguucauca

SEQ ID NO: 3970035 - RNA, 18 nt, Staphylococcus aureus subsp. aureus Mu50
cagauguugguucaucaa

SEQ ID NO: 3970036 - RNA, 23 nt, Staphylococcus aureus subsp. aureus Mu50
cagauguugguucaucaaacaac

SEQ ID NO: 3970037 - RNA, 20 nt, Staphylococcus aureus subsp. aureus Mu50
cagauucauaucuuucaauu

SEQ ID NO: 3970038 - RNA, 14 nt, Staphylococcus aureus subsp. aureus Mu50
cagauugauauaaa

SEQ ID NO: 3970039 - RNA, 15 nt, Staphylococcus aureus subsp. aureus Mu50
cagauuuguauuuug

SEQ ID NO: 3970040 - RNA, 21 nt, Staphylococcus aureus subsp. aureus Mu50
cagauuuuaagugguuaucac

SEQ ID NO: 3970041 - RNA, 23 nt, Staphylococcus aureus subsp. aureus Mu50
cagcaaaaagcccuauuguuuuu

SEQ ID NO: 3970042 - RNA, 12 nt, Staphylococcus aureus subsp. aureus Mu50
cagcaaauaaaa

SEQ ID NO: 3970043 - RNA, 23 nt, Staphylococcus aureus subsp. aureus Mu50
cagcaaauaaaaucauaacgaca

SEQ ID NO: 3970044 - RNA, 20 nt, Staphylococcus aureus subsp. aureus Mu50
cagcaaaugcuuaagaaauu

SEQ ID NO: 3970045 - RNA, 16 nt, Staphylococcus aureus subsp. aureus Mu50
cagcaaugacacuaau

SEQ ID NO: 3970046 - RNA, 17 nt, Staphylococcus aureus subsp. aureus Mu50
cagcacagcgauuaaau

SEQ ID NO: 3970047 - RNA, 14 nt, Staphylococcus aureus subsp. aureus Mu50
cagcaguaagauau

SEQ ID NO: 3970048 - RNA, 18 nt, Staphylococcus aureus subsp. aureus Mu50
cagcaguaagauuauuuu

SEQ ID NO: 3970049 - RNA, 16 nt, Staphylococcus aureus subsp. aureus Mu50
cagcaguugcacaaau

SEQ ID NO: 3970050 - RNA, 19 nt, Staphylococcus aureus subsp. aureus Mu50
cagcauuaaucguauuuuu

SEQ ID NO: 3970051 - RNA, 19 nt, Staphylococcus aureus subsp. aureus Mu50
cagcauugggacauaaaau

SEQ ID NO: 3970052 - RNA, 18 nt, Staphylococcus aureus subsp. aureus Mu50
cagcauuugcuguuaaua

SEQ ID NO: 3970053 - RNA, 20 nt, Staphylococcus aureus subsp. aureus Mu50
cagccgaggcaauauugaac

SEQ ID NO: 3970054 - RNA, 14 nt, Staphylococcus aureus subsp. aureus Mu50
cagccucuauaagu

SEQ ID NO: 3970055 - RNA, 15 nt, Staphylococcus aureus subsp. aureus Mu50
cagcgaaauuuguaa

SEQ ID NO: 3970056 - RNA, 14 nt, Staphylococcus aureus subsp. aureus Mu50
cagcgacauuuuua

SEQ ID NO: 3970057 - RNA, 17 nt, Staphylococcus aureus subsp. aureus Mu50
cagcggaauacagauga

SEQ ID NO: 3970058 - RNA, 19 nt, Staphylococcus aureus subsp. aureus Mu50
cagcggaauacagaugaug

SEQ ID NO: 3970059 - RNA, 16 nt, Staphylococcus aureus subsp. aureus Mu50
cagcguauuuuaauga

SEQ ID NO: 3970060 - RNA, 15 nt, Staphylococcus aureus subsp. aureus Mu50
cagcgucauauguug

SEQ ID NO: 3970061 - RNA, 21 nt, Staphylococcus aureus subsp. aureus Mu50
cagcuaaaaaguauacuaaac

SEQ ID NO: 3970062 - RNA, 19 nt, Staphylococcus aureus subsp. aureus Mu50
cagcuaaaaguuucccaag

SEQ ID NO: 3970063 - RNA, 20 nt, Staphylococcus aureus subsp. aureus Mu50
cagcuaaacgcaauacgaau

SEQ ID NO: 3970064 - RNA, 13 nt, Staphylococcus aureus subsp. aureus Mu50
cagcuaaauauuu

SEQ ID NO: 3970065 - RNA, 12 nt, Staphylococcus aureus subsp. aureus Mu50
cagcuaacaaaa

SEQ ID NO: 3970066 - RNA, 16 nt, Staphylococcus aureus subsp. aureus Mu50
cagcuacaaauaauga

SEQ ID NO: 3970067 - RNA, 17 nt, Staphylococcus aureus subsp. aureus Mu50
cagcuacaaauaaugag

SEQ ID NO: 3970068 - RNA, 15 nt, Staphylococcus aureus subsp. aureus Mu50
cagcucuuaaaucac

SEQ ID NO: 3970069 - RNA, 19 nt, Staphylococcus aureus subsp. aureus Mu50
cagcuggcaaauacaacuc

SEQ ID NO: 3970070 - RNA, 14 nt, Staphylococcus aureus subsp. aureus Mu50
cagcuguauuuaau

SEQ ID NO: 3970071 - RNA, 14 nt, Staphylococcus aureus subsp. aureus Mu50
cagcuuagcauagc

SEQ ID NO: 3970072 - RNA, 17 nt, Staphylococcus aureus subsp. aureus Mu50
cagcuucaaaaucaaau

SEQ ID NO: 3970073 - RNA, 12 nt, Staphylococcus aureus subsp. aureus Mu50
cagcuucauuaa

SEQ ID NO: 3970074 - RNA, 19 nt, Staphylococcus aureus subsp. aureus Mu50
cagcuucuaaguaauauaa

SEQ ID NO: 3970075 - RNA, 17 nt, Staphylococcus aureus subsp. aureus Mu50
cagcuucuuuaacaauu

SEQ ID NO: 3970076 - RNA, 17 nt, Staphylococcus aureus subsp. aureus Mu50
cagcuuuaauaauauga

SEQ ID NO: 3970077 - RNA, 10 nt, Staphylococcus aureus subsp. aureus Mu50
caggaaggaa

SEQ ID NO: 3970078 - RNA, 21 nt, Staphylococcus aureus subsp. aureus Mu50
caggaauaaauuuugcgaaaa

SEQ ID NO: 3970079 - RNA, 13 nt, Staphylococcus aureus subsp. aureus Mu50
caggaauagaugu

SEQ ID NO: 3970080 - RNA, 19 nt, Staphylococcus aureus subsp. aureus Mu50
caggaauaucuuucaaauu

SEQ ID NO: 3970081 - RNA, 14 nt, Staphylococcus aureus subsp. aureus Mu50
caggaauuguuaaa

SEQ ID NO: 3970082 - RNA, 22 nt, Staphylococcus aureus subsp. aureus Mu50
caggaucacguuuuucuuuaaa

SEQ ID NO: 3970083 - RNA, 14 nt, Staphylococcus aureus subsp. aureus Mu50
caggcaacuuuuau

SEQ ID NO: 3970084 - RNA, 14 nt, Staphylococcus aureus subsp. aureus Mu50
caggcaaugcaagu

SEQ ID NO: 3970085 - RNA, 23 nt, Staphylococcus aureus subsp. aureus Mu50
caggcgaaccgaagcgcagugac

SEQ ID NO: 3970086 - RNA, 18 nt, Staphylococcus aureus subsp. aureus Mu50
caggcguaucuguuuaug

SEQ ID NO: 3970087 - RNA, 14 nt, Staphylococcus aureus subsp. aureus Mu50
cagggaaaucaucu

SEQ ID NO: 3970088 - RNA, 14 nt, Staphylococcus aureus subsp. aureus Mu50
cagguaaugcaagu

SEQ ID NO: 3970089 - RNA, 18 nt, Staphylococcus aureus subsp. aureus Mu50
cagguaaugcaaguuggg

SEQ ID NO: 3970090 - RNA, 21 nt, Staphylococcus aureus subsp. aureus Mu50
caggucgcccuugccugugcu

SEQ ID NO: 3970091 - RNA, 23 nt, Staphylococcus aureus subsp. aureus Mu50
cagguuuuuuauuuucauauaaa

SEQ ID NO: 3970092 - RNA, 18 nt, Staphylococcus aureus subsp. aureus Mu50
caguaaauugauucuuug

SEQ ID NO: 3970093 - RNA, 20 nt, Staphylococcus aureus subsp. aureus Mu50
caguaagacgauuucaauga

SEQ ID NO: 3970094 - RNA, 13 nt, Staphylococcus aureus subsp. aureus Mu50
caguaaguaauaa

SEQ ID NO: 3970095 - RNA, 23 nt, Staphylococcus aureus subsp. aureus Mu50
caguaaguugauuucuacucgaa

SEQ ID NO: 3970096 - RNA, 22 nt, Staphylococcus aureus subsp. aureus Mu50
caguaauaauacgcuugauaaa

SEQ ID NO: 3970097 - RNA, 13 nt, Staphylococcus aureus subsp. aureus Mu50
caguaauauguug

SEQ ID NO: 3970098 - RNA, 12 nt, Staphylococcus aureus subsp. aureus Mu50
caguaaucaaag

SEQ ID NO: 3970099 - RNA, 21 nt, Staphylococcus aureus subsp. aureus Mu50
caguaaucaaagauuuuguug

SEQ ID NO: 3970100 - RNA, 19 nt, Staphylococcus aureus subsp. aureus Mu50
caguaaucaaaguaucagu

SEQ ID NO: 3970101 - RNA, 22 nt, Staphylococcus aureus subsp. aureus Mu50
caguaaucaugcauucuaugau

SEQ ID NO: 3970102 - RNA, 16 nt, Staphylococcus aureus subsp. aureus Mu50
cauaagaaaauacuaa

SEQ ID NO: 3970103 - RNA, 21 nt, Staphylococcus aureus subsp. aureus Mu50
cauaagaaaauacuaacaauu

SEQ ID NO: 3970104 - RNA, 16 nt, Staphylococcus aureus subsp. aureus Mu50
cauaagaaauacuaau

SEQ ID NO: 3970105 - RNA, 16 nt, Staphylococcus aureus subsp. aureus Mu50
cauaagccauaugcuu

SEQ ID NO: 3970106 - RNA, 17 nt, Staphylococcus aureus subsp. aureus Mu50
cauaaggucuuggacua

SEQ ID NO: 3970107 - RNA, 13 nt, Staphylococcus aureus subsp. aureus Mu50
cauaauaaaaagg

SEQ ID NO: 3970108 - RNA, 22 nt, Staphylococcus aureus subsp. aureus Mu50
cauaauaaaucuaucuacucaa

SEQ ID NO: 3970109 - RNA, 18 nt, Staphylococcus aureus subsp. aureus Mu50
cauaauagacuuauauua

SEQ ID NO: 3970110 - RNA, 21 nt, Staphylococcus aureus subsp. aureus Mu50
cauaauaucuuacuacuuaau

SEQ ID NO: 3970111 - RNA, 16 nt, Staphylococcus aureus subsp. aureus Mu50
cauaauauugaugaau

SEQ ID NO: 3970112 - RNA, 20 nt, Staphylococcus aureus subsp. aureus Mu50
cauaauauugaugaauaaau

SEQ ID NO: 3970113 - RNA, 19 nt, Staphylococcus aureus subsp. aureus Mu50
cauaauauuucuuaccauu

SEQ ID NO: 3970114 - RNA, 22 nt, Staphylococcus aureus subsp. aureus Mu50
cauaauauuucuuaccauuuau

SEQ ID NO: 3970115 - RNA, 16 nt, Staphylococcus aureus subsp. aureus Mu50
cauaaucaagucugca

SEQ ID NO: 3970116 - RNA, 11 nt, Staphylococcus aureus subsp. aureus Mu50
cauaaucaauu

SEQ ID NO: 3970117 - RNA, 21 nt, Staphylococcus aureus subsp. aureus Mu50
cauaaucauaaaaaucauaaa

SEQ ID NO: 3970118 - RNA, 17 nt, Staphylococcus aureus subsp. aureus Mu50
cauaauccauucuucuu

SEQ ID NO: 3970119 - RNA, 20 nt, Staphylococcus aureus subsp. aureus Mu50
cauaaucucuuuacaccauu

SEQ ID NO: 3970120 - RNA, 23 nt, Staphylococcus aureus subsp. aureus Mu50
cauaaucugcugcuguugaagaa

SEQ ID NO: 3970121 - RNA, 12 nt, Staphylococcus aureus subsp. aureus Mu50
cauaaucuuuau

SEQ ID NO: 3970122 - RNA, 23 nt, Staphylococcus aureus subsp. aureus Mu50
cauaaucuuuauuaauaaauucu

SEQ ID NO: 3970123 - RNA, 20 nt, Staphylococcus aureus subsp. aureus Mu50
cauaaucuuuuccuaaaccu

SEQ ID NO: 3970124 - RNA, 24 nt, Staphylococcus aureus subsp. aureus Mu50
cauaaugaacaagggccauccauu

SEQ ID NO: 3970125 - RNA, 17 nt, Staphylococcus aureus subsp. aureus Mu50
cauaaugaauucauuca

SEQ ID NO: 3970126 - RNA, 20 nt, Staphylococcus aureus subsp. aureus Mu50
cauaaugacuauaacaccaa

SEQ ID NO: 3970127 - RNA, 11 nt, Staphylococcus aureus subsp. aureus Mu50
cauaaugguuc

SEQ ID NO: 3970128 - RNA, 20 nt, Staphylococcus aureus subsp. aureus Mu50
cauaauguaagcgaauacaa

SEQ ID NO: 3970129 - RNA, 21 nt, Staphylococcus aureus subsp. aureus Mu50
cauaauuaacuuucuuuuguu

SEQ ID NO: 3970130 - RNA, 13 nt, Staphylococcus aureus subsp. aureus Mu50
cauaauuaauaac

SEQ ID NO: 3970131 - RNA, 14 nt, Staphylococcus aureus subsp. aureus Mu50
cauaauuaauaaca

SEQ ID NO: 3970132 - RNA, 19 nt, Staphylococcus aureus subsp. aureus Mu50
cauaauuaccuuuccauuc

SEQ ID NO: 3970133 - RNA, 17 nt, Staphylococcus aureus subsp. aureus Mu50
cauaauuaucauauaaa

SEQ ID NO: 3970134 - RNA, 11 nt, Staphylococcus aureus subsp. aureus Mu50
cauaauuuaaa

SEQ ID NO: 3970135 - RNA, 17 nt, Staphylococcus aureus subsp. aureus Mu50
cauaauuuaaaagauua

SEQ ID NO: 3970136 - RNA, 21 nt, Staphylococcus aureus subsp. aureus Mu50
cauaauuuaaaugauauugaa

SEQ ID NO: 3970137 - RNA, 22 nt, Staphylococcus aureus subsp. aureus Mu50
cauaauuugauguucuugaaaa

SEQ ID NO: 3970138 - RNA, 15 nt, Staphylococcus aureus subsp. aureus Mu50
cauaauuuuguuuug

SEQ ID NO: 3970139 - RNA, 13 nt, Staphylococcus aureus subsp. aureus Mu50
cauacaaauuuuu

SEQ ID NO: 3970140 - RNA, 18 nt, Staphylococcus aureus subsp. aureus Mu50
cauacaccuucagaugcu

SEQ ID NO: 3970141 - RNA, 14 nt, Staphylococcus aureus subsp. aureus Mu50
cauacacuaucauu

SEQ ID NO: 3970142 - RNA, 23 nt, Staphylococcus aureus subsp. aureus Mu50
cauacacuaucauuaucaaauaa

SEQ ID NO: 3970143 - RNA, 18 nt, Staphylococcus aureus subsp. aureus Mu50
cauacacuugauuaucau

SEQ ID NO: 3970144 - RNA, 16 nt, Staphylococcus aureus subsp. aureus Mu50
cauacagccauugaca

SEQ ID NO: 3970145 - RNA, 16 nt, Staphylococcus aureus subsp. aureus Mu50
cauacaggaaauugaa

SEQ ID NO: 3970146 - RNA, 15 nt, Staphylococcus aureus subsp. aureus Mu50
cauacauaucuuuug

SEQ ID NO: 3970147 - RNA, 20 nt, Staphylococcus aureus subsp. aureus Mu50
cauaccaaaaacauuaacca

SEQ ID NO: 3970148 - RNA, 23 nt, Staphylococcus aureus subsp. aureus Mu50
cauaccacuugaauacuuuuuaa

SEQ ID NO: 3970149 - RNA, 15 nt, Staphylococcus aureus subsp. aureus Mu50
cauacccauauuaaa

SEQ ID NO: 3970150 - RNA, 18 nt, Staphylococcus aureus subsp. aureus Mu50
cauacccauauuaaauuu

SEQ ID NO: 3970151 - RNA, 19 nt, Staphylococcus aureus subsp. aureus Mu50
cauacccauauuaaauuuu

SEQ ID NO: 3970152 - RNA, 16 nt, Staphylococcus aureus subsp. aureus Mu50
cauaccggcaaauaac

SEQ ID NO: 3970153 - RNA, 17 nt, Staphylococcus aureus subsp. aureus Mu50
cauaccguacaaaggua

SEQ ID NO: 3970154 - RNA, 17 nt, Staphylococcus aureus subsp. aureus Mu50
cauaccuacaaauaugu

SEQ ID NO: 3970155 - RNA, 19 nt, Staphylococcus aureus subsp. aureus Mu50
cauaccuugauuauaugcu

SEQ ID NO: 3970156 - RNA, 16 nt, Staphylococcus aureus subsp. aureus Mu50
cauacgaauuaaaaua

SEQ ID NO: 3970157 - RNA, 17 nt, Staphylococcus aureus subsp. aureus Mu50
cauacgaauuaaaauaa

SEQ ID NO: 3970158 - RNA, 14 nt, Staphylococcus aureus subsp. aureus Mu50
cauacgcaaugauu

SEQ ID NO: 3970159 - RNA, 22 nt, Staphylococcus aureus subsp. aureus Mu50
cauacgcaaugauuauaaauac

SEQ ID NO: 3970160 - RNA, 13 nt, Staphylococcus aureus subsp. aureus Mu50
cauacguaucaaa

SEQ ID NO: 3970161 - RNA, 18 nt, Staphylococcus aureus subsp. aureus Mu50
cauacguuccuaaagucg

SEQ ID NO: 3970162 - RNA, 13 nt, Staphylococcus aureus subsp. aureus Mu50
cauacuaaauaag

SEQ ID NO: 3970163 - RNA, 15 nt, Staphylococcus aureus subsp. aureus Mu50
cauacuauaaaaauu

SEQ ID NO: 3970164 - RNA, 18 nt, Staphylococcus aureus subsp. aureus Mu50
cauacuauaaaaauuuau

SEQ ID NO: 3970165 - RNA, 19 nt, Staphylococcus aureus subsp. aureus Mu50
cauacuauaagcaauuucu

SEQ ID NO: 3970166 - RNA, 20 nt, Staphylococcus aureus subsp. aureus Mu50
cauacuaucuacaauaacca

SEQ ID NO: 3970167 - RNA, 15 nt, Staphylococcus aureus subsp. aureus Mu50
cauacucacaaaaaa

SEQ ID NO: 3970168 - RNA, 13 nt, Staphylococcus aureus subsp. aureus Mu50
cauacuucaauaa

SEQ ID NO: 3970169 - RNA, 18 nt, Staphylococcus aureus subsp. aureus Mu50
cauacuucuauuuuauaa

SEQ ID NO: 3970170 - RNA, 22 nt, Staphylococcus aureus subsp. aureus Mu50
cauacuucuauuuuauaauaaa

SEQ ID NO: 3970171 - RNA, 22 nt, Staphylococcus aureus subsp. aureus Mu50
cauacuugucguauucuucaau

SEQ ID NO: 3970172 - RNA, 13 nt, Staphylococcus aureus subsp. aureus Mu50
cauacuuuuucag

SEQ ID NO: 3970173 - RNA, 16 nt, Staphylococcus aureus subsp. aureus Mu50
cauagacacuuaacuu

SEQ ID NO: 3970174 - RNA, 14 nt, Staphylococcus aureus subsp. aureus Mu50
cauagaccuaugaa

SEQ ID NO: 3970175 - RNA, 18 nt, Staphylococcus aureus subsp. aureus Mu50
cauagauaauugcuauaa

SEQ ID NO: 3970176 - RNA, 18 nt, Staphylococcus aureus subsp. aureus Mu50
cauagaugacgaucuaua

SEQ ID NO: 3970177 - RNA, 21 nt, Staphylococcus aureus subsp. aureus Mu50
cauagaugacgaucuauaauu

SEQ ID NO: 3970178 - RNA, 18 nt, Staphylococcus aureus subsp. aureus Mu50
cauagaugcauaaaaacc

SEQ ID NO: 3970179 - RNA, 13 nt, Staphylococcus aureus subsp. aureus Mu50
cauagauuauauu

SEQ ID NO: 3970180 - RNA, 16 nt, Staphylococcus aureus subsp. aureus Mu50
cauagccuauuuaaaa

SEQ ID NO: 3970181 - RNA, 14 nt, Staphylococcus aureus subsp. aureus Mu50
cauagcuaaauaaa

SEQ ID NO: 3970182 - RNA, 16 nt, Staphylococcus aureus subsp. aureus Mu50
cauagcuaaauaaauu

SEQ ID NO: 3970183 - RNA, 17 nt, Staphylococcus aureus subsp. aureus Mu50
cauagcuaaauaaauua

SEQ ID NO: 3970184 - RNA, 18 nt, Staphylococcus aureus subsp. aureus Mu50
cauagcucuucuuuuucu

SEQ ID NO: 3970185 - RNA, 23 nt, Staphylococcus aureus subsp. aureus Mu50
cauaggcgcuguuccaaauucau

SEQ ID NO: 3970186 - RNA, 15 nt, Staphylococcus aureus subsp. aureus Mu50
cauaggcuugccaau

SEQ ID NO: 3970187 - RNA, 14 nt, Staphylococcus aureus subsp. aureus Mu50
cauaguaaucgauu

SEQ ID NO: 3970188 - RNA, 16 nt, Staphylococcus aureus subsp. aureus Mu50
cauaguuauuaaaucu

SEQ ID NO: 3970189 - RNA, 19 nt, Staphylococcus aureus subsp. aureus Mu50
cauaguucaaauugaacuu

SEQ ID NO: 3970190 - RNA, 22 nt, Staphylococcus aureus subsp. aureus Mu50
caucacuugcuguugcaauaaa

SEQ ID NO: 3970191 - RNA, 12 nt, Staphylococcus aureus subsp. aureus Mu50
caucaguaccaa

SEQ ID NO: 3970192 - RNA, 21 nt, Staphylococcus aureus subsp. aureus Mu50
caucaguaccaaagaaaucac

SEQ ID NO: 3970193 - RNA, 22 nt, Staphylococcus aureus subsp. aureus Mu50
caucaguaccaaagaaaucacc

SEQ ID NO: 3970194 - RNA, 23 nt, Staphylococcus aureus subsp. aureus Mu50
caucaguuaauaauuuuggauuu

SEQ ID NO: 3970195 - RNA, 18 nt, Staphylococcus aureus subsp. aureus Mu50
caucaguuguguaauaaa

SEQ ID NO: 3970196 - RNA, 15 nt, Staphylococcus aureus subsp. aureus Mu50
caucauaauaaaucu

SEQ ID NO: 3970197 - RNA, 14 nt, Staphylococcus aureus subsp. aureus Mu50
caucauaaucugcu

SEQ ID NO: 3970198 - RNA, 23 nt, Staphylococcus aureus subsp. aureus Mu50
caucauaaucuuuuccuaaaccu

SEQ ID NO: 3970199 - RNA, 20 nt, Staphylococcus aureus subsp. aureus Mu50
caucauacuucaauaacaau

SEQ ID NO: 3970200 - RNA, 12 nt, Staphylococcus aureus subsp. aureus Mu50
caucaucaccau

SEQ ID NO: 3970201 - RNA, 13 nt, Staphylococcus aureus subsp. aureus Mu50
caucaucaccaua

SEQ ID NO: 3970202 - RNA, 19 nt, Staphylococcus aureus subsp. aureus Mu50
caucaucuauaauaccuaa

SEQ ID NO: 3970203 - RNA, 12 nt, Staphylococcus aureus subsp. aureus Mu50
caucaucuauuu

SEQ ID NO: 3970204 - RNA, 16 nt, Staphylococcus aureus subsp. aureus Mu50
caucaugaaauuagau

SEQ ID NO: 3970205 - RNA, 16 nt, Staphylococcus aureus subsp. aureus Mu50
caucauguuuaucuac

SEQ ID NO: 3970206 - RNA, 15 nt, Staphylococcus aureus subsp. aureus Mu50
caucauuaaauauuu

SEQ ID NO: 3970207 - RNA, 19 nt, Staphylococcus aureus subsp. aureus Mu50
caucauuaguuuuuaaaau

SEQ ID NO: 3970208 - RNA, 23 nt, Staphylococcus aureus subsp. aureus Mu50
caucauuauacgugcuuuaaagu

SEQ ID NO: 3970209 - RNA, 16 nt, Staphylococcus aureus subsp. aureus Mu50
caucauuuaaauauuu

SEQ ID NO: 3970210 - RNA, 22 nt, Staphylococcus aureus subsp. aureus Mu50
caucauuuaaauauuucacgau

SEQ ID NO: 3970211 - RNA, 15 nt, Staphylococcus aureus subsp. aureus Mu50
caucauuuaauugau

SEQ ID NO: 3970212 - RNA, 21 nt, Staphylococcus aureus subsp. aureus Mu50
caucauuuacgauacaucauu

SEQ ID NO: 3970213 - RNA, 12 nt, Staphylococcus aureus subsp. aureus Mu50
caucauuucuga

SEQ ID NO: 3970214 - RNA, 15 nt, Staphylococcus aureus subsp. aureus Mu50
caucauuucugaagu

SEQ ID NO: 3970215 - RNA, 20 nt, Staphylococcus aureus subsp. aureus Mu50
caucauuuguguaaaugaau

SEQ ID NO: 3970216 - RNA, 14 nt, Staphylococcus aureus subsp. aureus Mu50
caucauuuguguuu

SEQ ID NO: 3970217 - RNA, 15 nt, Staphylococcus aureus subsp. aureus Mu50
caucauuuucaauac

SEQ ID NO: 3970218 - RNA, 23 nt, Staphylococcus aureus subsp. aureus Mu50
caucauuuucaauacuugaaaga

SEQ ID NO: 3970219 - RNA, 22 nt, Staphylococcus aureus subsp. aureus Mu50
caucauuuuucguuguucauaa

SEQ ID NO: 3970220 - RNA, 19 nt, Staphylococcus aureus subsp. aureus Mu50
cauccaauuauguuuaucu

SEQ ID NO: 3970221 - RNA, 21 nt, Staphylococcus aureus subsp. aureus Mu50
cauccaauuauguuuaucuac

SEQ ID NO: 3970222 - RNA, 19 nt, Staphylococcus aureus subsp. aureus Mu50
cauccacuuuuugccuggc

SEQ ID NO: 3970223 - RNA, 13 nt, Staphylococcus aureus subsp. aureus Mu50
cauccauacaaau

SEQ ID NO: 3970224 - RNA, 14 nt, Staphylococcus aureus subsp. aureus Mu50
cauccauacaaauc

SEQ ID NO: 3970225 - RNA, 16 nt, Staphylococcus aureus subsp. aureus Mu50
caucccaacuuaauaa

SEQ ID NO: 3970226 - RNA, 17 nt, Staphylococcus aureus subsp. aureus Mu50
cauccgccaauuaaaau

SEQ ID NO: 3970227 - RNA, 19 nt, Staphylococcus aureus subsp. aureus Mu50
cauccggaccuuguaaauu

SEQ ID NO: 3970228 - RNA, 16 nt, Staphylococcus aureus subsp. aureus Mu50
cauccucauaauuauc

SEQ ID NO: 3970229 - RNA, 15 nt, Staphylococcus aureus subsp. aureus Mu50
caucgaucuaaauau

SEQ ID NO: 3970230 - RNA, 19 nt, Staphylococcus aureus subsp. aureus Mu50
caucgcaaauacauaauca

SEQ ID NO: 3970231 - RNA, 18 nt, Staphylococcus aureus subsp. aureus Mu50
caucguaaagaucauuuu

SEQ ID NO: 3970232 - RNA, 18 nt, Staphylococcus aureus subsp. aureus Mu50
caucguuaucuuuaagua

SEQ ID NO: 3970233 - RNA, 18 nt, Staphylococcus aureus subsp. aureus Mu50
caucuaaauaguuuuuca

SEQ ID NO: 3970234 - RNA, 19 nt, Staphylococcus aureus subsp. aureus Mu50
caucuaaaugcacgagcaa

SEQ ID NO: 3970235 - RNA, 22 nt, Staphylococcus aureus subsp. aureus Mu50
caucuacaacgccaauagguuc

SEQ ID NO: 3970236 - RNA, 21 nt, Staphylococcus aureus subsp. aureus Mu50
caucuacaauauucaauaauu

SEQ ID NO: 3970237 - RNA, 17 nt, Staphylococcus aureus subsp. aureus Mu50
caucuacuauuuaaucu

SEQ ID NO: 3970238 - RNA, 20 nt, Staphylococcus aureus subsp. aureus Mu50
caucuauauuuguuuguugu

SEQ ID NO: 3970239 - RNA, 13 nt, Staphylococcus aureus subsp. aureus Mu50
caucuauguggcu

SEQ ID NO: 3970240 - RNA, 15 nt, Staphylococcus aureus subsp. aureus Mu50
caucuauuauuaugu

SEQ ID NO: 3970241 - RNA, 16 nt, Staphylococcus aureus subsp. aureus Mu50
caucuauuauuauguu

SEQ ID NO: 3970242 - RNA, 20 nt, Staphylococcus aureus subsp. aureus Mu50
caucuauuauuauguuauaa

SEQ ID NO: 3970243 - RNA, 19 nt, Staphylococcus aureus subsp. aureus Mu50
caucuauuuaauaauguau

SEQ ID NO: 3970244 - RNA, 22 nt, Staphylococcus aureus subsp. aureus Mu50
caucuauuuaauaauguaucau

SEQ ID NO: 3970245 - RNA, 22 nt, Staphylococcus aureus subsp. aureus Mu50
caucuccaaaggccaugagcuc

SEQ ID NO: 3970246 - RNA, 18 nt, Staphylococcus aureus subsp. aureus Mu50
caucuccuugguuauuaa

SEQ ID NO: 3970247 - RNA, 14 nt, Staphylococcus aureus subsp. aureus Mu50
caucucuaugucuc

SEQ ID NO: 3970248 - RNA, 21 nt, Staphylococcus aureus subsp. aureus Mu50
caucucuuauaaguucaacca

SEQ ID NO: 3970249 - RNA, 12 nt, Staphylococcus aureus subsp. aureus Mu50
caucucuucugg

SEQ ID NO: 3970250 - RNA, 22 nt, Staphylococcus aureus subsp. aureus Mu50
caucugaaaaaauuaauaauuu

SEQ ID NO: 3970251 - RNA, 13 nt, Staphylococcus aureus subsp. aureus Mu50
caucuguugauaa

SEQ ID NO: 3970252 - RNA, 14 nt, Staphylococcus aureus subsp. aureus Mu50
caucuuaacaacuu

SEQ ID NO: 3970253 - RNA, 18 nt, Staphylococcus aureus subsp. aureus Mu50
caucuuaacaacuuuaau

SEQ ID NO: 3970254 - RNA, 22 nt, Staphylococcus aureus subsp. aureus Mu50
caucuuagacgcuguuuuaaau

SEQ ID NO: 3970255 - RNA, 19 nt, Staphylococcus aureus subsp. aureus Mu50
caucuuaucaagaauauaa

SEQ ID NO: 3970256 - RNA, 22 nt, Staphylococcus aureus subsp. aureus Mu50
caucuuaucaagaauauaacga

SEQ ID NO: 3970257 - RNA, 19 nt, Staphylococcus aureus subsp. aureus Mu50
caucuuaucggcucuuuuu

SEQ ID NO: 3970258 - RNA, 19 nt, Staphylococcus aureus subsp. aureus Mu50
caucuuaugacugcuuuuu

SEQ ID NO: 3970259 - RNA, 12 nt, Staphylococcus aureus subsp. aureus Mu50
caucuucaacau

SEQ ID NO: 3970260 - RNA, 20 nt, Staphylococcus aureus subsp. aureus Mu50
caucuucaagacgcauuguu

SEQ ID NO: 3970261 - RNA, 22 nt, Staphylococcus aureus subsp. aureus Mu50
caucuucaauauuuaaauuuua

SEQ ID NO: 3970262 - RNA, 23 nt, Staphylococcus aureus subsp. aureus Mu50
caucuucuggauagguaucacua

SEQ ID NO: 3970263 - RNA, 19 nt, Staphylococcus aureus subsp. aureus Mu50
caucuugagauuuucaaca

SEQ ID NO: 3970264 - RNA, 15 nt, Staphylococcus aureus subsp. aureus Mu50
caucuuguuguucug

SEQ ID NO: 3970265 - RNA, 18 nt, Staphylococcus aureus subsp. aureus Mu50
caucuuuaagcuuaaaua

SEQ ID NO: 3970266 - RNA, 19 nt, Staphylococcus aureus subsp. aureus Mu50
caucuuuaagcuuaaauag

SEQ ID NO: 3970267 - RNA, 13 nt, Staphylococcus aureus subsp. aureus Mu50
caucuuuaauuuu

SEQ ID NO: 3970268 - RNA, 21 nt, Staphylococcus aureus subsp. aureus Mu50
caucuuucaaaugcuuaauaa

SEQ ID NO: 3970269 - RNA, 21 nt, Staphylococcus aureus subsp. aureus Mu50
caucuuuguaaccuaaaaaca

SEQ ID NO: 3970270 - RNA, 17 nt, Staphylococcus aureus subsp. aureus Mu50
caucuuuuagguaauaa

SEQ ID NO: 3970271 - RNA, 18 nt, Staphylococcus aureus subsp. aureus Mu50
caucuuuugguuuaucug

SEQ ID NO: 3970272 - RNA, 13 nt, Staphylococcus aureus subsp. aureus Mu50
caucuuuuguugu

SEQ ID NO: 3970273 - RNA, 23 nt, Staphylococcus aureus subsp. aureus Mu50
caugaauuuuaauauauuuggag

SEQ ID NO: 3970274 - RNA, 15 nt, Staphylococcus aureus subsp. aureus Mu50
caugacagcaucauc

SEQ ID NO: 3970275 - RNA, 18 nt, Staphylococcus aureus subsp. aureus Mu50
caugacagcaucaucaau

SEQ ID NO: 3970276 - RNA, 17 nt, Staphylococcus aureus subsp. aureus Mu50
caugaccuaauauauua

SEQ ID NO: 3970277 - RNA, 21 nt, Staphylococcus aureus subsp. aureus Mu50
cauuacgccaccaguuucaag

SEQ ID NO: 3970278 - RNA, 19 nt, Staphylococcus aureus subsp. aureus Mu50
cauuacuaaaacaaauuca

SEQ ID NO: 3970279 - RNA, 18 nt, Staphylococcus aureus subsp. aureus Mu50
cauuacuaauugaucagc

SEQ ID NO: 3970280 - RNA, 22 nt, Staphylococcus aureus subsp. aureus Mu50
cauuacuaauugaucagcauuu

SEQ ID NO: 3970281 - RNA, 17 nt, Staphylococcus aureus subsp. aureus Mu50
cauuacuaucuucauca

SEQ ID NO: 3970282 - RNA, 18 nt, Staphylococcus aureus subsp. aureus Mu50
cauuacuaucuucaucau

SEQ ID NO: 3970283 - RNA, 20 nt, Staphylococcus aureus subsp. aureus Mu50
cauuacuuggaaauguauau

SEQ ID NO: 3970284 - RNA, 13 nt, Staphylococcus aureus subsp. aureus Mu50
cauuagauaauaa

SEQ ID NO: 3970285 - RNA, 15 nt, Staphylococcus aureus subsp. aureus Mu50
cauuagcaugauaaa

SEQ ID NO: 3970286 - RNA, 16 nt, Staphylococcus aureus subsp. aureus Mu50
cauuagcaugauaaag

SEQ ID NO: 3970287 - RNA, 23 nt, Staphylococcus aureus subsp. aureus Mu50
cauuagccaaaucuuuaauaacc

SEQ ID NO: 3970288 - RNA, 22 nt, Staphylococcus aureus subsp. aureus Mu50
cauuagccacagcuaaugugua

SEQ ID NO: 3970289 - RNA, 14 nt, Staphylococcus aureus subsp. aureus Mu50
cauuaguacuaaac

SEQ ID NO: 3970290 - RNA, 17 nt, Staphylococcus aureus subsp. aureus Mu50
cauuaguuaugugcuaa

SEQ ID NO: 3970291 - RNA, 20 nt, Staphylococcus aureus subsp. aureus Mu50
cauuaguucuguugauauuu

SEQ ID NO: 3970292 - RNA, 15 nt, Staphylococcus aureus subsp. aureus Mu50
cauuaguugcauaau

SEQ ID NO: 3970293 - RNA, 22 nt, Staphylococcus aureus subsp. aureus Mu50
cauuaguugcauaaucaauuuc

SEQ ID NO: 3970294 - RNA, 20 nt, Staphylococcus aureus subsp. aureus Mu50
cauuaguuguaucagugaca

SEQ ID NO: 3970295 - RNA, 18 nt, Staphylococcus aureus subsp. aureus Mu50
cauuaguuuuuaaaauua

SEQ ID NO: 3970296 - RNA, 18 nt, Staphylococcus aureus subsp. aureus Mu50
cauuauaauggacuaauu

SEQ ID NO: 3970297 - RNA, 22 nt, Staphylococcus aureus subsp. aureus Mu50
cauuauacgugcuuuaaaguug

SEQ ID NO: 3970298 - RNA, 16 nt, Staphylococcus aureus subsp. aureus Mu50
cauuauagaugacugu

SEQ ID NO: 3970299 - RNA, 18 nt, Staphylococcus aureus subsp. aureus Mu50
cauuauaguguucaagcu

SEQ ID NO: 3970300 - RNA, 13 nt, Staphylococcus aureus subsp. aureus Mu50
cauuaucaaauaa

SEQ ID NO: 3970301 - RNA, 15 nt, Staphylococcus aureus subsp. aureus Mu50
cauuaucaagaacuu

SEQ ID NO: 3970302 - RNA, 12 nt, Staphylococcus aureus subsp. aureus Mu50
cauuauuaagug

SEQ ID NO: 3970303 - RNA, 16 nt, Staphylococcus aureus subsp. aureus Mu50
cauuauugccuaaccu

SEQ ID NO: 3970304 - RNA, 14 nt, Staphylococcus aureus subsp. aureus Mu50
cauuauuuaaauaa

SEQ ID NO: 3970305 - RNA, 18 nt, Staphylococcus aureus subsp. aureus Mu50
cauuauuuagaauucuaa

SEQ ID NO: 3970306 - RNA, 13 nt, Staphylococcus aureus subsp. aureus Mu50
cauuauuugauaa

SEQ ID NO: 3970307 - RNA, 14 nt, Staphylococcus aureus subsp. aureus Mu50
cauuauuugauaaa

SEQ ID NO: 3970308 - RNA, 17 nt, Staphylococcus aureus subsp. aureus Mu50
cauuauuugauaaauaa

SEQ ID NO: 3970309 - RNA, 16 nt, Staphylococcus aureus subsp. aureus Mu50
cauuauuugcugcuaa

SEQ ID NO: 3970310 - RNA, 12 nt, Staphylococcus aureus subsp. aureus Mu50
cauucaaauaaa

SEQ ID NO: 3970311 - RNA, 15 nt, Staphylococcus aureus subsp. aureus Mu50
cauucaaauaaauga

SEQ ID NO: 3970312 - RNA, 16 nt, Staphylococcus aureus subsp. aureus Mu50
cauucacuucaaguua

SEQ ID NO: 3970313 - RNA, 15 nt, Staphylococcus aureus subsp. aureus Mu50
cauucauaaaugacu

SEQ ID NO: 3970314 - RNA, 17 nt, Staphylococcus aureus subsp. aureus Mu50
cauucauaaaugacuga

SEQ ID NO: 3970315 - RNA, 15 nt, Staphylococcus aureus subsp. aureus Mu50
cauucauacacuauc

SEQ ID NO: 3970316 - RNA, 21 nt, Staphylococcus aureus subsp. aureus Mu50
cauucauaccgaagaaacuaa

SEQ ID NO: 3970317 - RNA, 21 nt, Staphylococcus aureus subsp. aureus Mu50
cauucauggccaaauguugau

SEQ ID NO: 3970318 - RNA, 22 nt, Staphylococcus aureus subsp. aureus Mu50
cauucauggccaaauguugaua

SEQ ID NO: 3970319 - RNA, 20 nt, Staphylococcus aureus subsp. aureus Mu50
cauucauuaagcuuuguuug

SEQ ID NO: 3970320 - RNA, 13 nt, Staphylococcus aureus subsp. aureus Mu50
cauucauuacuug

SEQ ID NO: 3970321 - RNA, 21 nt, Staphylococcus aureus subsp. aureus Mu50
cauucauuuaguuaaauacaa

SEQ ID NO: 3970322 - RNA, 13 nt, Staphylococcus aureus subsp. aureus Mu50
cauuccaaaaauu

SEQ ID NO: 3970323 - RNA, 17 nt, Staphylococcus aureus subsp. aureus Mu50
cauucccuuaauaauaa

SEQ ID NO: 3970324 - RNA, 16 nt, Staphylococcus aureus subsp. aureus Mu50
cauuccuaauuauauu

SEQ ID NO: 3970325 - RNA, 19 nt, Staphylococcus aureus subsp. aureus Mu50
cauuccucuauuguaucuu

SEQ ID NO: 3970326 - RNA, 13 nt, Staphylococcus aureus subsp. aureus Mu50
cauucggauaaau

SEQ ID NO: 3970327 - RNA, 14 nt, Staphylococcus aureus subsp. aureus Mu50
cauucggauaaaua

SEQ ID NO: 3970328 - RNA, 17 nt, Staphylococcus aureus subsp. aureus Mu50
cauucuaguagcuagaa

SEQ ID NO: 3970329 - RNA, 20 nt, Staphylococcus aureus subsp. aureus Mu50
cauucuguguaaauauaaau

SEQ ID NO: 3970330 - RNA, 12 nt, Staphylococcus aureus subsp. aureus Mu50
cauucuuauuug

SEQ ID NO: 3970331 - RNA, 15 nt, Staphylococcus aureus subsp. aureus Mu50
cauucuucaaaaaau

SEQ ID NO: 3970332 - RNA, 16 nt, Staphylococcus aureus subsp. aureus Mu50
cauucuucaaaaaaua

SEQ ID NO: 3970333 - RNA, 22 nt, Staphylococcus aureus subsp. aureus Mu50
cauucuuccaacacccauauaa

SEQ ID NO: 3970334 - RNA, 15 nt, Staphylococcus aureus subsp. aureus Mu50
cauucuuuauagaaa

SEQ ID NO: 3970335 - RNA, 20 nt, Staphylococcus aureus subsp. aureus Mu50
cauucuuuauagaaaccaaa

SEQ ID NO: 3970336 - RNA, 20 nt, Staphylococcus aureus subsp. aureus Mu50
cauugaaaggaacauuucaa

SEQ ID NO: 3970337 - RNA, 14 nt, Staphylococcus aureus subsp. aureus Mu50
cauugaauaaauga

SEQ ID NO: 3970338 - RNA, 17 nt, Staphylococcus aureus subsp. aureus Mu50
cauugaauaaaugaagg

SEQ ID NO: 3970339 - RNA, 21 nt, Staphylococcus aureus subsp. aureus Mu50
cauugacacacccaaauuuag

SEQ ID NO: 3970340 - RNA, 18 nt, Staphylococcus aureus subsp. aureus Mu50
cauugaccaccuuuaucu

SEQ ID NO: 3970341 - RNA, 22 nt, Staphylococcus aureus subsp. aureus Mu50
cauugaccaccuuuaucuguaa

SEQ ID NO: 3970342 - RNA, 20 nt, Staphylococcus aureus subsp. aureus Mu50
cauugagauggucuuuuaau

SEQ ID NO: 3970343 - RNA, 21 nt, Staphylococcus aureus subsp. aureus Mu50
cauugagauuaucuuuagaca

SEQ ID NO: 3970344 - RNA, 15 nt, Staphylococcus aureus subsp. aureus Mu50
cauugauaaaauaau

SEQ ID NO: 3970345 - RNA, 15 nt, Staphylococcus aureus subsp. aureus Mu50
cauugauaagucuug

SEQ ID NO: 3970346 - RNA, 16 nt, Staphylococcus aureus subsp. aureus Mu50
cauugaucuuuuauaa

SEQ ID NO: 3970347 - RNA, 18 nt, Staphylococcus aureus subsp. aureus Mu50
cauugaugucaauuucac

SEQ ID NO: 3970348 - RNA, 17 nt, Staphylococcus aureus subsp. aureus Mu50
cauugcacuaugcauaa

SEQ ID NO: 3970349 - RNA, 22 nt, Staphylococcus aureus subsp. aureus Mu50
cauugcuuaacuuccuuuuuau

SEQ ID NO: 3970350 - RNA, 23 nt, Staphylococcus aureus subsp. aureus Mu50
cauugguaccuuuuuauuaucuu

SEQ ID NO: 3970351 - RNA, 16 nt, Staphylococcus aureus subsp. aureus Mu50
cauuguaaaacaaauu

SEQ ID NO: 3970352 - RNA, 21 nt, Staphylococcus aureus subsp. aureus Mu50
cauuguaaauauaguaauaaa

SEQ ID NO: 3970353 - RNA, 12 nt, Staphylococcus aureus subsp. aureus Mu50
cauuguaaauga

SEQ ID NO: 3970354 - RNA, 14 nt, Staphylococcus aureus subsp. aureus Mu50
cauuguaauaccaa

SEQ ID NO: 3970355 - RNA, 13 nt, Staphylococcus aureus subsp. aureus Mu50
cauuguauaaaaa

SEQ ID NO: 3970356 - RNA, 19 nt, Staphylococcus aureus subsp. aureus Mu50
cauuguccaacugcuuuuu

SEQ ID NO: 3970357 - RNA, 16 nt, Staphylococcus aureus subsp. aureus Mu50
cauugugaaaguuuuu

SEQ ID NO: 3970358 - RNA, 13 nt, Staphylococcus aureus subsp. aureus Mu50
cauugugaugaua

SEQ ID NO: 3970359 - RNA, 14 nt, Staphylococcus aureus subsp. aureus Mu50
cauuguggcuuuuu

SEQ ID NO: 3970360 - RNA, 22 nt, Staphylococcus aureus subsp. aureus Mu50
cauuguguccauaaauauuaaa

SEQ ID NO: 3970361 - RNA, 15 nt, Staphylococcus aureus subsp. aureus Mu50
cauuguuauccaaaa

SEQ ID NO: 3970362 - RNA, 20 nt, Staphylococcus aureus subsp. aureus Mu50
cauuguuauuaucguaaaaa

SEQ ID NO: 3970363 - RNA, 21 nt, Staphylococcus aureus subsp. aureus Mu50
cauuguuauuaucguaaaaaa

SEQ ID NO: 3970364 - RNA, 13 nt, Staphylococcus aureus subsp. aureus Mu50
cauuguugauaaa

SEQ ID NO: 3970365 - RNA, 12 nt, Staphylococcus aureus subsp. aureus Mu50
ccaaauaucagu

SEQ ID NO: 3970366 - RNA, 17 nt, Staphylococcus aureus subsp. aureus Mu50
ccaaauauuuuaucugu

SEQ ID NO: 3970367 - RNA, 20 nt, Staphylococcus aureus subsp. aureus Mu50
ccaaauccaucuaauucaau

SEQ ID NO: 3970368 - RNA, 17 nt, Staphylococcus aureus subsp. aureus Mu50
ccaaaucggaauaaaau

SEQ ID NO: 3970369 - RNA, 19 nt, Staphylococcus aureus subsp. aureus Mu50
ccaaaucggaauaaaauaa

SEQ ID NO: 3970370 - RNA, 21 nt, Staphylococcus aureus subsp. aureus Mu50
ccaaaucggaauaaaauaaau

SEQ ID NO: 3970371 - RNA, 13 nt, Staphylococcus aureus subsp. aureus Mu50
ccaaaucuuuaau

SEQ ID NO: 3970372 - RNA, 22 nt, Staphylococcus aureus subsp. aureus Mu50
ccaaaugugguggguauauaau

SEQ ID NO: 3970373 - RNA, 22 nt, Staphylococcus aureus subsp. aureus Mu50
ccaaauuuaggcaugucaaauc

SEQ ID NO: 3970374 - RNA, 14 nt, Staphylococcus aureus subsp. aureus Mu50
ccaaauuuuauacu

SEQ ID NO: 3970375 - RNA, 20 nt, Staphylococcus aureus subsp. aureus Mu50
ccaacaagguucuaaaucuu

SEQ ID NO: 3970376 - RNA, 22 nt, Staphylococcus aureus subsp. aureus Mu50
ccaacacagagaaauucgaaaa

SEQ ID NO: 3970377 - RNA, 22 nt, Staphylococcus aureus subsp. aureus Mu50
ccaacacagagaauuucgaaaa

SEQ ID NO: 3970378 - RNA, 16 nt, Staphylococcus aureus subsp. aureus Mu50
ccaacaccuaauauuu

SEQ ID NO: 3970379 - RNA, 21 nt, Staphylococcus aureus subsp. aureus Mu50
ccaacauauaaaaaauuauua

SEQ ID NO: 3970380 - RNA, 15 nt, Staphylococcus aureus subsp. aureus Mu50
ccaacaucuucaaca

SEQ ID NO: 3970381 - RNA, 17 nt, Staphylococcus aureus subsp. aureus Mu50
ccaacauguaacaaaau

SEQ ID NO: 3970382 - RNA, 19 nt, Staphylococcus aureus subsp. aureus Mu50
ccaaccccuuuauuuugau

SEQ ID NO: 3970383 - RNA, 21 nt, Staphylococcus aureus subsp. aureus Mu50
ccaacguuauucguuaacaau

SEQ ID NO: 3970384 - RNA, 19 nt, Staphylococcus aureus subsp. aureus Mu50
ccaagauaaaucaucauuc

SEQ ID NO: 3970385 - RNA, 20 nt, Staphylococcus aureus subsp. aureus Mu50
ccaagauaaaucaucauucu

SEQ ID NO: 3970386 - RNA, 17 nt, Staphylococcus aureus subsp. aureus Mu50
ccaagcucguuaaauca

SEQ ID NO: 3970387 - RNA, 23 nt, Staphylococcus aureus subsp. aureus Mu50
ccaaggaagucaccauauuuaac

SEQ ID NO: 3970388 - RNA, 22 nt, Staphylococcus aureus subsp. aureus Mu50
ccaaggauguuauaaaaugaau

SEQ ID NO: 3970389 - RNA, 20 nt, Staphylococcus aureus subsp. aureus Mu50
ccaaguacgcaauuuaauau

SEQ ID NO: 3970390 - RNA, 13 nt, Staphylococcus aureus subsp. aureus Mu50
ccaaguauuuucu

SEQ ID NO: 3970391 - RNA, 11 nt, Staphylococcus aureus subsp. aureus Mu50
ccaaguuaaug

SEQ ID NO: 3970392 - RNA, 15 nt, Staphylococcus aureus subsp. aureus Mu50
ccaaguucacuaaau

SEQ ID NO: 3970393 - RNA, 19 nt, Staphylococcus aureus subsp. aureus Mu50
ccaaguuuugcacgcauac

SEQ ID NO: 3970394 - RNA, 17 nt, Staphylococcus aureus subsp. aureus Mu50
ccaauaaaacuaugugu

SEQ ID NO: 3970395 - RNA, 10 nt, Staphylococcus aureus subsp. aureus Mu50
ccaauaaucc

SEQ ID NO: 3970396 - RNA, 21 nt, Staphylococcus aureus subsp. aureus Mu50
ccaauacagaacuuuaauaau

SEQ ID NO: 3970397 - RNA, 16 nt, Staphylococcus aureus subsp. aureus Mu50
ccaauacguuuccaau

SEQ ID NO: 3970398 - RNA, 18 nt, Staphylococcus aureus subsp. aureus Mu50
ccaauagaauucauuaau

SEQ ID NO: 3970399 - RNA, 22 nt, Staphylococcus aureus subsp. aureus Mu50
ccaauagguucauuauuuaaau

SEQ ID NO: 3970400 - RNA, 14 nt, Staphylococcus aureus subsp. aureus Mu50
ccaauaucauauuu

SEQ ID NO: 3970401 - RNA, 18 nt, Staphylococcus aureus subsp. aureus Mu50
ccaauaucuucuuuuaau

SEQ ID NO: 3970402 - RNA, 13 nt, Staphylococcus aureus subsp. aureus Mu50
ccaaucaauaguu

SEQ ID NO: 3970403 - RNA, 18 nt, Staphylococcus aureus subsp. aureus Mu50
ccaaucaucauuaaaucu

SEQ ID NO: 3970404 - RNA, 21 nt, Staphylococcus aureus subsp. aureus Mu50
ccaaucgauuuuauaucuuuc

SEQ ID NO: 3970405 - RNA, 19 nt, Staphylococcus aureus subsp. aureus Mu50
ccaaucuauuuuaaacuca

SEQ ID NO: 3970406 - RNA, 10 nt, Staphylococcus aureus subsp. aureus Mu50
ccaaugaauc

SEQ ID NO: 3970407 - RNA, 18 nt, Staphylococcus aureus subsp. aureus Mu50
ccaaugauagugaauaau

SEQ ID NO: 3970408 - RNA, 23 nt, Staphylococcus aureus subsp. aureus Mu50
ccaaugcguggauguguuuuaau

SEQ ID NO: 3970409 - RNA, 19 nt, Staphylococcus aureus subsp. aureus Mu50
ccaauggaaguuuuuuagu

SEQ ID NO: 3970410 - RNA, 16 nt, Staphylococcus aureus subsp. aureus Mu50
ccaauguauaaaaccu

SEQ ID NO: 3970411 - RNA, 12 nt, Staphylococcus aureus subsp. aureus Mu50
ccaauguguuua

SEQ ID NO: 3970412 - RNA, 21 nt, Staphylococcus aureus subsp. aureus Mu50
ccaauuaaaucgauuaagaau

SEQ ID NO: 3970413 - RNA, 22 nt, Staphylococcus aureus subsp. aureus Mu50
ccaauuaaaucgauuaagaaug

SEQ ID NO: 3970414 - RNA, 21 nt, Staphylococcus aureus subsp. aureus Mu50
ccaauuaucaacauaauauuu

SEQ ID NO: 3970415 - RNA, 22 nt, Staphylococcus aureus subsp. aureus Mu50
ccaauucauuuuauaaaucaaa

SEQ ID NO: 3970416 - RNA, 17 nt, Staphylococcus aureus subsp. aureus Mu50
ccaauuccaauaaacaa

SEQ ID NO: 3970417 - RNA, 21 nt, Staphylococcus aureus subsp. aureus Mu50
ccaauuccuuggugucgaaau

SEQ ID NO: 3970418 - RNA, 16 nt, Staphylococcus aureus subsp. aureus Mu50
ccaauugauuuugcug

SEQ ID NO: 3970419 - RNA, 22 nt, Staphylococcus aureus subsp. aureus Mu50
ccaauuguuucagcuuguccau

SEQ ID NO: 3970420 - RNA, 12 nt, Staphylococcus aureus subsp. aureus Mu50
ccaauuuguuga

SEQ ID NO: 3970421 - RNA, 22 nt, Staphylococcus aureus subsp. aureus Mu50
ccacagcuaauguguacuuaaa

SEQ ID NO: 3970422 - RNA, 12 nt, Staphylococcus aureus subsp. aureus Mu50
ccacauuuuccu

SEQ ID NO: 3970423 - RNA, 18 nt, Staphylococcus aureus subsp. aureus Mu50
ccaccaccugugacaaau

SEQ ID NO: 3970424 - RNA, 21 nt, Staphylococcus aureus subsp. aureus Mu50
ccaccguuaaaauauaugaau

SEQ ID NO: 3970425 - RNA, 20 nt, Staphylococcus aureus subsp. aureus Mu50
ccaccuacgcccaucaucac

SEQ ID NO: 3970426 - RNA, 14 nt, Staphylococcus aureus subsp. aureus Mu50
ccaccuuuaucugu

SEQ ID NO: 3970427 - RNA, 14 nt, Staphylococcus aureus subsp. aureus Mu50
ccacggcauuuaag

SEQ ID NO: 3970428 - RNA, 13 nt, Staphylococcus aureus subsp. aureus Mu50
ccacgguuuacca

SEQ ID NO: 3970429 - RNA, 14 nt, Staphylococcus aureus subsp. aureus Mu50
ccacgguuuaccac

SEQ ID NO: 3970430 - RNA, 15 nt, Staphylococcus aureus subsp. aureus Mu50
ccacuauauccuuuu

SEQ ID NO: 3970431 - RNA, 19 nt, Staphylococcus aureus subsp. aureus Mu50
ccacucaauucucuaacuu

SEQ ID NO: 3970432 - RNA, 16 nt, Staphylococcus aureus subsp. aureus Mu50
ccacuccuuaaacaaa

SEQ ID NO: 3970433 - RNA, 23 nt, Staphylococcus aureus subsp. aureus Mu50
ccacuccuuaaacaaauaaaugu

SEQ ID NO: 3970434 - RNA, 13 nt, Staphylococcus aureus subsp. aureus Mu50
ccacuucaucuaa

SEQ ID NO: 3970435 - RNA, 19 nt, Staphylococcus aureus subsp. aureus Mu50
ccacuucuucaccugcguc

SEQ ID NO: 3970436 - RNA, 16 nt, Staphylococcus aureus subsp. aureus Mu50
ccacuugaauacuuuu

SEQ ID NO: 3970437 - RNA, 20 nt, Staphylococcus aureus subsp. aureus Mu50
ccacuugaauacuuuuuaac

SEQ ID NO: 3970438 - RNA, 21 nt, Staphylococcus aureus subsp. aureus Mu50
ccacuugaauacuuuuuaacu

SEQ ID NO: 3970439 - RNA, 19 nt, Staphylococcus aureus subsp. aureus Mu50
ccacuuuuguuaaaaaaug

SEQ ID NO: 3970440 - RNA, 14 nt, Staphylococcus aureus subsp. aureus Mu50
ccagauaucauaau

SEQ ID NO: 3970441 - RNA, 15 nt, Staphylococcus aureus subsp. aureus Mu50
ccagaugaauuuuua

SEQ ID NO: 3970442 - RNA, 20 nt, Staphylococcus aureus subsp. aureus Mu50
ccagaugcaaugauaccuuu

SEQ ID NO: 3970443 - RNA, 20 nt, Staphylococcus aureus subsp. aureus Mu50
ccagcaugaaucgcauuuaa

SEQ ID NO: 3970444 - RNA, 16 nt, Staphylococcus aureus subsp. aureus Mu50
ccagcgacauguccug

SEQ ID NO: 3970445 - RNA, 21 nt, Staphylococcus aureus subsp. aureus Mu50
ccagcuuagcauagcguucaa

SEQ ID NO: 3970446 - RNA, 20 nt, Staphylococcus aureus subsp. aureus Mu50
ccagcuugaccgccuaugau

SEQ ID NO: 3970447 - RNA, 23 nt, Staphylococcus aureus subsp. aureus Mu50
ccaguacuuucgaguaauacuuu

SEQ ID NO: 3970448 - RNA, 13 nt, Staphylococcus aureus subsp. aureus Mu50
ccaguaucucuuu

SEQ ID NO: 3970449 - RNA, 13 nt, Staphylococcus aureus subsp. aureus Mu50
ccagucauguccc

SEQ ID NO: 3970450 - RNA, 18 nt, Staphylococcus aureus subsp. aureus Mu50
ccagucguaaugaugaca

SEQ ID NO: 3970451 - RNA, 15 nt, Staphylococcus aureus subsp. aureus Mu50
ccaguggaaaugaua

SEQ ID NO: 3970452 - RNA, 15 nt, Staphylococcus aureus subsp. aureus Mu50
cccugcuguuuuauu

SEQ ID NO: 3970453 - RNA, 18 nt, Staphylococcus aureus subsp. aureus Mu50
cccuuaaaucaaguauau

SEQ ID NO: 3970454 - RNA, 11 nt, Staphylococcus aureus subsp. aureus Mu50
cccuuaauaau

SEQ ID NO: 3970455 - RNA, 12 nt, Staphylococcus aureus subsp. aureus Mu50
cccuuaauaaua

SEQ ID NO: 3970456 - RNA, 16 nt, Staphylococcus aureus subsp. aureus Mu50
cccuugugauucaaau

SEQ ID NO: 3970457 - RNA, 24 nt, Staphylococcus aureus subsp. aureus Mu50
ccgaaaaaaccgagaaucuccauu

SEQ ID NO: 3970458 - RNA, 16 nt, Staphylococcus aureus subsp. aureus Mu50
ccgaaaauagacugac

SEQ ID NO: 3970459 - RNA, 18 nt, Staphylococcus aureus subsp. aureus Mu50
ccgaaaauugcuaaaaaa

SEQ ID NO: 3970460 - RNA, 18 nt, Staphylococcus aureus subsp. aureus Mu50
ccgaacacaaaaaugaag

SEQ ID NO: 3970461 - RNA, 22 nt, Staphylococcus aureus subsp. aureus Mu50
ccgaacaucugaaaaaauuaau

SEQ ID NO: 3970462 - RNA, 14 nt, Staphylococcus aureus subsp. aureus Mu50
ccgaauaauuuuga

SEQ ID NO: 3970463 - RNA, 14 nt, Staphylococcus aureus subsp. aureus Mu50
ccgacuauuuuuga

SEQ ID NO: 3970464 - RNA, 17 nt, Staphylococcus aureus subsp. aureus Mu50
ccgacuugauaaaaaau

SEQ ID NO: 3970465 - RNA, 18 nt, Staphylococcus aureus subsp. aureus Mu50
ccgacuugauaaaaaaug

SEQ ID NO: 3970466 - RNA, 14 nt, Staphylococcus aureus subsp. aureus Mu50
ccgacuuguugaua

SEQ ID NO: 3970467 - RNA, 13 nt, Staphylococcus aureus subsp. aureus Mu50
ccgaucaugccuu

SEQ ID NO: 3970468 - RNA, 13 nt, Staphylococcus aureus subsp. aureus Mu50
ccgauuguuucac

SEQ ID NO: 3970469 - RNA, 16 nt, Staphylococcus aureus subsp. aureus Mu50
ccgauuuugauauaaa

SEQ ID NO: 3970470 - RNA, 17 nt, Staphylococcus aureus subsp. aureus Mu50
ccgauuuugauauaaaa

SEQ ID NO: 3970471 - RNA, 18 nt, Staphylococcus aureus subsp. aureus Mu50
ccgcacuucuauauuaau

SEQ ID NO: 3970472 - RNA, 14 nt, Staphylococcus aureus subsp. aureus Mu50
ccgcagaccacauc

SEQ ID NO: 3970473 - RNA, 20 nt, Staphylococcus aureus subsp. aureus Mu50
ccgccaacuaauguuaaaau

SEQ ID NO: 3970474 - RNA, 14 nt, Staphylococcus aureus subsp. aureus Mu50
ccgccuaauaauaa

SEQ ID NO: 3970475 - RNA, 17 nt, Staphylococcus aureus subsp. aureus Mu50
ccgccuaauaauaaaau

SEQ ID NO: 3970476 - RNA, 14 nt, Staphylococcus aureus subsp. aureus Mu50
ccggcuuuuucuuu

SEQ ID NO: 3970477 - RNA, 16 nt, Staphylococcus aureus subsp. aureus Mu50
ccgucaaacuuaaaac

SEQ ID NO: 3970478 - RNA, 15 nt, Staphylococcus aureus subsp. aureus Mu50
ccgugauguuaaaau

SEQ ID NO: 3970479 - RNA, 21 nt, Staphylococcus aureus subsp. aureus Mu50
ccguguuuugauuuauuaucu

SEQ ID NO: 3970480 - RNA, 23 nt, Staphylococcus aureus subsp. aureus Mu50
ccguuaaaauauaugaauaaguc

SEQ ID NO: 3970481 - RNA, 16 nt, Staphylococcus aureus subsp. aureus Mu50
ccguuaaaauuuuaau

SEQ ID NO: 3970482 - RNA, 12 nt, Staphylococcus aureus subsp. aureus Mu50
ccguuauuuuca

SEQ ID NO: 3970483 - RNA, 16 nt, Staphylococcus aureus subsp. aureus Mu50
ccguugaauuaacaau

SEQ ID NO: 3970484 - RNA, 14 nt, Staphylococcus aureus subsp. aureus Mu50
ccguuuuuuauaaa

SEQ ID NO: 3970485 - RNA, 12 nt, Staphylococcus aureus subsp. aureus Mu50
ccuaaaaacaaa

SEQ ID NO: 3970486 - RNA, 21 nt, Staphylococcus aureus subsp. aureus Mu50
ccuaaaccucuaaauaaaauu

SEQ ID NO: 3970487 - RNA, 19 nt, Staphylococcus aureus subsp. aureus Mu50
ccuaaagguaacuuuuuaa

SEQ ID NO: 3970488 - RNA, 21 nt, Staphylococcus aureus subsp. aureus Mu50
ccuaaaucuuuaaauguauca

SEQ ID NO: 3970489 - RNA, 14 nt, Staphylococcus aureus subsp. aureus Mu50
ccuaaaugauuaau

SEQ ID NO: 3970490 - RNA, 17 nt, Staphylococcus aureus subsp. aureus Mu50
ccuaaaugauuaauaac

SEQ ID NO: 3970491 - RNA, 13 nt, Staphylococcus aureus subsp. aureus Mu50
ccuaacuuuuauu

SEQ ID NO: 3970492 - RNA, 19 nt, Staphylococcus aureus subsp. aureus Mu50
ccuaacuuuuauuaucagc

SEQ ID NO: 3970493 - RNA, 21 nt, Staphylococcus aureus subsp. aureus Mu50
ccuaagcauaauucaacuuaa

SEQ ID NO: 3970494 - RNA, 22 nt, Staphylococcus aureus subsp. aureus Mu50
ccuaagcucguuaauuuuauuu

SEQ ID NO: 3970495 - RNA, 16 nt, Staphylococcus aureus subsp. aureus Mu50
ccuaaggacuuuaugc

SEQ ID NO: 3970496 - RNA, 14 nt, Staphylococcus aureus subsp. aureus Mu50
ccuaaguuaauuua

SEQ ID NO: 3970497 - RNA, 18 nt, Staphylococcus aureus subsp. aureus Mu50
ccuaaguuaauuuaucgu

SEQ ID NO: 3970498 - RNA, 14 nt, Staphylococcus aureus subsp. aureus Mu50
ccuaauaaauaucu

SEQ ID NO: 3970499 - RNA, 13 nt, Staphylococcus aureus subsp. aureus Mu50
ccuaauaauaaaa

SEQ ID NO: 3970500 - RNA, 18 nt, Staphylococcus aureus subsp. aureus Mu50
ccuaauaauaaaauagcu

SEQ ID NO: 3970501 - RNA, 21 nt, Staphylococcus aureus subsp. aureus Mu50
ccuaauacacuugauaaaacu

SEQ ID NO: 3970502 - RNA, 13 nt, Staphylococcus aureus subsp. aureus Mu50
ccuaaugcgacau

SEQ ID NO: 3970503 - RNA, 12 nt, Staphylococcus aureus subsp. aureus Mu50
ccuaaugcuuua

SEQ ID NO: 3970504 - RNA, 17 nt, Staphylococcus aureus subsp. aureus Mu50
ccuaaugcuuuaauaaa

SEQ ID NO: 3970505 - RNA, 18 nt, Staphylococcus aureus subsp. aureus Mu50
ccuaaugcuuuaauaaau

SEQ ID NO: 3970506 - RNA, 20 nt, Staphylococcus aureus subsp. aureus Mu50
ccuaauggucgugcuugcgg

SEQ ID NO: 3970507 - RNA, 23 nt, Staphylococcus aureus subsp. aureus Mu50
ccuaauucgccaucuuuuuuagc

SEQ ID NO: 3970508 - RNA, 18 nt, Staphylococcus aureus subsp. aureus Mu50
ccuacaaauauguaauca

SEQ ID NO: 3970509 - RNA, 13 nt, Staphylococcus aureus subsp. aureus Mu50
ccuacaacaccaa

SEQ ID NO: 3970510 - RNA, 19 nt, Staphylococcus aureus subsp. aureus Mu50
ccuacaacaccaauugaaa

SEQ ID NO: 3970511 - RNA, 20 nt, Staphylococcus aureus subsp. aureus Mu50
ccuacaacuauucccacuca

SEQ ID NO: 3970512 - RNA, 21 nt, Staphylococcus aureus subsp. aureus Mu50
ccuacacuguuuuauaaauga

SEQ ID NO: 3970513 - RNA, 22 nt, Staphylococcus aureus subsp. aureus Mu50
ccuacagauuuuaaaaauucau

SEQ ID NO: 3970514 - RNA, 19 nt, Staphylococcus aureus subsp. aureus Mu50
ccuaccauuacugcagcau

SEQ ID NO: 3970515 - RNA, 18 nt, Staphylococcus aureus subsp. aureus Mu50
ccuacuaauauauuaauu

SEQ ID NO: 3970516 - RNA, 12 nt, Staphylococcus aureus subsp. aureus Mu50
ccuacugcuguc

SEQ ID NO: 3970517 - RNA, 19 nt, Staphylococcus aureus subsp. aureus Mu50
ccuacugcugucuuuuuga

SEQ ID NO: 3970518 - RNA, 23 nt, Staphylococcus aureus subsp. aureus Mu50
ccuacuuugauauguuuccucuu

SEQ ID NO: 3970519 - RNA, 16 nt, Staphylococcus aureus subsp. aureus Mu50
ccuacuuuuuuggcaa

SEQ ID NO: 3970520 - RNA, 17 nt, Staphylococcus aureus subsp. aureus Mu50
ccuagacgaucuuuaau

SEQ ID NO: 3970521 - RNA, 15 nt, Staphylococcus aureus subsp. aureus Mu50
ccuagauaccaaacu

SEQ ID NO: 3970522 - RNA, 13 nt, Staphylococcus aureus subsp. aureus Mu50
ccuagcaaaaaua

SEQ ID NO: 3970523 - RNA, 16 nt, Staphylococcus aureus subsp. aureus Mu50
ccuagcaaaaauacuu

SEQ ID NO: 3970524 - RNA, 17 nt, Staphylococcus aureus subsp. aureus Mu50
ccuaggaaauaaaaaau

SEQ ID NO: 3970525 - RNA, 19 nt, Staphylococcus aureus subsp. aureus Mu50
ccuaggaaauaaaaaauaa

SEQ ID NO: 3970526 - RNA, 13 nt, Staphylococcus aureus subsp. aureus Mu50
ccuauauguaggg

SEQ ID NO: 3970527 - RNA, 18 nt, Staphylococcus aureus subsp. aureus Mu50
ccuaugauauaugcugca

SEQ ID NO: 3970528 - RNA, 16 nt, Staphylococcus aureus subsp. aureus Mu50
ccuaugccaaauaacg

SEQ ID NO: 3970529 - RNA, 20 nt, Staphylococcus aureus subsp. aureus Mu50
ccuaugccaaauaacguuaa

SEQ ID NO: 3970530 - RNA, 14 nt, Staphylococcus aureus subsp. aureus Mu50
ccuauuaauaucau

SEQ ID NO: 3970531 - RNA, 18 nt, Staphylococcus aureus subsp. aureus Mu50
ccuauuacacuaaaaccu

SEQ ID NO: 3970532 - RNA, 12 nt, Staphylococcus aureus subsp. aureus Mu50
ccuauuaggauc

SEQ ID NO: 3970533 - RNA, 13 nt, Staphylococcus aureus subsp. aureus Mu50
ccuauucccaaaa

SEQ ID NO: 3970534 - RNA, 16 nt, Staphylococcus aureus subsp. aureus Mu50
ccuauuguuuuuuaua

SEQ ID NO: 3970535 - RNA, 17 nt, Staphylococcus aureus subsp. aureus Mu50
ccuauuuaaaagacaau

SEQ ID NO: 3970536 - RNA, 22 nt, Staphylococcus aureus subsp. aureus Mu50
ccuauuugacacauuauugaaa

SEQ ID NO: 3970537 - RNA, 18 nt, Staphylococcus aureus subsp. aureus Mu50
ccuauuuguggaaauaaa

SEQ ID NO: 3970538 - RNA, 18 nt, Staphylococcus aureus subsp. aureus Mu50
ccucaauuaguucuggca

SEQ ID NO: 3970539 - RNA, 22 nt, Staphylococcus aureus subsp. aureus Mu50
ccucacuagauaguuuauacuu

SEQ ID NO: 3970540 - RNA, 15 nt, Staphylococcus aureus subsp. aureus Mu50
cgaugacuuuuuaau

SEQ ID NO: 3970541 - RNA, 19 nt, Staphylococcus aureus subsp. aureus Mu50
cgaugagcgcauaaauuuu

SEQ ID NO: 3970542 - RNA, 22 nt, Staphylococcus aureus subsp. aureus Mu50
cgauuaaaugaugcaguaaaac

SEQ ID NO: 3970543 - RNA, 17 nt, Staphylococcus aureus subsp. aureus Mu50
cgauuaauaaaauucua

SEQ ID NO: 3970544 - RNA, 19 nt, Staphylococcus aureus subsp. aureus Mu50
cgauuaauaguacagucau

SEQ ID NO: 3970545 - RNA, 13 nt, Staphylococcus aureus subsp. aureus Mu50
cgauucaaucuaa

SEQ ID NO: 3970546 - RNA, 14 nt, Staphylococcus aureus subsp. aureus Mu50
cgauucaaucuaau

SEQ ID NO: 3970547 - RNA, 17 nt, Staphylococcus aureus subsp. aureus Mu50
cgauucaauuuaacguu

SEQ ID NO: 3970548 - RNA, 13 nt, Staphylococcus aureus subsp. aureus Mu50
cgauugaugcguu

SEQ ID NO: 3970549 - RNA, 12 nt, Staphylococcus aureus subsp. aureus Mu50
cgauugcaauug

SEQ ID NO: 3970550 - RNA, 15 nt, Staphylococcus aureus subsp. aureus Mu50
cgauuguuucaccag

SEQ ID NO: 3970551 - RNA, 16 nt, Staphylococcus aureus subsp. aureus Mu50
cgauuuaucauuauuu

SEQ ID NO: 3970552 - RNA, 16 nt, Staphylococcus aureus subsp. aureus Mu50
cgauuuauuauuacca

SEQ ID NO: 3970553 - RNA, 21 nt, Staphylococcus aureus subsp. aureus Mu50
cgauuuauuuauaaaauaaaa

SEQ ID NO: 3970554 - RNA, 15 nt, Staphylococcus aureus subsp. aureus Mu50
cgauuuguucaauga

SEQ ID NO: 3970555 - RNA, 22 nt, Staphylococcus aureus subsp. aureus Mu50
cgauuuuaaaagauaaauaaaa

SEQ ID NO: 3970556 - RNA, 12 nt, Staphylococcus aureus subsp. aureus Mu50
cgauuuuaaaga

SEQ ID NO: 3970557 - RNA, 15 nt, Staphylococcus aureus subsp. aureus Mu50
cgauuuuaaagaaaa

SEQ ID NO: 3970558 - RNA, 13 nt, Staphylococcus aureus subsp. aureus Mu50
cgauuuucaagua

SEQ ID NO: 3970559 - RNA, 13 nt, Staphylococcus aureus subsp. aureus Mu50
cgauuuuuaaugc

SEQ ID NO: 3970560 - RNA, 19 nt, Staphylococcus aureus subsp. aureus Mu50
cgcaauaucauaccgacac

SEQ ID NO: 3970561 - RNA, 19 nt, Staphylococcus aureus subsp. aureus Mu50
cgcaaugauaucuuuucca

SEQ ID NO: 3970562 - RNA, 22 nt, Staphylococcus aureus subsp. aureus Mu50
cgcaaugauaucuuuuccaaaa

SEQ ID NO: 3970563 - RNA, 14 nt, Staphylococcus aureus subsp. aureus Mu50
cgcaaugucuugug

SEQ ID NO: 3970564 - RNA, 13 nt, Staphylococcus aureus subsp. aureus Mu50
cgcaauuaaaagu

SEQ ID NO: 3970565 - RNA, 14 nt, Staphylococcus aureus subsp. aureus Mu50
cgcaauuuaauauu

SEQ ID NO: 3970566 - RNA, 12 nt, Staphylococcus aureus subsp. aureus Mu50
cgcaauuuuuaa

SEQ ID NO: 3970567 - RNA, 16 nt, Staphylococcus aureus subsp. aureus Mu50
cgcaauuuuuaacaaa

SEQ ID NO: 3970568 - RNA, 15 nt, Staphylococcus aureus subsp. aureus Mu50
cgcagcuucuuuaac

SEQ ID NO: 3970569 - RNA, 18 nt, Staphylococcus aureus subsp. aureus Mu50
cgcauacuuuuucagaau

SEQ ID NO: 3970570 - RNA, 18 nt, Staphylococcus aureus subsp. aureus Mu50
cgcaucuccaaaggccau

SEQ ID NO: 3970571 - RNA, 20 nt, Staphylococcus aureus subsp. aureus Mu50
cgcaucuuuugguuuaucug

SEQ ID NO: 3970572 - RNA, 12 nt, Staphylococcus aureus subsp. aureus Mu50
cgcauuguugua

SEQ ID NO: 3970573 - RNA, 14 nt, Staphylococcus aureus subsp. aureus Mu50
cgcauuuaaauaua

SEQ ID NO: 3970574 - RNA, 18 nt, Staphylococcus aureus subsp. aureus Mu50
cgccaauuaaaauuuguu

SEQ ID NO: 3970575 - RNA, 15 nt, Staphylococcus aureus subsp. aureus Mu50
cgccacaacauguuu

SEQ ID NO: 3970576 - RNA, 14 nt, Staphylococcus aureus subsp. aureus Mu50
cgccacuaugugaa

SEQ ID NO: 3970577 - RNA, 20 nt, Staphylococcus aureus subsp. aureus Mu50
cgccauaaucuucauuaauu

SEQ ID NO: 3970578 - RNA, 16 nt, Staphylococcus aureus subsp. aureus Mu50
cgccaucaauauuuau

SEQ ID NO: 3970579 - RNA, 23 nt, Staphylococcus aureus subsp. aureus Mu50
cgccaugacguauacaaauugau

SEQ ID NO: 3970580 - RNA, 23 nt, Staphylococcus aureus subsp. aureus Mu50
cgccucaaacggagcaacgauac

SEQ ID NO: 3970581 - RNA, 20 nt, Staphylococcus aureus subsp. aureus Mu50
cgcgacguuuaaaugcccac

SEQ ID NO: 3970582 - RNA, 23 nt, Staphylococcus aureus subsp. aureus Mu50
cgcgauaaauaacuuuaccacca

SEQ ID NO: 3970583 - RNA, 15 nt, Staphylococcus aureus subsp. aureus Mu50
cgcgauaaauaauaa

SEQ ID NO: 3970584 - RNA, 22 nt, Staphylococcus aureus subsp. aureus Mu50
cgcgcuuauugaaaagauaaac

SEQ ID NO: 3970585 - RNA, 14 nt, Staphylococcus aureus subsp. aureus Mu50
cgcguauuccauug

SEQ ID NO: 3970586 - RNA, 19 nt, Staphylococcus aureus subsp. aureus Mu50
cgcgugccaacaucuucaa

SEQ ID NO: 3970587 - RNA, 14 nt, Staphylococcus aureus subsp. aureus Mu50
cgcuacaaaacaua

SEQ ID NO: 3970588 - RNA, 20 nt, Staphylococcus aureus subsp. aureus Mu50
cgcuagugcgcgauaaauaa

SEQ ID NO: 3970589 - RNA, 22 nt, Staphylococcus aureus subsp. aureus Mu50
cgcuauauguaaagcuaauuuu

SEQ ID NO: 3970590 - RNA, 14 nt, Staphylococcus aureus subsp. aureus Mu50
cgcucuuuucaaaa

SEQ ID NO: 3970591 - RNA, 22 nt, Staphylococcus aureus subsp. aureus Mu50
cgcugccauuaaacgaaugauu

SEQ ID NO: 3970592 - RNA, 17 nt, Staphylococcus aureus subsp. aureus Mu50
cgcuguuucaagcguuu

SEQ ID NO: 3970593 - RNA, 15 nt, Staphylococcus aureus subsp. aureus Mu50
cgcuuaaaaugauug

SEQ ID NO: 3970594 - RNA, 23 nt, Staphylococcus aureus subsp. aureus Mu50
cgcuuaacccuaaagcuaaugca

SEQ ID NO: 3970595 - RNA, 22 nt, Staphylococcus aureus subsp. aureus Mu50
cgcuuagauaaauuaauaugaa

SEQ ID NO: 3970596 - RNA, 14 nt, Staphylococcus aureus subsp. aureus Mu50
cgcuuauuuuacua

SEQ ID NO: 3970597 - RNA, 14 nt, Staphylococcus aureus subsp. aureus Mu50
cgcuucuaacucac

SEQ ID NO: 3970598 - RNA, 14 nt, Staphylococcus aureus subsp. aureus Mu50
cgcuucuucuucag

SEQ ID NO: 3970599 - RNA, 15 nt, Staphylococcus aureus subsp. aureus Mu50
cgcuucuucuucaga

SEQ ID NO: 3970600 - RNA, 15 nt, Staphylococcus aureus subsp. aureus Mu50
cgcuuggauuuuuug

SEQ ID NO: 3970601 - RNA, 11 nt, Staphylococcus aureus subsp. aureus Mu50
cgcuuuauuac

SEQ ID NO: 3970602 - RNA, 17 nt, Staphylococcus aureus subsp. aureus Mu50
cgcuuuauuacuuuaau

SEQ ID NO: 3970603 - RNA, 17 nt, Staphylococcus aureus subsp. aureus Mu50
cgcuuuauucuucccaa

SEQ ID NO: 3970604 - RNA, 13 nt, Staphylococcus aureus subsp. aureus Mu50
cgcuuuugaaguu

SEQ ID NO: 3970605 - RNA, 22 nt, Staphylococcus aureus subsp. aureus Mu50
cgcuuuugaaguugguccaaau

SEQ ID NO: 3970606 - RNA, 18 nt, Staphylococcus aureus subsp. aureus Mu50
cgcuuuuuuuuauaaguu

SEQ ID NO: 3970607 - RNA, 13 nt, Staphylococcus aureus subsp. aureus Mu50
cggaaauacaaug

SEQ ID NO: 3970608 - RNA, 21 nt, Staphylococcus aureus subsp. aureus Mu50
cggaagauaggauuuacaccu

SEQ ID NO: 3970609 - RNA, 21 nt, Staphylococcus aureus subsp. aureus Mu50
cggaagauaggauuugcaccu

SEQ ID NO: 3970610 - RNA, 21 nt, Staphylococcus aureus subsp. aureus Mu50
cggaagcauauuucuaaauua

SEQ ID NO: 3970611 - RNA, 12 nt, Staphylococcus aureus subsp. aureus Mu50
cggaauaaaaua

SEQ ID NO: 3970612 - RNA, 16 nt, Staphylococcus aureus subsp. aureus Mu50
cggaauucaaccaauu

SEQ ID NO: 3970613 - RNA, 21 nt, Staphylococcus aureus subsp. aureus Mu50
cggaauugguuuuuagugaaa

SEQ ID NO: 3970614 - RNA, 22 nt, Staphylococcus aureus subsp. aureus Mu50
cggaccuuguaaauuuaaaugu

SEQ ID NO: 3970615 - RNA, 13 nt, Staphylococcus aureus subsp. aureus Mu50
cggacugaaagaa

SEQ ID NO: 3970616 - RNA, 10 nt, Staphylococcus aureus subsp. aureus Mu50
cggacugaug

SEQ ID NO: 3970617 - RNA, 19 nt, Staphylococcus aureus subsp. aureus Mu50
cggaucauuauuuagaauu

SEQ ID NO: 3970618 - RNA, 22 nt, Staphylococcus aureus subsp. aureus Mu50
cggaucauuauuuagaauucua

SEQ ID NO: 3970619 - RNA, 16 nt, Staphylococcus aureus subsp. aureus Mu50
cggauuaacauuaucc

SEQ ID NO: 3970620 - RNA, 16 nt, Staphylococcus aureus subsp. aureus Mu50
cggcacauucauaccg

SEQ ID NO: 3970621 - RNA, 22 nt, Staphylococcus aureus subsp. aureus Mu50
cggcacauucauaccgaagaaa

SEQ ID NO: 3970622 - RNA, 13 nt, Staphylococcus aureus subsp. aureus Mu50
cggcccauaauag

SEQ ID NO: 3970623 - RNA, 16 nt, Staphylococcus aureus subsp. aureus Mu50
cgggcuauauuugaua

SEQ ID NO: 3970624 - RNA, 17 nt, Staphylococcus aureus subsp. aureus Mu50
cggggaauuuuuaugca

SEQ ID NO: 3970625 - RNA, 21 nt, Staphylococcus aureus subsp. aureus Mu50
cggggccccaacaaaaagaau

SEQ ID NO: 3970626 - RNA, 19 nt, Staphylococcus aureus subsp. aureus Mu50
cggggccccaacaaagaag

SEQ ID NO: 3970627 - RNA, 17 nt, Staphylococcus aureus subsp. aureus Mu50
cggggccccaacacaga

SEQ ID NO: 3970628 - RNA, 18 nt, Staphylococcus aureus subsp. aureus Mu50
cguugguugugauuuguu

SEQ ID NO: 3970629 - RNA, 20 nt, Staphylococcus aureus subsp. aureus Mu50
cguugugcagcaacugcauu

SEQ ID NO: 3970630 - RNA, 23 nt, Staphylococcus aureus subsp. aureus Mu50
cguuguucauaaucauaauaaga

SEQ ID NO: 3970631 - RNA, 11 nt, Staphylococcus aureus subsp. aureus Mu50
cguuguugaaa

SEQ ID NO: 3970632 - RNA, 12 nt, Staphylococcus aureus subsp. aureus Mu50
cguuuaauaaug

SEQ ID NO: 3970633 - RNA, 16 nt, Staphylococcus aureus subsp. aureus Mu50
cguuuaauaccuauga

SEQ ID NO: 3970634 - RNA, 21 nt, Staphylococcus aureus subsp. aureus Mu50
cguuuaaucacaucuuuuuga

SEQ ID NO: 3970635 - RNA, 12 nt, Staphylococcus aureus subsp. aureus Mu50
cguuuauaucuu

SEQ ID NO: 3970636 - RNA, 23 nt, Staphylococcus aureus subsp. aureus Mu50
cguuucaaugaguucuaguuuuu

SEQ ID NO: 3970637 - RNA, 21 nt, Staphylococcus aureus subsp. aureus Mu50
cguuucagaaguuguuuagaa

SEQ ID NO: 3970638 - RNA, 21 nt, Staphylococcus aureus subsp. aureus Mu50
cguuucgucagauucaaacgu

SEQ ID NO: 3970639 - RNA, 19 nt, Staphylococcus aureus subsp. aureus Mu50
cguuugaagaauguuucau

SEQ ID NO: 3970640 - RNA, 12 nt, Staphylococcus aureus subsp. aureus Mu50
cguuuuaauaaa

SEQ ID NO: 3970641 - RNA, 14 nt, Staphylococcus aureus subsp. aureus Mu50
cguuuuauauuuau

SEQ ID NO: 3970642 - RNA, 15 nt, Staphylococcus aureus subsp. aureus Mu50
cguuuuauauuuauu

SEQ ID NO: 3970643 - RNA, 12 nt, Staphylococcus aureus subsp. aureus Mu50
cguuuuccauga

SEQ ID NO: 3970644 - RNA, 15 nt, Staphylococcus aureus subsp. aureus Mu50
cguuuucuaauuguu

SEQ ID NO: 3970645 - RNA, 19 nt, Staphylococcus aureus subsp. aureus Mu50
cguuuugcuaaccaucaua

SEQ ID NO: 3970646 - RNA, 13 nt, Staphylococcus aureus subsp. aureus Mu50
cguuuuguagaua

SEQ ID NO: 3970647 - RNA, 14 nt, Staphylococcus aureus subsp. aureus Mu50
cguuuuuaaauaau

SEQ ID NO: 3970648 - RNA, 20 nt, Staphylococcus aureus subsp. aureus Mu50
cguuuuuugguucuauaauu

SEQ ID NO: 3970649 - RNA, 13 nt, Staphylococcus aureus subsp. aureus Mu50
cguuuuuuuaaau

SEQ ID NO: 3970650 - RNA, 15 nt, Staphylococcus aureus subsp. aureus Mu50
cuaaaaaaauuaaaa

SEQ ID NO: 3970651 - RNA, 13 nt, Staphylococcus aureus subsp. aureus Mu50
cuaaaaacauaaa

SEQ ID NO: 3970652 - RNA, 13 nt, Staphylococcus aureus subsp. aureus Mu50
cuaaaaacuguga

SEQ ID NO: 3970653 - RNA, 21 nt, Staphylococcus aureus subsp. aureus Mu50
cuaaaaagcgugguucccaau

SEQ ID NO: 3970654 - RNA, 22 nt, Staphylococcus aureus subsp. aureus Mu50
cuaaaaaguacuuuuuaauucc

SEQ ID NO: 3970655 - RNA, 18 nt, Staphylococcus aureus subsp. aureus Mu50
cuaaaaauauugaauaau

SEQ ID NO: 3970656 - RNA, 23 nt, Staphylococcus aureus subsp. aureus Mu50
cuaaaaaugucguauauguaauc

SEQ ID NO: 3970657 - RNA, 11 nt, Staphylococcus aureus subsp. aureus Mu50
cuaaaacaaau

SEQ ID NO: 3970658 - RNA, 20 nt, Staphylococcus aureus subsp. aureus Mu50
cuaaaaccuauuccuaauaa

SEQ ID NO: 3970659 - RNA, 17 nt, Staphylococcus aureus subsp. aureus Mu50
cuaaaacggaaauaacc

SEQ ID NO: 3970660 - RNA, 21 nt, Staphylococcus aureus subsp. aureus Mu50
cuaaaacggaaauaaccacca

SEQ ID NO: 3970661 - RNA, 14 nt, Staphylococcus aureus subsp. aureus Mu50
cuaaaagaauuauu

SEQ ID NO: 3970662 - RNA, 14 nt, Staphylococcus aureus subsp. aureus Mu50
cuaaaaguuguaau

SEQ ID NO: 3970663 - RNA, 18 nt, Staphylococcus aureus subsp. aureus Mu50
cuaaaaguuguaauuuaa

SEQ ID NO: 3970664 - RNA, 21 nt, Staphylococcus aureus subsp. aureus Mu50
cuaaaaguuguaauuuaaaau

SEQ ID NO: 3970665 - RNA, 13 nt, Staphylococcus aureus subsp. aureus Mu50
cuaaaauaacaac

SEQ ID NO: 3970666 - RNA, 18 nt, Staphylococcus aureus subsp. aureus Mu50
cuaaaauacccauuuuuu

SEQ ID NO: 3970667 - RNA, 21 nt, Staphylococcus aureus subsp. aureus Mu50
cuaaaauagaaaaauuucaaa

SEQ ID NO: 3970668 - RNA, 12 nt, Staphylococcus aureus subsp. aureus Mu50
cuaaaauaucaa

SEQ ID NO: 3970669 - RNA, 18 nt, Staphylococcus aureus subsp. aureus Mu50
cuaaaauaucaaaauaua

SEQ ID NO: 3970670 - RNA, 17 nt, Staphylococcus aureus subsp. aureus Mu50
cuaaaauucuuucagcu

SEQ ID NO: 3970671 - RNA, 15 nt, Staphylococcus aureus subsp. aureus Mu50
cuaaacaaaggggau

SEQ ID NO: 3970672 - RNA, 18 nt, Staphylococcus aureus subsp. aureus Mu50
cuaaacaaugaugggaaa

SEQ ID NO: 3970673 - RNA, 20 nt, Staphylococcus aureus subsp. aureus Mu50
cuaaacauuuuugugcaaaa

SEQ ID NO: 3970674 - RNA, 15 nt, Staphylococcus aureus subsp. aureus Mu50
cuaaaccauugaaug

SEQ ID NO: 3970675 - RNA, 18 nt, Staphylococcus aureus subsp. aureus Mu50
cuaaaccgauuaauauaa

SEQ ID NO: 3970676 - RNA, 15 nt, Staphylococcus aureus subsp. aureus Mu50
cuaaaccucaacauu

SEQ ID NO: 3970677 - RNA, 15 nt, Staphylococcus aureus subsp. aureus Mu50
cuaaaccucuaaaua

SEQ ID NO: 3970678 - RNA, 16 nt, Staphylococcus aureus subsp. aureus Mu50
cuaaaccucuaaauaa

SEQ ID NO: 3970679 - RNA, 17 nt, Staphylococcus aureus subsp. aureus Mu50
cuaaaccucuaaauaaa

SEQ ID NO: 3970680 - RNA, 18 nt, Staphylococcus aureus subsp. aureus Mu50
cuaaaccuuuuuuaaguu

SEQ ID NO: 3970681 - RNA, 17 nt, Staphylococcus aureus subsp. aureus Mu50
cuaaacgcaauacgaau

SEQ ID NO: 3970682 - RNA, 21 nt, Staphylococcus aureus subsp. aureus Mu50
cuaaacgcaauacgaauaucu

SEQ ID NO: 3970683 - RNA, 15 nt, Staphylococcus aureus subsp. aureus Mu50
cuaaacgcuaaaauu

SEQ ID NO: 3970684 - RNA, 20 nt, Staphylococcus aureus subsp. aureus Mu50
cuaaacucguugcacucuuu

SEQ ID NO: 3970685 - RNA, 19 nt, Staphylococcus aureus subsp. aureus Mu50
cuaaacuucuauuaauaau

SEQ ID NO: 3970686 - RNA, 20 nt, Staphylococcus aureus subsp. aureus Mu50
cuaaagaaugacguuaucau

SEQ ID NO: 3970687 - RNA, 14 nt, Staphylococcus aureus subsp. aureus Mu50
cuaaagauauagaa

SEQ ID NO: 3970688 - RNA, 17 nt, Staphylococcus aureus subsp. aureus Mu50
cuaaagcgauuuccauc

SEQ ID NO: 3970689 - RNA, 16 nt, Staphylococcus aureus subsp. aureus Mu50
cuaaagcuaauacacc

SEQ ID NO: 3970690 - RNA, 14 nt, Staphylococcus aureus subsp. aureus Mu50
cuaaagcuaaugca

SEQ ID NO: 3970691 - RNA, 15 nt, Staphylococcus aureus subsp. aureus Mu50
cuaaagcuaaugcaa

SEQ ID NO: 3970692 - RNA, 24 nt, Staphylococcus aureus subsp. aureus Mu50
cuaaagcuauaaaaaaucuuuuga

SEQ ID NO: 3970693 - RNA, 22 nt, Staphylococcus aureus subsp. aureus Mu50
cuaaagggacaggcguaucugu

SEQ ID NO: 3970694 - RNA, 13 nt, Staphylococcus aureus subsp. aureus Mu50
cuaaagguaacuu

SEQ ID NO: 3970695 - RNA, 18 nt, Staphylococcus aureus subsp. aureus Mu50
cuaaagguauucuauuuu

SEQ ID NO: 3970696 - RNA, 14 nt, Staphylococcus aureus subsp. aureus Mu50
cuaaaguaaauaac

SEQ ID NO: 3970697 - RNA, 15 nt, Staphylococcus aureus subsp. aureus Mu50
cuaaaguaaauaaca

SEQ ID NO: 3970698 - RNA, 17 nt, Staphylococcus aureus subsp. aureus Mu50
cuaaagucgucucaaua

SEQ ID NO: 3970699 - RNA, 19 nt, Staphylococcus aureus subsp. aureus Mu50
cuaaaguguagccaaauaa

SEQ ID NO: 3970700 - RNA, 19 nt, Staphylococcus aureus subsp. aureus Mu50
cuaaaguuauaaauuauau

SEQ ID NO: 3970701 - RNA, 21 nt, Staphylococcus aureus subsp. aureus Mu50
cuaaaguuauaaauuauauuu

SEQ ID NO: 3970702 - RNA, 14 nt, Staphylococcus aureus subsp. aureus Mu50
cuaaauaaaauuaa

SEQ ID NO: 3970703 - RNA, 22 nt, Staphylococcus aureus subsp. aureus Mu50
cuaaauaaaauuaaaacagcaa

SEQ ID NO: 3970704 - RNA, 23 nt, Staphylococcus aureus subsp. aureus Mu50
cuaaauaguagacgguaucaucu

SEQ ID NO: 3970705 - RNA, 23 nt, Staphylococcus aureus subsp. aureus Mu50
cuaaauaguuuuucauauucaca

SEQ ID NO: 3970706 - RNA, 11 nt, Staphylococcus aureus subsp. aureus Mu50
cuaaauauaua

SEQ ID NO: 3970707 - RNA, 15 nt, Staphylococcus aureus subsp. aureus Mu50
cuaaauauuaaauua

SEQ ID NO: 3970708 - RNA, 17 nt, Staphylococcus aureus subsp. aureus Mu50
cuaaauauuaaauuauu

SEQ ID NO: 3970709 - RNA, 21 nt, Staphylococcus aureus subsp. aureus Mu50
cuaaaugaauugcuuguucuu

SEQ ID NO: 3970710 - RNA, 23 nt, Staphylococcus aureus subsp. aureus Mu50
cuaaaugcacgagcaacaucuuu

SEQ ID NO: 3970711 - RNA, 13 nt, Staphylococcus aureus subsp. aureus Mu50
cuaaauuaaaagu

SEQ ID NO: 3970712 - RNA, 18 nt, Staphylococcus aureus subsp. aureus Mu50
cuaaauucaauaaucuua

SEQ ID NO: 3970713 - RNA, 19 nt, Staphylococcus aureus subsp. aureus Mu50
cuaaauucaauaaucuuag

SEQ ID NO: 3970714 - RNA, 22 nt, Staphylococcus aureus subsp. aureus Mu50
cuaaauucaguucaaacagaaa

SEQ ID NO: 3970715 - RNA, 16 nt, Staphylococcus aureus subsp. aureus Mu50
cuaaauucuuuuuguu

SEQ ID NO: 3970716 - RNA, 17 nt, Staphylococcus aureus subsp. aureus Mu50
cuaauuugcaaaaucaa

SEQ ID NO: 3970717 - RNA, 18 nt, Staphylococcus aureus subsp. aureus Mu50
cuaauuugcaaaaucaac

SEQ ID NO: 3970718 - RNA, 14 nt, Staphylococcus aureus subsp. aureus Mu50
cuaauuuguuaguu

SEQ ID NO: 3970719 - RNA, 23 nt, Staphylococcus aureus subsp. aureus Mu50
cuaauuuugugaauuuauuuugu

SEQ ID NO: 3970720 - RNA, 13 nt, Staphylococcus aureus subsp. aureus Mu50
cuaauuuuuucau

SEQ ID NO: 3970721 - RNA, 23 nt, Staphylococcus aureus subsp. aureus Mu50
cuacaaaguuuauacuuaauaua

SEQ ID NO: 3970722 - RNA, 17 nt, Staphylococcus aureus subsp. aureus Mu50
cuacaacuguuggaaua

SEQ ID NO: 3970723 - RNA, 14 nt, Staphylococcus aureus subsp. aureus Mu50
cuacaacuucuucu

SEQ ID NO: 3970724 - RNA, 16 nt, Staphylococcus aureus subsp. aureus Mu50
cuacaauauagaaaau

SEQ ID NO: 3970725 - RNA, 22 nt, Staphylococcus aureus subsp. aureus Mu50
cuacaaucauaccggcaaauaa

SEQ ID NO: 3970726 - RNA, 22 nt, Staphylococcus aureus subsp. aureus Mu50
cuacaauccuauggcgcaauuu

SEQ ID NO: 3970727 - RNA, 16 nt, Staphylococcus aureus subsp. aureus Mu50
cuacaauuauaaauga

SEQ ID NO: 3970728 - RNA, 19 nt, Staphylococcus aureus subsp. aureus Mu50
cuacacuguuuuauaaaug

SEQ ID NO: 3970729 - RNA, 21 nt, Staphylococcus aureus subsp. aureus Mu50
cuacagaauggauaccuaaag

SEQ ID NO: 3970730 - RNA, 15 nt, Staphylococcus aureus subsp. aureus Mu50
cuacagagaaucaau

SEQ ID NO: 3970731 - RNA, 17 nt, Staphylococcus aureus subsp. aureus Mu50
cuacagauaaagcuucg

SEQ ID NO: 3970732 - RNA, 18 nt, Staphylococcus aureus subsp. aureus Mu50
cuacagauuuuaaaaauu

SEQ ID NO: 3970733 - RNA, 13 nt, Staphylococcus aureus subsp. aureus Mu50
cuacagcacugaa

SEQ ID NO: 3970734 - RNA, 23 nt, Staphylococcus aureus subsp. aureus Mu50
cuacagcacugaaaucuagaccu

SEQ ID NO: 3970735 - RNA, 17 nt, Staphylococcus aureus subsp. aureus Mu50
cuacaggcaaugcaagu

SEQ ID NO: 3970736 - RNA, 15 nt, Staphylococcus aureus subsp. aureus Mu50
cuacaguguaugaug

SEQ ID NO: 3970737 - RNA, 18 nt, Staphylococcus aureus subsp. aureus Mu50
cuacauacaacucguuuu

SEQ ID NO: 3970738 - RNA, 22 nt, Staphylococcus aureus subsp. aureus Mu50
cuacauacaacucguuuuucca

SEQ ID NO: 3970739 - RNA, 20 nt, Staphylococcus aureus subsp. aureus Mu50
cuacauuaaagaaaauaucu

SEQ ID NO: 3970740 - RNA, 17 nt, Staphylococcus aureus subsp. aureus Mu50
cuacauuauuacugauu

SEQ ID NO: 3970741 - RNA, 13 nt, Staphylococcus aureus subsp. aureus Mu50
cuaccaauaauuc

SEQ ID NO: 3970742 - RNA, 14 nt, Staphylococcus aureus subsp. aureus Mu50
cuaccaauaauucc

SEQ ID NO: 3970743 - RNA, 19 nt, Staphylococcus aureus subsp. aureus Mu50
cuacccguuuuuugguucu

SEQ ID NO: 3970744 - RNA, 14 nt, Staphylococcus aureus subsp. aureus Mu50
cuaccgauuguuaa

SEQ ID NO: 3970745 - RNA, 22 nt, Staphylococcus aureus subsp. aureus Mu50
cuaccgauuguuaauuuaaagu

SEQ ID NO: 3970746 - RNA, 14 nt, Staphylococcus aureus subsp. aureus Mu50
cuaccgcuaaaauu

SEQ ID NO: 3970747 - RNA, 21 nt, Staphylococcus aureus subsp. aureus Mu50
cuaccuacuuguucaauacuu

SEQ ID NO: 3970748 - RNA, 13 nt, Staphylococcus aureus subsp. aureus Mu50
cuaccuuccauuu

SEQ ID NO: 3970749 - RNA, 16 nt, Staphylococcus aureus subsp. aureus Mu50
cuacgaaguuauauug

SEQ ID NO: 3970750 - RNA, 23 nt, Staphylococcus aureus subsp. aureus Mu50
cuacgauuuucaagaccaaauau

SEQ ID NO: 3970751 - RNA, 16 nt, Staphylococcus aureus subsp. aureus Mu50
cuacgcauuuuaaaua

SEQ ID NO: 3970752 - RNA, 22 nt, Staphylococcus aureus subsp. aureus Mu50
cuacgccuugaccuacuuuuuc

SEQ ID NO: 3970753 - RNA, 16 nt, Staphylococcus aureus subsp. aureus Mu50
cuacgcugaugaauga

SEQ ID NO: 3970754 - RNA, 24 nt, Staphylococcus aureus subsp. aureus Mu50
cuacguguguaguagcaccgauuu

SEQ ID NO: 3970755 - RNA, 16 nt, Staphylococcus aureus subsp. aureus Mu50
cuacuaagcguuuaau

SEQ ID NO: 3970756 - RNA, 17 nt, Staphylococcus aureus subsp. aureus Mu50
cuacuaauauauuaauu

SEQ ID NO: 3970757 - RNA, 15 nt, Staphylococcus aureus subsp. aureus Mu50
cuacuaaucguugug

SEQ ID NO: 3970758 - RNA, 22 nt, Staphylococcus aureus subsp. aureus Mu50
cuacuaaucguuguggcuuuuu

SEQ ID NO: 3970759 - RNA, 13 nt, Staphylococcus aureus subsp. aureus Mu50
cuacuaaucuuag

SEQ ID NO: 3970760 - RNA, 15 nt, Staphylococcus aureus subsp. aureus Mu50
cuacuaaucuuuuuu

SEQ ID NO: 3970761 - RNA, 21 nt, Staphylococcus aureus subsp. aureus Mu50
cuacuaaucuuuuuuuaauua

SEQ ID NO: 3970762 - RNA, 21 nt, Staphylococcus aureus subsp. aureus Mu50
cuacuauaaauacgucaucuu

SEQ ID NO: 3970763 - RNA, 14 nt, Staphylococcus aureus subsp. aureus Mu50
cuacuauuaaauaa

SEQ ID NO: 3970764 - RNA, 16 nt, Staphylococcus aureus subsp. aureus Mu50
cuacuauuuaaucuua

SEQ ID NO: 3970765 - RNA, 23 nt, Staphylococcus aureus subsp. aureus Mu50
cuacugcaccgauaucauauaau

SEQ ID NO: 3970766 - RNA, 14 nt, Staphylococcus aureus subsp. aureus Mu50
cuacugcuugugug

SEQ ID NO: 3970767 - RNA, 20 nt, Staphylococcus aureus subsp. aureus Mu50
cuacugcuugugugaaauua

SEQ ID NO: 3970768 - RNA, 12 nt, Staphylococcus aureus subsp. aureus Mu50
cuacuuaaauua

SEQ ID NO: 3970769 - RNA, 18 nt, Staphylococcus aureus subsp. aureus Mu50
cuacuuaauuaauaauuu

SEQ ID NO: 3970770 - RNA, 20 nt, Staphylococcus aureus subsp. aureus Mu50
cuacuuaauuaauaauuuaa

SEQ ID NO: 3970771 - RNA, 19 nt, Staphylococcus aureus subsp. aureus Mu50
cuacuucguuuacgauacg

SEQ ID NO: 3970772 - RNA, 14 nt, Staphylococcus aureus subsp. aureus Mu50
cuacuuguucaaua

SEQ ID NO: 3970773 - RNA, 15 nt, Staphylococcus aureus subsp. aureus Mu50
cuacuuuauaaauau

SEQ ID NO: 3970774 - RNA, 19 nt, Staphylococcus aureus subsp. aureus Mu50
cuacuuugaagggagcauu

SEQ ID NO: 3970775 - RNA, 22 nt, Staphylococcus aureus subsp. aureus Mu50
cuacuuugaagggagcauuuca

SEQ ID NO: 3970776 - RNA, 15 nt, Staphylococcus aureus subsp. aureus Mu50
cuacuuugucugcaa

SEQ ID NO: 3970777 - RNA, 17 nt, Staphylococcus aureus subsp. aureus Mu50
cuacuuuuucaacugua

SEQ ID NO: 3970778 - RNA, 14 nt, Staphylococcus aureus subsp. aureus Mu50
cuagaaaacauaaa

SEQ ID NO: 3970779 - RNA, 19 nt, Staphylococcus aureus subsp. aureus Mu50
cuagaaaacauaaauacaa

SEQ ID NO: 3970780 - RNA, 22 nt, Staphylococcus aureus subsp. aureus Mu50
cuagaaaacauaaauacaaaaa

SEQ ID NO: 3970781 - RNA, 18 nt, Staphylococcus aureus subsp. aureus Mu50
cuagaaagaccauuguau

SEQ ID NO: 3970782 - RNA, 21 nt, Staphylococcus aureus subsp. aureus Mu50
cuagaaaguaaugcuguacua

SEQ ID NO: 3970783 - RNA, 17 nt, Staphylococcus aureus subsp. aureus Mu50
cuagaaauccucuuaua

SEQ ID NO: 3970784 - RNA, 22 nt, Staphylococcus aureus subsp. aureus Mu50
cuagaacuuaguacguaucauu

SEQ ID NO: 3970785 - RNA, 12 nt, Staphylococcus aureus subsp. aureus Mu50
cuagaauauaac

SEQ ID NO: 3970786 - RNA, 17 nt, Staphylococcus aureus subsp. aureus Mu50
cuagagauaacuagaau

SEQ ID NO: 3970787 - RNA, 19 nt, Staphylococcus aureus subsp. aureus Mu50
cuagagcguuuugcuuuag

SEQ ID NO: 3970788 - RNA, 18 nt, Staphylococcus aureus subsp. aureus Mu50
cuagauaccaaacugccu

SEQ ID NO: 3970789 - RNA, 15 nt, Staphylococcus aureus subsp. aureus Mu50
cuagauuuuaaauca

SEQ ID NO: 3970790 - RNA, 16 nt, Staphylococcus aureus subsp. aureus Mu50
cuagauuuuaaaucaa

SEQ ID NO: 3970791 - RNA, 12 nt, Staphylococcus aureus subsp. aureus Mu50
cuagcaaaugca

SEQ ID NO: 3970792 - RNA, 18 nt, Staphylococcus aureus subsp. aureus Mu50
cuagcaacugaucauuuu

SEQ ID NO: 3970793 - RNA, 19 nt, Staphylococcus aureus subsp. aureus Mu50
cuagcaagaauagauugau

SEQ ID NO: 3970794 - RNA, 14 nt, Staphylococcus aureus subsp. aureus Mu50
cuagcauaucuuua

SEQ ID NO: 3970795 - RNA, 17 nt, Staphylococcus aureus subsp. aureus Mu50
cuagcauaucuuuauca

SEQ ID NO: 3970796 - RNA, 14 nt, Staphylococcus aureus subsp. aureus Mu50
cuagccugaaauag

SEQ ID NO: 3970797 - RNA, 18 nt, Staphylococcus aureus subsp. aureus Mu50
cuagcggaacguaaguuu

SEQ ID NO: 3970798 - RNA, 23 nt, Staphylococcus aureus subsp. aureus Mu50
cuagcuaagauacuuuuaaauua

SEQ ID NO: 3970799 - RNA, 22 nt, Staphylococcus aureus subsp. aureus Mu50
cuagcuaaugcacgugagaaac

SEQ ID NO: 3970800 - RNA, 16 nt, Staphylococcus aureus subsp. aureus Mu50
cuaggaauauaaaacu

SEQ ID NO: 3970801 - RNA, 16 nt, Staphylococcus aureus subsp. aureus Mu50
cuaggauuaaaagcau

SEQ ID NO: 3970802 - RNA, 14 nt, Staphylococcus aureus subsp. aureus Mu50
cuaggguuaaaauu

SEQ ID NO: 3970803 - RNA, 15 nt, Staphylococcus aureus subsp. aureus Mu50
cuauggucaucaauu

SEQ ID NO: 3970804 - RNA, 16 nt, Staphylococcus aureus subsp. aureus Mu50
cuauguaaaauuauug

SEQ ID NO: 3970805 - RNA, 12 nt, Staphylococcus aureus subsp. aureus Mu50
cuauguaacuuu

SEQ ID NO: 3970806 - RNA, 17 nt, Staphylococcus aureus subsp. aureus Mu50
cuauuaaacauuuuuga

SEQ ID NO: 3970807 - RNA, 19 nt, Staphylococcus aureus subsp. aureus Mu50
cuauuaaacauuuuugaau

SEQ ID NO: 3970808 - RNA, 12 nt, Staphylococcus aureus subsp. aureus Mu50
cuauuaaauaau

SEQ ID NO: 3970809 - RNA, 17 nt, Staphylococcus aureus subsp. aureus Mu50
cuauuaauuacgucaua

SEQ ID NO: 3970810 - RNA, 19 nt, Staphylococcus aureus subsp. aureus Mu50
cuauuaauuacgucauaaa

SEQ ID NO: 3970811 - RNA, 13 nt, Staphylococcus aureus subsp. aureus Mu50
cuauuaauuuacu

SEQ ID NO: 3970812 - RNA, 16 nt, Staphylococcus aureus subsp. aureus Mu50
cuauuaauuugauaaa

SEQ ID NO: 3970813 - RNA, 15 nt, Staphylococcus aureus subsp. aureus Mu50
cuauuacuacauaau

SEQ ID NO: 3970814 - RNA, 18 nt, Staphylococcus aureus subsp. aureus Mu50
cuauuacuacauaauuua

SEQ ID NO: 3970815 - RNA, 19 nt, Staphylococcus aureus subsp. aureus Mu50
cuauuacuauaaaaaacag

SEQ ID NO: 3970816 - RNA, 18 nt, Staphylococcus aureus subsp. aureus Mu50
cuauuaggauccaauuca

SEQ ID NO: 3970817 - RNA, 18 nt, Staphylococcus aureus subsp. aureus Mu50
cuauuaggauccaauuua

SEQ ID NO: 3970818 - RNA, 19 nt, Staphylococcus aureus subsp. aureus Mu50
cuauuaucgaagaaacauu

SEQ ID NO: 3970819 - RNA, 22 nt, Staphylococcus aureus subsp. aureus Mu50
cuauuauuauguuauaaauucu

SEQ ID NO: 3970820 - RNA, 15 nt, Staphylococcus aureus subsp. aureus Mu50
cuauucacgaacauu

SEQ ID NO: 3970821 - RNA, 19 nt, Staphylococcus aureus subsp. aureus Mu50
cuauucauagaccuaugaa

SEQ ID NO: 3970822 - RNA, 20 nt, Staphylococcus aureus subsp. aureus Mu50
cuauuccuauuacuacauaa

SEQ ID NO: 3970823 - RNA, 17 nt, Staphylococcus aureus subsp. aureus Mu50
cuauugauauucuaaaa

SEQ ID NO: 3970824 - RNA, 19 nt, Staphylococcus aureus subsp. aureus Mu50
cuauugauauucuaaaaaa

SEQ ID NO: 3970825 - RNA, 17 nt, Staphylococcus aureus subsp. aureus Mu50
cuauuggucauuacuaa

SEQ ID NO: 3970826 - RNA, 17 nt, Staphylococcus aureus subsp. aureus Mu50
cuauuuaaaagacaauc

SEQ ID NO: 3970827 - RNA, 19 nt, Staphylococcus aureus subsp. aureus Mu50
cuauuuaucauacuucaaa

SEQ ID NO: 3970828 - RNA, 14 nt, Staphylococcus aureus subsp. aureus Mu50
cuauuuauugagau

SEQ ID NO: 3970829 - RNA, 17 nt, Staphylococcus aureus subsp. aureus Mu50
cuauuuauugagauaga

SEQ ID NO: 3970830 - RNA, 21 nt, Staphylococcus aureus subsp. aureus Mu50
cuauuucaacaaacauaaaua

SEQ ID NO: 3970831 - RNA, 17 nt, Staphylococcus aureus subsp. aureus Mu50
cuauuucacucuacaau

SEQ ID NO: 3970832 - RNA, 14 nt, Staphylococcus aureus subsp. aureus Mu50
cuauuuguggaaau

SEQ ID NO: 3970833 - RNA, 23 nt, Staphylococcus aureus subsp. aureus Mu50
cuauuuguuaugguauuuauaga

SEQ ID NO: 3970834 - RNA, 13 nt, Staphylococcus aureus subsp. aureus Mu50
cuauuuuauacau

SEQ ID NO: 3970835 - RNA, 16 nt, Staphylococcus aureus subsp. aureus Mu50
cuauuuuauacauaaa

SEQ ID NO: 3970836 - RNA, 21 nt, Staphylococcus aureus subsp. aureus Mu50
cuauuuuccaucacauaacua

SEQ ID NO: 3970837 - RNA, 11 nt, Staphylococcus aureus subsp. aureus Mu50
cuauuuuuaau

SEQ ID NO: 3970838 - RNA, 14 nt, Staphylococcus aureus subsp. aureus Mu50
cuauuuuuaaugua

SEQ ID NO: 3970839 - RNA, 18 nt, Staphylococcus aureus subsp. aureus Mu50
cuauuuuucgauuuugag

SEQ ID NO: 3970840 - RNA, 19 nt, Staphylococcus aureus subsp. aureus Mu50
cuauuuuucgauuuugaga

SEQ ID NO: 3970841 - RNA, 17 nt, Staphylococcus aureus subsp. aureus Mu50
cuauuuuugauuuaaua

SEQ ID NO: 3970842 - RNA, 19 nt, Staphylococcus aureus subsp. aureus Mu50
cuauuuuuuauguuuuaau

SEQ ID NO: 3970843 - RNA, 14 nt, Staphylococcus aureus subsp. aureus Mu50
cucaaaacaauuua

SEQ ID NO: 3970844 - RNA, 20 nt, Staphylococcus aureus subsp. aureus Mu50
cucaaaagcuguaguuucaa

SEQ ID NO: 3970845 - RNA, 18 nt, Staphylococcus aureus subsp. aureus Mu50
cucaaagaaacuauagau

SEQ ID NO: 3970846 - RNA, 20 nt, Staphylococcus aureus subsp. aureus Mu50
cucaaagguuuacuauuaaa

SEQ ID NO: 3970847 - RNA, 17 nt, Staphylococcus aureus subsp. aureus Mu50
cucaacacgauagucau

SEQ ID NO: 3970848 - RNA, 17 nt, Staphylococcus aureus subsp. aureus Mu50
cucaacauuaaaaugug

SEQ ID NO: 3970849 - RNA, 20 nt, Staphylococcus aureus subsp. aureus Mu50
cucaacgggaacaucauaau

SEQ ID NO: 3970850 - RNA, 17 nt, Staphylococcus aureus subsp. aureus Mu50
cucaacuugccuggcaa

SEQ ID NO: 3970851 - RNA, 18 nt, Staphylococcus aureus subsp. aureus Mu50
cucaaguaacucaaguga

SEQ ID NO: 3970852 - RNA, 16 nt, Staphylococcus aureus subsp. aureus Mu50
cucaagugauuuccca

SEQ ID NO: 3970853 - RNA, 23 nt, Staphylococcus aureus subsp. aureus Mu50
cucaagugauuucccacgugccu

SEQ ID NO: 3970854 - RNA, 22 nt, Staphylococcus aureus subsp. aureus Mu50
cucaaugauuguaauaucuaaa

SEQ ID NO: 3970855 - RNA, 18 nt, Staphylococcus aureus subsp. aureus Mu50
cucaaugcauuuaauuua

SEQ ID NO: 3970856 - RNA, 18 nt, Staphylococcus aureus subsp. aureus Mu50
cucaaugugagauauaaa

SEQ ID NO: 3970857 - RNA, 15 nt, Staphylococcus aureus subsp. aureus Mu50
cucaauuaauuuagu

SEQ ID NO: 3970858 - RNA, 18 nt, Staphylococcus aureus subsp. aureus Mu50
cucaauucucuaacuuua

SEQ ID NO: 3970859 - RNA, 21 nt, Staphylococcus aureus subsp. aureus Mu50
cucaauuuaguauaaauaaaa

SEQ ID NO: 3970860 - RNA, 23 nt, Staphylococcus aureus subsp. aureus Mu50
cucaauuuaguauaaauaaaaau

SEQ ID NO: 3970861 - RNA, 16 nt, Staphylococcus aureus subsp. aureus Mu50
cucaauuucauuugaa

SEQ ID NO: 3970862 - RNA, 12 nt, Staphylococcus aureus subsp. aureus Mu50
cucacaugugaa

SEQ ID NO: 3970863 - RNA, 13 nt, Staphylococcus aureus subsp. aureus Mu50
cucacaugugaaa

SEQ ID NO: 3970864 - RNA, 11 nt, Staphylococcus aureus subsp. aureus Mu50
cucacauuaag

SEQ ID NO: 3970865 - RNA, 13 nt, Staphylococcus aureus subsp. aureus Mu50
cucaccaaguuca

SEQ ID NO: 3970866 - RNA, 23 nt, Staphylococcus aureus subsp. aureus Mu50
cucaccuuuagacaauauuuuua

SEQ ID NO: 3970867 - RNA, 15 nt, Staphylococcus aureus subsp. aureus Mu50
cucacgauuaauaaa

SEQ ID NO: 3970868 - RNA, 17 nt, Staphylococcus aureus subsp. aureus Mu50
cucacugcacuuaugau

SEQ ID NO: 3970869 - RNA, 13 nt, Staphylococcus aureus subsp. aureus Mu50
cucacuuaauaaa

SEQ ID NO: 3970870 - RNA, 16 nt, Staphylococcus aureus subsp. aureus Mu50
cucacuucuuaaaaua

SEQ ID NO: 3970871 - RNA, 13 nt, Staphylococcus aureus subsp. aureus Mu50
cucagugcauuuu

SEQ ID NO: 3970872 - RNA, 15 nt, Staphylococcus aureus subsp. aureus Mu50
cucagugcauuuuuu

SEQ ID NO: 3970873 - RNA, 18 nt, Staphylococcus aureus subsp. aureus Mu50
cucauaaccgcuucuuuu

SEQ ID NO: 3970874 - RNA, 14 nt, Staphylococcus aureus subsp. aureus Mu50
cucauaaucaaguc

SEQ ID NO: 3970875 - RNA, 14 nt, Staphylococcus aureus subsp. aureus Mu50
cucauaauuaucau

SEQ ID NO: 3970876 - RNA, 19 nt, Staphylococcus aureus subsp. aureus Mu50
cucauaauuaucauauaaa

SEQ ID NO: 3970877 - RNA, 15 nt, Staphylococcus aureus subsp. aureus Mu50
cucauacaaauuuuu

SEQ ID NO: 3970878 - RNA, 19 nt, Staphylococcus aureus subsp. aureus Mu50
cucauaccaaaaacauuaa

SEQ ID NO: 3970879 - RNA, 21 nt, Staphylococcus aureus subsp. aureus Mu50
cucauacuauaagcaauuucu

SEQ ID NO: 3970880 - RNA, 14 nt, Staphylococcus aureus subsp. aureus Mu50
cucauagucaucuu

SEQ ID NO: 3970881 - RNA, 15 nt, Staphylococcus aureus subsp. aureus Mu50
cucauagucaucuua

SEQ ID NO: 3970882 - RNA, 16 nt, Staphylococcus aureus subsp. aureus Mu50
cucauaucuauuuuuc

SEQ ID NO: 3970883 - RNA, 18 nt, Staphylococcus aureus subsp. aureus Mu50
cucaucccucuaucaaau

SEQ ID NO: 3970884 - RNA, 18 nt, Staphylococcus aureus subsp. aureus Mu50
cucaucuaauuuaugaau

SEQ ID NO: 3970885 - RNA, 17 nt, Staphylococcus aureus subsp. aureus Mu50
cucaucuacuauuuaau

SEQ ID NO: 3970886 - RNA, 14 nt, Staphylococcus aureus subsp. aureus Mu50
cucaucuauuuaau

SEQ ID NO: 3970887 - RNA, 19 nt, Staphylococcus aureus subsp. aureus Mu50
cucaucuauuuaauaaugu

SEQ ID NO: 3970888 - RNA, 21 nt, Staphylococcus aureus subsp. aureus Mu50
cucaucuguccgauaucuuuu

SEQ ID NO: 3970889 - RNA, 22 nt, Staphylococcus aureus subsp. aureus Mu50
cucaugcauaagaaauacuaau

SEQ ID NO: 3970890 - RNA, 14 nt, Staphylococcus aureus subsp. aureus Mu50
cucauguuucagua

SEQ ID NO: 3970891 - RNA, 13 nt, Staphylococcus aureus subsp. aureus Mu50
cucuuuuaaauuc

SEQ ID NO: 3970892 - RNA, 23 nt, Staphylococcus aureus subsp. aureus Mu50
cucuuuuaccucugauaaaugaa

SEQ ID NO: 3970893 - RNA, 20 nt, Staphylococcus aureus subsp. aureus Mu50
cucuuuucacgaauaucuua

SEQ ID NO: 3970894 - RNA, 13 nt, Staphylococcus aureus subsp. aureus Mu50
cugaaaaaauuaa

SEQ ID NO: 3970895 - RNA, 13 nt, Staphylococcus aureus subsp. aureus Mu50
cugaaaaacuucu

SEQ ID NO: 3970896 - RNA, 15 nt, Staphylococcus aureus subsp. aureus Mu50
cugaaaaacuucuua

SEQ ID NO: 3970897 - RNA, 23 nt, Staphylococcus aureus subsp. aureus Mu50
cugaaaaacuucuuaacuugaaa

SEQ ID NO: 3970898 - RNA, 17 nt, Staphylococcus aureus subsp. aureus Mu50
cugaaaagaauaaguug

SEQ ID NO: 3970899 - RNA, 18 nt, Staphylococcus aureus subsp. aureus Mu50
cugaaaagaauaaguugu

SEQ ID NO: 3970900 - RNA, 13 nt, Staphylococcus aureus subsp. aureus Mu50
cugaaaauaucac

SEQ ID NO: 3970901 - RNA, 21 nt, Staphylococcus aureus subsp. aureus Mu50
cugaaacuaaauuaaaagugu

SEQ ID NO: 3970902 - RNA, 12 nt, Staphylococcus aureus subsp. aureus Mu50
cugaaauuuuuu

SEQ ID NO: 3970903 - RNA, 20 nt, Staphylococcus aureus subsp. aureus Mu50
cugaaauuuuuuagugaaaa

SEQ ID NO: 3970904 - RNA, 15 nt, Staphylococcus aureus subsp. aureus Mu50
cugaacauaaaaaau

SEQ ID NO: 3970905 - RNA, 23 nt, Staphylococcus aureus subsp. aureus Mu50
cugaagaacgaucuguccauuua

SEQ ID NO: 3970906 - RNA, 20 nt, Staphylococcus aureus subsp. aureus Mu50
cugaagacaccuuaucacuu

SEQ ID NO: 3970907 - RNA, 17 nt, Staphylococcus aureus subsp. aureus Mu50
cugaagcgcuuggauuu

SEQ ID NO: 3970908 - RNA, 20 nt, Staphylococcus aureus subsp. aureus Mu50
cugaaggagacauuucccau

SEQ ID NO: 3970909 - RNA, 23 nt, Staphylococcus aureus subsp. aureus Mu50
cugaaguuaucggcuaaaguuau

SEQ ID NO: 3970910 - RNA, 14 nt, Staphylococcus aureus subsp. aureus Mu50
cugaauaaaauaua

SEQ ID NO: 3970911 - RNA, 13 nt, Staphylococcus aureus subsp. aureus Mu50
cugaauaaauaac

SEQ ID NO: 3970912 - RNA, 21 nt, Staphylococcus aureus subsp. aureus Mu50
cugaaucugaagguaauuuaa

SEQ ID NO: 3970913 - RNA, 23 nt, Staphylococcus aureus subsp. aureus Mu50
cugaauguucgaagauuuuuuuc

SEQ ID NO: 3970914 - RNA, 18 nt, Staphylococcus aureus subsp. aureus Mu50
cugaauuaauauccaaaa

SEQ ID NO: 3970915 - RNA, 19 nt, Staphylococcus aureus subsp. aureus Mu50
cugaauuaauauccaaaau

SEQ ID NO: 3970916 - RNA, 17 nt, Staphylococcus aureus subsp. aureus Mu50
cugaauuagauuuuguu

SEQ ID NO: 3970917 - RNA, 23 nt, Staphylococcus aureus subsp. aureus Mu50
cugaauuuuaacuaagauuagua

SEQ ID NO: 3970918 - RNA, 18 nt, Staphylococcus aureus subsp. aureus Mu50
cugacauuucaucaauaa

SEQ ID NO: 3970919 - RNA, 12 nt, Staphylococcus aureus subsp. aureus Mu50
cugacuaauaaa

SEQ ID NO: 3970920 - RNA, 15 nt, Staphylococcus aureus subsp. aureus Mu50
cugacucuuaauuuu

SEQ ID NO: 3970921 - RNA, 18 nt, Staphylococcus aureus subsp. aureus Mu50
cugacuuuccaccagccu

SEQ ID NO: 3970922 - RNA, 19 nt, Staphylococcus aureus subsp. aureus Mu50
cugacuuuuaaaaaacaua

SEQ ID NO: 3970923 - RNA, 18 nt, Staphylococcus aureus subsp. aureus Mu50
cugagaaaaauauuucua

SEQ ID NO: 3970924 - RNA, 20 nt, Staphylococcus aureus subsp. aureus Mu50
cugagaaaaauauuucuaau

SEQ ID NO: 3970925 - RNA, 23 nt, Staphylococcus aureus subsp. aureus Mu50
cugagcaacaaaagauguugcuc

SEQ ID NO: 3970926 - RNA, 18 nt, Staphylococcus aureus subsp. aureus Mu50
cugagcuuuaauuuuuug

SEQ ID NO: 3970927 - RNA, 18 nt, Staphylococcus aureus subsp. aureus Mu50
cugaguauaccaauugcu

SEQ ID NO: 3970928 - RNA, 13 nt, Staphylococcus aureus subsp. aureus Mu50
cugaguucaauua

SEQ ID NO: 3970929 - RNA, 15 nt, Staphylococcus aureus subsp. aureus Mu50
cugaguuuuaaugaa

SEQ ID NO: 3970930 - RNA, 15 nt, Staphylococcus aureus subsp. aureus Mu50
cugauaauuuuucuu

SEQ ID NO: 3970931 - RNA, 20 nt, Staphylococcus aureus subsp. aureus Mu50
cugauacuucaucuguauca

SEQ ID NO: 3970932 - RNA, 18 nt, Staphylococcus aureus subsp. aureus Mu50
cugauauugaucugauuu

SEQ ID NO: 3970933 - RNA, 17 nt, Staphylococcus aureus subsp. aureus Mu50
cugaucgcauguuugua

SEQ ID NO: 3970934 - RNA, 14 nt, Staphylococcus aureus subsp. aureus Mu50
cugaucguaacauu

SEQ ID NO: 3970935 - RNA, 22 nt, Staphylococcus aureus subsp. aureus Mu50
cugaugcuagcuuucuuuuuca

SEQ ID NO: 3970936 - RNA, 20 nt, Staphylococcus aureus subsp. aureus Mu50
cugaugcuucgaauuuaaca

SEQ ID NO: 3970937 - RNA, 22 nt, Staphylococcus aureus subsp. aureus Mu50
cugauguaccacucauaaucaa

SEQ ID NO: 3970938 - RNA, 15 nt, Staphylococcus aureus subsp. aureus Mu50
cugauguguuauguu

SEQ ID NO: 3970939 - RNA, 17 nt, Staphylococcus aureus subsp. aureus Mu50
cugauguuugcauaccu

SEQ ID NO: 3970940 - RNA, 20 nt, Staphylococcus aureus subsp. aureus Mu50
cugauuacauauacgacauu

SEQ ID NO: 3970941 - RNA, 16 nt, Staphylococcus aureus subsp. aureus Mu50
cugauucgauggauac

SEQ ID NO: 3970942 - RNA, 16 nt, Staphylococcus aureus subsp. aureus Mu50
cugauucuucacuaaa

SEQ ID NO: 3970943 - RNA, 20 nt, Staphylococcus aureus subsp. aureus Mu50
cugauugcugcuguacaauu

SEQ ID NO: 3970944 - RNA, 22 nt, Staphylococcus aureus subsp. aureus Mu50
cugcaaaauguuacacaaauua

SEQ ID NO: 3970945 - RNA, 19 nt, Staphylococcus aureus subsp. aureus Mu50
cugcaaacacaguacaaau

SEQ ID NO: 3970946 - RNA, 20 nt, Staphylococcus aureus subsp. aureus Mu50
cugcaaauacgaguguuuua

SEQ ID NO: 3970947 - RNA, 16 nt, Staphylococcus aureus subsp. aureus Mu50
cugcaaaugccucuuu

SEQ ID NO: 3970948 - RNA, 22 nt, Staphylococcus aureus subsp. aureus Mu50
cugcaagucguucucuuaaaua

SEQ ID NO: 3970949 - RNA, 16 nt, Staphylococcus aureus subsp. aureus Mu50
cugcaaucguugaaaa

SEQ ID NO: 3970950 - RNA, 17 nt, Staphylococcus aureus subsp. aureus Mu50
cugcaauuauuuuucaa

SEQ ID NO: 3970951 - RNA, 21 nt, Staphylococcus aureus subsp. aureus Mu50
cugcaauuauuuuucaaauau

SEQ ID NO: 3970952 - RNA, 19 nt, Staphylococcus aureus subsp. aureus Mu50
cugcaauuuguaauacaag

SEQ ID NO: 3970953 - RNA, 17 nt, Staphylococcus aureus subsp. aureus Mu50
cugcacaucauaauaaa

SEQ ID NO: 3970954 - RNA, 18 nt, Staphylococcus aureus subsp. aureus Mu50
cugcacaucauaauaaau

SEQ ID NO: 3970955 - RNA, 13 nt, Staphylococcus aureus subsp. aureus Mu50
cugcaccaagaaa

SEQ ID NO: 3970956 - RNA, 18 nt, Staphylococcus aureus subsp. aureus Mu50
cugcaccgauaucauaua

SEQ ID NO: 3970957 - RNA, 17 nt, Staphylococcus aureus subsp. aureus Mu50
cugcaccuccaaccgcu

SEQ ID NO: 3970958 - RNA, 16 nt, Staphylococcus aureus subsp. aureus Mu50
cugcacuuaugauacu

SEQ ID NO: 3970959 - RNA, 13 nt, Staphylococcus aureus subsp. aureus Mu50
cugcagcaauuac

SEQ ID NO: 3970960 - RNA, 12 nt, Staphylococcus aureus subsp. aureus Mu50
cugcagucgcuu

SEQ ID NO: 3970961 - RNA, 17 nt, Staphylococcus aureus subsp. aureus Mu50
cugcaugggcuucugcu

SEQ ID NO: 3970962 - RNA, 16 nt, Staphylococcus aureus subsp. aureus Mu50
cugccaaaaugguuaa

SEQ ID NO: 3970963 - RNA, 18 nt, Staphylococcus aureus subsp. aureus Mu50
cugccaauaaaaugcaau

SEQ ID NO: 3970964 - RNA, 13 nt, Staphylococcus aureus subsp. aureus Mu50
cugccauauguuu

SEQ ID NO: 3970965 - RNA, 20 nt, Staphylococcus aureus subsp. aureus Mu50
cugccauuaaacgaaugauu

SEQ ID NO: 3970966 - RNA, 18 nt, Staphylococcus aureus subsp. aureus Mu50
cugcuaaaauaaaauuaa

SEQ ID NO: 3970967 - RNA, 15 nt, Staphylococcus aureus subsp. aureus Mu50
cugcuaauuuuuuca

SEQ ID NO: 3970968 - RNA, 20 nt, Staphylococcus aureus subsp. aureus Mu50
cugcugcuaaaauaaaauua

SEQ ID NO: 3970969 - RNA, 22 nt, Staphylococcus aureus subsp. aureus Mu50
cugcuguucuuuuuauuuacuc

SEQ ID NO: 3970970 - RNA, 16 nt, Staphylococcus aureus subsp. aureus Mu50
cugcuuaucauuacuu

SEQ ID NO: 3970971 - RNA, 18 nt, Staphylococcus aureus subsp. aureus Mu50
cugcuucaacuacuucau

SEQ ID NO: 3970972 - RNA, 16 nt, Staphylococcus aureus subsp. aureus Mu50
cugcuucuaaaacauc

SEQ ID NO: 3970973 - RNA, 18 nt, Staphylococcus aureus subsp. aureus Mu50
cugcuucuacccuugcaa

SEQ ID NO: 3970974 - RNA, 21 nt, Staphylococcus aureus subsp. aureus Mu50
cuggaaaugauaauuuaauaa

SEQ ID NO: 3970975 - RNA, 18 nt, Staphylococcus aureus subsp. aureus Mu50
cuggaacuuuaauaccag

SEQ ID NO: 3970976 - RNA, 13 nt, Staphylococcus aureus subsp. aureus Mu50
cuggaauaaaucg

SEQ ID NO: 3970977 - RNA, 16 nt, Staphylococcus aureus subsp. aureus Mu50
cuggaauaccuaauuc

SEQ ID NO: 3970978 - RNA, 18 nt, Staphylococcus aureus subsp. aureus Mu50
cuggaauauuaacaccag

SEQ ID NO: 3970979 - RNA, 21 nt, Staphylococcus aureus subsp. aureus Mu50
cuggcaaauugccuuucauuu

SEQ ID NO: 3970980 - RNA, 19 nt, Staphylococcus aureus subsp. aureus Mu50
cuggcucuucuuaucuuuu

SEQ ID NO: 3970981 - RNA, 14 nt, Staphylococcus aureus subsp. aureus Mu50
cugggaaugguugu

SEQ ID NO: 3970982 - RNA, 13 nt, Staphylococcus aureus subsp. aureus Mu50
cugggacauuaau

SEQ ID NO: 3970983 - RNA, 15 nt, Staphylococcus aureus subsp. aureus Mu50
cuggggaagaccauu

SEQ ID NO: 3970984 - RNA, 19 nt, Staphylococcus aureus subsp. aureus Mu50
cuggguuaccaaguaauga

SEQ ID NO: 3970985 - RNA, 20 nt, Staphylococcus aureus subsp. aureus Mu50
cuggguuaccaaguaaugau

SEQ ID NO: 3970986 - RNA, 19 nt, Staphylococcus aureus subsp. aureus Mu50
cuggguuuuaccauaaauu

SEQ ID NO: 3970987 - RNA, 16 nt, Staphylococcus aureus subsp. aureus Mu50
cugguaaauguugaua

SEQ ID NO: 3970988 - RNA, 18 nt, Staphylococcus aureus subsp. aureus Mu50
cugguacauaaauaccug

SEQ ID NO: 3970989 - RNA, 23 nt, Staphylococcus aureus subsp. aureus Mu50
cugguauuuuaugacguaauuaa

SEQ ID NO: 3970990 - RNA, 21 nt, Staphylococcus aureus subsp. aureus Mu50
cuggugguaacguaaacaugg

SEQ ID NO: 3970991 - RNA, 13 nt, Staphylococcus aureus subsp. aureus Mu50
cuguaaaacauuc

SEQ ID NO: 3970992 - RNA, 23 nt, Staphylococcus aureus subsp. aureus Mu50
cuguaaaacauucccuuaauaau

SEQ ID NO: 3970993 - RNA, 13 nt, Staphylococcus aureus subsp. aureus Mu50
cuguaaagcuauc

SEQ ID NO: 3970994 - RNA, 18 nt, Staphylococcus aureus subsp. aureus Mu50
cuguaaagcuauccaugu

SEQ ID NO: 3970995 - RNA, 17 nt, Staphylococcus aureus subsp. aureus Mu50
cuguaaaucaucauaac

SEQ ID NO: 3970996 - RNA, 17 nt, Staphylococcus aureus subsp. aureus Mu50
cuguaaauuaucuaaag

SEQ ID NO: 3970997 - RNA, 16 nt, Staphylococcus aureus subsp. aureus Mu50
cuguaacaaagucucu

SEQ ID NO: 3970998 - RNA, 16 nt, Staphylococcus aureus subsp. aureus Mu50
cuguaacauaaacaau

SEQ ID NO: 3970999 - RNA, 21 nt, Staphylococcus aureus subsp. aureus Mu50
cuguaacauaaacaauaacug

SEQ ID NO: 3971000 - RNA, 23 nt, Staphylococcus aureus subsp. aureus Mu50
cuguaacauaaacaauaacuguu

SEQ ID NO: 3971001 - RNA, 17 nt, Staphylococcus aureus subsp. aureus Mu50
cuguaaccaaaagaaau

SEQ ID NO: 3971002 - RNA, 17 nt, Staphylococcus aureus subsp. aureus Mu50
cuguaacgaguccauuu

SEQ ID NO: 3971003 - RNA, 23 nt, Staphylococcus aureus subsp. aureus Mu50
cuguaauaaagaauaaacaacau

SEQ ID NO: 3971004 - RNA, 14 nt, Staphylococcus aureus subsp. aureus Mu50
cuguaauaccuuua

SEQ ID NO: 3971005 - RNA, 19 nt, Staphylococcus aureus subsp. aureus Mu50
cuguacauccacuuuauaa

SEQ ID NO: 3971006 - RNA, 19 nt, Staphylococcus aureus subsp. aureus Mu50
cuguaccaucacuaaagua

SEQ ID NO: 3971007 - RNA, 20 nt, Staphylococcus aureus subsp. aureus Mu50
cuguaccguauuuuaauauu

SEQ ID NO: 3971008 - RNA, 21 nt, Staphylococcus aureus subsp. aureus Mu50
cuguaccguuuuuuauaaauc

SEQ ID NO: 3971009 - RNA, 12 nt, Staphylococcus aureus subsp. aureus Mu50
cuguaccugcua

SEQ ID NO: 3971010 - RNA, 13 nt, Staphylococcus aureus subsp. aureus Mu50
cuguacuauauuc

SEQ ID NO: 3971011 - RNA, 19 nt, Staphylococcus aureus subsp. aureus Mu50
cuguacuuuuauguuguua

SEQ ID NO: 3971012 - RNA, 22 nt, Staphylococcus aureus subsp. aureus Mu50
cuguacuuuuauguuguuauaa

SEQ ID NO: 3971013 - RNA, 22 nt, Staphylococcus aureus subsp. aureus Mu50
cuguagacaauuguaguaauga

SEQ ID NO: 3971014 - RNA, 23 nt, Staphylococcus aureus subsp. aureus Mu50
cuguagacaauuguaguaaugaa

SEQ ID NO: 3971015 - RNA, 14 nt, Staphylococcus aureus subsp. aureus Mu50
cuguagauaucaaa

SEQ ID NO: 3971016 - RNA, 18 nt, Staphylococcus aureus subsp. aureus Mu50
cuguagcgauaccuuuaa

SEQ ID NO: 3971017 - RNA, 19 nt, Staphylococcus aureus subsp. aureus Mu50
cuguaguuucaacuuuuga

SEQ ID NO: 3971018 - RNA, 13 nt, Staphylococcus aureus subsp. aureus Mu50
cuguauaaauaac

SEQ ID NO: 3971019 - RNA, 22 nt, Staphylococcus aureus subsp. aureus Mu50
cuguauacgacgucgcaacagg

SEQ ID NO: 3971020 - RNA, 11 nt, Staphylococcus aureus subsp. aureus Mu50
cuguauauaua

SEQ ID NO: 3971021 - RNA, 20 nt, Staphylococcus aureus subsp. aureus Mu50
cuguauauauauguaaauga

SEQ ID NO: 3971022 - RNA, 22 nt, Staphylococcus aureus subsp. aureus Mu50
cuguaucaaaaucgguuugauu

SEQ ID NO: 3971023 - RNA, 22 nt, Staphylococcus aureus subsp. aureus Mu50
cuguaugccgccuaauaauaaa

SEQ ID NO: 3971024 - RNA, 20 nt, Staphylococcus aureus subsp. aureus Mu50
cuguaugcgguuauaucauu

SEQ ID NO: 3971025 - RNA, 16 nt, Staphylococcus aureus subsp. aureus Mu50
cuguauuuaauaaacc

SEQ ID NO: 3971026 - RNA, 12 nt, Staphylococcus aureus subsp. aureus Mu50
cuguauuuacua

SEQ ID NO: 3971027 - RNA, 13 nt, Staphylococcus aureus subsp. aureus Mu50
cugucauuuucug

SEQ ID NO: 3971028 - RNA, 15 nt, Staphylococcus aureus subsp. aureus Mu50
cugucauuuucugcu

SEQ ID NO: 3971029 - RNA, 12 nt, Staphylococcus aureus subsp. aureus Mu50
cugucccaagcu

SEQ ID NO: 3971030 - RNA, 18 nt, Staphylococcus aureus subsp. aureus Mu50
cuguccgaggcuaauuuu

SEQ ID NO: 3971031 - RNA, 14 nt, Staphylococcus aureus subsp. aureus Mu50
cuguccgauuuuua

SEQ ID NO: 3971032 - RNA, 15 nt, Staphylococcus aureus subsp. aureus Mu50
cugucgcucauccuc

SEQ ID NO: 3971033 - RNA, 16 nt, Staphylococcus aureus subsp. aureus Mu50
cugucuaaaaacauaa

SEQ ID NO: 3971034 - RNA, 16 nt, Staphylococcus aureus subsp. aureus Mu50
cugucucauuaaugua

SEQ ID NO: 3971035 - RNA, 19 nt, Staphylococcus aureus subsp. aureus Mu50
cugucuuaauucauuccaa

SEQ ID NO: 3971036 - RNA, 15 nt, Staphylococcus aureus subsp. aureus Mu50
cugugauaaaaaucu

SEQ ID NO: 3971037 - RNA, 14 nt, Staphylococcus aureus subsp. aureus Mu50
cuguguacguuuca

SEQ ID NO: 3971038 - RNA, 13 nt, Staphylococcus aureus subsp. aureus Mu50
cuguguaucauca

SEQ ID NO: 3971039 - RNA, 14 nt, Staphylococcus aureus subsp. aureus Mu50
cugugugcuguucu

SEQ ID NO: 3971040 - RNA, 15 nt, Staphylococcus aureus subsp. aureus Mu50
cuguguuggggccca

SEQ ID NO: 3971041 - RNA, 20 nt, Staphylococcus aureus subsp. aureus Mu50
cuguguuggggcccacaccc

SEQ ID NO: 3971042 - RNA, 14 nt, Staphylococcus aureus subsp. aureus Mu50
cuguuaauaaauca

SEQ ID NO: 3971043 - RNA, 16 nt, Staphylococcus aureus subsp. aureus Mu50
cuguuaauaaaucauu

SEQ ID NO: 3971044 - RNA, 16 nt, Staphylococcus aureus subsp. aureus Mu50
cuguuacacuuuucuu

SEQ ID NO: 3971045 - RNA, 23 nt, Staphylococcus aureus subsp. aureus Mu50
cuguuaugaaguauccuuauuug

SEQ ID NO: 3971046 - RNA, 16 nt, Staphylococcus aureus subsp. aureus Mu50
cuguuauugcaauaaa

SEQ ID NO: 3971047 - RNA, 20 nt, Staphylococcus aureus subsp. aureus Mu50
cuguuauugcaauaaaauua

SEQ ID NO: 3971048 - RNA, 20 nt, Staphylococcus aureus subsp. aureus Mu50
cuguuccaccagucguaaug

SEQ ID NO: 3971049 - RNA, 13 nt, Staphylococcus aureus subsp. aureus Mu50
cuguucuauucca

SEQ ID NO: 3971050 - RNA, 15 nt, Staphylococcus aureus subsp. aureus Mu50
cuguugacauuugac

SEQ ID NO: 3971051 - RNA, 16 nt, Staphylococcus aureus subsp. aureus Mu50
cuguugcaguuucaau

SEQ ID NO: 3971052 - RNA, 20 nt, Staphylococcus aureus subsp. aureus Mu50
cuguuggaauaccuuuuucu

SEQ ID NO: 3971053 - RNA, 21 nt, Staphylococcus aureus subsp. aureus Mu50
cuguuggaauaccuuuuucua

SEQ ID NO: 3971054 - RNA, 20 nt, Staphylococcus aureus subsp. aureus Mu50
cuguuuaugagcuuaauaaa

SEQ ID NO: 3971055 - RNA, 17 nt, Staphylococcus aureus subsp. aureus Mu50
cuguuucacguaaugaa

SEQ ID NO: 3971056 - RNA, 19 nt, Staphylococcus aureus subsp. aureus Mu50
cuguuugagauauauuaau

SEQ ID NO: 3971057 - RNA, 18 nt, Staphylococcus aureus subsp. aureus Mu50
cuguuuuaucuacaguuu

SEQ ID NO: 3971058 - RNA, 19 nt, Staphylococcus aureus subsp. aureus Mu50
cuguuuugcgguuuuuuug

SEQ ID NO: 3971059 - RNA, 12 nt, Staphylococcus aureus subsp. aureus Mu50
cuuaaaaacaau

SEQ ID NO: 3971060 - RNA, 19 nt, Staphylococcus aureus subsp. aureus Mu50
cuuaaaaacgcuuuuaaac

SEQ ID NO: 3971061 - RNA, 22 nt, Staphylococcus aureus subsp. aureus Mu50
cuuaaaagacauccacagaauu

SEQ ID NO: 3971062 - RNA, 18 nt, Staphylococcus aureus subsp. aureus Mu50
cuuaaaauaugauuuaaa

SEQ ID NO: 3971063 - RNA, 17 nt, Staphylococcus aureus subsp. aureus Mu50
cuuaaaaugauuguuuu

SEQ ID NO: 3971064 - RNA, 14 nt, Staphylococcus aureus subsp. aureus Mu50
cuuaaaauuuaaau

SEQ ID NO: 3971065 - RNA, 13 nt, Staphylococcus aureus subsp. aureus Mu50
cuuaguacaaaau

SEQ ID NO: 3971066 - RNA, 23 nt, Staphylococcus aureus subsp. aureus Mu50
cuuaguacacguguauuguauuu

SEQ ID NO: 3971067 - RNA, 22 nt, Staphylococcus aureus subsp. aureus Mu50
cuuaguagauuuauuaaauaua

SEQ ID NO: 3971068 - RNA, 18 nt, Staphylococcus aureus subsp. aureus Mu50
cuuagucaauguauauuu

SEQ ID NO: 3971069 - RNA, 18 nt, Staphylococcus aureus subsp. aureus Mu50
cuuaguuuagguugauuu

SEQ ID NO: 3971070 - RNA, 22 nt, Staphylococcus aureus subsp. aureus Mu50
cuuaguuuagguugauuucugc

SEQ ID NO: 3971071 - RNA, 16 nt, Staphylococcus aureus subsp. aureus Mu50
cuuaguuugacaucua

SEQ ID NO: 3971072 - RNA, 19 nt, Staphylococcus aureus subsp. aureus Mu50
cuuaguuugacaucuauuu

SEQ ID NO: 3971073 - RNA, 14 nt, Staphylococcus aureus subsp. aureus Mu50
cuuauaaaaaacaa

SEQ ID NO: 3971074 - RNA, 15 nt, Staphylococcus aureus subsp. aureus Mu50
cuuauaaacaaaaga

SEQ ID NO: 3971075 - RNA, 14 nt, Staphylococcus aureus subsp. aureus Mu50
cuuauaacauucuu

SEQ ID NO: 3971076 - RNA, 21 nt, Staphylococcus aureus subsp. aureus Mu50
cuuauaacauucuucaaaaaa

SEQ ID NO: 3971077 - RNA, 16 nt, Staphylococcus aureus subsp. aureus Mu50
cuuauacguuacggcu

SEQ ID NO: 3971078 - RNA, 22 nt, Staphylococcus aureus subsp. aureus Mu50
cuuaucaaaaccgcuauaaaau

SEQ ID NO: 3971079 - RNA, 18 nt, Staphylococcus aureus subsp. aureus Mu50
cuuaucaacagcuucaaa

SEQ ID NO: 3971080 - RNA, 22 nt, Staphylococcus aureus subsp. aureus Mu50
cuuaucaauuagccaauaccga

SEQ ID NO: 3971081 - RNA, 20 nt, Staphylococcus aureus subsp. aureus Mu50
cuuaucaguuugcacuucaa

SEQ ID NO: 3971082 - RNA, 14 nt, Staphylococcus aureus subsp. aureus Mu50
cuuaucaucacacu

SEQ ID NO: 3971083 - RNA, 14 nt, Staphylococcus aureus subsp. aureus Mu50
cuuaucauuacuug

SEQ ID NO: 3971084 - RNA, 15 nt, Staphylococcus aureus subsp. aureus Mu50
cuuaucauuucaaau

SEQ ID NO: 3971085 - RNA, 18 nt, Staphylococcus aureus subsp. aureus Mu50
cuuaucauuucaaauaag

SEQ ID NO: 3971086 - RNA, 21 nt, Staphylococcus aureus subsp. aureus Mu50
cuuaucuuuaugauaauuaau

SEQ ID NO: 3971087 - RNA, 13 nt, Staphylococcus aureus subsp. aureus Mu50
cuuaugacugcuu

SEQ ID NO: 3971088 - RNA, 18 nt, Staphylococcus aureus subsp. aureus Mu50
cuuaugauacugauauuu

SEQ ID NO: 3971089 - RNA, 15 nt, Staphylococcus aureus subsp. aureus Mu50
cuuaugaugucaugu

SEQ ID NO: 3971090 - RNA, 15 nt, Staphylococcus aureus subsp. aureus Mu50
cuuaugcauagcucu

SEQ ID NO: 3971091 - RNA, 18 nt, Staphylococcus aureus subsp. aureus Mu50
cuuaugggggauuuuuuu

SEQ ID NO: 3971092 - RNA, 18 nt, Staphylococcus aureus subsp. aureus Mu50
cuuauggguucaauaucg

SEQ ID NO: 3971093 - RNA, 20 nt, Staphylococcus aureus subsp. aureus Mu50
cuuauguggaggacacauuu

SEQ ID NO: 3971094 - RNA, 21 nt, Staphylococcus aureus subsp. aureus Mu50
cuuauuaaaaaagaacauaaa

SEQ ID NO: 3971095 - RNA, 20 nt, Staphylococcus aureus subsp. aureus Mu50
cuuauuaaauaagaugaaau

SEQ ID NO: 3971096 - RNA, 17 nt, Staphylococcus aureus subsp. aureus Mu50
cuuauuauuaauuccuu

SEQ ID NO: 3971097 - RNA, 13 nt, Staphylococcus aureus subsp. aureus Mu50
cuuauuauuuugu

SEQ ID NO: 3971098 - RNA, 20 nt, Staphylococcus aureus subsp. aureus Mu50
cuuauuauuuuguauuuuuc

SEQ ID NO: 3971099 - RNA, 22 nt, Staphylococcus aureus subsp. aureus Mu50
cuuauuauuuuguauuuuucaa

SEQ ID NO: 3971100 - RNA, 17 nt, Staphylococcus aureus subsp. aureus Mu50
cuuauucuucacuuuca

SEQ ID NO: 3971101 - RNA, 21 nt, Staphylococcus aureus subsp. aureus Mu50
cuuauugauauaagauucaua

SEQ ID NO: 3971102 - RNA, 13 nt, Staphylococcus aureus subsp. aureus Mu50
cuuauuuauuuua

SEQ ID NO: 3971103 - RNA, 14 nt, Staphylococcus aureus subsp. aureus Mu50
cuuauuucuuuuca

SEQ ID NO: 3971104 - RNA, 15 nt, Staphylococcus aureus subsp. aureus Mu50
cuuauuugaaaugau

SEQ ID NO: 3971105 - RNA, 16 nt, Staphylococcus aureus subsp. aureus Mu50
cuuauuuguuuaauua

SEQ ID NO: 3971106 - RNA, 22 nt, Staphylococcus aureus subsp. aureus Mu50
cuuauuuguuuaauuaucuuua

SEQ ID NO: 3971107 - RNA, 14 nt, Staphylococcus aureus subsp. aureus Mu50
cuuauuuguuuauu

SEQ ID NO: 3971108 - RNA, 15 nt, Staphylococcus aureus subsp. aureus Mu50
cuuauuuguuuauua

SEQ ID NO: 3971109 - RNA, 16 nt, Staphylococcus aureus subsp. aureus Mu50
cuuauuuguuuauuag

SEQ ID NO: 3971110 - RNA, 13 nt, Staphylococcus aureus subsp. aureus Mu50
cuuauuuuacuau

SEQ ID NO: 3971111 - RNA, 19 nt, Staphylococcus aureus subsp. aureus Mu50
cuuauuuuguuuuaaaaaa

SEQ ID NO: 3971112 - RNA, 12 nt, Staphylococcus aureus subsp. aureus Mu50
cuuauuuuucau

SEQ ID NO: 3971113 - RNA, 13 nt, Staphylococcus aureus subsp. aureus Mu50
cuucaaaaaauaa

SEQ ID NO: 3971114 - RNA, 16 nt, Staphylococcus aureus subsp. aureus Mu50
cuucaaaguagacauu

SEQ ID NO: 3971115 - RNA, 20 nt, Staphylococcus aureus subsp. aureus Mu50
cuucaaaguuuucauuuuuu

SEQ ID NO: 3971116 - RNA, 13 nt, Staphylococcus aureus subsp. aureus Mu50
cuucaacauaacu

SEQ ID NO: 3971117 - RNA, 22 nt, Staphylococcus aureus subsp. aureus Mu50
cuucaacauagacacuuaacuu

SEQ ID NO: 3971118 - RNA, 14 nt, Staphylococcus aureus subsp. aureus Mu50
cuucaacgucaucu

SEQ ID NO: 3971119 - RNA, 15 nt, Staphylococcus aureus subsp. aureus Mu50
cuucaacuaaugucg

SEQ ID NO: 3971120 - RNA, 22 nt, Staphylococcus aureus subsp. aureus Mu50
cuucaacuucgauaugauuaaa

SEQ ID NO: 3971121 - RNA, 14 nt, Staphylococcus aureus subsp. aureus Mu50
cuucaagugccauu

SEQ ID NO: 3971122 - RNA, 14 nt, Staphylococcus aureus subsp. aureus Mu50
cuucaaguuguuuu

SEQ ID NO: 3971123 - RNA, 19 nt, Staphylococcus aureus subsp. aureus Mu50
cuucaauaucuucagcuaa

SEQ ID NO: 3971124 - RNA, 24 nt, Staphylococcus aureus subsp. aureus Mu50
cuucaauauucuuaucauucauua

SEQ ID NO: 3971125 - RNA, 13 nt, Staphylococcus aureus subsp. aureus Mu50
cuucaauauuuaa

SEQ ID NO: 3971126 - RNA, 17 nt, Staphylococcus aureus subsp. aureus Mu50
cuucaauauuuaaauuu

SEQ ID NO: 3971127 - RNA, 19 nt, Staphylococcus aureus subsp. aureus Mu50
cuucaaucgucacaucacg

SEQ ID NO: 3971128 - RNA, 17 nt, Staphylococcus aureus subsp. aureus Mu50
cuucaaucuaccaauac

SEQ ID NO: 3971129 - RNA, 17 nt, Staphylococcus aureus subsp. aureus Mu50
cuucaauuuauuuuuau

SEQ ID NO: 3971130 - RNA, 18 nt, Staphylococcus aureus subsp. aureus Mu50
cuucaauuucauuuuuga

SEQ ID NO: 3971131 - RNA, 18 nt, Staphylococcus aureus subsp. aureus Mu50
cuucacacuuuuagaauc

SEQ ID NO: 3971132 - RNA, 21 nt, Staphylococcus aureus subsp. aureus Mu50
cuucacaucaugugucuucca

SEQ ID NO: 3971133 - RNA, 14 nt, Staphylococcus aureus subsp. aureus Mu50
cuucacauuuaucc

SEQ ID NO: 3971134 - RNA, 19 nt, Staphylococcus aureus subsp. aureus Mu50
cuucaccaucuguaacuaa

SEQ ID NO: 3971135 - RNA, 14 nt, Staphylococcus aureus subsp. aureus Mu50
cuucaccaucuuua

SEQ ID NO: 3971136 - RNA, 15 nt, Staphylococcus aureus subsp. aureus Mu50
cuucacuaaaaauau

SEQ ID NO: 3971137 - RNA, 17 nt, Staphylococcus aureus subsp. aureus Mu50
cuucacuaaaaauauau

SEQ ID NO: 3971138 - RNA, 21 nt, Staphylococcus aureus subsp. aureus Mu50
cuucacuucucucuuauuaaa

SEQ ID NO: 3971139 - RNA, 22 nt, Staphylococcus aureus subsp. aureus Mu50
cuucagcuaaaaguuucccaag

SEQ ID NO: 3971140 - RNA, 15 nt, Staphylococcus aureus subsp. aureus Mu50
cuucagguguaguag

SEQ ID NO: 3971141 - RNA, 16 nt, Staphylococcus aureus subsp. aureus Mu50
cuucaguaauuucucc

SEQ ID NO: 3971142 - RNA, 19 nt, Staphylococcus aureus subsp. aureus Mu50
cuucaguaauuucuccaag

SEQ ID NO: 3971143 - RNA, 14 nt, Staphylococcus aureus subsp. aureus Mu50
cuucaguuaaauca

SEQ ID NO: 3971144 - RNA, 16 nt, Staphylococcus aureus subsp. aureus Mu50
cuucaguuaaaucuuu

SEQ ID NO: 3971145 - RNA, 21 nt, Staphylococcus aureus subsp. aureus Mu50
cuucaguuaaaucuuuaacuu

SEQ ID NO: 3971146 - RNA, 22 nt, Staphylococcus aureus subsp. aureus Mu50
cuucaguuaaaucuuuaacuuc

SEQ ID NO: 3971147 - RNA, 20 nt, Staphylococcus aureus subsp. aureus Mu50
cuucauaagucacaguaucu

SEQ ID NO: 3971148 - RNA, 20 nt, Staphylococcus aureus subsp. aureus Mu50
cuucauaaucguauucauau

SEQ ID NO: 3971149 - RNA, 15 nt, Staphylococcus aureus subsp. aureus Mu50
cuucauaguucaaau

SEQ ID NO: 3971150 - RNA, 17 nt, Staphylococcus aureus subsp. aureus Mu50
cuucauauccuucauua

SEQ ID NO: 3971151 - RNA, 13 nt, Staphylococcus aureus subsp. aureus Mu50
cuucaucaauaaa

SEQ ID NO: 3971152 - RNA, 21 nt, Staphylococcus aureus subsp. aureus Mu50
cuucaucaauaaauauugauu

SEQ ID NO: 3971153 - RNA, 16 nt, Staphylococcus aureus subsp. aureus Mu50
cuugauaaaaaaugaa

SEQ ID NO: 3971154 - RNA, 15 nt, Staphylococcus aureus subsp. aureus Mu50
cuugauaaaauaaau

SEQ ID NO: 3971155 - RNA, 22 nt, Staphylococcus aureus subsp. aureus Mu50
cuugauaaaauaaauaagcaau

SEQ ID NO: 3971156 - RNA, 12 nt, Staphylococcus aureus subsp. aureus Mu50
cuugauauucau

SEQ ID NO: 3971157 - RNA, 18 nt, Staphylococcus aureus subsp. aureus Mu50
cuugaucauuauaaaaug

SEQ ID NO: 3971158 - RNA, 14 nt, Staphylococcus aureus subsp. aureus Mu50
cuugaucuaaauga

SEQ ID NO: 3971159 - RNA, 22 nt, Staphylococcus aureus subsp. aureus Mu50
cuugauggugguaccacauaca

SEQ ID NO: 3971160 - RNA, 19 nt, Staphylococcus aureus subsp. aureus Mu50
cuugauuauauuuuucuuc

SEQ ID NO: 3971161 - RNA, 13 nt, Staphylococcus aureus subsp. aureus Mu50
cuugauuaucauu

SEQ ID NO: 3971162 - RNA, 15 nt, Staphylococcus aureus subsp. aureus Mu50
cuugauuuaacaacc

SEQ ID NO: 3971163 - RNA, 15 nt, Staphylococcus aureus subsp. aureus Mu50
cuugauuuaauuuuu

SEQ ID NO: 3971164 - RNA, 12 nt, Staphylococcus aureus subsp. aureus Mu50
cuugauuuaguu

SEQ ID NO: 3971165 - RNA, 17 nt, Staphylococcus aureus subsp. aureus Mu50
cuugauuuuauaaauca

SEQ ID NO: 3971166 - RNA, 18 nt, Staphylococcus aureus subsp. aureus Mu50
cuugcaaauauaucaucu

SEQ ID NO: 3971167 - RNA, 22 nt, Staphylococcus aureus subsp. aureus Mu50
cuugcaaauauaucaucucuau

SEQ ID NO: 3971168 - RNA, 17 nt, Staphylococcus aureus subsp. aureus Mu50
cuugcaauaccucccca

SEQ ID NO: 3971169 - RNA, 14 nt, Staphylococcus aureus subsp. aureus Mu50
cuugcacaccagug

SEQ ID NO: 3971170 - RNA, 21 nt, Staphylococcus aureus subsp. aureus Mu50
cuugcauacgaauuaaaauaa

SEQ ID NO: 3971171 - RNA, 15 nt, Staphylococcus aureus subsp. aureus Mu50
cuugccaucaauuuc

SEQ ID NO: 3971172 - RNA, 14 nt, Staphylococcus aureus subsp. aureus Mu50
cuugccuggcaacg

SEQ ID NO: 3971173 - RNA, 14 nt, Staphylococcus aureus subsp. aureus Mu50
cuugccuucaaauu

SEQ ID NO: 3971174 - RNA, 14 nt, Staphylococcus aureus subsp. aureus Mu50
cuugccuuuuuagg

SEQ ID NO: 3971175 - RNA, 17 nt, Staphylococcus aureus subsp. aureus Mu50
cuugcgauaaguucauc

SEQ ID NO: 3971176 - RNA, 13 nt, Staphylococcus aureus subsp. aureus Mu50
cuugcuaucaaac

SEQ ID NO: 3971177 - RNA, 19 nt, Staphylococcus aureus subsp. aureus Mu50
cuugcucuaauucaaugau

SEQ ID NO: 3971178 - RNA, 20 nt, Staphylococcus aureus subsp. aureus Mu50
cuugcuggacagcuacaauu

SEQ ID NO: 3971179 - RNA, 20 nt, Staphylococcus aureus subsp. aureus Mu50
cuugcuggauuacaccuuug

SEQ ID NO: 3971180 - RNA, 12 nt, Staphylococcus aureus subsp. aureus Mu50
cuugcuuacaau

SEQ ID NO: 3971181 - RNA, 20 nt, Staphylococcus aureus subsp. aureus Mu50
cuugcuuacaauaaucacuu

SEQ ID NO: 3971182 - RNA, 17 nt, Staphylococcus aureus subsp. aureus Mu50
cuuggaaauguauauga

SEQ ID NO: 3971183 - RNA, 17 nt, Staphylococcus aureus subsp. aureus Mu50
cuuggauucaaaugaca

SEQ ID NO: 3971184 - RNA, 23 nt, Staphylococcus aureus subsp. aureus Mu50
cuuggcaaugaaauuaccaacac

SEQ ID NO: 3971185 - RNA, 14 nt, Staphylococcus aureus subsp. aureus Mu50
cuuggcauuuuuuc

SEQ ID NO: 3971186 - RNA, 19 nt, Staphylococcus aureus subsp. aureus Mu50
cuuggccaauuaacuugau

SEQ ID NO: 3971187 - RNA, 17 nt, Staphylococcus aureus subsp. aureus Mu50
cuuggcgacauuuguaa

SEQ ID NO: 3971188 - RNA, 23 nt, Staphylococcus aureus subsp. aureus Mu50
cuuggcggggccccaacaaaaag

SEQ ID NO: 3971189 - RNA, 13 nt, Staphylococcus aureus subsp. aureus Mu50
cuuggcguauuuu

SEQ ID NO: 3971190 - RNA, 20 nt, Staphylococcus aureus subsp. aureus Mu50
cuuggcguauuuuuuguucu

SEQ ID NO: 3971191 - RNA, 13 nt, Staphylococcus aureus subsp. aureus Mu50
cuugguauuuuuu

SEQ ID NO: 3971192 - RNA, 17 nt, Staphylococcus aureus subsp. aureus Mu50
cuugguauuuuuuaaau

SEQ ID NO: 3971193 - RNA, 18 nt, Staphylococcus aureus subsp. aureus Mu50
cuuggugguuuugaugua

SEQ ID NO: 3971194 - RNA, 13 nt, Staphylococcus aureus subsp. aureus Mu50
cuugguuaaaguu

SEQ ID NO: 3971195 - RNA, 15 nt, Staphylococcus aureus subsp. aureus Mu50
cuuguaaacuucuuu

SEQ ID NO: 3971196 - RNA, 16 nt, Staphylococcus aureus subsp. aureus Mu50
cuuguaaacuucuuuu

SEQ ID NO: 3971197 - RNA, 21 nt, Staphylococcus aureus subsp. aureus Mu50
cuuguaaaucacgauuuucaa

SEQ ID NO: 3971198 - RNA, 16 nt, Staphylococcus aureus subsp. aureus Mu50
cuuguaaauuuaaaug

SEQ ID NO: 3971199 - RNA, 22 nt, Staphylococcus aureus subsp. aureus Mu50
cuuguaacaagcuuuucauuuu

SEQ ID NO: 3971200 - RNA, 21 nt, Staphylococcus aureus subsp. aureus Mu50
cuuguaacaagcuuuuuucaa

SEQ ID NO: 3971201 - RNA, 18 nt, Staphylococcus aureus subsp. aureus Mu50
cuuguaauauaacaagua

SEQ ID NO: 3971202 - RNA, 17 nt, Staphylococcus aureus subsp. aureus Mu50
cuuguaauccuuguucu

SEQ ID NO: 3971203 - RNA, 18 nt, Staphylococcus aureus subsp. aureus Mu50
cuuguaauccuuguucua

SEQ ID NO: 3971204 - RNA, 15 nt, Staphylococcus aureus subsp. aureus Mu50
cuuguacacauccuc

SEQ ID NO: 3971205 - RNA, 19 nt, Staphylococcus aureus subsp. aureus Mu50
cuuguacacauccucauaa

SEQ ID NO: 3971206 - RNA, 16 nt, Staphylococcus aureus subsp. aureus Mu50
cuuguacgauaacuac

SEQ ID NO: 3971207 - RNA, 21 nt, Staphylococcus aureus subsp. aureus Mu50
cuugucaguuuuuuuauaagc

SEQ ID NO: 3971208 - RNA, 17 nt, Staphylococcus aureus subsp. aureus Mu50
cuuguccuaacgcuaau

SEQ ID NO: 3971209 - RNA, 14 nt, Staphylococcus aureus subsp. aureus Mu50
cuugugaaauuaga

SEQ ID NO: 3971210 - RNA, 22 nt, Staphylococcus aureus subsp. aureus Mu50
cuugugauucaaauaaaucaaa

SEQ ID NO: 3971211 - RNA, 20 nt, Staphylococcus aureus subsp. aureus Mu50
cuugugcgguaaccauuuuu

SEQ ID NO: 3971212 - RNA, 14 nt, Staphylococcus aureus subsp. aureus Mu50
cuugugugaaauua

SEQ ID NO: 3971213 - RNA, 22 nt, Staphylococcus aureus subsp. aureus Mu50
cuuguucgauaaucguuaaaac

SEQ ID NO: 3971214 - RNA, 15 nt, Staphylococcus aureus subsp. aureus Mu50
cuuguucuaaaauaa

SEQ ID NO: 3971215 - RNA, 20 nt, Staphylococcus aureus subsp. aureus Mu50
cuuguugaacucugauauug

SEQ ID NO: 3971216 - RNA, 21 nt, Staphylococcus aureus subsp. aureus Mu50
cuuguuggcuuuuuuaauuuc

SEQ ID NO: 3971217 - RNA, 15 nt, Staphylococcus aureus subsp. aureus Mu50
cuuguugguauuuuu

SEQ ID NO: 3971218 - RNA, 14 nt, Staphylococcus aureus subsp. aureus Mu50
cuuguuuaaguuuu

SEQ ID NO: 3971219 - RNA, 18 nt, Staphylococcus aureus subsp. aureus Mu50
cuuguuuagggaauccca

SEQ ID NO: 3971220 - RNA, 20 nt, Staphylococcus aureus subsp. aureus Mu50
cuuguuuauuacauaauuua

SEQ ID NO: 3971221 - RNA, 21 nt, Staphylococcus aureus subsp. aureus Mu50
cuuguuuuaaacuuauuaauu

SEQ ID NO: 3971222 - RNA, 12 nt, Staphylococcus aureus subsp. aureus Mu50
cuuguuuuaaau

SEQ ID NO: 3971223 - RNA, 17 nt, Staphylococcus aureus subsp. aureus Mu50
cuuuaaaaauuaaguaa

SEQ ID NO: 3971224 - RNA, 18 nt, Staphylococcus aureus subsp. aureus Mu50
cuuuaaaacaucauucac

SEQ ID NO: 3971225 - RNA, 19 nt, Staphylococcus aureus subsp. aureus Mu50
cuuuaaaacaucauucaca

SEQ ID NO: 3971226 - RNA, 14 nt, Staphylococcus aureus subsp. aureus Mu50
cuuuaaacaagcau

SEQ ID NO: 3971227 - RNA, 20 nt, Staphylococcus aureus subsp. aureus Mu50
cuuuaaacucguaaauuuua

SEQ ID NO: 3971228 - RNA, 19 nt, Staphylococcus aureus subsp. aureus Mu50
cuuuaaaguuaaaguuuug

SEQ ID NO: 3971229 - RNA, 23 nt, Staphylococcus aureus subsp. aureus Mu50
cuuuaaaguuaaaguuuuguuca

SEQ ID NO: 3971230 - RNA, 17 nt, Staphylococcus aureus subsp. aureus Mu50
cuuuaaaguuguugaaa

SEQ ID NO: 3971231 - RNA, 16 nt, Staphylococcus aureus subsp. aureus Mu50
cuuuaaaucuacuuug

SEQ ID NO: 3971232 - RNA, 11 nt, Staphylococcus aureus subsp. aureus Mu50
cuuuaaaucuu

SEQ ID NO: 3971233 - RNA, 16 nt, Staphylococcus aureus subsp. aureus Mu50
cuuuaaaucuuguucu

SEQ ID NO: 3971234 - RNA, 21 nt, Staphylococcus aureus subsp. aureus Mu50
cuuuaaaucuuguucuaauug

SEQ ID NO: 3971235 - RNA, 14 nt, Staphylococcus aureus subsp. aureus Mu50
cuuuaaauuauaua

SEQ ID NO: 3971236 - RNA, 15 nt, Staphylococcus aureus subsp. aureus Mu50
cuuuaacaauugauu

SEQ ID NO: 3971237 - RNA, 23 nt, Staphylococcus aureus subsp. aureus Mu50
cuuuaaccacuccuuaaacaaau

SEQ ID NO: 3971238 - RNA, 23 nt, Staphylococcus aureus subsp. aureus Mu50
cuuuaacuguacgauucaauuua

SEQ ID NO: 3971239 - RNA, 19 nt, Staphylococcus aureus subsp. aureus Mu50
cuuuaacuucuuuuguuuu

SEQ ID NO: 3971240 - RNA, 20 nt, Staphylococcus aureus subsp. aureus Mu50
cuuuaacuucuuuuguuuua

SEQ ID NO: 3971241 - RNA, 12 nt, Staphylococcus aureus subsp. aureus Mu50
cuuucuuuucug

SEQ ID NO: 3971242 - RNA, 16 nt, Staphylococcus aureus subsp. aureus Mu50
cuuucuuuucugaaug

SEQ ID NO: 3971243 - RNA, 17 nt, Staphylococcus aureus subsp. aureus Mu50
cuuucuuuuucaucuuu

SEQ ID NO: 3971244 - RNA, 18 nt, Staphylococcus aureus subsp. aureus Mu50
cuuugaaagaaggaauaa

SEQ ID NO: 3971245 - RNA, 21 nt, Staphylococcus aureus subsp. aureus Mu50
cuuugaaagaaggaauaauuu

SEQ ID NO: 3971246 - RNA, 19 nt, Staphylococcus aureus subsp. aureus Mu50
cuuugaacauauuauaaaa

SEQ ID NO: 3971247 - RNA, 20 nt, Staphylococcus aureus subsp. aureus Mu50
cuuugaagggagcauuucau

SEQ ID NO: 3971248 - RNA, 20 nt, Staphylococcus aureus subsp. aureus Mu50
cuuugaagggguuuuuucuu

SEQ ID NO: 3971249 - RNA, 21 nt, Staphylococcus aureus subsp. aureus Mu50
cuuugaauauaguccuuccca

SEQ ID NO: 3971250 - RNA, 15 nt, Staphylococcus aureus subsp. aureus Mu50
cuuugacauguguua

SEQ ID NO: 3971251 - RNA, 16 nt, Staphylococcus aureus subsp. aureus Mu50
cuuugacauguguuaa

SEQ ID NO: 3971252 - RNA, 20 nt, Staphylococcus aureus subsp. aureus Mu50
cuuugauaacaauuuuaaau

SEQ ID NO: 3971253 - RNA, 20 nt, Staphylococcus aureus subsp. aureus Mu50
cuuugauauguuuccucuuu

SEQ ID NO: 3971254 - RNA, 19 nt, Staphylococcus aureus subsp. aureus Mu50
cuuugauguucacuaaaug

SEQ ID NO: 3971255 - RNA, 21 nt, Staphylococcus aureus subsp. aureus Mu50
cuuugcagauugauauaaauu

SEQ ID NO: 3971256 - RNA, 20 nt, Staphylococcus aureus subsp. aureus Mu50
cuuugcauacauaucuuuug

SEQ ID NO: 3971257 - RNA, 14 nt, Staphylococcus aureus subsp. aureus Mu50
cuuugcucaccuuu

SEQ ID NO: 3971258 - RNA, 22 nt, Staphylococcus aureus subsp. aureus Mu50
cuuuggaaauuuauuauaaaau

SEQ ID NO: 3971259 - RNA, 23 nt, Staphylococcus aureus subsp. aureus Mu50
cuuuggaaauuuauuauaaaaua

SEQ ID NO: 3971260 - RNA, 18 nt, Staphylococcus aureus subsp. aureus Mu50
cuuuggacuuuaaaguua

SEQ ID NO: 3971261 - RNA, 15 nt, Staphylococcus aureus subsp. aureus Mu50
cuuuggauuucuuuu

SEQ ID NO: 3971262 - RNA, 20 nt, Staphylococcus aureus subsp. aureus Mu50
cuuuggauuucuuuuuaaaa

SEQ ID NO: 3971263 - RNA, 17 nt, Staphylococcus aureus subsp. aureus Mu50
cuuuggcaccaguacuu

SEQ ID NO: 3971264 - RNA, 20 nt, Staphylococcus aureus subsp. aureus Mu50
cuuuguaaccuaaaaacaaa

SEQ ID NO: 3971265 - RNA, 18 nt, Staphylococcus aureus subsp. aureus Mu50
cuuuguagccuucaacua

SEQ ID NO: 3971266 - RNA, 23 nt, Staphylococcus aureus subsp. aureus Mu50
cuuuguauggaaauggugguuac

SEQ ID NO: 3971267 - RNA, 19 nt, Staphylococcus aureus subsp. aureus Mu50
cuuugucacgauagauuua

SEQ ID NO: 3971268 - RNA, 21 nt, Staphylococcus aureus subsp. aureus Mu50
cuuugucauuuugauuaagug

SEQ ID NO: 3971269 - RNA, 22 nt, Staphylococcus aureus subsp. aureus Mu50
cuuugucuguaaagcuauccau

SEQ ID NO: 3971270 - RNA, 15 nt, Staphylococcus aureus subsp. aureus Mu50
cuuugucuuuaauga

SEQ ID NO: 3971271 - RNA, 16 nt, Staphylococcus aureus subsp. aureus Mu50
cuuuguguuugcuuuu

SEQ ID NO: 3971272 - RNA, 19 nt, Staphylococcus aureus subsp. aureus Mu50
cuuuguguuugcuuuuuac

SEQ ID NO: 3971273 - RNA, 23 nt, Staphylococcus aureus subsp. aureus Mu50
cuuuguucugcuuuuucuuuauc

SEQ ID NO: 3971274 - RNA, 15 nt, Staphylococcus aureus subsp. aureus Mu50
cuuuguuggggccca

SEQ ID NO: 3971275 - RNA, 20 nt, Staphylococcus aureus subsp. aureus Mu50
cuuuguuggggcccacaccc

SEQ ID NO: 3971276 - RNA, 19 nt, Staphylococcus aureus subsp. aureus Mu50
cuuuguuguaagguggacu

SEQ ID NO: 3971277 - RNA, 15 nt, Staphylococcus aureus subsp. aureus Mu50
cuuuguuuaucaauu

SEQ ID NO: 3971278 - RNA, 17 nt, Staphylococcus aureus subsp. aureus Mu50
cuuuguuuaucaauuuc

SEQ ID NO: 3971279 - RNA, 19 nt, Staphylococcus aureus subsp. aureus Mu50
cuuuguuugcuucuguauc

SEQ ID NO: 3971280 - RNA, 14 nt, Staphylococcus aureus subsp. aureus Mu50
cuuuguuuucagua

SEQ ID NO: 3971281 - RNA, 12 nt, Staphylococcus aureus subsp. aureus Mu50
cuuuuaaaaaac

SEQ ID NO: 3971282 - RNA, 18 nt, Staphylococcus aureus subsp. aureus Mu50
cuuuuaaaaaacauaccu

SEQ ID NO: 3971283 - RNA, 21 nt, Staphylococcus aureus subsp. aureus Mu50
cuuuuaaaaucguugcagauu

SEQ ID NO: 3971284 - RNA, 17 nt, Staphylococcus aureus subsp. aureus Mu50
cuuuuaaaccguguucu

SEQ ID NO: 3971285 - RNA, 13 nt, Staphylococcus aureus subsp. aureus Mu50
cuuuuaaauuaaa

SEQ ID NO: 3971286 - RNA, 20 nt, Staphylococcus aureus subsp. aureus Mu50
cuuuuaaauuaugacuuauu

SEQ ID NO: 3971287 - RNA, 22 nt, Staphylococcus aureus subsp. aureus Mu50
cuuuuaacccacauuaaauauu

SEQ ID NO: 3971288 - RNA, 20 nt, Staphylococcus aureus subsp. aureus Mu50
cuuuuaauagaucuuuguau

SEQ ID NO: 3971289 - RNA, 16 nt, Staphylococcus aureus subsp. aureus Mu50
cuuuuaauaguguuau

SEQ ID NO: 3971290 - RNA, 21 nt, Staphylococcus aureus subsp. aureus Mu50
cuuuuaauauuugauaacaaa

SEQ ID NO: 3971291 - RNA, 16 nt, Staphylococcus aureus subsp. aureus Mu50
cuuuuaauucuuaauc

SEQ ID NO: 3971292 - RNA, 15 nt, Staphylococcus aureus subsp. aureus Mu50
cuuuuacaaacuuca

SEQ ID NO: 3971293 - RNA, 17 nt, Staphylococcus aureus subsp. aureus Mu50
cuuuuacaaacuucaca

SEQ ID NO: 3971294 - RNA, 23 nt, Staphylococcus aureus subsp. aureus Mu50
cuuuuacaaacuucacaucaugu

SEQ ID NO: 3971295 - RNA, 14 nt, Staphylococcus aureus subsp. aureus Mu50
cuuuuacauuugua

SEQ ID NO: 3971296 - RNA, 20 nt, Staphylococcus aureus subsp. aureus Mu50
cuuuuaccucugauaaauga

SEQ ID NO: 3971297 - RNA, 14 nt, Staphylococcus aureus subsp. aureus Mu50
cuuuuacuaaauga

SEQ ID NO: 3971298 - RNA, 21 nt, Staphylococcus aureus subsp. aureus Mu50
cuuuuacuuucucaucuauuu

SEQ ID NO: 3971299 - RNA, 16 nt, Staphylococcus aureus subsp. aureus Mu50
cuuuuagaguuuuuau

SEQ ID NO: 3971300 - RNA, 19 nt, Staphylococcus aureus subsp. aureus Mu50
cuuuuagaguuuuuauuau

SEQ ID NO: 3971301 - RNA, 12 nt, Staphylococcus aureus subsp. aureus Mu50
cuuuuauagaaa

SEQ ID NO: 3971302 - RNA, 20 nt, Staphylococcus aureus subsp. aureus Mu50
cuuuuauauuuuuaucaucu

SEQ ID NO: 3971303 - RNA, 21 nt, Staphylococcus aureus subsp. aureus Mu50
cuuuuauccaauguauaaaac

SEQ ID NO: 3971304 - RNA, 10 nt, Staphylococcus aureus subsp. aureus Mu50
cuuuuaugca

SEQ ID NO: 3971305 - RNA, 11 nt, Staphylococcus aureus subsp. aureus Mu50
cuuuuaugcau

SEQ ID NO: 3971306 - RNA, 12 nt, Staphylococcus aureus subsp. aureus Mu50
cuuuuaugcaug

SEQ ID NO: 3971307 - RNA, 13 nt, Staphylococcus aureus subsp. aureus Mu50
cuuuuaugcaugc

SEQ ID NO: 3971308 - RNA, 14 nt, Staphylococcus aureus subsp. aureus Mu50
cuuuuaugcaugcg

SEQ ID NO: 3971309 - RNA, 16 nt, Staphylococcus aureus subsp. aureus Mu50
cuuuuaugcaugcgca

SEQ ID NO: 3971310 - RNA, 23 nt, Staphylococcus aureus subsp. aureus Mu50
cuuuuaugcaugcgcaaaagcgc

SEQ ID NO: 3971311 - RNA, 18 nt, Staphylococcus aureus subsp. aureus Mu50
cuuuuaugucuaguucuu

SEQ ID NO: 3971312 - RNA, 19 nt, Staphylococcus aureus subsp. aureus Mu50
cuuuuauuacuuauuucuu

SEQ ID NO: 3971313 - RNA, 13 nt, Staphylococcus aureus subsp. aureus Mu50
cuuuuauuauuuu

SEQ ID NO: 3971314 - RNA, 16 nt, Staphylococcus aureus subsp. aureus Mu50
cuuuuauuauuuuaug

SEQ ID NO: 3971315 - RNA, 12 nt, Staphylococcus aureus subsp. aureus Mu50
cuuuuauuuuca

SEQ ID NO: 3971316 - RNA, 12 nt, Staphylococcus aureus subsp. aureus Mu50
cuuuucaaaaua

SEQ ID NO: 3971317 - RNA, 14 nt, Staphylococcus aureus subsp. aureus Mu50
cuuuuccauucaua

SEQ ID NO: 3971318 - RNA, 20 nt, Staphylococcus aureus subsp. aureus Mu50
cuuuucuagcuauauccagu

SEQ ID NO: 3971319 - RNA, 21 nt, Staphylococcus aureus subsp. aureus Mu50
cuuuucucgauuaauuuucuu

SEQ ID NO: 3971320 - RNA, 20 nt, Staphylococcus aureus subsp. aureus Mu50
cuuuugauguuuaugacaaa

SEQ ID NO: 3971321 - RNA, 14 nt, Staphylococcus aureus subsp. aureus Mu50
cuuuugauuuugaa

SEQ ID NO: 3971322 - RNA, 22 nt, Staphylococcus aureus subsp. aureus Mu50
cuuuugggaagcgucuuuuuug

SEQ ID NO: 3971323 - RNA, 13 nt, Staphylococcus aureus subsp. aureus Mu50
cuuuuggucuguu

SEQ ID NO: 3971324 - RNA, 13 nt, Staphylococcus aureus subsp. aureus Mu50
cuuuuguaaaaaa

SEQ ID NO: 3971325 - RNA, 21 nt, Staphylococcus aureus subsp. aureus Mu50
cuuuuguaaagcuuuaguuaa

SEQ ID NO: 3971326 - RNA, 14 nt, Staphylococcus aureus subsp. aureus Mu50
cuuuuguaauugaa

SEQ ID NO: 3971327 - RNA, 20 nt, Staphylococcus aureus subsp. aureus Mu50
cuuuuguguuugcccugcug

SEQ ID NO: 3971328 - RNA, 22 nt, Staphylococcus aureus subsp. aureus Mu50
gaaaauuucucacugcuguucu

SEQ ID NO: 3971329 - RNA, 21 nt, Staphylococcus aureus subsp. aureus Mu50
gaaacaagaaguuuccaacgu

SEQ ID NO: 3971330 - RNA, 22 nt, Staphylococcus aureus subsp. aureus Mu50
gaaacaauucauuaauaggauu

SEQ ID NO: 3971331 - RNA, 15 nt, Staphylococcus aureus subsp. aureus Mu50
gaaacacacuaaaag

SEQ ID NO: 3971332 - RNA, 15 nt, Staphylococcus aureus subsp. aureus Mu50
gaaacaucuugauau

SEQ ID NO: 3971333 - RNA, 16 nt, Staphylococcus aureus subsp. aureus Mu50
gaaacaucuugauauu

SEQ ID NO: 3971334 - RNA, 14 nt, Staphylococcus aureus subsp. aureus Mu50
gaaacauuaaaaua

SEQ ID NO: 3971335 - RNA, 22 nt, Staphylococcus aureus subsp. aureus Mu50
gaaaccguuuagaaagaauaca

SEQ ID NO: 3971336 - RNA, 19 nt, Staphylococcus aureus subsp. aureus Mu50
gaaacgucuuaauucuucu

SEQ ID NO: 3971337 - RNA, 13 nt, Staphylococcus aureus subsp. aureus Mu50
gaaacuaaauuaa

SEQ ID NO: 3971338 - RNA, 14 nt, Staphylococcus aureus subsp. aureus Mu50
gaaacuaauaauuu

SEQ ID NO: 3971339 - RNA, 21 nt, Staphylococcus aureus subsp. aureus Mu50
gaaacugauugggcugauaau

SEQ ID NO: 3971340 - RNA, 14 nt, Staphylococcus aureus subsp. aureus Mu50
gaaacuuuaauacu

SEQ ID NO: 3971341 - RNA, 15 nt, Staphylococcus aureus subsp. aureus Mu50
gaaacuuuaauacua

SEQ ID NO: 3971342 - RNA, 16 nt, Staphylococcus aureus subsp. aureus Mu50
gaaagacauuuaaaua

SEQ ID NO: 3971343 - RNA, 21 nt, Staphylococcus aureus subsp. aureus Mu50
gaaagacguuuuuuuauaaau

SEQ ID NO: 3971344 - RNA, 17 nt, Staphylococcus aureus subsp. aureus Mu50
gaaagaugauauauuca

SEQ ID NO: 3971345 - RNA, 22 nt, Staphylococcus aureus subsp. aureus Mu50
gaaagaugggauuucacuugac

SEQ ID NO: 3971346 - RNA, 21 nt, Staphylococcus aureus subsp. aureus Mu50
gaaagauuuguagcuugaaua

SEQ ID NO: 3971347 - RNA, 21 nt, Staphylococcus aureus subsp. aureus Mu50
gaaagcuaauaucaauaaugc

SEQ ID NO: 3971348 - RNA, 22 nt, Staphylococcus aureus subsp. aureus Mu50
gaaagguauaucuucauuuaaa

SEQ ID NO: 3971349 - RNA, 20 nt, Staphylococcus aureus subsp. aureus Mu50
gaaaguaauaaguaauaauu

SEQ ID NO: 3971350 - RNA, 23 nt, Staphylococcus aureus subsp. aureus Mu50
gaaaguaauaaguaauaauuuau

SEQ ID NO: 3971351 - RNA, 18 nt, Staphylococcus aureus subsp. aureus Mu50
gaaaguaccuaaaauaga

SEQ ID NO: 3971352 - RNA, 15 nt, Staphylococcus aureus subsp. aureus Mu50
gaaaguagaauuauu

SEQ ID NO: 3971353 - RNA, 20 nt, Staphylococcus aureus subsp. aureus Mu50
gaaaguagaauuauuuagaa

SEQ ID NO: 3971354 - RNA, 20 nt, Staphylococcus aureus subsp. aureus Mu50
gaaaguaucuaugaaauuuu

SEQ ID NO: 3971355 - RNA, 20 nt, Staphylococcus aureus subsp. aureus Mu50
gaaaguauuagauauauuug

SEQ ID NO: 3971356 - RNA, 15 nt, Staphylococcus aureus subsp. aureus Mu50
gaaaguucauuacaa

SEQ ID NO: 3971357 - RNA, 18 nt, Staphylococcus aureus subsp. aureus Mu50
gaaauaaaacaagacuac

SEQ ID NO: 3971358 - RNA, 21 nt, Staphylococcus aureus subsp. aureus Mu50
gaaauaaucuaguaucuauca

SEQ ID NO: 3971359 - RNA, 19 nt, Staphylococcus aureus subsp. aureus Mu50
gaaauaccuccugauugcu

SEQ ID NO: 3971360 - RNA, 17 nt, Staphylococcus aureus subsp. aureus Mu50
gaaauacuugaauuuaa

SEQ ID NO: 3971361 - RNA, 21 nt, Staphylococcus aureus subsp. aureus Mu50
gaaauacuugaauuuaauaag

SEQ ID NO: 3971362 - RNA, 23 nt, Staphylococcus aureus subsp. aureus Mu50
gaaauauaccaaccaaaaccaaa

SEQ ID NO: 3971363 - RNA, 15 nt, Staphylococcus aureus subsp. aureus Mu50
gaaauaucaagaugu

SEQ ID NO: 3971364 - RNA, 17 nt, Staphylococcus aureus subsp. aureus Mu50
gaaauauuguaaucacu

SEQ ID NO: 3971365 - RNA, 16 nt, Staphylococcus aureus subsp. aureus Mu50
gaaauauuuaucuuua

SEQ ID NO: 3971366 - RNA, 13 nt, Staphylococcus aureus subsp. aureus Mu50
gaaauauuugaaa

SEQ ID NO: 3971367 - RNA, 23 nt, Staphylococcus aureus subsp. aureus Mu50
gaaauauuugaaaauuucaccgc

SEQ ID NO: 3971368 - RNA, 17 nt, Staphylococcus aureus subsp. aureus Mu50
gaaaucaaaaauaauua

SEQ ID NO: 3971369 - RNA, 21 nt, Staphylococcus aureus subsp. aureus Mu50
gaaaucaaaaauaauuaugaa

SEQ ID NO: 3971370 - RNA, 13 nt, Staphylococcus aureus subsp. aureus Mu50
gaaaucauuuaaa

SEQ ID NO: 3971371 - RNA, 13 nt, Staphylococcus aureus subsp. aureus Mu50
gaaaucauuuggu

SEQ ID NO: 3971372 - RNA, 20 nt, Staphylococcus aureus subsp. aureus Mu50
gaaauccgcauaaauuagau

SEQ ID NO: 3971373 - RNA, 16 nt, Staphylococcus aureus subsp. aureus Mu50
gaaauccguuaaaauu

SEQ ID NO: 3971374 - RNA, 21 nt, Staphylococcus aureus subsp. aureus Mu50
gaaauccguuaaaauuuuaau

SEQ ID NO: 3971375 - RNA, 14 nt, Staphylococcus aureus subsp. aureus Mu50
gaaauccucuuaua

SEQ ID NO: 3971376 - RNA, 18 nt, Staphylococcus aureus subsp. aureus Mu50
gaaaucucggcauuuuua

SEQ ID NO: 3971377 - RNA, 12 nt, Staphylococcus aureus subsp. aureus Mu50
gaaaugaaugag

SEQ ID NO: 3971378 - RNA, 13 nt, Staphylococcus aureus subsp. aureus Mu50
gaaaugauaauuu

SEQ ID NO: 3971379 - RNA, 15 nt, Staphylococcus aureus subsp. aureus Mu50
gaaaugauaauuuaa

SEQ ID NO: 3971380 - RNA, 21 nt, Staphylococcus aureus subsp. aureus Mu50
gaaaugauacauuauuaaaua

SEQ ID NO: 3971381 - RNA, 13 nt, Staphylococcus aureus subsp. aureus Mu50
gaaaugcaaugag

SEQ ID NO: 3971382 - RNA, 20 nt, Staphylococcus aureus subsp. aureus Mu50
gaaauggugaacuaaauuga

SEQ ID NO: 3971383 - RNA, 11 nt, Staphylococcus aureus subsp. aureus Mu50
gaaauguagau

SEQ ID NO: 3971384 - RNA, 17 nt, Staphylococcus aureus subsp. aureus Mu50
gaaauguagauuacuuu

SEQ ID NO: 3971385 - RNA, 19 nt, Staphylococcus aureus subsp. aureus Mu50
gaaauguauaugagguuca

SEQ ID NO: 3971386 - RNA, 16 nt, Staphylococcus aureus subsp. aureus Mu50
gaaauguuuuggaaaa

SEQ ID NO: 3971387 - RNA, 16 nt, Staphylococcus aureus subsp. aureus Mu50
gaaauuaaaucgacaa

SEQ ID NO: 3971388 - RNA, 13 nt, Staphylococcus aureus subsp. aureus Mu50
gaaauuaaauuca

SEQ ID NO: 3971389 - RNA, 23 nt, Staphylococcus aureus subsp. aureus Mu50
gaaauuaauuaucuuaagucauc

SEQ ID NO: 3971390 - RNA, 11 nt, Staphylococcus aureus subsp. aureus Mu50
gaaauuagaaa

SEQ ID NO: 3971391 - RNA, 17 nt, Staphylococcus aureus subsp. aureus Mu50
gaaauuagaaccaucau

SEQ ID NO: 3971392 - RNA, 17 nt, Staphylococcus aureus subsp. aureus Mu50
gaaauucgcuugauuaa

SEQ ID NO: 3971393 - RNA, 17 nt, Staphylococcus aureus subsp. aureus Mu50
gaaauucuacaggcaau

SEQ ID NO: 3971394 - RNA, 22 nt, Staphylococcus aureus subsp. aureus Mu50
gaaauucuacaggcaaugcaag

SEQ ID NO: 3971395 - RNA, 15 nt, Staphylococcus aureus subsp. aureus Mu50
gaaauucuacaggua

SEQ ID NO: 3971396 - RNA, 17 nt, Staphylococcus aureus subsp. aureus Mu50
gaaauucuacagguaau

SEQ ID NO: 3971397 - RNA, 22 nt, Staphylococcus aureus subsp. aureus Mu50
gaaauucuacagguaaugcaag

SEQ ID NO: 3971398 - RNA, 21 nt, Staphylococcus aureus subsp. aureus Mu50
gaaauucuuuuguaauugaaa

SEQ ID NO: 3971399 - RNA, 21 nt, Staphylococcus aureus subsp. aureus Mu50
gaaauuguguugaaucaacag

SEQ ID NO: 3971400 - RNA, 15 nt, Staphylococcus aureus subsp. aureus Mu50
gaaauuuauuauaau

SEQ ID NO: 3971401 - RNA, 20 nt, Staphylococcus aureus subsp. aureus Mu50
gaaauuucauaaaguuuauu

SEQ ID NO: 3971402 - RNA, 20 nt, Staphylococcus aureus subsp. aureus Mu50
gaaauuuuaaaauaaaucuu

SEQ ID NO: 3971403 - RNA, 12 nt, Staphylococcus aureus subsp. aureus Mu50
gaaauuuuuaau

SEQ ID NO: 3971404 - RNA, 23 nt, Staphylococcus aureus subsp. aureus Mu50
gaaauuuuucacuucaaacaaag

SEQ ID NO: 3971405 - RNA, 18 nt, Staphylococcus aureus subsp. aureus Mu50
gaaauuuuuuagugaaaa

SEQ ID NO: 3971406 - RNA, 20 nt, Staphylococcus aureus subsp. aureus Mu50
gaaauuuuuuagugaaaaag

SEQ ID NO: 3971407 - RNA, 22 nt, Staphylococcus aureus subsp. aureus Mu50
gaaauuuuuuagugaaaaaguu

SEQ ID NO: 3971408 - RNA, 15 nt, Staphylococcus aureus subsp. aureus Mu50
gaacaaaauaacaug

SEQ ID NO: 3971409 - RNA, 14 nt, Staphylococcus aureus subsp. aureus Mu50
gaacaaaauguagg

SEQ ID NO: 3971410 - RNA, 16 nt, Staphylococcus aureus subsp. aureus Mu50
gaacaacauuaggaug

SEQ ID NO: 3971411 - RNA, 20 nt, Staphylococcus aureus subsp. aureus Mu50
gaacaacauugagauuaucu

SEQ ID NO: 3971412 - RNA, 23 nt, Staphylococcus aureus subsp. aureus Mu50
gaacaaucaauacagagucuaca

SEQ ID NO: 3971413 - RNA, 22 nt, Staphylococcus aureus subsp. aureus Mu50
gaacaaucggaagcauauuucu

SEQ ID NO: 3971414 - RNA, 23 nt, Staphylococcus aureus subsp. aureus Mu50
gaacaaucggaagcauauuucua

SEQ ID NO: 3971415 - RNA, 18 nt, Staphylococcus aureus subsp. aureus Mu50
gaaucaauugcauacgua

SEQ ID NO: 3971416 - RNA, 20 nt, Staphylococcus aureus subsp. aureus Mu50
gaaucacaguuauauauucc

SEQ ID NO: 3971417 - RNA, 10 nt, Staphylococcus aureus subsp. aureus Mu50
gaaucaguau

SEQ ID NO: 3971418 - RNA, 19 nt, Staphylococcus aureus subsp. aureus Mu50
gaauccuaugccaaauaac

SEQ ID NO: 3971419 - RNA, 17 nt, Staphylococcus aureus subsp. aureus Mu50
gaauccuucaucaauaa

SEQ ID NO: 3971420 - RNA, 15 nt, Staphylococcus aureus subsp. aureus Mu50
gaaucgaaccaaauu

SEQ ID NO: 3971421 - RNA, 15 nt, Staphylococcus aureus subsp. aureus Mu50
gaaucgauauaauga

SEQ ID NO: 3971422 - RNA, 22 nt, Staphylococcus aureus subsp. aureus Mu50
gaaucuaacugugcaacaaacg

SEQ ID NO: 3971423 - RNA, 14 nt, Staphylococcus aureus subsp. aureus Mu50
gaaucuagaauaua

SEQ ID NO: 3971424 - RNA, 18 nt, Staphylococcus aureus subsp. aureus Mu50
gaaucuuacauugauaaa

SEQ ID NO: 3971425 - RNA, 17 nt, Staphylococcus aureus subsp. aureus Mu50
gaaucuuauuuuguuuu

SEQ ID NO: 3971426 - RNA, 22 nt, Staphylococcus aureus subsp. aureus Mu50
gaaucuuauuuuguuuuaaaaa

SEQ ID NO: 3971427 - RNA, 16 nt, Staphylococcus aureus subsp. aureus Mu50
gaaucuuggaaguauc

SEQ ID NO: 3971428 - RNA, 20 nt, Staphylococcus aureus subsp. aureus Mu50
gaaugaaaaaguugaucuac

SEQ ID NO: 3971429 - RNA, 15 nt, Staphylococcus aureus subsp. aureus Mu50
gaaugaaaauaagcu

SEQ ID NO: 3971430 - RNA, 13 nt, Staphylococcus aureus subsp. aureus Mu50
gaaugaugaguau

SEQ ID NO: 3971431 - RNA, 18 nt, Staphylococcus aureus subsp. aureus Mu50
gaaugccguaacccaugg

SEQ ID NO: 3971432 - RNA, 13 nt, Staphylococcus aureus subsp. aureus Mu50
gaaugccuaauuu

SEQ ID NO: 3971433 - RNA, 21 nt, Staphylococcus aureus subsp. aureus Mu50
gaaugcgauuuccuuuagcaa

SEQ ID NO: 3971434 - RNA, 23 nt, Staphylococcus aureus subsp. aureus Mu50
gaauggauuacagcguaacuaaa

SEQ ID NO: 3971435 - RNA, 14 nt, Staphylococcus aureus subsp. aureus Mu50
gaauggcaaauaug

SEQ ID NO: 3971436 - RNA, 13 nt, Staphylococcus aureus subsp. aureus Mu50
gaauguacaauuu

SEQ ID NO: 3971437 - RNA, 16 nt, Staphylococcus aureus subsp. aureus Mu50
gaaugucgauauuucu

SEQ ID NO: 3971438 - RNA, 18 nt, Staphylococcus aureus subsp. aureus Mu50
gaaugugaacaucuaguu

SEQ ID NO: 3971439 - RNA, 15 nt, Staphylococcus aureus subsp. aureus Mu50
gaaugugaugauuaa

SEQ ID NO: 3971440 - RNA, 18 nt, Staphylococcus aureus subsp. aureus Mu50
gaaugugcuuguaacaag

SEQ ID NO: 3971441 - RNA, 16 nt, Staphylococcus aureus subsp. aureus Mu50
gaauguguaugguuuu

SEQ ID NO: 3971442 - RNA, 17 nt, Staphylococcus aureus subsp. aureus Mu50
gaauguuugguaacacu

SEQ ID NO: 3971443 - RNA, 17 nt, Staphylococcus aureus subsp. aureus Mu50
gaauuaaaauaacucgc

SEQ ID NO: 3971444 - RNA, 19 nt, Staphylococcus aureus subsp. aureus Mu50
gaauuaacaacaaauauaa

SEQ ID NO: 3971445 - RNA, 22 nt, Staphylococcus aureus subsp. aureus Mu50
gaauuaacuagugccucuuuua

SEQ ID NO: 3971446 - RNA, 17 nt, Staphylococcus aureus subsp. aureus Mu50
gaauuaagaaaaguuac

SEQ ID NO: 3971447 - RNA, 22 nt, Staphylococcus aureus subsp. aureus Mu50
gaauuaauauccaaaauccuga

SEQ ID NO: 3971448 - RNA, 17 nt, Staphylococcus aureus subsp. aureus Mu50
gaauuagauuuacgguu

SEQ ID NO: 3971449 - RNA, 18 nt, Staphylococcus aureus subsp. aureus Mu50
gaauuauucaaguaauau

SEQ ID NO: 3971450 - RNA, 15 nt, Staphylococcus aureus subsp. aureus Mu50
gaauuauuuaaaaug

SEQ ID NO: 3971451 - RNA, 17 nt, Staphylococcus aureus subsp. aureus Mu50
gaauuauuuaaaaugcu

SEQ ID NO: 3971452 - RNA, 18 nt, Staphylococcus aureus subsp. aureus Mu50
gaauucacgcaauaucau

SEQ ID NO: 3971453 - RNA, 13 nt, Staphylococcus aureus subsp. aureus Mu50
gaauucucgauuu

SEQ ID NO: 3971454 - RNA, 12 nt, Staphylococcus aureus subsp. aureus Mu50
gaauugaaaaau

SEQ ID NO: 3971455 - RNA, 11 nt, Staphylococcus aureus subsp. aureus Mu50
gaauugaguau

SEQ ID NO: 3971456 - RNA, 16 nt, Staphylococcus aureus subsp. aureus Mu50
gaauugaguauuaaau

SEQ ID NO: 3971457 - RNA, 23 nt, Staphylococcus aureus subsp. aureus Mu50
gaauugguuuuuagugaaaagaa

SEQ ID NO: 3971458 - RNA, 19 nt, Staphylococcus aureus subsp. aureus Mu50
gaauuuacuccuuacaaua

SEQ ID NO: 3971459 - RNA, 20 nt, Staphylococcus aureus subsp. aureus Mu50
gaauuuacuccuuacaauaa

SEQ ID NO: 3971460 - RNA, 18 nt, Staphylococcus aureus subsp. aureus Mu50
gaauuuagcaucaaaaau

SEQ ID NO: 3971461 - RNA, 21 nt, Staphylococcus aureus subsp. aureus Mu50
gaauuuaggaaugaauaaagc

SEQ ID NO: 3971462 - RNA, 22 nt, Staphylococcus aureus subsp. aureus Mu50
gaauuuaggaaugaauaaagcu

SEQ ID NO: 3971463 - RNA, 13 nt, Staphylococcus aureus subsp. aureus Mu50
gaauuucaucaaa

SEQ ID NO: 3971464 - RNA, 19 nt, Staphylococcus aureus subsp. aureus Mu50
gaauuucguuauuaaacua

SEQ ID NO: 3971465 - RNA, 18 nt, Staphylococcus aureus subsp. aureus Mu50
gaauuucuaauuuaguau

SEQ ID NO: 3971466 - RNA, 17 nt, Staphylococcus aureus subsp. aureus Mu50
gaauuucuuuaagugac

SEQ ID NO: 3971467 - RNA, 16 nt, Staphylococcus aureus subsp. aureus Mu50
gaauuugcacaaagau

SEQ ID NO: 3971468 - RNA, 13 nt, Staphylococcus aureus subsp. aureus Mu50
gaauuuuaauaua

SEQ ID NO: 3971469 - RNA, 18 nt, Staphylococcus aureus subsp. aureus Mu50
gaauuuuucaaagcgauc

SEQ ID NO: 3971470 - RNA, 21 nt, Staphylococcus aureus subsp. aureus Mu50
gaauuuuucaaagcgaucauu

SEQ ID NO: 3971471 - RNA, 21 nt, Staphylococcus aureus subsp. aureus Mu50
gacaaaguucacaacaaagug

SEQ ID NO: 3971472 - RNA, 14 nt, Staphylococcus aureus subsp. aureus Mu50
gacaaauuaaaaaa

SEQ ID NO: 3971473 - RNA, 13 nt, Staphylococcus aureus subsp. aureus Mu50
gacaacauaacaa

SEQ ID NO: 3971474 - RNA, 19 nt, Staphylococcus aureus subsp. aureus Mu50
gacaacauaacaaagaacc

SEQ ID NO: 3971475 - RNA, 18 nt, Staphylococcus aureus subsp. aureus Mu50
gacaacuaauaacaaaua

SEQ ID NO: 3971476 - RNA, 20 nt, Staphylococcus aureus subsp. aureus Mu50
gacaaucacagcaauaauaa

SEQ ID NO: 3971477 - RNA, 20 nt, Staphylococcus aureus subsp. aureus Mu50
gacaaucgcuugcuucuuuc

SEQ ID NO: 3971478 - RNA, 17 nt, Staphylococcus aureus subsp. aureus Mu50
gacaauguacauaaauu

SEQ ID NO: 3971479 - RNA, 14 nt, Staphylococcus aureus subsp. aureus Mu50
gacaauuauaauaa

SEQ ID NO: 3971480 - RNA, 20 nt, Staphylococcus aureus subsp. aureus Mu50
gacacaucacuauacgcaau

SEQ ID NO: 3971481 - RNA, 17 nt, Staphylococcus aureus subsp. aureus Mu50
gacacauuuacuuaaga

SEQ ID NO: 3971482 - RNA, 19 nt, Staphylococcus aureus subsp. aureus Mu50
gacacauuuacuuaagaac

SEQ ID NO: 3971483 - RNA, 18 nt, Staphylococcus aureus subsp. aureus Mu50
gacaccaacauauuuuaa

SEQ ID NO: 3971484 - RNA, 20 nt, Staphylococcus aureus subsp. aureus Mu50
gacacgcccgacaucauaaa

SEQ ID NO: 3971485 - RNA, 23 nt, Staphylococcus aureus subsp. aureus Mu50
gacacgcccgacaucauaaauga

SEQ ID NO: 3971486 - RNA, 21 nt, Staphylococcus aureus subsp. aureus Mu50
gacacuauaccauuuuuauag

SEQ ID NO: 3971487 - RNA, 18 nt, Staphylococcus aureus subsp. aureus Mu50
gacacuuaacuuguguua

SEQ ID NO: 3971488 - RNA, 19 nt, Staphylococcus aureus subsp. aureus Mu50
gacagcuacaauuuucuca

SEQ ID NO: 3971489 - RNA, 20 nt, Staphylococcus aureus subsp. aureus Mu50
gacagcuucucauugaaauc

SEQ ID NO: 3971490 - RNA, 15 nt, Staphylococcus aureus subsp. aureus Mu50
gacaguaaucaaagu

SEQ ID NO: 3971491 - RNA, 18 nt, Staphylococcus aureus subsp. aureus Mu50
gacaguuuccauaaauaa

SEQ ID NO: 3971492 - RNA, 14 nt, Staphylococcus aureus subsp. aureus Mu50
gacauaaaaaauaa

SEQ ID NO: 3971493 - RNA, 23 nt, Staphylococcus aureus subsp. aureus Mu50
gacauaaaauuaacuuaaaauuu

SEQ ID NO: 3971494 - RNA, 22 nt, Staphylococcus aureus subsp. aureus Mu50
gacauacuugucguauucuuca

SEQ ID NO: 3971495 - RNA, 18 nt, Staphylococcus aureus subsp. aureus Mu50
gacauagcguauugauuc

SEQ ID NO: 3971496 - RNA, 16 nt, Staphylococcus aureus subsp. aureus Mu50
gacauaugcagugacu

SEQ ID NO: 3971497 - RNA, 13 nt, Staphylococcus aureus subsp. aureus Mu50
gacaucauaaaug

SEQ ID NO: 3971498 - RNA, 14 nt, Staphylococcus aureus subsp. aureus Mu50
gacaucauuguuuu

SEQ ID NO: 3971499 - RNA, 12 nt, Staphylococcus aureus subsp. aureus Mu50
gacaucuagaug

SEQ ID NO: 3971500 - RNA, 17 nt, Staphylococcus aureus subsp. aureus Mu50
gacauguccauaauauc

SEQ ID NO: 3971501 - RNA, 23 nt, Staphylococcus aureus subsp. aureus Mu50
gacauuaaugauagcaaugaauu

SEQ ID NO: 3971502 - RNA, 13 nt, Staphylococcus aureus subsp. aureus Mu50
gagcguaaaguuu

SEQ ID NO: 3971503 - RNA, 21 nt, Staphylococcus aureus subsp. aureus Mu50
gagcguauuauuauugaaauc

SEQ ID NO: 3971504 - RNA, 23 nt, Staphylococcus aureus subsp. aureus Mu50
gagcuauucauagaccuaugaau

SEQ ID NO: 3971505 - RNA, 16 nt, Staphylococcus aureus subsp. aureus Mu50
gagcucauguuucagu

SEQ ID NO: 3971506 - RNA, 15 nt, Staphylococcus aureus subsp. aureus Mu50
gagcugcuucaacua

SEQ ID NO: 3971507 - RNA, 20 nt, Staphylococcus aureus subsp. aureus Mu50
gagcuugggacagaaaacaa

SEQ ID NO: 3971508 - RNA, 14 nt, Staphylococcus aureus subsp. aureus Mu50
gagcuuuaauuuuu

SEQ ID NO: 3971509 - RNA, 17 nt, Staphylococcus aureus subsp. aureus Mu50
gagcuuuucuaaugcua

SEQ ID NO: 3971510 - RNA, 21 nt, Staphylococcus aureus subsp. aureus Mu50
gaggauaauuauuaggggaga

SEQ ID NO: 3971511 - RNA, 19 nt, Staphylococcus aureus subsp. aureus Mu50
gaggauacauaaaucuaau

SEQ ID NO: 3971512 - RNA, 15 nt, Staphylococcus aureus subsp. aureus Mu50
gaggauauuuauucu

SEQ ID NO: 3971513 - RNA, 22 nt, Staphylococcus aureus subsp. aureus Mu50
gaggcacaguggauuacagaug

SEQ ID NO: 3971514 - RNA, 17 nt, Staphylococcus aureus subsp. aureus Mu50
gaggcgccacaacaugu

SEQ ID NO: 3971515 - RNA, 16 nt, Staphylococcus aureus subsp. aureus Mu50
gagggccccaacacag

SEQ ID NO: 3971516 - RNA, 13 nt, Staphylococcus aureus subsp. aureus Mu50
gagguaaaucuau

SEQ ID NO: 3971517 - RNA, 16 nt, Staphylococcus aureus subsp. aureus Mu50
gagguacuagaauuaa

SEQ ID NO: 3971518 - RNA, 13 nt, Staphylococcus aureus subsp. aureus Mu50
gagguauaauuaa

SEQ ID NO: 3971519 - RNA, 13 nt, Staphylococcus aureus subsp. aureus Mu50
gagguauauacaa

SEQ ID NO: 3971520 - RNA, 19 nt, Staphylococcus aureus subsp. aureus Mu50
gagguguggaguaaagauc

SEQ ID NO: 3971521 - RNA, 22 nt, Staphylococcus aureus subsp. aureus Mu50
gaguagcccuauuuuuaaugua

SEQ ID NO: 3971522 - RNA, 21 nt, Staphylococcus aureus subsp. aureus Mu50
gaguauccugauuuaauguua

SEQ ID NO: 3971523 - RNA, 13 nt, Staphylococcus aureus subsp. aureus Mu50
gaguauuaaauuu

SEQ ID NO: 3971524 - RNA, 19 nt, Staphylococcus aureus subsp. aureus Mu50
gaguauuacuugaaaauag

SEQ ID NO: 3971525 - RNA, 16 nt, Staphylococcus aureus subsp. aureus Mu50
gaguauuuuugcguua

SEQ ID NO: 3971526 - RNA, 20 nt, Staphylococcus aureus subsp. aureus Mu50
gagucaaagucauuuagaua

SEQ ID NO: 3971527 - RNA, 14 nt, Staphylococcus aureus subsp. aureus Mu50
gagucuuauuuuua

SEQ ID NO: 3971528 - RNA, 15 nt, Staphylococcus aureus subsp. aureus Mu50
gagugaaaauaagau

SEQ ID NO: 3971529 - RNA, 18 nt, Staphylococcus aureus subsp. aureus Mu50
gagugcacuuguaauauu

SEQ ID NO: 3971530 - RNA, 21 nt, Staphylococcus aureus subsp. aureus Mu50
gaguggauacuauacuuaaaa

SEQ ID NO: 3971531 - RNA, 19 nt, Staphylococcus aureus subsp. aureus Mu50
gaguguguccaucauuugu

SEQ ID NO: 3971532 - RNA, 13 nt, Staphylococcus aureus subsp. aureus Mu50
gaguuaaacgaaa

SEQ ID NO: 3971533 - RNA, 17 nt, Staphylococcus aureus subsp. aureus Mu50
gaguucaucuuguacag

SEQ ID NO: 3971534 - RNA, 20 nt, Staphylococcus aureus subsp. aureus Mu50
gaguucuuuuugaugaucau

SEQ ID NO: 3971535 - RNA, 19 nt, Staphylococcus aureus subsp. aureus Mu50
gaguuggcaucagacuaaa

SEQ ID NO: 3971536 - RNA, 20 nt, Staphylococcus aureus subsp. aureus Mu50
gaguuguacuacuugauucu

SEQ ID NO: 3971537 - RNA, 21 nt, Staphylococcus aureus subsp. aureus Mu50
gauaaaaaauaaagucauaug

SEQ ID NO: 3971538 - RNA, 19 nt, Staphylococcus aureus subsp. aureus Mu50
gauaaaaauuuaugucuua

SEQ ID NO: 3971539 - RNA, 19 nt, Staphylococcus aureus subsp. aureus Mu50
gauaaaaccaccuaccauu

SEQ ID NO: 3971540 - RNA, 20 nt, Staphylococcus aureus subsp. aureus Mu50
gauaaaaguuguauucugaa

SEQ ID NO: 3971541 - RNA, 12 nt, Staphylococcus aureus subsp. aureus Mu50
gauaaaauaaau

SEQ ID NO: 3971542 - RNA, 22 nt, Staphylococcus aureus subsp. aureus Mu50
gauaaaauaauuguucuucaga

SEQ ID NO: 3971543 - RNA, 23 nt, Staphylococcus aureus subsp. aureus Mu50
gauaaaauaauuguucuucagaa

SEQ ID NO: 3971544 - RNA, 18 nt, Staphylococcus aureus subsp. aureus Mu50
gauaaaguaugagugaua

SEQ ID NO: 3971545 - RNA, 20 nt, Staphylococcus aureus subsp. aureus Mu50
gauaaauaaacucaccaagu

SEQ ID NO: 3971546 - RNA, 21 nt, Staphylococcus aureus subsp. aureus Mu50
gauaaauaacuuuaccaccau

SEQ ID NO: 3971547 - RNA, 15 nt, Staphylococcus aureus subsp. aureus Mu50
gauaaauaauaaguu

SEQ ID NO: 3971548 - RNA, 22 nt, Staphylococcus aureus subsp. aureus Mu50
gauaaauaugauguuaaaaaau

SEQ ID NO: 3971549 - RNA, 22 nt, Staphylococcus aureus subsp. aureus Mu50
gauaaauauugaacaauuuuug

SEQ ID NO: 3971550 - RNA, 16 nt, Staphylococcus aureus subsp. aureus Mu50
gauaaaucaagaaaug

SEQ ID NO: 3971551 - RNA, 14 nt, Staphylococcus aureus subsp. aureus Mu50
gauaaaucaucauu

SEQ ID NO: 3971552 - RNA, 16 nt, Staphylococcus aureus subsp. aureus Mu50
gauaaaugaauugucu

SEQ ID NO: 3971553 - RNA, 22 nt, Staphylococcus aureus subsp. aureus Mu50
gauaaaugaauugucuuaauau

SEQ ID NO: 3971554 - RNA, 13 nt, Staphylococcus aureus subsp. aureus Mu50
gauaaauuaauau

SEQ ID NO: 3971555 - RNA, 20 nt, Staphylococcus aureus subsp. aureus Mu50
gauaaauucccauguauucu

SEQ ID NO: 3971556 - RNA, 15 nt, Staphylococcus aureus subsp. aureus Mu50
gauaacaaaacgauu

SEQ ID NO: 3971557 - RNA, 21 nt, Staphylococcus aureus subsp. aureus Mu50
gauaacaagaaguaauguuaa

SEQ ID NO: 3971558 - RNA, 16 nt, Staphylococcus aureus subsp. aureus Mu50
gauaacagcuacaaau

SEQ ID NO: 3971559 - RNA, 19 nt, Staphylococcus aureus subsp. aureus Mu50
gauaacagcuacaaauaau

SEQ ID NO: 3971560 - RNA, 21 nt, Staphylococcus aureus subsp. aureus Mu50
gauaacagcuacaaauaauga

SEQ ID NO: 3971561 - RNA, 22 nt, Staphylococcus aureus subsp. aureus Mu50
gauaaccauuaugauuaauccu

SEQ ID NO: 3971562 - RNA, 20 nt, Staphylococcus aureus subsp. aureus Mu50
gauaacuacacuuaauauau

SEQ ID NO: 3971563 - RNA, 21 nt, Staphylococcus aureus subsp. aureus Mu50
gauaacuguaacgugaggccc

SEQ ID NO: 3971564 - RNA, 16 nt, Staphylococcus aureus subsp. aureus Mu50
gauaaguggauuuucu

SEQ ID NO: 3971565 - RNA, 18 nt, Staphylococcus aureus subsp. aureus Mu50
gauaauacuguuuaaaua

SEQ ID NO: 3971566 - RNA, 20 nt, Staphylococcus aureus subsp. aureus Mu50
gauaauacuguuuaaauaaa

SEQ ID NO: 3971567 - RNA, 21 nt, Staphylococcus aureus subsp. aureus Mu50
gauaauacuguuuaaauaaaa

SEQ ID NO: 3971568 - RNA, 17 nt, Staphylococcus aureus subsp. aureus Mu50
gauaaucacaauacgaa

SEQ ID NO: 3971569 - RNA, 16 nt, Staphylococcus aureus subsp. aureus Mu50
gauaaucguuaaaaca

SEQ ID NO: 3971570 - RNA, 22 nt, Staphylococcus aureus subsp. aureus Mu50
gauaaucucauucuuuaauaua

SEQ ID NO: 3971571 - RNA, 15 nt, Staphylococcus aureus subsp. aureus Mu50
gauaaugcaccugug

SEQ ID NO: 3971572 - RNA, 18 nt, Staphylococcus aureus subsp. aureus Mu50
gauaaugcaccugugaua

SEQ ID NO: 3971573 - RNA, 22 nt, Staphylococcus aureus subsp. aureus Mu50
gauaauguacauguauaaaaga

SEQ ID NO: 3971574 - RNA, 23 nt, Staphylococcus aureus subsp. aureus Mu50
gauaauuaaaauaagauauauaa

SEQ ID NO: 3971575 - RNA, 20 nt, Staphylococcus aureus subsp. aureus Mu50
gauaauuauacguuacuaaa

SEQ ID NO: 3971576 - RNA, 23 nt, Staphylococcus aureus subsp. aureus Mu50
gauaauuucuucuucuguaauau

SEQ ID NO: 3971577 - RNA, 14 nt, Staphylococcus aureus subsp. aureus Mu50
gauacauaaaacau

SEQ ID NO: 3971578 - RNA, 18 nt, Staphylococcus aureus subsp. aureus Mu50
gauacauaaaauggcauc

SEQ ID NO: 3971579 - RNA, 14 nt, Staphylococcus aureus subsp. aureus Mu50
gauacauaaaucua

SEQ ID NO: 3971580 - RNA, 23 nt, Staphylococcus aureus subsp. aureus Mu50
gauacauauucucugcuucuaaa

SEQ ID NO: 3971581 - RNA, 19 nt, Staphylococcus aureus subsp. aureus Mu50
gauaccaaauauauuuuua

SEQ ID NO: 3971582 - RNA, 20 nt, Staphylococcus aureus subsp. aureus Mu50
gauaccuaagcugauuaaaa

SEQ ID NO: 3971583 - RNA, 21 nt, Staphylococcus aureus subsp. aureus Mu50
gauaccuuuaauaauauugaa

SEQ ID NO: 3971584 - RNA, 18 nt, Staphylococcus aureus subsp. aureus Mu50
gauaccuuuaauaucuaa

SEQ ID NO: 3971585 - RNA, 19 nt, Staphylococcus aureus subsp. aureus Mu50
gauaccuuuuucuaccaau

SEQ ID NO: 3971586 - RNA, 14 nt, Staphylococcus aureus subsp. aureus Mu50
gauacgcuuuuuaa

SEQ ID NO: 3971587 - RNA, 16 nt, Staphylococcus aureus subsp. aureus Mu50
gauacguuauuucaau

SEQ ID NO: 3971588 - RNA, 17 nt, Staphylococcus aureus subsp. aureus Mu50
gauacuaauaucuucuu

SEQ ID NO: 3971589 - RNA, 18 nt, Staphylococcus aureus subsp. aureus Mu50
gaugaacuuaaugcuuca

SEQ ID NO: 3971590 - RNA, 14 nt, Staphylococcus aureus subsp. aureus Mu50
gaugaauaaauaga

SEQ ID NO: 3971591 - RNA, 21 nt, Staphylococcus aureus subsp. aureus Mu50
gaugaaugauugcauugauuu

SEQ ID NO: 3971592 - RNA, 18 nt, Staphylococcus aureus subsp. aureus Mu50
gaugaauuuuuauuuuua

SEQ ID NO: 3971593 - RNA, 21 nt, Staphylococcus aureus subsp. aureus Mu50
gaugaauuuuuauuuuuagua

SEQ ID NO: 3971594 - RNA, 14 nt, Staphylococcus aureus subsp. aureus Mu50
gaugacuguagaaa

SEQ ID NO: 3971595 - RNA, 18 nt, Staphylococcus aureus subsp. aureus Mu50
gaugacuguagaaaacau

SEQ ID NO: 3971596 - RNA, 22 nt, Staphylococcus aureus subsp. aureus Mu50
gaugacuuugucuuuaaugaaa

SEQ ID NO: 3971597 - RNA, 21 nt, Staphylococcus aureus subsp. aureus Mu50
gaugagaaauguuaacgauag

SEQ ID NO: 3971598 - RNA, 16 nt, Staphylococcus aureus subsp. aureus Mu50
gaugagauaaaaucau

SEQ ID NO: 3971599 - RNA, 23 nt, Staphylococcus aureus subsp. aureus Mu50
gaugaguauacuuacugaaacua

SEQ ID NO: 3971600 - RNA, 17 nt, Staphylococcus aureus subsp. aureus Mu50
gaugauaaaaauaaaac

SEQ ID NO: 3971601 - RNA, 19 nt, Staphylococcus aureus subsp. aureus Mu50
gaugauaaaaauaaaaccg

SEQ ID NO: 3971602 - RNA, 13 nt, Staphylococcus aureus subsp. aureus Mu50
gaugauucuuauc

SEQ ID NO: 3971603 - RNA, 17 nt, Staphylococcus aureus subsp. aureus Mu50
gaugauuuauaaaaacu

SEQ ID NO: 3971604 - RNA, 18 nt, Staphylococcus aureus subsp. aureus Mu50
gaugauuuauaaaaacuu

SEQ ID NO: 3971605 - RNA, 14 nt, Staphylococcus aureus subsp. aureus Mu50
gaugcauaaaaacc

SEQ ID NO: 3971606 - RNA, 14 nt, Staphylococcus aureus subsp. aureus Mu50
gaugcgcuucuaac

SEQ ID NO: 3971607 - RNA, 16 nt, Staphylococcus aureus subsp. aureus Mu50
gaugcucguauagaaa

SEQ ID NO: 3971608 - RNA, 19 nt, Staphylococcus aureus subsp. aureus Mu50
gaugcuucgcacaacugca

SEQ ID NO: 3971609 - RNA, 19 nt, Staphylococcus aureus subsp. aureus Mu50
gaugcuucgcaucacugca

SEQ ID NO: 3971610 - RNA, 19 nt, Staphylococcus aureus subsp. aureus Mu50
gaugcuucucacaacugca

SEQ ID NO: 3971611 - RNA, 16 nt, Staphylococcus aureus subsp. aureus Mu50
gaugcuugaauguuug

SEQ ID NO: 3971612 - RNA, 18 nt, Staphylococcus aureus subsp. aureus Mu50
gaugcuuuaauuaaaguu

SEQ ID NO: 3971613 - RNA, 20 nt, Staphylococcus aureus subsp. aureus Mu50
gaugcuuuucuauccauagu

SEQ ID NO: 3971614 - RNA, 22 nt, Staphylococcus aureus subsp. aureus Mu50
gauggcguaagcaguuaauaag

SEQ ID NO: 3971615 - RNA, 19 nt, Staphylococcus aureus subsp. aureus Mu50
gaugggaaaucaguaauau

SEQ ID NO: 3971616 - RNA, 16 nt, Staphylococcus aureus subsp. aureus Mu50
gaugggagaaauuuuu

SEQ ID NO: 3971617 - RNA, 19 nt, Staphylococcus aureus subsp. aureus Mu50
gaugggagaaauuuuucac

SEQ ID NO: 3971618 - RNA, 19 nt, Staphylococcus aureus subsp. aureus Mu50
gaugggccccaacaaagag

SEQ ID NO: 3971619 - RNA, 13 nt, Staphylococcus aureus subsp. aureus Mu50
gaugguuuuguuu

SEQ ID NO: 3971620 - RNA, 17 nt, Staphylococcus aureus subsp. aureus Mu50
gauguacuauaaauccu

SEQ ID NO: 3971621 - RNA, 16 nt, Staphylococcus aureus subsp. aureus Mu50
gaugucacauaugacu

SEQ ID NO: 3971622 - RNA, 13 nt, Staphylococcus aureus subsp. aureus Mu50
gaugucgaaaaua

SEQ ID NO: 3971623 - RNA, 14 nt, Staphylococcus aureus subsp. aureus Mu50
gaugugaauguuuu

SEQ ID NO: 3971624 - RNA, 14 nt, Staphylococcus aureus subsp. aureus Mu50
gauguuaaaaaaua

SEQ ID NO: 3971625 - RNA, 14 nt, Staphylococcus aureus subsp. aureus Mu50
gauguuauaaaaug

SEQ ID NO: 3971626 - RNA, 13 nt, Staphylococcus aureus subsp. aureus Mu50
gauguucaucaac

SEQ ID NO: 3971627 - RNA, 17 nt, Staphylococcus aureus subsp. aureus Mu50
gauguuucaaaauaauu

SEQ ID NO: 3971628 - RNA, 23 nt, Staphylococcus aureus subsp. aureus Mu50
gauguuuucguuugcaaucaucu

SEQ ID NO: 3971629 - RNA, 12 nt, Staphylococcus aureus subsp. aureus Mu50
gauuaaaagugu

SEQ ID NO: 3971630 - RNA, 13 nt, Staphylococcus aureus subsp. aureus Mu50
gauuaaaaguguu

SEQ ID NO: 3971631 - RNA, 20 nt, Staphylococcus aureus subsp. aureus Mu50
gauuaaaguguuucaacaua

SEQ ID NO: 3971632 - RNA, 18 nt, Staphylococcus aureus subsp. aureus Mu50
gauuaaauacgccaaaua

SEQ ID NO: 3971633 - RNA, 12 nt, Staphylococcus aureus subsp. aureus Mu50
gauuaaaugaug

SEQ ID NO: 3971634 - RNA, 14 nt, Staphylococcus aureus subsp. aureus Mu50
gauuaaauucaucu

SEQ ID NO: 3971635 - RNA, 20 nt, Staphylococcus aureus subsp. aureus Mu50
gauuaaauucuuuucaagaa

SEQ ID NO: 3971636 - RNA, 15 nt, Staphylococcus aureus subsp. aureus Mu50
gauuaacaaggaagc

SEQ ID NO: 3971637 - RNA, 19 nt, Staphylococcus aureus subsp. aureus Mu50
gauuaacaaggaagcauga

SEQ ID NO: 3971638 - RNA, 16 nt, Staphylococcus aureus subsp. aureus Mu50
gauuaauuuucuuuuu

SEQ ID NO: 3971639 - RNA, 18 nt, Staphylococcus aureus subsp. aureus Mu50
gauuacagaugaugcuuc

SEQ ID NO: 3971640 - RNA, 15 nt, Staphylococcus aureus subsp. aureus Mu50
gauuaccguuaaaaa

SEQ ID NO: 3971641 - RNA, 16 nt, Staphylococcus aureus subsp. aureus Mu50
gauuauagguauaaga

SEQ ID NO: 3971642 - RNA, 11 nt, Staphylococcus aureus subsp. aureus Mu50
gauuauauaua

SEQ ID NO: 3971643 - RNA, 15 nt, Staphylococcus aureus subsp. aureus Mu50
gauuauauuuuucuu

SEQ ID NO: 3971644 - RNA, 20 nt, Staphylococcus aureus subsp. aureus Mu50
gauuaucauuguucauacgc

SEQ ID NO: 3971645 - RNA, 22 nt, Staphylococcus aureus subsp. aureus Mu50
gauuaucugacauuguugcuaa

SEQ ID NO: 3971646 - RNA, 17 nt, Staphylococcus aureus subsp. aureus Mu50
gauuauguaauucuagc

SEQ ID NO: 3971647 - RNA, 20 nt, Staphylococcus aureus subsp. aureus Mu50
gauuauuaugccuuugauuu

SEQ ID NO: 3971648 - RNA, 19 nt, Staphylococcus aureus subsp. aureus Mu50
gauuauuauuacaaugaaa

SEQ ID NO: 3971649 - RNA, 13 nt, Staphylococcus aureus subsp. aureus Mu50
gauuauucuucau

SEQ ID NO: 3971650 - RNA, 22 nt, Staphylococcus aureus subsp. aureus Mu50
gauuauucuucauuuauaacau

SEQ ID NO: 3971651 - RNA, 18 nt, Staphylococcus aureus subsp. aureus Mu50
gauuauugguugaaauua

SEQ ID NO: 3971652 - RNA, 20 nt, Staphylococcus aureus subsp. aureus Mu50
gauuauuuaaaacuuguaaa

SEQ ID NO: 3971653 - RNA, 22 nt, Staphylococcus aureus subsp. aureus Mu50
gauuauuuaaaacuuguaaauu

SEQ ID NO: 3971654 - RNA, 18 nt, Staphylococcus aureus subsp. aureus Mu50
gauuauuuagauaaaaau

SEQ ID NO: 3971655 - RNA, 20 nt, Staphylococcus aureus subsp. aureus Mu50
gauuauuuagauaaaaauua

SEQ ID NO: 3971656 - RNA, 14 nt, Staphylococcus aureus subsp. aureus Mu50
gauucaaaugacau

SEQ ID NO: 3971657 - RNA, 13 nt, Staphylococcus aureus subsp. aureus Mu50
gauucaaccuuaa

SEQ ID NO: 3971658 - RNA, 15 nt, Staphylococcus aureus subsp. aureus Mu50
gauucaccagguuuu

SEQ ID NO: 3971659 - RNA, 18 nt, Staphylococcus aureus subsp. aureus Mu50
gauucacucuguaauaaa

SEQ ID NO: 3971660 - RNA, 20 nt, Staphylococcus aureus subsp. aureus Mu50
gauucaggauuguagaaucu

SEQ ID NO: 3971661 - RNA, 16 nt, Staphylococcus aureus subsp. aureus Mu50
gauucauaaaauuuaa

SEQ ID NO: 3971662 - RNA, 21 nt, Staphylococcus aureus subsp. aureus Mu50
gauucauaaaauuuaaaacaa

SEQ ID NO: 3971663 - RNA, 17 nt, Staphylococcus aureus subsp. aureus Mu50
gauucauaucuuucaau

SEQ ID NO: 3971664 - RNA, 12 nt, Staphylococcus aureus subsp. aureus Mu50
gauucauauuua

SEQ ID NO: 3971665 - RNA, 15 nt, Staphylococcus aureus subsp. aureus Mu50
gauucauauuuaucg

SEQ ID NO: 3971666 - RNA, 21 nt, Staphylococcus aureus subsp. aureus Mu50
gauucaugaauaauuagauuu

SEQ ID NO: 3971667 - RNA, 19 nt, Staphylococcus aureus subsp. aureus Mu50
gauucauuuaaaaaucaaa

SEQ ID NO: 3971668 - RNA, 14 nt, Staphylococcus aureus subsp. aureus Mu50
gauucccaaauagu

SEQ ID NO: 3971669 - RNA, 23 nt, Staphylococcus aureus subsp. aureus Mu50
gauucguauucaaaguuuucauu

SEQ ID NO: 3971670 - RNA, 14 nt, Staphylococcus aureus subsp. aureus Mu50
gauucguuaucuaa

SEQ ID NO: 3971671 - RNA, 17 nt, Staphylococcus aureus subsp. aureus Mu50
gauucuacagcacugaa

SEQ ID NO: 3971672 - RNA, 13 nt, Staphylococcus aureus subsp. aureus Mu50
gauucuacagcau

SEQ ID NO: 3971673 - RNA, 17 nt, Staphylococcus aureus subsp. aureus Mu50
gauucuuauauguuuua

SEQ ID NO: 3971674 - RNA, 16 nt, Staphylococcus aureus subsp. aureus Mu50
gauucuuaucuuuaau

SEQ ID NO: 3971675 - RNA, 18 nt, Staphylococcus aureus subsp. aureus Mu50
gauucuuaucuuuaauca

SEQ ID NO: 3971676 - RNA, 14 nt, Staphylococcus aureus subsp. aureus Mu50
gauucuucacuaaa

SEQ ID NO: 3971677 - RNA, 19 nt, Staphylococcus aureus subsp. aureus Mu50
gcaagguuuucgccaauaa

SEQ ID NO: 3971678 - RNA, 22 nt, Staphylococcus aureus subsp. aureus Mu50
gcaagucucauaucuauuuuuc

SEQ ID NO: 3971679 - RNA, 22 nt, Staphylococcus aureus subsp. aureus Mu50
gcaagugcuuccacuucaucua

SEQ ID NO: 3971680 - RNA, 23 nt, Staphylococcus aureus subsp. aureus Mu50
gcaagugcuuccacuucaucuaa

SEQ ID NO: 3971681 - RNA, 19 nt, Staphylococcus aureus subsp. aureus Mu50
gcaaguguaucgcccauac

SEQ ID NO: 3971682 - RNA, 14 nt, Staphylococcus aureus subsp. aureus Mu50
gcaauaaaauuagc

SEQ ID NO: 3971683 - RNA, 19 nt, Staphylococcus aureus subsp. aureus Mu50
gcaauaacaccaauugaau

SEQ ID NO: 3971684 - RNA, 15 nt, Staphylococcus aureus subsp. aureus Mu50
gcaauacgcaauguu

SEQ ID NO: 3971685 - RNA, 14 nt, Staphylococcus aureus subsp. aureus Mu50
gcaauagcaccaua

SEQ ID NO: 3971686 - RNA, 15 nt, Staphylococcus aureus subsp. aureus Mu50
gcaauagcuauaacu

SEQ ID NO: 3971687 - RNA, 16 nt, Staphylococcus aureus subsp. aureus Mu50
gcaauaggaugaaacu

SEQ ID NO: 3971688 - RNA, 17 nt, Staphylococcus aureus subsp. aureus Mu50
gcaauaggaugaaacuu

SEQ ID NO: 3971689 - RNA, 23 nt, Staphylococcus aureus subsp. aureus Mu50
gcaaucaccuuuggcuacugcac

SEQ ID NO: 3971690 - RNA, 16 nt, Staphylococcus aureus subsp. aureus Mu50
gcaaucguugaaaaau

SEQ ID NO: 3971691 - RNA, 18 nt, Staphylococcus aureus subsp. aureus Mu50
gcaaucguugaaaaauau

SEQ ID NO: 3971692 - RNA, 14 nt, Staphylococcus aureus subsp. aureus Mu50
gcaaucuauauaaa

SEQ ID NO: 3971693 - RNA, 21 nt, Staphylococcus aureus subsp. aureus Mu50
gcaaucucuuuagaugagauu

SEQ ID NO: 3971694 - RNA, 14 nt, Staphylococcus aureus subsp. aureus Mu50
gcaaugaaauuacc

SEQ ID NO: 3971695 - RNA, 20 nt, Staphylococcus aureus subsp. aureus Mu50
gcaaugauaucuuuuccaaa

SEQ ID NO: 3971696 - RNA, 16 nt, Staphylococcus aureus subsp. aureus Mu50
gcaaugcgaguugggg

SEQ ID NO: 3971697 - RNA, 17 nt, Staphylococcus aureus subsp. aureus Mu50
gcaaugcgaguuggggu

SEQ ID NO: 3971698 - RNA, 15 nt, Staphylococcus aureus subsp. aureus Mu50
gcaauguaaugguua

SEQ ID NO: 3971699 - RNA, 14 nt, Staphylococcus aureus subsp. aureus Mu50
gcaauuaaagucaa

SEQ ID NO: 3971700 - RNA, 21 nt, Staphylococcus aureus subsp. aureus Mu50
gcaauuaaagucaauuuaaau

SEQ ID NO: 3971701 - RNA, 16 nt, Staphylococcus aureus subsp. aureus Mu50
gcaauuauuuuucaaa

SEQ ID NO: 3971702 - RNA, 21 nt, Staphylococcus aureus subsp. aureus Mu50
gcaauugauuguggugaaaua

SEQ ID NO: 3971703 - RNA, 16 nt, Staphylococcus aureus subsp. aureus Mu50
gcaauugguagucauc

SEQ ID NO: 3971704 - RNA, 19 nt, Staphylococcus aureus subsp. aureus Mu50
gcaauuuuucacuuauaac

SEQ ID NO: 3971705 - RNA, 16 nt, Staphylococcus aureus subsp. aureus Mu50
gcacaaaaaaaucucc

SEQ ID NO: 3971706 - RNA, 14 nt, Staphylococcus aureus subsp. aureus Mu50
gcacaacugcauaa

SEQ ID NO: 3971707 - RNA, 20 nt, Staphylococcus aureus subsp. aureus Mu50
gcacaacugcauaaaagccu

SEQ ID NO: 3971708 - RNA, 14 nt, Staphylococcus aureus subsp. aureus Mu50
gcacaagcaucuac

SEQ ID NO: 3971709 - RNA, 13 nt, Staphylococcus aureus subsp. aureus Mu50
gcacauaaaucaa

SEQ ID NO: 3971710 - RNA, 19 nt, Staphylococcus aureus subsp. aureus Mu50
gcacaucagauauaaguag

SEQ ID NO: 3971711 - RNA, 18 nt, Staphylococcus aureus subsp. aureus Mu50
gcacauuuuuaguuagaa

SEQ ID NO: 3971712 - RNA, 12 nt, Staphylococcus aureus subsp. aureus Mu50
gcaccauuauua

SEQ ID NO: 3971713 - RNA, 16 nt, Staphylococcus aureus subsp. aureus Mu50
gcaccgacaauuauaa

SEQ ID NO: 3971714 - RNA, 23 nt, Staphylococcus aureus subsp. aureus Mu50
gcaccgacaauuauaauaaaacu

SEQ ID NO: 3971715 - RNA, 21 nt, Staphylococcus aureus subsp. aureus Mu50
gcaccgauuuggucagcgaca

SEQ ID NO: 3971716 - RNA, 13 nt, Staphylococcus aureus subsp. aureus Mu50
gcaccuauuuuuu

SEQ ID NO: 3971717 - RNA, 15 nt, Staphylococcus aureus subsp. aureus Mu50
gcaccuccaaccgcu

SEQ ID NO: 3971718 - RNA, 20 nt, Staphylococcus aureus subsp. aureus Mu50
gcaccuggucguacuuucaa

SEQ ID NO: 3971719 - RNA, 15 nt, Staphylococcus aureus subsp. aureus Mu50
gcacgagacaauaau

SEQ ID NO: 3971720 - RNA, 16 nt, Staphylococcus aureus subsp. aureus Mu50
gcacgagacaauaaug

SEQ ID NO: 3971721 - RNA, 15 nt, Staphylococcus aureus subsp. aureus Mu50
gcacgagcaacaucu

SEQ ID NO: 3971722 - RNA, 22 nt, Staphylococcus aureus subsp. aureus Mu50
gcacgcgugccaacaucuucaa

SEQ ID NO: 3971723 - RNA, 16 nt, Staphylococcus aureus subsp. aureus Mu50
gcacggauaccuacug

SEQ ID NO: 3971724 - RNA, 19 nt, Staphylococcus aureus subsp. aureus Mu50
gcacuagccguuauuuuuu

SEQ ID NO: 3971725 - RNA, 21 nt, Staphylococcus aureus subsp. aureus Mu50
gcacuauaaaauucaccaacu

SEQ ID NO: 3971726 - RNA, 16 nt, Staphylococcus aureus subsp. aureus Mu50
gcacuaucaaugacau

SEQ ID NO: 3971727 - RNA, 14 nt, Staphylococcus aureus subsp. aureus Mu50
gcacugagcaacaa

SEQ ID NO: 3971728 - RNA, 12 nt, Staphylococcus aureus subsp. aureus Mu50
gcacuuggauuu

SEQ ID NO: 3971729 - RNA, 17 nt, Staphylococcus aureus subsp. aureus Mu50
gcagacguaucaucaaa

SEQ ID NO: 3971730 - RNA, 15 nt, Staphylococcus aureus subsp. aureus Mu50
gcagcaaugacacua

SEQ ID NO: 3971731 - RNA, 13 nt, Staphylococcus aureus subsp. aureus Mu50
gcagcaucauaau

SEQ ID NO: 3971732 - RNA, 16 nt, Staphylococcus aureus subsp. aureus Mu50
gcagcuugaucuaaau

SEQ ID NO: 3971733 - RNA, 13 nt, Staphylococcus aureus subsp. aureus Mu50
gcagcuuuauaau

SEQ ID NO: 3971734 - RNA, 13 nt, Staphylococcus aureus subsp. aureus Mu50
gcaggaaugauau

SEQ ID NO: 3971735 - RNA, 14 nt, Staphylococcus aureus subsp. aureus Mu50
gcaggcgaaccgaa

SEQ ID NO: 3971736 - RNA, 19 nt, Staphylococcus aureus subsp. aureus Mu50
gcaggcgaaccgaagcgca

SEQ ID NO: 3971737 - RNA, 18 nt, Staphylococcus aureus subsp. aureus Mu50
gcagggugcuaaauuuac

SEQ ID NO: 3971738 - RNA, 12 nt, Staphylococcus aureus subsp. aureus Mu50
gcaguauauauc

SEQ ID NO: 3971739 - RNA, 15 nt, Staphylococcus aureus subsp. aureus Mu50
gcaguauauaucaaa

SEQ ID NO: 3971740 - RNA, 22 nt, Staphylococcus aureus subsp. aureus Mu50
gcagugaaguuaacuauaacaa

SEQ ID NO: 3971741 - RNA, 20 nt, Staphylococcus aureus subsp. aureus Mu50
gcagugaucuuuuuuauauu

SEQ ID NO: 3971742 - RNA, 13 nt, Staphylococcus aureus subsp. aureus Mu50
gcaguugaaaaag

SEQ ID NO: 3971743 - RNA, 14 nt, Staphylococcus aureus subsp. aureus Mu50
gcaguugaaaaaga

SEQ ID NO: 3971744 - RNA, 23 nt, Staphylococcus aureus subsp. aureus Mu50
gcauaaaaaaagaacuacgcauu

SEQ ID NO: 3971745 - RNA, 17 nt, Staphylococcus aureus subsp. aureus Mu50
gcauacgaauuaaaaua

SEQ ID NO: 3971746 - RNA, 22 nt, Staphylococcus aureus subsp. aureus Mu50
gcauacugucaucuuucaacgc

SEQ ID NO: 3971747 - RNA, 14 nt, Staphylococcus aureus subsp. aureus Mu50
gcauagcucuugcu

SEQ ID NO: 3971748 - RNA, 16 nt, Staphylococcus aureus subsp. aureus Mu50
gcauauauauauagau

SEQ ID NO: 3971749 - RNA, 16 nt, Staphylococcus aureus subsp. aureus Mu50
gcauaucuuuaucauu

SEQ ID NO: 3971750 - RNA, 18 nt, Staphylococcus aureus subsp. aureus Mu50
gcauaucuuuaucauuau

SEQ ID NO: 3971751 - RNA, 21 nt, Staphylococcus aureus subsp. aureus Mu50
gcauaucuuuaucauuauucg

SEQ ID NO: 3971752 - RNA, 22 nt, Staphylococcus aureus subsp. aureus Mu50
gcauaugauaguguauguuuuu

SEQ ID NO: 3971753 - RNA, 16 nt, Staphylococcus aureus subsp. aureus Mu50
gcauauguaauacaaa

SEQ ID NO: 3971754 - RNA, 19 nt, Staphylococcus aureus subsp. aureus Mu50
gcauauguaauacaaaaga

SEQ ID NO: 3971755 - RNA, 14 nt, Staphylococcus aureus subsp. aureus Mu50
gcauauucacgaua

SEQ ID NO: 3971756 - RNA, 23 nt, Staphylococcus aureus subsp. aureus Mu50
gcauauucgcuuaaaaacgcuuu

SEQ ID NO: 3971757 - RNA, 16 nt, Staphylococcus aureus subsp. aureus Mu50
gcauauucuauuguug

SEQ ID NO: 3971758 - RNA, 19 nt, Staphylococcus aureus subsp. aureus Mu50
gcauauuuaauacauuuuu

SEQ ID NO: 3971759 - RNA, 19 nt, Staphylococcus aureus subsp. aureus Mu50
gcaucaaaaauaaaaaugc

SEQ ID NO: 3971760 - RNA, 16 nt, Staphylococcus aureus subsp. aureus Mu50
gcaucaacagauacuu

SEQ ID NO: 3971761 - RNA, 15 nt, Staphylococcus aureus subsp. aureus Mu50
gcaugaaucgcauuu

SEQ ID NO: 3971762 - RNA, 15 nt, Staphylococcus aureus subsp. aureus Mu50
gcaugacuguaagua

SEQ ID NO: 3971763 - RNA, 17 nt, Staphylococcus aureus subsp. aureus Mu50
gcaugacuguaaguaug

SEQ ID NO: 3971764 - RNA, 15 nt, Staphylococcus aureus subsp. aureus Mu50
gcaugccagaugcaa

SEQ ID NO: 3971765 - RNA, 14 nt, Staphylococcus aureus subsp. aureus Mu50
gcgcgacguuuaaa

SEQ ID NO: 3971766 - RNA, 17 nt, Staphylococcus aureus subsp. aureus Mu50
gcgcuguaauaccuuua

SEQ ID NO: 3971767 - RNA, 13 nt, Staphylococcus aureus subsp. aureus Mu50
gcggaaauaugau

SEQ ID NO: 3971768 - RNA, 20 nt, Staphylococcus aureus subsp. aureus Mu50
gcggaauacagaugaugcuu

SEQ ID NO: 3971769 - RNA, 23 nt, Staphylococcus aureus subsp. aureus Mu50
gcguacuuggcucaaaacuuuua

SEQ ID NO: 3971770 - RNA, 13 nt, Staphylococcus aureus subsp. aureus Mu50
gcguauuccauug

SEQ ID NO: 3971771 - RNA, 13 nt, Staphylococcus aureus subsp. aureus Mu50
gcguauuuuaaug

SEQ ID NO: 3971772 - RNA, 17 nt, Staphylococcus aureus subsp. aureus Mu50
gcgucugauucucuaac

SEQ ID NO: 3971773 - RNA, 15 nt, Staphylococcus aureus subsp. aureus Mu50
gcgugaagagaugaa

SEQ ID NO: 3971774 - RNA, 20 nt, Staphylococcus aureus subsp. aureus Mu50
gcguuuaaucacaucuuuuu

SEQ ID NO: 3971775 - RNA, 13 nt, Staphylococcus aureus subsp. aureus Mu50
gcuaaaaaaauua

SEQ ID NO: 3971776 - RNA, 11 nt, Staphylococcus aureus subsp. aureus Mu50
gcuaaaaauau

SEQ ID NO: 3971777 - RNA, 14 nt, Staphylococcus aureus subsp. aureus Mu50
gcuaaaaguauaaa

SEQ ID NO: 3971778 - RNA, 14 nt, Staphylococcus aureus subsp. aureus Mu50
gcuaaacaaagggg

SEQ ID NO: 3971779 - RNA, 18 nt, Staphylococcus aureus subsp. aureus Mu50
gcuaaacgcaauacgaau

SEQ ID NO: 3971780 - RNA, 23 nt, Staphylococcus aureus subsp. aureus Mu50
gcuaaauguuaaugcuucguaau

SEQ ID NO: 3971781 - RNA, 22 nt, Staphylococcus aureus subsp. aureus Mu50
gcuaacgaaucgccuacuauaa

SEQ ID NO: 3971782 - RNA, 14 nt, Staphylococcus aureus subsp. aureus Mu50
gcuaauacuaauca

SEQ ID NO: 3971783 - RNA, 12 nt, Staphylococcus aureus subsp. aureus Mu50
gcuaaucuauuu

SEQ ID NO: 3971784 - RNA, 15 nt, Staphylococcus aureus subsp. aureus Mu50
gcuaaugauaaucca

SEQ ID NO: 3971785 - RNA, 18 nt, Staphylococcus aureus subsp. aureus Mu50
gcuaaugcaacuaaaacu

SEQ ID NO: 3971786 - RNA, 18 nt, Staphylococcus aureus subsp. aureus Mu50
gcuaaugcauuauuauaa

SEQ ID NO: 3971787 - RNA, 23 nt, Staphylococcus aureus subsp. aureus Mu50
gcuaaugcauuauuauaauagcu

SEQ ID NO: 3971788 - RNA, 17 nt, Staphylococcus aureus subsp. aureus Mu50
gcuaauuucuaauacau

SEQ ID NO: 3971789 - RNA, 17 nt, Staphylococcus aureus subsp. aureus Mu50
gcuaauuuuaauuuuca

SEQ ID NO: 3971790 - RNA, 21 nt, Staphylococcus aureus subsp. aureus Mu50
gcuaauuuuuucaucauucaa

SEQ ID NO: 3971791 - RNA, 14 nt, Staphylococcus aureus subsp. aureus Mu50
gcuacaauuauaaa

SEQ ID NO: 3971792 - RNA, 19 nt, Staphylococcus aureus subsp. aureus Mu50
gcuacuugaauaccuuuua

SEQ ID NO: 3971793 - RNA, 22 nt, Staphylococcus aureus subsp. aureus Mu50
gcuagauuuuaaacgcucauca

SEQ ID NO: 3971794 - RNA, 17 nt, Staphylococcus aureus subsp. aureus Mu50
gcuagcuuucuuuuuca

SEQ ID NO: 3971795 - RNA, 20 nt, Staphylococcus aureus subsp. aureus Mu50
gcuagugcgcgauaaauaau

SEQ ID NO: 3971796 - RNA, 24 nt, Staphylococcus aureus subsp. aureus Mu50
gcuaguugaaccguaacuauauga

SEQ ID NO: 3971797 - RNA, 20 nt, Staphylococcus aureus subsp. aureus Mu50
gcuauaaaaguacuuuaaaa

SEQ ID NO: 3971798 - RNA, 14 nt, Staphylococcus aureus subsp. aureus Mu50
gcuauaaaauuuug

SEQ ID NO: 3971799 - RNA, 16 nt, Staphylococcus aureus subsp. aureus Mu50
gcuauaacucuaaaua

SEQ ID NO: 3971800 - RNA, 23 nt, Staphylococcus aureus subsp. aureus Mu50
gcuauaacucuaaauauaauaga

SEQ ID NO: 3971801 - RNA, 19 nt, Staphylococcus aureus subsp. aureus Mu50
gcuauaagaacuaaugguu

SEQ ID NO: 3971802 - RNA, 14 nt, Staphylococcus aureus subsp. aureus Mu50
gcuauacauugaua

SEQ ID NO: 3971803 - RNA, 14 nt, Staphylococcus aureus subsp. aureus Mu50
gcuauauaauuuau

SEQ ID NO: 3971804 - RNA, 18 nt, Staphylococcus aureus subsp. aureus Mu50
gcuauauaauuuauaaaa

SEQ ID NO: 3971805 - RNA, 12 nt, Staphylococcus aureus subsp. aureus Mu50
gcuaucaaacuu

SEQ ID NO: 3971806 - RNA, 15 nt, Staphylococcus aureus subsp. aureus Mu50
gcuaugaagaaaucu

SEQ ID NO: 3971807 - RNA, 20 nt, Staphylococcus aureus subsp. aureus Mu50
gcuauuucaacaaacauaaa

SEQ ID NO: 3971808 - RNA, 22 nt, Staphylococcus aureus subsp. aureus Mu50
gcuauuucaacaaacauaaaua

SEQ ID NO: 3971809 - RNA, 20 nt, Staphylococcus aureus subsp. aureus Mu50
gcuauuuuauacauaaauau

SEQ ID NO: 3971810 - RNA, 23 nt, Staphylococcus aureus subsp. aureus Mu50
gcuauuuuggauaauaugagaca

SEQ ID NO: 3971811 - RNA, 13 nt, Staphylococcus aureus subsp. aureus Mu50
gcucaaaacuuuu

SEQ ID NO: 3971812 - RNA, 15 nt, Staphylococcus aureus subsp. aureus Mu50
gcucaacuauauaua

SEQ ID NO: 3971813 - RNA, 19 nt, Staphylococcus aureus subsp. aureus Mu50
gcucaaguugauuauucua

SEQ ID NO: 3971814 - RNA, 18 nt, Staphylococcus aureus subsp. aureus Mu50
gcucaaucgcaucuguua

SEQ ID NO: 3971815 - RNA, 19 nt, Staphylococcus aureus subsp. aureus Mu50
gcucauccucauuaauaaa

SEQ ID NO: 3971816 - RNA, 18 nt, Staphylococcus aureus subsp. aureus Mu50
gcucauuucaauauuaaa

SEQ ID NO: 3971817 - RNA, 16 nt, Staphylococcus aureus subsp. aureus Mu50
gcuccauuuaauuugu

SEQ ID NO: 3971818 - RNA, 20 nt, Staphylococcus aureus subsp. aureus Mu50
gcucguuaaaucacauauga

SEQ ID NO: 3971819 - RNA, 19 nt, Staphylococcus aureus subsp. aureus Mu50
gcucguugcagauuuugca

SEQ ID NO: 3971820 - RNA, 20 nt, Staphylococcus aureus subsp. aureus Mu50
gcucuaaacuucuauuaaua

SEQ ID NO: 3971821 - RNA, 17 nt, Staphylococcus aureus subsp. aureus Mu50
gcucuaauccaaaauaa

SEQ ID NO: 3971822 - RNA, 20 nt, Staphylococcus aureus subsp. aureus Mu50
gcucuaauccaaaauaaucg

SEQ ID NO: 3971823 - RNA, 18 nt, Staphylococcus aureus subsp. aureus Mu50
gcucuaauucaaugauuu

SEQ ID NO: 3971824 - RNA, 22 nt, Staphylococcus aureus subsp. aureus Mu50
gcucuaauucaaugauuuuuaa

SEQ ID NO: 3971825 - RNA, 15 nt, Staphylococcus aureus subsp. aureus Mu50
gcucuauaucaaauu

SEQ ID NO: 3971826 - RNA, 20 nt, Staphylococcus aureus subsp. aureus Mu50
gcucuauggcuucgcuaaua

SEQ ID NO: 3971827 - RNA, 22 nt, Staphylococcus aureus subsp. aureus Mu50
gcucuuaauguacuuuucuguc

SEQ ID NO: 3971828 - RNA, 22 nt, Staphylococcus aureus subsp. aureus Mu50
gcucuuauaaagacaccuucaa

SEQ ID NO: 3971829 - RNA, 22 nt, Staphylococcus aureus subsp. aureus Mu50
gcucuucaaauuuaccgucauu

SEQ ID NO: 3971830 - RNA, 17 nt, Staphylococcus aureus subsp. aureus Mu50
gcucuuuuuguaugagu

SEQ ID NO: 3971831 - RNA, 18 nt, Staphylococcus aureus subsp. aureus Mu50
gcucuuuuuguuuaucug

SEQ ID NO: 3971832 - RNA, 21 nt, Staphylococcus aureus subsp. aureus Mu50
gcugaaauuuuuuagugaaaa

SEQ ID NO: 3971833 - RNA, 20 nt, Staphylococcus aureus subsp. aureus Mu50
gcugaaucgaguuugaaaua

SEQ ID NO: 3971834 - RNA, 11 nt, Staphylococcus aureus subsp. aureus Mu50
gcugaauuuua

SEQ ID NO: 3971835 - RNA, 18 nt, Staphylococcus aureus subsp. aureus Mu50
gcugauacccaaucauuc

SEQ ID NO: 3971836 - RNA, 21 nt, Staphylococcus aureus subsp. aureus Mu50
gcugcaagucucauaucuauu

SEQ ID NO: 3971837 - RNA, 22 nt, Staphylococcus aureus subsp. aureus Mu50
gcugcaagucucauaucuauuu

SEQ ID NO: 3971838 - RNA, 18 nt, Staphylococcus aureus subsp. aureus Mu50
gcugcaaucguugaaaaa

SEQ ID NO: 3971839 - RNA, 14 nt, Staphylococcus aureus subsp. aureus Mu50
gcugcaccaagaaa

SEQ ID NO: 3971840 - RNA, 15 nt, Staphylococcus aureus subsp. aureus Mu50
gcugcaucaauauga

SEQ ID NO: 3971841 - RNA, 15 nt, Staphylococcus aureus subsp. aureus Mu50
gcugcuguacaauuu

SEQ ID NO: 3971842 - RNA, 15 nt, Staphylococcus aureus subsp. aureus Mu50
gcuggcccccaacac

SEQ ID NO: 3971843 - RNA, 22 nt, Staphylococcus aureus subsp. aureus Mu50
gcuggcgcaaugauaucuuuuc

SEQ ID NO: 3971844 - RNA, 14 nt, Staphylococcus aureus subsp. aureus Mu50
gcuggguaauaaau

SEQ ID NO: 3971845 - RNA, 19 nt, Staphylococcus aureus subsp. aureus Mu50
gcugguaauauuuuuguug

SEQ ID NO: 3971846 - RNA, 22 nt, Staphylococcus aureus subsp. aureus Mu50
gcugguugcuucuuaucaacaa

SEQ ID NO: 3971847 - RNA, 12 nt, Staphylococcus aureus subsp. aureus Mu50
gcugucauaccu

SEQ ID NO: 3971848 - RNA, 15 nt, Staphylococcus aureus subsp. aureus Mu50
gcugucauaccuuuu

SEQ ID NO: 3971849 - RNA, 17 nt, Staphylococcus aureus subsp. aureus Mu50
gcuguccacuauauccu

SEQ ID NO: 3971850 - RNA, 19 nt, Staphylococcus aureus subsp. aureus Mu50
gcuguccaucgucaucacu

SEQ ID NO: 3971851 - RNA, 20 nt, Staphylococcus aureus subsp. aureus Mu50
gcuguccgaggcuaauuuua

SEQ ID NO: 3971852 - RNA, 21 nt, Staphylococcus aureus subsp. aureus Mu50
ggaacauuucaauccuuuguu

SEQ ID NO: 3971853 - RNA, 12 nt, Staphylococcus aureus subsp. aureus Mu50
ggaagaacagca

SEQ ID NO: 3971854 - RNA, 17 nt, Staphylococcus aureus subsp. aureus Mu50
ggaagauaggauuuaca

SEQ ID NO: 3971855 - RNA, 14 nt, Staphylococcus aureus subsp. aureus Mu50
ggaagcgucuuuuu

SEQ ID NO: 3971856 - RNA, 15 nt, Staphylococcus aureus subsp. aureus Mu50
ggaauaacuuuuuaa

SEQ ID NO: 3971857 - RNA, 21 nt, Staphylococcus aureus subsp. aureus Mu50
ggaauagauguugaugaagua

SEQ ID NO: 3971858 - RNA, 19 nt, Staphylococcus aureus subsp. aureus Mu50
ggaauauuaacaccagaua

SEQ ID NO: 3971859 - RNA, 23 nt, Staphylococcus aureus subsp. aureus Mu50
ggaauguuccuccaccaccugca

SEQ ID NO: 3971860 - RNA, 21 nt, Staphylococcus aureus subsp. aureus Mu50
ggaauuguuaauuucaacauu

SEQ ID NO: 3971861 - RNA, 20 nt, Staphylococcus aureus subsp. aureus Mu50
ggaauuuuuaugcauuauag

SEQ ID NO: 3971862 - RNA, 11 nt, Staphylococcus aureus subsp. aureus Mu50
ggacaauguag

SEQ ID NO: 3971863 - RNA, 19 nt, Staphylococcus aureus subsp. aureus Mu50
ggacauagguauaaucauu

SEQ ID NO: 3971864 - RNA, 18 nt, Staphylococcus aureus subsp. aureus Mu50
ggaccuauuguauuguuu

SEQ ID NO: 3971865 - RNA, 23 nt, Staphylococcus aureus subsp. aureus Mu50
ggacgauaacagcuacaaauaau

SEQ ID NO: 3971866 - RNA, 16 nt, Staphylococcus aureus subsp. aureus Mu50
ggagauuagagaagaa

SEQ ID NO: 3971867 - RNA, 15 nt, Staphylococcus aureus subsp. aureus Mu50
ggagcauuucauuag

SEQ ID NO: 3971868 - RNA, 18 nt, Staphylococcus aureus subsp. aureus Mu50
ggagcggaagauaggauu

SEQ ID NO: 3971869 - RNA, 23 nt, Staphylococcus aureus subsp. aureus Mu50
ggaguauuuuugcguuaauaauu

SEQ ID NO: 3971870 - RNA, 15 nt, Staphylococcus aureus subsp. aureus Mu50
ggagugggacagaaa

SEQ ID NO: 3971871 - RNA, 16 nt, Staphylococcus aureus subsp. aureus Mu50
ggagugggacagaaau

SEQ ID NO: 3971872 - RNA, 20 nt, Staphylococcus aureus subsp. aureus Mu50
ggagugggacagaaaugaua

SEQ ID NO: 3971873 - RNA, 13 nt, Staphylococcus aureus subsp. aureus Mu50
ggauaagaacgag

SEQ ID NO: 3971874 - RNA, 14 nt, Staphylococcus aureus subsp. aureus Mu50
ggauaauuuuauug

SEQ ID NO: 3971875 - RNA, 13 nt, Staphylococcus aureus subsp. aureus Mu50
ggauaucuuuguu

SEQ ID NO: 3971876 - RNA, 23 nt, Staphylococcus aureus subsp. aureus Mu50
ggauauuuuuuaauaaucaaacc

SEQ ID NO: 3971877 - RNA, 19 nt, Staphylococcus aureus subsp. aureus Mu50
ggaucacguuuuucuuuaa

SEQ ID NO: 3971878 - RNA, 15 nt, Staphylococcus aureus subsp. aureus Mu50
ggaucuuucaaagua

SEQ ID NO: 3971879 - RNA, 19 nt, Staphylococcus aureus subsp. aureus Mu50
ggaugaguuuaaaaauaug

SEQ ID NO: 3971880 - RNA, 18 nt, Staphylococcus aureus subsp. aureus Mu50
ggaugcacuccuauuguu

SEQ ID NO: 3971881 - RNA, 23 nt, Staphylococcus aureus subsp. aureus Mu50
ggaugggccccaacacagagaau

SEQ ID NO: 3971882 - RNA, 16 nt, Staphylococcus aureus subsp. aureus Mu50
ggaugugacaaauacu

SEQ ID NO: 3971883 - RNA, 16 nt, Staphylococcus aureus subsp. aureus Mu50
ggauguuuucguuugc

SEQ ID NO: 3971884 - RNA, 19 nt, Staphylococcus aureus subsp. aureus Mu50
ggauuaaaagcaucuuuaa

SEQ ID NO: 3971885 - RNA, 15 nt, Staphylococcus aureus subsp. aureus Mu50
ggauuaucuguaauu

SEQ ID NO: 3971886 - RNA, 19 nt, Staphylococcus aureus subsp. aureus Mu50
ggauuucuuauuuguaauu

SEQ ID NO: 3971887 - RNA, 17 nt, Staphylococcus aureus subsp. aureus Mu50
ggauuuuuacaaaguga

SEQ ID NO: 3971888 - RNA, 22 nt, Staphylococcus aureus subsp. aureus Mu50
ggauuuuuuuauguuugggaua

SEQ ID NO: 3971889 - RNA, 15 nt, Staphylococcus aureus subsp. aureus Mu50
ggcaaagucauuaaa

SEQ ID NO: 3971890 - RNA, 13 nt, Staphylococcus aureus subsp. aureus Mu50
ggcaaaucaaaca

SEQ ID NO: 3971891 - RNA, 14 nt, Staphylococcus aureus subsp. aureus Mu50
ggcaaauucaacuu

SEQ ID NO: 3971892 - RNA, 23 nt, Staphylococcus aureus subsp. aureus Mu50
ggcaagauuggcugugcuauaau

SEQ ID NO: 3971893 - RNA, 14 nt, Staphylococcus aureus subsp. aureus Mu50
ggcaauauacuuuu

SEQ ID NO: 3971894 - RNA, 21 nt, Staphylococcus aureus subsp. aureus Mu50
ggcaauauugaacaauucuuc

SEQ ID NO: 3971895 - RNA, 17 nt, Staphylococcus aureus subsp. aureus Mu50
ggcaaucuauauaaaug

SEQ ID NO: 3971896 - RNA, 15 nt, Staphylococcus aureus subsp. aureus Mu50
ggcaaugaaauuacc

SEQ ID NO: 3971897 - RNA, 20 nt, Staphylococcus aureus subsp. aureus Mu50
ggcaaugaaauuaccaacac

SEQ ID NO: 3971898 - RNA, 19 nt, Staphylococcus aureus subsp. aureus Mu50
ggcaauugagaaauagcaa

SEQ ID NO: 3971899 - RNA, 15 nt, Staphylococcus aureus subsp. aureus Mu50
ggcacauaaaucaau

SEQ ID NO: 3971900 - RNA, 21 nt, Staphylococcus aureus subsp. aureus Mu50
ggcacuuaagcuuuaaucaua

SEQ ID NO: 3971901 - RNA, 15 nt, Staphylococcus aureus subsp. aureus Mu50
ggcaggaaugauaua

SEQ ID NO: 3971902 - RNA, 23 nt, Staphylococcus aureus subsp. aureus Mu50
ggcaguaauuuucauuguuucag

SEQ ID NO: 3971903 - RNA, 16 nt, Staphylococcus aureus subsp. aureus Mu50
ggcauaaccuguaauu

SEQ ID NO: 3971904 - RNA, 13 nt, Staphylococcus aureus subsp. aureus Mu50
ggccaugagcucu

SEQ ID NO: 3971905 - RNA, 15 nt, Staphylococcus aureus subsp. aureus Mu50
ggcccacaccccaac

SEQ ID NO: 3971906 - RNA, 13 nt, Staphylococcus aureus subsp. aureus Mu50
ggccccaacacag

SEQ ID NO: 3971907 - RNA, 13 nt, Staphylococcus aureus subsp. aureus Mu50
ggcccccaacacu

SEQ ID NO: 3971908 - RNA, 17 nt, Staphylococcus aureus subsp. aureus Mu50
ggccuccucuuuuauuu

SEQ ID NO: 3971909 - RNA, 14 nt, Staphylococcus aureus subsp. aureus Mu50
ggccuuuuuuauug

SEQ ID NO: 3971910 - RNA, 18 nt, Staphylococcus aureus subsp. aureus Mu50
ggcgaauagcgauuuuaa

SEQ ID NO: 3971911 - RNA, 12 nt, Staphylococcus aureus subsp. aureus Mu50
ggcgacauaaau

SEQ ID NO: 3971912 - RNA, 23 nt, Staphylococcus aureus subsp. aureus Mu50
ggcgcuguuccaaauucauuugu

SEQ ID NO: 3971913 - RNA, 23 nt, Staphylococcus aureus subsp. aureus Mu50
ggcggggccccaacacagagaau

SEQ ID NO: 3971914 - RNA, 14 nt, Staphylococcus aureus subsp. aureus Mu50
ggcguacauauaau

SEQ ID NO: 3971915 - RNA, 18 nt, Staphylococcus aureus subsp. aureus Mu50
ggcuauacauugauaaau

SEQ ID NO: 3971916 - RNA, 17 nt, Staphylococcus aureus subsp. aureus Mu50
ggcuugguuauuuucaa

SEQ ID NO: 3971917 - RNA, 22 nt, Staphylococcus aureus subsp. aureus Mu50
ggcuugugaaugguugauuaua

SEQ ID NO: 3971918 - RNA, 11 nt, Staphylococcus aureus subsp. aureus Mu50
ggcuuuaaaau

SEQ ID NO: 3971919 - RNA, 19 nt, Staphylococcus aureus subsp. aureus Mu50
ggcuuugaagggagcauuu

SEQ ID NO: 3971920 - RNA, 22 nt, Staphylococcus aureus subsp. aureus Mu50
ggcuuuuuauaccaauaauuac

SEQ ID NO: 3971921 - RNA, 18 nt, Staphylococcus aureus subsp. aureus Mu50
ggcuuuuuuauuuuauaa

SEQ ID NO: 3971922 - RNA, 16 nt, Staphylococcus aureus subsp. aureus Mu50
gggaaauauuugaaaa

SEQ ID NO: 3971923 - RNA, 14 nt, Staphylococcus aureus subsp. aureus Mu50
gggaagaccauuuu

SEQ ID NO: 3971924 - RNA, 14 nt, Staphylococcus aureus subsp. aureus Mu50
gggacagaaaacaa

SEQ ID NO: 3971925 - RNA, 17 nt, Staphylococcus aureus subsp. aureus Mu50
gggagugggacagaaau

SEQ ID NO: 3971926 - RNA, 17 nt, Staphylococcus aureus subsp. aureus Mu50
gggauauagaaaaggga

SEQ ID NO: 3971927 - RNA, 18 nt, Staphylococcus aureus subsp. aureus Mu50
gggauuuuuuuauguuug

SEQ ID NO: 3971928 - RNA, 13 nt, Staphylococcus aureus subsp. aureus Mu50
gggcaaaaaagga

SEQ ID NO: 3971929 - RNA, 13 nt, Staphylococcus aureus subsp. aureus Mu50
gggcagaucauaa

SEQ ID NO: 3971930 - RNA, 19 nt, Staphylococcus aureus subsp. aureus Mu50
gggcauugagauuggaagg

SEQ ID NO: 3971931 - RNA, 12 nt, Staphylococcus aureus subsp. aureus Mu50
gggccccaacac

SEQ ID NO: 3971932 - RNA, 15 nt, Staphylococcus aureus subsp. aureus Mu50
gggccccaacacaga

SEQ ID NO: 3971933 - RNA, 20 nt, Staphylococcus aureus subsp. aureus Mu50
gggcuagagcguuuugcuuu

SEQ ID NO: 3971934 - RNA, 15 nt, Staphylococcus aureus subsp. aureus Mu50
gggcuuuuaugcaug

SEQ ID NO: 3971935 - RNA, 21 nt, Staphylococcus aureus subsp. aureus Mu50
ggggaagaccauuuuauauuu

SEQ ID NO: 3971936 - RNA, 19 nt, Staphylococcus aureus subsp. aureus Mu50
ggggcuuuuaugcaugcgc

SEQ ID NO: 3971937 - RNA, 19 nt, Staphylococcus aureus subsp. aureus Mu50
ggggugggacgacgaaaua

SEQ ID NO: 3971938 - RNA, 22 nt, Staphylococcus aureus subsp. aureus Mu50
ggguaaggugauugaacaauaa

SEQ ID NO: 3971939 - RNA, 12 nt, Staphylococcus aureus subsp. aureus Mu50
ggguaauguuuu

SEQ ID NO: 3971940 - RNA, 22 nt, Staphylococcus aureus subsp. aureus Mu50
guaaauauuuuuuaaaaugaua

SEQ ID NO: 3971941 - RNA, 17 nt, Staphylococcus aureus subsp. aureus Mu50
guaaaucacgauuuuca

SEQ ID NO: 3971942 - RNA, 23 nt, Staphylococcus aureus subsp. aureus Mu50
guaaaucccaaguuacaauauca

SEQ ID NO: 3971943 - RNA, 15 nt, Staphylococcus aureus subsp. aureus Mu50
guaaaugaaauaggc

SEQ ID NO: 3971944 - RNA, 14 nt, Staphylococcus aureus subsp. aureus Mu50
guaaauguuaaauu

SEQ ID NO: 3971945 - RNA, 13 nt, Staphylococcus aureus subsp. aureus Mu50
guaaauuacaaaa

SEQ ID NO: 3971946 - RNA, 17 nt, Staphylococcus aureus subsp. aureus Mu50
guaaauuuaaaauaaua

SEQ ID NO: 3971947 - RNA, 12 nt, Staphylococcus aureus subsp. aureus Mu50
guaaauuuaaau

SEQ ID NO: 3971948 - RNA, 15 nt, Staphylococcus aureus subsp. aureus Mu50
guaaauuuaucauuu

SEQ ID NO: 3971949 - RNA, 22 nt, Staphylococcus aureus subsp. aureus Mu50
guaacaagcauuuuucaauuau

SEQ ID NO: 3971950 - RNA, 12 nt, Staphylococcus aureus subsp. aureus Mu50
guaacaagcuuu

SEQ ID NO: 3971951 - RNA, 16 nt, Staphylococcus aureus subsp. aureus Mu50
guaacaauaacaccug

SEQ ID NO: 3971952 - RNA, 13 nt, Staphylococcus aureus subsp. aureus Mu50
guaacaauacgca

SEQ ID NO: 3971953 - RNA, 18 nt, Staphylococcus aureus subsp. aureus Mu50
guaacacgcucuuuucaa

SEQ ID NO: 3971954 - RNA, 23 nt, Staphylococcus aureus subsp. aureus Mu50
guaacauaaagcuguuuauuggu

SEQ ID NO: 3971955 - RNA, 17 nt, Staphylococcus aureus subsp. aureus Mu50
guaacauaucagcuuuu

SEQ ID NO: 3971956 - RNA, 21 nt, Staphylococcus aureus subsp. aureus Mu50
guaacauaucagcuuuuucau

SEQ ID NO: 3971957 - RNA, 19 nt, Staphylococcus aureus subsp. aureus Mu50
guaacauuagcaugauaaa

SEQ ID NO: 3971958 - RNA, 13 nt, Staphylococcus aureus subsp. aureus Mu50
guaacauuuaaaa

SEQ ID NO: 3971959 - RNA, 17 nt, Staphylococcus aureus subsp. aureus Mu50
guaacgcgcaaugagua

SEQ ID NO: 3971960 - RNA, 13 nt, Staphylococcus aureus subsp. aureus Mu50
guaacugauuuug

SEQ ID NO: 3971961 - RNA, 17 nt, Staphylococcus aureus subsp. aureus Mu50
guaagacaacaaaucga

SEQ ID NO: 3971962 - RNA, 16 nt, Staphylococcus aureus subsp. aureus Mu50
guaagacgauuucaau

SEQ ID NO: 3971963 - RNA, 22 nt, Staphylococcus aureus subsp. aureus Mu50
guaagagcucucguguauacaa

SEQ ID NO: 3971964 - RNA, 22 nt, Staphylococcus aureus subsp. aureus Mu50
guaagcaccuguuauugcaaua

SEQ ID NO: 3971965 - RNA, 21 nt, Staphylococcus aureus subsp. aureus Mu50
guaagcuucuguguuggggcc

SEQ ID NO: 3971966 - RNA, 20 nt, Staphylococcus aureus subsp. aureus Mu50
guaagguggacuucuaucuu

SEQ ID NO: 3971967 - RNA, 14 nt, Staphylococcus aureus subsp. aureus Mu50
guaauaaaaugaug

SEQ ID NO: 3971968 - RNA, 20 nt, Staphylococcus aureus subsp. aureus Mu50
guaauaaagcaauguugcau

SEQ ID NO: 3971969 - RNA, 18 nt, Staphylococcus aureus subsp. aureus Mu50
guaauaacaucuaaauuu

SEQ ID NO: 3971970 - RNA, 19 nt, Staphylococcus aureus subsp. aureus Mu50
guaauaauucagaugaaua

SEQ ID NO: 3971971 - RNA, 14 nt, Staphylococcus aureus subsp. aureus Mu50
guaauaauuuacag

SEQ ID NO: 3971972 - RNA, 19 nt, Staphylococcus aureus subsp. aureus Mu50
guaauacaucaucaaguuc

SEQ ID NO: 3971973 - RNA, 21 nt, Staphylococcus aureus subsp. aureus Mu50
guaauacaugacauucauuua

SEQ ID NO: 3971974 - RNA, 19 nt, Staphylococcus aureus subsp. aureus Mu50
guaauaccuuuacuuucau

SEQ ID NO: 3971975 - RNA, 16 nt, Staphylococcus aureus subsp. aureus Mu50
guaauacuauaugaaa

SEQ ID NO: 3971976 - RNA, 19 nt, Staphylococcus aureus subsp. aureus Mu50
guaauacuauaugaaaaga

SEQ ID NO: 3971977 - RNA, 21 nt, Staphylococcus aureus subsp. aureus Mu50
guaauacuauaugaaaagaga

SEQ ID NO: 3971978 - RNA, 15 nt, Staphylococcus aureus subsp. aureus Mu50
guaauagaacgaaau

SEQ ID NO: 3971979 - RNA, 22 nt, Staphylococcus aureus subsp. aureus Mu50
guaauagaacgaaauaguucaa

SEQ ID NO: 3971980 - RNA, 16 nt, Staphylococcus aureus subsp. aureus Mu50
guaauagcaaccauau

SEQ ID NO: 3971981 - RNA, 17 nt, Staphylococcus aureus subsp. aureus Mu50
guaauagcaaccauauu

SEQ ID NO: 3971982 - RNA, 17 nt, Staphylococcus aureus subsp. aureus Mu50
guaauaguuaacgauag

SEQ ID NO: 3971983 - RNA, 15 nt, Staphylococcus aureus subsp. aureus Mu50
guaauaugagugaaa

SEQ ID NO: 3971984 - RNA, 12 nt, Staphylococcus aureus subsp. aureus Mu50
guaauauuuuug

SEQ ID NO: 3971985 - RNA, 15 nt, Staphylococcus aureus subsp. aureus Mu50
guaaucaaagauuuu

SEQ ID NO: 3971986 - RNA, 17 nt, Staphylococcus aureus subsp. aureus Mu50
guaaucaagcaaugcau

SEQ ID NO: 3971987 - RNA, 21 nt, Staphylococcus aureus subsp. aureus Mu50
guaaucagguuuaaacaguuu

SEQ ID NO: 3971988 - RNA, 23 nt, Staphylococcus aureus subsp. aureus Mu50
guaaucauuauagcagguggcau

SEQ ID NO: 3971989 - RNA, 23 nt, Staphylococcus aureus subsp. aureus Mu50
guaaucgauugguaaaucuacua

SEQ ID NO: 3971990 - RNA, 18 nt, Staphylococcus aureus subsp. aureus Mu50
guaaucucguuuuuacau

SEQ ID NO: 3971991 - RNA, 18 nt, Staphylococcus aureus subsp. aureus Mu50
guaaugaagauuuuguug

SEQ ID NO: 3971992 - RNA, 17 nt, Staphylococcus aureus subsp. aureus Mu50
guaaugaaucaauugca

SEQ ID NO: 3971993 - RNA, 12 nt, Staphylococcus aureus subsp. aureus Mu50
guaaugauauua

SEQ ID NO: 3971994 - RNA, 13 nt, Staphylococcus aureus subsp. aureus Mu50
guaaugaugugaa

SEQ ID NO: 3971995 - RNA, 12 nt, Staphylococcus aureus subsp. aureus Mu50
guaaugauuuug

SEQ ID NO: 3971996 - RNA, 16 nt, Staphylococcus aureus subsp. aureus Mu50
guaaugauuuugcuuu

SEQ ID NO: 3971997 - RNA, 23 nt, Staphylococcus aureus subsp. aureus Mu50
guaaugcuuaaaaacaauauuga

SEQ ID NO: 3971998 - RNA, 16 nt, Staphylococcus aureus subsp. aureus Mu50
guaaugcuugagcuuu

SEQ ID NO: 3971999 - RNA, 16 nt, Staphylococcus aureus subsp. aureus Mu50
guaaugucauagacua

SEQ ID NO: 3972000 - RNA, 13 nt, Staphylococcus aureus subsp. aureus Mu50
guaaugucccguu

SEQ ID NO: 3972001 - RNA, 11 nt, Staphylococcus aureus subsp. aureus Mu50
guaauguguua

SEQ ID NO: 3972002 - RNA, 21 nt, Staphylococcus aureus subsp. aureus Mu50
guaauguuccccugaaaagaa

SEQ ID NO: 3972003 - RNA, 13 nt, Staphylococcus aureus subsp. aureus Mu50
guaauuaauacau

SEQ ID NO: 3972004 - RNA, 14 nt, Staphylococcus aureus subsp. aureus Mu50
guaauuauuauaau

SEQ ID NO: 3972005 - RNA, 13 nt, Staphylococcus aureus subsp. aureus Mu50
guaauuauuuuuc

SEQ ID NO: 3972006 - RNA, 23 nt, Staphylococcus aureus subsp. aureus Mu50
guaauuauuuuucucaacaguuu

SEQ ID NO: 3972007 - RNA, 18 nt, Staphylococcus aureus subsp. aureus Mu50
guaauugaugauuacucc

SEQ ID NO: 3972008 - RNA, 11 nt, Staphylococcus aureus subsp. aureus Mu50
guaauuguaau

SEQ ID NO: 3972009 - RNA, 15 nt, Staphylococcus aureus subsp. aureus Mu50
guaauuguaaucuau

SEQ ID NO: 3972010 - RNA, 12 nt, Staphylococcus aureus subsp. aureus Mu50
guaauuguuaua

SEQ ID NO: 3972011 - RNA, 21 nt, Staphylococcus aureus subsp. aureus Mu50
guaauuguuauaaguaaauaa

SEQ ID NO: 3972012 - RNA, 22 nt, Staphylococcus aureus subsp. aureus Mu50
guaauuguuauaaguaaauaau

SEQ ID NO: 3972013 - RNA, 15 nt, Staphylococcus aureus subsp. aureus Mu50
guaauuuaaaauagu

SEQ ID NO: 3972014 - RNA, 19 nt, Staphylococcus aureus subsp. aureus Mu50
guaauuuaaaauaguucuu

SEQ ID NO: 3972015 - RNA, 15 nt, Staphylococcus aureus subsp. aureus Mu50
guaauuucuccaagu

SEQ ID NO: 3972016 - RNA, 17 nt, Staphylococcus aureus subsp. aureus Mu50
guaauuuuuaaaucuac

SEQ ID NO: 3972017 - RNA, 24 nt, Staphylococcus aureus subsp. aureus Mu50
guacaaagguaauagaacgaaaua

SEQ ID NO: 3972018 - RNA, 19 nt, Staphylococcus aureus subsp. aureus Mu50
guacaauuuuuaaaaaccu

SEQ ID NO: 3972019 - RNA, 19 nt, Staphylococcus aureus subsp. aureus Mu50
guacacauccucauaauua

SEQ ID NO: 3972020 - RNA, 14 nt, Staphylococcus aureus subsp. aureus Mu50
guacaccauaaaug

SEQ ID NO: 3972021 - RNA, 15 nt, Staphylococcus aureus subsp. aureus Mu50
guacacgaauaccaa

SEQ ID NO: 3972022 - RNA, 17 nt, Staphylococcus aureus subsp. aureus Mu50
guacacgagucauuaaa

SEQ ID NO: 3972023 - RNA, 14 nt, Staphylococcus aureus subsp. aureus Mu50
guacagauaagaau

SEQ ID NO: 3972024 - RNA, 22 nt, Staphylococcus aureus subsp. aureus Mu50
guacagauaggaaacuuaaaua

SEQ ID NO: 3972025 - RNA, 15 nt, Staphylococcus aureus subsp. aureus Mu50
guacaguaauauuca

SEQ ID NO: 3972026 - RNA, 18 nt, Staphylococcus aureus subsp. aureus Mu50
guacaguuacuuucgcuu

SEQ ID NO: 3972027 - RNA, 17 nt, Staphylococcus aureus subsp. aureus Mu50
guacauaaaugcuaaaa

SEQ ID NO: 3972028 - RNA, 22 nt, Staphylococcus aureus subsp. aureus Mu50
guaucauuuaaaauauuuuuuc

SEQ ID NO: 3972029 - RNA, 14 nt, Staphylococcus aureus subsp. aureus Mu50
guaucauuucagaa

SEQ ID NO: 3972030 - RNA, 19 nt, Staphylococcus aureus subsp. aureus Mu50
guaucgaauuaagaaaagu

SEQ ID NO: 3972031 - RNA, 20 nt, Staphylococcus aureus subsp. aureus Mu50
guaucgaauuaagaaaaguu

SEQ ID NO: 3972032 - RNA, 17 nt, Staphylococcus aureus subsp. aureus Mu50
guaucgccaaucuauug

SEQ ID NO: 3972033 - RNA, 14 nt, Staphylococcus aureus subsp. aureus Mu50
guaucgccaucauu

SEQ ID NO: 3972034 - RNA, 21 nt, Staphylococcus aureus subsp. aureus Mu50
guaucuaguguucucauuaua

SEQ ID NO: 3972035 - RNA, 23 nt, Staphylococcus aureus subsp. aureus Mu50
guaucuaguguucucauuauaau

SEQ ID NO: 3972036 - RNA, 16 nt, Staphylococcus aureus subsp. aureus Mu50
guaucuauaaaaagaa

SEQ ID NO: 3972037 - RNA, 19 nt, Staphylococcus aureus subsp. aureus Mu50
guaucuauacaauuaugga

SEQ ID NO: 3972038 - RNA, 14 nt, Staphylococcus aureus subsp. aureus Mu50
guaucucauuuuuu

SEQ ID NO: 3972039 - RNA, 20 nt, Staphylococcus aureus subsp. aureus Mu50
guaucucugaaaaacuucuu

SEQ ID NO: 3972040 - RNA, 22 nt, Staphylococcus aureus subsp. aureus Mu50
guaucucugaaaaacuucuuaa

SEQ ID NO: 3972041 - RNA, 17 nt, Staphylococcus aureus subsp. aureus Mu50
guaugacaguaaucaaa

SEQ ID NO: 3972042 - RNA, 16 nt, Staphylococcus aureus subsp. aureus Mu50
guaugacugcaaauac

SEQ ID NO: 3972043 - RNA, 16 nt, Staphylococcus aureus subsp. aureus Mu50
guaugagugauagaaa

SEQ ID NO: 3972044 - RNA, 21 nt, Staphylococcus aureus subsp. aureus Mu50
guaugauagaauacuaaaagu

SEQ ID NO: 3972045 - RNA, 21 nt, Staphylococcus aureus subsp. aureus Mu50
guaugauagaugauacauucu

SEQ ID NO: 3972046 - RNA, 22 nt, Staphylococcus aureus subsp. aureus Mu50
guaugcuuguacaaaaaauugu

SEQ ID NO: 3972047 - RNA, 17 nt, Staphylococcus aureus subsp. aureus Mu50
guauggacuaagauaua

SEQ ID NO: 3972048 - RNA, 13 nt, Staphylococcus aureus subsp. aureus Mu50
guauggauguauu

SEQ ID NO: 3972049 - RNA, 16 nt, Staphylococcus aureus subsp. aureus Mu50
guaugguugauuacaa

SEQ ID NO: 3972050 - RNA, 20 nt, Staphylococcus aureus subsp. aureus Mu50
guauguacacgagucauuaa

SEQ ID NO: 3972051 - RNA, 21 nt, Staphylococcus aureus subsp. aureus Mu50
guauguacacgagucauuaaa

SEQ ID NO: 3972052 - RNA, 15 nt, Staphylococcus aureus subsp. aureus Mu50
guauuaaacauugcu

SEQ ID NO: 3972053 - RNA, 21 nt, Staphylococcus aureus subsp. aureus Mu50
guauuaauugaauugauuaua

SEQ ID NO: 3972054 - RNA, 22 nt, Staphylococcus aureus subsp. aureus Mu50
guauuacacgcauuacuuuaga

SEQ ID NO: 3972055 - RNA, 16 nt, Staphylococcus aureus subsp. aureus Mu50
guauuacuugaaaaua

SEQ ID NO: 3972056 - RNA, 19 nt, Staphylococcus aureus subsp. aureus Mu50
guauuagccaauaaaaugu

SEQ ID NO: 3972057 - RNA, 21 nt, Staphylococcus aureus subsp. aureus Mu50
guauuagccaauaaaauguca

SEQ ID NO: 3972058 - RNA, 20 nt, Staphylococcus aureus subsp. aureus Mu50
guauuauuauaauuuuguuu

SEQ ID NO: 3972059 - RNA, 19 nt, Staphylococcus aureus subsp. aureus Mu50
guauuauucucucauuugu

SEQ ID NO: 3972060 - RNA, 15 nt, Staphylococcus aureus subsp. aureus Mu50
guauucaaaaaauau

SEQ ID NO: 3972061 - RNA, 21 nt, Staphylococcus aureus subsp. aureus Mu50
guauucagucaguaaaaauac

SEQ ID NO: 3972062 - RNA, 16 nt, Staphylococcus aureus subsp. aureus Mu50
guauucgguuaauauu

SEQ ID NO: 3972063 - RNA, 18 nt, Staphylococcus aureus subsp. aureus Mu50
guauugaaugaauucauu

SEQ ID NO: 3972064 - RNA, 12 nt, Staphylococcus aureus subsp. aureus Mu50
guauuuaauaag

SEQ ID NO: 3972065 - RNA, 15 nt, Staphylococcus aureus subsp. aureus Mu50
guauuuaguaucaug

SEQ ID NO: 3972066 - RNA, 13 nt, Staphylococcus aureus subsp. aureus Mu50
guauuuuaaauuu

SEQ ID NO: 3972067 - RNA, 20 nt, Staphylococcus aureus subsp. aureus Mu50
guauuuuaaugauuuuucau

SEQ ID NO: 3972068 - RNA, 23 nt, Staphylococcus aureus subsp. aureus Mu50
guauuuuauuuauuuugauuaac

SEQ ID NO: 3972069 - RNA, 20 nt, Staphylococcus aureus subsp. aureus Mu50
guauuuugcgcuucuaguag

SEQ ID NO: 3972070 - RNA, 21 nt, Staphylococcus aureus subsp. aureus Mu50
guauuuuguucaguuaaaucu

SEQ ID NO: 3972071 - RNA, 14 nt, Staphylococcus aureus subsp. aureus Mu50
guauuuuuaagcug

SEQ ID NO: 3972072 - RNA, 23 nt, Staphylococcus aureus subsp. aureus Mu50
guauuuuucuuaauuaucauuac

SEQ ID NO: 3972073 - RNA, 18 nt, Staphylococcus aureus subsp. aureus Mu50
gucaaaucgaaauuucca

SEQ ID NO: 3972074 - RNA, 18 nt, Staphylococcus aureus subsp. aureus Mu50
gucaacagcauaaauaag

SEQ ID NO: 3972075 - RNA, 21 nt, Staphylococcus aureus subsp. aureus Mu50
gucaacuuuuuuaacuuuaac

SEQ ID NO: 3972076 - RNA, 17 nt, Staphylococcus aureus subsp. aureus Mu50
gucaaguaaauguuuua

SEQ ID NO: 3972077 - RNA, 15 nt, Staphylococcus aureus subsp. aureus Mu50
gucaauaaauuguuu

SEQ ID NO: 3972078 - RNA, 17 nt, Staphylococcus aureus subsp. aureus Mu50
gucaauaauuuuaucua

SEQ ID NO: 3972079 - RNA, 16 nt, Staphylococcus aureus subsp. aureus Mu50
gucaauucaaacugau

SEQ ID NO: 3972080 - RNA, 17 nt, Staphylococcus aureus subsp. aureus Mu50
gucaauuuaaauaaguu

SEQ ID NO: 3972081 - RNA, 19 nt, Staphylococcus aureus subsp. aureus Mu50
gucaauuucuuuaaagucu

SEQ ID NO: 3972082 - RNA, 22 nt, Staphylococcus aureus subsp. aureus Mu50
gucaauuuuaccauguuuuaca

SEQ ID NO: 3972083 - RNA, 19 nt, Staphylococcus aureus subsp. aureus Mu50
gucaauuuuuucaugauuu

SEQ ID NO: 3972084 - RNA, 20 nt, Staphylococcus aureus subsp. aureus Mu50
gucaauuuuuucaugauuua

SEQ ID NO: 3972085 - RNA, 18 nt, Staphylococcus aureus subsp. aureus Mu50
gucacauguaccacauuu

SEQ ID NO: 3972086 - RNA, 14 nt, Staphylococcus aureus subsp. aureus Mu50
gucacguaaaauau

SEQ ID NO: 3972087 - RNA, 21 nt, Staphylococcus aureus subsp. aureus Mu50
gucacuugucaugccgucgau

SEQ ID NO: 3972088 - RNA, 15 nt, Staphylococcus aureus subsp. aureus Mu50
gucacuuuauuaaau

SEQ ID NO: 3972089 - RNA, 15 nt, Staphylococcus aureus subsp. aureus Mu50
gucagcuuacaauaa

SEQ ID NO: 3972090 - RNA, 14 nt, Staphylococcus aureus subsp. aureus Mu50
gucaggggccccaa

SEQ ID NO: 3972091 - RNA, 16 nt, Staphylococcus aureus subsp. aureus Mu50
gucaggggccccaaca

SEQ ID NO: 3972092 - RNA, 13 nt, Staphylococcus aureus subsp. aureus Mu50
gucauaaaauacc

SEQ ID NO: 3972093 - RNA, 15 nt, Staphylococcus aureus subsp. aureus Mu50
gucauaaaauaccag

SEQ ID NO: 3972094 - RNA, 17 nt, Staphylococcus aureus subsp. aureus Mu50
gucauaaugaacgauau

SEQ ID NO: 3972095 - RNA, 23 nt, Staphylococcus aureus subsp. aureus Mu50
gucauacgcaaugauuauaaaua

SEQ ID NO: 3972096 - RNA, 18 nt, Staphylococcus aureus subsp. aureus Mu50
gucauacuaucuacaaua

SEQ ID NO: 3972097 - RNA, 18 nt, Staphylococcus aureus subsp. aureus Mu50
gucauagaaauuuuaaaa

SEQ ID NO: 3972098 - RNA, 22 nt, Staphylococcus aureus subsp. aureus Mu50
gucauaguauacauaauucaau

SEQ ID NO: 3972099 - RNA, 16 nt, Staphylococcus aureus subsp. aureus Mu50
gucauaugcauacacu

SEQ ID NO: 3972100 - RNA, 22 nt, Staphylococcus aureus subsp. aureus Mu50
gucaucaaaacguuugaagaau

SEQ ID NO: 3972101 - RNA, 21 nt, Staphylococcus aureus subsp. aureus Mu50
gucaucaaaaguuuguauauu

SEQ ID NO: 3972102 - RNA, 23 nt, Staphylococcus aureus subsp. aureus Mu50
gucaucaaaaguuuguauauucu

SEQ ID NO: 3972103 - RNA, 14 nt, Staphylococcus aureus subsp. aureus Mu50
gucaucaacacaca

SEQ ID NO: 3972104 - RNA, 17 nt, Staphylococcus aureus subsp. aureus Mu50
gucaucuggaauaccua

SEQ ID NO: 3972105 - RNA, 22 nt, Staphylococcus aureus subsp. aureus Mu50
gucaucuucaauucuuacaccu

SEQ ID NO: 3972106 - RNA, 23 nt, Staphylococcus aureus subsp. aureus Mu50
gucaugaauuuucaucauuaaac

SEQ ID NO: 3972107 - RNA, 12 nt, Staphylococcus aureus subsp. aureus Mu50
gucaugccuuca

SEQ ID NO: 3972108 - RNA, 21 nt, Staphylococcus aureus subsp. aureus Mu50
gucaugcguuguguaacuuua

SEQ ID NO: 3972109 - RNA, 14 nt, Staphylococcus aureus subsp. aureus Mu50
gucauucacauaca

SEQ ID NO: 3972110 - RNA, 14 nt, Staphylococcus aureus subsp. aureus Mu50
gucauuucaaucau

SEQ ID NO: 3972111 - RNA, 17 nt, Staphylococcus aureus subsp. aureus Mu50
guccauuuccaugaaua

SEQ ID NO: 3972112 - RNA, 22 nt, Staphylococcus aureus subsp. aureus Mu50
gucccagauucauaucuuucaa

SEQ ID NO: 3972113 - RNA, 17 nt, Staphylococcus aureus subsp. aureus Mu50
gucccauaaaagacaga

SEQ ID NO: 3972114 - RNA, 14 nt, Staphylococcus aureus subsp. aureus Mu50
gucccgcuuaaaau

SEQ ID NO: 3972115 - RNA, 18 nt, Staphylococcus aureus subsp. aureus Mu50
gugcaauaauaaauagga

SEQ ID NO: 3972116 - RNA, 23 nt, Staphylococcus aureus subsp. aureus Mu50
gugcaauauuauauuuugaauca

SEQ ID NO: 3972117 - RNA, 20 nt, Staphylococcus aureus subsp. aureus Mu50
gugcaauuaauguaaugaua

SEQ ID NO: 3972118 - RNA, 17 nt, Staphylococcus aureus subsp. aureus Mu50
gugcacuuguaauauua

SEQ ID NO: 3972119 - RNA, 13 nt, Staphylococcus aureus subsp. aureus Mu50
gugcauauuuaau

SEQ ID NO: 3972120 - RNA, 17 nt, Staphylococcus aureus subsp. aureus Mu50
gugcauauuuaauacau

SEQ ID NO: 3972121 - RNA, 12 nt, Staphylococcus aureus subsp. aureus Mu50
gugcaugacgau

SEQ ID NO: 3972122 - RNA, 17 nt, Staphylococcus aureus subsp. aureus Mu50
gugcauuguaauaccaa

SEQ ID NO: 3972123 - RNA, 13 nt, Staphylococcus aureus subsp. aureus Mu50
gugcauuuagaug

SEQ ID NO: 3972124 - RNA, 14 nt, Staphylococcus aureus subsp. aureus Mu50
gugccauuaaaauu

SEQ ID NO: 3972125 - RNA, 22 nt, Staphylococcus aureus subsp. aureus Mu50
gugccggcuuuuucuuuuguuu

SEQ ID NO: 3972126 - RNA, 15 nt, Staphylococcus aureus subsp. aureus Mu50
gugccucauccuuuu

SEQ ID NO: 3972127 - RNA, 15 nt, Staphylococcus aureus subsp. aureus Mu50
gugcgguuauuuaua

SEQ ID NO: 3972128 - RNA, 15 nt, Staphylococcus aureus subsp. aureus Mu50
gugcgugaagagaug

SEQ ID NO: 3972129 - RNA, 20 nt, Staphylococcus aureus subsp. aureus Mu50
gugcucuugcaauagcaaca

SEQ ID NO: 3972130 - RNA, 15 nt, Staphylococcus aureus subsp. aureus Mu50
gugcuguuaucaugg

SEQ ID NO: 3972131 - RNA, 18 nt, Staphylococcus aureus subsp. aureus Mu50
gugcuuauuuguuuauua

SEQ ID NO: 3972132 - RNA, 12 nt, Staphylococcus aureus subsp. aureus Mu50
gugcuuuuucaa

SEQ ID NO: 3972133 - RNA, 15 nt, Staphylococcus aureus subsp. aureus Mu50
guggaaagucagcuu

SEQ ID NO: 3972134 - RNA, 15 nt, Staphylococcus aureus subsp. aureus Mu50
guggaaauaaaacaa

SEQ ID NO: 3972135 - RNA, 17 nt, Staphylococcus aureus subsp. aureus Mu50
guggacguugaucuuug

SEQ ID NO: 3972136 - RNA, 21 nt, Staphylococcus aureus subsp. aureus Mu50
guggcguaguuugaauuggga

SEQ ID NO: 3972137 - RNA, 18 nt, Staphylococcus aureus subsp. aureus Mu50
guggcucgaaaauaaaac

SEQ ID NO: 3972138 - RNA, 12 nt, Staphylococcus aureus subsp. aureus Mu50
gugguacuuuuu

SEQ ID NO: 3972139 - RNA, 16 nt, Staphylococcus aureus subsp. aureus Mu50
gugguaugacugcaaa

SEQ ID NO: 3972140 - RNA, 23 nt, Staphylococcus aureus subsp. aureus Mu50
gugguuuucuuuauuuuaaacau

SEQ ID NO: 3972141 - RNA, 20 nt, Staphylococcus aureus subsp. aureus Mu50
guguaaauauaaauaugaau

SEQ ID NO: 3972142 - RNA, 16 nt, Staphylococcus aureus subsp. aureus Mu50
guguaacuuuaucacu

SEQ ID NO: 3972143 - RNA, 20 nt, Staphylococcus aureus subsp. aureus Mu50
guguaaucucguuuuuacau

SEQ ID NO: 3972144 - RNA, 14 nt, Staphylococcus aureus subsp. aureus Mu50
guguauauuauuuu

SEQ ID NO: 3972145 - RNA, 19 nt, Staphylococcus aureus subsp. aureus Mu50
guguaucaguuauuuuaau

SEQ ID NO: 3972146 - RNA, 20 nt, Staphylococcus aureus subsp. aureus Mu50
gugucaaauaggcauaauga

SEQ ID NO: 3972147 - RNA, 19 nt, Staphylococcus aureus subsp. aureus Mu50
guguccuagacgaucuuua

SEQ ID NO: 3972148 - RNA, 19 nt, Staphylococcus aureus subsp. aureus Mu50
gugucuaacgcuguuucaa

SEQ ID NO: 3972149 - RNA, 15 nt, Staphylococcus aureus subsp. aureus Mu50
gugugauuuuggaac

SEQ ID NO: 3972150 - RNA, 20 nt, Staphylococcus aureus subsp. aureus Mu50
gugugcaggauaacguucac

SEQ ID NO: 3972151 - RNA, 22 nt, Staphylococcus aureus subsp. aureus Mu50
gugugcaggauaacguucacuu

SEQ ID NO: 3972152 - RNA, 18 nt, Staphylococcus aureus subsp. aureus Mu50
guguggauuuaauuuuua

SEQ ID NO: 3972153 - RNA, 17 nt, Staphylococcus aureus subsp. aureus Mu50
guguguccaucauuugu

SEQ ID NO: 3972154 - RNA, 21 nt, Staphylococcus aureus subsp. aureus Mu50
guguguuuucuuuucaaaaua

SEQ ID NO: 3972155 - RNA, 15 nt, Staphylococcus aureus subsp. aureus Mu50
guguuaugaauuaga

SEQ ID NO: 3972156 - RNA, 18 nt, Staphylococcus aureus subsp. aureus Mu50
guguucgggaauuuuuua

SEQ ID NO: 3972157 - RNA, 19 nt, Staphylococcus aureus subsp. aureus Mu50
guguuggggcccacacccc

SEQ ID NO: 3972158 - RNA, 12 nt, Staphylococcus aureus subsp. aureus Mu50
guguuucuuuua

SEQ ID NO: 3972159 - RNA, 14 nt, Staphylococcus aureus subsp. aureus Mu50
guguuucuuuuauu

SEQ ID NO: 3972160 - RNA, 19 nt, Staphylococcus aureus subsp. aureus Mu50
guguuucuuuuauuuucau

SEQ ID NO: 3972161 - RNA, 11 nt, Staphylococcus aureus subsp. aureus Mu50
guguuugcuuu

SEQ ID NO: 3972162 - RNA, 21 nt, Staphylococcus aureus subsp. aureus Mu50
guguuuuaauaauaucuuuug

SEQ ID NO: 3972163 - RNA, 13 nt, Staphylococcus aureus subsp. aureus Mu50
guguuuucuuuuc

SEQ ID NO: 3972164 - RNA, 15 nt, Staphylococcus aureus subsp. aureus Mu50
guguuuuuauuuuua

SEQ ID NO: 3972165 - RNA, 14 nt, Staphylococcus aureus subsp. aureus Mu50
guuaaaaaauaugu

SEQ ID NO: 3972166 - RNA, 16 nt, Staphylococcus aureus subsp. aureus Mu50
guuaaaaaauauguau

SEQ ID NO: 3972167 - RNA, 22 nt, Staphylococcus aureus subsp. aureus Mu50
guuaaaaaauauguauguuuua

SEQ ID NO: 3972168 - RNA, 18 nt, Staphylococcus aureus subsp. aureus Mu50
guuaaaaauguaaauaaa

SEQ ID NO: 3972169 - RNA, 23 nt, Staphylococcus aureus subsp. aureus Mu50
guuaaaacacccugcuuaucauu

SEQ ID NO: 3972170 - RNA, 16 nt, Staphylococcus aureus subsp. aureus Mu50
guuaaaaccuuuucaa

SEQ ID NO: 3972171 - RNA, 21 nt, Staphylococcus aureus subsp. aureus Mu50
guuaaaaccuuuucaaauuau

SEQ ID NO: 3972172 - RNA, 12 nt, Staphylococcus aureus subsp. aureus Mu50
guuaaaauaaaa

SEQ ID NO: 3972173 - RNA, 17 nt, Staphylococcus aureus subsp. aureus Mu50
guuaaaauaaugucuua

SEQ ID NO: 3972174 - RNA, 23 nt, Staphylococcus aureus subsp. aureus Mu50
guuaaaaucgcagcaaugacacu

SEQ ID NO: 3972175 - RNA, 17 nt, Staphylococcus aureus subsp. aureus Mu50
guuaaacgcugauuuua

SEQ ID NO: 3972176 - RNA, 21 nt, Staphylococcus aureus subsp. aureus Mu50
guuaaacgcugauuuuauaaa

SEQ ID NO: 3972177 - RNA, 23 nt, Staphylococcus aureus subsp. aureus Mu50
guuaaacgugaauucgaugacuu

SEQ ID NO: 3972178 - RNA, 18 nt, Staphylococcus aureus subsp. aureus Mu50
guuaaacuagaaaacaua

SEQ ID NO: 3972179 - RNA, 19 nt, Staphylococcus aureus subsp. aureus Mu50
guuaaacuagaaaacauaa

SEQ ID NO: 3972180 - RNA, 23 nt, Staphylococcus aureus subsp. aureus Mu50
guuaaagaugucgaaaaguauau

SEQ ID NO: 3972181 - RNA, 15 nt, Staphylococcus aureus subsp. aureus Mu50
guuaaaguacuuaca

SEQ ID NO: 3972182 - RNA, 22 nt, Staphylococcus aureus subsp. aureus Mu50
guuaaagucuguugguuuauca

SEQ ID NO: 3972183 - RNA, 13 nt, Staphylococcus aureus subsp. aureus Mu50
guuaaaucaccaa

SEQ ID NO: 3972184 - RNA, 19 nt, Staphylococcus aureus subsp. aureus Mu50
guuaacauuugucauaaua

SEQ ID NO: 3972185 - RNA, 21 nt, Staphylococcus aureus subsp. aureus Mu50
guuaacauuugucauaauaga

SEQ ID NO: 3972186 - RNA, 14 nt, Staphylococcus aureus subsp. aureus Mu50
guuaaccauacaua

SEQ ID NO: 3972187 - RNA, 18 nt, Staphylococcus aureus subsp. aureus Mu50
guuaaccauacauaugcu

SEQ ID NO: 3972188 - RNA, 23 nt, Staphylococcus aureus subsp. aureus Mu50
guuaagagguuuugcacuaaugg

SEQ ID NO: 3972189 - RNA, 18 nt, Staphylococcus aureus subsp. aureus Mu50
guuaagauaccuuuuucu

SEQ ID NO: 3972190 - RNA, 16 nt, Staphylococcus aureus subsp. aureus Mu50
guuaaguauuuaaaua

SEQ ID NO: 3972191 - RNA, 18 nt, Staphylococcus aureus subsp. aureus Mu50
guuaaguauuuaaauaac

SEQ ID NO: 3972192 - RNA, 16 nt, Staphylococcus aureus subsp. aureus Mu50
guuaagugucuauguu

SEQ ID NO: 3972193 - RNA, 19 nt, Staphylococcus aureus subsp. aureus Mu50
guuaauaacccauuuucaa

SEQ ID NO: 3972194 - RNA, 20 nt, Staphylococcus aureus subsp. aureus Mu50
guuaauaacccauuuucaaa

SEQ ID NO: 3972195 - RNA, 15 nt, Staphylococcus aureus subsp. aureus Mu50
guuaauaagcgcauc

SEQ ID NO: 3972196 - RNA, 18 nt, Staphylococcus aureus subsp. aureus Mu50
guuaauauaacuucuauu

SEQ ID NO: 3972197 - RNA, 21 nt, Staphylococcus aureus subsp. aureus Mu50
guuaauauaauuaaacauuua

SEQ ID NO: 3972198 - RNA, 14 nt, Staphylococcus aureus subsp. aureus Mu50
guuaauauucuuuc

SEQ ID NO: 3972199 - RNA, 23 nt, Staphylococcus aureus subsp. aureus Mu50
guuaauauucuuucguuuucauc

SEQ ID NO: 3972200 - RNA, 14 nt, Staphylococcus aureus subsp. aureus Mu50
guuaaucaaaauua

SEQ ID NO: 3972201 - RNA, 19 nt, Staphylococcus aureus subsp. aureus Mu50
guuaaucagugaaauauca

SEQ ID NO: 3972202 - RNA, 20 nt, Staphylococcus aureus subsp. aureus Mu50
guucuauuccacaacaauca

SEQ ID NO: 3972203 - RNA, 13 nt, Staphylococcus aureus subsp. aureus Mu50
guucuauuugaua

SEQ ID NO: 3972204 - RNA, 22 nt, Staphylococcus aureus subsp. aureus Mu50
guucucauuauaaugauuuuua

SEQ ID NO: 3972205 - RNA, 14 nt, Staphylococcus aureus subsp. aureus Mu50
guucuccgaucaug

SEQ ID NO: 3972206 - RNA, 19 nt, Staphylococcus aureus subsp. aureus Mu50
guucuccgaucaugccuuc

SEQ ID NO: 3972207 - RNA, 15 nt, Staphylococcus aureus subsp. aureus Mu50
guucucgucuuucgu

SEQ ID NO: 3972208 - RNA, 20 nt, Staphylococcus aureus subsp. aureus Mu50
guucuguaaugauauuaagu

SEQ ID NO: 3972209 - RNA, 13 nt, Staphylococcus aureus subsp. aureus Mu50
guucuugagcugu

SEQ ID NO: 3972210 - RNA, 16 nt, Staphylococcus aureus subsp. aureus Mu50
guucuuuacuccaaag

SEQ ID NO: 3972211 - RNA, 18 nt, Staphylococcus aureus subsp. aureus Mu50
guucuuucuuguucuaaa

SEQ ID NO: 3972212 - RNA, 14 nt, Staphylococcus aureus subsp. aureus Mu50
guucuuucuuucuu

SEQ ID NO: 3972213 - RNA, 12 nt, Staphylococcus aureus subsp. aureus Mu50
guucuuugucug

SEQ ID NO: 3972214 - RNA, 13 nt, Staphylococcus aureus subsp. aureus Mu50
guucuuuuuguug

SEQ ID NO: 3972215 - RNA, 17 nt, Staphylococcus aureus subsp. aureus Mu50
guugaaaaccucuuuuu

SEQ ID NO: 3972216 - RNA, 22 nt, Staphylococcus aureus subsp. aureus Mu50
guugaauaauuaauguuucuuc

SEQ ID NO: 3972217 - RNA, 16 nt, Staphylococcus aureus subsp. aureus Mu50
guugacuguaaaacaa

SEQ ID NO: 3972218 - RNA, 15 nt, Staphylococcus aureus subsp. aureus Mu50
guugauaaauggaaa

SEQ ID NO: 3972219 - RNA, 18 nt, Staphylococcus aureus subsp. aureus Mu50
guugauaguuguaucauu

SEQ ID NO: 3972220 - RNA, 18 nt, Staphylococcus aureus subsp. aureus Mu50
guugauuuaagauuuaau

SEQ ID NO: 3972221 - RNA, 17 nt, Staphylococcus aureus subsp. aureus Mu50
guugcacaaauugcaau

SEQ ID NO: 3972222 - RNA, 23 nt, Staphylococcus aureus subsp. aureus Mu50
guugcacaaauugcaauggcaac

SEQ ID NO: 3972223 - RNA, 19 nt, Staphylococcus aureus subsp. aureus Mu50
guugcauaaucaauuucac

SEQ ID NO: 3972224 - RNA, 16 nt, Staphylococcus aureus subsp. aureus Mu50
guugcauauaaaaacc

SEQ ID NO: 3972225 - RNA, 21 nt, Staphylococcus aureus subsp. aureus Mu50
guugcugaauaaaauauaucu

SEQ ID NO: 3972226 - RNA, 20 nt, Staphylococcus aureus subsp. aureus Mu50
guuggaaaaggucaaaaaau

SEQ ID NO: 3972227 - RNA, 23 nt, Staphylococcus aureus subsp. aureus Mu50
guuggcaucagacuaaaaugaau

SEQ ID NO: 3972228 - RNA, 17 nt, Staphylococcus aureus subsp. aureus Mu50
guuggggcccacacccc

SEQ ID NO: 3972229 - RNA, 17 nt, Staphylococcus aureus subsp. aureus Mu50
guugguauuaauuuuuc

SEQ ID NO: 3972230 - RNA, 19 nt, Staphylococcus aureus subsp. aureus Mu50
guugguguuuagucuuuuu

SEQ ID NO: 3972231 - RNA, 15 nt, Staphylococcus aureus subsp. aureus Mu50
guugguugugauuug

SEQ ID NO: 3972232 - RNA, 22 nt, Staphylococcus aureus subsp. aureus Mu50
guugguuuaaaaauugauauug

SEQ ID NO: 3972233 - RNA, 13 nt, Staphylococcus aureus subsp. aureus Mu50
guugguuuaucag

SEQ ID NO: 3972234 - RNA, 15 nt, Staphylococcus aureus subsp. aureus Mu50
guuguaaaacuaagu

SEQ ID NO: 3972235 - RNA, 13 nt, Staphylococcus aureus subsp. aureus Mu50
guuguaaguuauu

SEQ ID NO: 3972236 - RNA, 21 nt, Staphylococcus aureus subsp. aureus Mu50
guuguaaucauugguuucauc

SEQ ID NO: 3972237 - RNA, 18 nt, Staphylococcus aureus subsp. aureus Mu50
guuguacaucauuaaaua

SEQ ID NO: 3972238 - RNA, 21 nt, Staphylococcus aureus subsp. aureus Mu50
guuguauucugaaacuuuaau

SEQ ID NO: 3972239 - RNA, 13 nt, Staphylococcus aureus subsp. aureus Mu50
guugucuuuacau

SEQ ID NO: 3972240 - RNA, 15 nt, Staphylococcus aureus subsp. aureus Mu50
guugugauauauagu

SEQ ID NO: 3972241 - RNA, 15 nt, Staphylococcus aureus subsp. aureus Mu50
guuguguaauaaagc

SEQ ID NO: 3972242 - RNA, 15 nt, Staphylococcus aureus subsp. aureus Mu50
guuguuauauaaaua

SEQ ID NO: 3972243 - RNA, 17 nt, Staphylococcus aureus subsp. aureus Mu50
guuguucccauuuuuaa

SEQ ID NO: 3972244 - RNA, 19 nt, Staphylococcus aureus subsp. aureus Mu50
guuguucccauuuuuaaaa

SEQ ID NO: 3972245 - RNA, 15 nt, Staphylococcus aureus subsp. aureus Mu50
guuguucuuuuuguu

SEQ ID NO: 3972246 - RNA, 16 nt, Staphylococcus aureus subsp. aureus Mu50
guuguugaaauuaaau

SEQ ID NO: 3972247 - RNA, 13 nt, Staphylococcus aureus subsp. aureus Mu50
guuguugaaauuu

SEQ ID NO: 3972248 - RNA, 14 nt, Staphylococcus aureus subsp. aureus Mu50
guuguugguuuugc

SEQ ID NO: 3972249 - RNA, 18 nt, Staphylococcus aureus subsp. aureus Mu50
guuguuuggaugcuuuuc

SEQ ID NO: 3972250 - RNA, 14 nt, Staphylococcus aureus subsp. aureus Mu50
guuuaaaaauaugu

SEQ ID NO: 3972251 - RNA, 14 nt, Staphylococcus aureus subsp. aureus Mu50
guuuaaaaaugcug

SEQ ID NO: 3972252 - RNA, 13 nt, Staphylococcus aureus subsp. aureus Mu50
guuuaaacauuuu

SEQ ID NO: 3972253 - RNA, 15 nt, Staphylococcus aureus subsp. aureus Mu50
guuuaaaguauaagg

SEQ ID NO: 3972254 - RNA, 13 nt, Staphylococcus aureus subsp. aureus Mu50
guuuaaauauuca

SEQ ID NO: 3972255 - RNA, 20 nt, Staphylococcus aureus subsp. aureus Mu50
guuuaaaugugcaauuagaa

SEQ ID NO: 3972256 - RNA, 18 nt, Staphylococcus aureus subsp. aureus Mu50
guuuaacaacacuaccca

SEQ ID NO: 3972257 - RNA, 16 nt, Staphylococcus aureus subsp. aureus Mu50
guuuaagauuuuaucu

SEQ ID NO: 3972258 - RNA, 17 nt, Staphylococcus aureus subsp. aureus Mu50
guuuaagauuuuaucuu

SEQ ID NO: 3972259 - RNA, 22 nt, Staphylococcus aureus subsp. aureus Mu50
guuuaauaacaaaauuaaauau

SEQ ID NO: 3972260 - RNA, 16 nt, Staphylococcus aureus subsp. aureus Mu50
guuuaauaaugguucu

SEQ ID NO: 3972261 - RNA, 22 nt, Staphylococcus aureus subsp. aureus Mu50
guuuaauggcagcgaucuuuuu

SEQ ID NO: 3972262 - RNA, 19 nt, Staphylococcus aureus subsp. aureus Mu50
guuuaauugcuguaaauau

SEQ ID NO: 3972263 - RNA, 20 nt, Staphylococcus aureus subsp. aureus Mu50
guuuaauugcuguaaauauu

SEQ ID NO: 3972264 - RNA, 20 nt, Staphylococcus aureus subsp. aureus Mu50
guuuaauuugauuaaauuca

SEQ ID NO: 3972265 - RNA, 23 nt, Staphylococcus aureus subsp. aureus Mu50
guuuaauuugauuaaauucaucu

SEQ ID NO: 3972266 - RNA, 14 nt, Staphylococcus aureus subsp. aureus Mu50
guuuaauuuuaaau

SEQ ID NO: 3972267 - RNA, 17 nt, Staphylococcus aureus subsp. aureus Mu50
guuuaauuuucuaaaua

SEQ ID NO: 3972268 - RNA, 13 nt, Staphylococcus aureus subsp. aureus Mu50
guuuaccuuaaau

SEQ ID NO: 3972269 - RNA, 15 nt, Staphylococcus aureus subsp. aureus Mu50
guuuacuauacuuug

SEQ ID NO: 3972270 - RNA, 17 nt, Staphylococcus aureus subsp. aureus Mu50
guuuacuauuaaaggaa

SEQ ID NO: 3972271 - RNA, 23 nt, Staphylococcus aureus subsp. aureus Mu50
guuuagaaaaguaaguaaaauaa

SEQ ID NO: 3972272 - RNA, 14 nt, Staphylococcus aureus subsp. aureus Mu50
guuuagauagcucu

SEQ ID NO: 3972273 - RNA, 22 nt, Staphylococcus aureus subsp. aureus Mu50
guuuagauucacuguauaaaua

SEQ ID NO: 3972274 - RNA, 20 nt, Staphylococcus aureus subsp. aureus Mu50
guuuauaaaaaaucaguuuu

SEQ ID NO: 3972275 - RNA, 18 nt, Staphylococcus aureus subsp. aureus Mu50
guuuauacuuaauauagu

SEQ ID NO: 3972276 - RNA, 14 nt, Staphylococcus aureus subsp. aureus Mu50
guuuauauugcaaa

SEQ ID NO: 3972277 - RNA, 16 nt, Staphylococcus aureus subsp. aureus Mu50
guuuauauugcaaaaa

SEQ ID NO: 3972278 - RNA, 17 nt, Staphylococcus aureus subsp. aureus Mu50
guuuauauugcaaaaau

SEQ ID NO: 3972279 - RNA, 15 nt, Staphylococcus aureus subsp. aureus Mu50
guuuaucaauuucuc

SEQ ID NO: 3972280 - RNA, 19 nt, Staphylococcus aureus subsp. aureus Mu50
guuuaucaauuucucuuuc

SEQ ID NO: 3972281 - RNA, 16 nt, Staphylococcus aureus subsp. aureus Mu50
guuuaucagcuuuaau

SEQ ID NO: 3972282 - RNA, 16 nt, Staphylococcus aureus subsp. aureus Mu50
guuuauccauauauga

SEQ ID NO: 3972283 - RNA, 22 nt, Staphylococcus aureus subsp. aureus Mu50
guuuauccauauaugaugauuu

SEQ ID NO: 3972284 - RNA, 22 nt, Staphylococcus aureus subsp. aureus Mu50
guuuaucgaucgguauuuucau

SEQ ID NO: 3972285 - RNA, 18 nt, Staphylococcus aureus subsp. aureus Mu50
guuuaucugaauuuuacu

SEQ ID NO: 3972286 - RNA, 17 nt, Staphylococcus aureus subsp. aureus Mu50
guuuauuacauaauuua

SEQ ID NO: 3972287 - RNA, 20 nt, Staphylococcus aureus subsp. aureus Mu50
guuuauuacauaauuuaucu

SEQ ID NO: 3972288 - RNA, 18 nt, Staphylococcus aureus subsp. aureus Mu50
guuuauuuaauaacgaag

SEQ ID NO: 3972289 - RNA, 15 nt, Staphylococcus aureus subsp. aureus Mu50
guuuauuuagaauaa

SEQ ID NO: 3972290 - RNA, 22 nt, Staphylococcus aureus subsp. aureus Mu50
uaaaaaaugcacugagcaacaa

SEQ ID NO: 3972291 - RNA, 13 nt, Staphylococcus aureus subsp. aureus Mu50
uaaaaaauuuaaa

SEQ ID NO: 3972292 - RNA, 20 nt, Staphylococcus aureus subsp. aureus Mu50
uaaaaaauuuaaauaauaau

SEQ ID NO: 3972293 - RNA, 13 nt, Staphylococcus aureus subsp. aureus Mu50
uaaaaaauuuaau

SEQ ID NO: 3972294 - RNA, 14 nt, Staphylococcus aureus subsp. aureus Mu50
uaaaaaauuuaaug

SEQ ID NO: 3972295 - RNA, 15 nt, Staphylococcus aureus subsp. aureus Mu50
uaaaaacaaaagaaa

SEQ ID NO: 3972296 - RNA, 19 nt, Staphylococcus aureus subsp. aureus Mu50
uaaaaacaauauugacuuu

SEQ ID NO: 3972297 - RNA, 15 nt, Staphylococcus aureus subsp. aureus Mu50
uaaaaaccaauauuu

SEQ ID NO: 3972298 - RNA, 20 nt, Staphylococcus aureus subsp. aureus Mu50
uaaaaaccuauucccaaaau

SEQ ID NO: 3972299 - RNA, 14 nt, Staphylococcus aureus subsp. aureus Mu50
uaaaaacgauucau

SEQ ID NO: 3972300 - RNA, 15 nt, Staphylococcus aureus subsp. aureus Mu50
uaaaaacguucaauc

SEQ ID NO: 3972301 - RNA, 17 nt, Staphylococcus aureus subsp. aureus Mu50
uaaaaacguucaaucgu

SEQ ID NO: 3972302 - RNA, 15 nt, Staphylococcus aureus subsp. aureus Mu50
uaaaaacucuaaaag

SEQ ID NO: 3972303 - RNA, 18 nt, Staphylococcus aureus subsp. aureus Mu50
uaaaaacucuaaaaguug

SEQ ID NO: 3972304 - RNA, 22 nt, Staphylococcus aureus subsp. aureus Mu50
uaaaaagaauaugauauugauu

SEQ ID NO: 3972305 - RNA, 18 nt, Staphylococcus aureus subsp. aureus Mu50
uaaaaagagaugggcuaa

SEQ ID NO: 3972306 - RNA, 18 nt, Staphylococcus aureus subsp. aureus Mu50
uaaaaagagguuuucauu

SEQ ID NO: 3972307 - RNA, 17 nt, Staphylococcus aureus subsp. aureus Mu50
uaaaaagaucauuaaaa

SEQ ID NO: 3972308 - RNA, 15 nt, Staphylococcus aureus subsp. aureus Mu50
uaaaaagcagcagua

SEQ ID NO: 3972309 - RNA, 21 nt, Staphylococcus aureus subsp. aureus Mu50
uaaaaagguacuaauguuaau

SEQ ID NO: 3972310 - RNA, 14 nt, Staphylococcus aureus subsp. aureus Mu50
uaaaaauaaaaccg

SEQ ID NO: 3972311 - RNA, 16 nt, Staphylococcus aureus subsp. aureus Mu50
uaaaaauacauuuugc

SEQ ID NO: 3972312 - RNA, 21 nt, Staphylococcus aureus subsp. aureus Mu50
uaaaaauacauuuugcucuaa

SEQ ID NO: 3972313 - RNA, 17 nt, Staphylococcus aureus subsp. aureus Mu50
uaaaaauaggaauacau

SEQ ID NO: 3972314 - RNA, 15 nt, Staphylococcus aureus subsp. aureus Mu50
uaaaaauauauuuca

SEQ ID NO: 3972315 - RNA, 14 nt, Staphylococcus aureus subsp. aureus Mu50
uaaaaauauugaau

SEQ ID NO: 3972316 - RNA, 11 nt, Staphylococcus aureus subsp. aureus Mu50
uaaaaaucaaa

SEQ ID NO: 3972317 - RNA, 14 nt, Staphylococcus aureus subsp. aureus Mu50
uaaaaaucaaagag

SEQ ID NO: 3972318 - RNA, 18 nt, Staphylococcus aureus subsp. aureus Mu50
uaaaaaucaaagaggcac

SEQ ID NO: 3972319 - RNA, 19 nt, Staphylococcus aureus subsp. aureus Mu50
uaaaaaucaaagaggcaca

SEQ ID NO: 3972320 - RNA, 19 nt, Staphylococcus aureus subsp. aureus Mu50
uaaaaaucaaagaggcuuu

SEQ ID NO: 3972321 - RNA, 19 nt, Staphylococcus aureus subsp. aureus Mu50
uaaaaaucauaaauaacac

SEQ ID NO: 3972322 - RNA, 15 nt, Staphylococcus aureus subsp. aureus Mu50
uaaaaauccucacaa

SEQ ID NO: 3972323 - RNA, 15 nt, Staphylococcus aureus subsp. aureus Mu50
uaaaaaucucaaaau

SEQ ID NO: 3972324 - RNA, 16 nt, Staphylococcus aureus subsp. aureus Mu50
uaaaaaucucaaaauu

SEQ ID NO: 3972325 - RNA, 16 nt, Staphylococcus aureus subsp. aureus Mu50
uaaaaaucuuaugaug

SEQ ID NO: 3972326 - RNA, 20 nt, Staphylococcus aureus subsp. aureus Mu50
uaaaaaucuuaugaugucau

SEQ ID NO: 3972327 - RNA, 14 nt, Staphylococcus aureus subsp. aureus Mu50
uaaaaaucuuggug

SEQ ID NO: 3972328 - RNA, 21 nt, Staphylococcus aureus subsp. aureus Mu50
uaaaaaucuuggugauagucu

SEQ ID NO: 3972329 - RNA, 22 nt, Staphylococcus aureus subsp. aureus Mu50
uaaaaaugcucaaguugauuau

SEQ ID NO: 3972330 - RNA, 20 nt, Staphylococcus aureus subsp. aureus Mu50
uaaaaaugcugguaaauguu

SEQ ID NO: 3972331 - RNA, 16 nt, Staphylococcus aureus subsp. aureus Mu50
uaaaaauguaaauaaa

SEQ ID NO: 3972332 - RNA, 15 nt, Staphylococcus aureus subsp. aureus Mu50
uaaaaauuauauaaa

SEQ ID NO: 3972333 - RNA, 19 nt, Staphylococcus aureus subsp. aureus Mu50
uaaaaauugauauugcaaa

SEQ ID NO: 3972334 - RNA, 22 nt, Staphylococcus aureus subsp. aureus Mu50
uaaaaauugcaaugcuaucaug

SEQ ID NO: 3972335 - RNA, 15 nt, Staphylococcus aureus subsp. aureus Mu50
uaaaaauuuaugucu

SEQ ID NO: 3972336 - RNA, 24 nt, Staphylococcus aureus subsp. aureus Mu50
uaaaaauuuauucaaaauucaaua

SEQ ID NO: 3972337 - RNA, 21 nt, Staphylococcus aureus subsp. aureus Mu50
uaaaaauuucgccucaucuaa

SEQ ID NO: 3972338 - RNA, 15 nt, Staphylococcus aureus subsp. aureus Mu50
uaaaacaaauuauua

SEQ ID NO: 3972339 - RNA, 22 nt, Staphylococcus aureus subsp. aureus Mu50
uaaaacaaauucauauuaacug

SEQ ID NO: 3972340 - RNA, 14 nt, Staphylococcus aureus subsp. aureus Mu50
uaaaacaauaauuu

SEQ ID NO: 3972341 - RNA, 17 nt, Staphylococcus aureus subsp. aureus Mu50
uaaaacaauaauuuaau

SEQ ID NO: 3972342 - RNA, 20 nt, Staphylococcus aureus subsp. aureus Mu50
uaaaacaauaauuuaauauu

SEQ ID NO: 3972343 - RNA, 19 nt, Staphylococcus aureus subsp. aureus Mu50
uaaaacaaugauuaaaauu

SEQ ID NO: 3972344 - RNA, 23 nt, Staphylococcus aureus subsp. aureus Mu50
uaaaacacccugcuuaucauuac

SEQ ID NO: 3972345 - RNA, 16 nt, Staphylococcus aureus subsp. aureus Mu50
uaaaacagaauuucau

SEQ ID NO: 3972346 - RNA, 18 nt, Staphylococcus aureus subsp. aureus Mu50
uaaaacagcaaauaaaau

SEQ ID NO: 3972347 - RNA, 20 nt, Staphylococcus aureus subsp. aureus Mu50
uaaaacaguaaguaauaaaa

SEQ ID NO: 3972348 - RNA, 14 nt, Staphylococcus aureus subsp. aureus Mu50
uaaaacaucauuca

SEQ ID NO: 3972349 - RNA, 21 nt, Staphylococcus aureus subsp. aureus Mu50
uaaaacauucccuuaauaaua

SEQ ID NO: 3972350 - RNA, 22 nt, Staphylococcus aureus subsp. aureus Mu50
uaaaacauucccuuaauaauaa

SEQ ID NO: 3972351 - RNA, 18 nt, Staphylococcus aureus subsp. aureus Mu50
uaaaaccuuacccaaaaa

SEQ ID NO: 3972352 - RNA, 17 nt, Staphylococcus aureus subsp. aureus Mu50
uaaaaccuuuucaaauu

SEQ ID NO: 3972353 - RNA, 22 nt, Staphylococcus aureus subsp. aureus Mu50
uaaaaccuuuucaaauuauaac

SEQ ID NO: 3972354 - RNA, 16 nt, Staphylococcus aureus subsp. aureus Mu50
uaaaacgacucauuau

SEQ ID NO: 3972355 - RNA, 20 nt, Staphylococcus aureus subsp. aureus Mu50
uaaaacgacucauuauaaau

SEQ ID NO: 3972356 - RNA, 22 nt, Staphylococcus aureus subsp. aureus Mu50
uaaaacgacucauuauaaauga

SEQ ID NO: 3972357 - RNA, 16 nt, Staphylococcus aureus subsp. aureus Mu50
uaaaacgauaagaauu

SEQ ID NO: 3972358 - RNA, 16 nt, Staphylococcus aureus subsp. aureus Mu50
uaaaacgauaauaaua

SEQ ID NO: 3972359 - RNA, 17 nt, Staphylococcus aureus subsp. aureus Mu50
uaaaacgauaauaauaa

SEQ ID NO: 3972360 - RNA, 15 nt, Staphylococcus aureus subsp. aureus Mu50
uaaaacgcuucauau

SEQ ID NO: 3972361 - RNA, 20 nt, Staphylococcus aureus subsp. aureus Mu50
uaaaacgcuucauauaaagu

SEQ ID NO: 3972362 - RNA, 22 nt, Staphylococcus aureus subsp. aureus Mu50
uaaaacguuaguacuuugauau

SEQ ID NO: 3972363 - RNA, 15 nt, Staphylococcus aureus subsp. aureus Mu50
uaaaacuaaguuauu

SEQ ID NO: 3972364 - RNA, 16 nt, Staphylococcus aureus subsp. aureus Mu50
uaaaacuaaugauagu

SEQ ID NO: 3972365 - RNA, 13 nt, Staphylococcus aureus subsp. aureus Mu50
uaaaacuacugau

SEQ ID NO: 3972366 - RNA, 20 nt, Staphylococcus aureus subsp. aureus Mu50
uaaaacuacugauuuauuga

SEQ ID NO: 3972367 - RNA, 23 nt, Staphylococcus aureus subsp. aureus Mu50
uaaaacuacugauuuauugauaa

SEQ ID NO: 3972368 - RNA, 16 nt, Staphylococcus aureus subsp. aureus Mu50
uaaaacuauaauaaag

SEQ ID NO: 3972369 - RNA, 15 nt, Staphylococcus aureus subsp. aureus Mu50
uaaaacuauguguau

SEQ ID NO: 3972370 - RNA, 15 nt, Staphylococcus aureus subsp. aureus Mu50
uaaaacugcaauaau

SEQ ID NO: 3972371 - RNA, 12 nt, Staphylococcus aureus subsp. aureus Mu50
uaaaacuuacau

SEQ ID NO: 3972372 - RNA, 16 nt, Staphylococcus aureus subsp. aureus Mu50
uaaaacuuauaacuga

SEQ ID NO: 3972373 - RNA, 20 nt, Staphylococcus aureus subsp. aureus Mu50
uaaaacuuguuguuauuuau

SEQ ID NO: 3972374 - RNA, 21 nt, Staphylococcus aureus subsp. aureus Mu50
uaaaacuuguuguuauuuauu

SEQ ID NO: 3972375 - RNA, 19 nt, Staphylococcus aureus subsp. aureus Mu50
uaaaagacagaaauuacua

SEQ ID NO: 3972376 - RNA, 19 nt, Staphylococcus aureus subsp. aureus Mu50
uaaaagagaauuuuaauua

SEQ ID NO: 3972377 - RNA, 23 nt, Staphylococcus aureus subsp. aureus Mu50
uaaaauuuuuugggcuuuuucac

SEQ ID NO: 3972378 - RNA, 23 nt, Staphylococcus aureus subsp. aureus Mu50
uaaaauuuuuuucauaauuaaua

SEQ ID NO: 3972379 - RNA, 14 nt, Staphylococcus aureus subsp. aureus Mu50
uaaacaaauaaaug

SEQ ID NO: 3972380 - RNA, 15 nt, Staphylococcus aureus subsp. aureus Mu50
uaaacaaauaaaugu

SEQ ID NO: 3972381 - RNA, 21 nt, Staphylococcus aureus subsp. aureus Mu50
uaaacaacugagucaaaguca

SEQ ID NO: 3972382 - RNA, 23 nt, Staphylococcus aureus subsp. aureus Mu50
uaaacaacugagucaaagucauu

SEQ ID NO: 3972383 - RNA, 21 nt, Staphylococcus aureus subsp. aureus Mu50
uaaacaacugcaauagcuaua

SEQ ID NO: 3972384 - RNA, 15 nt, Staphylococcus aureus subsp. aureus Mu50
uaaacaacuucugaa

SEQ ID NO: 3972385 - RNA, 14 nt, Staphylococcus aureus subsp. aureus Mu50
uaaacaagcaucau

SEQ ID NO: 3972386 - RNA, 18 nt, Staphylococcus aureus subsp. aureus Mu50
uaaacaagccaagauaaa

SEQ ID NO: 3972387 - RNA, 17 nt, Staphylococcus aureus subsp. aureus Mu50
uaaacaaugaugggaaa

SEQ ID NO: 3972388 - RNA, 19 nt, Staphylococcus aureus subsp. aureus Mu50
uaaacaauuccccaaagcc

SEQ ID NO: 3972389 - RNA, 15 nt, Staphylococcus aureus subsp. aureus Mu50
uaaacacaucuaugu

SEQ ID NO: 3972390 - RNA, 22 nt, Staphylococcus aureus subsp. aureus Mu50
uaaacacgcgguaaaacgaagu

SEQ ID NO: 3972391 - RNA, 17 nt, Staphylococcus aureus subsp. aureus Mu50
uaaacacuauaaaagcc

SEQ ID NO: 3972392 - RNA, 18 nt, Staphylococcus aureus subsp. aureus Mu50
uaaacacuauaaaagcca

SEQ ID NO: 3972393 - RNA, 12 nt, Staphylococcus aureus subsp. aureus Mu50
uaaacauauuua

SEQ ID NO: 3972394 - RNA, 17 nt, Staphylococcus aureus subsp. aureus Mu50
uaaacauauuuacuaag

SEQ ID NO: 3972395 - RNA, 14 nt, Staphylococcus aureus subsp. aureus Mu50
uaaacaugaacaau

SEQ ID NO: 3972396 - RNA, 18 nt, Staphylococcus aureus subsp. aureus Mu50
uaaacauggucaaucacu

SEQ ID NO: 3972397 - RNA, 19 nt, Staphylococcus aureus subsp. aureus Mu50
uaaacauggucaaucacuc

SEQ ID NO: 3972398 - RNA, 16 nt, Staphylococcus aureus subsp. aureus Mu50
uaaacauugaaaguac

SEQ ID NO: 3972399 - RNA, 13 nt, Staphylococcus aureus subsp. aureus Mu50
uaaacauuuagau

SEQ ID NO: 3972400 - RNA, 14 nt, Staphylococcus aureus subsp. aureus Mu50
uaaacauuuagauu

SEQ ID NO: 3972401 - RNA, 19 nt, Staphylococcus aureus subsp. aureus Mu50
uaaacauuuuugaauuuaa

SEQ ID NO: 3972402 - RNA, 20 nt, Staphylococcus aureus subsp. aureus Mu50
uaaacauuuuugaauuuaau

SEQ ID NO: 3972403 - RNA, 21 nt, Staphylococcus aureus subsp. aureus Mu50
uaaaccaaaucggaauaaaau

SEQ ID NO: 3972404 - RNA, 22 nt, Staphylococcus aureus subsp. aureus Mu50
uaaaccaaaucggaauaaaaua

SEQ ID NO: 3972405 - RNA, 17 nt, Staphylococcus aureus subsp. aureus Mu50
uaaaccagcuaaaccau

SEQ ID NO: 3972406 - RNA, 19 nt, Staphylococcus aureus subsp. aureus Mu50
uaaaccagcugauuccauu

SEQ ID NO: 3972407 - RNA, 19 nt, Staphylococcus aureus subsp. aureus Mu50
uaaaccauuuucaagagga

SEQ ID NO: 3972408 - RNA, 18 nt, Staphylococcus aureus subsp. aureus Mu50
uaaaccgauuaauauaau

SEQ ID NO: 3972409 - RNA, 21 nt, Staphylococcus aureus subsp. aureus Mu50
uaaaccgauuguuucaccagc

SEQ ID NO: 3972410 - RNA, 20 nt, Staphylococcus aureus subsp. aureus Mu50
uaaaccgcacuucuauauua

SEQ ID NO: 3972411 - RNA, 17 nt, Staphylococcus aureus subsp. aureus Mu50
uaaaccggcacuuauuu

SEQ ID NO: 3972412 - RNA, 15 nt, Staphylococcus aureus subsp. aureus Mu50
uaaaccuacaauaua

SEQ ID NO: 3972413 - RNA, 19 nt, Staphylococcus aureus subsp. aureus Mu50
uaaaccucaacauuaaaau

SEQ ID NO: 3972414 - RNA, 19 nt, Staphylococcus aureus subsp. aureus Mu50
uaaaccucuaaauaaaauu

SEQ ID NO: 3972415 - RNA, 22 nt, Staphylococcus aureus subsp. aureus Mu50
uaaaccucuaaauaaaauuaaa

SEQ ID NO: 3972416 - RNA, 11 nt, Staphylococcus aureus subsp. aureus Mu50
uaaaccuguua

SEQ ID NO: 3972417 - RNA, 17 nt, Staphylococcus aureus subsp. aureus Mu50
uaaaccuuuuuuaaguu

SEQ ID NO: 3972418 - RNA, 21 nt, Staphylococcus aureus subsp. aureus Mu50
uaaacgcaauacgaauaucug

SEQ ID NO: 3972419 - RNA, 19 nt, Staphylococcus aureus subsp. aureus Mu50
uaaacgcugauuuuauaaa

SEQ ID NO: 3972420 - RNA, 13 nt, Staphylococcus aureus subsp. aureus Mu50
uaaacguaucauu

SEQ ID NO: 3972421 - RNA, 19 nt, Staphylococcus aureus subsp. aureus Mu50
uaaacuaauagcauuugua

SEQ ID NO: 3972422 - RNA, 19 nt, Staphylococcus aureus subsp. aureus Mu50
uaaacuaguaauagaauag

SEQ ID NO: 3972423 - RNA, 23 nt, Staphylococcus aureus subsp. aureus Mu50
uaaacucauaccaaaaacauuaa

SEQ ID NO: 3972424 - RNA, 20 nt, Staphylococcus aureus subsp. aureus Mu50
uaaacucguugcacucuuuu

SEQ ID NO: 3972425 - RNA, 13 nt, Staphylococcus aureus subsp. aureus Mu50
uaaacuuaagaau

SEQ ID NO: 3972426 - RNA, 12 nt, Staphylococcus aureus subsp. aureus Mu50
uaaacuucuuuu

SEQ ID NO: 3972427 - RNA, 15 nt, Staphylococcus aureus subsp. aureus Mu50
uaaacuucuuuucuu

SEQ ID NO: 3972428 - RNA, 15 nt, Staphylococcus aureus subsp. aureus Mu50
uaaacuuuaugaaau

SEQ ID NO: 3972429 - RNA, 16 nt, Staphylococcus aureus subsp. aureus Mu50
uaaacuuuucuucaag

SEQ ID NO: 3972430 - RNA, 20 nt, Staphylococcus aureus subsp. aureus Mu50
uaaacuuuucuucaaguugu

SEQ ID NO: 3972431 - RNA, 13 nt, Staphylococcus aureus subsp. aureus Mu50
uaaagaaaauuuc

SEQ ID NO: 3972432 - RNA, 15 nt, Staphylococcus aureus subsp. aureus Mu50
uaaagaaacaugauu

SEQ ID NO: 3972433 - RNA, 19 nt, Staphylococcus aureus subsp. aureus Mu50
uaaagaaacaugauugaaa

SEQ ID NO: 3972434 - RNA, 21 nt, Staphylococcus aureus subsp. aureus Mu50
uaaagaaggggagaguuaauc

SEQ ID NO: 3972435 - RNA, 13 nt, Staphylococcus aureus subsp. aureus Mu50
uaaagaaugauuu

SEQ ID NO: 3972436 - RNA, 20 nt, Staphylococcus aureus subsp. aureus Mu50
uaaagagcaauuaaagucaa

SEQ ID NO: 3972437 - RNA, 21 nt, Staphylococcus aureus subsp. aureus Mu50
uaaagaguuauguuugucguu

SEQ ID NO: 3972438 - RNA, 22 nt, Staphylococcus aureus subsp. aureus Mu50
uaaagauagaaugaauaauucc

SEQ ID NO: 3972439 - RNA, 19 nt, Staphylococcus aureus subsp. aureus Mu50
uaaagaucauuuucaacau

SEQ ID NO: 3972440 - RNA, 18 nt, Staphylococcus aureus subsp. aureus Mu50
uaaagauggcugcaucaa

SEQ ID NO: 3972441 - RNA, 18 nt, Staphylococcus aureus subsp. aureus Mu50
uaaagaugucgaaaagua

SEQ ID NO: 3972442 - RNA, 16 nt, Staphylococcus aureus subsp. aureus Mu50
uaaagauuaaaauaug

SEQ ID NO: 3972443 - RNA, 17 nt, Staphylococcus aureus subsp. aureus Mu50
uaaagauuuacccauua

SEQ ID NO: 3972444 - RNA, 16 nt, Staphylococcus aureus subsp. aureus Mu50
uaaagcauaucucaag

SEQ ID NO: 3972445 - RNA, 19 nt, Staphylococcus aureus subsp. aureus Mu50
uaaagccaccuaaaucucc

SEQ ID NO: 3972446 - RNA, 15 nt, Staphylococcus aureus subsp. aureus Mu50
uaaagcgauaauaga

SEQ ID NO: 3972447 - RNA, 21 nt, Staphylococcus aureus subsp. aureus Mu50
uaaagcguucucuaauuucac

SEQ ID NO: 3972448 - RNA, 21 nt, Staphylococcus aureus subsp. aureus Mu50
uaaagcuaacauaccuaauaa

SEQ ID NO: 3972449 - RNA, 15 nt, Staphylococcus aureus subsp. aureus Mu50
uaaagcuaaugcaag

SEQ ID NO: 3972450 - RNA, 15 nt, Staphylococcus aureus subsp. aureus Mu50
uaaagcuauaaaaaa

SEQ ID NO: 3972451 - RNA, 17 nt, Staphylococcus aureus subsp. aureus Mu50
uaaagcugauuuuucau

SEQ ID NO: 3972452 - RNA, 18 nt, Staphylococcus aureus subsp. aureus Mu50
uaaagcugauuuuucauu

SEQ ID NO: 3972453 - RNA, 21 nt, Staphylococcus aureus subsp. aureus Mu50
uaaagcuggggaagaccauuu

SEQ ID NO: 3972454 - RNA, 18 nt, Staphylococcus aureus subsp. aureus Mu50
uaaagcuguuuauugguu

SEQ ID NO: 3972455 - RNA, 16 nt, Staphylococcus aureus subsp. aureus Mu50
uaaagcuuuaguuaaa

SEQ ID NO: 3972456 - RNA, 20 nt, Staphylococcus aureus subsp. aureus Mu50
uaaaggaagacauacucaca

SEQ ID NO: 3972457 - RNA, 22 nt, Staphylococcus aureus subsp. aureus Mu50
uaaaggaauagcuacaauuaaa

SEQ ID NO: 3972458 - RNA, 14 nt, Staphylococcus aureus subsp. aureus Mu50
uaaaggcaacaaau

SEQ ID NO: 3972459 - RNA, 22 nt, Staphylococcus aureus subsp. aureus Mu50
uaaaggguguuuagauagcucu

SEQ ID NO: 3972460 - RNA, 14 nt, Staphylococcus aureus subsp. aureus Mu50
uaaaggugauauuu

SEQ ID NO: 3972461 - RNA, 15 nt, Staphylococcus aureus subsp. aureus Mu50
uaaaguaaauaacac

SEQ ID NO: 3972462 - RNA, 16 nt, Staphylococcus aureus subsp. aureus Mu50
uaaaguauguugucau

SEQ ID NO: 3972463 - RNA, 21 nt, Staphylococcus aureus subsp. aureus Mu50
uaaagucaacaucguauucuu

SEQ ID NO: 3972464 - RNA, 16 nt, Staphylococcus aureus subsp. aureus Mu50
uaaauauuuuuaauua

SEQ ID NO: 3972465 - RNA, 16 nt, Staphylococcus aureus subsp. aureus Mu50
uaaaucaaacuuuuca

SEQ ID NO: 3972466 - RNA, 14 nt, Staphylococcus aureus subsp. aureus Mu50
uaaaucaaagcuau

SEQ ID NO: 3972467 - RNA, 13 nt, Staphylococcus aureus subsp. aureus Mu50
uaaaucaagaaau

SEQ ID NO: 3972468 - RNA, 17 nt, Staphylococcus aureus subsp. aureus Mu50
uaaaucaagaaauguua

SEQ ID NO: 3972469 - RNA, 19 nt, Staphylococcus aureus subsp. aureus Mu50
uaaaucaagaaauguuaaa

SEQ ID NO: 3972470 - RNA, 21 nt, Staphylococcus aureus subsp. aureus Mu50
uaaaucacauaugauaauuaa

SEQ ID NO: 3972471 - RNA, 20 nt, Staphylococcus aureus subsp. aureus Mu50
uaaaucacuagcuaaugcac

SEQ ID NO: 3972472 - RNA, 18 nt, Staphylococcus aureus subsp. aureus Mu50
uaaaucacugcuuucaag

SEQ ID NO: 3972473 - RNA, 22 nt, Staphylococcus aureus subsp. aureus Mu50
uaaaucacugcuuucaaguaau

SEQ ID NO: 3972474 - RNA, 16 nt, Staphylococcus aureus subsp. aureus Mu50
uaaaucauacgagaaa

SEQ ID NO: 3972475 - RNA, 14 nt, Staphylococcus aureus subsp. aureus Mu50
uaaaucauagaggc

SEQ ID NO: 3972476 - RNA, 21 nt, Staphylococcus aureus subsp. aureus Mu50
uaaaucaugacauaggcgcuu

SEQ ID NO: 3972477 - RNA, 16 nt, Staphylococcus aureus subsp. aureus Mu50
uaaaucauuucguuca

SEQ ID NO: 3972478 - RNA, 16 nt, Staphylococcus aureus subsp. aureus Mu50
uaaauccgcuuguuca

SEQ ID NO: 3972479 - RNA, 20 nt, Staphylococcus aureus subsp. aureus Mu50
uaaaucgaauugauggaaaa

SEQ ID NO: 3972480 - RNA, 16 nt, Staphylococcus aureus subsp. aureus Mu50
uaaaucgauaaaaugu

SEQ ID NO: 3972481 - RNA, 17 nt, Staphylococcus aureus subsp. aureus Mu50
uaaaucgauaaaaugua

SEQ ID NO: 3972482 - RNA, 14 nt, Staphylococcus aureus subsp. aureus Mu50
uaaaucgauaacag

SEQ ID NO: 3972483 - RNA, 18 nt, Staphylococcus aureus subsp. aureus Mu50
uaaaucuaagugguugaa

SEQ ID NO: 3972484 - RNA, 16 nt, Staphylococcus aureus subsp. aureus Mu50
uaaaucuacuacuaau

SEQ ID NO: 3972485 - RNA, 22 nt, Staphylococcus aureus subsp. aureus Mu50
uaaaucuauauaaaguugacaa

SEQ ID NO: 3972486 - RNA, 16 nt, Staphylococcus aureus subsp. aureus Mu50
uaaaucugauucauua

SEQ ID NO: 3972487 - RNA, 16 nt, Staphylococcus aureus subsp. aureus Mu50
uaaaucuguuuaaauu

SEQ ID NO: 3972488 - RNA, 19 nt, Staphylococcus aureus subsp. aureus Mu50
uaaaucuguuuaaauuuaa

SEQ ID NO: 3972489 - RNA, 19 nt, Staphylococcus aureus subsp. aureus Mu50
uaaaucuucuaguaauucu

SEQ ID NO: 3972490 - RNA, 20 nt, Staphylococcus aureus subsp. aureus Mu50
uaaaucuuguuggauuuuaa

SEQ ID NO: 3972491 - RNA, 23 nt, Staphylococcus aureus subsp. aureus Mu50
uaaaucuuguuggauuuuaacaa

SEQ ID NO: 3972492 - RNA, 15 nt, Staphylococcus aureus subsp. aureus Mu50
uaaaucuuuaaaugu

SEQ ID NO: 3972493 - RNA, 20 nt, Staphylococcus aureus subsp. aureus Mu50
uaaaucuuuaacuucugauu

SEQ ID NO: 3972494 - RNA, 23 nt, Staphylococcus aureus subsp. aureus Mu50
uaaaucuuuuagcuuuuguaaag

SEQ ID NO: 3972495 - RNA, 22 nt, Staphylococcus aureus subsp. aureus Mu50
uaaaugaaaguaccuaaaauag

SEQ ID NO: 3972496 - RNA, 23 nt, Staphylococcus aureus subsp. aureus Mu50
uaaaugaaaguaccuaaaauaga

SEQ ID NO: 3972497 - RNA, 14 nt, Staphylococcus aureus subsp. aureus Mu50
uaaaugaaauaucg

SEQ ID NO: 3972498 - RNA, 13 nt, Staphylococcus aureus subsp. aureus Mu50
uaaaugaaggcuu

SEQ ID NO: 3972499 - RNA, 16 nt, Staphylococcus aureus subsp. aureus Mu50
uaaaugaauuauuuaa

SEQ ID NO: 3972500 - RNA, 17 nt, Staphylococcus aureus subsp. aureus Mu50
uaaaugaauuauuuaaa

SEQ ID NO: 3972501 - RNA, 20 nt, Staphylococcus aureus subsp. aureus Mu50
uaaaugaauugucuuaauau

SEQ ID NO: 3972502 - RNA, 15 nt, Staphylococcus aureus subsp. aureus Mu50
uaaaugacauuuaau

SEQ ID NO: 3972503 - RNA, 16 nt, Staphylococcus aureus subsp. aureus Mu50
uaaaugacuucacauu

SEQ ID NO: 3972504 - RNA, 18 nt, Staphylococcus aureus subsp. aureus Mu50
uaaaugaugcaguaaaac

SEQ ID NO: 3972505 - RNA, 20 nt, Staphylococcus aureus subsp. aureus Mu50
uaaaugaugcaguaaaacca

SEQ ID NO: 3972506 - RNA, 14 nt, Staphylococcus aureus subsp. aureus Mu50
uaaaugauuaaagu

SEQ ID NO: 3972507 - RNA, 12 nt, Staphylococcus aureus subsp. aureus Mu50
uaaaugauuuau

SEQ ID NO: 3972508 - RNA, 15 nt, Staphylococcus aureus subsp. aureus Mu50
uaaaugauuucacuu

SEQ ID NO: 3972509 - RNA, 17 nt, Staphylococcus aureus subsp. aureus Mu50
uaaaugcaauacauuaa

SEQ ID NO: 3972510 - RNA, 21 nt, Staphylococcus aureus subsp. aureus Mu50
uaaaugcacgagcaacaucuu

SEQ ID NO: 3972511 - RNA, 20 nt, Staphylococcus aureus subsp. aureus Mu50
uaaaugcccaccauguacau

SEQ ID NO: 3972512 - RNA, 15 nt, Staphylococcus aureus subsp. aureus Mu50
uaaaugcuaaaagua

SEQ ID NO: 3972513 - RNA, 22 nt, Staphylococcus aureus subsp. aureus Mu50
uaaaugcuggguaauaaauugu

SEQ ID NO: 3972514 - RNA, 21 nt, Staphylococcus aureus subsp. aureus Mu50
uaaaugcuuaauuuguuuuaa

SEQ ID NO: 3972515 - RNA, 22 nt, Staphylococcus aureus subsp. aureus Mu50
uaaaugcuuaauuuguuuuaaa

SEQ ID NO: 3972516 - RNA, 16 nt, Staphylococcus aureus subsp. aureus Mu50
uaaauguacauuguaa

SEQ ID NO: 3972517 - RNA, 14 nt, Staphylococcus aureus subsp. aureus Mu50
uaaauguaucacuu

SEQ ID NO: 3972518 - RNA, 16 nt, Staphylococcus aureus subsp. aureus Mu50
uaaauguauuaaacau

SEQ ID NO: 3972519 - RNA, 16 nt, Staphylococcus aureus subsp. aureus Mu50
uaaaugucacugcaaa

SEQ ID NO: 3972520 - RNA, 21 nt, Staphylococcus aureus subsp. aureus Mu50
uaaaugucacugcaaacacag

SEQ ID NO: 3972521 - RNA, 14 nt, Staphylococcus aureus subsp. aureus Mu50
uaaaugucuuucaa

SEQ ID NO: 3972522 - RNA, 17 nt, Staphylococcus aureus subsp. aureus Mu50
uaaaugucuuucaaaua

SEQ ID NO: 3972523 - RNA, 13 nt, Staphylococcus aureus subsp. aureus Mu50
uaaaugugacuuu

SEQ ID NO: 3972524 - RNA, 16 nt, Staphylococcus aureus subsp. aureus Mu50
uaaaugugacuuuaaa

SEQ ID NO: 3972525 - RNA, 14 nt, Staphylococcus aureus subsp. aureus Mu50
uaaaugugcaauua

SEQ ID NO: 3972526 - RNA, 19 nt, Staphylococcus aureus subsp. aureus Mu50
uaaaugugcaauuagaaua

SEQ ID NO: 3972527 - RNA, 13 nt, Staphylococcus aureus subsp. aureus Mu50
uaaauguuauuaa

SEQ ID NO: 3972528 - RNA, 18 nt, Staphylococcus aureus subsp. aureus Mu50
uaaauguuauuaaccauc

SEQ ID NO: 3972529 - RNA, 19 nt, Staphylococcus aureus subsp. aureus Mu50
uaaauguuauuaaccauca

SEQ ID NO: 3972530 - RNA, 20 nt, Staphylococcus aureus subsp. aureus Mu50
uaaauguuauuaaccaucau

SEQ ID NO: 3972531 - RNA, 16 nt, Staphylococcus aureus subsp. aureus Mu50
uaaauguuuauaucuu

SEQ ID NO: 3972532 - RNA, 14 nt, Staphylococcus aureus subsp. aureus Mu50
uaaauuaaaucgau

SEQ ID NO: 3972533 - RNA, 14 nt, Staphylococcus aureus subsp. aureus Mu50
uaaauuaauagaga

SEQ ID NO: 3972534 - RNA, 12 nt, Staphylococcus aureus subsp. aureus Mu50
uaaauuaauaug

SEQ ID NO: 3972535 - RNA, 13 nt, Staphylococcus aureus subsp. aureus Mu50
uaaauuaauauga

SEQ ID NO: 3972536 - RNA, 21 nt, Staphylococcus aureus subsp. aureus Mu50
uaaauuacccacaucuuuuua

SEQ ID NO: 3972537 - RNA, 15 nt, Staphylococcus aureus subsp. aureus Mu50
uaaauuacuauauuu

SEQ ID NO: 3972538 - RNA, 21 nt, Staphylococcus aureus subsp. aureus Mu50
uaaauuacuugcacaccagug

SEQ ID NO: 3972539 - RNA, 23 nt, Staphylococcus aureus subsp. aureus Mu50
uaaauuauaguacguuugcauau

SEQ ID NO: 3972540 - RNA, 13 nt, Staphylococcus aureus subsp. aureus Mu50
uaaauuauauacc

SEQ ID NO: 3972541 - RNA, 14 nt, Staphylococcus aureus subsp. aureus Mu50
uaaauuauauguuu

SEQ ID NO: 3972542 - RNA, 18 nt, Staphylococcus aureus subsp. aureus Mu50
uaaauuaucuaaagaaau

SEQ ID NO: 3972543 - RNA, 23 nt, Staphylococcus aureus subsp. aureus Mu50
uaaauuauggagcggaagauagg

SEQ ID NO: 3972544 - RNA, 18 nt, Staphylococcus aureus subsp. aureus Mu50
uaaauucaaaucuggcac

SEQ ID NO: 3972545 - RNA, 14 nt, Staphylococcus aureus subsp. aureus Mu50
uaaauucaucuguu

SEQ ID NO: 3972546 - RNA, 13 nt, Staphylococcus aureus subsp. aureus Mu50
uaaauucaucuua

SEQ ID NO: 3972547 - RNA, 21 nt, Staphylococcus aureus subsp. aureus Mu50
uaaauucaucuugcaaguauu

SEQ ID NO: 3972548 - RNA, 20 nt, Staphylococcus aureus subsp. aureus Mu50
uaaauuccaagagaauuaau

SEQ ID NO: 3972549 - RNA, 16 nt, Staphylococcus aureus subsp. aureus Mu50
uaaauucuaaaacgga

SEQ ID NO: 3972550 - RNA, 20 nt, Staphylococcus aureus subsp. aureus Mu50
uaaauucuuuucaagaaauu

SEQ ID NO: 3972551 - RNA, 13 nt, Staphylococcus aureus subsp. aureus Mu50
uaaauugagaagu

SEQ ID NO: 3972552 - RNA, 21 nt, Staphylococcus aureus subsp. aureus Mu50
uaacauguauuuaguaucaug

SEQ ID NO: 3972553 - RNA, 23 nt, Staphylococcus aureus subsp. aureus Mu50
uaacauguauuuaguaucaugau

SEQ ID NO: 3972554 - RNA, 13 nt, Staphylococcus aureus subsp. aureus Mu50
uaacauuagcaug

SEQ ID NO: 3972555 - RNA, 21 nt, Staphylococcus aureus subsp. aureus Mu50
uaacauuagcauuaaauucca

SEQ ID NO: 3972556 - RNA, 16 nt, Staphylococcus aureus subsp. aureus Mu50
uaacauucuucaaaaa

SEQ ID NO: 3972557 - RNA, 19 nt, Staphylococcus aureus subsp. aureus Mu50
uaacauucuucaaaaaaua

SEQ ID NO: 3972558 - RNA, 19 nt, Staphylococcus aureus subsp. aureus Mu50
uaacauuuauucuuucucu

SEQ ID NO: 3972559 - RNA, 20 nt, Staphylococcus aureus subsp. aureus Mu50
uaacauuugcuaguagaguu

SEQ ID NO: 3972560 - RNA, 14 nt, Staphylococcus aureus subsp. aureus Mu50
uaaccaaaagaaau

SEQ ID NO: 3972561 - RNA, 16 nt, Staphylococcus aureus subsp. aureus Mu50
uaaccaaaagaaauuc

SEQ ID NO: 3972562 - RNA, 14 nt, Staphylococcus aureus subsp. aureus Mu50
uaaccaaucaucgc

SEQ ID NO: 3972563 - RNA, 22 nt, Staphylococcus aureus subsp. aureus Mu50
uaaccaaucaucgcaaauacau

SEQ ID NO: 3972564 - RNA, 20 nt, Staphylococcus aureus subsp. aureus Mu50
uaaccagugcaacuacgaua

SEQ ID NO: 3972565 - RNA, 20 nt, Staphylococcus aureus subsp. aureus Mu50
uaaccaguucgaaaauuaua

SEQ ID NO: 3972566 - RNA, 14 nt, Staphylococcus aureus subsp. aureus Mu50
uaaccauaaugaac

SEQ ID NO: 3972567 - RNA, 12 nt, Staphylococcus aureus subsp. aureus Mu50
uaaccauaguaa

SEQ ID NO: 3972568 - RNA, 16 nt, Staphylococcus aureus subsp. aureus Mu50
uaaccaucauaaaugu

SEQ ID NO: 3972569 - RNA, 13 nt, Staphylococcus aureus subsp. aureus Mu50
uaaccauuaugau

SEQ ID NO: 3972570 - RNA, 14 nt, Staphylococcus aureus subsp. aureus Mu50
uaaccauuaugauu

SEQ ID NO: 3972571 - RNA, 14 nt, Staphylococcus aureus subsp. aureus Mu50
uaaccauuuaaaaa

SEQ ID NO: 3972572 - RNA, 14 nt, Staphylococcus aureus subsp. aureus Mu50
uaacccacauuaaa

SEQ ID NO: 3972573 - RNA, 18 nt, Staphylococcus aureus subsp. aureus Mu50
uaacccacauuaaauauu

SEQ ID NO: 3972574 - RNA, 15 nt, Staphylococcus aureus subsp. aureus Mu50
uaaccccuccuggug

SEQ ID NO: 3972575 - RNA, 16 nt, Staphylococcus aureus subsp. aureus Mu50
uaaccccuccuggugc

SEQ ID NO: 3972576 - RNA, 16 nt, Staphylococcus aureus subsp. aureus Mu50
uaacccuaaaaugaau

SEQ ID NO: 3972577 - RNA, 20 nt, Staphylococcus aureus subsp. aureus Mu50
uaacccuaaagcuaaugcaa

SEQ ID NO: 3972578 - RNA, 15 nt, Staphylococcus aureus subsp. aureus Mu50
uaaccgaaauauugu

SEQ ID NO: 3972579 - RNA, 14 nt, Staphylococcus aureus subsp. aureus Mu50
uaaccgcacuuucu

SEQ ID NO: 3972580 - RNA, 15 nt, Staphylococcus aureus subsp. aureus Mu50
uaaccgcauacagau

SEQ ID NO: 3972581 - RNA, 19 nt, Staphylococcus aureus subsp. aureus Mu50
uaaccgcuucuuuuaaguu

SEQ ID NO: 3972582 - RNA, 19 nt, Staphylococcus aureus subsp. aureus Mu50
uaaccgucacaaaccauuc

SEQ ID NO: 3972583 - RNA, 18 nt, Staphylococcus aureus subsp. aureus Mu50
uaaccuaaguuaauuuau

SEQ ID NO: 3972584 - RNA, 21 nt, Staphylococcus aureus subsp. aureus Mu50
uaaccuaauucgccaucuuuu

SEQ ID NO: 3972585 - RNA, 14 nt, Staphylococcus aureus subsp. aureus Mu50
uaaccuugauuuaa

SEQ ID NO: 3972586 - RNA, 19 nt, Staphylococcus aureus subsp. aureus Mu50
uaaccuuuaaaacaucauu

SEQ ID NO: 3972587 - RNA, 22 nt, Staphylococcus aureus subsp. aureus Mu50
uaaccuuucgcagcuucuuuaa

SEQ ID NO: 3972588 - RNA, 22 nt, Staphylococcus aureus subsp. aureus Mu50
uaacgaaaaagaugguuuuguu

SEQ ID NO: 3972589 - RNA, 17 nt, Staphylococcus aureus subsp. aureus Mu50
uaacgacccaaauuaua

SEQ ID NO: 3972590 - RNA, 22 nt, Staphylococcus aureus subsp. aureus Mu50
uaacgauaguuuuuuuucauag

SEQ ID NO: 3972591 - RNA, 23 nt, Staphylococcus aureus subsp. aureus Mu50
uaacgaugguugcuucacuguuu

SEQ ID NO: 3972592 - RNA, 15 nt, Staphylococcus aureus subsp. aureus Mu50
uaacgcaaugucuug

SEQ ID NO: 3972593 - RNA, 17 nt, Staphylococcus aureus subsp. aureus Mu50
uaacgcaguugaaaaag

SEQ ID NO: 3972594 - RNA, 22 nt, Staphylococcus aureus subsp. aureus Mu50
uaacggaaauacaaugaauugu

SEQ ID NO: 3972595 - RNA, 12 nt, Staphylococcus aureus subsp. aureus Mu50
uaacggcucgcg

SEQ ID NO: 3972596 - RNA, 15 nt, Staphylococcus aureus subsp. aureus Mu50
uaacguacaauguau

SEQ ID NO: 3972597 - RNA, 16 nt, Staphylococcus aureus subsp. aureus Mu50
uaacguacaauguauu

SEQ ID NO: 3972598 - RNA, 22 nt, Staphylococcus aureus subsp. aureus Mu50
uaacguauagaugcuaauguaa

SEQ ID NO: 3972599 - RNA, 20 nt, Staphylococcus aureus subsp. aureus Mu50
uaacgucauuuuuaauaaug

SEQ ID NO: 3972600 - RNA, 19 nt, Staphylococcus aureus subsp. aureus Mu50
uaacgugaggcccauaaau

SEQ ID NO: 3972601 - RNA, 15 nt, Staphylococcus aureus subsp. aureus Mu50
uaacguucacuuggu

SEQ ID NO: 3972602 - RNA, 15 nt, Staphylococcus aureus subsp. aureus Mu50
uaacguucuguuuug

SEQ ID NO: 3972603 - RNA, 13 nt, Staphylococcus aureus subsp. aureus Mu50
uaacuaaaauguc

SEQ ID NO: 3972604 - RNA, 23 nt, Staphylococcus aureus subsp. aureus Mu50
uaacuaaaaugucuuugaaaaac

SEQ ID NO: 3972605 - RNA, 15 nt, Staphylococcus aureus subsp. aureus Mu50
uaacuacacuuaaua

SEQ ID NO: 3972606 - RNA, 22 nt, Staphylococcus aureus subsp. aureus Mu50
uaacuagauguucacauucuug

SEQ ID NO: 3972607 - RNA, 23 nt, Staphylococcus aureus subsp. aureus Mu50
uaacuagugccucuuuuauuauu

SEQ ID NO: 3972608 - RNA, 14 nt, Staphylococcus aureus subsp. aureus Mu50
uaacuauaaauaga

SEQ ID NO: 3972609 - RNA, 22 nt, Staphylococcus aureus subsp. aureus Mu50
uaacuauauugugcuaaguuag

SEQ ID NO: 3972610 - RNA, 23 nt, Staphylococcus aureus subsp. aureus Mu50
uaacuauauugugcuaaguuagg

SEQ ID NO: 3972611 - RNA, 17 nt, Staphylococcus aureus subsp. aureus Mu50
uaacuaugaaugcugug

SEQ ID NO: 3972612 - RNA, 14 nt, Staphylococcus aureus subsp. aureus Mu50
uaacuauggucauc

SEQ ID NO: 3972613 - RNA, 17 nt, Staphylococcus aureus subsp. aureus Mu50
uaacuauguuacuuaua

SEQ ID NO: 3972614 - RNA, 21 nt, Staphylococcus aureus subsp. aureus Mu50
uaacuauguuacuuauauauu

SEQ ID NO: 3972615 - RNA, 18 nt, Staphylococcus aureus subsp. aureus Mu50
uaacucaaagaaacuaua

SEQ ID NO: 3972616 - RNA, 20 nt, Staphylococcus aureus subsp. aureus Mu50
uaacucaaauaucuaaacaa

SEQ ID NO: 3972617 - RNA, 22 nt, Staphylococcus aureus subsp. aureus Mu50
uaacucaaauaucuaaacaauu

SEQ ID NO: 3972618 - RNA, 23 nt, Staphylococcus aureus subsp. aureus Mu50
uaacucuaaauauaauagaaaua

SEQ ID NO: 3972619 - RNA, 16 nt, Staphylococcus aureus subsp. aureus Mu50
uaacucuuuguauaag

SEQ ID NO: 3972620 - RNA, 24 nt, Staphylococcus aureus subsp. aureus Mu50
uaacugaauuaaagcaucgaacaa

SEQ ID NO: 3972621 - RNA, 13 nt, Staphylococcus aureus subsp. aureus Mu50
uaacugaguuuua

SEQ ID NO: 3972622 - RNA, 14 nt, Staphylococcus aureus subsp. aureus Mu50
uaacugauaauacu

SEQ ID NO: 3972623 - RNA, 21 nt, Staphylococcus aureus subsp. aureus Mu50
uaacugccauauagauauuag

SEQ ID NO: 3972624 - RNA, 23 nt, Staphylococcus aureus subsp. aureus Mu50
uaacugguugauaaauaaacuca

SEQ ID NO: 3972625 - RNA, 14 nt, Staphylococcus aureus subsp. aureus Mu50
uaacuguaaaacau

SEQ ID NO: 3972626 - RNA, 15 nt, Staphylococcus aureus subsp. aureus Mu50
uaacuguaaaacauu

SEQ ID NO: 3972627 - RNA, 21 nt, Staphylococcus aureus subsp. aureus Mu50
uaacuguacgauucaauuuaa

SEQ ID NO: 3972628 - RNA, 16 nt, Staphylococcus aureus subsp. aureus Mu50
uaacuguuuauccaua

SEQ ID NO: 3972629 - RNA, 13 nt, Staphylococcus aureus subsp. aureus Mu50
uaacuuaaaauuu

SEQ ID NO: 3972630 - RNA, 13 nt, Staphylococcus aureus subsp. aureus Mu50
uaacuuaccauga

SEQ ID NO: 3972631 - RNA, 19 nt, Staphylococcus aureus subsp. aureus Mu50
uaacuuacuauuuguuaug

SEQ ID NO: 3972632 - RNA, 15 nt, Staphylococcus aureus subsp. aureus Mu50
uaacuuacuuuugua

SEQ ID NO: 3972633 - RNA, 16 nt, Staphylococcus aureus subsp. aureus Mu50
uaacuucauaauauau

SEQ ID NO: 3972634 - RNA, 19 nt, Staphylococcus aureus subsp. aureus Mu50
uaacuucauaauauauccu

SEQ ID NO: 3972635 - RNA, 10 nt, Staphylococcus aureus subsp. aureus Mu50
uaacuuccua

SEQ ID NO: 3972636 - RNA, 21 nt, Staphylococcus aureus subsp. aureus Mu50
uaacuuccuaaaauuuacaaa

SEQ ID NO: 3972637 - RNA, 16 nt, Staphylococcus aureus subsp. aureus Mu50
uaacuucguuuuaaua

SEQ ID NO: 3972638 - RNA, 18 nt, Staphylococcus aureus subsp. aureus Mu50
uaacuucugauucuucac

SEQ ID NO: 3972639 - RNA, 22 nt, Staphylococcus aureus subsp. aureus Mu50
uaagugauuucuucauuaucaa

SEQ ID NO: 3972640 - RNA, 21 nt, Staphylococcus aureus subsp. aureus Mu50
uaagugccuugccaugauuua

SEQ ID NO: 3972641 - RNA, 19 nt, Staphylococcus aureus subsp. aureus Mu50
uaagugggacuuuuuauau

SEQ ID NO: 3972642 - RNA, 17 nt, Staphylococcus aureus subsp. aureus Mu50
uaaguguaaaugaaagu

SEQ ID NO: 3972643 - RNA, 12 nt, Staphylococcus aureus subsp. aureus Mu50
uaaguuaaaaau

SEQ ID NO: 3972644 - RNA, 15 nt, Staphylococcus aureus subsp. aureus Mu50
uaaguuaaaaaugua

SEQ ID NO: 3972645 - RNA, 17 nt, Staphylococcus aureus subsp. aureus Mu50
uaaguuaaaauaaaaug

SEQ ID NO: 3972646 - RNA, 15 nt, Staphylococcus aureus subsp. aureus Mu50
uaaguuaaugugcau

SEQ ID NO: 3972647 - RNA, 13 nt, Staphylococcus aureus subsp. aureus Mu50
uaaguuaauuuau

SEQ ID NO: 3972648 - RNA, 22 nt, Staphylococcus aureus subsp. aureus Mu50
uaaguuaauuuaucguuuagua

SEQ ID NO: 3972649 - RNA, 23 nt, Staphylococcus aureus subsp. aureus Mu50
uaaguuaugacuaacgaaaaaga

SEQ ID NO: 3972650 - RNA, 21 nt, Staphylococcus aureus subsp. aureus Mu50
uaaguuauuuggauauuuauu

SEQ ID NO: 3972651 - RNA, 21 nt, Staphylococcus aureus subsp. aureus Mu50
uaaguucaccuaaaugauuaa

SEQ ID NO: 3972652 - RNA, 14 nt, Staphylococcus aureus subsp. aureus Mu50
uaaguugauuucua

SEQ ID NO: 3972653 - RNA, 15 nt, Staphylococcus aureus subsp. aureus Mu50
uaaguuugucuuuga

SEQ ID NO: 3972654 - RNA, 20 nt, Staphylococcus aureus subsp. aureus Mu50
uaaguuugucuuugaacaua

SEQ ID NO: 3972655 - RNA, 14 nt, Staphylococcus aureus subsp. aureus Mu50
uaaguuuguuuucu

SEQ ID NO: 3972656 - RNA, 19 nt, Staphylococcus aureus subsp. aureus Mu50
uaaguuuuugaauaucuaa

SEQ ID NO: 3972657 - RNA, 14 nt, Staphylococcus aureus subsp. aureus Mu50
uaauaaaaaccaau

SEQ ID NO: 3972658 - RNA, 23 nt, Staphylococcus aureus subsp. aureus Mu50
uaauaaaaaccaauauuucuggg

SEQ ID NO: 3972659 - RNA, 22 nt, Staphylococcus aureus subsp. aureus Mu50
uaauaaaaacucuaaaaguugu

SEQ ID NO: 3972660 - RNA, 13 nt, Staphylococcus aureus subsp. aureus Mu50
uaauaaaccuaaa

SEQ ID NO: 3972661 - RNA, 16 nt, Staphylococcus aureus subsp. aureus Mu50
uaauaaaccuacaaua

SEQ ID NO: 3972662 - RNA, 16 nt, Staphylococcus aureus subsp. aureus Mu50
uaauaaagaauaaaca

SEQ ID NO: 3972663 - RNA, 19 nt, Staphylococcus aureus subsp. aureus Mu50
uaauaaagcugauuuuuca

SEQ ID NO: 3972664 - RNA, 21 nt, Staphylococcus aureus subsp. aureus Mu50
uaauaaauaggaugaaaaaga

SEQ ID NO: 3972665 - RNA, 22 nt, Staphylococcus aureus subsp. aureus Mu50
uaauaaauaggaugaaaaagau

SEQ ID NO: 3972666 - RNA, 11 nt, Staphylococcus aureus subsp. aureus Mu50
uaauaaauauc

SEQ ID NO: 3972667 - RNA, 16 nt, Staphylococcus aureus subsp. aureus Mu50
uaauaaauaucuuagu

SEQ ID NO: 3972668 - RNA, 18 nt, Staphylococcus aureus subsp. aureus Mu50
uaauaaauaucuuaguau

SEQ ID NO: 3972669 - RNA, 22 nt, Staphylococcus aureus subsp. aureus Mu50
uaauaaaucacgccauaaucuu

SEQ ID NO: 3972670 - RNA, 15 nt, Staphylococcus aureus subsp. aureus Mu50
uaauaaaucauuagu

SEQ ID NO: 3972671 - RNA, 22 nt, Staphylococcus aureus subsp. aureus Mu50
uaauaaaucauuaguuguauca

SEQ ID NO: 3972672 - RNA, 19 nt, Staphylococcus aureus subsp. aureus Mu50
uaauaaaucgaauugaugg

SEQ ID NO: 3972673 - RNA, 12 nt, Staphylococcus aureus subsp. aureus Mu50
uaauaaauugua

SEQ ID NO: 3972674 - RNA, 22 nt, Staphylococcus aureus subsp. aureus Mu50
uaauaaauuguuaucguucaau

SEQ ID NO: 3972675 - RNA, 21 nt, Staphylococcus aureus subsp. aureus Mu50
uaauaaauuuccaaaguaaua

SEQ ID NO: 3972676 - RNA, 12 nt, Staphylococcus aureus subsp. aureus Mu50
uaauaacaaaau

SEQ ID NO: 3972677 - RNA, 21 nt, Staphylococcus aureus subsp. aureus Mu50
uaauaacauccccaaaaauag

SEQ ID NO: 3972678 - RNA, 14 nt, Staphylococcus aureus subsp. aureus Mu50
uaauaacaucuaaa

SEQ ID NO: 3972679 - RNA, 17 nt, Staphylococcus aureus subsp. aureus Mu50
uaauaacaucuaaauuu

SEQ ID NO: 3972680 - RNA, 18 nt, Staphylococcus aureus subsp. aureus Mu50
uaauaaccauguaaaauu

SEQ ID NO: 3972681 - RNA, 20 nt, Staphylococcus aureus subsp. aureus Mu50
uaauaacccgaacacaaaaa

SEQ ID NO: 3972682 - RNA, 17 nt, Staphylococcus aureus subsp. aureus Mu50
uaauaacgcauauaagc

SEQ ID NO: 3972683 - RNA, 21 nt, Staphylococcus aureus subsp. aureus Mu50
uaauaagaauauucgauacau

SEQ ID NO: 3972684 - RNA, 16 nt, Staphylococcus aureus subsp. aureus Mu50
uaauaagcugaaauaa

SEQ ID NO: 3972685 - RNA, 16 nt, Staphylococcus aureus subsp. aureus Mu50
uaauaaguaauaauuu

SEQ ID NO: 3972686 - RNA, 20 nt, Staphylococcus aureus subsp. aureus Mu50
uaauaagucugaugucgaaa

SEQ ID NO: 3972687 - RNA, 14 nt, Staphylococcus aureus subsp. aureus Mu50
uaauaagugcuguu

SEQ ID NO: 3972688 - RNA, 20 nt, Staphylococcus aureus subsp. aureus Mu50
uaauaaguugaauauaaaaa

SEQ ID NO: 3972689 - RNA, 17 nt, Staphylococcus aureus subsp. aureus Mu50
uaauaauaaaauagcug

SEQ ID NO: 3972690 - RNA, 13 nt, Staphylococcus aureus subsp. aureus Mu50
uaauaauaaucuu

SEQ ID NO: 3972691 - RNA, 19 nt, Staphylococcus aureus subsp. aureus Mu50
uaauaauacuucuaaucgu

SEQ ID NO: 3972692 - RNA, 15 nt, Staphylococcus aureus subsp. aureus Mu50
uaauaauauaaauaa

SEQ ID NO: 3972693 - RNA, 13 nt, Staphylococcus aureus subsp. aureus Mu50
uaauaauaucuuu

SEQ ID NO: 3972694 - RNA, 14 nt, Staphylococcus aureus subsp. aureus Mu50
uaauaauaucuuuu

SEQ ID NO: 3972695 - RNA, 21 nt, Staphylococcus aureus subsp. aureus Mu50
uaauaaucggacugauggaaa

SEQ ID NO: 3972696 - RNA, 17 nt, Staphylococcus aureus subsp. aureus Mu50
uaauaaucuuuaacauu

SEQ ID NO: 3972697 - RNA, 19 nt, Staphylococcus aureus subsp. aureus Mu50
uaauaaugaauucuauccu

SEQ ID NO: 3972698 - RNA, 16 nt, Staphylococcus aureus subsp. aureus Mu50
uaauaauguaucauuu

SEQ ID NO: 3972699 - RNA, 14 nt, Staphylococcus aureus subsp. aureus Mu50
uaauaauuaaacaa

SEQ ID NO: 3972700 - RNA, 19 nt, Staphylococcus aureus subsp. aureus Mu50
uaauaauuaaauauaaaga

SEQ ID NO: 3972701 - RNA, 18 nt, Staphylococcus aureus subsp. aureus Mu50
uaauaauuaauaagcauu

SEQ ID NO: 3972702 - RNA, 18 nt, Staphylococcus aureus subsp. aureus Mu50
uaauaauuggaaucaucu

SEQ ID NO: 3972703 - RNA, 14 nt, Staphylococcus aureus subsp. aureus Mu50
uaauaauuguccau

SEQ ID NO: 3972704 - RNA, 15 nt, Staphylococcus aureus subsp. aureus Mu50
uaauaauuuaacuaa

SEQ ID NO: 3972705 - RNA, 18 nt, Staphylococcus aureus subsp. aureus Mu50
uaauaauuuuuuuccuuu

SEQ ID NO: 3972706 - RNA, 19 nt, Staphylococcus aureus subsp. aureus Mu50
uaauacacuugauaaaacu

SEQ ID NO: 3972707 - RNA, 14 nt, Staphylococcus aureus subsp. aureus Mu50
uaauacauacugau

SEQ ID NO: 3972708 - RNA, 16 nt, Staphylococcus aureus subsp. aureus Mu50
uaauacaucuaauaaa

SEQ ID NO: 3972709 - RNA, 18 nt, Staphylococcus aureus subsp. aureus Mu50
uaauacaucuaauaaaua

SEQ ID NO: 3972710 - RNA, 21 nt, Staphylococcus aureus subsp. aureus Mu50
uaauaccagcauccauugcac

SEQ ID NO: 3972711 - RNA, 15 nt, Staphylococcus aureus subsp. aureus Mu50
uaauaccauugugau

SEQ ID NO: 3972712 - RNA, 22 nt, Staphylococcus aureus subsp. aureus Mu50
uaauaccuaauugcuuaauauc

SEQ ID NO: 3972713 - RNA, 20 nt, Staphylococcus aureus subsp. aureus Mu50
uaauaccuaugauauaugcu

SEQ ID NO: 3972714 - RNA, 19 nt, Staphylococcus aureus subsp. aureus Mu50
uaauaccuuuacuuucauu

SEQ ID NO: 3972715 - RNA, 17 nt, Staphylococcus aureus subsp. aureus Mu50
uaauacgucguaaugaa

SEQ ID NO: 3972716 - RNA, 21 nt, Staphylococcus aureus subsp. aureus Mu50
uaauacguguguuuucuuuuc

SEQ ID NO: 3972717 - RNA, 16 nt, Staphylococcus aureus subsp. aureus Mu50
uaauacuauaugaaaa

SEQ ID NO: 3972718 - RNA, 22 nt, Staphylococcus aureus subsp. aureus Mu50
uaauacuguauuuuaacgucau

SEQ ID NO: 3972719 - RNA, 18 nt, Staphylococcus aureus subsp. aureus Mu50
uaauacuguuuaaauaaa

SEQ ID NO: 3972720 - RNA, 20 nt, Staphylococcus aureus subsp. aureus Mu50
uaauacuguuuaaauaaaau

SEQ ID NO: 3972721 - RNA, 18 nt, Staphylococcus aureus subsp. aureus Mu50
uaauacuucucaauuuag

SEQ ID NO: 3972722 - RNA, 12 nt, Staphylococcus aureus subsp. aureus Mu50
uaauacuuucaa

SEQ ID NO: 3972723 - RNA, 19 nt, Staphylococcus aureus subsp. aureus Mu50
uaauacuuucaaacaaauc

SEQ ID NO: 3972724 - RNA, 15 nt, Staphylococcus aureus subsp. aureus Mu50
uaauacuuuucucga

SEQ ID NO: 3972725 - RNA, 13 nt, Staphylococcus aureus subsp. aureus Mu50
uaauagaaauaau

SEQ ID NO: 3972726 - RNA, 22 nt, Staphylococcus aureus subsp. aureus Mu50
uaaucuaaaaauagauguacaa

SEQ ID NO: 3972727 - RNA, 15 nt, Staphylococcus aureus subsp. aureus Mu50
uaaucuauaaauggc

SEQ ID NO: 3972728 - RNA, 19 nt, Staphylococcus aureus subsp. aureus Mu50
uaaucuauauaaaaacugu

SEQ ID NO: 3972729 - RNA, 14 nt, Staphylococcus aureus subsp. aureus Mu50
uaaucuauauauau

SEQ ID NO: 3972730 - RNA, 16 nt, Staphylococcus aureus subsp. aureus Mu50
uaaucuauuuucugcc

SEQ ID NO: 3972731 - RNA, 17 nt, Staphylococcus aureus subsp. aureus Mu50
uaaucugcaaaugccuc

SEQ ID NO: 3972732 - RNA, 18 nt, Staphylococcus aureus subsp. aureus Mu50
uaaucugcugcuguugaa

SEQ ID NO: 3972733 - RNA, 17 nt, Staphylococcus aureus subsp. aureus Mu50
uaaucuggguuguaauc

SEQ ID NO: 3972734 - RNA, 20 nt, Staphylococcus aureus subsp. aureus Mu50
uaaucuggguuguaaucuca

SEQ ID NO: 3972735 - RNA, 17 nt, Staphylococcus aureus subsp. aureus Mu50
uaaucuuaggugucauc

SEQ ID NO: 3972736 - RNA, 15 nt, Staphylococcus aureus subsp. aureus Mu50
uaaucuucacgcuua

SEQ ID NO: 3972737 - RNA, 22 nt, Staphylococcus aureus subsp. aureus Mu50
uaaucuucauuaauuacagcgu

SEQ ID NO: 3972738 - RNA, 16 nt, Staphylococcus aureus subsp. aureus Mu50
uaaucuugauuauauu

SEQ ID NO: 3972739 - RNA, 17 nt, Staphylococcus aureus subsp. aureus Mu50
uaaucuugauuauauuu

SEQ ID NO: 3972740 - RNA, 22 nt, Staphylococcus aureus subsp. aureus Mu50
uaaucuugauuauauuuuucuu

SEQ ID NO: 3972741 - RNA, 16 nt, Staphylococcus aureus subsp. aureus Mu50
uaaucuuguuuucauu

SEQ ID NO: 3972742 - RNA, 18 nt, Staphylococcus aureus subsp. aureus Mu50
uaaucuuguuuucauuua

SEQ ID NO: 3972743 - RNA, 22 nt, Staphylococcus aureus subsp. aureus Mu50
uaaucuuguuuucauuuaaaag

SEQ ID NO: 3972744 - RNA, 22 nt, Staphylococcus aureus subsp. aureus Mu50
uaaucuuuaacauuuauucuuu

SEQ ID NO: 3972745 - RNA, 21 nt, Staphylococcus aureus subsp. aureus Mu50
uaaucuuuuuuacuaaaauca

SEQ ID NO: 3972746 - RNA, 15 nt, Staphylococcus aureus subsp. aureus Mu50
uaaucuuuuuuuaau

SEQ ID NO: 3972747 - RNA, 18 nt, Staphylococcus aureus subsp. aureus Mu50
uaaucuuuuuuuaauuaa

SEQ ID NO: 3972748 - RNA, 13 nt, Staphylococcus aureus subsp. aureus Mu50
uaaugaacaaggg

SEQ ID NO: 3972749 - RNA, 19 nt, Staphylococcus aureus subsp. aureus Mu50
uaaugaagguaagugcuca

SEQ ID NO: 3972750 - RNA, 13 nt, Staphylococcus aureus subsp. aureus Mu50
uaaugaauaguaa

SEQ ID NO: 3972751 - RNA, 16 nt, Staphylococcus aureus subsp. aureus Mu50
uaaugacaaauuauca

SEQ ID NO: 3972752 - RNA, 17 nt, Staphylococcus aureus subsp. aureus Mu50
uaaugacuauaacacca

SEQ ID NO: 3972753 - RNA, 21 nt, Staphylococcus aureus subsp. aureus Mu50
uaaugagauuauucugagauu

SEQ ID NO: 3972754 - RNA, 16 nt, Staphylococcus aureus subsp. aureus Mu50
uaaugauaaauuaaag

SEQ ID NO: 3972755 - RNA, 18 nt, Staphylococcus aureus subsp. aureus Mu50
uaaugauaaauuaaagcu

SEQ ID NO: 3972756 - RNA, 18 nt, Staphylococcus aureus subsp. aureus Mu50
uaaugauaauccaccaaa

SEQ ID NO: 3972757 - RNA, 20 nt, Staphylococcus aureus subsp. aureus Mu50
uaaugauacaaacccauaua

SEQ ID NO: 3972758 - RNA, 15 nt, Staphylococcus aureus subsp. aureus Mu50
uaaugauaguguaug

SEQ ID NO: 3972759 - RNA, 17 nt, Staphylococcus aureus subsp. aureus Mu50
uaaugauaguguaugaa

SEQ ID NO: 3972760 - RNA, 13 nt, Staphylococcus aureus subsp. aureus Mu50
uaaugauauuaag

SEQ ID NO: 3972761 - RNA, 13 nt, Staphylococcus aureus subsp. aureus Mu50
uaaugaucaucua

SEQ ID NO: 3972762 - RNA, 14 nt, Staphylococcus aureus subsp. aureus Mu50
uaaugaucaucuau

SEQ ID NO: 3972763 - RNA, 20 nt, Staphylococcus aureus subsp. aureus Mu50
uaaugaugacaucaauaucu

SEQ ID NO: 3972764 - RNA, 18 nt, Staphylococcus aureus subsp. aureus Mu50
uaaugaugugaauuggau

SEQ ID NO: 3972765 - RNA, 12 nt, Staphylococcus aureus subsp. aureus Mu50
uaaugauuaacu

SEQ ID NO: 3972766 - RNA, 16 nt, Staphylococcus aureus subsp. aureus Mu50
uaaugauucuacagca

SEQ ID NO: 3972767 - RNA, 22 nt, Staphylococcus aureus subsp. aureus Mu50
uaaugauugacgauuuaauuaa

SEQ ID NO: 3972768 - RNA, 11 nt, Staphylococcus aureus subsp. aureus Mu50
uaaugauuuug

SEQ ID NO: 3972769 - RNA, 19 nt, Staphylococcus aureus subsp. aureus Mu50
uaaugauuuuuauuauugu

SEQ ID NO: 3972770 - RNA, 22 nt, Staphylococcus aureus subsp. aureus Mu50
uaaugauuuuuauuauugucau

SEQ ID NO: 3972771 - RNA, 14 nt, Staphylococcus aureus subsp. aureus Mu50
uaaugauuuuucau

SEQ ID NO: 3972772 - RNA, 19 nt, Staphylococcus aureus subsp. aureus Mu50
uaaugcaacuugaucauua

SEQ ID NO: 3972773 - RNA, 23 nt, Staphylococcus aureus subsp. aureus Mu50
uaaugcaagcgacgauuggaaag
